United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 222

SEQ ID NO: 9196377 - DNA, 22 bp, Homo sapiens
ttcacaatagctggcatcatct

SEQ ID NO: 9196378 - DNA, 22 bp, Homo sapiens
ttcacaaaatggtttgttgatg

SEQ ID NO: 9196379 - DNA, 22 bp, Homo sapiens
ttcacaaaacactattttctgg

SEQ ID NO: 9196380 - DNA, 22 bp, Homo sapiens
ttcacaaacaccagaatggcta

SEQ ID NO: 9196381 - DNA, 22 bp, Homo sapiens
ttcacaaacttcatgatggcac

SEQ ID NO: 9196382 - DNA, 22 bp, Homo sapiens
ttcacaaaaatgctgaacagtt

SEQ ID NO: 9196383 - DNA, 22 bp, Homo sapiens
ttcacattccgcggctattttc

SEQ ID NO: 9196384 - DNA, 22 bp, Homo sapiens
ttcatggagttgagaaggctaa

SEQ ID NO: 9196385 - DNA, 18 bp, Homo sapiens
ttcatgttggcttaggga

SEQ ID NO: 9196386 - DNA, 22 bp, Homo sapiens
ttcatgttcatgcttaggaaaa

SEQ ID NO: 9196387 - DNA, 22 bp, Homo sapiens
ttcatgtagtgtaatgtcttca

SEQ ID NO: 9196388 - DNA, 22 bp, Homo sapiens
ttcatgtaataggatgtgttaa

SEQ ID NO: 9196389 - DNA, 22 bp, Homo sapiens
ttcctcagaccctcattgtgag

SEQ ID NO: 9196390 - DNA, 22 bp, Homo sapiens
ttcctcagctgtgtcctggcga

SEQ ID NO: 9196391 - DNA, 22 bp, Homo sapiens
ttcctcagctgtttgggctcat

SEQ ID NO: 9196392 - DNA, 22 bp, Homo sapiens
ttcctcaggcttccctttgtcc

SEQ ID NO: 9196393 - DNA, 20 bp, Homo sapiens
ttccacatctttgcacatgc

SEQ ID NO: 9196394 - DNA, 22 bp, Homo sapiens
ttccagaaatctttcagctcaa

SEQ ID NO: 9196395 - DNA, 22 bp, Homo sapiens
ttccacaagtgatatctagctg

SEQ ID NO: 9196396 - DNA, 22 bp, Homo sapiens
ttccagaattgggagccttgag

SEQ ID NO: 9196397 - DNA, 20 bp, Homo sapiens
ttcctgtcctctctttcagg

SEQ ID NO: 9196398 - DNA, 22 bp, Homo sapiens
ttcctgtccgcaatggcctggg

SEQ ID NO: 9196399 - DNA, 22 bp, Homo sapiens
ttccttctagagcttgtttagg

SEQ ID NO: 9196400 - DNA, 22 bp, Homo sapiens
ttccttctgaagcctttgtgtt

SEQ ID NO: 9196401 - DNA, 22 bp, Homo sapiens
ttccttctcagccctcgaggat

SEQ ID NO: 9196402 - DNA, 22 bp, Homo sapiens
ttccttctagcccaagtattgg

SEQ ID NO: 9196403 - DNA, 22 bp, Homo sapiens
ttccttctattcagctccaaga

SEQ ID NO: 9196404 - DNA, 22 bp, Homo sapiens
ttctagaaactggagcaaacag

SEQ ID NO: 9196405 - DNA, 22 bp, Homo sapiens
ttctagaaacacatgcaaacag

SEQ ID NO: 9196406 - DNA, 22 bp, Homo sapiens
ttctagaaccatgacttcaggg

SEQ ID NO: 9196407 - DNA, 22 bp, Homo sapiens
ttctagacaaatgtgttcattc

SEQ ID NO: 9196408 - DNA, 22 bp, Homo sapiens
catgggggtctggacaacaggc

SEQ ID NO: 9196409 - DNA, 22 bp, Homo sapiens
catgtcaataaatataactgca

SEQ ID NO: 9196410 - DNA, 22 bp, Homo sapiens
catgtcccaaatgcaggcaaag

SEQ ID NO: 9196411 - DNA, 22 bp, Homo sapiens
catggattgaatataaattaga

SEQ ID NO: 9196412 - DNA, 22 bp, Homo sapiens
catggatatattgtacagtagc

SEQ ID NO: 9196413 - DNA, 22 bp, Homo sapiens
catggaatggttgaatgacgaa

SEQ ID NO: 9196414 - DNA, 22 bp, Homo sapiens
catggacagtgggacagtgtgt

SEQ ID NO: 9196415 - DNA, 22 bp, Homo sapiens
catggaattttctaggcataaa

SEQ ID NO: 9196416 - DNA, 22 bp, Homo sapiens
catggacaacctccattcgagt

SEQ ID NO: 9196417 - DNA, 22 bp, Homo sapiens
catggacatatgagacctttcc

SEQ ID NO: 9196418 - DNA, 22 bp, Homo sapiens
ccaagagttcaagagtgaacca

SEQ ID NO: 9196419 - DNA, 22 bp, Homo sapiens
cattttaaatgatttaagccaa

SEQ ID NO: 9196420 - DNA, 22 bp, Homo sapiens
aggaccaggtctaatgaagaca

SEQ ID NO: 9196421 - DNA, 22 bp, Homo sapiens
cagtgcctgtcttattcttaca

SEQ ID NO: 9196422 - DNA, 22 bp, Homo sapiens
cagtgcctggccggcttccatt

SEQ ID NO: 9196423 - DNA, 22 bp, Homo sapiens
cagtgcctgtgggcttcttcca

SEQ ID NO: 9196424 - DNA, 22 bp, Homo sapiens
cagttctggaggctccacatct

SEQ ID NO: 9196425 - DNA, 22 bp, Homo sapiens
caggaagggggatccttggaag

SEQ ID NO: 9196426 - DNA, 22 bp, Homo sapiens
agctgccacatggtgtcactgt

SEQ ID NO: 9196427 - DNA, 22 bp, Homo sapiens
caggaaggcgcggctgtgcctg

SEQ ID NO: 9196428 - DNA, 22 bp, Homo sapiens
caggaaggcccacctgtcctgt

SEQ ID NO: 9196429 - DNA, 19 bp, Homo sapiens
caggaaggggcgaatctgg

SEQ ID NO: 9196430 - DNA, 22 bp, Homo sapiens
caggaaggggctcactctggcc

SEQ ID NO: 9196431 - DNA, 22 bp, Homo sapiens
caggaaggaccgtccagatcag

SEQ ID NO: 9196432 - DNA, 22 bp, Homo sapiens
caggctggacattagatacata

SEQ ID NO: 9196433 - DNA, 22 bp, Homo sapiens
caggctggagtgcagtggtgcc

SEQ ID NO: 9196434 - DNA, 22 bp, Homo sapiens
caggctggagtgcagtgtcgcc

SEQ ID NO: 9196435 - DNA, 22 bp, Homo sapiens
caggctggagtgcagttgtgca

SEQ ID NO: 9196436 - DNA, 22 bp, Homo sapiens
ccatggctgcaattcttctgga

SEQ ID NO: 9196437 - DNA, 22 bp, Homo sapiens
aggctcagcctgggcctagagc

SEQ ID NO: 9196438 - DNA, 22 bp, Homo sapiens
aggctcagtatagctggcaagt

SEQ ID NO: 9196439 - DNA, 22 bp, Homo sapiens
ccagcctcatcgcctgcctgtc

SEQ ID NO: 9196440 - DNA, 22 bp, Homo sapiens
ccagcctcatcatattcctgct

SEQ ID NO: 9196441 - DNA, 22 bp, Homo sapiens
ccagccctgccagagagagctg

SEQ ID NO: 9196442 - DNA, 22 bp, Homo sapiens
ccagcctcatcgcctgcctgtc

SEQ ID NO: 9196443 - DNA, 22 bp, Homo sapiens
ccagcctccatgtagatagctg

SEQ ID NO: 9196444 - DNA, 19 bp, Homo sapiens
ccagcctctcttccacccc

SEQ ID NO: 9196445 - DNA, 22 bp, Homo sapiens
ccaggagagcaggcgtgcagct

SEQ ID NO: 9196446 - DNA, 22 bp, Homo sapiens
ccctggaggaccccaatgtggc

SEQ ID NO: 9196447 - DNA, 22 bp, Homo sapiens
agggatgctgctaagtggtcta

SEQ ID NO: 9196448 - DNA, 22 bp, Homo sapiens
agggatgctttgctgacagatt

SEQ ID NO: 9196449 - DNA, 22 bp, Homo sapiens
agggatgcccagataattggta

SEQ ID NO: 9196450 - DNA, 22 bp, Homo sapiens
agggatgctaataaatcaaaga

SEQ ID NO: 9196451 - DNA, 22 bp, Homo sapiens
aggcttcctcgtgccttagata

SEQ ID NO: 9196452 - DNA, 22 bp, Homo sapiens
aggcttctctgcaagatgttaa

SEQ ID NO: 9196453 - DNA, 22 bp, Homo sapiens
agggaagaaaatccatcgctgc

SEQ ID NO: 9196454 - DNA, 22 bp, Homo sapiens
agggaagaaaatccatcgctgc

SEQ ID NO: 9196455 - DNA, 22 bp, Homo sapiens
cctccccacgggcagccggcgc

SEQ ID NO: 9196456 - DNA, 22 bp, Homo sapiens
ccctggaggctggaggcagtag

SEQ ID NO: 9196457 - DNA, 23 bp, Homo sapiens
aggttcaggagatggaggaacaa

SEQ ID NO: 9196458 - DNA, 22 bp, Homo sapiens
cgtgccactgcactctagcctg

SEQ ID NO: 9196459 - DNA, 22 bp, Homo sapiens
agtcagtgttctgggttgtaat

SEQ ID NO: 9196460 - DNA, 22 bp, Homo sapiens
aggtctgagagccgctttcccc

SEQ ID NO: 9196461 - DNA, 19 bp, Homo sapiens
aggtctgcagctgcagttt

SEQ ID NO: 9196462 - DNA, 22 bp, Homo sapiens
aggtctgcctcactcacttctg

SEQ ID NO: 9196463 - DNA, 22 bp, Homo sapiens
aggtctgagtcccaggggtacc

SEQ ID NO: 9196464 - DNA, 17 bp, Homo sapiens
aggtctgagagtatctg

SEQ ID NO: 9196465 - DNA, 19 bp, Homo sapiens
aggtgagtgtgggaaaggg

SEQ ID NO: 9196466 - DNA, 22 bp, Homo sapiens
agggtggcaccacatatcatag

SEQ ID NO: 9196467 - DNA, 20 bp, Homo sapiens
agggtggcaagttagtgaca

SEQ ID NO: 9196468 - DNA, 22 bp, Homo sapiens
agggtggcacctggaagggatg

SEQ ID NO: 9196469 - DNA, 22 bp, Homo sapiens
agggtggccaccaagtatgtca

SEQ ID NO: 9196470 - DNA, 22 bp, Homo sapiens
cctggctcagcagctctttctc

SEQ ID NO: 9196471 - DNA, 22 bp, Homo sapiens
agtgggcagcccaggaggtctt

SEQ ID NO: 9196472 - DNA, 22 bp, Homo sapiens
ctgagaggatgctgcagtggag

SEQ ID NO: 9196473 - DNA, 21 bp, Homo sapiens
agtgtgtgtggaatgagaata

SEQ ID NO: 9196474 - DNA, 18 bp, Homo sapiens
agtcatttacttttgtga

SEQ ID NO: 9196475 - DNA, 22 bp, Homo sapiens
agtcattttgccagtcttcagg

SEQ ID NO: 9196476 - DNA, 22 bp, Homo sapiens
agtctgccaagccagatcatgt

SEQ ID NO: 9196477 - DNA, 20 bp, Homo sapiens
agtctgcctgctccttctcc

SEQ ID NO: 9196478 - DNA, 22 bp, Homo sapiens
agtgatttgcagtatttactaa

SEQ ID NO: 9196479 - DNA, 22 bp, Homo sapiens
agtgatttgactcttttattgt

SEQ ID NO: 9196480 - DNA, 22 bp, Homo sapiens
ctgtttcagaacttcttaaaaa

SEQ ID NO: 9196481 - DNA, 22 bp, Homo sapiens
cttcagatcctaatttgtcttt

SEQ ID NO: 9196482 - DNA, 22 bp, Homo sapiens
cttcatcatttgcactctaaga

SEQ ID NO: 9196483 - DNA, 22 bp, Homo sapiens
atctcataatcgtcattgcttt

SEQ ID NO: 9196484 - DNA, 22 bp, Homo sapiens
atcattcatcttattgccagtc

SEQ ID NO: 9196485 - DNA, 22 bp, Homo sapiens
ctgtgtgtgaacacagcccagc

SEQ ID NO: 9196486 - DNA, 22 bp, Homo sapiens
atattttgaagttaataatgtg

SEQ ID NO: 9196487 - DNA, 22 bp, Homo sapiens
atatcacagatgcagaaagaga

SEQ ID NO: 9196488 - DNA, 22 bp, Homo sapiens
atatattttttgagacagagtc

SEQ ID NO: 9196489 - DNA, 22 bp, Homo sapiens
atatattttgcggtcacgtggc

SEQ ID NO: 9196490 - DNA, 22 bp, Homo sapiens
atagaattcgtgtttgtaattc

SEQ ID NO: 9196491 - DNA, 22 bp, Homo sapiens
atagaattctttgaaatttatg

SEQ ID NO: 9196492 - DNA, 22 bp, Homo sapiens
atagaattatggaaagcatctt

SEQ ID NO: 9196493 - DNA, 22 bp, Homo sapiens
atagaatttgcactaaatctgc

SEQ ID NO: 9196494 - DNA, 22 bp, Homo sapiens
atagtacacatcctacaatgtt

SEQ ID NO: 9196495 - DNA, 23 bp, Homo sapiens
atagaaactaacaatttggctta

SEQ ID NO: 9196496 - DNA, 18 bp, Homo sapiens
atagaaacctttaatcag

SEQ ID NO: 9196497 - DNA, 22 bp, Homo sapiens
atagaaacagatgcacttctct

SEQ ID NO: 9196498 - DNA, 20 bp, Homo sapiens
ataatttaccctgcaccact

SEQ ID NO: 9196499 - DNA, 22 bp, Homo sapiens
ataatttaaattagtatgtgat

SEQ ID NO: 9196500 - DNA, 22 bp, Homo sapiens
ataattaatttcagtaatctcc

SEQ ID NO: 9196501 - DNA, 22 bp, Homo sapiens
atacatgactcacacattctgc

SEQ ID NO: 9196502 - DNA, 22 bp, Homo sapiens
agtgttagtgaaaggtgtttat

SEQ ID NO: 9196503 - DNA, 22 bp, Homo sapiens
agtttcacaaattgtcaatagc

SEQ ID NO: 9196504 - DNA, 22 bp, Homo sapiens
agttttcaatatatgatagtga

SEQ ID NO: 9196505 - DNA, 22 bp, Homo sapiens
agtttcatattaccatgtcacc

SEQ ID NO: 9196506 - DNA, 22 bp, Homo sapiens
agttttctcacatcaaaaatga

SEQ ID NO: 9196507 - DNA, 22 bp, Homo sapiens
agttttctttcatctatcagca

SEQ ID NO: 9196508 - DNA, 22 bp, Homo sapiens
agttttctgctaaaccagctaa

SEQ ID NO: 9196509 - DNA, 22 bp, Homo sapiens
ataatacatggttaacctcttt

SEQ ID NO: 9196510 - DNA, 22 bp, Homo sapiens
caatagaaggcacagataggta

SEQ ID NO: 9196511 - DNA, 22 bp, Homo sapiens
caatagaaaactcaatacttaa

SEQ ID NO: 9196512 - DNA, 22 bp, Homo sapiens
caatatataggaacaacttagg

SEQ ID NO: 9196513 - DNA, 22 bp, Homo sapiens
caaggctggagtgtaatggcat

SEQ ID NO: 9196514 - DNA, 22 bp, Homo sapiens
caatttcattaatagatataga

SEQ ID NO: 9196515 - DNA, 22 bp, Homo sapiens
caatttcatcttgtgcttcaat

SEQ ID NO: 9196516 - DNA, 18 bp, Homo sapiens
caatttcatccttaagcc

SEQ ID NO: 9196517 - DNA, 20 bp, Homo sapiens
caatttcatcatttcctgtg

SEQ ID NO: 9196518 - DNA, 22 bp, Homo sapiens
caatttcagtgctgtggagagg

SEQ ID NO: 9196519 - DNA, 22 bp, Homo sapiens
caatttcagtctcagagagttc

SEQ ID NO: 9196520 - DNA, 22 bp, Homo sapiens
caatttcagacctttccttgga

SEQ ID NO: 9196521 - DNA, 22 bp, Homo sapiens
caatttcactaataatatttac

SEQ ID NO: 9196522 - DNA, 18 bp, Homo sapiens
caatttcaatggtctgaa

SEQ ID NO: 9196523 - DNA, 22 bp, Homo sapiens
caatgttttgttgaatgaatag

SEQ ID NO: 9196524 - DNA, 22 bp, Homo sapiens
caatttcaatacaaaatacatt

SEQ ID NO: 9196525 - DNA, 19 bp, Homo sapiens
caattctgcaacactgtcc

SEQ ID NO: 9196526 - DNA, 22 bp, Homo sapiens
cacaaatggttgtagacattaa

SEQ ID NO: 9196527 - DNA, 22 bp, Homo sapiens
cacaaatgtgcagaaatgtgag

SEQ ID NO: 9196528 - DNA, 22 bp, Homo sapiens
cacaaatgactgaaacgactgt

SEQ ID NO: 9196529 - DNA, 22 bp, Homo sapiens
ggaagctgaggcccagtgaagg

SEQ ID NO: 9196530 - DNA, 21 bp, Homo sapiens
cacacagtgatctatccacat

SEQ ID NO: 9196531 - DNA, 22 bp, Homo sapiens
gctgggcttgtggccagctggg

SEQ ID NO: 9196532 - DNA, 22 bp, Homo sapiens
gctggaagaatgagtgcctcgt

SEQ ID NO: 9196533 - DNA, 22 bp, Homo sapiens
caaagtcctagaacagtgcttg

SEQ ID NO: 9196534 - DNA, 22 bp, Homo sapiens
caaagtcatggggatgcaggtc

SEQ ID NO: 9196535 - DNA, 22 bp, Homo sapiens
caaattttgtgtgttctctagt

SEQ ID NO: 9196536 - DNA, 22 bp, Homo sapiens
caacttttctgtgaatttaagt

SEQ ID NO: 9196537 - DNA, 22 bp, Homo sapiens
cacatgaaggctggggtcgtga

SEQ ID NO: 9196538 - DNA, 22 bp, Homo sapiens
cacatgcaccagaaatcaacat

SEQ ID NO: 9196539 - DNA, 22 bp, Homo sapiens
cacattctgtccttgaactgca

SEQ ID NO: 9196540 - DNA, 22 bp, Homo sapiens
cacttctgttgccttgtgcaat

SEQ ID NO: 9196541 - DNA, 22 bp, Homo sapiens
cactatttcctggattttgacg

SEQ ID NO: 9196542 - DNA, 22 bp, Homo sapiens
cactccaagacctactttctct

SEQ ID NO: 9196543 - DNA, 22 bp, Homo sapiens
cactctccagcacaccccattt

SEQ ID NO: 9196544 - DNA, 21 bp, Homo sapiens
cactctcccaatccttgctga

SEQ ID NO: 9196545 - DNA, 22 bp, Homo sapiens
cacctgcctcatttgtccctgc

SEQ ID NO: 9196546 - DNA, 22 bp, Homo sapiens
cacctgcctgcaggggctccac

SEQ ID NO: 9196547 - DNA, 22 bp, Homo sapiens
gggttcctccagttcctagagc

SEQ ID NO: 9196548 - DNA, 22 bp, Homo sapiens
cagatgtttgtctatatgcttt

SEQ ID NO: 9196549 - DNA, 22 bp, Homo sapiens
ggtcaaagttgaagaagggcat

SEQ ID NO: 9196550 - DNA, 22 bp, Homo sapiens
ggtcaaagggtgagatggcagg

SEQ ID NO: 9196551 - DNA, 22 bp, Homo sapiens
ggtcaaagtgaggagtcaggtt

SEQ ID NO: 9196552 - DNA, 22 bp, Homo sapiens
gggtaaggtcagccagaagttc

SEQ ID NO: 9196553 - DNA, 22 bp, Homo sapiens
cagaatttgaagtaatattcca

SEQ ID NO: 9196554 - DNA, 22 bp, Homo sapiens
gtaggcagggctgtggggagaa

SEQ ID NO: 9196555 - DNA, 22 bp, Homo sapiens
cagatttaagatatttgtattg

SEQ ID NO: 9196556 - DNA, 22 bp, Homo sapiens
cagatttaagagataaacagtg

SEQ ID NO: 9196557 - DNA, 22 bp, Homo sapiens
gtcacagaggctgccagggttg

SEQ ID NO: 9196558 - DNA, 22 bp, Homo sapiens
atgctaaagctttgctttcatt

SEQ ID NO: 9196559 - DNA, 22 bp, Homo sapiens
atgctaaatgttaatgttacct

SEQ ID NO: 9196560 - DNA, 22 bp, Homo sapiens
atgctaaatggccagtaccaaa

SEQ ID NO: 9196561 - DNA, 22 bp, Homo sapiens
gaatttcctctaaacccctgag

SEQ ID NO: 9196562 - DNA, 22 bp, Homo sapiens
gaatttcaggacaactggaagg

SEQ ID NO: 9196563 - DNA, 22 bp, Homo sapiens
gaatttcagatcagagaccatt

SEQ ID NO: 9196564 - DNA, 22 bp, Homo sapiens
gaatttcattgctctgctgtgt

SEQ ID NO: 9196565 - DNA, 22 bp, Homo sapiens
atgctacttgccagttacttga

SEQ ID NO: 9196566 - DNA, 22 bp, Homo sapiens
gacaggaaacaagaaggcagga

SEQ ID NO: 9196567 - DNA, 22 bp, Homo sapiens
gaatttcaaaagccagaacggg

SEQ ID NO: 9196568 - DNA, 22 bp, Homo sapiens
gaatttcaaagaggttaagagg

SEQ ID NO: 9196569 - DNA, 22 bp, Homo sapiens
gaatttcaacagtcctcaaatg

SEQ ID NO: 9196570 - DNA, 22 bp, Homo sapiens
gaatttcaagcagtgcaatgtt

SEQ ID NO: 9196571 - DNA, 22 bp, Homo sapiens
gaatttcacaaggtgaggataa

SEQ ID NO: 9196572 - DNA, 22 bp, Homo sapiens
atgccactgcactccagcctgg

SEQ ID NO: 9196573 - DNA, 22 bp, Homo sapiens
atgccactgcactccagcctag

SEQ ID NO: 9196574 - DNA, 22 bp, Homo sapiens
atgatgttattttcagaaacat

SEQ ID NO: 9196575 - DNA, 22 bp, Homo sapiens
gaagccttgaactgcaaacccc

SEQ ID NO: 9196576 - DNA, 22 bp, Homo sapiens
atctttctctgcactatacaat

SEQ ID NO: 9196577 - DNA, 22 bp, Homo sapiens
atctttctatggtactttctcc

SEQ ID NO: 9196578 - DNA, 19 bp, Homo sapiens
ctttttcaccttctagaag

SEQ ID NO: 9196579 - DNA, 22 bp, Homo sapiens
atgagatgttcaggagtctgag

SEQ ID NO: 9196580 - DNA, 22 bp, Homo sapiens
atgagaggtttcgtcagaggaa

SEQ ID NO: 9196581 - DNA, 22 bp, Homo sapiens
atgttacttagaataattctgg

SEQ ID NO: 9196582 - DNA, 21 bp, Homo sapiens
atgtgcttagctgctggtagt

SEQ ID NO: 9196583 - DNA, 22 bp, Homo sapiens
atgtcataaatatactgttcct

SEQ ID NO: 9196584 - DNA, 22 bp, Homo sapiens
atgtgctaagcactacttgtca

SEQ ID NO: 9196585 - DNA, 22 bp, Homo sapiens
gaggctctttctttggacttca

SEQ ID NO: 9196586 - DNA, 22 bp, Homo sapiens
atggatttgcttatacacatgt

SEQ ID NO: 9196587 - DNA, 22 bp, Homo sapiens
atggcaaaaactgcagttacct

SEQ ID NO: 9196588 - DNA, 22 bp, Homo sapiens
gagacaggccaggtggtactta

SEQ ID NO: 9196589 - DNA, 22 bp, Homo sapiens
atggataatgtctctgtttccc

SEQ ID NO: 9196590 - DNA, 22 bp, Homo sapiens
gagacaggcagctagtgggtca

SEQ ID NO: 9196591 - DNA, 22 bp, Homo sapiens
atgctgtgtctagcaggaacac

SEQ ID NO: 9196592 - DNA, 22 bp, Homo sapiens
atgctgtgtttgagaacctagg

SEQ ID NO: 9196593 - DNA, 22 bp, Homo sapiens
atgctgtctctgctatccaaag

SEQ ID NO: 9196594 - DNA, 22 bp, Homo sapiens
atgctggtggttgatggcagga

SEQ ID NO: 9196595 - DNA, 22 bp, Homo sapiens
atgctggtaagttgcaaatgtt

SEQ ID NO: 9196596 - DNA, 22 bp, Homo sapiens
atgctgtggtagacagcattcc

SEQ ID NO: 9196597 - DNA, 22 bp, Homo sapiens
atgctgtgtcaccttaggattt

SEQ ID NO: 9196598 - DNA, 22 bp, Homo sapiens
atgctgtgtcaggaatttgata

SEQ ID NO: 9196599 - DNA, 22 bp, Homo sapiens
atgctgtgtattttactctttc

SEQ ID NO: 9196600 - DNA, 22 bp, Homo sapiens
gattcaggcctgcatctcagca

SEQ ID NO: 9196601 - DNA, 23 bp, Homo sapiens
gattcaggattagttgtccagag

SEQ ID NO: 9196602 - DNA, 22 bp, Homo sapiens
gatgtgctttgttaaacagatg

SEQ ID NO: 9196603 - DNA, 22 bp, Homo sapiens
gatgtgcttagtacagatgtgt

SEQ ID NO: 9196604 - DNA, 22 bp, Homo sapiens
gatgtgtagagggaatttcaaa

SEQ ID NO: 9196605 - DNA, 22 bp, Homo sapiens
attataggcttgagccaccgtg

SEQ ID NO: 9196606 - DNA, 23 bp, Homo sapiens
attatccagtgcacttcacagct

SEQ ID NO: 9196607 - DNA, 22 bp, Homo sapiens
attatcttgataaaatggcagt

SEQ ID NO: 9196608 - DNA, 22 bp, Homo sapiens
attccaaagcacatcagaacta

SEQ ID NO: 9196609 - DNA, 22 bp, Homo sapiens
attccacttccactagtttctc

SEQ ID NO: 9196610 - DNA, 22 bp, Homo sapiens
attcacaaataacaggtgcaga

SEQ ID NO: 9196611 - DNA, 22 bp, Homo sapiens
attccaaacagtgctgcagact

SEQ ID NO: 9196612 - DNA, 20 bp, Homo sapiens
attccacttgtttgaggtac

SEQ ID NO: 9196613 - DNA, 22 bp, Homo sapiens
attccacttgattttaggggaa

SEQ ID NO: 9196614 - DNA, 22 bp, Homo sapiens
attctgacctgaatagacttgg

SEQ ID NO: 9196615 - DNA, 22 bp, Homo sapiens
attctgagaggcacaatgtgga

SEQ ID NO: 9196616 - DNA, 22 bp, Homo sapiens
attctgccgctgccacttacta

SEQ ID NO: 9196617 - DNA, 22 bp, Homo sapiens
attcttttaaatggcagtagta

SEQ ID NO: 9196618 - DNA, 22 bp, Homo sapiens
attcttttttaaggaatagaac

SEQ ID NO: 9196619 - DNA, 18 bp, Homo sapiens
gcaggtgtggagaagggg

SEQ ID NO: 9196620 - DNA, 22 bp, Homo sapiens
gctccccaaaagctccaggaaa

SEQ ID NO: 9196621 - DNA, 22 bp, Homo sapiens
gctccccagcttagccctggct

SEQ ID NO: 9196622 - DNA, 22 bp, Homo sapiens
caaagaagagatttacagagct

SEQ ID NO: 9196623 - DNA, 22 bp, Homo sapiens
caaaagaagctcttggggctag

SEQ ID NO: 9196624 - DNA, 22 bp, Homo sapiens
attttgatgctatctaatgaat

SEQ ID NO: 9196625 - DNA, 22 bp, Homo sapiens
gccttcctgcagctctgagcgt

SEQ ID NO: 9196626 - DNA, 22 bp, Homo sapiens
gccttccttacacctgctcagc

SEQ ID NO: 9196627 - DNA, 22 bp, Homo sapiens
attttccagcctttctagaact

SEQ ID NO: 9196628 - DNA, 21 bp, Homo sapiens
attttcattaattcagtgtgg

SEQ ID NO: 9196629 - DNA, 22 bp, Homo sapiens
attttcattttgcagggtgaga

SEQ ID NO: 9196630 - DNA, 22 bp, Homo sapiens
attttcatggcttctgctcagt

SEQ ID NO: 9196631 - DNA, 21 bp, Homo sapiens
attttcattaattcagtgtgg

SEQ ID NO: 9196632 - DNA, 22 bp, Homo sapiens
attttcatcgctaggttggcct

SEQ ID NO: 9196633 - DNA, 22 bp, Homo sapiens
atttgtaatttcttatctgtgt

SEQ ID NO: 9196634 - DNA, 22 bp, Homo sapiens
atttggttactcagttgtctga

SEQ ID NO: 9196635 - DNA, 22 bp, Homo sapiens
atttgtaaagtgcttaaaagta

SEQ ID NO: 9196636 - DNA, 22 bp, Homo sapiens
atttgtcaacaggcatttaggt

SEQ ID NO: 9196637 - DNA, 22 bp, Homo sapiens
atttgtcagtggaagtgattca

SEQ ID NO: 9196638 - DNA, 22 bp, Homo sapiens
gccatcatatcccctgtgacct

SEQ ID NO: 9196639 - DNA, 22 bp, Homo sapiens
atttatgtatctgtgtagatca

SEQ ID NO: 9196640 - DNA, 22 bp, Homo sapiens
atttatcaacatgtaccattgg

SEQ ID NO: 9196641 - DNA, 22 bp, Homo sapiens
atttatattttgggagctcctg

SEQ ID NO: 9196642 - DNA, 22 bp, Homo sapiens
atttatcaccagttagctgact

SEQ ID NO: 9196643 - DNA, 22 bp, Homo sapiens
atttcccagggccctcatagtt

SEQ ID NO: 9196644 - DNA, 22 bp, Homo sapiens
atttctgtttgctactataagt

SEQ ID NO: 9196645 - DNA, 22 bp, Homo sapiens
aaagtatatatgcactttagaa

SEQ ID NO: 9196646 - DNA, 22 bp, Homo sapiens
aaagtatatttacttactgtga

SEQ ID NO: 9196647 - DNA, 22 bp, Homo sapiens
aaaggttctcttgttcattatt

SEQ ID NO: 9196648 - DNA, 22 bp, Homo sapiens
aaaggaagatctatacacccca

SEQ ID NO: 9196649 - DNA, 22 bp, Homo sapiens
aaaggaagattgagcttttcca

SEQ ID NO: 9196650 - DNA, 22 bp, Homo sapiens
aaattttcctggtaaagatgga

SEQ ID NO: 9196651 - DNA, 22 bp, Homo sapiens
aacaaacaaacattttgtcatc

SEQ ID NO: 9196652 - DNA, 22 bp, Homo sapiens
aaagataatgtttccttattct

SEQ ID NO: 9196653 - DNA, 22 bp, Homo sapiens
aaatcagatgcttcctagttgg

SEQ ID NO: 9196654 - DNA, 22 bp, Homo sapiens
aaatcccagatagtaatgtatt

SEQ ID NO: 9196655 - DNA, 22 bp, Homo sapiens
aaataattgagttggtcaatat

SEQ ID NO: 9196656 - DNA, 22 bp, Homo sapiens
aaatagatttctctgggtttgt

SEQ ID NO: 9196657 - DNA, 22 bp, Homo sapiens
aaataagaggacagatgtttgg

SEQ ID NO: 9196658 - DNA, 22 bp, Homo sapiens
aaataagaaattcttctttgca

SEQ ID NO: 9196659 - DNA, 22 bp, Homo sapiens
aaatctcaaaggcttagcatct

SEQ ID NO: 9196660 - DNA, 21 bp, Homo sapiens
aaatgcaggctctttgttttc

SEQ ID NO: 9196661 - DNA, 22 bp, Homo sapiens
aaatgtactgatacttatttta

SEQ ID NO: 9196662 - DNA, 22 bp, Homo sapiens
aaacattgtacattctgtagct

SEQ ID NO: 9196663 - DNA, 22 bp, Homo sapiens
aaaggtagtacttctagaaggg

SEQ ID NO: 9196664 - DNA, 22 bp, Homo sapiens
aaattaagagtaactctgtaga

SEQ ID NO: 9196665 - DNA, 20 bp, Homo sapiens
aaattactgccacacatttc

SEQ ID NO: 9196666 - DNA, 22 bp, Homo sapiens
aaatgcagacagcttcacacac

SEQ ID NO: 9196667 - DNA, 22 bp, Homo sapiens
aaatgcagaatgatttcatcta

SEQ ID NO: 9196668 - DNA, 22 bp, Homo sapiens
aaacaagtttagaataatgaat

SEQ ID NO: 9196669 - DNA, 22 bp, Homo sapiens
aaaagacatctatttcaggcag

SEQ ID NO: 9196670 - DNA, 22 bp, Homo sapiens
aaaaaagattgatggtggatgc

SEQ ID NO: 9196671 - DNA, 22 bp, Homo sapiens
aacaaatggaacacaaatcttt

SEQ ID NO: 9196672 - DNA, 22 bp, Homo sapiens
aacactgaaatgtcttaagatt

SEQ ID NO: 9196673 - DNA, 22 bp, Homo sapiens
aacagcagggacttgaatggaa

SEQ ID NO: 9196674 - DNA, 22 bp, Homo sapiens
aaatgtgcttgtgatcagctgt

SEQ ID NO: 9196675 - DNA, 22 bp, Homo sapiens
aaatgttaggttgtactgagtc

SEQ ID NO: 9196676 - DNA, 19 bp, Homo sapiens
aaattctgacagtctttta

SEQ ID NO: 9196677 - DNA, 22 bp, Homo sapiens
aaattctgatttaataagtgta

SEQ ID NO: 9196678 - DNA, 22 bp, Homo sapiens
aaattctgcaatttgacaagat

SEQ ID NO: 9196679 - DNA, 22 bp, Homo sapiens
aaattctgtcctgaatgccatt

SEQ ID NO: 9196680 - DNA, 22 bp, Homo sapiens
aaattctggcctatcacagtga

SEQ ID NO: 9196681 - DNA, 22 bp, Homo sapiens
aaattctgtcctgaatgccatt

SEQ ID NO: 9196682 - DNA, 22 bp, Homo sapiens
aaattctatgtcaatgtttatt

SEQ ID NO: 9196683 - DNA, 22 bp, Homo sapiens
aaattgagacttttttcctcca

SEQ ID NO: 9196684 - DNA, 22 bp, Homo sapiens
aacaggaattgcaggcagatct

SEQ ID NO: 9196685 - DNA, 22 bp, Homo sapiens
aacatgcatgaagaagttatat

SEQ ID NO: 9196686 - DNA, 22 bp, Homo sapiens
aacatgcacatcatagctcgtg

SEQ ID NO: 9196687 - DNA, 22 bp, Homo sapiens
aacatgcagtgagccgatgagg

SEQ ID NO: 9196688 - DNA, 22 bp, Homo sapiens
aacatgcaggttttagggttgc

SEQ ID NO: 9196689 - DNA, 22 bp, Homo sapiens
aacatgcatgttatttatcagt

SEQ ID NO: 9196690 - DNA, 18 bp, Homo sapiens
aacatgcattagaactgc

SEQ ID NO: 9196691 - DNA, 22 bp, Homo sapiens
aaccacagagccccctcagatg

SEQ ID NO: 9196692 - DNA, 22 bp, Homo sapiens
aaccagagctttaaaaatctgt

SEQ ID NO: 9196693 - DNA, 22 bp, Homo sapiens
aataacttgaagatctcttcca

SEQ ID NO: 9196694 - DNA, 22 bp, Homo sapiens
aataacttcatcttcaggatag

SEQ ID NO: 9196695 - DNA, 22 bp, Homo sapiens
aactgaaacgtatttttgagat

SEQ ID NO: 9196696 - DNA, 22 bp, Homo sapiens
aatcatgtactgctgtggcttt

SEQ ID NO: 9196697 - DNA, 22 bp, Homo sapiens
aatcatgtgggatagtctgctc

SEQ ID NO: 9196698 - DNA, 22 bp, Homo sapiens
aatcatgtttcagatgagtttt

SEQ ID NO: 9196699 - DNA, 22 bp, Homo sapiens
aagagagggacttattaaagtc

SEQ ID NO: 9196700 - DNA, 22 bp, Homo sapiens
aatttaactgagagtactttta

SEQ ID NO: 9196701 - DNA, 22 bp, Homo sapiens
aagacaggaaaagctccaggcc

SEQ ID NO: 9196702 - DNA, 22 bp, Homo sapiens
aagaatacgtatcaacaatggt

SEQ ID NO: 9196703 - DNA, 22 bp, Homo sapiens
aatgttttgcattagttttcta

SEQ ID NO: 9196704 - DNA, 22 bp, Homo sapiens
aatgttttctctgtgaacacat

SEQ ID NO: 9196705 - DNA, 22 bp, Homo sapiens
aatgttttatagctcaagcaat

SEQ ID NO: 9196706 - DNA, 22 bp, Homo sapiens
aatgttttagattactgctggg

SEQ ID NO: 9196707 - DNA, 22 bp, Homo sapiens
aacttattgaacattctcgaat

SEQ ID NO: 9196708 - DNA, 22 bp, Homo sapiens
aacttcagggggcacattcaag

SEQ ID NO: 9196709 - DNA, 22 bp, Homo sapiens
aagatttactttctttgtaata

SEQ ID NO: 9196710 - DNA, 22 bp, Homo sapiens
aagatttattagatgcttacct

SEQ ID NO: 9196711 - DNA, 22 bp, Homo sapiens
aagatttactagcataatagct

SEQ ID NO: 9196712 - DNA, 22 bp, Homo sapiens
acagcagcttcctgactgtact

SEQ ID NO: 9196713 - DNA, 22 bp, Homo sapiens
acagaattatcaggaaatgtta

SEQ ID NO: 9196714 - DNA, 22 bp, Homo sapiens
aataacttcagttcttacatta

SEQ ID NO: 9196715 - DNA, 22 bp, Homo sapiens
aagtttctattattacattcgt

SEQ ID NO: 9196716 - DNA, 22 bp, Homo sapiens
aataatattcctctgtgtgcgt

SEQ ID NO: 9196717 - DNA, 22 bp, Homo sapiens
aataattatttgagagcagacc

SEQ ID NO: 9196718 - DNA, 22 bp, Homo sapiens
aataatgtgtgctgcagtctta

SEQ ID NO: 9196719 - DNA, 22 bp, Homo sapiens
aataattagtgggacagagaac

SEQ ID NO: 9196720 - DNA, 22 bp, Homo sapiens
actaattggaacactttttgcc

SEQ ID NO: 9196721 - DNA, 22 bp, Homo sapiens
actaattgctttcttgtgctga

SEQ ID NO: 9196722 - DNA, 22 bp, Homo sapiens
actccccagactgccatgctgg

SEQ ID NO: 9196723 - DNA, 18 bp, Homo sapiens
actccccacaggctctgt

SEQ ID NO: 9196724 - DNA, 22 bp, Homo sapiens
actccccaaaactaaccatgca

SEQ ID NO: 9196725 - DNA, 22 bp, Homo sapiens
aagtcacagagttggaagtcag

SEQ ID NO: 9196726 - DNA, 22 bp, Homo sapiens
aagtcacattctgaggtattgg

SEQ ID NO: 9196727 - DNA, 22 bp, Homo sapiens
acttgaattatatttctagaga

SEQ ID NO: 9196728 - DNA, 22 bp, Homo sapiens
acttcctgctatgagcttctgt

SEQ ID NO: 9196729 - DNA, 19 bp, Homo sapiens
acttcctgcccgctccttt

SEQ ID NO: 9196730 - DNA, 22 bp, Homo sapiens
aatcccagctactcaggaagtt

SEQ ID NO: 9196731 - DNA, 22 bp, Homo sapiens
agaaaacataggagacaggaaa

SEQ ID NO: 9196732 - DNA, 22 bp, Homo sapiens
aatgaacaagagagagaacttt

SEQ ID NO: 9196733 - DNA, 22 bp, Homo sapiens
aatgaacatataaagagatctt

SEQ ID NO: 9196734 - DNA, 22 bp, Homo sapiens
agaagggaactcagagatgatt

SEQ ID NO: 9196735 - DNA, 21 bp, Homo sapiens
agaagggattgtggtaaagat

SEQ ID NO: 9196736 - DNA, 21 bp, Homo sapiens
agaagggattgtggtaaagat

SEQ ID NO: 9196737 - DNA, 22 bp, Homo sapiens
aaggctggtttccttgatgttt

SEQ ID NO: 9196738 - DNA, 22 bp, Homo sapiens
aagggaatgttgtggctggttt

SEQ ID NO: 9196739 - DNA, 22 bp, Homo sapiens
aagtaccattcaaatgcaaata

SEQ ID NO: 9196740 - DNA, 22 bp, Homo sapiens
aagtaccaagtttgtttgacgc

SEQ ID NO: 9196741 - DNA, 22 bp, Homo sapiens
aaggtgaaactggaagctggcc

SEQ ID NO: 9196742 - DNA, 22 bp, Homo sapiens
accatcttttcctctgcctcct

SEQ ID NO: 9196743 - DNA, 22 bp, Homo sapiens
accatgctaaaacatgctgcta

SEQ ID NO: 9196744 - DNA, 22 bp, Homo sapiens
accatcttagtggccagctctc

SEQ ID NO: 9196745 - DNA, 22 bp, Homo sapiens
accatgtcatttattggccaaa

SEQ ID NO: 9196746 - DNA, 18 bp, Homo sapiens
aaggcagtatgattgcac

SEQ ID NO: 9196747 - DNA, 22 bp, Homo sapiens
aagccaggggttggtatgctat

SEQ ID NO: 9196748 - DNA, 22 bp, Homo sapiens
aagccaggggctgcttaggaga

SEQ ID NO: 9196749 - DNA, 22 bp, Homo sapiens
aagccaggcatgcttggacagt

SEQ ID NO: 9196750 - DNA, 22 bp, Homo sapiens
agctatgtgtgcagggacagga

SEQ ID NO: 9196751 - DNA, 22 bp, Homo sapiens
agctatttctcttattatatcc

SEQ ID NO: 9196752 - DNA, 22 bp, Homo sapiens
agctatttctcttattatatcc

SEQ ID NO: 9196753 - DNA, 22 bp, Homo sapiens
agcccagcttccttctgtctct

SEQ ID NO: 9196754 - DNA, 22 bp, Homo sapiens
acacatatatttgcatatacac

SEQ ID NO: 9196755 - DNA, 22 bp, Homo sapiens
acacagatttcactggaataga

SEQ ID NO: 9196756 - DNA, 22 bp, Homo sapiens
acacaggaagagagataataat

SEQ ID NO: 9196757 - DNA, 22 bp, Homo sapiens
acagaaattgctaatagctcat

SEQ ID NO: 9196758 - DNA, 22 bp, Homo sapiens
acagaaattctgggacagaaaa

SEQ ID NO: 9196759 - DNA, 22 bp, Homo sapiens
acaaatgagaatgtagacagag

SEQ ID NO: 9196760 - DNA, 22 bp, Homo sapiens
agcaccatcacagctgtatgtc

SEQ ID NO: 9196761 - DNA, 22 bp, Homo sapiens
acaaggtttggtcctatatttt

SEQ ID NO: 9196762 - DNA, 22 bp, Homo sapiens
acaaatggaacaatgaagactg

SEQ ID NO: 9196763 - DNA, 20 bp, Homo sapiens
aatgtctcctaaaaggtcag

SEQ ID NO: 9196764 - DNA, 22 bp, Homo sapiens
aatgtcatagcatttcttcaat

SEQ ID NO: 9196765 - DNA, 22 bp, Homo sapiens
aatgcaaacttcttgttacttg

SEQ ID NO: 9196766 - DNA, 22 bp, Homo sapiens
aatgcaatgcagcacctccttg

SEQ ID NO: 9196767 - DNA, 22 bp, Homo sapiens
aatgtttggctagatagatgga

SEQ ID NO: 9196768 - DNA, 22 bp, Homo sapiens
aattactgatctacaaaatcca

SEQ ID NO: 9196769 - DNA, 22 bp, Homo sapiens
aatgtttgaccaaaaaactgca

SEQ ID NO: 9196770 - DNA, 22 bp, Homo sapiens
aatgtttgcatctattcacatg

SEQ ID NO: 9196771 - DNA, 22 bp, Homo sapiens
aatgtttgagcatctacatgct

SEQ ID NO: 9196772 - DNA, 20 bp, Homo sapiens
aatgttcagtaattgtttta

SEQ ID NO: 9196773 - DNA, 22 bp, Homo sapiens
aatttacagttgctgatggtac

SEQ ID NO: 9196774 - DNA, 20 bp, Homo sapiens
aatttactcacagaatgaat

SEQ ID NO: 9196775 - DNA, 21 bp, Homo sapiens
aatttagtcaacagactgtgg

SEQ ID NO: 9196776 - DNA, 22 bp, Homo sapiens
aatttataataaatagggcttt

SEQ ID NO: 9196777 - DNA, 22 bp, Homo sapiens
aatttatatgtaattaggcaca

SEQ ID NO: 9196778 - DNA, 22 bp, Homo sapiens
aattatcagatataaaactgca

SEQ ID NO: 9196779 - DNA, 22 bp, Homo sapiens
agtcaaagggtatttggattga

SEQ ID NO: 9196780 - DNA, 22 bp, Homo sapiens
agtcaaagaagatggttccaaa

SEQ ID NO: 9196781 - DNA, 22 bp, Homo sapiens
agtcaaagatgaccgagttcct

SEQ ID NO: 9196782 - DNA, 22 bp, Homo sapiens
agtatttcttcatatgattact

SEQ ID NO: 9196783 - DNA, 22 bp, Homo sapiens
agtatactagtgcagcatgtat

SEQ ID NO: 9196784 - DNA, 22 bp, Homo sapiens
acgcctgtaatcccagcacttt

SEQ ID NO: 9196785 - DNA, 22 bp, Homo sapiens
aggtctctcagccctgacattc

SEQ ID NO: 9196786 - DNA, 22 bp, Homo sapiens
aggtctctggggaactccaggg

SEQ ID NO: 9196787 - DNA, 22 bp, Homo sapiens
aggtctctcacactcacagggc

SEQ ID NO: 9196788 - DNA, 22 bp, Homo sapiens
acctggagtcatttgaggagta

SEQ ID NO: 9196789 - DNA, 22 bp, Homo sapiens
acctgcacagccccagaatgcc

SEQ ID NO: 9196790 - DNA, 22 bp, Homo sapiens
acctgccagaatccaagccaca

SEQ ID NO: 9196791 - DNA, 22 bp, Homo sapiens
actggaaaggctctgaatggga

SEQ ID NO: 9196792 - DNA, 22 bp, Homo sapiens
actggaaaaccactgaaatgag

SEQ ID NO: 9196793 - DNA, 22 bp, Homo sapiens
agaacagaggccttatgtttca

SEQ ID NO: 9196794 - DNA, 22 bp, Homo sapiens
atctaaaatgtggttagttggt

SEQ ID NO: 9196795 - DNA, 22 bp, Homo sapiens
atctatttctgctaataacaat

SEQ ID NO: 9196796 - DNA, 20 bp, Homo sapiens
atcggcttgcctggaaacaa

SEQ ID NO: 9196797 - DNA, 22 bp, Homo sapiens
atcatcctagaaggaagctagg

SEQ ID NO: 9196798 - DNA, 22 bp, Homo sapiens
atatttcatggggttccatact

SEQ ID NO: 9196799 - DNA, 22 bp, Homo sapiens
atatttcacgtaggttgttttc

SEQ ID NO: 9196800 - DNA, 22 bp, Homo sapiens
atatttcagctttacttaggaa

SEQ ID NO: 9196801 - DNA, 22 bp, Homo sapiens
actttcatttgtgaagactgta

SEQ ID NO: 9196802 - DNA, 22 bp, Homo sapiens
actttcatggtagttgtattct

SEQ ID NO: 9196803 - DNA, 22 bp, Homo sapiens
actttctattgtttagattctg

SEQ ID NO: 9196804 - DNA, 19 bp, Homo sapiens
acttctgaggaactgcaca

SEQ ID NO: 9196805 - DNA, 22 bp, Homo sapiens
atacattagctcatatgattaa

SEQ ID NO: 9196806 - DNA, 22 bp, Homo sapiens
ataaacagctccatttagtgcc

SEQ ID NO: 9196807 - DNA, 22 bp, Homo sapiens
ataaacagtaaatgtgagcagt

SEQ ID NO: 9196808 - DNA, 22 bp, Homo sapiens
aggaagaacagataatggacgc

SEQ ID NO: 9196809 - DNA, 21 bp, Homo sapiens
aggaagaaaggttggaggttg

SEQ ID NO: 9196810 - DNA, 22 bp, Homo sapiens
aggaagaatgtttacatatcaa

SEQ ID NO: 9196811 - DNA, 23 bp, Homo sapiens
agctggaggctgtctactcccaa

SEQ ID NO: 9196812 - DNA, 22 bp, Homo sapiens
agctggaggggccagcaggtgt

SEQ ID NO: 9196813 - DNA, 22 bp, Homo sapiens
agctggtgtcacctccagtcca

SEQ ID NO: 9196814 - DNA, 22 bp, Homo sapiens
aggacacagctcttcagtaaga

SEQ ID NO: 9196815 - DNA, 22 bp, Homo sapiens
aggacacagacttagatttaaa

SEQ ID NO: 9196816 - DNA, 22 bp, Homo sapiens
acagtaaaaagccttagaattt

SEQ ID NO: 9196817 - DNA, 22 bp, Homo sapiens
acagtaaaattaagggcagtta

SEQ ID NO: 9196818 - DNA, 18 bp, Homo sapiens
acagtaaagaaaggaatt

SEQ ID NO: 9196819 - DNA, 22 bp, Homo sapiens
acagtaaacaatgcagcaaatt

SEQ ID NO: 9196820 - DNA, 22 bp, Homo sapiens
acagtaaatcaacagaatatct

SEQ ID NO: 9196821 - DNA, 22 bp, Homo sapiens
acatagcaagtgctcaataaat

SEQ ID NO: 9196822 - DNA, 22 bp, Homo sapiens
acatagcataaagaatgactct

SEQ ID NO: 9196823 - DNA, 22 bp, Homo sapiens
acatgctacacagagctcctcg

SEQ ID NO: 9196824 - DNA, 22 bp, Homo sapiens
acatgctagactttctttatga

SEQ ID NO: 9196825 - DNA, 22 bp, Homo sapiens
acatcatgagagacttaaattg

SEQ ID NO: 9196826 - DNA, 22 bp, Homo sapiens
acatgttcatgcatgcacaggt

SEQ ID NO: 9196827 - DNA, 22 bp, Homo sapiens
aggctcttcttttattaactga

SEQ ID NO: 9196828 - DNA, 22 bp, Homo sapiens
aggctctttccactctggtgca

SEQ ID NO: 9196829 - DNA, 20 bp, Homo sapiens
acattgattatgtttgtaga

SEQ ID NO: 9196830 - DNA, 22 bp, Homo sapiens
acatttccacagactgaggtca

SEQ ID NO: 9196831 - DNA, 22 bp, Homo sapiens
acatttgactacatttatatat

SEQ ID NO: 9196832 - DNA, 22 bp, Homo sapiens
acatttgagcatctactaagtg

SEQ ID NO: 9196833 - DNA, 22 bp, Homo sapiens
acatttgataattataaagaca

SEQ ID NO: 9196834 - DNA, 22 bp, Homo sapiens
acatttgatggagttagtaggt

SEQ ID NO: 9196835 - DNA, 22 bp, Homo sapiens
acatttgagtcatatttgctta

SEQ ID NO: 9196836 - DNA, 22 bp, Homo sapiens
acatttgaggatgttaagaatg

SEQ ID NO: 9196837 - DNA, 22 bp, Homo sapiens
accagccccaccgggactgcag

SEQ ID NO: 9196838 - DNA, 22 bp, Homo sapiens
accagcattggacttagaatgc

SEQ ID NO: 9196839 - DNA, 22 bp, Homo sapiens
acatttgtatatatgcagcata

SEQ ID NO: 9196840 - DNA, 22 bp, Homo sapiens
acatttgtatttggtgagtggt

SEQ ID NO: 9196841 - DNA, 22 bp, Homo sapiens
acatttgtctggctagaaagtt

SEQ ID NO: 9196842 - DNA, 22 bp, Homo sapiens
atgcacccatgtacatacacat

SEQ ID NO: 9196843 - DNA, 22 bp, Homo sapiens
atgcacatacatatgctctata

SEQ ID NO: 9196844 - DNA, 22 bp, Homo sapiens
agacatttggagccaactttcc

SEQ ID NO: 9196845 - DNA, 22 bp, Homo sapiens
agacatttggaagatacacata

SEQ ID NO: 9196846 - DNA, 22 bp, Homo sapiens
agacagcatgatacatgatgct

SEQ ID NO: 9196847 - DNA, 22 bp, Homo sapiens
agacagcagggagcaggattca

SEQ ID NO: 9196848 - DNA, 22 bp, Homo sapiens
agaagttatccaccttagatgc

SEQ ID NO: 9196849 - DNA, 22 bp, Homo sapiens
atgaacaatgactacatattga

SEQ ID NO: 9196850 - DNA, 22 bp, Homo sapiens
agacaaagacagcatctcaggt

SEQ ID NO: 9196851 - DNA, 22 bp, Homo sapiens
atgaacaagtatttgcatgagc

SEQ ID NO: 9196852 - DNA, 22 bp, Homo sapiens
atgtgtaaattgttaggtttaa

SEQ ID NO: 9196853 - DNA, 22 bp, Homo sapiens
atgtgtaaaaggcatgttttat

SEQ ID NO: 9196854 - DNA, 22 bp, Homo sapiens
agagacccattgccggaatcac

SEQ ID NO: 9196855 - DNA, 22 bp, Homo sapiens
agacattttagacataaaagat

SEQ ID NO: 9196856 - DNA, 23 bp, Homo sapiens
agacccagagactggctctgctc

SEQ ID NO: 9196857 - DNA, 22 bp, Homo sapiens
agacccagaaagcagctgcatt

SEQ ID NO: 9196858 - DNA, 22 bp, Homo sapiens
atggccagcaagttcagaattt

SEQ ID NO: 9196859 - DNA, 22 bp, Homo sapiens
atggccagggtggcactgtggt

SEQ ID NO: 9196860 - DNA, 22 bp, Homo sapiens
atttcacagcgtggttgactgc

SEQ ID NO: 9196861 - DNA, 22 bp, Homo sapiens
atttcacagctgctgttcaggt

SEQ ID NO: 9196862 - DNA, 20 bp, Homo sapiens
agatacagtttaattactct

SEQ ID NO: 9196863 - DNA, 17 bp, Homo sapiens
atttcacttagcatgag

SEQ ID NO: 9196864 - DNA, 22 bp, Homo sapiens
atttcacatctatctcagattt

SEQ ID NO: 9196865 - DNA, 22 bp, Homo sapiens
atttcacattaatttgatgctc

SEQ ID NO: 9196866 - DNA, 22 bp, Homo sapiens
agagtgggtgatctctgttgtc

SEQ ID NO: 9196867 - DNA, 22 bp, Homo sapiens
attgctgaaagtattttatgac

SEQ ID NO: 9196868 - DNA, 22 bp, Homo sapiens
attgctcagcacaagcagcaga

SEQ ID NO: 9196869 - DNA, 22 bp, Homo sapiens
attgctaggaacaggttgcacc

SEQ ID NO: 9196870 - DNA, 22 bp, Homo sapiens
attttaaccctcttatatatac

SEQ ID NO: 9196871 - DNA, 22 bp, Homo sapiens
atttggcaacattaattgaatc

SEQ ID NO: 9196872 - DNA, 22 bp, Homo sapiens
atgtttatgacctccataagga

SEQ ID NO: 9196873 - DNA, 22 bp, Homo sapiens
atgtgtatacttgtgcttactc

SEQ ID NO: 9196874 - DNA, 22 bp, Homo sapiens
atgtgtatatttggtgtcaata

SEQ ID NO: 9196875 - DNA, 22 bp, Homo sapiens
attccagtgtgcttccttgcta

SEQ ID NO: 9196876 - DNA, 22 bp, Homo sapiens
agaggcctttctgttgagtgaa

SEQ ID NO: 9196877 - DNA, 22 bp, Homo sapiens
agaggcctgtgtgctccagtgg

SEQ ID NO: 9196878 - DNA, 22 bp, Homo sapiens
attcatttgctattgtgtatgg

SEQ ID NO: 9196879 - DNA, 22 bp, Homo sapiens
agcatacagtaggtgctcagtt

SEQ ID NO: 9196880 - DNA, 22 bp, Homo sapiens
agcatacaccctaaactgctta

SEQ ID NO: 9196881 - DNA, 22 bp, Homo sapiens
agcaggctccttccttctctgg

SEQ ID NO: 9196882 - DNA, 22 bp, Homo sapiens
cacacacagttttgtattctgt

SEQ ID NO: 9196883 - DNA, 22 bp, Homo sapiens
cacaattttcctttaagtgtat

SEQ ID NO: 9196884 - DNA, 22 bp, Homo sapiens
caatttttgtacttatagtact

SEQ ID NO: 9196885 - DNA, 22 bp, Homo sapiens
caacttcttggcttcctaatgg

SEQ ID NO: 9196886 - DNA, 22 bp, Homo sapiens
caaaataccacgacttgtttta

SEQ ID NO: 9196887 - DNA, 22 bp, Homo sapiens
agcctcttccagctcctttcta

SEQ ID NO: 9196888 - DNA, 22 bp, Homo sapiens
cagcatcaacattctcagctct

SEQ ID NO: 9196889 - DNA, 22 bp, Homo sapiens
cagactttctggaagctaaaaa

SEQ ID NO: 9196890 - DNA, 22 bp, Homo sapiens
agcccaagccagtgcttctaga

SEQ ID NO: 9196891 - DNA, 22 bp, Homo sapiens
cagaatcaagtccaattagcac

SEQ ID NO: 9196892 - DNA, 22 bp, Homo sapiens
cagaatcagtgacacatgtata

SEQ ID NO: 9196893 - DNA, 22 bp, Homo sapiens
cagaatgagtagcatcttcacc

SEQ ID NO: 9196894 - DNA, 22 bp, Homo sapiens
gctgtgtgctgggcatggcact

SEQ ID NO: 9196895 - DNA, 22 bp, Homo sapiens
gctgtgttgggaatcatgtggg

SEQ ID NO: 9196896 - DNA, 22 bp, Homo sapiens
gcttttggccagatggggaaac

SEQ ID NO: 9196897 - DNA, 22 bp, Homo sapiens
gctggtccagggcctctgtggg

SEQ ID NO: 9196898 - DNA, 22 bp, Homo sapiens
gctggtccactccctggaggct

SEQ ID NO: 9196899 - DNA, 22 bp, Homo sapiens
gctgtagtgaatggccgcgttc

SEQ ID NO: 9196900 - DNA, 22 bp, Homo sapiens
ggaaggaagtgcagactttaaa

SEQ ID NO: 9196901 - DNA, 22 bp, Homo sapiens
ggaaggaagtgcagactttaaa

SEQ ID NO: 9196902 - DNA, 19 bp, Homo sapiens
ggaaggagagaaatgcatg

SEQ ID NO: 9196903 - DNA, 22 bp, Homo sapiens
ggaaggaattccaagactaaag

SEQ ID NO: 9196904 - DNA, 22 bp, Homo sapiens
ggaaggctttgtagaagtgcca

SEQ ID NO: 9196905 - DNA, 22 bp, Homo sapiens
gctccccaggctggtcccctcg

SEQ ID NO: 9196906 - DNA, 22 bp, Homo sapiens
gctccccattgatctgcaggct

SEQ ID NO: 9196907 - DNA, 22 bp, Homo sapiens
gctgcctccactggctcccagt

SEQ ID NO: 9196908 - DNA, 22 bp, Homo sapiens
gctgcctcccagagccctgcag

SEQ ID NO: 9196909 - DNA, 22 bp, Homo sapiens
gctgcctccgccggctccacag

SEQ ID NO: 9196910 - DNA, 22 bp, Homo sapiens
gctgcctctcctgagttgacag

SEQ ID NO: 9196911 - DNA, 22 bp, Homo sapiens
gctgcctctgcacagctcactc

SEQ ID NO: 9196912 - DNA, 22 bp, Homo sapiens
gctggagtaggaccatgcttga

SEQ ID NO: 9196913 - DNA, 22 bp, Homo sapiens
gctggagtgatgcctgtgtctc

SEQ ID NO: 9196914 - DNA, 22 bp, Homo sapiens
gctggagtctacattcaagaat

SEQ ID NO: 9196915 - DNA, 22 bp, Homo sapiens
gctggagttagaactagcctgg

SEQ ID NO: 9196916 - DNA, 22 bp, Homo sapiens
gctggagtgcagttgcacagtc

SEQ ID NO: 9196917 - DNA, 22 bp, Homo sapiens
gctggagttgtgggtttactaa

SEQ ID NO: 9196918 - DNA, 23 bp, Homo sapiens
gctgcctctgttggtcttcagtt

SEQ ID NO: 9196919 - DNA, 22 bp, Homo sapiens
gctgcctctgcgactctgggcg

SEQ ID NO: 9196920 - DNA, 22 bp, Homo sapiens
gctgcctctgtagctttggacc

SEQ ID NO: 9196921 - DNA, 22 bp, Homo sapiens
gcacagcacagcaacatgtttt

SEQ ID NO: 9196922 - DNA, 22 bp, Homo sapiens
gcacagacagaatccctactcc

SEQ ID NO: 9196923 - DNA, 19 bp, Homo sapiens
gagtattttccaacttggt

SEQ ID NO: 9196924 - DNA, 22 bp, Homo sapiens
gcaaggatgtactgcaatagga

SEQ ID NO: 9196925 - DNA, 18 bp, Homo sapiens
gcaaggctcaggccaggc

SEQ ID NO: 9196926 - DNA, 22 bp, Homo sapiens
gcaataaagtagcagctcatca

SEQ ID NO: 9196927 - DNA, 22 bp, Homo sapiens
gcaaggctcccgcagcccaggg

SEQ ID NO: 9196928 - DNA, 22 bp, Homo sapiens
gcaataaaatgtaatgattggg

SEQ ID NO: 9196929 - DNA, 22 bp, Homo sapiens
gcctggagtagcatggcaagcc

SEQ ID NO: 9196930 - DNA, 22 bp, Homo sapiens
gcctgcagacgtgttttcctca

SEQ ID NO: 9196931 - DNA, 22 bp, Homo sapiens
gcctcaggtgcatctctcattc

SEQ ID NO: 9196932 - DNA, 22 bp, Homo sapiens
gcctcatcgctgctcggcccgg

SEQ ID NO: 9196933 - DNA, 19 bp, Homo sapiens
gcctcatttccacctcccc

SEQ ID NO: 9196934 - DNA, 22 bp, Homo sapiens
gcctcaggtaaaacttgagttt

SEQ ID NO: 9196935 - DNA, 17 bp, Homo sapiens
gccctgcctgctgccct

SEQ ID NO: 9196936 - DNA, 22 bp, Homo sapiens
gcagttgctcttgaggcacttt

SEQ ID NO: 9196937 - DNA, 22 bp, Homo sapiens
gtgccacctctgccccagaggg

SEQ ID NO: 9196938 - DNA, 22 bp, Homo sapiens
gtctaattcctgctcttactca

SEQ ID NO: 9196939 - DNA, 22 bp, Homo sapiens
gtctcccaacccctgtgcccag

SEQ ID NO: 9196940 - DNA, 22 bp, Homo sapiens
gtgagccgagtatagttcatag

SEQ ID NO: 9196941 - DNA, 22 bp, Homo sapiens
gtatttttcagttaggagctta

SEQ ID NO: 9196942 - DNA, 22 bp, Homo sapiens
gtatttttaggtaaggaaagta

SEQ ID NO: 9196943 - DNA, 22 bp, Homo sapiens
gtatttttagtagagtcggggt

SEQ ID NO: 9196944 - DNA, 22 bp, Homo sapiens
gtatttttcattccaagtgaga

SEQ ID NO: 9196945 - DNA, 22 bp, Homo sapiens
gtcaaaatgagctttgttattg

SEQ ID NO: 9196946 - DNA, 19 bp, Homo sapiens
ggtgtttcttcattttcca

SEQ ID NO: 9196947 - DNA, 22 bp, Homo sapiens
ggttcagtggaatgtgttgacc

SEQ ID NO: 9196948 - DNA, 22 bp, Homo sapiens
ggtcccagctgctcaagaggct

SEQ ID NO: 9196949 - DNA, 22 bp, Homo sapiens
ggtcccaggaatctgtgttcta

SEQ ID NO: 9196950 - DNA, 22 bp, Homo sapiens
ggtggaaggcctggaaggaggc

SEQ ID NO: 9196951 - DNA, 22 bp, Homo sapiens
gggccccaaaatgccaggctct

SEQ ID NO: 9196952 - DNA, 22 bp, Homo sapiens
gggccccactggggctgcctgc

SEQ ID NO: 9196953 - DNA, 22 bp, Homo sapiens
ggctgcctgctcctcctgcacg

SEQ ID NO: 9196954 - DNA, 22 bp, Homo sapiens
ggctggagacaacgtcctgccc

SEQ ID NO: 9196955 - DNA, 17 bp, Homo sapiens
ggctggagcagctcccc

SEQ ID NO: 9196956 - DNA, 22 bp, Homo sapiens
ggctggcagtgtgagagaggga

SEQ ID NO: 9196957 - DNA, 22 bp, Homo sapiens
ggctggagtgggctccagagtt

SEQ ID NO: 9196958 - DNA, 19 bp, Homo sapiens
ggctggagtggccatctgt

SEQ ID NO: 9196959 - DNA, 22 bp, Homo sapiens
ggctggaggtagaagaacactt

SEQ ID NO: 9196960 - DNA, 22 bp, Homo sapiens
ggctgcctctatttaggatcaa

SEQ ID NO: 9196961 - DNA, 23 bp, Homo sapiens
gggagatgggaaatgaaggctct

SEQ ID NO: 9196962 - DNA, 17 bp, Homo sapiens
ggaggcaacagacaggg

SEQ ID NO: 9196963 - DNA, 22 bp, Homo sapiens
ggcagtggaggaccctgtgtct

SEQ ID NO: 9196964 - DNA, 22 bp, Homo sapiens
ggcagtgagctggagggaagga

SEQ ID NO: 9196965 - DNA, 21 bp, Homo sapiens
ggcagtgatgtgaagtgcatc

SEQ ID NO: 9196966 - DNA, 22 bp, Homo sapiens
ggcagtgagtcccggagaggcc

SEQ ID NO: 9196967 - DNA, 22 bp, Homo sapiens
ggcagggactatgtttcatgga

SEQ ID NO: 9196968 - DNA, 22 bp, Homo sapiens
ggctcactgcaacttccgcctc

SEQ ID NO: 9196969 - DNA, 22 bp, Homo sapiens
ggccagctgctcagtgtctctg

SEQ ID NO: 9196970 - DNA, 21 bp, Homo sapiens
ggccagctgcatatgtcactg

SEQ ID NO: 9196971 - DNA, 22 bp, Homo sapiens
tatgtcaaaaaagattatgttt

SEQ ID NO: 9196972 - DNA, 22 bp, Homo sapiens
tattaagagatgtatgaagaga

SEQ ID NO: 9196973 - DNA, 22 bp, Homo sapiens
tatgtttgttatcacaactagg

SEQ ID NO: 9196974 - DNA, 22 bp, Homo sapiens
tatgtttcttccttttcataca

SEQ ID NO: 9196975 - DNA, 22 bp, Homo sapiens
tatcagatgacatcttctatgg

SEQ ID NO: 9196976 - DNA, 22 bp, Homo sapiens
tatcagatggtgatacatatca

SEQ ID NO: 9196977 - DNA, 22 bp, Homo sapiens
tatcacatcaatgttttaaaat

SEQ ID NO: 9196978 - DNA, 22 bp, Homo sapiens
tatcatttagagtatttcttca

SEQ ID NO: 9196979 - DNA, 22 bp, Homo sapiens
tatcatttgttattattagtgg

SEQ ID NO: 9196980 - DNA, 22 bp, Homo sapiens
tcaaagatagatgttgagaaat

SEQ ID NO: 9196981 - DNA, 22 bp, Homo sapiens
tcaaaggcggtccaggaataaa

SEQ ID NO: 9196982 - DNA, 22 bp, Homo sapiens
tattttgtatttatgcaagaaa

SEQ ID NO: 9196983 - DNA, 19 bp, Homo sapiens
tcaaaggcttttaggagac

SEQ ID NO: 9196984 - DNA, 22 bp, Homo sapiens
tcaaataccagcaatttcatgt

SEQ ID NO: 9196985 - DNA, 22 bp, Homo sapiens
tcaaatctttaacatgtgcaaa

SEQ ID NO: 9196986 - DNA, 22 bp, Homo sapiens
tattacaaattataatgggaga

SEQ ID NO: 9196987 - DNA, 23 bp, Homo sapiens
tattacaattggtcttattaaga

SEQ ID NO: 9196988 - DNA, 22 bp, Homo sapiens
tattgtctcacagttttggagg

SEQ ID NO: 9196989 - DNA, 22 bp, Homo sapiens
tattgtcacgtcttaattctag

SEQ ID NO: 9196990 - DNA, 22 bp, Homo sapiens
tattgtcaagaagtttatagtg

SEQ ID NO: 9196991 - DNA, 22 bp, Homo sapiens
tatttgcaggcttttgtcatgg

SEQ ID NO: 9196992 - DNA, 22 bp, Homo sapiens
tatttgcaggacatagatatgg

SEQ ID NO: 9196993 - DNA, 22 bp, Homo sapiens
tagttttataatgttaacatct

SEQ ID NO: 9196994 - DNA, 20 bp, Homo sapiens
tagttgccaaaatgccctgc

SEQ ID NO: 9196995 - DNA, 22 bp, Homo sapiens
tagtttaatggtcaactaatga

SEQ ID NO: 9196996 - DNA, 22 bp, Homo sapiens
tagactgttacagcttttcaga

SEQ ID NO: 9196997 - DNA, 22 bp, Homo sapiens
tagactggtgaattagggggaa

SEQ ID NO: 9196998 - DNA, 22 bp, Homo sapiens
tagaacttagcactagacttgt

SEQ ID NO: 9196999 - DNA, 22 bp, Homo sapiens
tagatatatctgtcatactggt

SEQ ID NO: 9197000 - DNA, 22 bp, Homo sapiens
tagatataggacagtactgtat

SEQ ID NO: 9197001 - DNA, 22 bp, Homo sapiens
tagatctgatacaattcatctg

SEQ ID NO: 9197002 - DNA, 22 bp, Homo sapiens
tactgtgttgtgctgaaaggga

SEQ ID NO: 9197003 - DNA, 22 bp, Homo sapiens
tactgtgtgaccctgggtaggt

SEQ ID NO: 9197004 - DNA, 22 bp, Homo sapiens
tactgtgtgcccagccgagctg

SEQ ID NO: 9197005 - DNA, 22 bp, Homo sapiens
tactgttttttagactcatggt

SEQ ID NO: 9197006 - DNA, 22 bp, Homo sapiens
tactgttttctttacaccatgt

SEQ ID NO: 9197007 - DNA, 22 bp, Homo sapiens
tactgtttcctgaagcagatgc

SEQ ID NO: 9197008 - DNA, 22 bp, Homo sapiens
taccagggaacagggatattaa

SEQ ID NO: 9197009 - DNA, 22 bp, Homo sapiens
tactagttctcatatgaaataa

SEQ ID NO: 9197010 - DNA, 22 bp, Homo sapiens
tactatgtgaaaatactatagt

SEQ ID NO: 9197011 - DNA, 22 bp, Homo sapiens
tacatgcatgtcacagaatgaa

SEQ ID NO: 9197012 - DNA, 22 bp, Homo sapiens
tacatgcatacttgtgtgtgta

SEQ ID NO: 9197013 - DNA, 19 bp, Homo sapiens
tacatgcacatgtgcgtgc

SEQ ID NO: 9197014 - DNA, 18 bp, Homo sapiens
tacatgcataaatgaagc

SEQ ID NO: 9197015 - DNA, 22 bp, Homo sapiens
tacatgcacatgaacatgtgtg

SEQ ID NO: 9197016 - DNA, 22 bp, Homo sapiens
tacatgcaatgaggattctagt

SEQ ID NO: 9197017 - DNA, 22 bp, Homo sapiens
tacatgcaaggatatttgtgcg

SEQ ID NO: 9197018 - DNA, 22 bp, Homo sapiens
tacatgcattggatggcaatag

SEQ ID NO: 9197019 - DNA, 22 bp, Homo sapiens
taattattctagtcacatagca

SEQ ID NO: 9197020 - DNA, 22 bp, Homo sapiens
taattcagaagtcctggctgga

SEQ ID NO: 9197021 - DNA, 22 bp, Homo sapiens
taattcagagtagttgtggagc

SEQ ID NO: 9197022 - DNA, 22 bp, Homo sapiens
taattcagtcattaatcttagc

SEQ ID NO: 9197023 - DNA, 22 bp, Homo sapiens
taattcagtcattaatcttagc

SEQ ID NO: 9197024 - DNA, 22 bp, Homo sapiens
taattcagggccagaatcccca

SEQ ID NO: 9197025 - DNA, 22 bp, Homo sapiens
taattcaggtagaacttaccag

SEQ ID NO: 9197026 - DNA, 22 bp, Homo sapiens
taattcagtgttcacttggaca

SEQ ID NO: 9197027 - DNA, 18 bp, Homo sapiens
taaggaagggggtgaaga

SEQ ID NO: 9197028 - DNA, 22 bp, Homo sapiens
taaggaagtacccattcttagg

SEQ ID NO: 9197029 - DNA, 22 bp, Homo sapiens
taaggaagtcacaagaatcgct

SEQ ID NO: 9197030 - DNA, 21 bp, Homo sapiens
taaggaagagcattttaggtc

SEQ ID NO: 9197031 - DNA, 22 bp, Homo sapiens
taaggaaggggaaagacatgtc

SEQ ID NO: 9197032 - DNA, 22 bp, Homo sapiens
tacaacattgtgttgcttcata

SEQ ID NO: 9197033 - DNA, 22 bp, Homo sapiens
taatttcaaatttcttagcgtg

SEQ ID NO: 9197034 - DNA, 22 bp, Homo sapiens
taatttcaagtttagggctcta

SEQ ID NO: 9197035 - DNA, 22 bp, Homo sapiens
taatttcaaatttcttagcgtg

SEQ ID NO: 9197036 - DNA, 22 bp, Homo sapiens
tacacaactgacaaccattctg

SEQ ID NO: 9197037 - DNA, 22 bp, Homo sapiens
gtgtttctggggcattcatagt

SEQ ID NO: 9197038 - DNA, 22 bp, Homo sapiens
gtttgaaacatgcacctggagg

SEQ ID NO: 9197039 - DNA, 22 bp, Homo sapiens
gtttcttttgtgatcaccaacc

SEQ ID NO: 9197040 - DNA, 22 bp, Homo sapiens
gtttcacacatcctgcacatag

SEQ ID NO: 9197041 - DNA, 22 bp, Homo sapiens
gtttcacacatcctgcacatag

SEQ ID NO: 9197042 - DNA, 22 bp, Homo sapiens
gtttcactgcactatagcacca

SEQ ID NO: 9197043 - DNA, 22 bp, Homo sapiens
gtttcacagtctgcagaatttt

SEQ ID NO: 9197044 - DNA, 22 bp, Homo sapiens
taaatgcagcagtttctgttct

SEQ ID NO: 9197045 - DNA, 20 bp, Homo sapiens
taaatgcatctgttcaactg

SEQ ID NO: 9197046 - DNA, 22 bp, Homo sapiens
taaaactttgaaggtgctcagt

SEQ ID NO: 9197047 - DNA, 22 bp, Homo sapiens
taagacatttgaaatgtgatcc

SEQ ID NO: 9197048 - DNA, 22 bp, Homo sapiens
taacatgcagagtttagctttt

SEQ ID NO: 9197049 - DNA, 22 bp, Homo sapiens
taagagcagaacagcaacatat

SEQ ID NO: 9197050 - DNA, 22 bp, Homo sapiens
taacaggcaaggtcacaccttg

SEQ ID NO: 9197051 - DNA, 22 bp, Homo sapiens
taacagtaaagtaagttagctt

SEQ ID NO: 9197052 - DNA, 22 bp, Homo sapiens
taacagtatccccatttgcaag

SEQ ID NO: 9197053 - DNA, 22 bp, Homo sapiens
tcctgcctcttgccttcttcac

SEQ ID NO: 9197054 - DNA, 22 bp, Homo sapiens
tcctgcctcttttcttattcca

SEQ ID NO: 9197055 - DNA, 22 bp, Homo sapiens
tcctgcctcaggctctggagta

SEQ ID NO: 9197056 - DNA, 22 bp, Homo sapiens
tcctgcacagcctaagtagaaa

SEQ ID NO: 9197057 - DNA, 22 bp, Homo sapiens
tcctgcacaccttgagcttgga

SEQ ID NO: 9197058 - DNA, 22 bp, Homo sapiens
tcctgaaattctggttgtcact

SEQ ID NO: 9197059 - DNA, 19 bp, Homo sapiens
tcctgaaaacttctggaat

SEQ ID NO: 9197060 - DNA, 22 bp, Homo sapiens
tcctgaagaggttgtctttata

SEQ ID NO: 9197061 - DNA, 22 bp, Homo sapiens
tcctgaagcagttagcatgagc

SEQ ID NO: 9197062 - DNA, 22 bp, Homo sapiens
tccagtatgactgatgtccttc

SEQ ID NO: 9197063 - DNA, 22 bp, Homo sapiens
tcccagccttatctcccctggc

SEQ ID NO: 9197064 - DNA, 22 bp, Homo sapiens
tccattcttttgctgtcttcct

SEQ ID NO: 9197065 - DNA, 22 bp, Homo sapiens
tccatggagtttttatttggta

SEQ ID NO: 9197066 - DNA, 22 bp, Homo sapiens
tccctgaaacataatagatgcc

SEQ ID NO: 9197067 - DNA, 22 bp, Homo sapiens
tcctaaatacatatcaaagatc

SEQ ID NO: 9197068 - DNA, 19 bp, Homo sapiens
tcctcaggggctcacagac

SEQ ID NO: 9197069 - DNA, 22 bp, Homo sapiens
tcctcagaagaacccctagatt

SEQ ID NO: 9197070 - DNA, 22 bp, Homo sapiens
tcctcaaatatttacttactga

SEQ ID NO: 9197071 - DNA, 18 bp, Homo sapiens
tccaaaatcatgtatttt

SEQ ID NO: 9197072 - DNA, 22 bp, Homo sapiens
tccaaatattcggtctttctga

SEQ ID NO: 9197073 - DNA, 22 bp, Homo sapiens
tccaaatgagctctgccttcca

SEQ ID NO: 9197074 - DNA, 22 bp, Homo sapiens
tccaaatattcatctacttctg

SEQ ID NO: 9197075 - DNA, 23 bp, Homo sapiens
tcatttcaggttgcatggtacca

SEQ ID NO: 9197076 - DNA, 22 bp, Homo sapiens
tcatttcaatgatactactaag

SEQ ID NO: 9197077 - DNA, 22 bp, Homo sapiens
tcatttcagccatttttaaatg

SEQ ID NO: 9197078 - DNA, 21 bp, Homo sapiens
tcatttcagggccttggcttc

SEQ ID NO: 9197079 - DNA, 22 bp, Homo sapiens
tcatttcagatgcatttagaat

SEQ ID NO: 9197080 - DNA, 22 bp, Homo sapiens
tcatttatattgtattctgtag

SEQ ID NO: 9197081 - DNA, 22 bp, Homo sapiens
tcagtaaaacctgcttttagtg

SEQ ID NO: 9197082 - DNA, 22 bp, Homo sapiens
tcagtaaataactcagatgctc

SEQ ID NO: 9197083 - DNA, 23 bp, Homo sapiens
tcagtaaatggtaaagtctcttc

SEQ ID NO: 9197084 - DNA, 22 bp, Homo sapiens
tcataaatgcagtgtcataaat

SEQ ID NO: 9197085 - DNA, 22 bp, Homo sapiens
tcatgaaaatagatcagaaatt

SEQ ID NO: 9197086 - DNA, 22 bp, Homo sapiens
tcagtgtttcctgtggtacagc

SEQ ID NO: 9197087 - DNA, 23 bp, Homo sapiens
tcataaatattagcacagtagga

SEQ ID NO: 9197088 - DNA, 22 bp, Homo sapiens
tcataaagtgaaggatgatggg

SEQ ID NO: 9197089 - DNA, 22 bp, Homo sapiens
tcataaagcttgcctgcagtgt

SEQ ID NO: 9197090 - DNA, 22 bp, Homo sapiens
tcataaagttacccaaatttta

SEQ ID NO: 9197091 - DNA, 22 bp, Homo sapiens
tcataaagttctaagaattgta

SEQ ID NO: 9197092 - DNA, 22 bp, Homo sapiens
tcagtgtttacatgcatccttg

SEQ ID NO: 9197093 - DNA, 22 bp, Homo sapiens
tcagtctcagcacctagtcaca

SEQ ID NO: 9197094 - DNA, 22 bp, Homo sapiens
tcacatgctactgagccagacc

SEQ ID NO: 9197095 - DNA, 22 bp, Homo sapiens
tcacatgctgtgggatctgtat

SEQ ID NO: 9197096 - DNA, 22 bp, Homo sapiens
tcacatttctttatgtagtctt

SEQ ID NO: 9197097 - DNA, 22 bp, Homo sapiens
tcaacaataggatatagcaggt

SEQ ID NO: 9197098 - DNA, 22 bp, Homo sapiens
tcaacatacatacatggtcagg

SEQ ID NO: 9197099 - DNA, 22 bp, Homo sapiens
tcacattttatctattttaagt

SEQ ID NO: 9197100 - DNA, 22 bp, Homo sapiens
tcacattttagtaccatgattt

SEQ ID NO: 9197101 - DNA, 22 bp, Homo sapiens
tcagaatatattcatgttgtca

SEQ ID NO: 9197102 - DNA, 22 bp, Homo sapiens
tcagaatggacccagactatag

SEQ ID NO: 9197103 - DNA, 22 bp, Homo sapiens
tcagaatgaaatttctttcaga

SEQ ID NO: 9197104 - DNA, 22 bp, Homo sapiens
tcagcatgttcttaggtcacag

SEQ ID NO: 9197105 - DNA, 22 bp, Homo sapiens
tcagcaaaggaccagcacaggc

SEQ ID NO: 9197106 - DNA, 17 bp, Homo sapiens
tcagcaaagacaaagga

SEQ ID NO: 9197107 - DNA, 22 bp, Homo sapiens
tcagatttcttcttgcaacggc

SEQ ID NO: 9197108 - DNA, 22 bp, Homo sapiens
tcagatttatgaatatactatg

SEQ ID NO: 9197109 - DNA, 22 bp, Homo sapiens
tcagatttgaatattcctttcg

SEQ ID NO: 9197110 - DNA, 22 bp, Homo sapiens
tcagattttattttcctgttac

SEQ ID NO: 9197111 - DNA, 22 bp, Homo sapiens
tcagatgtccttccagagattt

SEQ ID NO: 9197112 - DNA, 22 bp, Homo sapiens
tcagatgtctccaagggctggg

SEQ ID NO: 9197113 - DNA, 22 bp, Homo sapiens
tcagatgtctctcagcagggtt

SEQ ID NO: 9197114 - DNA, 22 bp, Homo sapiens
tcagatgttcacacttttagct

SEQ ID NO: 9197115 - DNA, 22 bp, Homo sapiens
tcagatgttgaaaaggaaaagt

SEQ ID NO: 9197116 - DNA, 22 bp, Homo sapiens
tcagaatgtgcagaggaacagt

SEQ ID NO: 9197117 - DNA, 22 bp, Homo sapiens
tcagaatgggccttcctgtccc

SEQ ID NO: 9197118 - DNA, 19 bp, Homo sapiens
tcagaattctgtctcttga

SEQ ID NO: 9197119 - DNA, 22 bp, Homo sapiens
tcagaattgattttcaaaacag

SEQ ID NO: 9197120 - DNA, 22 bp, Homo sapiens
gaatggaaactgggagatggcc

SEQ ID NO: 9197121 - DNA, 19 bp, Homo sapiens
gaatgggaatgggaaagct

SEQ ID NO: 9197122 - DNA, 18 bp, Homo sapiens
gacaaatgcaatttaaag

SEQ ID NO: 9197123 - DNA, 22 bp, Homo sapiens
gaattttcaggtagcaatttca

SEQ ID NO: 9197124 - DNA, 22 bp, Homo sapiens
gaatttatctacgttaagtatg

SEQ ID NO: 9197125 - DNA, 22 bp, Homo sapiens
gacatatgatattaaatgagca

SEQ ID NO: 9197126 - DNA, 22 bp, Homo sapiens
gacatcaattcagcattttaag

SEQ ID NO: 9197127 - DNA, 22 bp, Homo sapiens
gacatacagaatctgcagactt

SEQ ID NO: 9197128 - DNA, 22 bp, Homo sapiens
gactatgtgtattttactcacc

SEQ ID NO: 9197129 - DNA, 22 bp, Homo sapiens
gaccttgtaaattttcactcca

SEQ ID NO: 9197130 - DNA, 22 bp, Homo sapiens
gagagctgtaatagtcatgtct

SEQ ID NO: 9197131 - DNA, 22 bp, Homo sapiens
gagaagaacttgggcaaagtca

SEQ ID NO: 9197132 - DNA, 22 bp, Homo sapiens
gagcagaactactcacatatcg

SEQ ID NO: 9197133 - DNA, 22 bp, Homo sapiens
gagcaatagcaccaattaactc

SEQ ID NO: 9197134 - DNA, 18 bp, Homo sapiens
gaggatggaaggagatgc

SEQ ID NO: 9197135 - DNA, 22 bp, Homo sapiens
gaggaggttccgggtggagaag

SEQ ID NO: 9197136 - DNA, 22 bp, Homo sapiens
gaggatggtatgaggcaagcaa

SEQ ID NO: 9197137 - DNA, 22 bp, Homo sapiens
gaggatggaggcagttagggcc

SEQ ID NO: 9197138 - DNA, 22 bp, Homo sapiens
gaggctggtaggaaaggaaaca

SEQ ID NO: 9197139 - DNA, 22 bp, Homo sapiens
gagggtgggctcctatctgggt

SEQ ID NO: 9197140 - DNA, 22 bp, Homo sapiens
ctttggcaatgtcattttcaat

SEQ ID NO: 9197141 - DNA, 22 bp, Homo sapiens
ctttggcacagtgtttactagc

SEQ ID NO: 9197142 - DNA, 22 bp, Homo sapiens
gaaagacatagttgcaagatgg

SEQ ID NO: 9197143 - DNA, 22 bp, Homo sapiens
ctttccttctcgtggttctcac

SEQ ID NO: 9197144 - DNA, 22 bp, Homo sapiens
ctttccaagaatgcagatacct

SEQ ID NO: 9197145 - DNA, 22 bp, Homo sapiens
cttgctggtattttctctctca

SEQ ID NO: 9197146 - DNA, 22 bp, Homo sapiens
cttcttccaagcttatgctcaa

SEQ ID NO: 9197147 - DNA, 22 bp, Homo sapiens
cttcttcctgctgcagcctcca

SEQ ID NO: 9197148 - DNA, 22 bp, Homo sapiens
cttcttcccagcttccctcacc

SEQ ID NO: 9197149 - DNA, 22 bp, Homo sapiens
cttcttcctgaaagctggctct

SEQ ID NO: 9197150 - DNA, 22 bp, Homo sapiens
cttgcttcattagtgtcttagt

SEQ ID NO: 9197151 - DNA, 22 bp, Homo sapiens
cttcacataaacaaagggccat

SEQ ID NO: 9197152 - DNA, 22 bp, Homo sapiens
cttcacttgctcatcatgctat

SEQ ID NO: 9197153 - DNA, 22 bp, Homo sapiens
ctgggaggcggaggttgcagtg

SEQ ID NO: 9197154 - DNA, 22 bp, Homo sapiens
ctggagctaataatccatctga

SEQ ID NO: 9197155 - DNA, 22 bp, Homo sapiens
ctgggctcctaaccatccaggt

SEQ ID NO: 9197156 - DNA, 20 bp, Homo sapiens
ctgtggcatcttgaaggagg

SEQ ID NO: 9197157 - DNA, 22 bp, Homo sapiens
ctgtgggcatttgagtgtgggt

SEQ ID NO: 9197158 - DNA, 22 bp, Homo sapiens
ctgtgtgtgtctgcagcatact

SEQ ID NO: 9197159 - DNA, 22 bp, Homo sapiens
ctgtgttttgagatattattaa

SEQ ID NO: 9197160 - DNA, 22 bp, Homo sapiens
ctgtgtttgctatgcaaagaca

SEQ ID NO: 9197161 - DNA, 22 bp, Homo sapiens
ctgtgtttggacaacttttcag

SEQ ID NO: 9197162 - DNA, 22 bp, Homo sapiens
ctgtgtgtttatatcatttcct

SEQ ID NO: 9197163 - DNA, 22 bp, Homo sapiens
ctgtggacctgctcttagagac

SEQ ID NO: 9197164 - DNA, 21 bp, Homo sapiens
ctgtggacaggctggggcatg

SEQ ID NO: 9197165 - DNA, 22 bp, Homo sapiens
ctgtggacaaggatgttagcta

SEQ ID NO: 9197166 - DNA, 22 bp, Homo sapiens
ctggttctgattttgctgcatt

SEQ ID NO: 9197167 - DNA, 21 bp, Homo sapiens
ctgtcatgcaaccattctcca

SEQ ID NO: 9197168 - DNA, 19 bp, Homo sapiens
tttgaaagagttttattgg

SEQ ID NO: 9197169 - DNA, 22 bp, Homo sapiens
ctctgaagatggtaccagcttt

SEQ ID NO: 9197170 - DNA, 22 bp, Homo sapiens
ctctgaagggagggccaagccc

SEQ ID NO: 9197171 - DNA, 22 bp, Homo sapiens
ctctgacaagacagaccataac

SEQ ID NO: 9197172 - DNA, 22 bp, Homo sapiens
ctctgacaccatctcatgacag

SEQ ID NO: 9197173 - DNA, 22 bp, Homo sapiens
tttgaaagacagaatatttttg

SEQ ID NO: 9197174 - DNA, 22 bp, Homo sapiens
tttgttcatgcctatattctca

SEQ ID NO: 9197175 - DNA, 22 bp, Homo sapiens
tttctacaacacttctgaatct

SEQ ID NO: 9197176 - DNA, 22 bp, Homo sapiens
tttctacagctggtgcaacttt

SEQ ID NO: 9197177 - DNA, 22 bp, Homo sapiens
tttcatgttacatttaaaatgt

SEQ ID NO: 9197178 - DNA, 22 bp, Homo sapiens
ctccttcccctactcagcatcc

SEQ ID NO: 9197179 - DNA, 22 bp, Homo sapiens
ctccttcccctactcagcatcc

SEQ ID NO: 9197180 - DNA, 22 bp, Homo sapiens
ctccttcccttcaagtgttcct

SEQ ID NO: 9197181 - DNA, 22 bp, Homo sapiens
tttcacatagaaagtgatttac

SEQ ID NO: 9197182 - DNA, 22 bp, Homo sapiens
tttcagaaattgttattattct

SEQ ID NO: 9197183 - DNA, 22 bp, Homo sapiens
ctgccccaggacctcttctgga

SEQ ID NO: 9197184 - DNA, 22 bp, Homo sapiens
ctgcagcctcaacctcctgagc

SEQ ID NO: 9197185 - DNA, 22 bp, Homo sapiens
ctgcagcctaggtgcagctggg

SEQ ID NO: 9197186 - DNA, 22 bp, Homo sapiens
ctgccttcatctctgagctggg

SEQ ID NO: 9197187 - DNA, 22 bp, Homo sapiens
ctgccttccaaccccagactcc

SEQ ID NO: 9197188 - DNA, 22 bp, Homo sapiens
ctgctggttgcacagagctagg

SEQ ID NO: 9197189 - DNA, 22 bp, Homo sapiens
ctgctggttagtcttagtggga

SEQ ID NO: 9197190 - DNA, 22 bp, Homo sapiens
ctgctggtctctttggattgcg

SEQ ID NO: 9197191 - DNA, 22 bp, Homo sapiens
ctggagagggagccctggcagt

SEQ ID NO: 9197192 - DNA, 22 bp, Homo sapiens
ctggagagagaaaaagccttaa

SEQ ID NO: 9197193 - DNA, 22 bp, Homo sapiens
ctggagaggccccaagatattt

SEQ ID NO: 9197194 - DNA, 22 bp, Homo sapiens
ctggaaggtaacaaggccatta

SEQ ID NO: 9197195 - DNA, 22 bp, Homo sapiens
ctggagaaaatccatgtgtatg

SEQ ID NO: 9197196 - DNA, 22 bp, Homo sapiens
ctggagaaacatcaggcatagg

SEQ ID NO: 9197197 - DNA, 22 bp, Homo sapiens
ctggaagaggaagccagctgga

SEQ ID NO: 9197198 - DNA, 20 bp, Homo sapiens
ctggaagcctttccagagca

SEQ ID NO: 9197199 - DNA, 22 bp, Homo sapiens
ctggaagcttgtttgccagtct

SEQ ID NO: 9197200 - DNA, 22 bp, Homo sapiens
ctggaagctggaacaggtgtgg

SEQ ID NO: 9197201 - DNA, 22 bp, Homo sapiens
cggaggttgaggctgcagtgag

SEQ ID NO: 9197202 - DNA, 22 bp, Homo sapiens
ttcaaatccctgctccactatt

SEQ ID NO: 9197203 - DNA, 20 bp, Homo sapiens
ttatttcagttgctagattg

SEQ ID NO: 9197204 - DNA, 22 bp, Homo sapiens
ttatttcatataatgttatcaa

SEQ ID NO: 9197205 - DNA, 22 bp, Homo sapiens
ccttttctatgtaccagcagtg

SEQ ID NO: 9197206 - DNA, 22 bp, Homo sapiens
cctttttcagcttctagaggct

SEQ ID NO: 9197207 - DNA, 22 bp, Homo sapiens
ttaagcaaatgtcagttgttag

SEQ ID NO: 9197208 - DNA, 22 bp, Homo sapiens
ttaaattccagcctcataatag

SEQ ID NO: 9197209 - DNA, 22 bp, Homo sapiens
ttaaattattgagggattgtca

SEQ ID NO: 9197210 - DNA, 22 bp, Homo sapiens
tgtcaatatgtaataactgaat

SEQ ID NO: 9197211 - DNA, 22 bp, Homo sapiens
tgtcaataactggagtcattat

SEQ ID NO: 9197212 - DNA, 22 bp, Homo sapiens
ttacataacggtatgaaaaatg

SEQ ID NO: 9197213 - DNA, 22 bp, Homo sapiens
ttagttttcccatctttatggt

SEQ ID NO: 9197214 - DNA, 22 bp, Homo sapiens
ttataaaggtttgtgcatattt

SEQ ID NO: 9197215 - DNA, 22 bp, Homo sapiens
ccttgcctcattgtgcttctcc

SEQ ID NO: 9197216 - DNA, 22 bp, Homo sapiens
ttataacatcaatcagagttaa

SEQ ID NO: 9197217 - DNA, 22 bp, Homo sapiens
ttatatttctggtagccttcag

SEQ ID NO: 9197218 - DNA, 22 bp, Homo sapiens
ctcacccagaggctttccccct

SEQ ID NO: 9197219 - DNA, 22 bp, Homo sapiens
ctcagagagttaagtgaattac

SEQ ID NO: 9197220 - DNA, 22 bp, Homo sapiens
cgtgtgttgaaagatgtacatc

SEQ ID NO: 9197221 - DNA, 22 bp, Homo sapiens
ttgcatgcaaggcctccgtggc

SEQ ID NO: 9197222 - DNA, 22 bp, Homo sapiens
ctcaggtcgctatttctcttac

SEQ ID NO: 9197223 - DNA, 22 bp, Homo sapiens
ctcaggtcttagttctgtcatc

SEQ ID NO: 9197224 - DNA, 22 bp, Homo sapiens
ctccagcctcatctcctggctg

SEQ ID NO: 9197225 - DNA, 22 bp, Homo sapiens
ccatggaagaactgatgtgcca

SEQ ID NO: 9197226 - DNA, 22 bp, Homo sapiens
ccagtgtggtaggtccacaggt

SEQ ID NO: 9197227 - DNA, 22 bp, Homo sapiens
ccagtgtgttagtggatttccc

SEQ ID NO: 9197228 - DNA, 22 bp, Homo sapiens
tgccctcagcagcagctcctgc

SEQ ID NO: 9197229 - DNA, 22 bp, Homo sapiens
tgcagtctggatgtcctcagat

SEQ ID NO: 9197230 - DNA, 22 bp, Homo sapiens
cccagcccatctcaaaggtcta

SEQ ID NO: 9197231 - DNA, 20 bp, Homo sapiens
cccagcccctacctgttgcc

SEQ ID NO: 9197232 - DNA, 22 bp, Homo sapiens
cccagcccacggtcctgggtgg

SEQ ID NO: 9197233 - DNA, 22 bp, Homo sapiens
cccagcccagcgttcgaggggt

SEQ ID NO: 9197234 - DNA, 18 bp, Homo sapiens
tgaacacagtacaattcc

SEQ ID NO: 9197235 - DNA, 22 bp, Homo sapiens
tgaagaggccgtgtgcaggtga

SEQ ID NO: 9197236 - DNA, 22 bp, Homo sapiens
tgaaggaatggaggatcagagc

SEQ ID NO: 9197237 - DNA, 22 bp, Homo sapiens
tgaaggaatgagtatactgttt

SEQ ID NO: 9197238 - DNA, 17 bp, Homo sapiens
tgaaggaaggatgatgt

SEQ ID NO: 9197239 - DNA, 22 bp, Homo sapiens
tgaaggaagaataggcagtgtt

SEQ ID NO: 9197240 - DNA, 22 bp, Homo sapiens
tgaaggaatgagggagtgggtc

SEQ ID NO: 9197241 - DNA, 22 bp, Homo sapiens
tgaaggaaatgacggcagaaga

SEQ ID NO: 9197242 - DNA, 22 bp, Homo sapiens
tgaaggaaagagggaacatccc

SEQ ID NO: 9197243 - DNA, 22 bp, Homo sapiens
ccagcctcactggcatcaccta

SEQ ID NO: 9197244 - DNA, 22 bp, Homo sapiens
ccagcccttgagatggaaggga

SEQ ID NO: 9197245 - DNA, 22 bp, Homo sapiens
ccagccctttgtggttcactga

SEQ ID NO: 9197246 - DNA, 22 bp, Homo sapiens
ccaggctcaggcctgctcgttg

SEQ ID NO: 9197247 - DNA, 22 bp, Homo sapiens
tgacaatgggtggacaagatag

SEQ ID NO: 9197248 - DNA, 22 bp, Homo sapiens
tgacaatggggcacatggaaag

SEQ ID NO: 9197249 - DNA, 22 bp, Homo sapiens
tgaaggagaattaataggcatt

SEQ ID NO: 9197250 - DNA, 22 bp, Homo sapiens
tgacatctgtcaccctgctgac

SEQ ID NO: 9197251 - DNA, 22 bp, Homo sapiens
tgacatctgggccctcagctaa

SEQ ID NO: 9197252 - DNA, 22 bp, Homo sapiens
tgacccaagtagtgccttttct

SEQ ID NO: 9197253 - DNA, 19 bp, Homo sapiens
tgagagtgaggaaggcttc

SEQ ID NO: 9197254 - DNA, 22 bp, Homo sapiens
tgagcagaaaagaatgctgagc

SEQ ID NO: 9197255 - DNA, 22 bp, Homo sapiens
tgaggacattggtcaggacatg

SEQ ID NO: 9197256 - DNA, 22 bp, Homo sapiens
tggtctgagcggggccattcag

SEQ ID NO: 9197257 - DNA, 22 bp, Homo sapiens
cctgccttcagccctgaagtct

SEQ ID NO: 9197258 - DNA, 22 bp, Homo sapiens
cctgctggcattcttgctccct

SEQ ID NO: 9197259 - DNA, 22 bp, Homo sapiens
cctggagcactctccctggctg

SEQ ID NO: 9197260 - DNA, 22 bp, Homo sapiens
tgtattctaaatacatcttacc

SEQ ID NO: 9197261 - DNA, 22 bp, Homo sapiens
tgggggtgtgccagggacctcc

SEQ ID NO: 9197262 - DNA, 23 bp, Homo sapiens
cctgcaaagaaacaagccacctg

SEQ ID NO: 9197263 - DNA, 22 bp, Homo sapiens
cctgattcagtggtgcccagag

SEQ ID NO: 9197264 - DNA, 22 bp, Homo sapiens
cctgcacttctcacagctgctg

SEQ ID NO: 9197265 - DNA, 23 bp, Homo sapiens
cctgaagggtcagggtcctcagc

SEQ ID NO: 9197266 - DNA, 17 bp, Homo sapiens
cctgaaggcacttccag

SEQ ID NO: 9197267 - DNA, 22 bp, Homo sapiens
ccctgcctgtgggcatcaacat

SEQ ID NO: 9197268 - DNA, 22 bp, Homo sapiens
ccctgcctacagggttttcttt

SEQ ID NO: 9197269 - DNA, 22 bp, Homo sapiens
ccctgcagtgtgacctcaccta

SEQ ID NO: 9197270 - DNA, 22 bp, Homo sapiens
ccctgccttggggtccacaccg

SEQ ID NO: 9197271 - DNA, 22 bp, Homo sapiens
ccctgccttcttggcctttaaa

SEQ ID NO: 9197272 - DNA, 22 bp, Homo sapiens
tggaagaatgtttgccttataa

SEQ ID NO: 9197273 - DNA, 22 bp, Homo sapiens
tgcctcagtttctccatatgaa

SEQ ID NO: 9197274 - DNA, 22 bp, Homo sapiens
tgcctcataacactcctggagt

SEQ ID NO: 9197275 - DNA, 22 bp, Homo sapiens
tgcctccaccattgctcacttt

SEQ ID NO: 9197276 - DNA, 22 bp, Homo sapiens
tgcttgtctctctgtgcccact

SEQ ID NO: 9197277 - DNA, 22 bp, Homo sapiens
tggctaacaaggtgaaaccccg

SEQ ID NO: 9197278 - DNA, 22 bp, Homo sapiens
cctcactttcctttctcctggg

SEQ ID NO: 9197279 - DNA, 22 bp, Homo sapiens
cctccctccattgccatcgtct

SEQ ID NO: 9197280 - DNA, 22 bp, Homo sapiens
cctccccatgacccggtgctgg

SEQ ID NO: 9197281 - DNA, 22 bp, Homo sapiens
cctatgttcttggcaagcagca

SEQ ID NO: 9197282 - DNA, 17 bp, Homo sapiens
cctcacagggaccagac

SEQ ID NO: 9197283 - DNA, 20 bp, Homo sapiens
cctcacagggcagagagggg

SEQ ID NO: 9197284 - DNA, 22 bp, Homo sapiens
cctcacagaggggcagccatct

SEQ ID NO: 9197285 - DNA, 22 bp, Homo sapiens
ccggctactcgggaggctgacg

SEQ ID NO: 9197286 - DNA, 22 bp, Homo sapiens
cataaattgtacccattccaac

SEQ ID NO: 9197287 - DNA, 22 bp, Homo sapiens
cataaattcagttctgcctctt

SEQ ID NO: 9197288 - DNA, 22 bp, Homo sapiens
cagttaatgtcctatacaatag

SEQ ID NO: 9197289 - DNA, 22 bp, Homo sapiens
cagtgggaatgaagtggaggcc

SEQ ID NO: 9197290 - DNA, 22 bp, Homo sapiens
cagtgggacatgggcactgggc

SEQ ID NO: 9197291 - DNA, 22 bp, Homo sapiens
cagtgggattgggattggaacc

SEQ ID NO: 9197292 - DNA, 22 bp, Homo sapiens
tatttccacctattattttctg

SEQ ID NO: 9197293 - DNA, 22 bp, Homo sapiens
tatttccacctattattttctg

SEQ ID NO: 9197294 - DNA, 22 bp, Homo sapiens
tatttccagaggagtatagaag

SEQ ID NO: 9197295 - DNA, 22 bp, Homo sapiens
tatttccaaaagcctattatga

SEQ ID NO: 9197296 - DNA, 22 bp, Homo sapiens
tatttccacaccttttgaatct

SEQ ID NO: 9197297 - DNA, 22 bp, Homo sapiens
tatttcattctttatcaggagc

SEQ ID NO: 9197298 - DNA, 22 bp, Homo sapiens
tatttataacagtgagaacggg

SEQ ID NO: 9197299 - DNA, 22 bp, Homo sapiens
tcacagactcaagggcatagga

SEQ ID NO: 9197300 - DNA, 22 bp, Homo sapiens
tcacagacctggtgggaggtgg

SEQ ID NO: 9197301 - DNA, 22 bp, Homo sapiens
tcacaaatgtctcctgtcctgt

SEQ ID NO: 9197302 - DNA, 22 bp, Homo sapiens
tcacaaatcattttatctgtgt

SEQ ID NO: 9197303 - DNA, 22 bp, Homo sapiens
tcacaaatattttaacagtagg

SEQ ID NO: 9197304 - DNA, 21 bp, Homo sapiens
tcacagactggtcagtgaggc

SEQ ID NO: 9197305 - DNA, 22 bp, Homo sapiens
tcacagacttgtctccagggat

SEQ ID NO: 9197306 - DNA, 18 bp, Homo sapiens
tcacagacttactgggcc

SEQ ID NO: 9197307 - DNA, 22 bp, Homo sapiens
tcacagttcaaaccccatatct

SEQ ID NO: 9197308 - DNA, 22 bp, Homo sapiens
tagctagaaagtttcagctgtg

SEQ ID NO: 9197309 - DNA, 22 bp, Homo sapiens
tagggctcgggcacaggacagg

SEQ ID NO: 9197310 - DNA, 22 bp, Homo sapiens
tatcatttaacagaatcattgc

SEQ ID NO: 9197311 - DNA, 22 bp, Homo sapiens
tatatttaaatccaggttgaaa

SEQ ID NO: 9197312 - DNA, 21 bp, Homo sapiens
tagcaatacgtggaccatggg

SEQ ID NO: 9197313 - DNA, 22 bp, Homo sapiens
caggctggtcccagagcattgc

SEQ ID NO: 9197314 - DNA, 22 bp, Homo sapiens
caggctgggctggtgttagagt

SEQ ID NO: 9197315 - DNA, 22 bp, Homo sapiens
caggctgggctccggagataaa

SEQ ID NO: 9197316 - DNA, 22 bp, Homo sapiens
caggctgggcagcctccccggc

SEQ ID NO: 9197317 - DNA, 22 bp, Homo sapiens
tagagcttagtatcctgttaag

SEQ ID NO: 9197318 - DNA, 22 bp, Homo sapiens
caggctggagtgcaatggtgct

SEQ ID NO: 9197319 - DNA, 22 bp, Homo sapiens
caggctggagtgcaatggcaca

SEQ ID NO: 9197320 - DNA, 22 bp, Homo sapiens
caggctggagtgagtgtagtgg

SEQ ID NO: 9197321 - DNA, 22 bp, Homo sapiens
caggctggagtgcaatgacgcc

SEQ ID NO: 9197322 - DNA, 22 bp, Homo sapiens
caggctggagtacaattgtgtg

SEQ ID NO: 9197323 - DNA, 22 bp, Homo sapiens
caggctggagtgcagtggcgcc

SEQ ID NO: 9197324 - DNA, 22 bp, Homo sapiens
caggctggagtgcagtggcgct

SEQ ID NO: 9197325 - DNA, 22 bp, Homo sapiens
caggctggagtgcagtggggcg

SEQ ID NO: 9197326 - DNA, 22 bp, Homo sapiens
tactatttggaattttaaattg

SEQ ID NO: 9197327 - DNA, 22 bp, Homo sapiens
tactatgttcttcctaaatagt

SEQ ID NO: 9197328 - DNA, 22 bp, Homo sapiens
tactcattcatgttgttgtatg

SEQ ID NO: 9197329 - DNA, 22 bp, Homo sapiens
tactcactattctatcagatag

SEQ ID NO: 9197330 - DNA, 17 bp, Homo sapiens
tccagcctcctctgctg

SEQ ID NO: 9197331 - DNA, 22 bp, Homo sapiens
tccagcctcatttctcctgctt

SEQ ID NO: 9197332 - DNA, 22 bp, Homo sapiens
tccagcccagctgtccccttca

SEQ ID NO: 9197333 - DNA, 22 bp, Homo sapiens
tccagccctgtggcttccaccc

SEQ ID NO: 9197334 - DNA, 22 bp, Homo sapiens
tcatgcacatgtgtcaccatca

SEQ ID NO: 9197335 - DNA, 22 bp, Homo sapiens
tcatgcaacggctcgctgagcc

SEQ ID NO: 9197336 - DNA, 22 bp, Homo sapiens
tcatgcaaggctgaaacatggt

SEQ ID NO: 9197337 - DNA, 22 bp, Homo sapiens
tcatgcaacaacacattctggc

SEQ ID NO: 9197338 - DNA, 22 bp, Homo sapiens
tcattctctgggatgcagtttg

SEQ ID NO: 9197339 - DNA, 22 bp, Homo sapiens
tcattctgcatcactcttgctc

SEQ ID NO: 9197340 - DNA, 20 bp, Homo sapiens
tccaagccctccttccattc

SEQ ID NO: 9197341 - DNA, 22 bp, Homo sapiens
tcctctccatgtctcacgccac

SEQ ID NO: 9197342 - DNA, 22 bp, Homo sapiens
tccctcacctagtctttgactc

SEQ ID NO: 9197343 - DNA, 19 bp, Homo sapiens
tccccagcacctctgagtc

SEQ ID NO: 9197344 - DNA, 22 bp, Homo sapiens
tcccagccaggctctaccactt

SEQ ID NO: 9197345 - DNA, 22 bp, Homo sapiens
cattcaaattaagattttgtta

SEQ ID NO: 9197346 - DNA, 22 bp, Homo sapiens
cattcacagcaggtcagctgaa

SEQ ID NO: 9197347 - DNA, 22 bp, Homo sapiens
cattcacaactgagcattgttg

SEQ ID NO: 9197348 - DNA, 22 bp, Homo sapiens
cattcacaatggattgcttcaa

SEQ ID NO: 9197349 - DNA, 22 bp, Homo sapiens
cattcacattcttcttactgtt

SEQ ID NO: 9197350 - DNA, 22 bp, Homo sapiens
tctcaacaccacttgctgaaga

SEQ ID NO: 9197351 - DNA, 22 bp, Homo sapiens
tctccacactttctctcccagg

SEQ ID NO: 9197352 - DNA, 22 bp, Homo sapiens
tctcccacagtctcccatggct

SEQ ID NO: 9197353 - DNA, 22 bp, Homo sapiens
ccacattcaccagctgcacgac

SEQ ID NO: 9197354 - DNA, 22 bp, Homo sapiens
ccacattctcatgtaatccttt

SEQ ID NO: 9197355 - DNA, 22 bp, Homo sapiens
ccacattcatcagttgttaatg

SEQ ID NO: 9197356 - DNA, 18 bp, Homo sapiens
tcctctctttccccaggg

SEQ ID NO: 9197357 - DNA, 22 bp, Homo sapiens
tcctctccatgtctcacgccac

SEQ ID NO: 9197358 - DNA, 22 bp, Homo sapiens
tcgcctccaaagagttcctgag

SEQ ID NO: 9197359 - DNA, 22 bp, Homo sapiens
ccaccctgtgtttttgccattg

SEQ ID NO: 9197360 - DNA, 22 bp, Homo sapiens
ccaccctggacaggcctctgag

SEQ ID NO: 9197361 - DNA, 19 bp, Homo sapiens
ccagccctgtcacttcttg

SEQ ID NO: 9197362 - DNA, 20 bp, Homo sapiens
ccagcatgtacacatgtgga

SEQ ID NO: 9197363 - DNA, 22 bp, Homo sapiens
ccagcatggcacctgagatgag

SEQ ID NO: 9197364 - DNA, 22 bp, Homo sapiens
ccagccctgcctctcagggccc

SEQ ID NO: 9197365 - DNA, 22 bp, Homo sapiens
tctgagagtctctgaggcagat

SEQ ID NO: 9197366 - DNA, 22 bp, Homo sapiens
tctgagaggcagaccttcctaa

SEQ ID NO: 9197367 - DNA, 22 bp, Homo sapiens
tctgagagccactgaacagcaa

SEQ ID NO: 9197368 - DNA, 22 bp, Homo sapiens
tctgaaggttgagaagggctga

SEQ ID NO: 9197369 - DNA, 22 bp, Homo sapiens
tctcttaaaagagtaatagaga

SEQ ID NO: 9197370 - DNA, 22 bp, Homo sapiens
tctgaattcagtatggtctttc

SEQ ID NO: 9197371 - DNA, 22 bp, Homo sapiens
tctgaattaatcatgcctcttt

SEQ ID NO: 9197372 - DNA, 22 bp, Homo sapiens
ccagcatgagacgatgatgaag

SEQ ID NO: 9197373 - DNA, 18 bp, Homo sapiens
ccagcatgccagaggctg

SEQ ID NO: 9197374 - DNA, 22 bp, Homo sapiens
ttgtaaagggcatttgcacagt

SEQ ID NO: 9197375 - DNA, 22 bp, Homo sapiens
ttgtaacaatctgtcataaatg

SEQ ID NO: 9197376 - DNA, 22 bp, Homo sapiens
ttgtaacacttttctattaata

SEQ ID NO: 9197377 - DNA, 22 bp, Homo sapiens
ttgtaacagctgcttaatagag

SEQ ID NO: 9197378 - DNA, 22 bp, Homo sapiens
ttgtaacagtagctgtcagctc

SEQ ID NO: 9197379 - DNA, 22 bp, Homo sapiens
ttgtaagagagaattgcaaatt

SEQ ID NO: 9197380 - DNA, 20 bp, Homo sapiens
ttgtgtaggtctaatgcata

SEQ ID NO: 9197381 - DNA, 22 bp, Homo sapiens
ttgcagaatacttattctgtat

SEQ ID NO: 9197382 - DNA, 22 bp, Homo sapiens
ttgacacagatcaatattcaac

SEQ ID NO: 9197383 - DNA, 22 bp, Homo sapiens
ttgacaatgcactgtgctaagt

SEQ ID NO: 9197384 - DNA, 22 bp, Homo sapiens
ttgacaattgggagatataaag

SEQ ID NO: 9197385 - DNA, 22 bp, Homo sapiens
ttgacaatccctgttagaagtg

SEQ ID NO: 9197386 - DNA, 22 bp, Homo sapiens
ttgacaaagatatattcatgct

SEQ ID NO: 9197387 - DNA, 22 bp, Homo sapiens
ttgacaaaggaccttgctattt

SEQ ID NO: 9197388 - DNA, 22 bp, Homo sapiens
ttgctgtgtcatttgtttaatc

SEQ ID NO: 9197389 - DNA, 22 bp, Homo sapiens
ttgctgtgaaaccatgggaagt

SEQ ID NO: 9197390 - DNA, 22 bp, Homo sapiens
ttggaaacaagatttctactta

SEQ ID NO: 9197391 - DNA, 22 bp, Homo sapiens
ttggaaatgcatttgttattat

SEQ ID NO: 9197392 - DNA, 22 bp, Homo sapiens
ttggaaatgcaaatatattgaa

SEQ ID NO: 9197393 - DNA, 22 bp, Homo sapiens
ttggaaattgcaagtgatttgc

SEQ ID NO: 9197394 - DNA, 23 bp, Homo sapiens
tttcacaatgagcattacagaat

SEQ ID NO: 9197395 - DNA, 22 bp, Homo sapiens
tttcacagaactcactaaggag

SEQ ID NO: 9197396 - DNA, 22 bp, Homo sapiens
tttcacagatgttttggagtct

SEQ ID NO: 9197397 - DNA, 23 bp, Homo sapiens
tttcaacaggcagagaagactta

SEQ ID NO: 9197398 - DNA, 22 bp, Homo sapiens
tttcaagactcattgagtattg

SEQ ID NO: 9197399 - DNA, 22 bp, Homo sapiens
tttcacagcatataggtgtact

SEQ ID NO: 9197400 - DNA, 22 bp, Homo sapiens
tttcacagatgttttggagtct

SEQ ID NO: 9197401 - DNA, 22 bp, Homo sapiens
tttcacatttgttttaagaagt

SEQ ID NO: 9197402 - DNA, 22 bp, Homo sapiens
tttcaccatcttggccaggctg

SEQ ID NO: 9197403 - DNA, 20 bp, Homo sapiens
tttcaccatcttggccaggc

SEQ ID NO: 9197404 - DNA, 22 bp, Homo sapiens
tttcatgtaatcatttaggtgg

SEQ ID NO: 9197405 - DNA, 22 bp, Homo sapiens
tttcatgtactgtcgaagttga

SEQ ID NO: 9197406 - DNA, 22 bp, Homo sapiens
tttcatgtacttttttgataga

SEQ ID NO: 9197407 - DNA, 22 bp, Homo sapiens
tttcatgtgcaattagcaatat

SEQ ID NO: 9197408 - DNA, 22 bp, Homo sapiens
tttcatgttacagtgtaaaagt

SEQ ID NO: 9197409 - DNA, 22 bp, Homo sapiens
tttcccagttccctgctctata

SEQ ID NO: 9197410 - DNA, 22 bp, Homo sapiens
tttaatctattccctaaacacc

SEQ ID NO: 9197411 - DNA, 21 bp, Homo sapiens
tttaaagaataggaagggagg

SEQ ID NO: 9197412 - DNA, 22 bp, Homo sapiens
tttaaagaaattcctcatcttt

SEQ ID NO: 9197413 - DNA, 22 bp, Homo sapiens
tttaaagagaatgtgaaggagt

SEQ ID NO: 9197414 - DNA, 21 bp, Homo sapiens
tttatcatcacgagcttgagc

SEQ ID NO: 9197415 - DNA, 22 bp, Homo sapiens
tttatccattcaccagttgaac

SEQ ID NO: 9197416 - DNA, 22 bp, Homo sapiens
tttatctattgtattgttgatg

SEQ ID NO: 9197417 - DNA, 22 bp, Homo sapiens
tttatatagagatttgtgcatg

SEQ ID NO: 9197418 - DNA, 22 bp, Homo sapiens
tttagagacacactggcatttg

SEQ ID NO: 9197419 - DNA, 22 bp, Homo sapiens
tttagagaccctctgctatttt

SEQ ID NO: 9197420 - DNA, 21 bp, Homo sapiens
tttagagaatactcactattt

SEQ ID NO: 9197421 - DNA, 22 bp, Homo sapiens
ttcagttttgcttttaatcatg

SEQ ID NO: 9197422 - DNA, 22 bp, Homo sapiens
ttcataaacaactgatggtaat

SEQ ID NO: 9197423 - DNA, 22 bp, Homo sapiens
ttcagtttatacctgttgatta

SEQ ID NO: 9197424 - DNA, 22 bp, Homo sapiens
ttccagtgactaagcttctgct

SEQ ID NO: 9197425 - DNA, 22 bp, Homo sapiens
ttccagtgaaacatgaggtgtg

SEQ ID NO: 9197426 - DNA, 22 bp, Homo sapiens
ttccaggaacagatgaaggttg

SEQ ID NO: 9197427 - DNA, 22 bp, Homo sapiens
ttcaaagataatgtagcatttt

SEQ ID NO: 9197428 - DNA, 22 bp, Homo sapiens
ttcaaagagaaattgtattttc

SEQ ID NO: 9197429 - DNA, 22 bp, Homo sapiens
ttcacagagagaactcaaacca

SEQ ID NO: 9197430 - DNA, 22 bp, Homo sapiens
ttcacaatctggcttagcattg

SEQ ID NO: 9197431 - DNA, 19 bp, Homo sapiens
ttcacagctctgtgtcagt

SEQ ID NO: 9197432 - DNA, 22 bp, Homo sapiens
ttcacagctaagagctaagtaa

SEQ ID NO: 9197433 - DNA, 22 bp, Homo sapiens
ttcacagctccttttactcaac

SEQ ID NO: 9197434 - DNA, 22 bp, Homo sapiens
ttcacagctccttttactcaac

SEQ ID NO: 9197435 - DNA, 22 bp, Homo sapiens
ttcacagattgactggattcct

SEQ ID NO: 9197436 - DNA, 22 bp, Homo sapiens
ttcacaggatatatgtgcaggg

SEQ ID NO: 9197437 - DNA, 22 bp, Homo sapiens
ttatagaatccagttgttgtat

SEQ ID NO: 9197438 - DNA, 22 bp, Homo sapiens
tcctgcctgtttacctgtactt

SEQ ID NO: 9197439 - DNA, 22 bp, Homo sapiens
ttattgttaggcttttggaatt

SEQ ID NO: 9197440 - DNA, 21 bp, Homo sapiens
ttctctccatatgcccagccc

SEQ ID NO: 9197441 - DNA, 22 bp, Homo sapiens
ttctcagatgattcagataaac

SEQ ID NO: 9197442 - DNA, 22 bp, Homo sapiens
ttccttctggaagcttcagggg

SEQ ID NO: 9197443 - DNA, 22 bp, Homo sapiens
ttccttctggaggctccagggg

SEQ ID NO: 9197444 - DNA, 22 bp, Homo sapiens
ttccttcttcattgtgttacag

SEQ ID NO: 9197445 - DNA, 22 bp, Homo sapiens
ttccttcttgtaatgatctgcc

SEQ ID NO: 9197446 - DNA, 22 bp, Homo sapiens
ttccttcttccagaggctgccc

SEQ ID NO: 9197447 - DNA, 22 bp, Homo sapiens
ttcctgcagcaaggagaagctg

SEQ ID NO: 9197448 - DNA, 22 bp, Homo sapiens
ttcctgcacagttaagtgctca

SEQ ID NO: 9197449 - DNA, 22 bp, Homo sapiens
ttcctgcaaagccagatgtcga

SEQ ID NO: 9197450 - DNA, 22 bp, Homo sapiens
ttcctgaatataaagacactag

SEQ ID NO: 9197451 - DNA, 22 bp, Homo sapiens
ttcctgaatgctgttgtgctgt

SEQ ID NO: 9197452 - DNA, 22 bp, Homo sapiens
ttcctgacttgccaggtgtgac

SEQ ID NO: 9197453 - DNA, 22 bp, Homo sapiens
ttcctgccctgcctgtgccact

SEQ ID NO: 9197454 - DNA, 22 bp, Homo sapiens
ttcctgctccatttgctgagct

SEQ ID NO: 9197455 - DNA, 22 bp, Homo sapiens
ttcctgcctacatgccttatgc

SEQ ID NO: 9197456 - DNA, 22 bp, Homo sapiens
ttcttttctgcagctggtattt

SEQ ID NO: 9197457 - DNA, 22 bp, Homo sapiens
ttcttcagactactgatgattg

SEQ ID NO: 9197458 - DNA, 22 bp, Homo sapiens
ttgaaatatttgggagtgtttg

SEQ ID NO: 9197459 - DNA, 22 bp, Homo sapiens
ttgaacaatttggtatacaaac

SEQ ID NO: 9197460 - DNA, 22 bp, Homo sapiens
ttgaaatgtagtcctgccttca

SEQ ID NO: 9197461 - DNA, 22 bp, Homo sapiens
ttgaacattggcaatttcatat

SEQ ID NO: 9197462 - DNA, 22 bp, Homo sapiens
tttttataccacctctcactta

SEQ ID NO: 9197463 - DNA, 22 bp, Homo sapiens
tttgatttactggatattctca

SEQ ID NO: 9197464 - DNA, 22 bp, Homo sapiens
tttgatagttgattaaattcca

SEQ ID NO: 9197465 - DNA, 22 bp, Homo sapiens
tttcctcagaagtgtctactat

SEQ ID NO: 9197466 - DNA, 22 bp, Homo sapiens
tttcctcatttatctgctggga

SEQ ID NO: 9197467 - DNA, 22 bp, Homo sapiens
tttcctctgagtgagctgggag

SEQ ID NO: 9197468 - DNA, 22 bp, Homo sapiens
tttgacaacagcaaatgtcaca

SEQ ID NO: 9197469 - DNA, 22 bp, Homo sapiens
tttgacaaatccttcagcaatg

SEQ ID NO: 9197470 - DNA, 22 bp, Homo sapiens
tttgacaataattgcatttata

SEQ ID NO: 9197471 - DNA, 22 bp, Homo sapiens
tttgacaagagggcatcttcag

SEQ ID NO: 9197472 - DNA, 19 bp, Homo sapiens
tttgaaaggattgttattt

SEQ ID NO: 9197473 - DNA, 22 bp, Homo sapiens
tttgaaagcctggcttttctct

SEQ ID NO: 9197474 - DNA, 21 bp, Homo sapiens
tttgaaagccctatgttttca

SEQ ID NO: 9197475 - DNA, 22 bp, Homo sapiens
ttttaatgggcgactattatgg

SEQ ID NO: 9197476 - DNA, 22 bp, Homo sapiens
tttgttcacatgtcatgtacaa

SEQ ID NO: 9197477 - DNA, 22 bp, Homo sapiens
ttttaaagagatgctgtgcata

SEQ ID NO: 9197478 - DNA, 22 bp, Homo sapiens
ttttaaaggcagattatggctt

SEQ ID NO: 9197479 - DNA, 22 bp, Homo sapiens
ttttaaaggatactcttgtcta

SEQ ID NO: 9197480 - DNA, 22 bp, Homo sapiens
ttttaaaggatagctctggttg

SEQ ID NO: 9197481 - DNA, 21 bp, Homo sapiens
ttttaacaaggatttccctag

SEQ ID NO: 9197482 - DNA, 22 bp, Homo sapiens
ttttaaaggctgtatgaccaag

SEQ ID NO: 9197483 - DNA, 22 bp, Homo sapiens
tttgtgtttgtacaatgcacta

SEQ ID NO: 9197484 - DNA, 22 bp, Homo sapiens
tttgttcaacatcacttccacc

SEQ ID NO: 9197485 - DNA, 22 bp, Homo sapiens
tttgtaaagtctgttctgagtt

SEQ ID NO: 9197486 - DNA, 22 bp, Homo sapiens
tttgtaaaggcctgaatttcag

SEQ ID NO: 9197487 - DNA, 22 bp, Homo sapiens
ttttcatgtgatgtgacatttc

SEQ ID NO: 9197488 - DNA, 22 bp, Homo sapiens
ttttcatggccaccgcaagtga

SEQ ID NO: 9197489 - DNA, 22 bp, Homo sapiens
ttttcatgttccttgttaagtg

SEQ ID NO: 9197490 - DNA, 22 bp, Homo sapiens
ttttcattgagcacctgagtaa

SEQ ID NO: 9197491 - DNA, 22 bp, Homo sapiens
ttttcattagaatgactgagaa

SEQ ID NO: 9197492 - DNA, 22 bp, Homo sapiens
ttttcattgtaaatcaggaaac

SEQ ID NO: 9197493 - DNA, 22 bp, Homo sapiens
ttttcatttttgtagatgcaag

SEQ ID NO: 9197494 - DNA, 22 bp, Homo sapiens
ttttctcaggtgcttatctaag

SEQ ID NO: 9197495 - DNA, 19 bp, Homo sapiens
ttttctcagcttctagcgg

SEQ ID NO: 9197496 - DNA, 22 bp, Homo sapiens
ttttctcttgttaatgtactga

SEQ ID NO: 9197497 - DNA, 22 bp, Homo sapiens
ttttctcaagatccaatgcact

SEQ ID NO: 9197498 - DNA, 19 bp, Homo sapiens
ggctgcctttccttaccag

SEQ ID NO: 9197499 - DNA, 22 bp, Homo sapiens
ggctccagtttccccttggggc

SEQ ID NO: 9197500 - DNA, 22 bp, Homo sapiens
ggctcctgtcccctcagctgct

SEQ ID NO: 9197501 - DNA, 22 bp, Homo sapiens
ggctcctgtcctcctggagctc

SEQ ID NO: 9197502 - DNA, 22 bp, Homo sapiens
ggctgggagctggacaggccgg

SEQ ID NO: 9197503 - DNA, 22 bp, Homo sapiens
cagaacattgttttctcatctg

SEQ ID NO: 9197504 - DNA, 22 bp, Homo sapiens
cagaacatccccactgctacct

SEQ ID NO: 9197505 - DNA, 22 bp, Homo sapiens
cagaaattcccatttcagattc

SEQ ID NO: 9197506 - DNA, 22 bp, Homo sapiens
ggaacagcgtggggctctcctg

SEQ ID NO: 9197507 - DNA, 17 bp, Homo sapiens
ggagagtgggaatggcc

SEQ ID NO: 9197508 - DNA, 22 bp, Homo sapiens
cacagctaactttcactgagca

SEQ ID NO: 9197509 - DNA, 22 bp, Homo sapiens
ggaggggatttagtagatgcta

SEQ ID NO: 9197510 - DNA, 22 bp, Homo sapiens
cacagcattaactgggacagct

SEQ ID NO: 9197511 - DNA, 22 bp, Homo sapiens
cacagcataatgaaatatactt

SEQ ID NO: 9197512 - DNA, 22 bp, Homo sapiens
cacagcattcacagaaagacat

SEQ ID NO: 9197513 - DNA, 22 bp, Homo sapiens
caaattgatctgtctttatgaa

SEQ ID NO: 9197514 - DNA, 22 bp, Homo sapiens
caaatttaggtaacagtctgta

SEQ ID NO: 9197515 - DNA, 22 bp, Homo sapiens
caaattctcaaggtttatccca

SEQ ID NO: 9197516 - DNA, 18 bp, Homo sapiens
caaattctcattgatttc

SEQ ID NO: 9197517 - DNA, 22 bp, Homo sapiens
gctgggagcaagtactcatctt

SEQ ID NO: 9197518 - DNA, 22 bp, Homo sapiens
gctgggagcaaagccatgcata

SEQ ID NO: 9197519 - DNA, 22 bp, Homo sapiens
gcttccagacgatcatgtaaga

SEQ ID NO: 9197520 - DNA, 22 bp, Homo sapiens
caatggttctcaaactatcatg

SEQ ID NO: 9197521 - DNA, 22 bp, Homo sapiens
cagaggaccattgtatgtattg

SEQ ID NO: 9197522 - DNA, 22 bp, Homo sapiens
cagaagcacatgtttacatgta

SEQ ID NO: 9197523 - DNA, 22 bp, Homo sapiens
gtaagatttaaaatagcaattg

SEQ ID NO: 9197524 - DNA, 19 bp, Homo sapiens
ggtgtgaagtgaggagtta

SEQ ID NO: 9197525 - DNA, 22 bp, Homo sapiens
cagcagactggagtaggcagtg

SEQ ID NO: 9197526 - DNA, 20 bp, Homo sapiens
cagccctttatcctcctatg

SEQ ID NO: 9197527 - DNA, 22 bp, Homo sapiens
gtcctaccatgaattcactcca

SEQ ID NO: 9197528 - DNA, 22 bp, Homo sapiens
gtcctatattcttttaaaattt

SEQ ID NO: 9197529 - DNA, 22 bp, Homo sapiens
gtctatttgggatcatgatatg

SEQ ID NO: 9197530 - DNA, 22 bp, Homo sapiens
cagcatgattggtgtctggtga

SEQ ID NO: 9197531 - DNA, 22 bp, Homo sapiens
cagcatgaaaagtgttgctatc

SEQ ID NO: 9197532 - DNA, 22 bp, Homo sapiens
cagcatgacagtctgcagcaga

SEQ ID NO: 9197533 - DNA, 22 bp, Homo sapiens
cagcatgaatgtgttcgtaggg

SEQ ID NO: 9197534 - DNA, 22 bp, Homo sapiens
cagcatgaaacaattgagccca

SEQ ID NO: 9197535 - DNA, 22 bp, Homo sapiens
cagcatgagaaaatgaatcaga

SEQ ID NO: 9197536 - DNA, 22 bp, Homo sapiens
cagcatgatgagtgcagtttgg

SEQ ID NO: 9197537 - DNA, 22 bp, Homo sapiens
cagcatgatgctcacacaaaac

SEQ ID NO: 9197538 - DNA, 22 bp, Homo sapiens
cagcatgatcccagttgattgc

SEQ ID NO: 9197539 - DNA, 22 bp, Homo sapiens
gtctcttagtctcattttctgc

SEQ ID NO: 9197540 - DNA, 22 bp, Homo sapiens
gtctttctgctgcacggactgc

SEQ ID NO: 9197541 - DNA, 22 bp, Homo sapiens
gtgcaaagtgcatggggaaggg

SEQ ID NO: 9197542 - DNA, 22 bp, Homo sapiens
gaggctgctttgatgacaggag

SEQ ID NO: 9197543 - DNA, 22 bp, Homo sapiens
atgtttcaccagttttataaga

SEQ ID NO: 9197544 - DNA, 22 bp, Homo sapiens
atgtttcagttctaaagttaga

SEQ ID NO: 9197545 - DNA, 22 bp, Homo sapiens
atgtttcatcagtaaggttttg

SEQ ID NO: 9197546 - DNA, 22 bp, Homo sapiens
gatctcagacaggtggacaggg

SEQ ID NO: 9197547 - DNA, 22 bp, Homo sapiens
gatctgaaaatgctcttcttct

SEQ ID NO: 9197548 - DNA, 22 bp, Homo sapiens
gatctgaagagttattttctga

SEQ ID NO: 9197549 - DNA, 22 bp, Homo sapiens
gatctgaaccttgcctgttggg

SEQ ID NO: 9197550 - DNA, 22 bp, Homo sapiens
gatctgaaatagctactgcaga

SEQ ID NO: 9197551 - DNA, 22 bp, Homo sapiens
gatctgaagagcaatgaaatat

SEQ ID NO: 9197552 - DNA, 22 bp, Homo sapiens
gatctgaagatatgaaatattt

SEQ ID NO: 9197553 - DNA, 22 bp, Homo sapiens
gatctgaatagacttgctaagg

SEQ ID NO: 9197554 - DNA, 16 bp, Homo sapiens
gatctgaaggtgctgg

SEQ ID NO: 9197555 - DNA, 22 bp, Homo sapiens
gatctgaatcaatagaataact

SEQ ID NO: 9197556 - DNA, 22 bp, Homo sapiens
gatctgagaaatccttggccag

SEQ ID NO: 9197557 - DNA, 22 bp, Homo sapiens
gatctgagatctaaaccagagg

SEQ ID NO: 9197558 - DNA, 22 bp, Homo sapiens
atgtttctaaaacttgcatggc

SEQ ID NO: 9197559 - DNA, 22 bp, Homo sapiens
gagctttgcattattcagaagc

SEQ ID NO: 9197560 - DNA, 22 bp, Homo sapiens
gaggaaggatttagtttgaggg

SEQ ID NO: 9197561 - DNA, 22 bp, Homo sapiens
gaggaaggctaaggggcttaga

SEQ ID NO: 9197562 - DNA, 22 bp, Homo sapiens
gaggaaggagggaaagcgcgcg

SEQ ID NO: 9197563 - DNA, 22 bp, Homo sapiens
gaggaaggaatgcagtgtatgc

SEQ ID NO: 9197564 - DNA, 22 bp, Homo sapiens
atgtaatagggtaacataacat

SEQ ID NO: 9197565 - DNA, 22 bp, Homo sapiens
atgtaacaaatggtatacatgt

SEQ ID NO: 9197566 - DNA, 22 bp, Homo sapiens
atcttcagcgaggtttcctttc

SEQ ID NO: 9197567 - DNA, 22 bp, Homo sapiens
atgaatatgtacacatctgtca

SEQ ID NO: 9197568 - DNA, 22 bp, Homo sapiens
atgaatattgaatgtcttatga

SEQ ID NO: 9197569 - DNA, 22 bp, Homo sapiens
atgaatgacatctgattccata

SEQ ID NO: 9197570 - DNA, 22 bp, Homo sapiens
atgaatgggtcattatttgatc

SEQ ID NO: 9197571 - DNA, 22 bp, Homo sapiens
gaagaaagatcaaatagtttcc

SEQ ID NO: 9197572 - DNA, 22 bp, Homo sapiens
atgcacaaacccacaattagtc

SEQ ID NO: 9197573 - DNA, 22 bp, Homo sapiens
atgcaatgttcctttcttcacc

SEQ ID NO: 9197574 - DNA, 22 bp, Homo sapiens
atgcaatgttcctttcttcacc

SEQ ID NO: 9197575 - DNA, 22 bp, Homo sapiens
gaaatctccaatcttttcttta

SEQ ID NO: 9197576 - DNA, 19 bp, Homo sapiens
gaaatctctttcttgtctt

SEQ ID NO: 9197577 - DNA, 22 bp, Homo sapiens
atgcttgtgtaagaagcctatg

SEQ ID NO: 9197578 - DNA, 22 bp, Homo sapiens
gacagggaggaaagagactgct

SEQ ID NO: 9197579 - DNA, 22 bp, Homo sapiens
gaatcatgtctagaagcagtgg

SEQ ID NO: 9197580 - DNA, 22 bp, Homo sapiens
gaatcatgctcaataatgcttg

SEQ ID NO: 9197581 - DNA, 22 bp, Homo sapiens
gaatgtttgactaaaggtagct

SEQ ID NO: 9197582 - DNA, 22 bp, Homo sapiens
gaatgtgggctgtgaagaggag

SEQ ID NO: 9197583 - DNA, 22 bp, Homo sapiens
gaatgttactttgattttgtcc

SEQ ID NO: 9197584 - DNA, 22 bp, Homo sapiens
gacagggactccctggttagaa

SEQ ID NO: 9197585 - DNA, 22 bp, Homo sapiens
gacagggacgaggcttcaggca

SEQ ID NO: 9197586 - DNA, 22 bp, Homo sapiens
atgccacttcattccagcctcg

SEQ ID NO: 9197587 - DNA, 22 bp, Homo sapiens
gcaggctgtgaggctcagatgg

SEQ ID NO: 9197588 - DNA, 22 bp, Homo sapiens
gcaggctgtctaaagttagagt

SEQ ID NO: 9197589 - DNA, 22 bp, Homo sapiens
gcaggctgtagacaccaaacta

SEQ ID NO: 9197590 - DNA, 22 bp, Homo sapiens
gcaggctgtggtatgttgggca

SEQ ID NO: 9197591 - DNA, 22 bp, Homo sapiens
attgttcaatgtaataattttg

SEQ ID NO: 9197592 - DNA, 22 bp, Homo sapiens
gcagcctttggaattagagact

SEQ ID NO: 9197593 - DNA, 17 bp, Homo sapiens
gcagcctcttggtagtg

SEQ ID NO: 9197594 - DNA, 22 bp, Homo sapiens
gcagaatgtccaagctgggccc

SEQ ID NO: 9197595 - DNA, 22 bp, Homo sapiens
gcagaatgtcagtatggtcacc

SEQ ID NO: 9197596 - DNA, 22 bp, Homo sapiens
gcagaatgtttccaaggtttgt

SEQ ID NO: 9197597 - DNA, 22 bp, Homo sapiens
atgtttctcactgtttctctat

SEQ ID NO: 9197598 - DNA, 22 bp, Homo sapiens
caaattcaatgaacatgtttaa

SEQ ID NO: 9197599 - DNA, 22 bp, Homo sapiens
caaatagacttaagcatctgta

SEQ ID NO: 9197600 - DNA, 22 bp, Homo sapiens
gctatttctttaaattgatctc

SEQ ID NO: 9197601 - DNA, 22 bp, Homo sapiens
gctatttctatattataaagaa

SEQ ID NO: 9197602 - DNA, 22 bp, Homo sapiens
gctatgttagacattctcattt

SEQ ID NO: 9197603 - DNA, 22 bp, Homo sapiens
atttacatttatttgagaaggt

SEQ ID NO: 9197604 - DNA, 22 bp, Homo sapiens
attttaataagatccatttggt

SEQ ID NO: 9197605 - DNA, 23 bp, Homo sapiens
attttaaccttgactaacatgca

SEQ ID NO: 9197606 - DNA, 22 bp, Homo sapiens
atttgattagctgtgtaatttt

SEQ ID NO: 9197607 - DNA, 22 bp, Homo sapiens
gcctgcctagaattgcagcttt

SEQ ID NO: 9197608 - DNA, 22 bp, Homo sapiens
attttacataaggaaggtttaa

SEQ ID NO: 9197609 - DNA, 22 bp, Homo sapiens
attttactactccaattaatga

SEQ ID NO: 9197610 - DNA, 22 bp, Homo sapiens
attttgaaatacttgaaggaaa

SEQ ID NO: 9197611 - DNA, 22 bp, Homo sapiens
attttctagatagatgatgcat

SEQ ID NO: 9197612 - DNA, 22 bp, Homo sapiens
agtatttctgaatattatcata

SEQ ID NO: 9197613 - DNA, 22 bp, Homo sapiens
agtagattttagattacatagt

SEQ ID NO: 9197614 - DNA, 20 bp, Homo sapiens
ccttctccagcttgttcttg

SEQ ID NO: 9197615 - DNA, 22 bp, Homo sapiens
ccttctcctgccttgggttcat

SEQ ID NO: 9197616 - DNA, 22 bp, Homo sapiens
agtcacatggactcaggatgac

SEQ ID NO: 9197617 - DNA, 22 bp, Homo sapiens
ctagctgacgggttgataggtg

SEQ ID NO: 9197618 - DNA, 22 bp, Homo sapiens
ctagtctggacatctcacatgt

SEQ ID NO: 9197619 - DNA, 22 bp, Homo sapiens
ctatatttcttggctttaaaca

SEQ ID NO: 9197620 - DNA, 22 bp, Homo sapiens
ctatatttggtgagggatgtct

SEQ ID NO: 9197621 - DNA, 22 bp, Homo sapiens
agggttagtctttgcagctagg

SEQ ID NO: 9197622 - DNA, 21 bp, Homo sapiens
agttcctgcttcattgtcttt

SEQ ID NO: 9197623 - DNA, 22 bp, Homo sapiens
agttcctgaacttcttaatgac

SEQ ID NO: 9197624 - DNA, 22 bp, Homo sapiens
agttatttcagtaacataatag

SEQ ID NO: 9197625 - DNA, 22 bp, Homo sapiens
agtgtttcacagcactttttct

SEQ ID NO: 9197626 - DNA, 22 bp, Homo sapiens
agtgtgagtttggttgagactt

SEQ ID NO: 9197627 - DNA, 22 bp, Homo sapiens
agtgtgagttacaaagtgtgaa

SEQ ID NO: 9197628 - DNA, 22 bp, Homo sapiens
agtgtgagtgctcatgtccatc

SEQ ID NO: 9197629 - DNA, 22 bp, Homo sapiens
agtgtgagtaattgagtctgtc

SEQ ID NO: 9197630 - DNA, 19 bp, Homo sapiens
agtgtgagtaattggagtt

SEQ ID NO: 9197631 - DNA, 22 bp, Homo sapiens
agtgtgagccctggagtggtgc

SEQ ID NO: 9197632 - DNA, 22 bp, Homo sapiens
agtgtgagattaaaccgaatca

SEQ ID NO: 9197633 - DNA, 22 bp, Homo sapiens
agtgtgagcctacaggccaaag

SEQ ID NO: 9197634 - DNA, 22 bp, Homo sapiens
agtgtgagctaatagcagagcc

SEQ ID NO: 9197635 - DNA, 22 bp, Homo sapiens
agtgtgaggggttctttgatat

SEQ ID NO: 9197636 - DNA, 22 bp, Homo sapiens
agtgtgagtaattcagggaggg

SEQ ID NO: 9197637 - DNA, 22 bp, Homo sapiens
agtgtgagatgattgaggagca

SEQ ID NO: 9197638 - DNA, 19 bp, Homo sapiens
agtgtgagactccatctca

SEQ ID NO: 9197639 - DNA, 22 bp, Homo sapiens
agtgtgagaacggactaataaa

SEQ ID NO: 9197640 - DNA, 22 bp, Homo sapiens
agtctattgcctaacagagagg

SEQ ID NO: 9197641 - DNA, 22 bp, Homo sapiens
agtctatttgctgtccgagcaa

SEQ ID NO: 9197642 - DNA, 22 bp, Homo sapiens
agtctattttcagaagcagttt

SEQ ID NO: 9197643 - DNA, 22 bp, Homo sapiens
agtctatttccccttctcttga

SEQ ID NO: 9197644 - DNA, 19 bp, Homo sapiens
agtctcacccaagcagtct

SEQ ID NO: 9197645 - DNA, 22 bp, Homo sapiens
ctcacagtctctccctaatttt

SEQ ID NO: 9197646 - DNA, 22 bp, Homo sapiens
ctcacagttggctcattaatga

SEQ ID NO: 9197647 - DNA, 22 bp, Homo sapiens
agtgaaaagatgcatttctctg

SEQ ID NO: 9197648 - DNA, 22 bp, Homo sapiens
agtgaggggcagctgagtgggc

SEQ ID NO: 9197649 - DNA, 22 bp, Homo sapiens
agtgaggggcagctgagtgggc

SEQ ID NO: 9197650 - DNA, 22 bp, Homo sapiens
agtgaggggattcaggcaaggt

SEQ ID NO: 9197651 - DNA, 22 bp, Homo sapiens
agtggagcagagaggggatctt

SEQ ID NO: 9197652 - DNA, 22 bp, Homo sapiens
atcacaaaggtctcagagcaca

SEQ ID NO: 9197653 - DNA, 22 bp, Homo sapiens
atcacaaagggttttctctgag

SEQ ID NO: 9197654 - DNA, 22 bp, Homo sapiens
atcacaatccctctctctgata

SEQ ID NO: 9197655 - DNA, 22 bp, Homo sapiens
ctgtaatcccagctacctggga

SEQ ID NO: 9197656 - DNA, 19 bp, Homo sapiens
ctgtccttggctgcactgt

SEQ ID NO: 9197657 - DNA, 22 bp, Homo sapiens
atcaagaatgttcattcttcta

SEQ ID NO: 9197658 - DNA, 22 bp, Homo sapiens
ctggtcccagctctgccaccaa

SEQ ID NO: 9197659 - DNA, 22 bp, Homo sapiens
cttaagaaattgcattctaatc

SEQ ID NO: 9197660 - DNA, 22 bp, Homo sapiens
atcatcagggacatttctgtgc

SEQ ID NO: 9197661 - DNA, 22 bp, Homo sapiens
cttaacaagcccaactttcatt

SEQ ID NO: 9197662 - DNA, 20 bp, Homo sapiens
atccatcagagaaaataaag

SEQ ID NO: 9197663 - DNA, 22 bp, Homo sapiens
cttaatctcacctgcaaagtcc

SEQ ID NO: 9197664 - DNA, 22 bp, Homo sapiens
cttaataaatggtagctgttat

SEQ ID NO: 9197665 - DNA, 22 bp, Homo sapiens
cttatgtatgctactttgtggt

SEQ ID NO: 9197666 - DNA, 22 bp, Homo sapiens
cttccttccttccccgaaatgc

SEQ ID NO: 9197667 - DNA, 22 bp, Homo sapiens
cttccttctcactagcagcgcc

SEQ ID NO: 9197668 - DNA, 22 bp, Homo sapiens
cttccttctgtaagaccagttg

SEQ ID NO: 9197669 - DNA, 22 bp, Homo sapiens
cttccttctgaagcatagaagc

SEQ ID NO: 9197670 - DNA, 22 bp, Homo sapiens
cttccttgcggcccctgcctag

SEQ ID NO: 9197671 - DNA, 22 bp, Homo sapiens
cttcacaaagctctctttatgt

SEQ ID NO: 9197672 - DNA, 22 bp, Homo sapiens
cttcacaaaatatttcattata

SEQ ID NO: 9197673 - DNA, 22 bp, Homo sapiens
cttcacaaatggcctagagttc

SEQ ID NO: 9197674 - DNA, 22 bp, Homo sapiens
cttctgtgttaaatgagtcttt

SEQ ID NO: 9197675 - DNA, 22 bp, Homo sapiens
atctccccgagcttacctcctg

SEQ ID NO: 9197676 - DNA, 22 bp, Homo sapiens
cttccttgtggtccttctcatt

SEQ ID NO: 9197677 - DNA, 22 bp, Homo sapiens
atctcctcgcaggccagaacac

SEQ ID NO: 9197678 - DNA, 22 bp, Homo sapiens
atctgtgtgttgagttctcagc

SEQ ID NO: 9197679 - DNA, 22 bp, Homo sapiens
atctgtatatttttcaatgcaa

SEQ ID NO: 9197680 - DNA, 22 bp, Homo sapiens
atctgtaactgctatcatctcc

SEQ ID NO: 9197681 - DNA, 22 bp, Homo sapiens
ctgggagaggaacctcgagggt

SEQ ID NO: 9197682 - DNA, 22 bp, Homo sapiens
atacatgcttgggtgtagtgcg

SEQ ID NO: 9197683 - DNA, 19 bp, Homo sapiens
atacatgcatttacatgct

SEQ ID NO: 9197684 - DNA, 22 bp, Homo sapiens
atacatgcacatttttatacat

SEQ ID NO: 9197685 - DNA, 22 bp, Homo sapiens
atacatgtgtgtgcatacatgt

SEQ ID NO: 9197686 - DNA, 22 bp, Homo sapiens
atacacattactttctgtctga

SEQ ID NO: 9197687 - DNA, 22 bp, Homo sapiens
ctgctaaacctctctgagagct

SEQ ID NO: 9197688 - DNA, 22 bp, Homo sapiens
atacacatatcaggtgtataca

SEQ ID NO: 9197689 - DNA, 19 bp, Homo sapiens
atacacatacgtaaactga

SEQ ID NO: 9197690 - DNA, 22 bp, Homo sapiens
ctgctgtggatgcaggacctca

SEQ ID NO: 9197691 - DNA, 22 bp, Homo sapiens
ctgctgtgggttaagacactgt

SEQ ID NO: 9197692 - DNA, 22 bp, Homo sapiens
atacaagttaatgagaatgaca

SEQ ID NO: 9197693 - DNA, 22 bp, Homo sapiens
ctgctgtggtgtcaagcatctc

SEQ ID NO: 9197694 - DNA, 22 bp, Homo sapiens
ctgctgtgccttaaaatgcaag

SEQ ID NO: 9197695 - DNA, 22 bp, Homo sapiens
cctcagcttgatttctgcagag

SEQ ID NO: 9197696 - DNA, 22 bp, Homo sapiens
cctgagagccagtgcctgccca

SEQ ID NO: 9197697 - DNA, 22 bp, Homo sapiens
cctgagagccctagccaggcgc

SEQ ID NO: 9197698 - DNA, 22 bp, Homo sapiens
cctgaagacaacttttatcacc

SEQ ID NO: 9197699 - DNA, 20 bp, Homo sapiens
cctgaagagtttctctttct

SEQ ID NO: 9197700 - DNA, 22 bp, Homo sapiens
cctgagagtaggtgtctcttta

SEQ ID NO: 9197701 - DNA, 22 bp, Homo sapiens
aggctgggtacctgtcatatgc

SEQ ID NO: 9197702 - DNA, 22 bp, Homo sapiens
cccaggctgtctgtcctttgct

SEQ ID NO: 9197703 - DNA, 22 bp, Homo sapiens
cccaggctgtgcaaacttcaaa

SEQ ID NO: 9197704 - DNA, 22 bp, Homo sapiens
cccaggcttttctcttgcccca

SEQ ID NO: 9197705 - DNA, 22 bp, Homo sapiens
cccaggctgcatgagtccatgg

SEQ ID NO: 9197706 - DNA, 22 bp, Homo sapiens
ccctccattaaaacagacctat

SEQ ID NO: 9197707 - DNA, 22 bp, Homo sapiens
ccccagcacaggctcctcagat

SEQ ID NO: 9197708 - DNA, 22 bp, Homo sapiens
ccccagataggttcatgcccta

SEQ ID NO: 9197709 - DNA, 22 bp, Homo sapiens
ccagaactgagaaaataaattt

SEQ ID NO: 9197710 - DNA, 22 bp, Homo sapiens
ccagaactgggcaacagaaagt

SEQ ID NO: 9197711 - DNA, 22 bp, Homo sapiens
ccagctctggcttcttgctggg

SEQ ID NO: 9197712 - DNA, 22 bp, Homo sapiens
aggctggagggcaatggcaaga

SEQ ID NO: 9197713 - DNA, 20 bp, Homo sapiens
aggctggggtgttttgccca

SEQ ID NO: 9197714 - DNA, 22 bp, Homo sapiens
aggctggggaattgaatttgct

SEQ ID NO: 9197715 - DNA, 22 bp, Homo sapiens
aggctgggaaggtaaagttgta

SEQ ID NO: 9197716 - DNA, 22 bp, Homo sapiens
aggctgggcaccgttttgatcc

SEQ ID NO: 9197717 - DNA, 22 bp, Homo sapiens
aggctgggctccgcccaactcc

SEQ ID NO: 9197718 - DNA, 22 bp, Homo sapiens
ccaggctggagtatagtggcgc

SEQ ID NO: 9197719 - DNA, 22 bp, Homo sapiens
ccagggctggaccagtgcttgg

SEQ ID NO: 9197720 - DNA, 20 bp, Homo sapiens
aggaaggagaatctgagcaa

SEQ ID NO: 9197721 - DNA, 22 bp, Homo sapiens
aggaattaacaatatatttagg

SEQ ID NO: 9197722 - DNA, 22 bp, Homo sapiens
cagggtttcaccatgttagcag

SEQ ID NO: 9197723 - DNA, 22 bp, Homo sapiens
aggaaaagtgtgaagtatggag

SEQ ID NO: 9197724 - DNA, 22 bp, Homo sapiens
caggctggagttacctttaggg

SEQ ID NO: 9197725 - DNA, 22 bp, Homo sapiens
agctggagaatgtggatgatcc

SEQ ID NO: 9197726 - DNA, 22 bp, Homo sapiens
agctggagatgagtgacgtgcc

SEQ ID NO: 9197727 - DNA, 22 bp, Homo sapiens
agctggagaaacctgggagggt

SEQ ID NO: 9197728 - DNA, 20 bp, Homo sapiens
agctggagaagggcccttcc

SEQ ID NO: 9197729 - DNA, 22 bp, Homo sapiens
agctggagaataggaattagtg

SEQ ID NO: 9197730 - DNA, 22 bp, Homo sapiens
agctggagccagtgtgaggctt

SEQ ID NO: 9197731 - DNA, 22 bp, Homo sapiens
agctggagcttcaagcaggtaa

SEQ ID NO: 9197732 - DNA, 19 bp, Homo sapiens
agctggagattggagggca

SEQ ID NO: 9197733 - DNA, 22 bp, Homo sapiens
agctggagatgcccagcaccgg

SEQ ID NO: 9197734 - DNA, 22 bp, Homo sapiens
agctgggactcaactgtctggg

SEQ ID NO: 9197735 - DNA, 22 bp, Homo sapiens
agctggaggagtttctcctagc

SEQ ID NO: 9197736 - DNA, 22 bp, Homo sapiens
caggcagagctgaagatagatg

SEQ ID NO: 9197737 - DNA, 22 bp, Homo sapiens
agctggtcttaaatgtgtccag

SEQ ID NO: 9197738 - DNA, 22 bp, Homo sapiens
caggcagaggaggccttctcct

SEQ ID NO: 9197739 - DNA, 22 bp, Homo sapiens
caggcagagtgagaagcccttg

SEQ ID NO: 9197740 - DNA, 22 bp, Homo sapiens
agctgcctgcttatgagctcca

SEQ ID NO: 9197741 - DNA, 21 bp, Homo sapiens
agctgcctccacttctgaggc

SEQ ID NO: 9197742 - DNA, 17 bp, Homo sapiens
agctgcctctcccacca

SEQ ID NO: 9197743 - DNA, 22 bp, Homo sapiens
caggaaatggctgaataaattc

SEQ ID NO: 9197744 - DNA, 22 bp, Homo sapiens
ccaaactgtttcgtatttatgc

SEQ ID NO: 9197745 - DNA, 22 bp, Homo sapiens
aggatctgttgaataaatttga

SEQ ID NO: 9197746 - DNA, 22 bp, Homo sapiens
aggaattaataaccagtaagcc

SEQ ID NO: 9197747 - DNA, 22 bp, Homo sapiens
aggaatttgctggaacacagat

SEQ ID NO: 9197748 - DNA, 18 bp, Homo sapiens
cagtgaggatgaagggtt

SEQ ID NO: 9197749 - DNA, 22 bp, Homo sapiens
cagttataggagccattgtata

SEQ ID NO: 9197750 - DNA, 22 bp, Homo sapiens
cagttctgactttcataatgtc

SEQ ID NO: 9197751 - DNA, 22 bp, Homo sapiens
catcagaaaccttgaggaaact

SEQ ID NO: 9197752 - DNA, 22 bp, Homo sapiens
catcagaagaaagacaaatgat

SEQ ID NO: 9197753 - DNA, 22 bp, Homo sapiens
catcagaaggaaggacgattat

SEQ ID NO: 9197754 - DNA, 22 bp, Homo sapiens
aggagtgggggcgagaagttaa

SEQ ID NO: 9197755 - DNA, 22 bp, Homo sapiens
aggcaaagcgataccagagcta

SEQ ID NO: 9197756 - DNA, 22 bp, Homo sapiens
aggcaaagaggatattttgggg

SEQ ID NO: 9197757 - DNA, 22 bp, Homo sapiens
acatacatatgtttaaatgcat

SEQ ID NO: 9197758 - DNA, 22 bp, Homo sapiens
acatacatcaagtatcacaaga

SEQ ID NO: 9197759 - DNA, 23 bp, Homo sapiens
acatacatggagataaagtgatg

SEQ ID NO: 9197760 - DNA, 22 bp, Homo sapiens
aggaagccactgaatgaaagtt

SEQ ID NO: 9197761 - DNA, 22 bp, Homo sapiens
agcttagcacacacaggcaggt

SEQ ID NO: 9197762 - DNA, 22 bp, Homo sapiens
agctgtgtagggaatcagagaa

SEQ ID NO: 9197763 - DNA, 22 bp, Homo sapiens
agctgtgtaagtcatgtaggtg

SEQ ID NO: 9197764 - DNA, 22 bp, Homo sapiens
agctgggatgaggagcatcctt

SEQ ID NO: 9197765 - DNA, 22 bp, Homo sapiens
agctgggaggtgggcagtgaga

SEQ ID NO: 9197766 - DNA, 22 bp, Homo sapiens
agctgggaggctcctctgtgac

SEQ ID NO: 9197767 - DNA, 22 bp, Homo sapiens
agctgggagctgaaggctgatt

SEQ ID NO: 9197768 - DNA, 21 bp, Homo sapiens
acagcctccatctcctgggct

SEQ ID NO: 9197769 - DNA, 22 bp, Homo sapiens
acattctatgaagataatttta

SEQ ID NO: 9197770 - DNA, 22 bp, Homo sapiens
acattctagatatgttatattt

SEQ ID NO: 9197771 - DNA, 22 bp, Homo sapiens
acattctaacattgtacagata

SEQ ID NO: 9197772 - DNA, 22 bp, Homo sapiens
acattctaaagcatgctcagga

SEQ ID NO: 9197773 - DNA, 22 bp, Homo sapiens
acattcatgggttttacattat

SEQ ID NO: 9197774 - DNA, 22 bp, Homo sapiens
acattcaagatgcattcactta

SEQ ID NO: 9197775 - DNA, 22 bp, Homo sapiens
acatgaaaaatgtttgcagttt

SEQ ID NO: 9197776 - DNA, 22 bp, Homo sapiens
accagtctgttgttgcagagtg

SEQ ID NO: 9197777 - DNA, 19 bp, Homo sapiens
accaggagtatcagagctg

SEQ ID NO: 9197778 - DNA, 23 bp, Homo sapiens
aggcttcctatcttagagctggg

SEQ ID NO: 9197779 - DNA, 22 bp, Homo sapiens
accaaatgcttggctgctgtga

SEQ ID NO: 9197780 - DNA, 20 bp, Homo sapiens
accaggacaagacaaaagtg

SEQ ID NO: 9197781 - DNA, 22 bp, Homo sapiens
aggtagcttggtgctttcattc

SEQ ID NO: 9197782 - DNA, 21 bp, Homo sapiens
accttctgaattacctaccaa

SEQ ID NO: 9197783 - DNA, 22 bp, Homo sapiens
actctcccttggagcctcaggc

SEQ ID NO: 9197784 - DNA, 22 bp, Homo sapiens
actccctctctagtccttgcaa

SEQ ID NO: 9197785 - DNA, 22 bp, Homo sapiens
agtactttttgttcaattgtgc

SEQ ID NO: 9197786 - DNA, 22 bp, Homo sapiens
agtactgtcagcagggtgttga

SEQ ID NO: 9197787 - DNA, 22 bp, Homo sapiens
agtacttttttgatatctgagt

SEQ ID NO: 9197788 - DNA, 22 bp, Homo sapiens
agtataattagatatcaaaagt

SEQ ID NO: 9197789 - DNA, 22 bp, Homo sapiens
actgcccttgtcctggcacacc

SEQ ID NO: 9197790 - DNA, 20 bp, Homo sapiens
atcaaaatcctattgaggtt

SEQ ID NO: 9197791 - DNA, 22 bp, Homo sapiens
atcaaaatgctccagtgatggt

SEQ ID NO: 9197792 - DNA, 22 bp, Homo sapiens
atatttttccatgtgggactct

SEQ ID NO: 9197793 - DNA, 21 bp, Homo sapiens
atatttttgtttggactgtca

SEQ ID NO: 9197794 - DNA, 19 bp, Homo sapiens
agaaatctcgagatttgtt

SEQ ID NO: 9197795 - DNA, 22 bp, Homo sapiens
agaacagggactggaggcttca

SEQ ID NO: 9197796 - DNA, 22 bp, Homo sapiens
agaacatttgtcaaaaagccaa

SEQ ID NO: 9197797 - DNA, 22 bp, Homo sapiens
acttccttccaaacattcattt

SEQ ID NO: 9197798 - DNA, 22 bp, Homo sapiens
acttcctgtgttggtcttgctg

SEQ ID NO: 9197799 - DNA, 22 bp, Homo sapiens
acttcctggcgtagctgacatt

SEQ ID NO: 9197800 - DNA, 22 bp, Homo sapiens
acttcctgggtgttgtaaggtc

SEQ ID NO: 9197801 - DNA, 22 bp, Homo sapiens
acttccttttcaaccatacagc

SEQ ID NO: 9197802 - DNA, 22 bp, Homo sapiens
acttccttgtcaggtgcatcat

SEQ ID NO: 9197803 - DNA, 22 bp, Homo sapiens
acttccttgtactgactccatt

SEQ ID NO: 9197804 - DNA, 22 bp, Homo sapiens
acttccttttgggaaactgttt

SEQ ID NO: 9197805 - DNA, 22 bp, Homo sapiens
actgtttgctgatagatattta

SEQ ID NO: 9197806 - DNA, 23 bp, Homo sapiens
agtttttaatggtcatagctgag

SEQ ID NO: 9197807 - DNA, 21 bp, Homo sapiens
agtttttactcttaactgtgg

SEQ ID NO: 9197808 - DNA, 21 bp, Homo sapiens
actgttattcccattttcacc

SEQ ID NO: 9197809 - DNA, 22 bp, Homo sapiens
atacatcatttcccatcaatcg

SEQ ID NO: 9197810 - DNA, 22 bp, Homo sapiens
atagagtgatgtaaggtatgtg

SEQ ID NO: 9197811 - DNA, 23 bp, Homo sapiens
acttttcaattagctatgcttaa

SEQ ID NO: 9197812 - DNA, 22 bp, Homo sapiens
atgaacacatgtacacatttct

SEQ ID NO: 9197813 - DNA, 22 bp, Homo sapiens
agacacattttacattaactgt

SEQ ID NO: 9197814 - DNA, 22 bp, Homo sapiens
agaatcaattagattctatgag

SEQ ID NO: 9197815 - DNA, 22 bp, Homo sapiens
agaatcaactgaaaattggtga

SEQ ID NO: 9197816 - DNA, 22 bp, Homo sapiens
agacccaggtttcaaactactc

SEQ ID NO: 9197817 - DNA, 22 bp, Homo sapiens
atgcggagccccaagcttgaag

SEQ ID NO: 9197818 - DNA, 22 bp, Homo sapiens
atgcctttctttggtgcaggtt

SEQ ID NO: 9197819 - DNA, 22 bp, Homo sapiens
atgatatacttcctagaacagt

SEQ ID NO: 9197820 - DNA, 22 bp, Homo sapiens
atgatacattgcaaaattttaa

SEQ ID NO: 9197821 - DNA, 22 bp, Homo sapiens
atgcatcaaagtctgaaatttc

SEQ ID NO: 9197822 - DNA, 22 bp, Homo sapiens
atgcatcaggcactaggaatag

SEQ ID NO: 9197823 - DNA, 22 bp, Homo sapiens
agagcacaggctcaccattgtt

SEQ ID NO: 9197824 - DNA, 21 bp, Homo sapiens
agagcacaggtggacaatgct

SEQ ID NO: 9197825 - DNA, 22 bp, Homo sapiens
agacttaattctgcaagtgtag

SEQ ID NO: 9197826 - DNA, 22 bp, Homo sapiens
agactgtatgatttgagtttat

SEQ ID NO: 9197827 - DNA, 22 bp, Homo sapiens
agacttctcttggctatattat

SEQ ID NO: 9197828 - DNA, 22 bp, Homo sapiens
agagaatctgggaagatgttaa

SEQ ID NO: 9197829 - DNA, 22 bp, Homo sapiens
agatgcttaagttttcagtgta

SEQ ID NO: 9197830 - DNA, 23 bp, Homo sapiens
agaggcaggagtggcttgcccgg

SEQ ID NO: 9197831 - DNA, 19 bp, Homo sapiens
agaggctgtcacctgtagc

SEQ ID NO: 9197832 - DNA, 22 bp, Homo sapiens
agcagtcagtcctgaatgaagg

SEQ ID NO: 9197833 - DNA, 21 bp, Homo sapiens
agcatgcactacttcatctta

SEQ ID NO: 9197834 - DNA, 22 bp, Homo sapiens
agcatgaaaggcgtgccaactt

SEQ ID NO: 9197835 - DNA, 22 bp, Homo sapiens
agcatgcttttttaccttacat

SEQ ID NO: 9197836 - DNA, 22 bp, Homo sapiens
cacagcaatagctaactgatac

SEQ ID NO: 9197837 - DNA, 22 bp, Homo sapiens
cacagaactggttaatagcaga

SEQ ID NO: 9197838 - DNA, 22 bp, Homo sapiens
caatacaattaccagttaatca

SEQ ID NO: 9197839 - DNA, 22 bp, Homo sapiens
cagatgaaggcctgaatgtcta

SEQ ID NO: 9197840 - DNA, 22 bp, Homo sapiens
cagatgaagtaggtgacgagca

SEQ ID NO: 9197841 - DNA, 22 bp, Homo sapiens
agctagagaatgacagagtctg

SEQ ID NO: 9197842 - DNA, 22 bp, Homo sapiens
agctaattagaaatagattatt

SEQ ID NO: 9197843 - DNA, 22 bp, Homo sapiens
aaatttcagttggaatgagctc

SEQ ID NO: 9197844 - DNA, 22 bp, Homo sapiens
aaatttcagttacctttacgtt

SEQ ID NO: 9197845 - DNA, 22 bp, Homo sapiens
aaatttcaagcaaagtagctat

SEQ ID NO: 9197846 - DNA, 20 bp, Homo sapiens
aaatttaggaaattttacgc

SEQ ID NO: 9197847 - DNA, 22 bp, Homo sapiens
aaattattacaagctagttggc

SEQ ID NO: 9197848 - DNA, 22 bp, Homo sapiens
aacactgtaacagcatcatttt

SEQ ID NO: 9197849 - DNA, 22 bp, Homo sapiens
aagtatttctggcctgtgaaag

SEQ ID NO: 9197850 - DNA, 22 bp, Homo sapiens
aagtatttggaatggcattttt

SEQ ID NO: 9197851 - DNA, 22 bp, Homo sapiens
aagtatttcgttctgaaaaagt

SEQ ID NO: 9197852 - DNA, 22 bp, Homo sapiens
aagtatttcgttctgaaaaagt

SEQ ID NO: 9197853 - DNA, 22 bp, Homo sapiens
aagtatttcagcggttctttgt

SEQ ID NO: 9197854 - DNA, 20 bp, Homo sapiens
aagtttctggtttatatctt

SEQ ID NO: 9197855 - DNA, 22 bp, Homo sapiens
aagtttctgttcgctttaataa

SEQ ID NO: 9197856 - DNA, 22 bp, Homo sapiens
aaccatgctagcatcaaaatgt

SEQ ID NO: 9197857 - DNA, 22 bp, Homo sapiens
aacattctgtcaattgatgacc

SEQ ID NO: 9197858 - DNA, 22 bp, Homo sapiens
aacattctggttctaaaaacct

SEQ ID NO: 9197859 - DNA, 22 bp, Homo sapiens
aacattcttaagatttgtgtct

SEQ ID NO: 9197860 - DNA, 22 bp, Homo sapiens
aacattcttcaaatatcactct

SEQ ID NO: 9197861 - DNA, 22 bp, Homo sapiens
aacattctttagctcttcctgc

SEQ ID NO: 9197862 - DNA, 22 bp, Homo sapiens
aacattgcagcttaattgcagg

SEQ ID NO: 9197863 - DNA, 22 bp, Homo sapiens
aacattgcaaataagcttgcag

SEQ ID NO: 9197864 - DNA, 20 bp, Homo sapiens
aacattgcttcaatgtaacc

SEQ ID NO: 9197865 - DNA, 22 bp, Homo sapiens
aacattgccatggttaatttta

SEQ ID NO: 9197866 - DNA, 22 bp, Homo sapiens
aacatttcagcaaataagaaca

SEQ ID NO: 9197867 - DNA, 22 bp, Homo sapiens
aatcacatgtgctcaattttaa

SEQ ID NO: 9197868 - DNA, 22 bp, Homo sapiens
aattagcatttcccatataaat

SEQ ID NO: 9197869 - DNA, 22 bp, Homo sapiens
aattagagatcgcaataacggg

SEQ ID NO: 9197870 - DNA, 22 bp, Homo sapiens
aagaatgaaggatttagctgtt

SEQ ID NO: 9197871 - DNA, 22 bp, Homo sapiens
aagacaatgagtcctgatggga

SEQ ID NO: 9197872 - DNA, 22 bp, Homo sapiens
aatgttaattcacagccaaata

SEQ ID NO: 9197873 - DNA, 22 bp, Homo sapiens
aatgttaagtttagattataac

SEQ ID NO: 9197874 - DNA, 22 bp, Homo sapiens
aatgttaatgtgtttgcttatg

SEQ ID NO: 9197875 - DNA, 22 bp, Homo sapiens
aatgttttgtatgcctctgagc

SEQ ID NO: 9197876 - DNA, 22 bp, Homo sapiens
aactcttgggctgcatgctgtt

SEQ ID NO: 9197877 - DNA, 22 bp, Homo sapiens
aactcctctctggtggttcgtc

SEQ ID NO: 9197878 - DNA, 22 bp, Homo sapiens
aactctggctgcttcccaggtc

SEQ ID NO: 9197879 - DNA, 22 bp, Homo sapiens
aactctggttcagtgatttcag

SEQ ID NO: 9197880 - DNA, 22 bp, Homo sapiens
acactaattaagctgctttact

SEQ ID NO: 9197881 - DNA, 19 bp, Homo sapiens
acagaaatgtaagtgagac

SEQ ID NO: 9197882 - DNA, 22 bp, Homo sapiens
aacattcaaaacccagttcagt

SEQ ID NO: 9197883 - DNA, 22 bp, Homo sapiens
aacatgcacaattttaggcctg

SEQ ID NO: 9197884 - DNA, 22 bp, Homo sapiens
aacattctattttgctaaaaca

SEQ ID NO: 9197885 - DNA, 22 bp, Homo sapiens
aacattctcattgggatatgtg

SEQ ID NO: 9197886 - DNA, 22 bp, Homo sapiens
aacattctatgtgcattcagaa

SEQ ID NO: 9197887 - DNA, 22 bp, Homo sapiens
aacattctactgtactgcattg

SEQ ID NO: 9197888 - DNA, 22 bp, Homo sapiens
aacaggaatgaggagaaaaggt

SEQ ID NO: 9197889 - DNA, 22 bp, Homo sapiens
aacatttgcatgctttattaga

SEQ ID NO: 9197890 - DNA, 22 bp, Homo sapiens
aacatttgcgagtgggtttggg

SEQ ID NO: 9197891 - DNA, 22 bp, Homo sapiens
aacatttgcagaggaaagctat

SEQ ID NO: 9197892 - DNA, 22 bp, Homo sapiens
aacatttgaaaatcaagaatct

SEQ ID NO: 9197893 - DNA, 22 bp, Homo sapiens
aacatttgtgtttgctaaaaat

SEQ ID NO: 9197894 - DNA, 23 bp, Homo sapiens
aacatttgtaaggtgattttgtt

SEQ ID NO: 9197895 - DNA, 22 bp, Homo sapiens
aacatttgtactaaagaagttc

SEQ ID NO: 9197896 - DNA, 22 bp, Homo sapiens
aaatggtaatgtctttctgttt

SEQ ID NO: 9197897 - DNA, 22 bp, Homo sapiens
aacaatgtgattgaagctagaa

SEQ ID NO: 9197898 - DNA, 22 bp, Homo sapiens
aacaggaaaacagcacaatagc

SEQ ID NO: 9197899 - DNA, 19 bp, Homo sapiens
aagcatggtgcctcacctc

SEQ ID NO: 9197900 - DNA, 22 bp, Homo sapiens
aactttgtgtgtttaatatggc

SEQ ID NO: 9197901 - DNA, 22 bp, Homo sapiens
aactttgtcttttatgcttaca

SEQ ID NO: 9197902 - DNA, 22 bp, Homo sapiens
aagaatgagctcaaagatctta

SEQ ID NO: 9197903 - DNA, 22 bp, Homo sapiens
aaacttgttctcttgtgcctat

SEQ ID NO: 9197904 - DNA, 22 bp, Homo sapiens
aaacagttttctcatttagtgt

SEQ ID NO: 9197905 - DNA, 22 bp, Homo sapiens
aaacactgcagggtttacttga

SEQ ID NO: 9197906 - DNA, 22 bp, Homo sapiens
aaacactggcaatttcatgcac

SEQ ID NO: 9197907 - DNA, 22 bp, Homo sapiens
aaatataatttctgcctcaata

SEQ ID NO: 9197908 - DNA, 22 bp, Homo sapiens
aaatcagttctccctttcttca

SEQ ID NO: 9197909 - DNA, 22 bp, Homo sapiens
aaatatgttttccagttgtcat

SEQ ID NO: 9197910 - DNA, 22 bp, Homo sapiens
aaatcatgaggacattatgcca

SEQ ID NO: 9197911 - DNA, 22 bp, Homo sapiens
aaatccaagctttggtaactga

SEQ ID NO: 9197912 - DNA, 22 bp, Homo sapiens
aaatccaggagaatttccactt

SEQ ID NO: 9197913 - DNA, 20 bp, Homo sapiens
aaatgccagtgattctgctt

SEQ ID NO: 9197914 - DNA, 22 bp, Homo sapiens
aaatggcaggctctttgctagt

SEQ ID NO: 9197915 - DNA, 22 bp, Homo sapiens
aattttgttttagtggaggctg

SEQ ID NO: 9197916 - DNA, 22 bp, Homo sapiens
agatctgagggtccaagggagg

SEQ ID NO: 9197917 - DNA, 22 bp, Homo sapiens
agatgttttggagacactaacc

SEQ ID NO: 9197918 - DNA, 22 bp, Homo sapiens
agatgttttctaattctatatt

SEQ ID NO: 9197919 - DNA, 22 bp, Homo sapiens
aatttcaagtcttgaagaagta

SEQ ID NO: 9197920 - DNA, 22 bp, Homo sapiens
agagaaagtcctgatctctcta

SEQ ID NO: 9197921 - DNA, 22 bp, Homo sapiens
agagaaatagattggtccagaa

SEQ ID NO: 9197922 - DNA, 22 bp, Homo sapiens
aattattgagcatctactgtgt

SEQ ID NO: 9197923 - DNA, 22 bp, Homo sapiens
agagagcagtctggaagaaaca

SEQ ID NO: 9197924 - DNA, 20 bp, Homo sapiens
agagagcacaggcaggaaag

SEQ ID NO: 9197925 - DNA, 22 bp, Homo sapiens
aatgtataaccataggaaattt

SEQ ID NO: 9197926 - DNA, 22 bp, Homo sapiens
agaatttatgacaacgatagcc

SEQ ID NO: 9197927 - DNA, 22 bp, Homo sapiens
agaatttaggcttgtctgctgt

SEQ ID NO: 9197928 - DNA, 22 bp, Homo sapiens
agaatttaggatgcatgtgaat

SEQ ID NO: 9197929 - DNA, 22 bp, Homo sapiens
agaattgttggggtaataaaag

SEQ ID NO: 9197930 - DNA, 22 bp, Homo sapiens
agaataatactgaaatgctgaa

SEQ ID NO: 9197931 - DNA, 22 bp, Homo sapiens
aatggaatacctaggtggccca

SEQ ID NO: 9197932 - DNA, 22 bp, Homo sapiens
agatttgaaacttgcttcataa

SEQ ID NO: 9197933 - DNA, 22 bp, Homo sapiens
acacacatggtattgttcagaa

SEQ ID NO: 9197934 - DNA, 22 bp, Homo sapiens
acacacatggtattgttcagaa

SEQ ID NO: 9197935 - DNA, 22 bp, Homo sapiens
agattttatagataatttccca

SEQ ID NO: 9197936 - DNA, 22 bp, Homo sapiens
agattttagtgtagaggacttg

SEQ ID NO: 9197937 - DNA, 22 bp, Homo sapiens
acagaactgggaaatgcacata

SEQ ID NO: 9197938 - DNA, 20 bp, Homo sapiens
acagaactgagaacagtctc

SEQ ID NO: 9197939 - DNA, 21 bp, Homo sapiens
acagaactgtatagtgataaa

SEQ ID NO: 9197940 - DNA, 22 bp, Homo sapiens
agcccagctttcacccctctgg

SEQ ID NO: 9197941 - DNA, 22 bp, Homo sapiens
acagaactgtgtgatgattaag

SEQ ID NO: 9197942 - DNA, 20 bp, Homo sapiens
agccaggctcaagctccccc

SEQ ID NO: 9197943 - DNA, 22 bp, Homo sapiens
agcatgaaaacatgaaacagca

SEQ ID NO: 9197944 - DNA, 18 bp, Homo sapiens
aagtgggaaaagcaagca

SEQ ID NO: 9197945 - DNA, 22 bp, Homo sapiens
aagtgggaatagaaatgaaggt

SEQ ID NO: 9197946 - DNA, 22 bp, Homo sapiens
actcatatactgttgtttttaa

SEQ ID NO: 9197947 - DNA, 22 bp, Homo sapiens
actcatctattagatatctgtt

SEQ ID NO: 9197948 - DNA, 23 bp, Homo sapiens
actcatccttgatttgcagatgt

SEQ ID NO: 9197949 - DNA, 22 bp, Homo sapiens
aataaagtagcgtttaaggtgc

SEQ ID NO: 9197950 - DNA, 22 bp, Homo sapiens
aagtaaatatctgtagtcttta

SEQ ID NO: 9197951 - DNA, 22 bp, Homo sapiens
aagtaaatatctgtttatagca

SEQ ID NO: 9197952 - DNA, 22 bp, Homo sapiens
aagtaaatgttggagctcaaat

SEQ ID NO: 9197953 - DNA, 22 bp, Homo sapiens
aagtgaggcctaggcactgggt

SEQ ID NO: 9197954 - DNA, 22 bp, Homo sapiens
aagtgattctagtcatgattct

SEQ ID NO: 9197955 - DNA, 22 bp, Homo sapiens
aagtgaaattgccattcttata

SEQ ID NO: 9197956 - DNA, 22 bp, Homo sapiens
agaaacgcctgtgaaattatct

SEQ ID NO: 9197957 - DNA, 22 bp, Homo sapiens
aatatggcttgttactatgttt

SEQ ID NO: 9197958 - DNA, 22 bp, Homo sapiens
acttagttaagtattttggaaa

SEQ ID NO: 9197959 - DNA, 22 bp, Homo sapiens
acttccagctaggttctgctaa

SEQ ID NO: 9197960 - DNA, 22 bp, Homo sapiens
acttccgattttcagcacacat

SEQ ID NO: 9197961 - DNA, 22 bp, Homo sapiens
acttccagtgtctgctgctagc

SEQ ID NO: 9197962 - DNA, 22 bp, Homo sapiens
aatatcagtatattgtatcagt

SEQ ID NO: 9197963 - DNA, 22 bp, Homo sapiens
aagtaaaatgtttcctttatta

SEQ ID NO: 9197964 - DNA, 22 bp, Homo sapiens
aaggttgctgttttgcttcaaa

SEQ ID NO: 9197965 - DNA, 22 bp, Homo sapiens
accagctgctgattgctaaatg

SEQ ID NO: 9197966 - DNA, 22 bp, Homo sapiens
acattctgtgagtcatgtttta

SEQ ID NO: 9197967 - DNA, 22 bp, Homo sapiens
acattctgttgaggctgggtca

SEQ ID NO: 9197968 - DNA, 22 bp, Homo sapiens
acattctgtgatgctgtcccaa

SEQ ID NO: 9197969 - DNA, 22 bp, Homo sapiens
acattcaaaatatttctgatgt

SEQ ID NO: 9197970 - DNA, 22 bp, Homo sapiens
acattctgaaaaacagtgtttt

SEQ ID NO: 9197971 - DNA, 22 bp, Homo sapiens
acattctgaaatccatgtgggt

SEQ ID NO: 9197972 - DNA, 22 bp, Homo sapiens
acattctgtatcatctgtctca

SEQ ID NO: 9197973 - DNA, 22 bp, Homo sapiens
acattctgaataggcattttat

SEQ ID NO: 9197974 - DNA, 22 bp, Homo sapiens
acattctgaatgcctgacagta

SEQ ID NO: 9197975 - DNA, 22 bp, Homo sapiens
acattctggatgtctgatgaga

SEQ ID NO: 9197976 - DNA, 20 bp, Homo sapiens
acagatgaggaaaatgaagt

SEQ ID NO: 9197977 - DNA, 22 bp, Homo sapiens
acaggaaagagctaggcatagg

SEQ ID NO: 9197978 - DNA, 22 bp, Homo sapiens
acaggaaattggcatatcagtt

SEQ ID NO: 9197979 - DNA, 22 bp, Homo sapiens
acagtgcaggtctcaacaatta

SEQ ID NO: 9197980 - DNA, 22 bp, Homo sapiens
acagtgcataaaaacaactttt

SEQ ID NO: 9197981 - DNA, 20 bp, Homo sapiens
acaggctttctgaggctggc

SEQ ID NO: 9197982 - DNA, 22 bp, Homo sapiens
acaggcttttacggatatcttt

SEQ ID NO: 9197983 - DNA, 22 bp, Homo sapiens
acaggctgagcgtccatcttca

SEQ ID NO: 9197984 - DNA, 22 bp, Homo sapiens
acaggcttgcactagggtggca

SEQ ID NO: 9197985 - DNA, 22 bp, Homo sapiens
acaggcttagggcttgggcccg

SEQ ID NO: 9197986 - DNA, 22 bp, Homo sapiens
ggtaggaagatagagcaaagtt

SEQ ID NO: 9197987 - DNA, 22 bp, Homo sapiens
ggtcagggttccaggtatcttc

SEQ ID NO: 9197988 - DNA, 22 bp, Homo sapiens
ggtgctattcctatacagcatt

SEQ ID NO: 9197989 - DNA, 21 bp, Homo sapiens
ggtcttcccactgtctggtga

SEQ ID NO: 9197990 - DNA, 23 bp, Homo sapiens
gtgctgtgagccccttggcctcc

SEQ ID NO: 9197991 - DNA, 22 bp, Homo sapiens
gtgcctctgagctctgctacag

SEQ ID NO: 9197992 - DNA, 23 bp, Homo sapiens
gtgattctctctgtgtgggcagg

SEQ ID NO: 9197993 - DNA, 22 bp, Homo sapiens
gtgcaaattccactggaaagct

SEQ ID NO: 9197994 - DNA, 20 bp, Homo sapiens
gtctcctctttgcattccta

SEQ ID NO: 9197995 - DNA, 22 bp, Homo sapiens
gtctcctggaaatatgcccata

SEQ ID NO: 9197996 - DNA, 22 bp, Homo sapiens
gtcttcctaatttgctattagg

SEQ ID NO: 9197997 - DNA, 22 bp, Homo sapiens
gtaaattatttcaagatcatct

SEQ ID NO: 9197998 - DNA, 22 bp, Homo sapiens
gtctcccatgtccctgtccagt

SEQ ID NO: 9197999 - DNA, 22 bp, Homo sapiens
gtctcccatctctgtccttgtg

SEQ ID NO: 9198000 - DNA, 22 bp, Homo sapiens
gtctccccagggccctcttcat

SEQ ID NO: 9198001 - DNA, 22 bp, Homo sapiens
ggatggcagacagtgagtggct

SEQ ID NO: 9198002 - DNA, 22 bp, Homo sapiens
ggattagattcacacctgtctt

SEQ ID NO: 9198003 - DNA, 22 bp, Homo sapiens
ggatgaggtagatgaacaaggg

SEQ ID NO: 9198004 - DNA, 22 bp, Homo sapiens
ggatgctggggaccaatctctg

SEQ ID NO: 9198005 - DNA, 22 bp, Homo sapiens
ggatgctgactttggagcatgg

SEQ ID NO: 9198006 - DNA, 22 bp, Homo sapiens
ggagatggtggaagctggtgca

SEQ ID NO: 9198007 - DNA, 22 bp, Homo sapiens
ggcatgctcaggcttcttgctg

SEQ ID NO: 9198008 - DNA, 22 bp, Homo sapiens
ggcatgctgtaggcattcagta

SEQ ID NO: 9198009 - DNA, 22 bp, Homo sapiens
gggcagtgttgctctcaaagtc

SEQ ID NO: 9198010 - DNA, 19 bp, Homo sapiens
ggctggagaaaggaatcag

SEQ ID NO: 9198011 - DNA, 22 bp, Homo sapiens
ggctccagggagtggagagaag

SEQ ID NO: 9198012 - DNA, 22 bp, Homo sapiens
ggctccaggctcctatttcact

SEQ ID NO: 9198013 - DNA, 22 bp, Homo sapiens
ggctagcttagagtcatgctag

SEQ ID NO: 9198014 - DNA, 22 bp, Homo sapiens
ggaagccagaaagtgagaatat

SEQ ID NO: 9198015 - DNA, 22 bp, Homo sapiens
ggaagccaggccaatgagaaca

SEQ ID NO: 9198016 - DNA, 22 bp, Homo sapiens
ggaagccaggcccagagatgct

SEQ ID NO: 9198017 - DNA, 22 bp, Homo sapiens
ggaaggaagtaaatgatgctat

SEQ ID NO: 9198018 - DNA, 22 bp, Homo sapiens
ggaaggaagtaaatgatgctat

SEQ ID NO: 9198019 - DNA, 22 bp, Homo sapiens
ggaaggaagattctaactggag

SEQ ID NO: 9198020 - DNA, 22 bp, Homo sapiens
ggaaggaagaggaccgagctgg

SEQ ID NO: 9198021 - DNA, 22 bp, Homo sapiens
ggaaggaaagcagcttggccct

SEQ ID NO: 9198022 - DNA, 22 bp, Homo sapiens
ggaaggaaattggggcagttgt

SEQ ID NO: 9198023 - DNA, 22 bp, Homo sapiens
ggaaggaacaaaccctgtgtgg

SEQ ID NO: 9198024 - DNA, 18 bp, Homo sapiens
ggaaggaagaatgcattt

SEQ ID NO: 9198025 - DNA, 22 bp, Homo sapiens
ggaagctgttgtgagtgcagca

SEQ ID NO: 9198026 - DNA, 22 bp, Homo sapiens
gctgggagtcgcgtctgtggcc

SEQ ID NO: 9198027 - DNA, 22 bp, Homo sapiens
gctgaaggcccggaggacaggg

SEQ ID NO: 9198028 - DNA, 22 bp, Homo sapiens
gctgaagggagtgctgagtctg

SEQ ID NO: 9198029 - DNA, 22 bp, Homo sapiens
gctgaaggtgtgtggagagagg

SEQ ID NO: 9198030 - DNA, 21 bp, Homo sapiens
gctgaaggtgggttgtacagg

SEQ ID NO: 9198031 - DNA, 22 bp, Homo sapiens
gctgaaggtctctggagaggtc

SEQ ID NO: 9198032 - DNA, 22 bp, Homo sapiens
gcctcagggataggatgagcat

SEQ ID NO: 9198033 - DNA, 22 bp, Homo sapiens
gcctcaggcctatagctgctgt

SEQ ID NO: 9198034 - DNA, 22 bp, Homo sapiens
gccttctgtgctcctggccttt

SEQ ID NO: 9198035 - DNA, 22 bp, Homo sapiens
gccttctgcgctcgtgtctccg

SEQ ID NO: 9198036 - DNA, 22 bp, Homo sapiens
gccttctgattgctggactgac

SEQ ID NO: 9198037 - DNA, 22 bp, Homo sapiens
gccttctgatcgctggactgac

SEQ ID NO: 9198038 - DNA, 22 bp, Homo sapiens
gctcacagaacttctcttccca

SEQ ID NO: 9198039 - DNA, 22 bp, Homo sapiens
gctcacaggtctgtggctattg

SEQ ID NO: 9198040 - DNA, 22 bp, Homo sapiens
gctatcttcatggaaatacagg

SEQ ID NO: 9198041 - DNA, 22 bp, Homo sapiens
gcaggctgagttgggaaaccaa

SEQ ID NO: 9198042 - DNA, 22 bp, Homo sapiens
gcaggctgagtattaccctagt

SEQ ID NO: 9198043 - DNA, 22 bp, Homo sapiens
gcaggctgagagtccaagaagg

SEQ ID NO: 9198044 - DNA, 22 bp, Homo sapiens
gcaggctgaaactcggggtcta

SEQ ID NO: 9198045 - DNA, 22 bp, Homo sapiens
gcaggctgccaccttctgagtt

SEQ ID NO: 9198046 - DNA, 22 bp, Homo sapiens
gcaggctgatagaggattccat

SEQ ID NO: 9198047 - DNA, 22 bp, Homo sapiens
gcaggctgatgactggagttgg

SEQ ID NO: 9198048 - DNA, 22 bp, Homo sapiens
gcatttttgatcccactaggat

SEQ ID NO: 9198049 - DNA, 22 bp, Homo sapiens
gccagcccagctccaggggaaa

SEQ ID NO: 9198050 - DNA, 22 bp, Homo sapiens
gcatccttttttcctgccctgc

SEQ ID NO: 9198051 - DNA, 22 bp, Homo sapiens
gcatccttgggcccagctcctg

SEQ ID NO: 9198052 - DNA, 23 bp, Homo sapiens
gcatgaagtgctacgtctacagc

SEQ ID NO: 9198053 - DNA, 22 bp, Homo sapiens
tcagtttctttactcatagaat

SEQ ID NO: 9198054 - DNA, 22 bp, Homo sapiens
tcagtttcttctttagataaaa

SEQ ID NO: 9198055 - DNA, 22 bp, Homo sapiens
tcatccactggggatcccatgt

SEQ ID NO: 9198056 - DNA, 22 bp, Homo sapiens
tcatccaaggattttattgcat

SEQ ID NO: 9198057 - DNA, 22 bp, Homo sapiens
tcatccaaggattttattgcat

SEQ ID NO: 9198058 - DNA, 22 bp, Homo sapiens
tcatccaagggctctgaggcaa

SEQ ID NO: 9198059 - DNA, 22 bp, Homo sapiens
tcatccaaggagaccttgcaga

SEQ ID NO: 9198060 - DNA, 22 bp, Homo sapiens
tcatccagtaccatggaaggca

SEQ ID NO: 9198061 - DNA, 22 bp, Homo sapiens
tcataaagcatttcagcttttg

SEQ ID NO: 9198062 - DNA, 22 bp, Homo sapiens
tcataaagagtgctgttgtttt

SEQ ID NO: 9198063 - DNA, 22 bp, Homo sapiens
tcatctccctcctggatacctg

SEQ ID NO: 9198064 - DNA, 22 bp, Homo sapiens
tcatccctaaggacagctctgc

SEQ ID NO: 9198065 - DNA, 22 bp, Homo sapiens
tcagccagggggagagaatgga

SEQ ID NO: 9198066 - DNA, 22 bp, Homo sapiens
tcagcctccgaaagtgctggga

SEQ ID NO: 9198067 - DNA, 22 bp, Homo sapiens
tcagcctcctaatttcctgtga

SEQ ID NO: 9198068 - DNA, 22 bp, Homo sapiens
tcagcctctctgagtccagacc

SEQ ID NO: 9198069 - DNA, 22 bp, Homo sapiens
tcagcctcaggtgttcagattt

SEQ ID NO: 9198070 - DNA, 22 bp, Homo sapiens
tcagcctcattttctgctctgt

SEQ ID NO: 9198071 - DNA, 23 bp, Homo sapiens
tcagcctcttaggacttctcacc

SEQ ID NO: 9198072 - DNA, 22 bp, Homo sapiens
tcacagcaccaggatctctcca

SEQ ID NO: 9198073 - DNA, 22 bp, Homo sapiens
tcacagcaggcagatattgttg

SEQ ID NO: 9198074 - DNA, 22 bp, Homo sapiens
tcacagcattgagtgtactaga

SEQ ID NO: 9198075 - DNA, 22 bp, Homo sapiens
tcacagcatttttagaaagatt

SEQ ID NO: 9198076 - DNA, 19 bp, Homo sapiens
tcacagcatctgtctgaac

SEQ ID NO: 9198077 - DNA, 22 bp, Homo sapiens
tcacagcaaatgctgcttctca

SEQ ID NO: 9198078 - DNA, 22 bp, Homo sapiens
tcacagcaaaagtgtgcagagc

SEQ ID NO: 9198079 - DNA, 22 bp, Homo sapiens
tcacagcaaatgctgcttctca

SEQ ID NO: 9198080 - DNA, 22 bp, Homo sapiens
tcacagacatggtgaggtaaca

SEQ ID NO: 9198081 - DNA, 22 bp, Homo sapiens
tcacagacagaagggatgggat

SEQ ID NO: 9198082 - DNA, 22 bp, Homo sapiens
tcacagacacattaaacatgtg

SEQ ID NO: 9198083 - DNA, 20 bp, Homo sapiens
tcacacataagtgaacgcac

SEQ ID NO: 9198084 - DNA, 22 bp, Homo sapiens
tcacacatactcatgtgtgagt

SEQ ID NO: 9198085 - DNA, 23 bp, Homo sapiens
tcacacagctggtcaggtacaga

SEQ ID NO: 9198086 - DNA, 22 bp, Homo sapiens
tcaattaagaggctaagttact

SEQ ID NO: 9198087 - DNA, 20 bp, Homo sapiens
tcaaaataggtgtgggcgga

SEQ ID NO: 9198088 - DNA, 18 bp, Homo sapiens
tcaaaatatttctgtgga

SEQ ID NO: 9198089 - DNA, 21 bp, Homo sapiens
tcaatacaggtgcatgtgtct

SEQ ID NO: 9198090 - DNA, 22 bp, Homo sapiens
tcaatgatagtacaatcagcct

SEQ ID NO: 9198091 - DNA, 22 bp, Homo sapiens
tcacatgcagtcactgagcagg

SEQ ID NO: 9198092 - DNA, 22 bp, Homo sapiens
tcagaacttcagttttcttaat

SEQ ID NO: 9198093 - DNA, 21 bp, Homo sapiens
tcagaactggtgcagatgaat

SEQ ID NO: 9198094 - DNA, 22 bp, Homo sapiens
tcagaactggaagaggttctgc

SEQ ID NO: 9198095 - DNA, 22 bp, Homo sapiens
tcagaactgctgctcctgcaaa

SEQ ID NO: 9198096 - DNA, 19 bp, Homo sapiens
tcagaactcagaatgtgta

SEQ ID NO: 9198097 - DNA, 22 bp, Homo sapiens
tcagaactatagtagtttcatg

SEQ ID NO: 9198098 - DNA, 22 bp, Homo sapiens
tcagaactacatggacatgtta

SEQ ID NO: 9198099 - DNA, 22 bp, Homo sapiens
tcctcagtcagctccgttcttg

SEQ ID NO: 9198100 - DNA, 22 bp, Homo sapiens
tccctttcacttaactagccca

SEQ ID NO: 9198101 - DNA, 22 bp, Homo sapiens
tcctcatggtagaatccaaaga

SEQ ID NO: 9198102 - DNA, 22 bp, Homo sapiens
tcctccagctgtatcctgcctg

SEQ ID NO: 9198103 - DNA, 22 bp, Homo sapiens
tcctcccttgactcctgctttt

SEQ ID NO: 9198104 - DNA, 22 bp, Homo sapiens
tcctccctaaatcctagactgt

SEQ ID NO: 9198105 - DNA, 18 bp, Homo sapiens
tcccttctcccttgcctc

SEQ ID NO: 9198106 - DNA, 22 bp, Homo sapiens
tccagtcctatctgcccttgga

SEQ ID NO: 9198107 - DNA, 18 bp, Homo sapiens
tccagtcccagctctgcc

SEQ ID NO: 9198108 - DNA, 22 bp, Homo sapiens
tccagtcctgggagcctttctg

SEQ ID NO: 9198109 - DNA, 20 bp, Homo sapiens
tccagtccccacttgctcct

SEQ ID NO: 9198110 - DNA, 23 bp, Homo sapiens
tccagtcccctaaatctcactgt

SEQ ID NO: 9198111 - DNA, 22 bp, Homo sapiens
tccagtccactgccttgctctt

SEQ ID NO: 9198112 - DNA, 22 bp, Homo sapiens
tcccagattcctgctcttatat

SEQ ID NO: 9198113 - DNA, 22 bp, Homo sapiens
tccagccctgcttcctgcctca

SEQ ID NO: 9198114 - DNA, 20 bp, Homo sapiens
tccagccctgcttctctctt

SEQ ID NO: 9198115 - DNA, 17 bp, Homo sapiens
tccagccctgcccgacg

SEQ ID NO: 9198116 - DNA, 22 bp, Homo sapiens
tccagccctgcccattctctcg

SEQ ID NO: 9198117 - DNA, 22 bp, Homo sapiens
tccagccccttttactcattca

SEQ ID NO: 9198118 - DNA, 22 bp, Homo sapiens
tccagcccgagggcgctgatga

SEQ ID NO: 9198119 - DNA, 22 bp, Homo sapiens
tccagcccctcctgagccaagc

SEQ ID NO: 9198120 - DNA, 22 bp, Homo sapiens
tccagccccggcttccttacag

SEQ ID NO: 9198121 - DNA, 22 bp, Homo sapiens
tccagcccatccctagcctggg

SEQ ID NO: 9198122 - DNA, 20 bp, Homo sapiens
tccagcccaggtcctgcctg

SEQ ID NO: 9198123 - DNA, 21 bp, Homo sapiens
tccaccctctctgctcccagt

SEQ ID NO: 9198124 - DNA, 22 bp, Homo sapiens
tccacctggattttgtctacag

SEQ ID NO: 9198125 - DNA, 22 bp, Homo sapiens
tccacctgagtttcagttattt

SEQ ID NO: 9198126 - DNA, 22 bp, Homo sapiens
tccaccatgtaacaagctctgt

SEQ ID NO: 9198127 - DNA, 22 bp, Homo sapiens
tccaccagggtttcatctccct

SEQ ID NO: 9198128 - DNA, 22 bp, Homo sapiens
tcatgtttggagtttgctcact

SEQ ID NO: 9198129 - DNA, 22 bp, Homo sapiens
taccattttgaggatggagaga

SEQ ID NO: 9198130 - DNA, 22 bp, Homo sapiens
tacctgcacagccagccatgtg

SEQ ID NO: 9198131 - DNA, 22 bp, Homo sapiens
tactgctgaatggtgctgggca

SEQ ID NO: 9198132 - DNA, 22 bp, Homo sapiens
tactgaattgtaagatgatgcc

SEQ ID NO: 9198133 - DNA, 22 bp, Homo sapiens
tacttattgttgaactgaatca

SEQ ID NO: 9198134 - DNA, 22 bp, Homo sapiens
tacttgagaatagtgaataatg

SEQ ID NO: 9198135 - DNA, 22 bp, Homo sapiens
tacttcctgtttccatgtctgt

SEQ ID NO: 9198136 - DNA, 22 bp, Homo sapiens
tacttccagcagcctgcttgct

SEQ ID NO: 9198137 - DNA, 22 bp, Homo sapiens
tacattcagaagaatggacacg

SEQ ID NO: 9198138 - DNA, 22 bp, Homo sapiens
tacattcatggtgacttgtatg

SEQ ID NO: 9198139 - DNA, 22 bp, Homo sapiens
tacatacacaaatgctgaatgg

SEQ ID NO: 9198140 - DNA, 22 bp, Homo sapiens
tacatacagtggatgctttagg

SEQ ID NO: 9198141 - DNA, 22 bp, Homo sapiens
tacagcagagtgggatgcatct

SEQ ID NO: 9198142 - DNA, 22 bp, Homo sapiens
taatttcaccgttgctagaaat

SEQ ID NO: 9198143 - DNA, 22 bp, Homo sapiens
taatttcacagttcaacgcaca

SEQ ID NO: 9198144 - DNA, 22 bp, Homo sapiens
taatttcaatagcttgcataat

SEQ ID NO: 9198145 - DNA, 22 bp, Homo sapiens
taatttcactgatatgaagtca

SEQ ID NO: 9198146 - DNA, 22 bp, Homo sapiens
taatttcagtgggctctgggct

SEQ ID NO: 9198147 - DNA, 22 bp, Homo sapiens
taatttcagtgcaagctcacgg

SEQ ID NO: 9198148 - DNA, 22 bp, Homo sapiens
taagtttatagataaatgccta

SEQ ID NO: 9198149 - DNA, 22 bp, Homo sapiens
taatttcttcatctctgcagct

SEQ ID NO: 9198150 - DNA, 22 bp, Homo sapiens
tacaatgaccatattatgtaag

SEQ ID NO: 9198151 - DNA, 22 bp, Homo sapiens
taacaatgcaaaatgaatttag

SEQ ID NO: 9198152 - DNA, 22 bp, Homo sapiens
taacacagagttttaaatgtgg

SEQ ID NO: 9198153 - DNA, 22 bp, Homo sapiens
taacacagacagccactagtaa

SEQ ID NO: 9198154 - DNA, 21 bp, Homo sapiens
taacacattttggtactttgg

SEQ ID NO: 9198155 - DNA, 22 bp, Homo sapiens
taacacatagatattttaactt

SEQ ID NO: 9198156 - DNA, 22 bp, Homo sapiens
gttttataattgcttcataaga

SEQ ID NO: 9198157 - DNA, 22 bp, Homo sapiens
gttttataggctgttgctatat

SEQ ID NO: 9198158 - DNA, 22 bp, Homo sapiens
taaacatgttgacatcttacct

SEQ ID NO: 9198159 - DNA, 22 bp, Homo sapiens
taaagaacacagggaatagcac

SEQ ID NO: 9198160 - DNA, 22 bp, Homo sapiens
taaagacactggttttaatcat

SEQ ID NO: 9198161 - DNA, 22 bp, Homo sapiens
taaataagttcttcattgtttg

SEQ ID NO: 9198162 - DNA, 22 bp, Homo sapiens
gtttatatgaacttcataccca

SEQ ID NO: 9198163 - DNA, 22 bp, Homo sapiens
gtttcttagacagacattatct

SEQ ID NO: 9198164 - DNA, 23 bp, Homo sapiens
gttttacaggtgagaaaatggag

SEQ ID NO: 9198165 - DNA, 22 bp, Homo sapiens
gttccacaaagattgtctctct

SEQ ID NO: 9198166 - DNA, 22 bp, Homo sapiens
gttccacatcacactacttgat

SEQ ID NO: 9198167 - DNA, 22 bp, Homo sapiens
gttccttcctatcccgagagcc

SEQ ID NO: 9198168 - DNA, 16 bp, Homo sapiens
gttccttcccacacct

SEQ ID NO: 9198169 - DNA, 23 bp, Homo sapiens
gttccttcatgtggtcattggtt

SEQ ID NO: 9198170 - DNA, 22 bp, Homo sapiens
gttactcttgagaggctgaggt

SEQ ID NO: 9198171 - DNA, 22 bp, Homo sapiens
gttataaaggtgataatggtca

SEQ ID NO: 9198172 - DNA, 22 bp, Homo sapiens
gttataaatacctaataggatt

SEQ ID NO: 9198173 - DNA, 22 bp, Homo sapiens
gtgtgtgtgcatataacatata

SEQ ID NO: 9198174 - DNA, 22 bp, Homo sapiens
tagcacagttcactatgataca

SEQ ID NO: 9198175 - DNA, 22 bp, Homo sapiens
tagattttacttctgtcattac

SEQ ID NO: 9198176 - DNA, 22 bp, Homo sapiens
tagattttttggagactctctg

SEQ ID NO: 9198177 - DNA, 22 bp, Homo sapiens
tagcactatctattgcatgcaa

SEQ ID NO: 9198178 - DNA, 22 bp, Homo sapiens
taggaaataaatacttatggtt

SEQ ID NO: 9198179 - DNA, 22 bp, Homo sapiens
taggaaataattcactctggct

SEQ ID NO: 9198180 - DNA, 22 bp, Homo sapiens
taggaaggaggccatcttggcg

SEQ ID NO: 9198181 - DNA, 22 bp, Homo sapiens
taggaaggaagagcctcagatt

SEQ ID NO: 9198182 - DNA, 22 bp, Homo sapiens
taggctctccaagcccaggacc

SEQ ID NO: 9198183 - DNA, 22 bp, Homo sapiens
taggaagggctcagggctcggt

SEQ ID NO: 9198184 - DNA, 22 bp, Homo sapiens
taggaagggaaaggcttcaact

SEQ ID NO: 9198185 - DNA, 22 bp, Homo sapiens
taggaaggcctgtcactacttg

SEQ ID NO: 9198186 - DNA, 22 bp, Homo sapiens
taggaaggtccatgtcttatct

SEQ ID NO: 9198187 - DNA, 22 bp, Homo sapiens
tagtcctttccggctgctataa

SEQ ID NO: 9198188 - DNA, 22 bp, Homo sapiens
tagtattttagaaaaccatgaa

SEQ ID NO: 9198189 - DNA, 22 bp, Homo sapiens
tagtatttcctgtaagctatag

SEQ ID NO: 9198190 - DNA, 22 bp, Homo sapiens
tagtatatctttagtacatagt

SEQ ID NO: 9198191 - DNA, 22 bp, Homo sapiens
tatattacctgcctgatctata

SEQ ID NO: 9198192 - DNA, 22 bp, Homo sapiens
tatattataagccctttcagaa

SEQ ID NO: 9198193 - DNA, 19 bp, Homo sapiens
tatatttgagtgtgcatgc

SEQ ID NO: 9198194 - DNA, 22 bp, Homo sapiens
tatatttgtgtgtgatttatga

SEQ ID NO: 9198195 - DNA, 22 bp, Homo sapiens
tattcagaaaataaattggatt

SEQ ID NO: 9198196 - DNA, 22 bp, Homo sapiens
tattcacagttgatttacagtt

SEQ ID NO: 9198197 - DNA, 22 bp, Homo sapiens
tatgtttatactttgatgtact

SEQ ID NO: 9198198 - DNA, 22 bp, Homo sapiens
tattcacaaaatgaggtcctca

SEQ ID NO: 9198199 - DNA, 22 bp, Homo sapiens
tattcacaggcacgaaatattg

SEQ ID NO: 9198200 - DNA, 22 bp, Homo sapiens
tattcacaggcacgaaatattg

SEQ ID NO: 9198201 - DNA, 22 bp, Homo sapiens
tatgtttaaatgtatgtgtatg

SEQ ID NO: 9198202 - DNA, 22 bp, Homo sapiens
tatgttaaatgtttgatgttta

SEQ ID NO: 9198203 - DNA, 22 bp, Homo sapiens
tatgctactagaaataaaatgg

SEQ ID NO: 9198204 - DNA, 22 bp, Homo sapiens
tatgctagatggaaaaatattg

SEQ ID NO: 9198205 - DNA, 22 bp, Homo sapiens
tatgcctacctccaaaatatat

SEQ ID NO: 9198206 - DNA, 22 bp, Homo sapiens
tatgccactgctctccatccta

SEQ ID NO: 9198207 - DNA, 22 bp, Homo sapiens
tattttcattctgtgtgactgt

SEQ ID NO: 9198208 - DNA, 22 bp, Homo sapiens
tattttcaccttctctggatat

SEQ ID NO: 9198209 - DNA, 22 bp, Homo sapiens
tatttctaagagatatctgtac

SEQ ID NO: 9198210 - DNA, 22 bp, Homo sapiens
tatttcaagaacttctatccat

SEQ ID NO: 9198211 - DNA, 22 bp, Homo sapiens
tatttcagcaagaagaatgtgg

SEQ ID NO: 9198212 - DNA, 22 bp, Homo sapiens
ttcctctcaacatgcctgccgg

SEQ ID NO: 9198213 - DNA, 17 bp, Homo sapiens
ttcctctcacatttttt

SEQ ID NO: 9198214 - DNA, 22 bp, Homo sapiens
ttcagtttgctacaagcaacat

SEQ ID NO: 9198215 - DNA, 22 bp, Homo sapiens
ttccttttgcaaggtcctctag

SEQ ID NO: 9198216 - DNA, 22 bp, Homo sapiens
ctacattaaattggcttactta

SEQ ID NO: 9198217 - DNA, 22 bp, Homo sapiens
ctagtgtttattaacataattc

SEQ ID NO: 9198218 - DNA, 22 bp, Homo sapiens
ttcttcagtttggtaaatgtaa

SEQ ID NO: 9198219 - DNA, 21 bp, Homo sapiens
ttcttcagtttaatataaaat

SEQ ID NO: 9198220 - DNA, 22 bp, Homo sapiens
ttcttcagtgcccctctagtag

SEQ ID NO: 9198221 - DNA, 22 bp, Homo sapiens
ttcttcagtgtagcaactgtat

SEQ ID NO: 9198222 - DNA, 22 bp, Homo sapiens
ttctgaaaggcatgtcaggtag

SEQ ID NO: 9198223 - DNA, 21 bp, Homo sapiens
ttcttcaggccaatgctcatt

SEQ ID NO: 9198224 - DNA, 22 bp, Homo sapiens
ttcttcaggatacgtcatccag

SEQ ID NO: 9198225 - DNA, 22 bp, Homo sapiens
ttcttcaggaagagcctggact

SEQ ID NO: 9198226 - DNA, 22 bp, Homo sapiens
ttcttcagcttctacctgcgtc

SEQ ID NO: 9198227 - DNA, 22 bp, Homo sapiens
ttcttcagggaagcttgttaat

SEQ ID NO: 9198228 - DNA, 22 bp, Homo sapiens
ttcttcaggtggttttggtaac

SEQ ID NO: 9198229 - DNA, 22 bp, Homo sapiens
ttcttcagtctaggcctttctt

SEQ ID NO: 9198230 - DNA, 22 bp, Homo sapiens
ttcttcagtgacaaaggcaaaa

SEQ ID NO: 9198231 - DNA, 22 bp, Homo sapiens
ttcttcagtcccactagccaca

SEQ ID NO: 9198232 - DNA, 22 bp, Homo sapiens
ttgatttttccagcttctagag

SEQ ID NO: 9198233 - DNA, 23 bp, Homo sapiens
ccttgtctggctggctggacttt

SEQ ID NO: 9198234 - DNA, 22 bp, Homo sapiens
ccttctgggccaacttccagga

SEQ ID NO: 9198235 - DNA, 18 bp, Homo sapiens
ccttctgacgcttgagaa

SEQ ID NO: 9198236 - DNA, 22 bp, Homo sapiens
ttacagaactgccctagttggc

SEQ ID NO: 9198237 - DNA, 20 bp, Homo sapiens
ttacagaaatgatgttattt

SEQ ID NO: 9198238 - DNA, 22 bp, Homo sapiens
ttatttcattgatttctaagac

SEQ ID NO: 9198239 - DNA, 22 bp, Homo sapiens
ttatttcatgtaaaatttatgt

SEQ ID NO: 9198240 - DNA, 22 bp, Homo sapiens
ttatttttaaaagttcacacag

SEQ ID NO: 9198241 - DNA, 17 bp, Homo sapiens
ttattttttgggctgag

SEQ ID NO: 9198242 - DNA, 20 bp, Homo sapiens
cctttctggagtgctgttca

SEQ ID NO: 9198243 - DNA, 22 bp, Homo sapiens
tggttccactaacctgagagcc

SEQ ID NO: 9198244 - DNA, 22 bp, Homo sapiens
tggttccaatcgcactggctca

SEQ ID NO: 9198245 - DNA, 22 bp, Homo sapiens
tggttccaagatggctgccaca

SEQ ID NO: 9198246 - DNA, 22 bp, Homo sapiens
tgttgcccaggttctctcctgc

SEQ ID NO: 9198247 - DNA, 22 bp, Homo sapiens
tgttggaaaggccaggctgtgg

SEQ ID NO: 9198248 - DNA, 17 bp, Homo sapiens
tgttttcattcattgct

SEQ ID NO: 9198249 - DNA, 22 bp, Homo sapiens
tgttttcatttgatgtaacaaa

SEQ ID NO: 9198250 - DNA, 21 bp, Homo sapiens
tgttttccaccttgaggcaag

SEQ ID NO: 9198251 - DNA, 22 bp, Homo sapiens
tgttttcctcctggtttctgcc

SEQ ID NO: 9198252 - DNA, 22 bp, Homo sapiens
ttaaaatctaaagcagttgtct

SEQ ID NO: 9198253 - DNA, 18 bp, Homo sapiens
ctgaaggcaccagggcag

SEQ ID NO: 9198254 - DNA, 22 bp, Homo sapiens
ctctggagtcaggcagccctgg

SEQ ID NO: 9198255 - DNA, 22 bp, Homo sapiens
ttttcctgcctgtctctagagg

SEQ ID NO: 9198256 - DNA, 22 bp, Homo sapiens
tttttctgagaatatgagagga

SEQ ID NO: 9198257 - DNA, 22 bp, Homo sapiens
ctgaagttctacaagcctcagg

SEQ ID NO: 9198258 - DNA, 22 bp, Homo sapiens
ctgagaggggaccagggtgttt

SEQ ID NO: 9198259 - DNA, 22 bp, Homo sapiens
ctcctgtcccggggaccgccga

SEQ ID NO: 9198260 - DNA, 22 bp, Homo sapiens
tttcaaagtaaggattttcatc

SEQ ID NO: 9198261 - DNA, 22 bp, Homo sapiens
tttcaaagtcaatatcattacc

SEQ ID NO: 9198262 - DNA, 22 bp, Homo sapiens
tttcaaagttgggaattgtaat

SEQ ID NO: 9198263 - DNA, 22 bp, Homo sapiens
ctccctcacacccttgcccaga

SEQ ID NO: 9198264 - DNA, 22 bp, Homo sapiens
ctcccagtgttgttttctgatg

SEQ ID NO: 9198265 - DNA, 21 bp, Homo sapiens
ctcaggctggcagcaggctag

SEQ ID NO: 9198266 - DNA, 22 bp, Homo sapiens
ttgtttcaaatatttcagaata

SEQ ID NO: 9198267 - DNA, 22 bp, Homo sapiens
ttgtttcagctgtatgctatgt

SEQ ID NO: 9198268 - DNA, 22 bp, Homo sapiens
ctctgctgttcttatgtgtcct

SEQ ID NO: 9198269 - DNA, 22 bp, Homo sapiens
ctctgctgcttgccagtcattg

SEQ ID NO: 9198270 - DNA, 22 bp, Homo sapiens
ctctgacagccttcattatgca

SEQ ID NO: 9198271 - DNA, 22 bp, Homo sapiens
tttctgatatactgtagaatcc

SEQ ID NO: 9198272 - DNA, 22 bp, Homo sapiens
tttctgcatatgtatgtatgga

SEQ ID NO: 9198273 - DNA, 22 bp, Homo sapiens
tttctgcagcagactcagtgtg

SEQ ID NO: 9198274 - DNA, 22 bp, Homo sapiens
ctctcaaatgtcattcctctat

SEQ ID NO: 9198275 - DNA, 22 bp, Homo sapiens
ctctatgttatgcagaattaag

SEQ ID NO: 9198276 - DNA, 19 bp, Homo sapiens
tttctctccctcatcccga

SEQ ID NO: 9198277 - DNA, 22 bp, Homo sapiens
tttctctctacagtactttcat

SEQ ID NO: 9198278 - DNA, 22 bp, Homo sapiens
cttctgctggcatactgcccca

SEQ ID NO: 9198279 - DNA, 22 bp, Homo sapiens
cttctggatttattcattcctt

SEQ ID NO: 9198280 - DNA, 22 bp, Homo sapiens
cttctcttggtagttcttgttg

SEQ ID NO: 9198281 - DNA, 22 bp, Homo sapiens
cttgtggagatatccatgtctg

SEQ ID NO: 9198282 - DNA, 23 bp, Homo sapiens
cttgtggacagtagcttcagcct

SEQ ID NO: 9198283 - DNA, 22 bp, Homo sapiens
ctttctttgcagtgagccagag

SEQ ID NO: 9198284 - DNA, 22 bp, Homo sapiens
ctttaacagttccattcaattt

SEQ ID NO: 9198285 - DNA, 22 bp, Homo sapiens
ctttctcttcagcacccagccc

SEQ ID NO: 9198286 - DNA, 22 bp, Homo sapiens
gaaaatttctgccacatgtgtg

SEQ ID NO: 9198287 - DNA, 22 bp, Homo sapiens
gaaacactggtaaagactgccg

SEQ ID NO: 9198288 - DNA, 22 bp, Homo sapiens
gaaacactatgccaagacaggg

SEQ ID NO: 9198289 - DNA, 22 bp, Homo sapiens
gaaacactcaatttagtaattc

SEQ ID NO: 9198290 - DNA, 22 bp, Homo sapiens
cttttcattgtttgtacatgca

SEQ ID NO: 9198291 - DNA, 22 bp, Homo sapiens
cttccttcaatataatttttac

SEQ ID NO: 9198292 - DNA, 22 bp, Homo sapiens
cttcctgttgtcacagtctgcg

SEQ ID NO: 9198293 - DNA, 20 bp, Homo sapiens
cttccttttccttcgtcaaa

SEQ ID NO: 9198294 - DNA, 22 bp, Homo sapiens
cttccttccacaccttcagaat

SEQ ID NO: 9198295 - DNA, 22 bp, Homo sapiens
cttccagagatccatgaatacc

SEQ ID NO: 9198296 - DNA, 22 bp, Homo sapiens
cttccagaggaactctgcagtg

SEQ ID NO: 9198297 - DNA, 22 bp, Homo sapiens
cttaggaaagttggctgatttc

SEQ ID NO: 9198298 - DNA, 22 bp, Homo sapiens
cttaaagagtatttaatataat

SEQ ID NO: 9198299 - DNA, 22 bp, Homo sapiens
ctgtatttgtcctctatttatt

SEQ ID NO: 9198300 - DNA, 22 bp, Homo sapiens
ctgtccttactgcttctggctt

SEQ ID NO: 9198301 - DNA, 22 bp, Homo sapiens
ctgggctttgaagccaggctgc

SEQ ID NO: 9198302 - DNA, 20 bp, Homo sapiens
ctgtagagcacaagtggagg

SEQ ID NO: 9198303 - DNA, 22 bp, Homo sapiens
ctgggagattgctagagatgca

SEQ ID NO: 9198304 - DNA, 22 bp, Homo sapiens
ctgggagatctgttgggactgg

SEQ ID NO: 9198305 - DNA, 22 bp, Homo sapiens
ctgggagatctcctgagggcag

SEQ ID NO: 9198306 - DNA, 22 bp, Homo sapiens
ctgggagatgactcagagcagg

SEQ ID NO: 9198307 - DNA, 22 bp, Homo sapiens
ctgggagattgaggccatggtg

SEQ ID NO: 9198308 - DNA, 22 bp, Homo sapiens
ctgggagattcaggtgaagttt

SEQ ID NO: 9198309 - DNA, 22 bp, Homo sapiens
ctgggagaggtggtgggaagta

SEQ ID NO: 9198310 - DNA, 22 bp, Homo sapiens
ctgggagatatgaggatctgga

SEQ ID NO: 9198311 - DNA, 20 bp, Homo sapiens
ctgctgtgttattgtagaac

SEQ ID NO: 9198312 - DNA, 22 bp, Homo sapiens
ctgctgtgattgggagaaaccg

SEQ ID NO: 9198313 - DNA, 22 bp, Homo sapiens
ctgctgtgcagacagactctct

SEQ ID NO: 9198314 - DNA, 22 bp, Homo sapiens
ctgctgtgtggtgaaactcagt

SEQ ID NO: 9198315 - DNA, 22 bp, Homo sapiens
gagagggctgcctggtgtgagg

SEQ ID NO: 9198316 - DNA, 22 bp, Homo sapiens
gagcatgcccctcacaggaaca

SEQ ID NO: 9198317 - DNA, 21 bp, Homo sapiens
gagcatctccttcctcctgct

SEQ ID NO: 9198318 - DNA, 22 bp, Homo sapiens
gaggctgaagtgtacatgggtg

SEQ ID NO: 9198319 - DNA, 22 bp, Homo sapiens
gaggcaggcactgttatcagca

SEQ ID NO: 9198320 - DNA, 22 bp, Homo sapiens
gagaaagaaagggaagtttgtt

SEQ ID NO: 9198321 - DNA, 22 bp, Homo sapiens
gagaaaggcattcctatgcaaa

SEQ ID NO: 9198322 - DNA, 22 bp, Homo sapiens
gacattctgtgactctgaacag

SEQ ID NO: 9198323 - DNA, 22 bp, Homo sapiens
gacattctgtcaatgttgactc

SEQ ID NO: 9198324 - DNA, 22 bp, Homo sapiens
gactcgctcccttttgtcttat

SEQ ID NO: 9198325 - DNA, 22 bp, Homo sapiens
gactccagggattggaagatgt

SEQ ID NO: 9198326 - DNA, 22 bp, Homo sapiens
gaaggggactggcagctgcaga

SEQ ID NO: 9198327 - DNA, 19 bp, Homo sapiens
gaaggggaaggtgggtacc

SEQ ID NO: 9198328 - DNA, 22 bp, Homo sapiens
gaatatttgtaattactgttga

SEQ ID NO: 9198329 - DNA, 22 bp, Homo sapiens
gaatgaattttggatggtgaag

SEQ ID NO: 9198330 - DNA, 22 bp, Homo sapiens
gaatgaatctgtaagtgacaag

SEQ ID NO: 9198331 - DNA, 22 bp, Homo sapiens
gaatgaagcaggtcacacagtt

SEQ ID NO: 9198332 - DNA, 22 bp, Homo sapiens
gaatgaaagatttgcattctat

SEQ ID NO: 9198333 - DNA, 22 bp, Homo sapiens
gaatgaaaaccttggctcaaat

SEQ ID NO: 9198334 - DNA, 22 bp, Homo sapiens
gacactttaggatttaaaagtc

SEQ ID NO: 9198335 - DNA, 22 bp, Homo sapiens
gaagggaaggaaagaaccagca

SEQ ID NO: 9198336 - DNA, 22 bp, Homo sapiens
gaagggagaaggttgggtgacg

SEQ ID NO: 9198337 - DNA, 20 bp, Homo sapiens
tcttacaatcgttacatcca

SEQ ID NO: 9198338 - DNA, 22 bp, Homo sapiens
tgaaatgagatagataatcagg

SEQ ID NO: 9198339 - DNA, 22 bp, Homo sapiens
tcttgatttactctaatagctt

SEQ ID NO: 9198340 - DNA, 22 bp, Homo sapiens
tgaaacacaagcctggttagtg

SEQ ID NO: 9198341 - DNA, 22 bp, Homo sapiens
tgaaacactttcaattacatat

SEQ ID NO: 9198342 - DNA, 21 bp, Homo sapiens
tgaaacactctttccatgaga

SEQ ID NO: 9198343 - DNA, 20 bp, Homo sapiens
ccagtccaaattccttatga

SEQ ID NO: 9198344 - DNA, 22 bp, Homo sapiens
ccagtcccagctctgccatgct

SEQ ID NO: 9198345 - DNA, 22 bp, Homo sapiens
ccagtgcctatccttctcctgt

SEQ ID NO: 9198346 - DNA, 22 bp, Homo sapiens
ccatccctcctccaccagctag

SEQ ID NO: 9198347 - DNA, 18 bp, Homo sapiens
ccatcaccctaactagtg

SEQ ID NO: 9198348 - DNA, 22 bp, Homo sapiens
cccaaggcctctccttggcttg

SEQ ID NO: 9198349 - DNA, 22 bp, Homo sapiens
cccaaggcagggattttctgct

SEQ ID NO: 9198350 - DNA, 22 bp, Homo sapiens
cctccatctccagcttctgcct

SEQ ID NO: 9198351 - DNA, 22 bp, Homo sapiens
cctccatcaccatctgccctca

SEQ ID NO: 9198352 - DNA, 22 bp, Homo sapiens
cctgcctcaggactctgcatat

SEQ ID NO: 9198353 - DNA, 22 bp, Homo sapiens
cctgcctcccagaggtcctcta

SEQ ID NO: 9198354 - DNA, 22 bp, Homo sapiens
cctgcctcatcaacttgtcgtg

SEQ ID NO: 9198355 - DNA, 22 bp, Homo sapiens
cctgcaggtaaggctaactgcc

SEQ ID NO: 9198356 - DNA, 22 bp, Homo sapiens
tgctgggcaccagtgcctgcag

SEQ ID NO: 9198357 - DNA, 22 bp, Homo sapiens
cccagtgttccttgaggggctg

SEQ ID NO: 9198358 - DNA, 22 bp, Homo sapiens
cccagtgtgcccctcctgcagc

SEQ ID NO: 9198359 - DNA, 22 bp, Homo sapiens
cccagtgtggttctttggagaa

SEQ ID NO: 9198360 - DNA, 22 bp, Homo sapiens
cccagtgtggttgtgaattctg

SEQ ID NO: 9198361 - DNA, 22 bp, Homo sapiens
cccagtgtgatgaggttgctaa

SEQ ID NO: 9198362 - DNA, 22 bp, Homo sapiens
cccagtgtctgggcctgcaggg

SEQ ID NO: 9198363 - DNA, 22 bp, Homo sapiens
cccagtgtcaccaacaggacac

SEQ ID NO: 9198364 - DNA, 20 bp, Homo sapiens
cccagtgtccagccttgcca

SEQ ID NO: 9198365 - DNA, 22 bp, Homo sapiens
cccagtgtcattctaagggagg

SEQ ID NO: 9198366 - DNA, 22 bp, Homo sapiens
cccagtgtctccaacatcagat

SEQ ID NO: 9198367 - DNA, 22 bp, Homo sapiens
cccagtgtctcttgtgcctttc

SEQ ID NO: 9198368 - DNA, 22 bp, Homo sapiens
tgcttccttcccgttcttctcc

SEQ ID NO: 9198369 - DNA, 22 bp, Homo sapiens
tgcttcctgaggccgtcttctc

SEQ ID NO: 9198370 - DNA, 22 bp, Homo sapiens
tgcttcctgctaaggctgcctg

SEQ ID NO: 9198371 - DNA, 22 bp, Homo sapiens
tgcttcctatccacacaatgcc

SEQ ID NO: 9198372 - DNA, 22 bp, Homo sapiens
tgcttgtcaccctgcctgagtg

SEQ ID NO: 9198373 - DNA, 22 bp, Homo sapiens
tgcttgtcacatacaggagcat

SEQ ID NO: 9198374 - DNA, 22 bp, Homo sapiens
tgcttccttgagctctccaatc

SEQ ID NO: 9198375 - DNA, 22 bp, Homo sapiens
tgcttgtccctctttatgatgg

SEQ ID NO: 9198376 - DNA, 22 bp, Homo sapiens
tgcttgtcaggataagctctgg

SEQ ID NO: 9198377 - DNA, 22 bp, Homo sapiens
tgccttctcccttggaccctga

SEQ ID NO: 9198378 - DNA, 22 bp, Homo sapiens
tgctagattttagtttggaatg

SEQ ID NO: 9198379 - DNA, 22 bp, Homo sapiens
cccagtgctatgcctattacat

SEQ ID NO: 9198380 - DNA, 22 bp, Homo sapiens
ccctggagtcctggcagttgat

SEQ ID NO: 9198381 - DNA, 19 bp, Homo sapiens
tggaaactcctgatattag

SEQ ID NO: 9198382 - DNA, 22 bp, Homo sapiens
tggaaactgggagttaaatgta

SEQ ID NO: 9198383 - DNA, 22 bp, Homo sapiens
tggagaattctatgttgagggg

SEQ ID NO: 9198384 - DNA, 22 bp, Homo sapiens
catcaaaattagacattgttga

SEQ ID NO: 9198385 - DNA, 22 bp, Homo sapiens
tcatcaaagtcaaagaatgact

SEQ ID NO: 9198386 - DNA, 22 bp, Homo sapiens
tcatacaactaagagtttcaga

SEQ ID NO: 9198387 - DNA, 22 bp, Homo sapiens
tcagtttcctggttttaatatt

SEQ ID NO: 9198388 - DNA, 22 bp, Homo sapiens
catcgtgtctaggtgtgcagca

SEQ ID NO: 9198389 - DNA, 22 bp, Homo sapiens
catccttcatacgactgaccct

SEQ ID NO: 9198390 - DNA, 22 bp, Homo sapiens
catcagctgagggtgagcagaa

SEQ ID NO: 9198391 - DNA, 22 bp, Homo sapiens
catgtgctgtagcagagaggaa

SEQ ID NO: 9198392 - DNA, 22 bp, Homo sapiens
catgtgtaggtataacttgtga

SEQ ID NO: 9198393 - DNA, 22 bp, Homo sapiens
catgtgtagaccgtgacctcat

SEQ ID NO: 9198394 - DNA, 19 bp, Homo sapiens
catgctgacctgctgtggt

SEQ ID NO: 9198395 - DNA, 22 bp, Homo sapiens
catgctgtgtggttagaactgt

SEQ ID NO: 9198396 - DNA, 22 bp, Homo sapiens
catgctgtactctgtgtcagaa

SEQ ID NO: 9198397 - DNA, 22 bp, Homo sapiens
catgccaacaacaagcaatgag

SEQ ID NO: 9198398 - DNA, 22 bp, Homo sapiens
tccaagatctacagcagtttag

SEQ ID NO: 9198399 - DNA, 22 bp, Homo sapiens
tccagatggatttaagacctaa

SEQ ID NO: 9198400 - DNA, 19 bp, Homo sapiens
tccagatgatatggattac

SEQ ID NO: 9198401 - DNA, 19 bp, Homo sapiens
catggtgaaaccccgtctc

SEQ ID NO: 9198402 - DNA, 22 bp, Homo sapiens
catggttttgagcctattatgc

SEQ ID NO: 9198403 - DNA, 22 bp, Homo sapiens
catttccactctgggagtcaga

SEQ ID NO: 9198404 - DNA, 22 bp, Homo sapiens
catttcaccttagagaattatt

SEQ ID NO: 9198405 - DNA, 23 bp, Homo sapiens
tccataatcccagaaagctcaga

SEQ ID NO: 9198406 - DNA, 22 bp, Homo sapiens
cattttcatgagtttctgttca

SEQ ID NO: 9198407 - DNA, 22 bp, Homo sapiens
cattttgtgctagacactatgg

SEQ ID NO: 9198408 - DNA, 19 bp, Homo sapiens
cattttaagcatccccagt

SEQ ID NO: 9198409 - DNA, 22 bp, Homo sapiens
cattttaagatgacctggtttc

SEQ ID NO: 9198410 - DNA, 22 bp, Homo sapiens
tcctggctaatgctgctgatgg

SEQ ID NO: 9198411 - DNA, 23 bp, Homo sapiens
ccaagactgttaggagtggggag

SEQ ID NO: 9198412 - DNA, 22 bp, Homo sapiens
ccaccccaaatgaagacctctc

SEQ ID NO: 9198413 - DNA, 22 bp, Homo sapiens
tacaatagggcttttgtttatg

SEQ ID NO: 9198414 - DNA, 22 bp, Homo sapiens
tacagcctcgaactcctgcatt

SEQ ID NO: 9198415 - DNA, 22 bp, Homo sapiens
tacagcagggcgctgtgatgaa

SEQ ID NO: 9198416 - DNA, 22 bp, Homo sapiens
tagcagcacctacacgtcagag

SEQ ID NO: 9198417 - DNA, 22 bp, Homo sapiens
tagcagcaggggaaacagctgt

SEQ ID NO: 9198418 - DNA, 22 bp, Homo sapiens
taccccaagagtgtctgccatg

SEQ ID NO: 9198419 - DNA, 22 bp, Homo sapiens
tacctcagattgctgccttggg

SEQ ID NO: 9198420 - DNA, 22 bp, Homo sapiens
tcacatggcgagctttaaaata

SEQ ID NO: 9198421 - DNA, 19 bp, Homo sapiens
cagtggagattggaggagg

SEQ ID NO: 9198422 - DNA, 22 bp, Homo sapiens
tcacacatgtaagggctttgga

SEQ ID NO: 9198423 - DNA, 22 bp, Homo sapiens
tcacacatttctcaagtgtagg

SEQ ID NO: 9198424 - DNA, 16 bp, Homo sapiens
tcacacatttgttggt

SEQ ID NO: 9198425 - DNA, 22 bp, Homo sapiens
cagtccctagtggagctcacag

SEQ ID NO: 9198426 - DNA, 22 bp, Homo sapiens
tcaaattttaacatgcattaga

SEQ ID NO: 9198427 - DNA, 22 bp, Homo sapiens
tcaaaggcattgccaataagta

SEQ ID NO: 9198428 - DNA, 22 bp, Homo sapiens
tatattcatattgttgtctctc

SEQ ID NO: 9198429 - DNA, 22 bp, Homo sapiens
tatattcaatgattagtatcag

SEQ ID NO: 9198430 - DNA, 22 bp, Homo sapiens
tatatatatgcacacacaccta

SEQ ID NO: 9198431 - DNA, 22 bp, Homo sapiens
tagtttcttcacctgtaaaatg

SEQ ID NO: 9198432 - DNA, 22 bp, Homo sapiens
tagtgtctcggggcccaggatt

SEQ ID NO: 9198433 - DNA, 22 bp, Homo sapiens
tatgatttgtagacatttgatt

SEQ ID NO: 9198434 - DNA, 22 bp, Homo sapiens
ttctgattcatgatccagttct

SEQ ID NO: 9198435 - DNA, 22 bp, Homo sapiens
ttctgcacccatagctgatgat

SEQ ID NO: 9198436 - DNA, 18 bp, Homo sapiens
ttctcagactttggaagt

SEQ ID NO: 9198437 - DNA, 22 bp, Homo sapiens
ttctccagcacattttctttga

SEQ ID NO: 9198438 - DNA, 22 bp, Homo sapiens
ttctcagaaaatgtagagaaaa

SEQ ID NO: 9198439 - DNA, 22 bp, Homo sapiens
ttgaaaaccgtgggaggctgaa

SEQ ID NO: 9198440 - DNA, 22 bp, Homo sapiens
ttgaaaacatttatattagaat

SEQ ID NO: 9198441 - DNA, 22 bp, Homo sapiens
ttgaaacagtagctcatagacc

SEQ ID NO: 9198442 - DNA, 22 bp, Homo sapiens
ttgaaaatggtaagcatgatat

SEQ ID NO: 9198443 - DNA, 22 bp, Homo sapiens
ttgaaagacattatttatatat

SEQ ID NO: 9198444 - DNA, 22 bp, Homo sapiens
ttgaaacattacctgtatttcc

SEQ ID NO: 9198445 - DNA, 22 bp, Homo sapiens
ttgaaagatatgttaatctttc

SEQ ID NO: 9198446 - DNA, 22 bp, Homo sapiens
ttgagggtctggatctgctgct

SEQ ID NO: 9198447 - DNA, 19 bp, Homo sapiens
ttgagaaagttgatttggg

SEQ ID NO: 9198448 - DNA, 22 bp, Homo sapiens
ttcttcagagagtagaagcaag

SEQ ID NO: 9198449 - DNA, 22 bp, Homo sapiens
ttcttcagatggtgagacctcc

SEQ ID NO: 9198450 - DNA, 22 bp, Homo sapiens
ttcttcagatcctacaagtctg

SEQ ID NO: 9198451 - DNA, 22 bp, Homo sapiens
ttcttcagcccatatcttccag

SEQ ID NO: 9198452 - DNA, 23 bp, Homo sapiens
ttcttcagccttatagccctggg

SEQ ID NO: 9198453 - DNA, 22 bp, Homo sapiens
ttcttcagcctaccttgacctc

SEQ ID NO: 9198454 - DNA, 22 bp, Homo sapiens
ttcttcagactccctctttaag

SEQ ID NO: 9198455 - DNA, 22 bp, Homo sapiens
ttcttctagagttcagaagcca

SEQ ID NO: 9198456 - DNA, 22 bp, Homo sapiens
ttcttccttggtttcctggata

SEQ ID NO: 9198457 - DNA, 22 bp, Homo sapiens
ttcttcctctgtaaaaggtgac

SEQ ID NO: 9198458 - DNA, 22 bp, Homo sapiens
ttcatcaggcatcatgctcaag

SEQ ID NO: 9198459 - DNA, 22 bp, Homo sapiens
ttccatccatgtcccgtttctg

SEQ ID NO: 9198460 - DNA, 22 bp, Homo sapiens
ttccatgcctagaacaggattc

SEQ ID NO: 9198461 - DNA, 22 bp, Homo sapiens
ttccatgcctctatttagaatt

SEQ ID NO: 9198462 - DNA, 22 bp, Homo sapiens
ttccatgcaagaagtatggctc

SEQ ID NO: 9198463 - DNA, 22 bp, Homo sapiens
ttccatgaaagtgaaatggagc

SEQ ID NO: 9198464 - DNA, 22 bp, Homo sapiens
ttccatgaaggagactgagaag

SEQ ID NO: 9198465 - DNA, 22 bp, Homo sapiens
ttccatgactgaagcaggggcg

SEQ ID NO: 9198466 - DNA, 22 bp, Homo sapiens
ttcccagaatgaatggatggag

SEQ ID NO: 9198467 - DNA, 22 bp, Homo sapiens
ttcccagtattaccttcaggaa

SEQ ID NO: 9198468 - DNA, 22 bp, Homo sapiens
ttccccaggtgattctcatggc

SEQ ID NO: 9198469 - DNA, 22 bp, Homo sapiens
ttcagaacaatatgaacagaac

SEQ ID NO: 9198470 - DNA, 22 bp, Homo sapiens
ttcaatatgatattagctgtgg

SEQ ID NO: 9198471 - DNA, 22 bp, Homo sapiens
ttcaatcattagaatctcaggc

SEQ ID NO: 9198472 - DNA, 22 bp, Homo sapiens
ttcaagtagtcacacatgatat

SEQ ID NO: 9198473 - DNA, 21 bp, Homo sapiens
ttcatcagccagaaatcaagc

SEQ ID NO: 9198474 - DNA, 22 bp, Homo sapiens
tcctcctgtttctcaggcctgg

SEQ ID NO: 9198475 - DNA, 22 bp, Homo sapiens
tcctccttgttttgtctctgct

SEQ ID NO: 9198476 - DNA, 22 bp, Homo sapiens
ttagtgtcttcttcatcctctg

SEQ ID NO: 9198477 - DNA, 22 bp, Homo sapiens
ttcaaaatccgggaggcgcccc

SEQ ID NO: 9198478 - DNA, 22 bp, Homo sapiens
ttcaaaatgcacaaagggctag

SEQ ID NO: 9198479 - DNA, 21 bp, Homo sapiens
ttcaaaatggtgtgtttgtct

SEQ ID NO: 9198480 - DNA, 21 bp, Homo sapiens
ttcaaaatggtgtgtttgtct

SEQ ID NO: 9198481 - DNA, 22 bp, Homo sapiens
ttattttctcctcagaaagtgg

SEQ ID NO: 9198482 - DNA, 22 bp, Homo sapiens
ttcaaacaactcatttatgcaa

SEQ ID NO: 9198483 - DNA, 22 bp, Homo sapiens
ttcaaaattgttctaagctctg

SEQ ID NO: 9198484 - DNA, 22 bp, Homo sapiens
ttatgtttgagtatatgactca

SEQ ID NO: 9198485 - DNA, 22 bp, Homo sapiens
ttgttcttgtctttgccttcac

SEQ ID NO: 9198486 - DNA, 22 bp, Homo sapiens
tttaagaagttatgttataaat

SEQ ID NO: 9198487 - DNA, 22 bp, Homo sapiens
tttacagatctgttgatttgtt

SEQ ID NO: 9198488 - DNA, 22 bp, Homo sapiens
tttacaagtttacagaatgatg

SEQ ID NO: 9198489 - DNA, 20 bp, Homo sapiens
tttaagaagtttctgaggaa

SEQ ID NO: 9198490 - DNA, 22 bp, Homo sapiens
tttaagagcatttgcaatttat

SEQ ID NO: 9198491 - DNA, 22 bp, Homo sapiens
tttaagagctagtatgtcattt

SEQ ID NO: 9198492 - DNA, 22 bp, Homo sapiens
tttagcgtagctgacagctaat

SEQ ID NO: 9198493 - DNA, 22 bp, Homo sapiens
tttcacattcagatatagactt

SEQ ID NO: 9198494 - DNA, 22 bp, Homo sapiens
tttcacattcagatatagactt

SEQ ID NO: 9198495 - DNA, 22 bp, Homo sapiens
tttcacatttgttttaagaagt

SEQ ID NO: 9198496 - DNA, 23 bp, Homo sapiens
tttcacatttactgttagatggc

SEQ ID NO: 9198497 - DNA, 20 bp, Homo sapiens
tttcacaatgaacatgtctc

SEQ ID NO: 9198498 - DNA, 22 bp, Homo sapiens
tttcacaactgcttatttgaga

SEQ ID NO: 9198499 - DNA, 22 bp, Homo sapiens
tttcacaagacagctactgttg

SEQ ID NO: 9198500 - DNA, 22 bp, Homo sapiens
tttcacaagtttcaggattctg

SEQ ID NO: 9198501 - DNA, 22 bp, Homo sapiens
tttcacaactgcttatttgaga

SEQ ID NO: 9198502 - DNA, 22 bp, Homo sapiens
tttcaagttctgttctagggta

SEQ ID NO: 9198503 - DNA, 22 bp, Homo sapiens
tttcaagtggcgagataaggaa

SEQ ID NO: 9198504 - DNA, 20 bp, Homo sapiens
tttcaagtcagcaattctca

SEQ ID NO: 9198505 - DNA, 22 bp, Homo sapiens
tttccttcttagcggtgttctt

SEQ ID NO: 9198506 - DNA, 21 bp, Homo sapiens
tttcccagcagagatagctgg

SEQ ID NO: 9198507 - DNA, 22 bp, Homo sapiens
tttccatgatcgttatagaact

SEQ ID NO: 9198508 - DNA, 22 bp, Homo sapiens
tttccatgttatcttgcagact

SEQ ID NO: 9198509 - DNA, 22 bp, Homo sapiens
tttccatgtgtactggccagaa

SEQ ID NO: 9198510 - DNA, 22 bp, Homo sapiens
tttccatgttggtgaaatgagg

SEQ ID NO: 9198511 - DNA, 22 bp, Homo sapiens
tttctaaatggtggctgcattg

SEQ ID NO: 9198512 - DNA, 22 bp, Homo sapiens
tttctaaaatagattttatggt

SEQ ID NO: 9198513 - DNA, 22 bp, Homo sapiens
tttcgtttgcttatataataga

SEQ ID NO: 9198514 - DNA, 22 bp, Homo sapiens
tttctaaacaaagggagtttgg

SEQ ID NO: 9198515 - DNA, 22 bp, Homo sapiens
tttccagattaagataccactt

SEQ ID NO: 9198516 - DNA, 22 bp, Homo sapiens
tttccagagcatgtctgctcag

SEQ ID NO: 9198517 - DNA, 22 bp, Homo sapiens
tttccagagggtgctcagggcg

SEQ ID NO: 9198518 - DNA, 22 bp, Homo sapiens
tttccagggctctgtagaagaa

SEQ ID NO: 9198519 - DNA, 22 bp, Homo sapiens
tttccagtcaccactagatcag

SEQ ID NO: 9198520 - DNA, 22 bp, Homo sapiens
tttccagtgaaattttgaatgt

SEQ ID NO: 9198521 - DNA, 22 bp, Homo sapiens
tttcataatactgtacatgaaa

SEQ ID NO: 9198522 - DNA, 22 bp, Homo sapiens
tttcataatactgtacatgaaa

SEQ ID NO: 9198523 - DNA, 19 bp, Homo sapiens
ttgctaaatggaaaagcac

SEQ ID NO: 9198524 - DNA, 22 bp, Homo sapiens
ttgcttcagtcagtgctgccca

SEQ ID NO: 9198525 - DNA, 22 bp, Homo sapiens
ttgcttcctctagtttcttgaa

SEQ ID NO: 9198526 - DNA, 22 bp, Homo sapiens
ttgcttccccctgttctagttc

SEQ ID NO: 9198527 - DNA, 22 bp, Homo sapiens
ttgccttcctgcccagcttctg

SEQ ID NO: 9198528 - DNA, 22 bp, Homo sapiens
ttgcttccttgagctggtctga

SEQ ID NO: 9198529 - DNA, 23 bp, Homo sapiens
ttggcaaagcctatgaagtcctc

SEQ ID NO: 9198530 - DNA, 22 bp, Homo sapiens
ttggcaaaatttaaagaagtga

SEQ ID NO: 9198531 - DNA, 22 bp, Homo sapiens
ttgggctcaggagtttgagacc

SEQ ID NO: 9198532 - DNA, 18 bp, Homo sapiens
ttggctttgagaactggt

SEQ ID NO: 9198533 - DNA, 22 bp, Homo sapiens
ttggcttttatgcagcttaggt

SEQ ID NO: 9198534 - DNA, 22 bp, Homo sapiens
ttgtataagaagttggcagata

SEQ ID NO: 9198535 - DNA, 22 bp, Homo sapiens
tttgcagtttcattgctgaaat

SEQ ID NO: 9198536 - DNA, 22 bp, Homo sapiens
tttgagcagcagatgcacttag

SEQ ID NO: 9198537 - DNA, 21 bp, Homo sapiens
tttgagaattggtcagagtgc

SEQ ID NO: 9198538 - DNA, 22 bp, Homo sapiens
tttgaagactactgggagtgaa

SEQ ID NO: 9198539 - DNA, 22 bp, Homo sapiens
tttgagaaggtgacaaattcta

SEQ ID NO: 9198540 - DNA, 19 bp, Homo sapiens
tttgagaagttattatcta

SEQ ID NO: 9198541 - DNA, 21 bp, Homo sapiens
tttgaaagtgggtgattcttt

SEQ ID NO: 9198542 - DNA, 22 bp, Homo sapiens
ttttccagatggatactagaat

SEQ ID NO: 9198543 - DNA, 22 bp, Homo sapiens
tttgtgcaagacatgctaagag

SEQ ID NO: 9198544 - DNA, 22 bp, Homo sapiens
ttttacaggtcataggtatagt

SEQ ID NO: 9198545 - DNA, 22 bp, Homo sapiens
ttttacaagctgagtcgttaaa

SEQ ID NO: 9198546 - DNA, 22 bp, Homo sapiens
ttttcacaagggtccaactagt

SEQ ID NO: 9198547 - DNA, 22 bp, Homo sapiens
ttttacattgggaaatgcctct

SEQ ID NO: 9198548 - DNA, 18 bp, Homo sapiens
ctgaggcttagagaggtt

SEQ ID NO: 9198549 - DNA, 22 bp, Homo sapiens
ctgagggtcaacttgattgtat

SEQ ID NO: 9198550 - DNA, 22 bp, Homo sapiens
ctgcagcctccaccttttgggt

SEQ ID NO: 9198551 - DNA, 22 bp, Homo sapiens
ataatacatggttgatcttttc

SEQ ID NO: 9198552 - DNA, 18 bp, Homo sapiens
ctgcttctgtctgccagt

SEQ ID NO: 9198553 - DNA, 22 bp, Homo sapiens
ctgctgtgtgaccatggacagg

SEQ ID NO: 9198554 - DNA, 22 bp, Homo sapiens
atacaagactcagcacagacgg

SEQ ID NO: 9198555 - DNA, 22 bp, Homo sapiens
atacttcatgcttcatgtctgt

SEQ ID NO: 9198556 - DNA, 22 bp, Homo sapiens
ctggagtgcaacctctgcctcc

SEQ ID NO: 9198557 - DNA, 22 bp, Homo sapiens
atcctcacatttgggcaggtga

SEQ ID NO: 9198558 - DNA, 19 bp, Homo sapiens
ctgtggactctagatcatg

SEQ ID NO: 9198559 - DNA, 23 bp, Homo sapiens
ctgtggacttccttcattctact

SEQ ID NO: 9198560 - DNA, 22 bp, Homo sapiens
atccaaatcatgtcagaagaac

SEQ ID NO: 9198561 - DNA, 22 bp, Homo sapiens
atccaaatatattttattcact

SEQ ID NO: 9198562 - DNA, 22 bp, Homo sapiens
ctgggtcccctcagtgacactg

SEQ ID NO: 9198563 - DNA, 22 bp, Homo sapiens
ctgggagaatttgttgaaggat

SEQ ID NO: 9198564 - DNA, 22 bp, Homo sapiens
ctgggagacaagagagggctga

SEQ ID NO: 9198565 - DNA, 22 bp, Homo sapiens
ctgggagagcctttcctgagtc

SEQ ID NO: 9198566 - DNA, 22 bp, Homo sapiens
ctgggagagaagcgaagctggg

SEQ ID NO: 9198567 - DNA, 22 bp, Homo sapiens
ctgggagacgcagctggggatc

SEQ ID NO: 9198568 - DNA, 22 bp, Homo sapiens
atatatattgcccaggctggtt

SEQ ID NO: 9198569 - DNA, 22 bp, Homo sapiens
atatatatgctgatggctgcca

SEQ ID NO: 9198570 - DNA, 22 bp, Homo sapiens
atatttctccaaatgttttcaa

SEQ ID NO: 9198571 - DNA, 22 bp, Homo sapiens
atatgtttttggaaagaacaca

SEQ ID NO: 9198572 - DNA, 22 bp, Homo sapiens
atatgtttttcacaggtttaag

SEQ ID NO: 9198573 - DNA, 22 bp, Homo sapiens
atatggctgttgcacatctaag

SEQ ID NO: 9198574 - DNA, 18 bp, Homo sapiens
atatgttaattaggtagg

SEQ ID NO: 9198575 - DNA, 22 bp, Homo sapiens
cctgccctatgaccagcttcac

SEQ ID NO: 9198576 - DNA, 22 bp, Homo sapiens
cctgcccaggagtctctctgtg

SEQ ID NO: 9198577 - DNA, 22 bp, Homo sapiens
agtatatttgttaagattattc

SEQ ID NO: 9198578 - DNA, 22 bp, Homo sapiens
agtatatttgttaagattattc

SEQ ID NO: 9198579 - DNA, 22 bp, Homo sapiens
agtatatatgaggaaccacaaa

SEQ ID NO: 9198580 - DNA, 19 bp, Homo sapiens
cctttggtttttggttcat

SEQ ID NO: 9198581 - DNA, 22 bp, Homo sapiens
cctttgttcattgccttcagtc

SEQ ID NO: 9198582 - DNA, 22 bp, Homo sapiens
agtgggagaatgaataagggcc

SEQ ID NO: 9198583 - DNA, 22 bp, Homo sapiens
agtggctgtgaaatacatggga

SEQ ID NO: 9198584 - DNA, 21 bp, Homo sapiens
agtgggacacctaagagattt

SEQ ID NO: 9198585 - DNA, 22 bp, Homo sapiens
agtgggacagtgtagagcgtca

SEQ ID NO: 9198586 - DNA, 22 bp, Homo sapiens
ctcctgcaagcctccccaagca

SEQ ID NO: 9198587 - DNA, 22 bp, Homo sapiens
ctcgcatgccctgcctcatcca

SEQ ID NO: 9198588 - DNA, 22 bp, Homo sapiens
agtgctataaaggtagaccaca

SEQ ID NO: 9198589 - DNA, 22 bp, Homo sapiens
ctctctaagctccacatttcct

SEQ ID NO: 9198590 - DNA, 22 bp, Homo sapiens
ctctccttgcagatggctgcct

SEQ ID NO: 9198591 - DNA, 22 bp, Homo sapiens
ctctctaagaacttgatcttgt

SEQ ID NO: 9198592 - DNA, 20 bp, Homo sapiens
ctctcccagcacagcttcct

SEQ ID NO: 9198593 - DNA, 22 bp, Homo sapiens
agtatcatgttggaattaatca

SEQ ID NO: 9198594 - DNA, 22 bp, Homo sapiens
cgggttcacgccattctcctgc

SEQ ID NO: 9198595 - DNA, 22 bp, Homo sapiens
ctcaaatagaactgatctataa

SEQ ID NO: 9198596 - DNA, 21 bp, Homo sapiens
ctcaaaattctttctgttgga

SEQ ID NO: 9198597 - DNA, 22 bp, Homo sapiens
ctcaaatgtttccacttctgct

SEQ ID NO: 9198598 - DNA, 22 bp, Homo sapiens
ctcaagaaggatgagctattgc

SEQ ID NO: 9198599 - DNA, 22 bp, Homo sapiens
ctcaccagacatggaacctgtc

SEQ ID NO: 9198600 - DNA, 22 bp, Homo sapiens
ctcagaattacatcccatttta

SEQ ID NO: 9198601 - DNA, 22 bp, Homo sapiens
ctcagaatctgccaagttcagg

SEQ ID NO: 9198602 - DNA, 22 bp, Homo sapiens
ctcagatgtagaaagattgtga

SEQ ID NO: 9198603 - DNA, 22 bp, Homo sapiens
ctcagatgtgttggatggaaaa

SEQ ID NO: 9198604 - DNA, 22 bp, Homo sapiens
ctcagatgtttgatattgttat

SEQ ID NO: 9198605 - DNA, 22 bp, Homo sapiens
ctcagcaagattaagcagcttg

SEQ ID NO: 9198606 - DNA, 22 bp, Homo sapiens
ctcagcaaccctagaacatttg

SEQ ID NO: 9198607 - DNA, 22 bp, Homo sapiens
ctcagcaacccacacacggtct

SEQ ID NO: 9198608 - DNA, 20 bp, Homo sapiens
aggccccaggaaactctcag

SEQ ID NO: 9198609 - DNA, 22 bp, Homo sapiens
aggcagtgagtgtgacttcaca

SEQ ID NO: 9198610 - DNA, 23 bp, Homo sapiens
aggcagtgggggccactttgctt

SEQ ID NO: 9198611 - DNA, 23 bp, Homo sapiens
aggcagtggtggtaacatgtcaa

SEQ ID NO: 9198612 - DNA, 22 bp, Homo sapiens
aggcctctgagcagcactcatg

SEQ ID NO: 9198613 - DNA, 22 bp, Homo sapiens
ccaggctctgagcctcactctt

SEQ ID NO: 9198614 - DNA, 22 bp, Homo sapiens
ccaggcccgttcccttctccag

SEQ ID NO: 9198615 - DNA, 23 bp, Homo sapiens
ccagtgattgcctggaaggaggt

SEQ ID NO: 9198616 - DNA, 22 bp, Homo sapiens
cctccagctgcctcagtctctt

SEQ ID NO: 9198617 - DNA, 22 bp, Homo sapiens
cctccccacaggccaaataggc

SEQ ID NO: 9198618 - DNA, 22 bp, Homo sapiens
cctccccacagcccaggagact

SEQ ID NO: 9198619 - DNA, 23 bp, Homo sapiens
cctccccaccagactctaacata

SEQ ID NO: 9198620 - DNA, 22 bp, Homo sapiens
cctccccacccacggctggtgg

SEQ ID NO: 9198621 - DNA, 22 bp, Homo sapiens
cctcagagaaatgtctattcaa

SEQ ID NO: 9198622 - DNA, 22 bp, Homo sapiens
ccatctccactgtccctgtcaa

SEQ ID NO: 9198623 - DNA, 22 bp, Homo sapiens
ccatgaattcactccatgctag

SEQ ID NO: 9198624 - DNA, 22 bp, Homo sapiens
ccatccttgtcatcttcatgtt

SEQ ID NO: 9198625 - DNA, 22 bp, Homo sapiens
ccatctccaaataccatcacat

SEQ ID NO: 9198626 - DNA, 22 bp, Homo sapiens
agggaagaagctggtagtaggt

SEQ ID NO: 9198627 - DNA, 20 bp, Homo sapiens
aggaactggaagggaggaaa

SEQ ID NO: 9198628 - DNA, 23 bp, Homo sapiens
aggaactgaggcctagggaggta

SEQ ID NO: 9198629 - DNA, 22 bp, Homo sapiens
aggaaataggaccagacaaagc

SEQ ID NO: 9198630 - DNA, 22 bp, Homo sapiens
agctgtgtgactctaagcaagt

SEQ ID NO: 9198631 - DNA, 22 bp, Homo sapiens
agctgtgtcctgaagacactgc

SEQ ID NO: 9198632 - DNA, 23 bp, Homo sapiens
agctgggaattttctgaagcttt

SEQ ID NO: 9198633 - DNA, 22 bp, Homo sapiens
agctgggaagactggaagacag

SEQ ID NO: 9198634 - DNA, 22 bp, Homo sapiens
agctgtgttattagaaacctgc

SEQ ID NO: 9198635 - DNA, 22 bp, Homo sapiens
agctgtgtggtgtctgacagct

SEQ ID NO: 9198636 - DNA, 23 bp, Homo sapiens
agctgtgtggccttgggcaagtt

SEQ ID NO: 9198637 - DNA, 22 bp, Homo sapiens
agcttgcctgtttcctagggct

SEQ ID NO: 9198638 - DNA, 22 bp, Homo sapiens
agcttgcctcttaatcacctca

SEQ ID NO: 9198639 - DNA, 22 bp, Homo sapiens
agcttgcctccccctcttagga

SEQ ID NO: 9198640 - DNA, 20 bp, Homo sapiens
agcttgcccctgtctttgcc

SEQ ID NO: 9198641 - DNA, 22 bp, Homo sapiens
agcttgccagttgaagatcttc

SEQ ID NO: 9198642 - DNA, 22 bp, Homo sapiens
agcttgccagtcatatctgttt

SEQ ID NO: 9198643 - DNA, 18 bp, Homo sapiens
agcttgcctcaagctttt

SEQ ID NO: 9198644 - DNA, 22 bp, Homo sapiens
cagcttgcacacatattagacg

SEQ ID NO: 9198645 - DNA, 22 bp, Homo sapiens
cagctctctaaggtcttgcttt

SEQ ID NO: 9198646 - DNA, 22 bp, Homo sapiens
cagctctcacacttagcttcta

SEQ ID NO: 9198647 - DNA, 22 bp, Homo sapiens
agctggaggataactcacttct

SEQ ID NO: 9198648 - DNA, 22 bp, Homo sapiens
aggaagctggtgtgaggatgaa

SEQ ID NO: 9198649 - DNA, 22 bp, Homo sapiens
aggaagctggttacgaagggat

SEQ ID NO: 9198650 - DNA, 22 bp, Homo sapiens
aggaagctcggagagggcaaat

SEQ ID NO: 9198651 - DNA, 19 bp, Homo sapiens
aggaaggaacctgagtctg

SEQ ID NO: 9198652 - DNA, 22 bp, Homo sapiens
aggaaggactgcagcatttggt

SEQ ID NO: 9198653 - DNA, 22 bp, Homo sapiens
aggaaggactccatggtccgtc

SEQ ID NO: 9198654 - DNA, 20 bp, Homo sapiens
aggaaggaagtttgcatgga

SEQ ID NO: 9198655 - DNA, 22 bp, Homo sapiens
aggagaggcatcaagaaaatcg

SEQ ID NO: 9198656 - DNA, 23 bp, Homo sapiens
aggcaatgccctgctgagaactc

SEQ ID NO: 9198657 - DNA, 22 bp, Homo sapiens
catgcagcctgtgaacagtgtc

SEQ ID NO: 9198658 - DNA, 22 bp, Homo sapiens
catgcagcggcgtttggtttaa

SEQ ID NO: 9198659 - DNA, 22 bp, Homo sapiens
catgcaggaggaaaaagcagct

SEQ ID NO: 9198660 - DNA, 22 bp, Homo sapiens
catgcagcagaataatgactat

SEQ ID NO: 9198661 - DNA, 22 bp, Homo sapiens
catgcagcaggatctcattccc

SEQ ID NO: 9198662 - DNA, 22 bp, Homo sapiens
catgccattaacattagctagc

SEQ ID NO: 9198663 - DNA, 22 bp, Homo sapiens
catgccctccttgccttcactg

SEQ ID NO: 9198664 - DNA, 22 bp, Homo sapiens
catgccatttttctagattgag

SEQ ID NO: 9198665 - DNA, 22 bp, Homo sapiens
catgcacagtgatatctgaaga

SEQ ID NO: 9198666 - DNA, 22 bp, Homo sapiens
catgcactctttgagaaggatg

SEQ ID NO: 9198667 - DNA, 22 bp, Homo sapiens
cagcagcacctattatagtgtt

SEQ ID NO: 9198668 - DNA, 19 bp, Homo sapiens
gtatatttatatggctgta

SEQ ID NO: 9198669 - DNA, 22 bp, Homo sapiens
gtatattttgatcaccctctat

SEQ ID NO: 9198670 - DNA, 22 bp, Homo sapiens
cagcagagtatggcactcaact

SEQ ID NO: 9198671 - DNA, 21 bp, Homo sapiens
ggtggggtacctaaggtagct

SEQ ID NO: 9198672 - DNA, 22 bp, Homo sapiens
ggtggggtatttggtacttgta

SEQ ID NO: 9198673 - DNA, 22 bp, Homo sapiens
ggtggggttttaggctgctgca

SEQ ID NO: 9198674 - DNA, 22 bp, Homo sapiens
cagcaaggcattctgtggatta

SEQ ID NO: 9198675 - DNA, 23 bp, Homo sapiens
ggttccaggaacacagcctgatg

SEQ ID NO: 9198676 - DNA, 22 bp, Homo sapiens
ggttccttcctgccttagccac

SEQ ID NO: 9198677 - DNA, 22 bp, Homo sapiens
cagcaagggataaagagttact

SEQ ID NO: 9198678 - DNA, 22 bp, Homo sapiens
cagcaataaggtaagcttctcc

SEQ ID NO: 9198679 - DNA, 22 bp, Homo sapiens
gtaaaatctttcctatttgcct

SEQ ID NO: 9198680 - DNA, 22 bp, Homo sapiens
ggttgagacagcagggatgtgt

SEQ ID NO: 9198681 - DNA, 22 bp, Homo sapiens
gtattttaagtgactactaggt

SEQ ID NO: 9198682 - DNA, 22 bp, Homo sapiens
gggcgcatcacctgaggtcagg

SEQ ID NO: 9198683 - DNA, 21 bp, Homo sapiens
gggctttttatttagcactgt

SEQ ID NO: 9198684 - DNA, 22 bp, Homo sapiens
cagaagtggatattagagtaat

SEQ ID NO: 9198685 - DNA, 22 bp, Homo sapiens
gggaaggacattctgggctcag

SEQ ID NO: 9198686 - DNA, 22 bp, Homo sapiens
gggaaggaaatcttgcttgtga

SEQ ID NO: 9198687 - DNA, 22 bp, Homo sapiens
gggaaggaaagttattagcaga

SEQ ID NO: 9198688 - DNA, 22 bp, Homo sapiens
gggaaggacacagccatgactg

SEQ ID NO: 9198689 - DNA, 22 bp, Homo sapiens
gggaaggagcctgcttgctaga

SEQ ID NO: 9198690 - DNA, 22 bp, Homo sapiens
gggaaggaggtggcttgaagtg

SEQ ID NO: 9198691 - DNA, 22 bp, Homo sapiens
gggaaggaggtggacctgcccc

SEQ ID NO: 9198692 - DNA, 22 bp, Homo sapiens
gggaattgaggtatgctgggct

SEQ ID NO: 9198693 - DNA, 19 bp, Homo sapiens
gggactggaggatgtggag

SEQ ID NO: 9198694 - DNA, 22 bp, Homo sapiens
gggactggaactactggtgcag

SEQ ID NO: 9198695 - DNA, 22 bp, Homo sapiens
cagaagcagtgagagatgtgca

SEQ ID NO: 9198696 - DNA, 22 bp, Homo sapiens
ggcttttgtttcagctctgcta

SEQ ID NO: 9198697 - DNA, 22 bp, Homo sapiens
ggcttttgaattccaaggcatt

SEQ ID NO: 9198698 - DNA, 22 bp, Homo sapiens
ggcttttgctgtgttttccaga

SEQ ID NO: 9198699 - DNA, 22 bp, Homo sapiens
gggaaagaccttcctggggtgt

SEQ ID NO: 9198700 - DNA, 22 bp, Homo sapiens
gcttctctggctggtctgccac

SEQ ID NO: 9198701 - DNA, 22 bp, Homo sapiens
caaggattaatagaatgaatca

SEQ ID NO: 9198702 - DNA, 22 bp, Homo sapiens
cacaatgtggtttgtcatcttt

SEQ ID NO: 9198703 - DNA, 22 bp, Homo sapiens
cacaaaatatcaagcactttta

SEQ ID NO: 9198704 - DNA, 22 bp, Homo sapiens
cacacattagagccaatgtcag

SEQ ID NO: 9198705 - DNA, 18 bp, Homo sapiens
gctgccttcccagtcaag

SEQ ID NO: 9198706 - DNA, 22 bp, Homo sapiens
gctgccttgaacatcctaagta

SEQ ID NO: 9198707 - DNA, 22 bp, Homo sapiens
caagatcagggtgccagaatgg

SEQ ID NO: 9198708 - DNA, 22 bp, Homo sapiens
caaagtaatatggtcccagtga

SEQ ID NO: 9198709 - DNA, 22 bp, Homo sapiens
caaagtaactgcctttccaatt

SEQ ID NO: 9198710 - DNA, 22 bp, Homo sapiens
caaagtatatttcatagtctca

SEQ ID NO: 9198711 - DNA, 22 bp, Homo sapiens
gctgcagctcgccttccggcct

SEQ ID NO: 9198712 - DNA, 22 bp, Homo sapiens
caacatttcaaggtctttagga

SEQ ID NO: 9198713 - DNA, 22 bp, Homo sapiens
ggcagtgttccagaccttcacc

SEQ ID NO: 9198714 - DNA, 22 bp, Homo sapiens
ggcagtgttctggttgtcagga

SEQ ID NO: 9198715 - DNA, 22 bp, Homo sapiens
caccccaagttctgtccactgc

SEQ ID NO: 9198716 - DNA, 22 bp, Homo sapiens
cacactgactggaatcaaggat

SEQ ID NO: 9198717 - DNA, 22 bp, Homo sapiens
ggatgggaacttggtagggcat

SEQ ID NO: 9198718 - DNA, 22 bp, Homo sapiens
ggcacacaaaggcagcatttga

SEQ ID NO: 9198719 - DNA, 22 bp, Homo sapiens
attcttcaccatggataatttg

SEQ ID NO: 9198720 - DNA, 22 bp, Homo sapiens
attcttcactgtttcagaatga

SEQ ID NO: 9198721 - DNA, 22 bp, Homo sapiens
attcttcacctgagtcagtcta

SEQ ID NO: 9198722 - DNA, 22 bp, Homo sapiens
attgacaaatctgaacatacgg

SEQ ID NO: 9198723 - DNA, 22 bp, Homo sapiens
attcttcagatcagcagggcct

SEQ ID NO: 9198724 - DNA, 22 bp, Homo sapiens
attccttctaaaacgctgccct

SEQ ID NO: 9198725 - DNA, 22 bp, Homo sapiens
attccttctattctctgtgggt

SEQ ID NO: 9198726 - DNA, 22 bp, Homo sapiens
attatttatcctcttggtctat

SEQ ID NO: 9198727 - DNA, 22 bp, Homo sapiens
attacaataaggtttatttgta

SEQ ID NO: 9198728 - DNA, 22 bp, Homo sapiens
gcaaggctggtggtggtgaagt

SEQ ID NO: 9198729 - DNA, 22 bp, Homo sapiens
gatgatcatctgtaaagttaga

SEQ ID NO: 9198730 - DNA, 22 bp, Homo sapiens
attaatcatttctgcattatct

SEQ ID NO: 9198731 - DNA, 22 bp, Homo sapiens
attattaaagctacatcaagga

SEQ ID NO: 9198732 - DNA, 22 bp, Homo sapiens
attagaagcgtgaatcctttca

SEQ ID NO: 9198733 - DNA, 22 bp, Homo sapiens
attagaagatagtgatttctgc

SEQ ID NO: 9198734 - DNA, 22 bp, Homo sapiens
atgtttctgaagtttacagata

SEQ ID NO: 9198735 - DNA, 22 bp, Homo sapiens
atgttttatattttgcagcagt

SEQ ID NO: 9198736 - DNA, 22 bp, Homo sapiens
atgttttatgttccactcaagg

SEQ ID NO: 9198737 - DNA, 22 bp, Homo sapiens
atgtgtttataattactcaatc

SEQ ID NO: 9198738 - DNA, 20 bp, Homo sapiens
atgtttctctgtcgtgattt

SEQ ID NO: 9198739 - DNA, 22 bp, Homo sapiens
atttctcactcacagtccatgt

SEQ ID NO: 9198740 - DNA, 22 bp, Homo sapiens
gcctcactgcagccccaggaag

SEQ ID NO: 9198741 - DNA, 22 bp, Homo sapiens
gcctccatgtgtcctgagtcgc

SEQ ID NO: 9198742 - DNA, 22 bp, Homo sapiens
gcctgtctacactttctctgca

SEQ ID NO: 9198743 - DNA, 22 bp, Homo sapiens
gcctgtctgcagggctgtcatt

SEQ ID NO: 9198744 - DNA, 22 bp, Homo sapiens
gcctgtctgcgtcacgcttatt

SEQ ID NO: 9198745 - DNA, 22 bp, Homo sapiens
atttctcaaaggaatagagtga

SEQ ID NO: 9198746 - DNA, 22 bp, Homo sapiens
atttcatgaatgctgctgttga

SEQ ID NO: 9198747 - DNA, 22 bp, Homo sapiens
atttcagtagtccttacttgta

SEQ ID NO: 9198748 - DNA, 22 bp, Homo sapiens
atttcagtgttggttagcaagc

SEQ ID NO: 9198749 - DNA, 22 bp, Homo sapiens
atttcagattcgagaggaagtg

SEQ ID NO: 9198750 - DNA, 22 bp, Homo sapiens
atttactgaagggtaggttgtt

SEQ ID NO: 9198751 - DNA, 22 bp, Homo sapiens
atttactggaaaaactatgagc

SEQ ID NO: 9198752 - DNA, 22 bp, Homo sapiens
atttactttgctgagatccatc

SEQ ID NO: 9198753 - DNA, 22 bp, Homo sapiens
atttactactgctatctagaag

SEQ ID NO: 9198754 - DNA, 22 bp, Homo sapiens
atttactagggctgtttaagta

SEQ ID NO: 9198755 - DNA, 22 bp, Homo sapiens
cttgccttcagtgtccctttgc

SEQ ID NO: 9198756 - DNA, 23 bp, Homo sapiens
cttgcctggcctctctgcccaga

SEQ ID NO: 9198757 - DNA, 22 bp, Homo sapiens
cttgtggagtgcctgctgcagt

SEQ ID NO: 9198758 - DNA, 22 bp, Homo sapiens
atgaaaagggagtgatatttgt

SEQ ID NO: 9198759 - DNA, 22 bp, Homo sapiens
atgaaaactttagcctcattag

SEQ ID NO: 9198760 - DNA, 22 bp, Homo sapiens
atgaaaacggaccagagctatt

SEQ ID NO: 9198761 - DNA, 22 bp, Homo sapiens
atgaaaacagcctcctgtgata

SEQ ID NO: 9198762 - DNA, 22 bp, Homo sapiens
atgaaatggtggttttccattt

SEQ ID NO: 9198763 - DNA, 22 bp, Homo sapiens
cttttcatgagtctgttatggg

SEQ ID NO: 9198764 - DNA, 22 bp, Homo sapiens
atgagttttgggggatgttaga

SEQ ID NO: 9198765 - DNA, 20 bp, Homo sapiens
atgattttgcactaacttca

SEQ ID NO: 9198766 - DNA, 22 bp, Homo sapiens
atgattttttctaacacagtcg

SEQ ID NO: 9198767 - DNA, 22 bp, Homo sapiens
atgattttctgataaagaactg

SEQ ID NO: 9198768 - DNA, 22 bp, Homo sapiens
atgcaaaagtaattgcaatttt

SEQ ID NO: 9198769 - DNA, 22 bp, Homo sapiens
atgattttttctaacacagtcg

SEQ ID NO: 9198770 - DNA, 22 bp, Homo sapiens
atgcactttctagagattctga

SEQ ID NO: 9198771 - DNA, 22 bp, Homo sapiens
atgcaaaattaccattctgttc

SEQ ID NO: 9198772 - DNA, 22 bp, Homo sapiens
atgcaaaagtagttgcagtttt

SEQ ID NO: 9198773 - DNA, 22 bp, Homo sapiens
atgcaaataaacagtctagttg

SEQ ID NO: 9198774 - DNA, 22 bp, Homo sapiens
atgcaaatattaatggtatgac

SEQ ID NO: 9198775 - DNA, 22 bp, Homo sapiens
atgcaaatgaacatgttgctag

SEQ ID NO: 9198776 - DNA, 22 bp, Homo sapiens
atgcaaatcttaagtatgtgtg

SEQ ID NO: 9198777 - DNA, 22 bp, Homo sapiens
atgcatgcagggaagacagtag

SEQ ID NO: 9198778 - DNA, 22 bp, Homo sapiens
atgcatgaaagaatccaagcct

SEQ ID NO: 9198779 - DNA, 23 bp, Homo sapiens
atgcatcatgaaaactagagagc

SEQ ID NO: 9198780 - DNA, 22 bp, Homo sapiens
atgccactgcgctctagcctgg

SEQ ID NO: 9198781 - DNA, 22 bp, Homo sapiens
atggaaatgatggaacattaaa

SEQ ID NO: 9198782 - DNA, 22 bp, Homo sapiens
atgccactgcgctccagcctgg

SEQ ID NO: 9198783 - DNA, 22 bp, Homo sapiens
atggaagggacagaagggcaag

SEQ ID NO: 9198784 - DNA, 22 bp, Homo sapiens
atggaagacagataaggcagaa

SEQ ID NO: 9198785 - DNA, 22 bp, Homo sapiens
atggaatgtgaacatgatggca

SEQ ID NO: 9198786 - DNA, 22 bp, Homo sapiens
gagagctgtttatcttcttcaa

SEQ ID NO: 9198787 - DNA, 22 bp, Homo sapiens
gagagctgtgttcattctacca

SEQ ID NO: 9198788 - DNA, 22 bp, Homo sapiens
gagagctgtccggctgagcagc

SEQ ID NO: 9198789 - DNA, 22 bp, Homo sapiens
atggccagtctattcatggtta

SEQ ID NO: 9198790 - DNA, 21 bp, Homo sapiens
atgtgaaaccttccacgctga

SEQ ID NO: 9198791 - DNA, 22 bp, Homo sapiens
gaggggagaggcttatggatca

SEQ ID NO: 9198792 - DNA, 22 bp, Homo sapiens
atgtgtgtatatatagtcattt

SEQ ID NO: 9198793 - DNA, 22 bp, Homo sapiens
atgtgtattttgtactattggg

SEQ ID NO: 9198794 - DNA, 22 bp, Homo sapiens
atgtgtcaattttcaaatgctt

SEQ ID NO: 9198795 - DNA, 22 bp, Homo sapiens
atgtgtatttccatcgatcagc

SEQ ID NO: 9198796 - DNA, 22 bp, Homo sapiens
atgtgtatgatacctttgctga

SEQ ID NO: 9198797 - DNA, 22 bp, Homo sapiens
atggctggatttgatccatggg

SEQ ID NO: 9198798 - DNA, 22 bp, Homo sapiens
atggtaaaagatatactgtgca

SEQ ID NO: 9198799 - DNA, 22 bp, Homo sapiens
caaatgatagagccgattatca

SEQ ID NO: 9198800 - DNA, 22 bp, Homo sapiens
agcacagctggaaaataaatca

SEQ ID NO: 9198801 - DNA, 22 bp, Homo sapiens
agcacagctgctgaatgataca

SEQ ID NO: 9198802 - DNA, 22 bp, Homo sapiens
caaatgcatagaaagatgaaac

SEQ ID NO: 9198803 - DNA, 22 bp, Homo sapiens
caaatgttaagacaggatcaag

SEQ ID NO: 9198804 - DNA, 22 bp, Homo sapiens
agcacagagattatttacaaga

SEQ ID NO: 9198805 - DNA, 22 bp, Homo sapiens
attttctatgttgtaattgtta

SEQ ID NO: 9198806 - DNA, 22 bp, Homo sapiens
caactcctccccagcatgccaa

SEQ ID NO: 9198807 - DNA, 22 bp, Homo sapiens
caacttcttggcttcctaatgg

SEQ ID NO: 9198808 - DNA, 22 bp, Homo sapiens
caaggcagtccctactccctgc

SEQ ID NO: 9198809 - DNA, 22 bp, Homo sapiens
cacaggaaggccttctcacaat

SEQ ID NO: 9198810 - DNA, 23 bp, Homo sapiens
cacaggctgcgcataagcttctc

SEQ ID NO: 9198811 - DNA, 22 bp, Homo sapiens
cacagtagccatgtctcaagta

SEQ ID NO: 9198812 - DNA, 22 bp, Homo sapiens
cacagtcacatatctatgtgtg

SEQ ID NO: 9198813 - DNA, 22 bp, Homo sapiens
cagcagcagtgttctagaatct

SEQ ID NO: 9198814 - DNA, 22 bp, Homo sapiens
cagcagagggagccattgaaat

SEQ ID NO: 9198815 - DNA, 22 bp, Homo sapiens
agctccctgcacgaccctgccc

SEQ ID NO: 9198816 - DNA, 22 bp, Homo sapiens
agctcccctcgtttctctccat

SEQ ID NO: 9198817 - DNA, 22 bp, Homo sapiens
cagaacttgctggacagcagat

SEQ ID NO: 9198818 - DNA, 22 bp, Homo sapiens
agccaggcagggctctcgctct

SEQ ID NO: 9198819 - DNA, 21 bp, Homo sapiens
atggctggtggctcagcctcc

SEQ ID NO: 9198820 - DNA, 22 bp, Homo sapiens
atgtacagccacttcacagtta

SEQ ID NO: 9198821 - DNA, 22 bp, Homo sapiens
atgtccaatttcagagtctcat

SEQ ID NO: 9198822 - DNA, 21 bp, Homo sapiens
atgtcaaatgctttattttat

SEQ ID NO: 9198823 - DNA, 22 bp, Homo sapiens
agacagtaataaaataggtaag

SEQ ID NO: 9198824 - DNA, 22 bp, Homo sapiens
agaattagtcacaattatagga

SEQ ID NO: 9198825 - DNA, 22 bp, Homo sapiens
agaattcagaatgcatttctaa

SEQ ID NO: 9198826 - DNA, 21 bp, Homo sapiens
agaattaaattggatttgtgt

SEQ ID NO: 9198827 - DNA, 22 bp, Homo sapiens
agaattagaggccatgtacttg

SEQ ID NO: 9198828 - DNA, 22 bp, Homo sapiens
agaattaggtaagttcatctga

SEQ ID NO: 9198829 - DNA, 22 bp, Homo sapiens
agaagaatacttgatgttcatg

SEQ ID NO: 9198830 - DNA, 22 bp, Homo sapiens
agaagcacaccagtagacaggg

SEQ ID NO: 9198831 - DNA, 22 bp, Homo sapiens
attcagattcctaggtttcatt

SEQ ID NO: 9198832 - DNA, 22 bp, Homo sapiens
attcacagtatggacgaaatga

SEQ ID NO: 9198833 - DNA, 22 bp, Homo sapiens
agagggtgctggagagacattg

SEQ ID NO: 9198834 - DNA, 22 bp, Homo sapiens
agagggtgaatgagatagaaaa

SEQ ID NO: 9198835 - DNA, 22 bp, Homo sapiens
attctgtagggcttgctgacac

SEQ ID NO: 9198836 - DNA, 22 bp, Homo sapiens
attataaacctttgagggtggg

SEQ ID NO: 9198837 - DNA, 22 bp, Homo sapiens
atgttttaccctttgcacaaac

SEQ ID NO: 9198838 - DNA, 22 bp, Homo sapiens
atgtttgtcaggattgtaatta

SEQ ID NO: 9198839 - DNA, 22 bp, Homo sapiens
atgtttgactgagtttggcaga

SEQ ID NO: 9198840 - DNA, 22 bp, Homo sapiens
atgtttctgagtgtatatacat

SEQ ID NO: 9198841 - DNA, 22 bp, Homo sapiens
atgttaagaatgcagacaaatg

SEQ ID NO: 9198842 - DNA, 22 bp, Homo sapiens
atgttaagttactgaaatgaga

SEQ ID NO: 9198843 - DNA, 22 bp, Homo sapiens
atgtgtctttgagactctgcta

SEQ ID NO: 9198844 - DNA, 22 bp, Homo sapiens
agatggttgtcgcaaatgaatg

SEQ ID NO: 9198845 - DNA, 22 bp, Homo sapiens
atttcattgaagttaattcttc

SEQ ID NO: 9198846 - DNA, 22 bp, Homo sapiens
agatgaagatgccactaagacc

SEQ ID NO: 9198847 - DNA, 22 bp, Homo sapiens
agatgaaaatacgtgactttaa

SEQ ID NO: 9198848 - DNA, 22 bp, Homo sapiens
agcaaaataaggtaatttattg

SEQ ID NO: 9198849 - DNA, 22 bp, Homo sapiens
agagtggggacagggcctgtcc

SEQ ID NO: 9198850 - DNA, 22 bp, Homo sapiens
agagtgggacacgggcgctgtc

SEQ ID NO: 9198851 - DNA, 22 bp, Homo sapiens
attcttcatacagacaagtcct

SEQ ID NO: 9198852 - DNA, 22 bp, Homo sapiens
agagggtgggcacgtgatggat

SEQ ID NO: 9198853 - DNA, 22 bp, Homo sapiens
attcttcattgttgattcatgt

SEQ ID NO: 9198854 - DNA, 23 bp, Homo sapiens
attcttcattatcttctagaaaa

SEQ ID NO: 9198855 - DNA, 22 bp, Homo sapiens
atttaacaagacagagaactgg

SEQ ID NO: 9198856 - DNA, 22 bp, Homo sapiens
attgttaataactattacattg

SEQ ID NO: 9198857 - DNA, 23 bp, Homo sapiens
actgattaggcattacctggaag

SEQ ID NO: 9198858 - DNA, 22 bp, Homo sapiens
actgattgcattcatagggttt

SEQ ID NO: 9198859 - DNA, 22 bp, Homo sapiens
actgaaggtctcagcaaggatg

SEQ ID NO: 9198860 - DNA, 22 bp, Homo sapiens
actgaagggtaatgtgggagcc

SEQ ID NO: 9198861 - DNA, 22 bp, Homo sapiens
actgcacagatgaagctgtaaa

SEQ ID NO: 9198862 - DNA, 22 bp, Homo sapiens
actgaaggaaagcctttgcatg

SEQ ID NO: 9198863 - DNA, 22 bp, Homo sapiens
actgaaggctttcccaaggtca

SEQ ID NO: 9198864 - DNA, 22 bp, Homo sapiens
actccaaggccacatgcattcc

SEQ ID NO: 9198865 - DNA, 22 bp, Homo sapiens
actcatttgacactttaaactg

SEQ ID NO: 9198866 - DNA, 22 bp, Homo sapiens
actcattaaataggatgatttt

SEQ ID NO: 9198867 - DNA, 22 bp, Homo sapiens
actcaaaagaccagagagctga

SEQ ID NO: 9198868 - DNA, 18 bp, Homo sapiens
actattgaggtattcttg

SEQ ID NO: 9198869 - DNA, 22 bp, Homo sapiens
actattgtgtagtagaagcatc

SEQ ID NO: 9198870 - DNA, 22 bp, Homo sapiens
actattagcatatcatgaatgg

SEQ ID NO: 9198871 - DNA, 22 bp, Homo sapiens
acctccccgggagcagcctcct

SEQ ID NO: 9198872 - DNA, 20 bp, Homo sapiens
agggtggggacgttctgact

SEQ ID NO: 9198873 - DNA, 22 bp, Homo sapiens
atcattctgatggtcaatgcta

SEQ ID NO: 9198874 - DNA, 22 bp, Homo sapiens
atcatttgtgcatagtaacaga

SEQ ID NO: 9198875 - DNA, 22 bp, Homo sapiens
atccagaacacctgtatcacca

SEQ ID NO: 9198876 - DNA, 22 bp, Homo sapiens
atcacaaaggctgcttcatgat

SEQ ID NO: 9198877 - DNA, 22 bp, Homo sapiens
atatatttactctcctgttgca

SEQ ID NO: 9198878 - DNA, 22 bp, Homo sapiens
atatattttgaatagcctctgt

SEQ ID NO: 9198879 - DNA, 22 bp, Homo sapiens
atatatttgagaatattcatga

SEQ ID NO: 9198880 - DNA, 22 bp, Homo sapiens
agaaaatttattcatgttagtt

SEQ ID NO: 9198881 - DNA, 22 bp, Homo sapiens
acttccaagtgacattcatatc

SEQ ID NO: 9198882 - DNA, 22 bp, Homo sapiens
acttcatgtactgttcaaggcc

SEQ ID NO: 9198883 - DNA, 22 bp, Homo sapiens
acttcatgttgctcttggctat

SEQ ID NO: 9198884 - DNA, 22 bp, Homo sapiens
acttcatgttgtttacaactta

SEQ ID NO: 9198885 - DNA, 22 bp, Homo sapiens
actgtgttaaatacagagatgg

SEQ ID NO: 9198886 - DNA, 22 bp, Homo sapiens
acttcacaaagagatcatctaa

SEQ ID NO: 9198887 - DNA, 22 bp, Homo sapiens
acttcagaaaatgttgaatgtt

SEQ ID NO: 9198888 - DNA, 22 bp, Homo sapiens
actgtgaacggactgaagccca

SEQ ID NO: 9198889 - DNA, 22 bp, Homo sapiens
agtttacttgaatgatgaattc

SEQ ID NO: 9198890 - DNA, 22 bp, Homo sapiens
actgtaaaatgagatatgtata

SEQ ID NO: 9198891 - DNA, 22 bp, Homo sapiens
accatttgactctctaaggata

SEQ ID NO: 9198892 - DNA, 22 bp, Homo sapiens
acccgatgttggtgctctagta

SEQ ID NO: 9198893 - DNA, 22 bp, Homo sapiens
acccggagtcggaggttgcagt

SEQ ID NO: 9198894 - DNA, 22 bp, Homo sapiens
agggaattcactggaacgccct

SEQ ID NO: 9198895 - DNA, 22 bp, Homo sapiens
agggaagaggaccagagtctct

SEQ ID NO: 9198896 - DNA, 22 bp, Homo sapiens
acatttgtcttctttcagatta

SEQ ID NO: 9198897 - DNA, 22 bp, Homo sapiens
agggaagaatcactgggatgtt

SEQ ID NO: 9198898 - DNA, 22 bp, Homo sapiens
agggaagagcttgcaagaaacc

SEQ ID NO: 9198899 - DNA, 22 bp, Homo sapiens
acatgcaaaaatatatttatga

SEQ ID NO: 9198900 - DNA, 23 bp, Homo sapiens
acatgcaaaaatcacagtctcct

SEQ ID NO: 9198901 - DNA, 22 bp, Homo sapiens
acatgcaaagggatgcaattat

SEQ ID NO: 9198902 - DNA, 22 bp, Homo sapiens
acatgcaaatgtgcatgcatgt

SEQ ID NO: 9198903 - DNA, 19 bp, Homo sapiens
acatgcaaggcacctgcag

SEQ ID NO: 9198904 - DNA, 22 bp, Homo sapiens
acatgcaagcccctgaacacat

SEQ ID NO: 9198905 - DNA, 20 bp, Homo sapiens
acatgcagtggtcatttcag

SEQ ID NO: 9198906 - DNA, 22 bp, Homo sapiens
aggcccttgggtcctctccaca

SEQ ID NO: 9198907 - DNA, 22 bp, Homo sapiens
acatggcaaaagggactttaca

SEQ ID NO: 9198908 - DNA, 22 bp, Homo sapiens
aggctagctttggctcagtaaa

SEQ ID NO: 9198909 - DNA, 22 bp, Homo sapiens
aggctagctgtttcagggctag

SEQ ID NO: 9198910 - DNA, 22 bp, Homo sapiens
aggctagctaatgagtactgtg

SEQ ID NO: 9198911 - DNA, 22 bp, Homo sapiens
acatttaccctggaacattgga

SEQ ID NO: 9198912 - DNA, 22 bp, Homo sapiens
acatttattactcaggttgttg

SEQ ID NO: 9198913 - DNA, 22 bp, Homo sapiens
acatttattttggcacggcaca

SEQ ID NO: 9198914 - DNA, 22 bp, Homo sapiens
aggaatgatagtaaaagagaat

SEQ ID NO: 9198915 - DNA, 17 bp, Homo sapiens
agctgccttgcttgagc

SEQ ID NO: 9198916 - DNA, 22 bp, Homo sapiens
acagcacttattcagcacagtg

SEQ ID NO: 9198917 - DNA, 22 bp, Homo sapiens
acagttatctttgaaatagaga

SEQ ID NO: 9198918 - DNA, 22 bp, Homo sapiens
acagttattttcccagcattta

SEQ ID NO: 9198919 - DNA, 22 bp, Homo sapiens
acagtttggcgtgattgatagt

SEQ ID NO: 9198920 - DNA, 22 bp, Homo sapiens
aaggcctttgccccgatacagg

SEQ ID NO: 9198921 - DNA, 22 bp, Homo sapiens
aaggctcagggtttaagtttct

SEQ ID NO: 9198922 - DNA, 22 bp, Homo sapiens
acatttgtgcaacgtatccaca

SEQ ID NO: 9198923 - DNA, 22 bp, Homo sapiens
acatttgtgcacatgtgcatgg

SEQ ID NO: 9198924 - DNA, 22 bp, Homo sapiens
aaggctggcaatatatttgtta

SEQ ID NO: 9198925 - DNA, 22 bp, Homo sapiens
aaggctggcaatatatttgtta

SEQ ID NO: 9198926 - DNA, 22 bp, Homo sapiens
acatttgtttctctagagtagg

SEQ ID NO: 9198927 - DNA, 22 bp, Homo sapiens
acattttacaccaagacttctt

SEQ ID NO: 9198928 - DNA, 22 bp, Homo sapiens
accatgttggccaagctggtct

SEQ ID NO: 9198929 - DNA, 22 bp, Homo sapiens
aaggggaaaaagtgttaggagt

SEQ ID NO: 9198930 - DNA, 19 bp, Homo sapiens
aagctccagcagatccttt

SEQ ID NO: 9198931 - DNA, 22 bp, Homo sapiens
acagtctttctacattctgtgc

SEQ ID NO: 9198932 - DNA, 22 bp, Homo sapiens
acatatgtgttgtacatgcatg

SEQ ID NO: 9198933 - DNA, 22 bp, Homo sapiens
agaaatgacacacatgagacat

SEQ ID NO: 9198934 - DNA, 22 bp, Homo sapiens
agaaattattagtgaatagtct

SEQ ID NO: 9198935 - DNA, 22 bp, Homo sapiens
agaacaatgttaaattattaag

SEQ ID NO: 9198936 - DNA, 22 bp, Homo sapiens
agaacaatgaggtatggatgga

SEQ ID NO: 9198937 - DNA, 22 bp, Homo sapiens
agaacaatgcgtattttactcc

SEQ ID NO: 9198938 - DNA, 22 bp, Homo sapiens
aatcagaatcagttgacacagc

SEQ ID NO: 9198939 - DNA, 22 bp, Homo sapiens
actttcttaggctgtataaatg

SEQ ID NO: 9198940 - DNA, 22 bp, Homo sapiens
actttcttggtcccatgtttga

SEQ ID NO: 9198941 - DNA, 22 bp, Homo sapiens
actttatgtttgatatctatgg

SEQ ID NO: 9198942 - DNA, 22 bp, Homo sapiens
aataccacctcattctggaggc

SEQ ID NO: 9198943 - DNA, 22 bp, Homo sapiens
actctccacccactcactctgt

SEQ ID NO: 9198944 - DNA, 23 bp, Homo sapiens
actccccagtctcttcttgccaa

SEQ ID NO: 9198945 - DNA, 22 bp, Homo sapiens
aattctgttactaatgtgatgt

SEQ ID NO: 9198946 - DNA, 22 bp, Homo sapiens
aattgcttactgtttttcacct

SEQ ID NO: 9198947 - DNA, 22 bp, Homo sapiens
acaatgaagggagacacttgct

SEQ ID NO: 9198948 - DNA, 22 bp, Homo sapiens
acaatgaatatcatgaagtact

SEQ ID NO: 9198949 - DNA, 22 bp, Homo sapiens
acaatgaaaggtattctgaact

SEQ ID NO: 9198950 - DNA, 22 bp, Homo sapiens
acaatgaacacacaaggaattc

SEQ ID NO: 9198951 - DNA, 22 bp, Homo sapiens
acaatgaaccaaatttaccaat

SEQ ID NO: 9198952 - DNA, 22 bp, Homo sapiens
acaatgaacgctttttaactgt

SEQ ID NO: 9198953 - DNA, 22 bp, Homo sapiens
acaagcatgggctttgacatca

SEQ ID NO: 9198954 - DNA, 22 bp, Homo sapiens
agagacagatctgagggacctc

SEQ ID NO: 9198955 - DNA, 22 bp, Homo sapiens
aatgtttgtgcataaatatgtt

SEQ ID NO: 9198956 - DNA, 22 bp, Homo sapiens
aatgtgtaaaaggttttcttca

SEQ ID NO: 9198957 - DNA, 22 bp, Homo sapiens
aatgggcacacttagagagtaa

SEQ ID NO: 9198958 - DNA, 22 bp, Homo sapiens
aatgggaggtagtatgggaggt

SEQ ID NO: 9198959 - DNA, 22 bp, Homo sapiens
agacaatggagggaaatacttc

SEQ ID NO: 9198960 - DNA, 22 bp, Homo sapiens
agacaatatgtatattaagaat

SEQ ID NO: 9198961 - DNA, 21 bp, Homo sapiens
agacaatgctgtaaaattcag

SEQ ID NO: 9198962 - DNA, 22 bp, Homo sapiens
aatgggctttggccagtaggag

SEQ ID NO: 9198963 - DNA, 23 bp, Homo sapiens
aatgtgctgtattcatttctgga

SEQ ID NO: 9198964 - DNA, 22 bp, Homo sapiens
aatgtgctgtcaacatttcgaa

SEQ ID NO: 9198965 - DNA, 22 bp, Homo sapiens
aatgtgctggtaactgctttgc

SEQ ID NO: 9198966 - DNA, 22 bp, Homo sapiens
aatgtgctccactccaggctgc

SEQ ID NO: 9198967 - DNA, 22 bp, Homo sapiens
aatgtgctttgttcagccattt

SEQ ID NO: 9198968 - DNA, 19 bp, Homo sapiens
aatgtgcttgggagactgc

SEQ ID NO: 9198969 - DNA, 22 bp, Homo sapiens
aatgtgcttctggctgtggtca

SEQ ID NO: 9198970 - DNA, 22 bp, Homo sapiens
aatgtgctccaattgtctactt

SEQ ID NO: 9198971 - DNA, 22 bp, Homo sapiens
aatgtaaaatatcttgtacttg

SEQ ID NO: 9198972 - DNA, 22 bp, Homo sapiens
acacagaagatctcttaatgct

SEQ ID NO: 9198973 - DNA, 22 bp, Homo sapiens
acaatgcaccagcatcttcacc

SEQ ID NO: 9198974 - DNA, 17 bp, Homo sapiens
acaatgcagtctctagt

SEQ ID NO: 9198975 - DNA, 22 bp, Homo sapiens
acacagagtccttactgaggta

SEQ ID NO: 9198976 - DNA, 22 bp, Homo sapiens
acacagaggaaagtgtgaaggg

SEQ ID NO: 9198977 - DNA, 22 bp, Homo sapiens
acacatgtgattctaagacagc

SEQ ID NO: 9198978 - DNA, 22 bp, Homo sapiens
acacatgtacagattagtattt

SEQ ID NO: 9198979 - DNA, 22 bp, Homo sapiens
acacatgtttgtgtagtcagtt

SEQ ID NO: 9198980 - DNA, 19 bp, Homo sapiens
acacatgtgtgttatgtgc

SEQ ID NO: 9198981 - DNA, 22 bp, Homo sapiens
acactatttaaatctaacctgt

SEQ ID NO: 9198982 - DNA, 22 bp, Homo sapiens
acactctgtaatgtcacactcc

SEQ ID NO: 9198983 - DNA, 22 bp, Homo sapiens
acactttactcttacaccattg

SEQ ID NO: 9198984 - DNA, 22 bp, Homo sapiens
acactgaatgctgtttagaaat

SEQ ID NO: 9198985 - DNA, 22 bp, Homo sapiens
acagcacaggagttgaatgggc

SEQ ID NO: 9198986 - DNA, 23 bp, Homo sapiens
acagacattccataatgtacacc

SEQ ID NO: 9198987 - DNA, 22 bp, Homo sapiens
acagactgtcatgacactatat

SEQ ID NO: 9198988 - DNA, 22 bp, Homo sapiens
acagactgtgagtatgcatagt

SEQ ID NO: 9198989 - DNA, 19 bp, Homo sapiens
agccagggtccagacatgt

SEQ ID NO: 9198990 - DNA, 22 bp, Homo sapiens
acactttatcaatattcaaaaa

SEQ ID NO: 9198991 - DNA, 22 bp, Homo sapiens
acagaattaatgaaaattacaa

SEQ ID NO: 9198992 - DNA, 22 bp, Homo sapiens
aagatgtgtgattaagctctga

SEQ ID NO: 9198993 - DNA, 22 bp, Homo sapiens
aagcaatagcaacaactttaca

SEQ ID NO: 9198994 - DNA, 22 bp, Homo sapiens
aagcaaggccggaaggaaactc

SEQ ID NO: 9198995 - DNA, 22 bp, Homo sapiens
aagatgtgatggtagcttttac

SEQ ID NO: 9198996 - DNA, 22 bp, Homo sapiens
acagcaaaagacaagaacttaa

SEQ ID NO: 9198997 - DNA, 22 bp, Homo sapiens
aagcaatagggtaatctactca

SEQ ID NO: 9198998 - DNA, 22 bp, Homo sapiens
aatttccagaccccatccacag

SEQ ID NO: 9198999 - DNA, 22 bp, Homo sapiens
aattttaagcatatgactggtt

SEQ ID NO: 9199000 - DNA, 22 bp, Homo sapiens
aattttaatcagtggtgctgag

SEQ ID NO: 9199001 - DNA, 22 bp, Homo sapiens
aatttcagaccatttgcaatta

SEQ ID NO: 9199002 - DNA, 22 bp, Homo sapiens
aatttcagaactatctgggagt

SEQ ID NO: 9199003 - DNA, 22 bp, Homo sapiens
aatttcagatgtcataaatata

SEQ ID NO: 9199004 - DNA, 22 bp, Homo sapiens
aatttcagcttaagttgtttgg

SEQ ID NO: 9199005 - DNA, 21 bp, Homo sapiens
aagaaagataattaaggaccc

SEQ ID NO: 9199006 - DNA, 22 bp, Homo sapiens
aattcacaatgtgtagtcatgc

SEQ ID NO: 9199007 - DNA, 22 bp, Homo sapiens
aattctgaaagattccttattc

SEQ ID NO: 9199008 - DNA, 22 bp, Homo sapiens
aatttcactgtggagcacattt

SEQ ID NO: 9199009 - DNA, 22 bp, Homo sapiens
aatttcactggaaaagataatt

SEQ ID NO: 9199010 - DNA, 22 bp, Homo sapiens
aatttcactgataaagactcca

SEQ ID NO: 9199011 - DNA, 22 bp, Homo sapiens
aatttcacctgcactacatcgc

SEQ ID NO: 9199012 - DNA, 22 bp, Homo sapiens
aagaaaacatgatctaatttaa

SEQ ID NO: 9199013 - DNA, 22 bp, Homo sapiens
aacactttcttccttgctcagg

SEQ ID NO: 9199014 - DNA, 22 bp, Homo sapiens
aacactgtatcagtcttcaata

SEQ ID NO: 9199015 - DNA, 22 bp, Homo sapiens
aaggctggttccatccctggtg

SEQ ID NO: 9199016 - DNA, 22 bp, Homo sapiens
aaatttctggaagtgtcagagt

SEQ ID NO: 9199017 - DNA, 22 bp, Homo sapiens
aaatttgtcaacttcatatgtt

SEQ ID NO: 9199018 - DNA, 22 bp, Homo sapiens
aaatttgtcaacttcatatgtt

SEQ ID NO: 9199019 - DNA, 22 bp, Homo sapiens
aacaatgtcctgtgagatgata

SEQ ID NO: 9199020 - DNA, 22 bp, Homo sapiens
aacacaatcttccagtttgctg

SEQ ID NO: 9199021 - DNA, 22 bp, Homo sapiens
aaggaagagtctagaacaggca

SEQ ID NO: 9199022 - DNA, 22 bp, Homo sapiens
aaggaaagacaggacggaattc

SEQ ID NO: 9199023 - DNA, 22 bp, Homo sapiens
aaatgcattggtttctacttgt

SEQ ID NO: 9199024 - DNA, 22 bp, Homo sapiens
aaatgcatttcactaatgtttc

SEQ ID NO: 9199025 - DNA, 22 bp, Homo sapiens
aaatgcattctgttttcactag

SEQ ID NO: 9199026 - DNA, 22 bp, Homo sapiens
aaatgcattaagtcagaacaat

SEQ ID NO: 9199027 - DNA, 22 bp, Homo sapiens
aactacttgactgacagattca

SEQ ID NO: 9199028 - DNA, 22 bp, Homo sapiens
aacccgggaggcggaggttgtg

SEQ ID NO: 9199029 - DNA, 22 bp, Homo sapiens
aacccgggaggtggaggttatg

SEQ ID NO: 9199030 - DNA, 22 bp, Homo sapiens
aacatctgatcgaacagtgcca

SEQ ID NO: 9199031 - DNA, 22 bp, Homo sapiens
aacatgtgtctggctagattgt

SEQ ID NO: 9199032 - DNA, 22 bp, Homo sapiens
aaagccagagcaagctgtcaca

SEQ ID NO: 9199033 - DNA, 22 bp, Homo sapiens
aaacactgaagacctatctggt

SEQ ID NO: 9199034 - DNA, 22 bp, Homo sapiens
aaacagataagggacaatttca

SEQ ID NO: 9199035 - DNA, 22 bp, Homo sapiens
aaacagctacttctgtataatg

SEQ ID NO: 9199036 - DNA, 22 bp, Homo sapiens
aaacagatgagttataatagcc

SEQ ID NO: 9199037 - DNA, 20 bp, Homo sapiens
aaacattcatgtacaagtga

SEQ ID NO: 9199038 - DNA, 22 bp, Homo sapiens
aaagactcaattgttccctaat

SEQ ID NO: 9199039 - DNA, 22 bp, Homo sapiens
aaagactcttaactccctagcg

SEQ ID NO: 9199040 - DNA, 22 bp, Homo sapiens
aaagaaatagatggcatttaaa

SEQ ID NO: 9199041 - DNA, 22 bp, Homo sapiens
aaacttttttaggttcataggc

SEQ ID NO: 9199042 - DNA, 22 bp, Homo sapiens
aaaattcatggcttgggaaaag

SEQ ID NO: 9199043 - DNA, 22 bp, Homo sapiens
aaaactacatttgacattttgt

SEQ ID NO: 9199044 - DNA, 22 bp, Homo sapiens
aaaactctgcagttagtttcta

SEQ ID NO: 9199045 - DNA, 22 bp, Homo sapiens
aaaaatacttcacttctgggtg

SEQ ID NO: 9199046 - DNA, 22 bp, Homo sapiens
aaacactcatgtgttactctcc

SEQ ID NO: 9199047 - DNA, 22 bp, Homo sapiens
aaaattgaggctcatgttaaat

SEQ ID NO: 9199048 - DNA, 22 bp, Homo sapiens
aaaatgtgcagtttttaagctg

SEQ ID NO: 9199049 - DNA, 22 bp, Homo sapiens
aaaattctgtcattaaattgtg

SEQ ID NO: 9199050 - DNA, 22 bp, Homo sapiens
aaacagtattatcaatatattt

SEQ ID NO: 9199051 - DNA, 20 bp, Homo sapiens
aaaatatgtataactcttct

SEQ ID NO: 9199052 - DNA, 22 bp, Homo sapiens
aaatgcatggctgttttaaagc

SEQ ID NO: 9199053 - DNA, 22 bp, Homo sapiens
aagcctccttattaaaggatat

SEQ ID NO: 9199054 - DNA, 22 bp, Homo sapiens
aaatctctggcagaaataaact

SEQ ID NO: 9199055 - DNA, 22 bp, Homo sapiens
aaatctctgaacttaataatgc

SEQ ID NO: 9199056 - DNA, 22 bp, Homo sapiens
aaatctctgcaggcaaatgtga

SEQ ID NO: 9199057 - DNA, 22 bp, Homo sapiens
aaatctgtttcaggtatatttg

SEQ ID NO: 9199058 - DNA, 22 bp, Homo sapiens
aaatctcattatttataccata

SEQ ID NO: 9199059 - DNA, 22 bp, Homo sapiens
aaatctcactggcaggcaggca

SEQ ID NO: 9199060 - DNA, 22 bp, Homo sapiens
aaatctcaatttgaattgtagc

SEQ ID NO: 9199061 - DNA, 20 bp, Homo sapiens
aagattcattgtaattaggg

SEQ ID NO: 9199062 - DNA, 22 bp, Homo sapiens
aagatcagctcccgagtctgag

SEQ ID NO: 9199063 - DNA, 22 bp, Homo sapiens
aaatactattgaccaggtctct

SEQ ID NO: 9199064 - DNA, 22 bp, Homo sapiens
aaagtttgagtgatttgacaca

SEQ ID NO: 9199065 - DNA, 22 bp, Homo sapiens
aacactgtcttatacttcaatg

SEQ ID NO: 9199066 - DNA, 22 bp, Homo sapiens
aacacttagatttttaaggttt

SEQ ID NO: 9199067 - DNA, 22 bp, Homo sapiens
aacacttctcatcactgcaagc

SEQ ID NO: 9199068 - DNA, 22 bp, Homo sapiens
aaagatttaagaataatttgtg

SEQ ID NO: 9199069 - DNA, 22 bp, Homo sapiens
aagaacataacagaagctgtgt

SEQ ID NO: 9199070 - DNA, 22 bp, Homo sapiens
aagaacatgaacacaatgttta

SEQ ID NO: 9199071 - DNA, 22 bp, Homo sapiens
aagaacatgagttatgatgatt

SEQ ID NO: 9199072 - DNA, 18 bp, Homo sapiens
aaaggcagattactggga

SEQ ID NO: 9199073 - DNA, 22 bp, Homo sapiens
aacccgggaggcagaggttgtg

SEQ ID NO: 9199074 - DNA, 22 bp, Homo sapiens
aaaggcagtgtgatactgtggt

SEQ ID NO: 9199075 - DNA, 22 bp, Homo sapiens
gtccttaatctgattggtgcag

SEQ ID NO: 9199076 - DNA, 22 bp, Homo sapiens
gtccttaaagagagcatcattc

SEQ ID NO: 9199077 - DNA, 22 bp, Homo sapiens
gtccttaaccacttgtgtttat

SEQ ID NO: 9199078 - DNA, 22 bp, Homo sapiens
gtccttaacaaacggggaaaag

SEQ ID NO: 9199079 - DNA, 22 bp, Homo sapiens
gtccttaaatgctgctgcagga

SEQ ID NO: 9199080 - DNA, 22 bp, Homo sapiens
gtccatcttattacagagcttt

SEQ ID NO: 9199081 - DNA, 22 bp, Homo sapiens
gtctgactcataagatctcttg

SEQ ID NO: 9199082 - DNA, 22 bp, Homo sapiens
gtctgagaactactgaggataa

SEQ ID NO: 9199083 - DNA, 22 bp, Homo sapiens
gtccttccccagccagctctgg

SEQ ID NO: 9199084 - DNA, 22 bp, Homo sapiens
gtatactcaacctgcctagaat

SEQ ID NO: 9199085 - DNA, 21 bp, Homo sapiens
gtatatcagcagtgaattcaa

SEQ ID NO: 9199086 - DNA, 22 bp, Homo sapiens
gtacatttaggattcattgaaa

SEQ ID NO: 9199087 - DNA, 22 bp, Homo sapiens
gtaaagtacatacatgaactca

SEQ ID NO: 9199088 - DNA, 22 bp, Homo sapiens
gtgccttccccggtggtctgtt

SEQ ID NO: 9199089 - DNA, 23 bp, Homo sapiens
gtgctacttacagggagcttggt

SEQ ID NO: 9199090 - DNA, 22 bp, Homo sapiens
gtggaagcctaagagtagggag

SEQ ID NO: 9199091 - DNA, 22 bp, Homo sapiens
gtggaagctgatgggagacagg

SEQ ID NO: 9199092 - DNA, 22 bp, Homo sapiens
gtgcctgctgcagctgagcagt

SEQ ID NO: 9199093 - DNA, 22 bp, Homo sapiens
gtggagacttctactagagacc

SEQ ID NO: 9199094 - DNA, 22 bp, Homo sapiens
gtggagacgggacagaagctaa

SEQ ID NO: 9199095 - DNA, 22 bp, Homo sapiens
gtggagacctcctaggatgtgt

SEQ ID NO: 9199096 - DNA, 22 bp, Homo sapiens
gtggagtggtgatggataggtt

SEQ ID NO: 9199097 - DNA, 22 bp, Homo sapiens
gtggagtgcaacggttggagtt

SEQ ID NO: 9199098 - DNA, 22 bp, Homo sapiens
taaaacactcagcacctagcaa

SEQ ID NO: 9199099 - DNA, 22 bp, Homo sapiens
taaaacacctgtagtgtctgcc

SEQ ID NO: 9199100 - DNA, 22 bp, Homo sapiens
gtttaaagtcttggaaggagga

SEQ ID NO: 9199101 - DNA, 22 bp, Homo sapiens
gtttaaagtagcttccttttgg

SEQ ID NO: 9199102 - DNA, 22 bp, Homo sapiens
gtttaacatctgtgaagctgct

SEQ ID NO: 9199103 - DNA, 22 bp, Homo sapiens
gtgtgtatgtagaactatgtat

SEQ ID NO: 9199104 - DNA, 22 bp, Homo sapiens
gtgtaaaaacatactatttcta

SEQ ID NO: 9199105 - DNA, 18 bp, Homo sapiens
gtggggtgttgtgaggat

SEQ ID NO: 9199106 - DNA, 22 bp, Homo sapiens
gtggggtagatctttctcagga

SEQ ID NO: 9199107 - DNA, 22 bp, Homo sapiens
ggaaagaaagtgtgaacaactt

SEQ ID NO: 9199108 - DNA, 22 bp, Homo sapiens
ggaaggtcacagatgagggaag

SEQ ID NO: 9199109 - DNA, 17 bp, Homo sapiens
ggaaggtcaaggggagg

SEQ ID NO: 9199110 - DNA, 22 bp, Homo sapiens
gcttccttggtcctggtctaag

SEQ ID NO: 9199111 - DNA, 22 bp, Homo sapiens
gcttccttctaccacatcatgc

SEQ ID NO: 9199112 - DNA, 22 bp, Homo sapiens
gcttccttgggaaaattagatg

SEQ ID NO: 9199113 - DNA, 22 bp, Homo sapiens
gcttccttattgttgccatagt

SEQ ID NO: 9199114 - DNA, 22 bp, Homo sapiens
gcttccttccttacattggtgg

SEQ ID NO: 9199115 - DNA, 20 bp, Homo sapiens
gcttccttcccagcccccac

SEQ ID NO: 9199116 - DNA, 22 bp, Homo sapiens
gcttctgatgtcagacttctgg

SEQ ID NO: 9199117 - DNA, 22 bp, Homo sapiens
gcttcctggagggagagagctg

SEQ ID NO: 9199118 - DNA, 17 bp, Homo sapiens
ggagacagggtctttaa

SEQ ID NO: 9199119 - DNA, 22 bp, Homo sapiens
ggagctgaggacactacatttt

SEQ ID NO: 9199120 - DNA, 22 bp, Homo sapiens
ggagctgagagtagtccctttt

SEQ ID NO: 9199121 - DNA, 22 bp, Homo sapiens
ggaggtggaggttgcagtgagc

SEQ ID NO: 9199122 - DNA, 22 bp, Homo sapiens
ggcacacatggtggttggtgaa

SEQ ID NO: 9199123 - DNA, 22 bp, Homo sapiens
ggcacacaggcagatggagtgt

SEQ ID NO: 9199124 - DNA, 22 bp, Homo sapiens
ggcacacatagatctgcactgg

SEQ ID NO: 9199125 - DNA, 22 bp, Homo sapiens
ggcacacagatggagcactagc

SEQ ID NO: 9199126 - DNA, 22 bp, Homo sapiens
ggcacacagcttggcaggagat

SEQ ID NO: 9199127 - DNA, 22 bp, Homo sapiens
ggcacacagcggaatttgctct

SEQ ID NO: 9199128 - DNA, 22 bp, Homo sapiens
gggcggatcatttgaggtcagg

SEQ ID NO: 9199129 - DNA, 22 bp, Homo sapiens
gggcggatcacctgaggtcagg

SEQ ID NO: 9199130 - DNA, 22 bp, Homo sapiens
gggatgaggatcaatcagggag

SEQ ID NO: 9199131 - DNA, 22 bp, Homo sapiens
gggtgacattaggaagatagac

SEQ ID NO: 9199132 - DNA, 22 bp, Homo sapiens
ggcttcctggggcctcctgcaa

SEQ ID NO: 9199133 - DNA, 22 bp, Homo sapiens
ggcttcctggagaaggtctgag

SEQ ID NO: 9199134 - DNA, 22 bp, Homo sapiens
ggcttcctgggcatgtgttcta

SEQ ID NO: 9199135 - DNA, 22 bp, Homo sapiens
ggcttcctccttcctgctgtca

SEQ ID NO: 9199136 - DNA, 22 bp, Homo sapiens
ggcttcctatcccatctgagtg

SEQ ID NO: 9199137 - DNA, 18 bp, Homo sapiens
ggctgcctgttcctgaag

SEQ ID NO: 9199138 - DNA, 22 bp, Homo sapiens
ggctcagccccgtaacacagca

SEQ ID NO: 9199139 - DNA, 22 bp, Homo sapiens
gatgggcagcacagctggccaa

SEQ ID NO: 9199140 - DNA, 20 bp, Homo sapiens
gatgggaatcggagctggta

SEQ ID NO: 9199141 - DNA, 22 bp, Homo sapiens
gatggaatgaatggcagataca

SEQ ID NO: 9199142 - DNA, 22 bp, Homo sapiens
gatgggtactcgttggactgag

SEQ ID NO: 9199143 - DNA, 21 bp, Homo sapiens
gatttataagccttaagccta

SEQ ID NO: 9199144 - DNA, 22 bp, Homo sapiens
gatttatagtatgtgctttcag

SEQ ID NO: 9199145 - DNA, 22 bp, Homo sapiens
gatttataaaggttgcactgga

SEQ ID NO: 9199146 - DNA, 22 bp, Homo sapiens
gatgtttcccacactgtttccc

SEQ ID NO: 9199147 - DNA, 22 bp, Homo sapiens
gatgtttcatgctagcatgtgt

SEQ ID NO: 9199148 - DNA, 22 bp, Homo sapiens
gcacctgctggggctgatgaga

SEQ ID NO: 9199149 - DNA, 22 bp, Homo sapiens
gcacctgctggaatcagtctgt

SEQ ID NO: 9199150 - DNA, 22 bp, Homo sapiens
gcacctgcctgggactgaagat

SEQ ID NO: 9199151 - DNA, 22 bp, Homo sapiens
gattttgtcaaattccaaatgt

SEQ ID NO: 9199152 - DNA, 22 bp, Homo sapiens
gcaatagattatgatctacagt

SEQ ID NO: 9199153 - DNA, 22 bp, Homo sapiens
gcacaaaaggtacttcatgtag

SEQ ID NO: 9199154 - DNA, 22 bp, Homo sapiens
gcaattgctttagggaaaggta

SEQ ID NO: 9199155 - DNA, 22 bp, Homo sapiens
gcacaaaacacattttgacaat

SEQ ID NO: 9199156 - DNA, 21 bp, Homo sapiens
gattttaaagagactgccaca

SEQ ID NO: 9199157 - DNA, 22 bp, Homo sapiens
gattttaattataggaggtcct

SEQ ID NO: 9199158 - DNA, 22 bp, Homo sapiens
gcagcctctgcagttcaggagg

SEQ ID NO: 9199159 - DNA, 21 bp, Homo sapiens
gcaggggatagaaatggtctg

SEQ ID NO: 9199160 - DNA, 22 bp, Homo sapiens
gcaggctggaggctgttctggg

SEQ ID NO: 9199161 - DNA, 22 bp, Homo sapiens
gcaggctggggtagccccactt

SEQ ID NO: 9199162 - DNA, 21 bp, Homo sapiens
gcaggctggtcaaacctcagt

SEQ ID NO: 9199163 - DNA, 22 bp, Homo sapiens
gcaggctggtctgaccatccct

SEQ ID NO: 9199164 - DNA, 22 bp, Homo sapiens
gcaggctgctgagatccttagg

SEQ ID NO: 9199165 - DNA, 22 bp, Homo sapiens
gcaggctgccctcttgtgttga

SEQ ID NO: 9199166 - DNA, 22 bp, Homo sapiens
gcctgctttgtgcctgatcttt

SEQ ID NO: 9199167 - DNA, 22 bp, Homo sapiens
gcctgcctttgtatgaccctga

SEQ ID NO: 9199168 - DNA, 22 bp, Homo sapiens
gcctgcctgttggctgaggtgc

SEQ ID NO: 9199169 - DNA, 21 bp, Homo sapiens
gcctgcctgcgtgaccctctt

SEQ ID NO: 9199170 - DNA, 22 bp, Homo sapiens
gcctgcctcaaaatcccagttc

SEQ ID NO: 9199171 - DNA, 22 bp, Homo sapiens
gcctgcctgaaggctgtaccag

SEQ ID NO: 9199172 - DNA, 22 bp, Homo sapiens
gccatgttttggtaaataccat

SEQ ID NO: 9199173 - DNA, 21 bp, Homo sapiens
gccatttcacacagacatttg

SEQ ID NO: 9199174 - DNA, 22 bp, Homo sapiens
gctccagctcgtggctcccagc

SEQ ID NO: 9199175 - DNA, 22 bp, Homo sapiens
gctccagctccggctccgaagc

SEQ ID NO: 9199176 - DNA, 22 bp, Homo sapiens
gctccagctctgttctggggaa

SEQ ID NO: 9199177 - DNA, 22 bp, Homo sapiens
gctccagcacctagagcaggtc

SEQ ID NO: 9199178 - DNA, 22 bp, Homo sapiens
gctccagccacatggtagaagg

SEQ ID NO: 9199179 - DNA, 22 bp, Homo sapiens
gctcatgactgtaatcccagca

SEQ ID NO: 9199180 - DNA, 22 bp, Homo sapiens
gctgggatgcgtcttcccaggc

SEQ ID NO: 9199181 - DNA, 22 bp, Homo sapiens
gctgaggatatagcaggaacaa

SEQ ID NO: 9199182 - DNA, 20 bp, Homo sapiens
gctgaggattcctggcccct

SEQ ID NO: 9199183 - DNA, 22 bp, Homo sapiens
gatcatcatctttcaggcaagt

SEQ ID NO: 9199184 - DNA, 22 bp, Homo sapiens
gatcatcaagcaagaacctgat

SEQ ID NO: 9199185 - DNA, 22 bp, Homo sapiens
gatattttgagaaatcctatga

SEQ ID NO: 9199186 - DNA, 22 bp, Homo sapiens
gatatatgtaaaagtagacaga

SEQ ID NO: 9199187 - DNA, 22 bp, Homo sapiens
gatatttattaagtggttggta

SEQ ID NO: 9199188 - DNA, 22 bp, Homo sapiens
gatagtattacaggaaatcata

SEQ ID NO: 9199189 - DNA, 21 bp, Homo sapiens
gatacagagggccactgattg

SEQ ID NO: 9199190 - DNA, 22 bp, Homo sapiens
gatgatttgaggatttcatgag

SEQ ID NO: 9199191 - DNA, 22 bp, Homo sapiens
gatgacatctcaatttgttctt

SEQ ID NO: 9199192 - DNA, 22 bp, Homo sapiens
gatctgtttcaattgtcttagt

SEQ ID NO: 9199193 - DNA, 22 bp, Homo sapiens
gatgaaaaattgctgtgtcata

SEQ ID NO: 9199194 - DNA, 23 bp, Homo sapiens
gagtttcttccaggagccctggg

SEQ ID NO: 9199195 - DNA, 22 bp, Homo sapiens
gagtctgatgtcccccaggcca

SEQ ID NO: 9199196 - DNA, 22 bp, Homo sapiens
gagtgagggcagcaggggctgc

SEQ ID NO: 9199197 - DNA, 22 bp, Homo sapiens
gagtgcctggggcatctcctgc

SEQ ID NO: 9199198 - DNA, 21 bp, Homo sapiens
gagtgggacatgggagtggtt

SEQ ID NO: 9199199 - DNA, 22 bp, Homo sapiens
gagctggaagtctgtggtcaga

SEQ ID NO: 9199200 - DNA, 22 bp, Homo sapiens
gaggaaggtcccatcagaattt

SEQ ID NO: 9199201 - DNA, 22 bp, Homo sapiens
gaggaagggctgcctgccgggc

SEQ ID NO: 9199202 - DNA, 22 bp, Homo sapiens
gaggctgggggctgccttcctc

SEQ ID NO: 9199203 - DNA, 22 bp, Homo sapiens
gaggctgggaagtccaagacca

SEQ ID NO: 9199204 - DNA, 22 bp, Homo sapiens
gaggctggcagaaaagcacagg

SEQ ID NO: 9199205 - DNA, 22 bp, Homo sapiens
gaggctggaggtcaaagatgaa

SEQ ID NO: 9199206 - DNA, 22 bp, Homo sapiens
gaggtggggttttgttcttgaa

SEQ ID NO: 9199207 - DNA, 20 bp, Homo sapiens
gagtcacagaagaagctgaa

SEQ ID NO: 9199208 - DNA, 22 bp, Homo sapiens
ctttggcagcctctgctattga

SEQ ID NO: 9199209 - DNA, 22 bp, Homo sapiens
gaactgaagacttttactgtac

SEQ ID NO: 9199210 - DNA, 22 bp, Homo sapiens
gaacagaattaccgaagatctg

SEQ ID NO: 9199211 - DNA, 22 bp, Homo sapiens
gaaatacaaatgcctagatcct

SEQ ID NO: 9199212 - DNA, 22 bp, Homo sapiens
gaaaatacaaatagccttgaaa

SEQ ID NO: 9199213 - DNA, 21 bp, Homo sapiens
gaaaatacaatgagcttgacc

SEQ ID NO: 9199214 - DNA, 22 bp, Homo sapiens
gaaaatacttcagtgttctggc

SEQ ID NO: 9199215 - DNA, 18 bp, Homo sapiens
gaaaatactctgggctca

SEQ ID NO: 9199216 - DNA, 22 bp, Homo sapiens
ctttgttttactcagaggcatg

SEQ ID NO: 9199217 - DNA, 22 bp, Homo sapiens
gaagtggggaagcaacaggaga

SEQ ID NO: 9199218 - DNA, 22 bp, Homo sapiens
gaagggaaggaaagaaccagca

SEQ ID NO: 9199219 - DNA, 19 bp, Homo sapiens
gaaggctgaaatgaagcac

SEQ ID NO: 9199220 - DNA, 22 bp, Homo sapiens
gaaggaagtttattttagaaga

SEQ ID NO: 9199221 - DNA, 20 bp, Homo sapiens
gaaggaagggggcaaggtga

SEQ ID NO: 9199222 - DNA, 22 bp, Homo sapiens
gaaggaagtcattagtgcagac

SEQ ID NO: 9199223 - DNA, 22 bp, Homo sapiens
gaaggaagggctggctgtcttg

SEQ ID NO: 9199224 - DNA, 22 bp, Homo sapiens
gaaggaagccgtttctctccag

SEQ ID NO: 9199225 - DNA, 22 bp, Homo sapiens
gaaggaagctgtctggatgtgt

SEQ ID NO: 9199226 - DNA, 22 bp, Homo sapiens
gaaggagagggtcaaggataat

SEQ ID NO: 9199227 - DNA, 22 bp, Homo sapiens
gacaggaagtctgaaggaggga

SEQ ID NO: 9199228 - DNA, 22 bp, Homo sapiens
gacacagagataggcctgtgtt

SEQ ID NO: 9199229 - DNA, 22 bp, Homo sapiens
gaattctttaggtgaatttcta

SEQ ID NO: 9199230 - DNA, 22 bp, Homo sapiens
gaattcttttctttctgaaagt

SEQ ID NO: 9199231 - DNA, 22 bp, Homo sapiens
gaattcatcgtcttagctgcca

SEQ ID NO: 9199232 - DNA, 22 bp, Homo sapiens
gaattcagttatctaattcaag

SEQ ID NO: 9199233 - DNA, 22 bp, Homo sapiens
gaattcattagggaagctatct

SEQ ID NO: 9199234 - DNA, 17 bp, Homo sapiens
gagagctgctgcttccg

SEQ ID NO: 9199235 - DNA, 22 bp, Homo sapiens
gacttattcacgcagctatact

SEQ ID NO: 9199236 - DNA, 22 bp, Homo sapiens
tgtcatgtaacctttctgagcc

SEQ ID NO: 9199237 - DNA, 22 bp, Homo sapiens
tggtcccagcacaaaccttgct

SEQ ID NO: 9199238 - DNA, 22 bp, Homo sapiens
cctgccatgccagcatgcccgt

SEQ ID NO: 9199239 - DNA, 22 bp, Homo sapiens
cctgccatggtagacttccagg

SEQ ID NO: 9199240 - DNA, 22 bp, Homo sapiens
tgtctcttggattgcttgctct

SEQ ID NO: 9199241 - DNA, 22 bp, Homo sapiens
tgtctcttgagctgcctgatgc

SEQ ID NO: 9199242 - DNA, 22 bp, Homo sapiens
tgtctcttctgcctccagctgt

SEQ ID NO: 9199243 - DNA, 22 bp, Homo sapiens
tgtctcatctcttaaccccact

SEQ ID NO: 9199244 - DNA, 18 bp, Homo sapiens
tgtccatgttgttcctga

SEQ ID NO: 9199245 - DNA, 22 bp, Homo sapiens
tgtcctcatcttttccagaaat

SEQ ID NO: 9199246 - DNA, 22 bp, Homo sapiens
tgtgttcctctgcttcctcccc

SEQ ID NO: 9199247 - DNA, 22 bp, Homo sapiens
tgtgtgtatatgcatttatcta

SEQ ID NO: 9199248 - DNA, 22 bp, Homo sapiens
tgtgtgtataataatgtctgca

SEQ ID NO: 9199249 - DNA, 22 bp, Homo sapiens
tgtgtgtactctccagtcctga

SEQ ID NO: 9199250 - DNA, 22 bp, Homo sapiens
tgtgtgtatccattagaggcca

SEQ ID NO: 9199251 - DNA, 21 bp, Homo sapiens
tgtgtgtatgcacacacatgc

SEQ ID NO: 9199252 - DNA, 22 bp, Homo sapiens
cctctgtaatgattcactgaat

SEQ ID NO: 9199253 - DNA, 22 bp, Homo sapiens
cctctggtcccagctctgctgc

SEQ ID NO: 9199254 - DNA, 22 bp, Homo sapiens
cctctctgtgtggcctctccat

SEQ ID NO: 9199255 - DNA, 22 bp, Homo sapiens
cctcctctgggaagattcagag

SEQ ID NO: 9199256 - DNA, 22 bp, Homo sapiens
tggatctgactggcttttcttc

SEQ ID NO: 9199257 - DNA, 22 bp, Homo sapiens
ccctggagctagtctgagcaga

SEQ ID NO: 9199258 - DNA, 22 bp, Homo sapiens
ccctccagctcaaagcaaccgg

SEQ ID NO: 9199259 - DNA, 22 bp, Homo sapiens
ccctccaggcactgccctcttc

SEQ ID NO: 9199260 - DNA, 22 bp, Homo sapiens
tgctgaataaagatatattttc

SEQ ID NO: 9199261 - DNA, 22 bp, Homo sapiens
tgctcagtagagtttttggaat

SEQ ID NO: 9199262 - DNA, 22 bp, Homo sapiens
cccaggctcctgactcattcta

SEQ ID NO: 9199263 - DNA, 22 bp, Homo sapiens
cccaggctcctactgtattctg

SEQ ID NO: 9199264 - DNA, 23 bp, Homo sapiens
tgctggagacaagtgtgagaagg

SEQ ID NO: 9199265 - DNA, 22 bp, Homo sapiens
tgctggagacatagcaggcagc

SEQ ID NO: 9199266 - DNA, 22 bp, Homo sapiens
tgctggagactcactcaggtgc

SEQ ID NO: 9199267 - DNA, 22 bp, Homo sapiens
tgctggagacctgcttgcacca

SEQ ID NO: 9199268 - DNA, 22 bp, Homo sapiens
tgctggagagccttggccaagg

SEQ ID NO: 9199269 - DNA, 22 bp, Homo sapiens
tgctggagagctagttctgcag

SEQ ID NO: 9199270 - DNA, 22 bp, Homo sapiens
tgctggagatgaaagggccctg

SEQ ID NO: 9199271 - DNA, 22 bp, Homo sapiens
tgctggagcaacattattgtgc

SEQ ID NO: 9199272 - DNA, 22 bp, Homo sapiens
tgctggagcatctgagagcatc

SEQ ID NO: 9199273 - DNA, 19 bp, Homo sapiens
tgcctgctcctggcttcca

SEQ ID NO: 9199274 - DNA, 22 bp, Homo sapiens
ctgaagaggacgcagcagcaag

SEQ ID NO: 9199275 - DNA, 22 bp, Homo sapiens
ctctttttcagccttaccaaag

SEQ ID NO: 9199276 - DNA, 22 bp, Homo sapiens
ctgcctcctcacgtccacagtg

SEQ ID NO: 9199277 - DNA, 22 bp, Homo sapiens
ctgccatctgagccaaaagtgc

SEQ ID NO: 9199278 - DNA, 22 bp, Homo sapiens
ctgatgttcatttcttttgtac

SEQ ID NO: 9199279 - DNA, 22 bp, Homo sapiens
ctgatcctcctttaagtagctg

SEQ ID NO: 9199280 - DNA, 22 bp, Homo sapiens
ctgatctgtcctcctcagagcc

SEQ ID NO: 9199281 - DNA, 22 bp, Homo sapiens
ctgattctttcttcttgccagg

SEQ ID NO: 9199282 - DNA, 22 bp, Homo sapiens
ctgattttcaaaatgtgttaaa

SEQ ID NO: 9199283 - DNA, 22 bp, Homo sapiens
ctgattgtagctcacactattt

SEQ ID NO: 9199284 - DNA, 22 bp, Homo sapiens
ctggagtgttatggtcaagtca

SEQ ID NO: 9199285 - DNA, 20 bp, Homo sapiens
ctggagtctaggagtactgg

SEQ ID NO: 9199286 - DNA, 22 bp, Homo sapiens
ctggagtagccggacgggtctg

SEQ ID NO: 9199287 - DNA, 22 bp, Homo sapiens
ctggagtcctgcatttgctctt

SEQ ID NO: 9199288 - DNA, 22 bp, Homo sapiens
ctgcttctaagaacctgcagct

SEQ ID NO: 9199289 - DNA, 19 bp, Homo sapiens
ctggaatgtggctggtgca

SEQ ID NO: 9199290 - DNA, 22 bp, Homo sapiens
ttgtttcatggggatgtttatt

SEQ ID NO: 9199291 - DNA, 22 bp, Homo sapiens
ttgtttcagctgtatgctatgt

SEQ ID NO: 9199292 - DNA, 22 bp, Homo sapiens
ctccagtcatagtctgtcttgt

SEQ ID NO: 9199293 - DNA, 22 bp, Homo sapiens
ctccagtcctagtctcttgctt

SEQ ID NO: 9199294 - DNA, 22 bp, Homo sapiens
ctccagtctaggtcctacttat

SEQ ID NO: 9199295 - DNA, 22 bp, Homo sapiens
ttgttaaaaatagatttccagg

SEQ ID NO: 9199296 - DNA, 22 bp, Homo sapiens
ctcatccaccctcaacaaagat

SEQ ID NO: 9199297 - DNA, 22 bp, Homo sapiens
ctcatccaccctcactaggaaa

SEQ ID NO: 9199298 - DNA, 22 bp, Homo sapiens
ctcataaagtgagaatatgacc

SEQ ID NO: 9199299 - DNA, 22 bp, Homo sapiens
ctcataatgtgactgtatttga

SEQ ID NO: 9199300 - DNA, 20 bp, Homo sapiens
ctcatctctgagcctcctgg

SEQ ID NO: 9199301 - DNA, 22 bp, Homo sapiens
ctcatccatgtcgtaacatatg

SEQ ID NO: 9199302 - DNA, 22 bp, Homo sapiens
ctcatccagtcaagcttttaga

SEQ ID NO: 9199303 - DNA, 22 bp, Homo sapiens
ctcatccacgtgcttttctagt

SEQ ID NO: 9199304 - DNA, 22 bp, Homo sapiens
ctcatccatgaccgtgtttccc

SEQ ID NO: 9199305 - DNA, 22 bp, Homo sapiens
ctcatccaccgcagcccctcag

SEQ ID NO: 9199306 - DNA, 22 bp, Homo sapiens
tttcagttcagtttattatatc

SEQ ID NO: 9199307 - DNA, 22 bp, Homo sapiens
tttcagttgtcctgttaatagc

SEQ ID NO: 9199308 - DNA, 22 bp, Homo sapiens
ctctcctcagaacaggccctct

SEQ ID NO: 9199309 - DNA, 22 bp, Homo sapiens
ctctcctccaggaactcacagt

SEQ ID NO: 9199310 - DNA, 23 bp, Homo sapiens
ctctccccctttgatgttagctc

SEQ ID NO: 9199311 - DNA, 22 bp, Homo sapiens
tttacatgtaatgttatacaaa

SEQ ID NO: 9199312 - DNA, 22 bp, Homo sapiens
tttacatgtccttcaagagcag

SEQ ID NO: 9199313 - DNA, 22 bp, Homo sapiens
tttacatgtccttcaagagcag

SEQ ID NO: 9199314 - DNA, 22 bp, Homo sapiens
tttacatgtcaagactggcagt

SEQ ID NO: 9199315 - DNA, 22 bp, Homo sapiens
tttacatgagtagcagatgttc

SEQ ID NO: 9199316 - DNA, 22 bp, Homo sapiens
tttaacactagtttctttaact

SEQ ID NO: 9199317 - DNA, 22 bp, Homo sapiens
tttaacactcagtttaatagcc

SEQ ID NO: 9199318 - DNA, 22 bp, Homo sapiens
ctcctgacacagtccacacttg

SEQ ID NO: 9199319 - DNA, 22 bp, Homo sapiens
ctcctgacttgtgagcccctcc

SEQ ID NO: 9199320 - DNA, 22 bp, Homo sapiens
tttagacatctataattgctaa

SEQ ID NO: 9199321 - DNA, 22 bp, Homo sapiens
ttccttttagaatcatgaagac

SEQ ID NO: 9199322 - DNA, 22 bp, Homo sapiens
ttcctttctctggactgcagcc

SEQ ID NO: 9199323 - DNA, 22 bp, Homo sapiens
ttccttctaatattctgcctgt

SEQ ID NO: 9199324 - DNA, 22 bp, Homo sapiens
ctaggcatgtgaggaattctaa

SEQ ID NO: 9199325 - DNA, 22 bp, Homo sapiens
ttctgtcaaagactttttcagg

SEQ ID NO: 9199326 - DNA, 22 bp, Homo sapiens
ctattttaacttgattacctct

SEQ ID NO: 9199327 - DNA, 22 bp, Homo sapiens
ttcttcctcacactctcaccca

SEQ ID NO: 9199328 - DNA, 22 bp, Homo sapiens
ctatttatgtgctattttgtat

SEQ ID NO: 9199329 - DNA, 22 bp, Homo sapiens
ctattcaattttgctattgtag

SEQ ID NO: 9199330 - DNA, 22 bp, Homo sapiens
ctatttcattgtgctgagtctg

SEQ ID NO: 9199331 - DNA, 22 bp, Homo sapiens
ctatttcaaggcccagatatga

SEQ ID NO: 9199332 - DNA, 22 bp, Homo sapiens
ctatttcagcagaagccggaga

SEQ ID NO: 9199333 - DNA, 22 bp, Homo sapiens
ctcagcaggtaccacatgatct

SEQ ID NO: 9199334 - DNA, 22 bp, Homo sapiens
ttgacttttcttggtcacatga

SEQ ID NO: 9199335 - DNA, 22 bp, Homo sapiens
ttgacctatgtttcttcatctg

SEQ ID NO: 9199336 - DNA, 22 bp, Homo sapiens
ttgagtttacattgtattagcc

SEQ ID NO: 9199337 - DNA, 22 bp, Homo sapiens
ttgataaaatgatgaaatcact

SEQ ID NO: 9199338 - DNA, 18 bp, Homo sapiens
ttgataaacaatttcatt

SEQ ID NO: 9199339 - DNA, 22 bp, Homo sapiens
ttcccacagtgactccagagaa

SEQ ID NO: 9199340 - DNA, 22 bp, Homo sapiens
ttccaaaggaatggggagctat

SEQ ID NO: 9199341 - DNA, 22 bp, Homo sapiens
ttccaaatgcccatctacacag

SEQ ID NO: 9199342 - DNA, 22 bp, Homo sapiens
ttccaaatgttggacaactgta

SEQ ID NO: 9199343 - DNA, 22 bp, Homo sapiens
ttccttcccctagctgagaaac

SEQ ID NO: 9199344 - DNA, 22 bp, Homo sapiens
ttccttccatagcaaaacatgc

SEQ ID NO: 9199345 - DNA, 22 bp, Homo sapiens
ttccttccctcagtggctgaag

SEQ ID NO: 9199346 - DNA, 22 bp, Homo sapiens
ttccttccacttcaggattttg

SEQ ID NO: 9199347 - DNA, 22 bp, Homo sapiens
ttccttccagcttgtgacagtc

SEQ ID NO: 9199348 - DNA, 22 bp, Homo sapiens
ttccttccgggcaccaggcact

SEQ ID NO: 9199349 - DNA, 22 bp, Homo sapiens
ttccttcctcctccagttctgg

SEQ ID NO: 9199350 - DNA, 22 bp, Homo sapiens
ttccttcctctttcacaacagc

SEQ ID NO: 9199351 - DNA, 22 bp, Homo sapiens
ttccttcctggggatttatcat

SEQ ID NO: 9199352 - DNA, 22 bp, Homo sapiens
ttccttcctgtcttccttactg

SEQ ID NO: 9199353 - DNA, 22 bp, Homo sapiens
ctaatttttgttctgcattgaa

SEQ ID NO: 9199354 - DNA, 22 bp, Homo sapiens
ctaatttaatgaatgagtctta

SEQ ID NO: 9199355 - DNA, 22 bp, Homo sapiens
ctaattttcccaaggccttcta

SEQ ID NO: 9199356 - DNA, 22 bp, Homo sapiens
ttcattcttgggatcagagagt

SEQ ID NO: 9199357 - DNA, 22 bp, Homo sapiens
gtttgtaaccagaacagagagt

SEQ ID NO: 9199358 - DNA, 22 bp, Homo sapiens
caggaaggaaagggtgtggaga

SEQ ID NO: 9199359 - DNA, 22 bp, Homo sapiens
caggaaggaaagggtgtggaga

SEQ ID NO: 9199360 - DNA, 22 bp, Homo sapiens
caggcagactttgagaatgatg

SEQ ID NO: 9199361 - DNA, 22 bp, Homo sapiens
taatttacagttcgccatgtct

SEQ ID NO: 9199362 - DNA, 22 bp, Homo sapiens
taatttactcagatgttcaatc

SEQ ID NO: 9199363 - DNA, 22 bp, Homo sapiens
taattgtatggagaaggctgca

SEQ ID NO: 9199364 - DNA, 21 bp, Homo sapiens
tacatcagttttcttggctca

SEQ ID NO: 9199365 - DNA, 22 bp, Homo sapiens
tacatcaagataaaaactgtca

SEQ ID NO: 9199366 - DNA, 22 bp, Homo sapiens
tacatgtgataaattgattaaa

SEQ ID NO: 9199367 - DNA, 22 bp, Homo sapiens
tacagtaaagctgctatgaatt

SEQ ID NO: 9199368 - DNA, 19 bp, Homo sapiens
caggccctggacccatctg

SEQ ID NO: 9199369 - DNA, 22 bp, Homo sapiens
tacaaatgaaccaactttgatg

SEQ ID NO: 9199370 - DNA, 22 bp, Homo sapiens
taacatttaaatttttcacata

SEQ ID NO: 9199371 - DNA, 22 bp, Homo sapiens
taacattgtcagttcaactgct

SEQ ID NO: 9199372 - DNA, 22 bp, Homo sapiens
caggatggtcttcatttggctc

SEQ ID NO: 9199373 - DNA, 22 bp, Homo sapiens
taagaaacatttttatgacagt

SEQ ID NO: 9199374 - DNA, 22 bp, Homo sapiens
taacatttcggtgacagtggga

SEQ ID NO: 9199375 - DNA, 22 bp, Homo sapiens
gttcctcacgtggacagatgat

SEQ ID NO: 9199376 - DNA, 22 bp, Homo sapiens
gttcctcagcccttacttagcc

SEQ ID NO: 9199377 - DNA, 22 bp, Homo sapiens
gttcctcaaaaaggagagcccc

SEQ ID NO: 9199378 - DNA, 22 bp, Homo sapiens
gttcctcatgagtaccccttaa

SEQ ID NO: 9199379 - DNA, 22 bp, Homo sapiens
gttcctcatccagtcatgacta

SEQ ID NO: 9199380 - DNA, 22 bp, Homo sapiens
gttcacagtctacatagtaaag

SEQ ID NO: 9199381 - DNA, 22 bp, Homo sapiens
gttcacagtctacatagtaaag

SEQ ID NO: 9199382 - DNA, 22 bp, Homo sapiens
gttcacagcttcttaggtcata

SEQ ID NO: 9199383 - DNA, 22 bp, Homo sapiens
gtttcctgtttctcagcagccc

SEQ ID NO: 9199384 - DNA, 22 bp, Homo sapiens
gtttgcttttttgaatcaggag

SEQ ID NO: 9199385 - DNA, 22 bp, Homo sapiens
gtttcctaggcttatacagctg

SEQ ID NO: 9199386 - DNA, 22 bp, Homo sapiens
gtttcaaaagtcaggctattct

SEQ ID NO: 9199387 - DNA, 22 bp, Homo sapiens
gtttacattaagtattagcatc

SEQ ID NO: 9199388 - DNA, 22 bp, Homo sapiens
gtgggaagtctctcggaggaag

SEQ ID NO: 9199389 - DNA, 22 bp, Homo sapiens
gtgggacagtcagaagtgagca

SEQ ID NO: 9199390 - DNA, 22 bp, Homo sapiens
gtgtgctattctcttatattca

SEQ ID NO: 9199391 - DNA, 22 bp, Homo sapiens
gtgtgctagctgcttcacacag

SEQ ID NO: 9199392 - DNA, 17 bp, Homo sapiens
gtgtgctactatcattt

SEQ ID NO: 9199393 - DNA, 22 bp, Homo sapiens
cagctgctgtaacagaatactt

SEQ ID NO: 9199394 - DNA, 22 bp, Homo sapiens
gtggggcagtggcctgggagca

SEQ ID NO: 9199395 - DNA, 23 bp, Homo sapiens
ccaaagtcgaagtctagtccaga

SEQ ID NO: 9199396 - DNA, 22 bp, Homo sapiens
ccaaagtcagtgctcagtcgtc

SEQ ID NO: 9199397 - DNA, 22 bp, Homo sapiens
tccctgcctctcagacttcctt

SEQ ID NO: 9199398 - DNA, 22 bp, Homo sapiens
catttgcatatgaagaagtaag

SEQ ID NO: 9199399 - DNA, 23 bp, Homo sapiens
catttgatcctcacaataaatgg

SEQ ID NO: 9199400 - DNA, 22 bp, Homo sapiens
catttatataaaatgtccagaa

SEQ ID NO: 9199401 - DNA, 22 bp, Homo sapiens
ccaaatgctccactgactttgg

SEQ ID NO: 9199402 - DNA, 18 bp, Homo sapiens
ccacagcagagttcttac

SEQ ID NO: 9199403 - DNA, 22 bp, Homo sapiens
ccagatagcaggtcagaagtgc

SEQ ID NO: 9199404 - DNA, 22 bp, Homo sapiens
ccagatgagaccacactgctgg

SEQ ID NO: 9199405 - DNA, 22 bp, Homo sapiens
tctcccacagccgtgcttcaag

SEQ ID NO: 9199406 - DNA, 22 bp, Homo sapiens
ccagaatttggatcatgatttt

SEQ ID NO: 9199407 - DNA, 16 bp, Homo sapiens
ccacctgcagctctca

SEQ ID NO: 9199408 - DNA, 22 bp, Homo sapiens
ccactgccgatgttccatcttg

SEQ ID NO: 9199409 - DNA, 22 bp, Homo sapiens
ccagaatgtgtgaaatttgatg

SEQ ID NO: 9199410 - DNA, 22 bp, Homo sapiens
tctgtctgtagttttacatgat

SEQ ID NO: 9199411 - DNA, 23 bp, Homo sapiens
tctgtctgtgtatgtgcagaaag

SEQ ID NO: 9199412 - DNA, 22 bp, Homo sapiens
tctgtcttcttcattgcctata

SEQ ID NO: 9199413 - DNA, 17 bp, Homo sapiens
tctgtcttgactgtcac

SEQ ID NO: 9199414 - DNA, 22 bp, Homo sapiens
ccaggaagcataatgtagtggg

SEQ ID NO: 9199415 - DNA, 22 bp, Homo sapiens
tctgcctcctgcttgtcccgac

SEQ ID NO: 9199416 - DNA, 22 bp, Homo sapiens
ccagctctagccccatgtggct

SEQ ID NO: 9199417 - DNA, 22 bp, Homo sapiens
ccagctctcaaggctccctggg

SEQ ID NO: 9199418 - DNA, 22 bp, Homo sapiens
tctgagttcataccaggctacc

SEQ ID NO: 9199419 - DNA, 22 bp, Homo sapiens
tctgagtttttgcagctgctgt

SEQ ID NO: 9199420 - DNA, 22 bp, Homo sapiens
ccagcctcatcatattcctgct

SEQ ID NO: 9199421 - DNA, 22 bp, Homo sapiens
ccagccctacagtatcacctgt

SEQ ID NO: 9199422 - DNA, 21 bp, Homo sapiens
ccagcccagcctccttctctt

SEQ ID NO: 9199423 - DNA, 22 bp, Homo sapiens
ccagcccctatcctcgctccac

SEQ ID NO: 9199424 - DNA, 22 bp, Homo sapiens
tctcttaataagtaaatactga

SEQ ID NO: 9199425 - DNA, 22 bp, Homo sapiens
cagtctcctgggggctgttgtt

SEQ ID NO: 9199426 - DNA, 22 bp, Homo sapiens
cagtctccgccagctcctcaca

SEQ ID NO: 9199427 - DNA, 22 bp, Homo sapiens
tatttagaacagacaatagaaa

SEQ ID NO: 9199428 - DNA, 19 bp, Homo sapiens
tatttacttcttgattgca

SEQ ID NO: 9199429 - DNA, 22 bp, Homo sapiens
tatttacttttaaattgagaac

SEQ ID NO: 9199430 - DNA, 22 bp, Homo sapiens
tcactcagcattcactgggcct

SEQ ID NO: 9199431 - DNA, 22 bp, Homo sapiens
tcactccatagcttaactcttt

SEQ ID NO: 9199432 - DNA, 22 bp, Homo sapiens
tcacttcccagacggggtggca

SEQ ID NO: 9199433 - DNA, 22 bp, Homo sapiens
tcactccatctttgctactggt

SEQ ID NO: 9199434 - DNA, 22 bp, Homo sapiens
tcagaaatgatcgttattcatt

SEQ ID NO: 9199435 - DNA, 22 bp, Homo sapiens
tcagaaatacaaaacacttact

SEQ ID NO: 9199436 - DNA, 22 bp, Homo sapiens
tcagaaattttctcagtagttc

SEQ ID NO: 9199437 - DNA, 22 bp, Homo sapiens
tatgcacagaagtttgctgaat

SEQ ID NO: 9199438 - DNA, 22 bp, Homo sapiens
tatgcacagttacaagaatatc

SEQ ID NO: 9199439 - DNA, 17 bp, Homo sapiens
tatctcatacaattata

SEQ ID NO: 9199440 - DNA, 22 bp, Homo sapiens
tatgtgcttaatacatggtgtt

SEQ ID NO: 9199441 - DNA, 22 bp, Homo sapiens
tatgtgctttgcactgtgctat

SEQ ID NO: 9199442 - DNA, 22 bp, Homo sapiens
tatgtgctgccaccagggagag

SEQ ID NO: 9199443 - DNA, 22 bp, Homo sapiens
tatgtgctgaagtctttacacc

SEQ ID NO: 9199444 - DNA, 22 bp, Homo sapiens
tatgtgctatcaaatgctcatt

SEQ ID NO: 9199445 - DNA, 22 bp, Homo sapiens
tatgtgctaaacaccttccata

SEQ ID NO: 9199446 - DNA, 22 bp, Homo sapiens
tatgtgctaagctccagatcag

SEQ ID NO: 9199447 - DNA, 22 bp, Homo sapiens
tatgtgtaatcatatctgatac

SEQ ID NO: 9199448 - DNA, 22 bp, Homo sapiens
tatgtgtaatcaaacacatgct

SEQ ID NO: 9199449 - DNA, 22 bp, Homo sapiens
tatgtgtatgtacatacataca

SEQ ID NO: 9199450 - DNA, 22 bp, Homo sapiens
tatgtgtatgttcattcatgca

SEQ ID NO: 9199451 - DNA, 22 bp, Homo sapiens
tatgtgtattgagcattgttac

SEQ ID NO: 9199452 - DNA, 22 bp, Homo sapiens
tatctattatgttctatgtgtc

SEQ ID NO: 9199453 - DNA, 22 bp, Homo sapiens
tataagaaacaaggcaaatttt

SEQ ID NO: 9199454 - DNA, 22 bp, Homo sapiens
tataagaaattgccaacctgtt

SEQ ID NO: 9199455 - DNA, 22 bp, Homo sapiens
tataagaagtgaagaagagtta

SEQ ID NO: 9199456 - DNA, 19 bp, Homo sapiens
catgtgcatgagcacagga

SEQ ID NO: 9199457 - DNA, 22 bp, Homo sapiens
catgtgcagtgtaagacatgct

SEQ ID NO: 9199458 - DNA, 23 bp, Homo sapiens
catgtctgctttcatgctacaac

SEQ ID NO: 9199459 - DNA, 20 bp, Homo sapiens
tccagcccagcagcctgaca

SEQ ID NO: 9199460 - DNA, 18 bp, Homo sapiens
tccagcccacattttctg

SEQ ID NO: 9199461 - DNA, 22 bp, Homo sapiens
tccagcccagctcctctcagaa

SEQ ID NO: 9199462 - DNA, 22 bp, Homo sapiens
tcattttcacacataaatagca

SEQ ID NO: 9199463 - DNA, 22 bp, Homo sapiens
catccccagagcagttccacta

SEQ ID NO: 9199464 - DNA, 22 bp, Homo sapiens
catccccaattagcgcccagct

SEQ ID NO: 9199465 - DNA, 22 bp, Homo sapiens
catgatttactaaaatttgttt

SEQ ID NO: 9199466 - DNA, 22 bp, Homo sapiens
tcatgtaaagtgtaggtttaga

SEQ ID NO: 9199467 - DNA, 22 bp, Homo sapiens
tcatgtaagagcttttgtgtca

SEQ ID NO: 9199468 - DNA, 18 bp, Homo sapiens
tcatgtcactgtgctccc

SEQ ID NO: 9199469 - DNA, 22 bp, Homo sapiens
catgatacttgaatttggaagg

SEQ ID NO: 9199470 - DNA, 22 bp, Homo sapiens
catgatcagaaagagaagctag

SEQ ID NO: 9199471 - DNA, 22 bp, Homo sapiens
catgatcaccacttgacagccc

SEQ ID NO: 9199472 - DNA, 20 bp, Homo sapiens
tctgacccagagcccaggct

SEQ ID NO: 9199473 - DNA, 22 bp, Homo sapiens
tctgacccgtggctctgcctcc

SEQ ID NO: 9199474 - DNA, 22 bp, Homo sapiens
tctgaccctcagatcatgtcca

SEQ ID NO: 9199475 - DNA, 23 bp, Homo sapiens
tctgagagaacaatgcctcctat

SEQ ID NO: 9199476 - DNA, 22 bp, Homo sapiens
tctgaggctaagagacagaggc

SEQ ID NO: 9199477 - DNA, 22 bp, Homo sapiens
tctgcaaaagtgttcataaaga

SEQ ID NO: 9199478 - DNA, 22 bp, Homo sapiens
tctgatgagggaaagtcttatg

SEQ ID NO: 9199479 - DNA, 21 bp, Homo sapiens
tctgatggtagatgagatgtg

SEQ ID NO: 9199480 - DNA, 22 bp, Homo sapiens
tctgcctgctaactcctgcacc

SEQ ID NO: 9199481 - DNA, 22 bp, Homo sapiens
tctgccatcttacatggtcact

SEQ ID NO: 9199482 - DNA, 22 bp, Homo sapiens
tctgcatgatgaacaaatgagc

SEQ ID NO: 9199483 - DNA, 22 bp, Homo sapiens
tctgcaggtagagctcaggaat

SEQ ID NO: 9199484 - DNA, 22 bp, Homo sapiens
tctgcagggtcccagcctcagc

SEQ ID NO: 9199485 - DNA, 22 bp, Homo sapiens
tctgcaggctgtacaggaagca

SEQ ID NO: 9199486 - DNA, 22 bp, Homo sapiens
tctgcaggatggatgctcagaa

SEQ ID NO: 9199487 - DNA, 22 bp, Homo sapiens
tctgcaggatcagagccagagg

SEQ ID NO: 9199488 - DNA, 22 bp, Homo sapiens
tctgcagctttcccctgattta

SEQ ID NO: 9199489 - DNA, 22 bp, Homo sapiens
tctgcactcctgtttcacctgg

SEQ ID NO: 9199490 - DNA, 22 bp, Homo sapiens
tctgcactgggagcatgtctgg

SEQ ID NO: 9199491 - DNA, 20 bp, Homo sapiens
tctgcactcctgcatgtgcc

SEQ ID NO: 9199492 - DNA, 22 bp, Homo sapiens
tctgggccctaaaccagctcta

SEQ ID NO: 9199493 - DNA, 22 bp, Homo sapiens
tctgggaggtaaccatgctgat

SEQ ID NO: 9199494 - DNA, 22 bp, Homo sapiens
tctggctccacacctcactgca

SEQ ID NO: 9199495 - DNA, 22 bp, Homo sapiens
tctgggaactctgtcatttccc

SEQ ID NO: 9199496 - DNA, 22 bp, Homo sapiens
tctttaattgtggaagagcagc

SEQ ID NO: 9199497 - DNA, 22 bp, Homo sapiens
tcttgattcatgttccctgcat

SEQ ID NO: 9199498 - DNA, 22 bp, Homo sapiens
tctttccaaggactctgtagca

SEQ ID NO: 9199499 - DNA, 22 bp, Homo sapiens
tctttctagtggcctctattct

SEQ ID NO: 9199500 - DNA, 22 bp, Homo sapiens
tctttcctgtaactgctgttca

SEQ ID NO: 9199501 - DNA, 22 bp, Homo sapiens
tctttctacatcatttgcttct

SEQ ID NO: 9199502 - DNA, 22 bp, Homo sapiens
tctttccttagaataattcttt

SEQ ID NO: 9199503 - DNA, 22 bp, Homo sapiens
tctttcctctgagctcctgtag

SEQ ID NO: 9199504 - DNA, 17 bp, Homo sapiens
tctttcctgccatgctc

SEQ ID NO: 9199505 - DNA, 21 bp, Homo sapiens
tctttcctgcccagttgccct

SEQ ID NO: 9199506 - DNA, 22 bp, Homo sapiens
tcttccaggagggcatttcttt

SEQ ID NO: 9199507 - DNA, 22 bp, Homo sapiens
tcttccttgctccttgtcactt

SEQ ID NO: 9199508 - DNA, 22 bp, Homo sapiens
tcttccttgccttgcttcatca

SEQ ID NO: 9199509 - DNA, 22 bp, Homo sapiens
tcttcctttcattcatgtgtta

SEQ ID NO: 9199510 - DNA, 22 bp, Homo sapiens
tcttccttgtaagggctttaga

SEQ ID NO: 9199511 - DNA, 16 bp, Homo sapiens
tcttccttttgatttt

SEQ ID NO: 9199512 - DNA, 22 bp, Homo sapiens
tcttccttttgtaccttctgaa

SEQ ID NO: 9199513 - DNA, 22 bp, Homo sapiens
tcttccttctttgatgacaagg

SEQ ID NO: 9199514 - DNA, 22 bp, Homo sapiens
tcttccttcgcccttgctgttt

SEQ ID NO: 9199515 - DNA, 22 bp, Homo sapiens
tcttccttaaatgtttggtaga

SEQ ID NO: 9199516 - DNA, 22 bp, Homo sapiens
tcttctgtgatctatgtgtttt

SEQ ID NO: 9199517 - DNA, 22 bp, Homo sapiens
tcttcacaccgggcagcaggaa

SEQ ID NO: 9199518 - DNA, 22 bp, Homo sapiens
tcttcacagatgcatatacttc

SEQ ID NO: 9199519 - DNA, 22 bp, Homo sapiens
tcttccaatggtttctagattt

SEQ ID NO: 9199520 - DNA, 22 bp, Homo sapiens
tcttccagaatgcattctcttt

SEQ ID NO: 9199521 - DNA, 22 bp, Homo sapiens
tcttccagaagtgttttcagaa

SEQ ID NO: 9199522 - DNA, 20 bp, Homo sapiens
tcttccagagacattttccc

SEQ ID NO: 9199523 - DNA, 22 bp, Homo sapiens
tcttccagctcatattctatca

SEQ ID NO: 9199524 - DNA, 22 bp, Homo sapiens
tctgtctgagggagtgacattt

SEQ ID NO: 9199525 - DNA, 22 bp, Homo sapiens
tctgtctgagtggtgttagagt

SEQ ID NO: 9199526 - DNA, 22 bp, Homo sapiens
tctgtgtgcccacctgacacct

SEQ ID NO: 9199527 - DNA, 22 bp, Homo sapiens
tcttaggtgactctccaggcca

SEQ ID NO: 9199528 - DNA, 22 bp, Homo sapiens
tcttagatgttagctctgtgtg

SEQ ID NO: 9199529 - DNA, 22 bp, Homo sapiens
tcttaaagcttacttcaattgt

SEQ ID NO: 9199530 - DNA, 22 bp, Homo sapiens
tctgtttttgaggctatcttct

SEQ ID NO: 9199531 - DNA, 22 bp, Homo sapiens
tctgtaaaacttctttgtaaat

SEQ ID NO: 9199532 - DNA, 22 bp, Homo sapiens
tctgtaaaattagtataattgt

SEQ ID NO: 9199533 - DNA, 22 bp, Homo sapiens
tctgtaatcccagctactcagg

SEQ ID NO: 9199534 - DNA, 22 bp, Homo sapiens
tctgtaatcttccccagctcag

SEQ ID NO: 9199535 - DNA, 22 bp, Homo sapiens
tctgtaaatctactaagagctc

SEQ ID NO: 9199536 - DNA, 22 bp, Homo sapiens
tctgtagtctctgatatatctg

SEQ ID NO: 9199537 - DNA, 22 bp, Homo sapiens
tctgtagtaggttgtagttctt

SEQ ID NO: 9199538 - DNA, 22 bp, Homo sapiens
tctgtagtatggtacttattta

SEQ ID NO: 9199539 - DNA, 22 bp, Homo sapiens
tctaggccgtaggatacagagc

SEQ ID NO: 9199540 - DNA, 22 bp, Homo sapiens
tctatgttagagatacatccta

SEQ ID NO: 9199541 - DNA, 22 bp, Homo sapiens
tctatgttggtccatattatgg

SEQ ID NO: 9199542 - DNA, 22 bp, Homo sapiens
tctattttatactcaaatcttc

SEQ ID NO: 9199543 - DNA, 22 bp, Homo sapiens
tctattcattcaatttagctct

SEQ ID NO: 9199544 - DNA, 22 bp, Homo sapiens
tctattttgtttccagctctac

SEQ ID NO: 9199545 - DNA, 22 bp, Homo sapiens
tctcacagcattatccagggca

SEQ ID NO: 9199546 - DNA, 19 bp, Homo sapiens
tctcacaagcaacattgtt

SEQ ID NO: 9199547 - DNA, 22 bp, Homo sapiens
tctaaagtcatgtccctgaagt

SEQ ID NO: 9199548 - DNA, 22 bp, Homo sapiens
tccttcctggggtctctgctgc

SEQ ID NO: 9199549 - DNA, 22 bp, Homo sapiens
tccttccttcctgaaattttag

SEQ ID NO: 9199550 - DNA, 23 bp, Homo sapiens
tccttcctttgagaggctccatc

SEQ ID NO: 9199551 - DNA, 21 bp, Homo sapiens
tccttccttgaggtcctttcc

SEQ ID NO: 9199552 - DNA, 22 bp, Homo sapiens
tccttctgaaaaatgcacacga

SEQ ID NO: 9199553 - DNA, 22 bp, Homo sapiens
tccttctgtagtccctgtccct

SEQ ID NO: 9199554 - DNA, 22 bp, Homo sapiens
tccttcttccctggtttgcatc

SEQ ID NO: 9199555 - DNA, 23 bp, Homo sapiens
tccttcaagttaggaagtgaaca

SEQ ID NO: 9199556 - DNA, 22 bp, Homo sapiens
tccttacagaaagcagtagaca

SEQ ID NO: 9199557 - DNA, 22 bp, Homo sapiens
tccttacatagtgctgaaatat

SEQ ID NO: 9199558 - DNA, 22 bp, Homo sapiens
tccttacatagtgctgaaatat

SEQ ID NO: 9199559 - DNA, 22 bp, Homo sapiens
tccttcaaagctcctagtgagc

SEQ ID NO: 9199560 - DNA, 22 bp, Homo sapiens
tcgaaggaggcactcagacatg

SEQ ID NO: 9199561 - DNA, 21 bp, Homo sapiens
tccttttcaatcgggcccttt

SEQ ID NO: 9199562 - DNA, 22 bp, Homo sapiens
tcctttctccttccgacttcat

SEQ ID NO: 9199563 - DNA, 22 bp, Homo sapiens
tcctttcttcttctgcccatgg

SEQ ID NO: 9199564 - DNA, 22 bp, Homo sapiens
tcctttctccagctggcattgt

SEQ ID NO: 9199565 - DNA, 22 bp, Homo sapiens
tctaaagatttggattcatttg

SEQ ID NO: 9199566 - DNA, 22 bp, Homo sapiens
tctaaagtactactactgttgg

SEQ ID NO: 9199567 - DNA, 22 bp, Homo sapiens
tctaaagatttggattcatttg

SEQ ID NO: 9199568 - DNA, 23 bp, Homo sapiens
tctaaaattcatcatttacgttc

SEQ ID NO: 9199569 - DNA, 22 bp, Homo sapiens
tcgttatagaacattcttgggt

SEQ ID NO: 9199570 - DNA, 22 bp, Homo sapiens
tcctggcttcctgctcttgtca

SEQ ID NO: 9199571 - DNA, 22 bp, Homo sapiens
tcctgtccacagccctgacctc

SEQ ID NO: 9199572 - DNA, 22 bp, Homo sapiens
tcctgtctaaagacctgcaggc

SEQ ID NO: 9199573 - DNA, 22 bp, Homo sapiens
tcctgtctcagtgtatttgcag

SEQ ID NO: 9199574 - DNA, 22 bp, Homo sapiens
tcctgtctgtctttggtccctt

SEQ ID NO: 9199575 - DNA, 22 bp, Homo sapiens
tcctggctctaagtcctgagtg

SEQ ID NO: 9199576 - DNA, 22 bp, Homo sapiens
tcctggctcctgatctgtcact

SEQ ID NO: 9199577 - DNA, 22 bp, Homo sapiens
tcctggagaatcctgccacctg

SEQ ID NO: 9199578 - DNA, 22 bp, Homo sapiens
tcctggaggagatccaatctga

SEQ ID NO: 9199579 - DNA, 18 bp, Homo sapiens
taagaattgagagtttac

SEQ ID NO: 9199580 - DNA, 22 bp, Homo sapiens
taagaattgtgttgaatagagt

SEQ ID NO: 9199581 - DNA, 22 bp, Homo sapiens
taagaatattgggaatggatgg

SEQ ID NO: 9199582 - DNA, 22 bp, Homo sapiens
taagaatcagtagatatagatt

SEQ ID NO: 9199583 - DNA, 22 bp, Homo sapiens
taagaatctattaggaatatgt

SEQ ID NO: 9199584 - DNA, 22 bp, Homo sapiens
taagaactcgtgatcatttgaa

SEQ ID NO: 9199585 - DNA, 22 bp, Homo sapiens
taagaatacctctcagctcttt

SEQ ID NO: 9199586 - DNA, 22 bp, Homo sapiens
taagaagtgctgaattgaatat

SEQ ID NO: 9199587 - DNA, 22 bp, Homo sapiens
taagaagtacaaaaattttctg

SEQ ID NO: 9199588 - DNA, 22 bp, Homo sapiens
tctgaaaatgttgactttgttt

SEQ ID NO: 9199589 - DNA, 21 bp, Homo sapiens
tctctttctggaagcttccct

SEQ ID NO: 9199590 - DNA, 22 bp, Homo sapiens
tctctttctttgtatgtctatt

SEQ ID NO: 9199591 - DNA, 22 bp, Homo sapiens
tctgaacatcctacaacatttt

SEQ ID NO: 9199592 - DNA, 22 bp, Homo sapiens
tctgaaggcctggagggtccca

SEQ ID NO: 9199593 - DNA, 18 bp, Homo sapiens
tctgaaggaatgattcca

SEQ ID NO: 9199594 - DNA, 22 bp, Homo sapiens
tctgaaggcatcctcactgcaa

SEQ ID NO: 9199595 - DNA, 21 bp, Homo sapiens
tctgaaggcattttccaaggt

SEQ ID NO: 9199596 - DNA, 22 bp, Homo sapiens
tctgaaggattttgtactcaaa

SEQ ID NO: 9199597 - DNA, 22 bp, Homo sapiens
tctgaagggctgagtggaggag

SEQ ID NO: 9199598 - DNA, 22 bp, Homo sapiens
tctgaaggtgctagagaaagct

SEQ ID NO: 9199599 - DNA, 22 bp, Homo sapiens
tctgaaggttacttctgctcag

SEQ ID NO: 9199600 - DNA, 22 bp, Homo sapiens
tctcttcttgattttcactgga

SEQ ID NO: 9199601 - DNA, 22 bp, Homo sapiens
tctctctcagccattacagaac

SEQ ID NO: 9199602 - DNA, 22 bp, Homo sapiens
tctctcagaaagcccatgtctg

SEQ ID NO: 9199603 - DNA, 22 bp, Homo sapiens
tctccccaggggtatgggtatt

SEQ ID NO: 9199604 - DNA, 21 bp, Homo sapiens
tctccccattcttattcccat

SEQ ID NO: 9199605 - DNA, 22 bp, Homo sapiens
tctccccagtatggattctctg

SEQ ID NO: 9199606 - DNA, 22 bp, Homo sapiens
tctccccaaccatggcactcac

SEQ ID NO: 9199607 - DNA, 22 bp, Homo sapiens
tctccccagctgagctgccctt

SEQ ID NO: 9199608 - DNA, 22 bp, Homo sapiens
tctccccagaccctggacataa

SEQ ID NO: 9199609 - DNA, 22 bp, Homo sapiens
tctccccaaaggactcactctc

SEQ ID NO: 9199610 - DNA, 23 bp, Homo sapiens
tctcagaaaggagaagtaatttg

SEQ ID NO: 9199611 - DNA, 22 bp, Homo sapiens
tctcactcatttcctaggtctt

SEQ ID NO: 9199612 - DNA, 22 bp, Homo sapiens
tctcactgcaaatattatgtat

SEQ ID NO: 9199613 - DNA, 22 bp, Homo sapiens
tctcagaaaaaggagaaactgg

SEQ ID NO: 9199614 - DNA, 22 bp, Homo sapiens
tctcagatgcccttgcatcacc

SEQ ID NO: 9199615 - DNA, 23 bp, Homo sapiens
tctcagattcagagatccctaaa

SEQ ID NO: 9199616 - DNA, 22 bp, Homo sapiens
tctcagatggcatcagctagag

SEQ ID NO: 9199617 - DNA, 19 bp, Homo sapiens
tctcatccagcattcaaga

SEQ ID NO: 9199618 - DNA, 22 bp, Homo sapiens
tctcatgctgtagtgcactaac

SEQ ID NO: 9199619 - DNA, 22 bp, Homo sapiens
tctcatgctgtagtgcactaac

SEQ ID NO: 9199620 - DNA, 22 bp, Homo sapiens
tctcatgctgaagtattttctc

SEQ ID NO: 9199621 - DNA, 22 bp, Homo sapiens
tctcatgccctgtttttggttg

SEQ ID NO: 9199622 - DNA, 22 bp, Homo sapiens
tctcatgcctggaattatcatt

SEQ ID NO: 9199623 - DNA, 22 bp, Homo sapiens
tctccaaggccctactctattt

SEQ ID NO: 9199624 - DNA, 22 bp, Homo sapiens
tctcatttggctttgttttaaa

SEQ ID NO: 9199625 - DNA, 22 bp, Homo sapiens
tctcatttgcctcatctataaa

SEQ ID NO: 9199626 - DNA, 23 bp, Homo sapiens
tctcatttcccttgatctatctt

SEQ ID NO: 9199627 - DNA, 22 bp, Homo sapiens
tctcatttgtgtgcaattcaga

SEQ ID NO: 9199628 - DNA, 22 bp, Homo sapiens
tgattccctgcctgtgctgtga

SEQ ID NO: 9199629 - DNA, 22 bp, Homo sapiens
tgattaagttgcattttaatat

SEQ ID NO: 9199630 - DNA, 22 bp, Homo sapiens
tgatggttttattaataggacc

SEQ ID NO: 9199631 - DNA, 22 bp, Homo sapiens
tgatgtaagagatacacttgat

SEQ ID NO: 9199632 - DNA, 22 bp, Homo sapiens
tgatgtcaggcaagatacttaa

SEQ ID NO: 9199633 - DNA, 22 bp, Homo sapiens
tgatatcagctggcagcagtgg

SEQ ID NO: 9199634 - DNA, 23 bp, Homo sapiens
tgcaaaatttgcagagttcgatg

SEQ ID NO: 9199635 - DNA, 22 bp, Homo sapiens
tgcaaatgcccatttattttct

SEQ ID NO: 9199636 - DNA, 22 bp, Homo sapiens
tgcaaatgatgaaactaacttt

SEQ ID NO: 9199637 - DNA, 22 bp, Homo sapiens
tgcaaatggagcatgtataaga

SEQ ID NO: 9199638 - DNA, 22 bp, Homo sapiens
tgcaaatcatactgagatgatt

SEQ ID NO: 9199639 - DNA, 18 bp, Homo sapiens
tgcaaatggctgtttgat

SEQ ID NO: 9199640 - DNA, 22 bp, Homo sapiens
tgcaaaataatgaacgattttt

SEQ ID NO: 9199641 - DNA, 22 bp, Homo sapiens
tgattttgtcatgtttctgata

SEQ ID NO: 9199642 - DNA, 22 bp, Homo sapiens
tgattttattggtgaggaaatt

SEQ ID NO: 9199643 - DNA, 22 bp, Homo sapiens
tgatttatgcattatactgttg

SEQ ID NO: 9199644 - DNA, 22 bp, Homo sapiens
tgcaaggtgctccaagggcgct

SEQ ID NO: 9199645 - DNA, 22 bp, Homo sapiens
tgcacaaacacagagaatagat

SEQ ID NO: 9199646 - DNA, 22 bp, Homo sapiens
tgcacacaaatgtgaacgtgcc

SEQ ID NO: 9199647 - DNA, 22 bp, Homo sapiens
tgcacacaagttggagaatgaa

SEQ ID NO: 9199648 - DNA, 22 bp, Homo sapiens
tgcacacacacgtagagaaaag

SEQ ID NO: 9199649 - DNA, 22 bp, Homo sapiens
tgcacacactctgcatatactt

SEQ ID NO: 9199650 - DNA, 19 bp, Homo sapiens
tgcacacagataagtatct

SEQ ID NO: 9199651 - DNA, 20 bp, Homo sapiens
tgcacacagaaatttgcatt

SEQ ID NO: 9199652 - DNA, 22 bp, Homo sapiens
tgcacacagctgggcctggctg

SEQ ID NO: 9199653 - DNA, 22 bp, Homo sapiens
tgcacacagccagtgagtggca

SEQ ID NO: 9199654 - DNA, 22 bp, Homo sapiens
tgcacacagatggtacatgcat

SEQ ID NO: 9199655 - DNA, 22 bp, Homo sapiens
tgcacacagtggacaagtcttg

SEQ ID NO: 9199656 - DNA, 22 bp, Homo sapiens
tgcacacaggtctaggacatgg

SEQ ID NO: 9199657 - DNA, 22 bp, Homo sapiens
tgcacacacatgaagtagcatg

SEQ ID NO: 9199658 - DNA, 22 bp, Homo sapiens
tgcacacacaggagtctcctcc

SEQ ID NO: 9199659 - DNA, 22 bp, Homo sapiens
tgcacacacatgcagagggaga

SEQ ID NO: 9199660 - DNA, 22 bp, Homo sapiens
tgcacacacgcggcacatctgt

SEQ ID NO: 9199661 - DNA, 20 bp, Homo sapiens
tgcacacaccctgtcctcca

SEQ ID NO: 9199662 - DNA, 22 bp, Homo sapiens
tgcacacaccgtgcttcactga

SEQ ID NO: 9199663 - DNA, 22 bp, Homo sapiens
tgcacacacggagataggcttt

SEQ ID NO: 9199664 - DNA, 22 bp, Homo sapiens
tgcacacactcgtgtatatgag

SEQ ID NO: 9199665 - DNA, 19 bp, Homo sapiens
tgcagccacgtgagagact

SEQ ID NO: 9199666 - DNA, 22 bp, Homo sapiens
tgcagcctctctgcttcaggaa

SEQ ID NO: 9199667 - DNA, 21 bp, Homo sapiens
tgcagcctctgcccagcagtg

SEQ ID NO: 9199668 - DNA, 18 bp, Homo sapiens
tgcagcctgtagtcttgt

SEQ ID NO: 9199669 - DNA, 22 bp, Homo sapiens
tgcagcctggtggtcactggag

SEQ ID NO: 9199670 - DNA, 22 bp, Homo sapiens
tgcagcctggcttcgcgcctcc

SEQ ID NO: 9199671 - DNA, 22 bp, Homo sapiens
tgcagcctagacattctggtca

SEQ ID NO: 9199672 - DNA, 22 bp, Homo sapiens
tgcagccttggcaaccagggac

SEQ ID NO: 9199673 - DNA, 22 bp, Homo sapiens
tgcagcactgttcacaatagcc

SEQ ID NO: 9199674 - DNA, 22 bp, Homo sapiens
tgcacacagttctcaggaaaga

SEQ ID NO: 9199675 - DNA, 22 bp, Homo sapiens
tgcacacatacatgggaagtgc

SEQ ID NO: 9199676 - DNA, 22 bp, Homo sapiens
tgcaccctcatcagtcaaatgg

SEQ ID NO: 9199677 - DNA, 21 bp, Homo sapiens
tgcacctgttcactgcagttc

SEQ ID NO: 9199678 - DNA, 22 bp, Homo sapiens
tgcacgtgcaagcacagataga

SEQ ID NO: 9199679 - DNA, 22 bp, Homo sapiens
tgcagggtggtttgaagggtct

SEQ ID NO: 9199680 - DNA, 22 bp, Homo sapiens
tgcagggtagatgcaggctgtg

SEQ ID NO: 9199681 - DNA, 17 bp, Homo sapiens
tgcaggctcctgtccct

SEQ ID NO: 9199682 - DNA, 18 bp, Homo sapiens
tgcatgcttttgtttcca

SEQ ID NO: 9199683 - DNA, 22 bp, Homo sapiens
tgcatgcatgtgagcatgcata

SEQ ID NO: 9199684 - DNA, 22 bp, Homo sapiens
tgcatgaacggagggtaagctg

SEQ ID NO: 9199685 - DNA, 22 bp, Homo sapiens
tgcatgaacacatgtgcatgta

SEQ ID NO: 9199686 - DNA, 22 bp, Homo sapiens
tgcatgaaatattttctgtagg

SEQ ID NO: 9199687 - DNA, 22 bp, Homo sapiens
tgcatgcaacaattcttctata

SEQ ID NO: 9199688 - DNA, 22 bp, Homo sapiens
tgcatgcaaaaaaatctgcatt

SEQ ID NO: 9199689 - DNA, 22 bp, Homo sapiens
tgcatgcaaagtgtctgctttg

SEQ ID NO: 9199690 - DNA, 22 bp, Homo sapiens
tgcatgtgtgtattcagagact

SEQ ID NO: 9199691 - DNA, 23 bp, Homo sapiens
tgcatcctcatttttcacacgag

SEQ ID NO: 9199692 - DNA, 20 bp, Homo sapiens
tgccacctggtttaagtgtg

SEQ ID NO: 9199693 - DNA, 22 bp, Homo sapiens
tgccacctgtacatgctatctg

SEQ ID NO: 9199694 - DNA, 22 bp, Homo sapiens
tgccacctagtggtctttagtc

SEQ ID NO: 9199695 - DNA, 22 bp, Homo sapiens
tgccacctggacaaccttatgc

SEQ ID NO: 9199696 - DNA, 22 bp, Homo sapiens
tgccaaatattctctacgtgct

SEQ ID NO: 9199697 - DNA, 22 bp, Homo sapiens
tgccatccaacagttccatctt

SEQ ID NO: 9199698 - DNA, 17 bp, Homo sapiens
tgccatcccccttgggc

SEQ ID NO: 9199699 - DNA, 22 bp, Homo sapiens
tgccatctcctggtcaactggt

SEQ ID NO: 9199700 - DNA, 22 bp, Homo sapiens
tgccatcctgtgtcatgctcat

SEQ ID NO: 9199701 - DNA, 22 bp, Homo sapiens
tgccatcttcaataacactgag

SEQ ID NO: 9199702 - DNA, 22 bp, Homo sapiens
tgccatcttccttcctctgcac

SEQ ID NO: 9199703 - DNA, 22 bp, Homo sapiens
tgccatctctccatagcataga

SEQ ID NO: 9199704 - DNA, 19 bp, Homo sapiens
tgcccaggcctcccaaaag

SEQ ID NO: 9199705 - DNA, 22 bp, Homo sapiens
tgccatttacgagcagtatgac

SEQ ID NO: 9199706 - DNA, 22 bp, Homo sapiens
tgcctcagtcagcttccctggg

SEQ ID NO: 9199707 - DNA, 22 bp, Homo sapiens
tgcctcagagttgtccctacca

SEQ ID NO: 9199708 - DNA, 22 bp, Homo sapiens
tgcctcagagtgggcttgctat

SEQ ID NO: 9199709 - DNA, 22 bp, Homo sapiens
tgcctgctttctcctcaactca

SEQ ID NO: 9199710 - DNA, 22 bp, Homo sapiens
tgcctgccacgcttgctaccac

SEQ ID NO: 9199711 - DNA, 22 bp, Homo sapiens
tgagatagtatatggaaagagt

SEQ ID NO: 9199712 - DNA, 22 bp, Homo sapiens
tgagattttcctaaatataatg

SEQ ID NO: 9199713 - DNA, 22 bp, Homo sapiens
tgagatttcgccgacagtattt

SEQ ID NO: 9199714 - DNA, 22 bp, Homo sapiens
tgagatggagccactgcactct

SEQ ID NO: 9199715 - DNA, 22 bp, Homo sapiens
tgagatggggtcatgctttgtc

SEQ ID NO: 9199716 - DNA, 22 bp, Homo sapiens
tgagcacagctttcactagaaa

SEQ ID NO: 9199717 - DNA, 22 bp, Homo sapiens
tgagcttgctacatagatcaga

SEQ ID NO: 9199718 - DNA, 22 bp, Homo sapiens
tgaggccacagtatcagaacag

SEQ ID NO: 9199719 - DNA, 22 bp, Homo sapiens
tgaggccacttccccacagccc

SEQ ID NO: 9199720 - DNA, 22 bp, Homo sapiens
tgaggccagcttcagcagtgga

SEQ ID NO: 9199721 - DNA, 22 bp, Homo sapiens
tgaggccaggacccccagcagg

SEQ ID NO: 9199722 - DNA, 19 bp, Homo sapiens
tgaggccaaggtcacagat

SEQ ID NO: 9199723 - DNA, 22 bp, Homo sapiens
tgagggagcacacactgaagtg

SEQ ID NO: 9199724 - DNA, 22 bp, Homo sapiens
tgagggagtcatgattaaggaa

SEQ ID NO: 9199725 - DNA, 22 bp, Homo sapiens
tgagggagttgggtgtatagga

SEQ ID NO: 9199726 - DNA, 22 bp, Homo sapiens
tgagtatatgatttgtgtttgc

SEQ ID NO: 9199727 - DNA, 22 bp, Homo sapiens
tgaactcctgacctcatgatcc

SEQ ID NO: 9199728 - DNA, 22 bp, Homo sapiens
tgaacacacacctatgtacaaa

SEQ ID NO: 9199729 - DNA, 22 bp, Homo sapiens
tgaacacacacatcttaataat

SEQ ID NO: 9199730 - DNA, 22 bp, Homo sapiens
tgaaattcaaaacacatttgtc

SEQ ID NO: 9199731 - DNA, 22 bp, Homo sapiens
tgaaatcttagccattctgcct

SEQ ID NO: 9199732 - DNA, 22 bp, Homo sapiens
tgaaatgcaacagttatttttg

SEQ ID NO: 9199733 - DNA, 22 bp, Homo sapiens
tgaaatctgtcccactttagct

SEQ ID NO: 9199734 - DNA, 22 bp, Homo sapiens
tgaaatcaatgtcttctgtctc

SEQ ID NO: 9199735 - DNA, 22 bp, Homo sapiens
tgaaatactttggctctttgtt

SEQ ID NO: 9199736 - DNA, 22 bp, Homo sapiens
tgaaaactccaagtttcatcag

SEQ ID NO: 9199737 - DNA, 21 bp, Homo sapiens
tgacccttctagcagaacaca

SEQ ID NO: 9199738 - DNA, 22 bp, Homo sapiens
tgacccttagtgaacattagaa

SEQ ID NO: 9199739 - DNA, 22 bp, Homo sapiens
tgactgccgattgtccttctct

SEQ ID NO: 9199740 - DNA, 22 bp, Homo sapiens
tgactgccccttccattcctgc

SEQ ID NO: 9199741 - DNA, 22 bp, Homo sapiens
tgacttccctgaatgacctagt

SEQ ID NO: 9199742 - DNA, 22 bp, Homo sapiens
tgacttccagcaacttcctcca

SEQ ID NO: 9199743 - DNA, 22 bp, Homo sapiens
tgactatgtggccttgaccaag

SEQ ID NO: 9199744 - DNA, 22 bp, Homo sapiens
tgactcccaggataggatctgg

SEQ ID NO: 9199745 - DNA, 22 bp, Homo sapiens
tgacgttttaggtgttaaatcg

SEQ ID NO: 9199746 - DNA, 22 bp, Homo sapiens
tgacctttctttgagattcctg

SEQ ID NO: 9199747 - DNA, 22 bp, Homo sapiens
tgacaggcactgctgtagtgct

SEQ ID NO: 9199748 - DNA, 22 bp, Homo sapiens
tgacacagattagagacatacc

SEQ ID NO: 9199749 - DNA, 22 bp, Homo sapiens
tgacacagattagagacatacc

SEQ ID NO: 9199750 - DNA, 22 bp, Homo sapiens
tgacacagggcatgcagcagaa

SEQ ID NO: 9199751 - DNA, 23 bp, Homo sapiens
tgacacaggtcaaaaataagatg

SEQ ID NO: 9199752 - DNA, 22 bp, Homo sapiens
tgacacaggtcaaatctacttt

SEQ ID NO: 9199753 - DNA, 22 bp, Homo sapiens
tgacacagtatcaaacatgatt

SEQ ID NO: 9199754 - DNA, 22 bp, Homo sapiens
tgacacagtgggggatcctttt

SEQ ID NO: 9199755 - DNA, 22 bp, Homo sapiens
tgacacagtatcaaacatgatt

SEQ ID NO: 9199756 - DNA, 22 bp, Homo sapiens
tgacacagttgtcgactctaca

SEQ ID NO: 9199757 - DNA, 22 bp, Homo sapiens
tgaaggtggcataggagagatg

SEQ ID NO: 9199758 - DNA, 22 bp, Homo sapiens
tgaatcctagttgaagataagg

SEQ ID NO: 9199759 - DNA, 22 bp, Homo sapiens
tgaattcttttagaattcagtg

SEQ ID NO: 9199760 - DNA, 22 bp, Homo sapiens
tgaattctttccatgttcccat

SEQ ID NO: 9199761 - DNA, 22 bp, Homo sapiens
tgaattcttcccctgcaccaac

SEQ ID NO: 9199762 - DNA, 22 bp, Homo sapiens
tgaattcttatgaaagtgcttg

SEQ ID NO: 9199763 - DNA, 22 bp, Homo sapiens
tgaatttaagcactgatgttaa

SEQ ID NO: 9199764 - DNA, 22 bp, Homo sapiens
tgaattctaatgggtgagatcc

SEQ ID NO: 9199765 - DNA, 20 bp, Homo sapiens
tgaattctagatgactggag

SEQ ID NO: 9199766 - DNA, 22 bp, Homo sapiens
tgaattctgctgtagcaagtcc

SEQ ID NO: 9199767 - DNA, 22 bp, Homo sapiens
tgaattctctttcctggagcat

SEQ ID NO: 9199768 - DNA, 22 bp, Homo sapiens
tgaattctcatctcctgacact

SEQ ID NO: 9199769 - DNA, 22 bp, Homo sapiens
tgaattctcagaaggcaagggc

SEQ ID NO: 9199770 - DNA, 22 bp, Homo sapiens
tgaattctcacaagcctggaag

SEQ ID NO: 9199771 - DNA, 22 bp, Homo sapiens
tgaattctctgcctgcgtattt

SEQ ID NO: 9199772 - DNA, 22 bp, Homo sapiens
tgaattctggctcttctgttta

SEQ ID NO: 9199773 - DNA, 22 bp, Homo sapiens
tgaattctggccctctcactta

SEQ ID NO: 9199774 - DNA, 22 bp, Homo sapiens
tgaattctggccaatggaatgt

SEQ ID NO: 9199775 - DNA, 20 bp, Homo sapiens
tgaattctgggtttatctgc

SEQ ID NO: 9199776 - DNA, 21 bp, Homo sapiens
tgaattctggggtagttggga

SEQ ID NO: 9199777 - DNA, 22 bp, Homo sapiens
tgaattctgggtcagcagcttg

SEQ ID NO: 9199778 - DNA, 22 bp, Homo sapiens
tgaattcttatctgggctgtgc

SEQ ID NO: 9199779 - DNA, 22 bp, Homo sapiens
tgaattcttaatgaaatctact

SEQ ID NO: 9199780 - DNA, 19 bp, Homo sapiens
tgaattctgttagaggcag

SEQ ID NO: 9199781 - DNA, 22 bp, Homo sapiens
tgaattctgtttgggccgctta

SEQ ID NO: 9199782 - DNA, 22 bp, Homo sapiens
tggcaaaggaacctattttaaa

SEQ ID NO: 9199783 - DNA, 22 bp, Homo sapiens
tggcaaaggcgctcacatgcct

SEQ ID NO: 9199784 - DNA, 22 bp, Homo sapiens
tggcaaaggggaccatgttgaa

SEQ ID NO: 9199785 - DNA, 22 bp, Homo sapiens
tggcaaagtaattgggtttctc

SEQ ID NO: 9199786 - DNA, 22 bp, Homo sapiens
tggcaaagctagacattccctc

SEQ ID NO: 9199787 - DNA, 22 bp, Homo sapiens
tggcaaaggaaatgatttaaga

SEQ ID NO: 9199788 - DNA, 23 bp, Homo sapiens
tggcaaagcattcttataacagt

SEQ ID NO: 9199789 - DNA, 22 bp, Homo sapiens
tggcaaagattaccacatctac

SEQ ID NO: 9199790 - DNA, 22 bp, Homo sapiens
tggcaaagaccgcaattacttt

SEQ ID NO: 9199791 - DNA, 22 bp, Homo sapiens
tggcaaagatgaagcatttcgt

SEQ ID NO: 9199792 - DNA, 22 bp, Homo sapiens
tggcaaagatggttctcaccat

SEQ ID NO: 9199793 - DNA, 22 bp, Homo sapiens
tggcaaagacgctagctaagat

SEQ ID NO: 9199794 - DNA, 22 bp, Homo sapiens
tggcaaagactgcaaggacttt

SEQ ID NO: 9199795 - DNA, 22 bp, Homo sapiens
tggcaaagtttatcaggaatat

SEQ ID NO: 9199796 - DNA, 22 bp, Homo sapiens
tggcaaagtgactccttggggc

SEQ ID NO: 9199797 - DNA, 22 bp, Homo sapiens
tggcaaagtatctgtcccagct

SEQ ID NO: 9199798 - DNA, 22 bp, Homo sapiens
tggcaatgttagcaaagcattt

SEQ ID NO: 9199799 - DNA, 21 bp, Homo sapiens
tggccagctgctcgtctcctc

SEQ ID NO: 9199800 - DNA, 22 bp, Homo sapiens
tggccagccttgtcatcgcttt

SEQ ID NO: 9199801 - DNA, 22 bp, Homo sapiens
tggccagcagagttcactctct

SEQ ID NO: 9199802 - DNA, 22 bp, Homo sapiens
tggccagcccttcagccatgcc

SEQ ID NO: 9199803 - DNA, 22 bp, Homo sapiens
tggctcccgcagaccctgtgct

SEQ ID NO: 9199804 - DNA, 22 bp, Homo sapiens
tggctgggagctggaactgggc

SEQ ID NO: 9199805 - DNA, 22 bp, Homo sapiens
tggctggagcattccttgtctt

SEQ ID NO: 9199806 - DNA, 22 bp, Homo sapiens
tggcttcctgcacagtgtctgc

SEQ ID NO: 9199807 - DNA, 22 bp, Homo sapiens
tggcttcctgcatggatcctct

SEQ ID NO: 9199808 - DNA, 22 bp, Homo sapiens
tgggaacattttgagctgagag

SEQ ID NO: 9199809 - DNA, 22 bp, Homo sapiens
tgggaaagactcaggacaggag

SEQ ID NO: 9199810 - DNA, 22 bp, Homo sapiens
tgggactgagaatatgatgggg

SEQ ID NO: 9199811 - DNA, 22 bp, Homo sapiens
tgggaagaggcgggaggctgtt

SEQ ID NO: 9199812 - DNA, 22 bp, Homo sapiens
tgggagacactggtgggagctt

SEQ ID NO: 9199813 - DNA, 21 bp, Homo sapiens
tgggagacacagccttgagct

SEQ ID NO: 9199814 - DNA, 22 bp, Homo sapiens
tggaaatacaagaagtatgtca

SEQ ID NO: 9199815 - DNA, 22 bp, Homo sapiens
tggaaatagatagtatcattca

SEQ ID NO: 9199816 - DNA, 22 bp, Homo sapiens
tggaaatagctccagtttcatt

SEQ ID NO: 9199817 - DNA, 22 bp, Homo sapiens
tggaaatatttgctcattatct

SEQ ID NO: 9199818 - DNA, 22 bp, Homo sapiens
tgcttgacttagtttctcattt

SEQ ID NO: 9199819 - DNA, 22 bp, Homo sapiens
tgcttgtcttcaggattatggt

SEQ ID NO: 9199820 - DNA, 21 bp, Homo sapiens
tgcttgtctgcctagaggctt

SEQ ID NO: 9199821 - DNA, 22 bp, Homo sapiens
tgcttctgggtaggcctcagga

SEQ ID NO: 9199822 - DNA, 21 bp, Homo sapiens
tgctttctaaaaatactattg

SEQ ID NO: 9199823 - DNA, 17 bp, Homo sapiens
tgctttcttcctgccct

SEQ ID NO: 9199824 - DNA, 19 bp, Homo sapiens
tggaagaggaagggaaata

SEQ ID NO: 9199825 - DNA, 22 bp, Homo sapiens
tggaaggaaaggtagcagagaa

SEQ ID NO: 9199826 - DNA, 22 bp, Homo sapiens
tggaaggaagccaaggaaggtt

SEQ ID NO: 9199827 - DNA, 22 bp, Homo sapiens
tggaaggagactgggaagtgtg

SEQ ID NO: 9199828 - DNA, 22 bp, Homo sapiens
tggaaggagctaaggacctggg

SEQ ID NO: 9199829 - DNA, 22 bp, Homo sapiens
tggaatgttttcctaaatcaga

SEQ ID NO: 9199830 - DNA, 22 bp, Homo sapiens
tggaatttagttaattccattt

SEQ ID NO: 9199831 - DNA, 22 bp, Homo sapiens
tggaatgttgataaacataggc

SEQ ID NO: 9199832 - DNA, 23 bp, Homo sapiens
tggaatgtttcttgtactgaatg

SEQ ID NO: 9199833 - DNA, 22 bp, Homo sapiens
tggaatgtttccccagcctgca

SEQ ID NO: 9199834 - DNA, 22 bp, Homo sapiens
tggaatgaaaagtacttcagaa

SEQ ID NO: 9199835 - DNA, 22 bp, Homo sapiens
tggaatgaatttggcttcctcc

SEQ ID NO: 9199836 - DNA, 22 bp, Homo sapiens
tggaatgagctggctaataacc

SEQ ID NO: 9199837 - DNA, 22 bp, Homo sapiens
tggagctggaagacagtgatat

SEQ ID NO: 9199838 - DNA, 22 bp, Homo sapiens
tggagctggcagcggaaaaggg

SEQ ID NO: 9199839 - DNA, 22 bp, Homo sapiens
tggagagtaaatggcagaatca

SEQ ID NO: 9199840 - DNA, 22 bp, Homo sapiens
tggagagtctcaaggcaggaaa

SEQ ID NO: 9199841 - DNA, 22 bp, Homo sapiens
tggagagcctggagtccctgat

SEQ ID NO: 9199842 - DNA, 22 bp, Homo sapiens
tggaggtgtataaggtagcttc

SEQ ID NO: 9199843 - DNA, 22 bp, Homo sapiens
tggagtgcaatagtaataaggt

SEQ ID NO: 9199844 - DNA, 20 bp, Homo sapiens
tggagctgtggtaaggagca

SEQ ID NO: 9199845 - DNA, 22 bp, Homo sapiens
tggaggcaggggatacaggtca

SEQ ID NO: 9199846 - DNA, 22 bp, Homo sapiens
tgctggaggattaaacaagtca

SEQ ID NO: 9199847 - DNA, 22 bp, Homo sapiens
tgctggaggagaaggttgctca

SEQ ID NO: 9199848 - DNA, 20 bp, Homo sapiens
tgctggaggcgccggcgctc

SEQ ID NO: 9199849 - DNA, 22 bp, Homo sapiens
tgctggaggccgagaagcagca

SEQ ID NO: 9199850 - DNA, 22 bp, Homo sapiens
tgctggagtctcttgaccctgg

SEQ ID NO: 9199851 - DNA, 22 bp, Homo sapiens
tgctggagtaacaagacactca

SEQ ID NO: 9199852 - DNA, 19 bp, Homo sapiens
tgctggaggttgacagggt

SEQ ID NO: 9199853 - DNA, 22 bp, Homo sapiens
tgctggaggggatgccttcact

SEQ ID NO: 9199854 - DNA, 22 bp, Homo sapiens
tgctggaggggcctgaccagga

SEQ ID NO: 9199855 - DNA, 22 bp, Homo sapiens
tgctggagggggtaccactcaa

SEQ ID NO: 9199856 - DNA, 23 bp, Homo sapiens
tgctggagtttactcaggccagc

SEQ ID NO: 9199857 - DNA, 19 bp, Homo sapiens
tgctggagtgacattctga

SEQ ID NO: 9199858 - DNA, 22 bp, Homo sapiens
tgctggagtgagtggtttctta

SEQ ID NO: 9199859 - DNA, 22 bp, Homo sapiens
tgctggagttcgacattgcaaa

SEQ ID NO: 9199860 - DNA, 23 bp, Homo sapiens
tgctggagaagcaaagttctgag

SEQ ID NO: 9199861 - DNA, 22 bp, Homo sapiens
tgctggagctccgggctgtagg

SEQ ID NO: 9199862 - DNA, 21 bp, Homo sapiens
tgctggaggacagggtttcat

SEQ ID NO: 9199863 - DNA, 22 bp, Homo sapiens
tgctggagaaagtttttctgaa

SEQ ID NO: 9199864 - DNA, 22 bp, Homo sapiens
tgctggagaagctcctgggact

SEQ ID NO: 9199865 - DNA, 22 bp, Homo sapiens
tgctgggctggagctgccaggg

SEQ ID NO: 9199866 - DNA, 22 bp, Homo sapiens
tgctgggctggggcctcagacc

SEQ ID NO: 9199867 - DNA, 22 bp, Homo sapiens
tgctgggctagggtggagctct

SEQ ID NO: 9199868 - DNA, 22 bp, Homo sapiens
tgctgggctcaacctccagagc

SEQ ID NO: 9199869 - DNA, 22 bp, Homo sapiens
tgctgggcctttacctccaggg

SEQ ID NO: 9199870 - DNA, 22 bp, Homo sapiens
tgctgggcctgcccctgtcagc

SEQ ID NO: 9199871 - DNA, 20 bp, Homo sapiens
tgctgggcatgcagtggaaa

SEQ ID NO: 9199872 - DNA, 22 bp, Homo sapiens
tgctgggcatttatgcagatgg

SEQ ID NO: 9199873 - DNA, 22 bp, Homo sapiens
tgcttagatgaggcagcaggag

SEQ ID NO: 9199874 - DNA, 19 bp, Homo sapiens
tgcttaattcctagtaggt

SEQ ID NO: 9199875 - DNA, 22 bp, Homo sapiens
tgctgtctttttcccttcctaa

SEQ ID NO: 9199876 - DNA, 22 bp, Homo sapiens
tgctgtgacctttgagtacgca

SEQ ID NO: 9199877 - DNA, 22 bp, Homo sapiens
tgctgtctttcattgtctgcct

SEQ ID NO: 9199878 - DNA, 22 bp, Homo sapiens
tgctgcagggccttccctgcat

SEQ ID NO: 9199879 - DNA, 22 bp, Homo sapiens
tgctgatgctgttctgttagga

SEQ ID NO: 9199880 - DNA, 22 bp, Homo sapiens
tgccttcttgaatatggttctt

SEQ ID NO: 9199881 - DNA, 22 bp, Homo sapiens
tgccttcttctccctggctcag

SEQ ID NO: 9199882 - DNA, 22 bp, Homo sapiens
tgcgagagtgtagttgtctgga

SEQ ID NO: 9199883 - DNA, 22 bp, Homo sapiens
tgctcagtgtcttttttggagg

SEQ ID NO: 9199884 - DNA, 22 bp, Homo sapiens
tgctcacattaggcatccatgg

SEQ ID NO: 9199885 - DNA, 22 bp, Homo sapiens
tgctcaaatgtggacaactgat

SEQ ID NO: 9199886 - DNA, 22 bp, Homo sapiens
tgctcacactcatgtccacgct

SEQ ID NO: 9199887 - DNA, 22 bp, Homo sapiens
tgctcacagcccagaacataat

SEQ ID NO: 9199888 - DNA, 22 bp, Homo sapiens
tgcgccatgtgctctcggccct

SEQ ID NO: 9199889 - DNA, 23 bp, Homo sapiens
tgctaaaggcagaatattcacct

SEQ ID NO: 9199890 - DNA, 16 bp, Homo sapiens
tgctattttagagagg

SEQ ID NO: 9199891 - DNA, 22 bp, Homo sapiens
tgctatttggaaaagcatttgg

SEQ ID NO: 9199892 - DNA, 19 bp, Homo sapiens
tgctatttgaagaagtgta

SEQ ID NO: 9199893 - DNA, 22 bp, Homo sapiens
tgctatgtgagtgctccaggtg

SEQ ID NO: 9199894 - DNA, 22 bp, Homo sapiens
tgtacaatctgatgatgtatgg

SEQ ID NO: 9199895 - DNA, 22 bp, Homo sapiens
tgtacaaattcattgaactgta

SEQ ID NO: 9199896 - DNA, 22 bp, Homo sapiens
tgtaagaagggccagagctcca

SEQ ID NO: 9199897 - DNA, 22 bp, Homo sapiens
tgtaagaaaagtaaatagtgac

SEQ ID NO: 9199898 - DNA, 22 bp, Homo sapiens
tgtaagaacaactgtcaaatgt

SEQ ID NO: 9199899 - DNA, 22 bp, Homo sapiens
tgtaacaatgaatatagtgact

SEQ ID NO: 9199900 - DNA, 22 bp, Homo sapiens
tgtaacaaatacccttgaagtt

SEQ ID NO: 9199901 - DNA, 23 bp, Homo sapiens
tgtaaattttgtagtcacatttt

SEQ ID NO: 9199902 - DNA, 22 bp, Homo sapiens
tgtaaattgaaggaaatttgtg

SEQ ID NO: 9199903 - DNA, 22 bp, Homo sapiens
tgtaaattgtcacctaaatgct

SEQ ID NO: 9199904 - DNA, 23 bp, Homo sapiens
tggttctaggcctataattatat

SEQ ID NO: 9199905 - DNA, 22 bp, Homo sapiens
tggttctaaaggactatacaga

SEQ ID NO: 9199906 - DNA, 22 bp, Homo sapiens
tgtaaattctatacacttaaaa

SEQ ID NO: 9199907 - DNA, 22 bp, Homo sapiens
tgtaaagttacttttgaaagga

SEQ ID NO: 9199908 - DNA, 22 bp, Homo sapiens
tgtaaataattcctaggctttt

SEQ ID NO: 9199909 - DNA, 22 bp, Homo sapiens
tggtttgacaatgaggactggt

SEQ ID NO: 9199910 - DNA, 22 bp, Homo sapiens
tggtggcaattcaaagacagca

SEQ ID NO: 9199911 - DNA, 22 bp, Homo sapiens
tgtcaaagacagaaggaaatgg

SEQ ID NO: 9199912 - DNA, 22 bp, Homo sapiens
tgtcaaagtatcagtctctggc

SEQ ID NO: 9199913 - DNA, 22 bp, Homo sapiens
tgtatgtaaaggtcttcatgtt

SEQ ID NO: 9199914 - DNA, 22 bp, Homo sapiens
tgtatgctttggttgtttctct

SEQ ID NO: 9199915 - DNA, 22 bp, Homo sapiens
tgtatgtatacactgatcatca

SEQ ID NO: 9199916 - DNA, 22 bp, Homo sapiens
tgtattcttagttttaatcaga

SEQ ID NO: 9199917 - DNA, 22 bp, Homo sapiens
tgtatttattcttctggtgttt

SEQ ID NO: 9199918 - DNA, 22 bp, Homo sapiens
tgtagaacaagaaaatctcagt

SEQ ID NO: 9199919 - DNA, 22 bp, Homo sapiens
tgtactaggggtgtggaaggta

SEQ ID NO: 9199920 - DNA, 22 bp, Homo sapiens
tgtatacaggattactcatagc

SEQ ID NO: 9199921 - DNA, 22 bp, Homo sapiens
tgtatcacatgactctgcacta

SEQ ID NO: 9199922 - DNA, 22 bp, Homo sapiens
tgtatgaggcatacatcaggca

SEQ ID NO: 9199923 - DNA, 22 bp, Homo sapiens
tgtcatagtgtggtagcagtgg

SEQ ID NO: 9199924 - DNA, 22 bp, Homo sapiens
tgtcatatgtaatatgttcatt

SEQ ID NO: 9199925 - DNA, 23 bp, Homo sapiens
tgtcctttttgaggcctcctcct

SEQ ID NO: 9199926 - DNA, 22 bp, Homo sapiens
tgtcctttactgattgcttctg

SEQ ID NO: 9199927 - DNA, 22 bp, Homo sapiens
tgtccttagaagaagtgaaaga

SEQ ID NO: 9199928 - DNA, 22 bp, Homo sapiens
tgtcctcagatatgtctactct

SEQ ID NO: 9199929 - DNA, 22 bp, Homo sapiens
tgggtaagtggaggacaaagta

SEQ ID NO: 9199930 - DNA, 22 bp, Homo sapiens
tgggggtgccctatgaggaagc

SEQ ID NO: 9199931 - DNA, 22 bp, Homo sapiens
tgggggtgactatctcgggaat

SEQ ID NO: 9199932 - DNA, 22 bp, Homo sapiens
tgggggtgaaagtctggacagt

SEQ ID NO: 9199933 - DNA, 22 bp, Homo sapiens
tggggtggatagaaagtgatgt

SEQ ID NO: 9199934 - DNA, 22 bp, Homo sapiens
tggtaaatgctattcctatatt

SEQ ID NO: 9199935 - DNA, 22 bp, Homo sapiens
tgggatggcatcctgggccttg

SEQ ID NO: 9199936 - DNA, 22 bp, Homo sapiens
tgttgtaatcattttatgaaaa

SEQ ID NO: 9199937 - DNA, 22 bp, Homo sapiens
tgtttattgctgcaattgtgcc

SEQ ID NO: 9199938 - DNA, 22 bp, Homo sapiens
tgtttattcatggctaatgaaa

SEQ ID NO: 9199939 - DNA, 22 bp, Homo sapiens
tgttactgagtaatgtatagat

SEQ ID NO: 9199940 - DNA, 22 bp, Homo sapiens
tgttaaatgttttgctagtgtc

SEQ ID NO: 9199941 - DNA, 22 bp, Homo sapiens
tgttaaatgtattatgtgttct

SEQ ID NO: 9199942 - DNA, 22 bp, Homo sapiens
tgtttcaaaacagtgataattt

SEQ ID NO: 9199943 - DNA, 22 bp, Homo sapiens
ttaaaccatagtttaacataag

SEQ ID NO: 9199944 - DNA, 17 bp, Homo sapiens
ttaaaccataaagaagg

SEQ ID NO: 9199945 - DNA, 22 bp, Homo sapiens
tgtgtagaaagatctccaagat

SEQ ID NO: 9199946 - DNA, 22 bp, Homo sapiens
tgtgtagaggtaagtaacactt

SEQ ID NO: 9199947 - DNA, 17 bp, Homo sapiens
tgtgtagagcatcgcca

SEQ ID NO: 9199948 - DNA, 22 bp, Homo sapiens
tgtgtgttattttcagccatta

SEQ ID NO: 9199949 - DNA, 22 bp, Homo sapiens
tgtgtgtgtgcgcgcacgcata

SEQ ID NO: 9199950 - DNA, 23 bp, Homo sapiens
tgtgtgtgtattctacgcaaggt

SEQ ID NO: 9199951 - DNA, 22 bp, Homo sapiens
tgtgggcaggagcacaagtcag

SEQ ID NO: 9199952 - DNA, 19 bp, Homo sapiens
tgtgggcaagggatggcag

SEQ ID NO: 9199953 - DNA, 22 bp, Homo sapiens
tgtgggcagctggagctgttca

SEQ ID NO: 9199954 - DNA, 22 bp, Homo sapiens
tgtgggcaaagggtagctgggt

SEQ ID NO: 9199955 - DNA, 22 bp, Homo sapiens
tgtgacataagtagaggcttga

SEQ ID NO: 9199956 - DNA, 22 bp, Homo sapiens
tgtgcatgttgcttgaactcct

SEQ ID NO: 9199957 - DNA, 22 bp, Homo sapiens
tgtgccaagatcaaacttttct

SEQ ID NO: 9199958 - DNA, 22 bp, Homo sapiens
tgtctcctgggtcccttccacc

SEQ ID NO: 9199959 - DNA, 22 bp, Homo sapiens
tgtctagttttagcttttggag

SEQ ID NO: 9199960 - DNA, 22 bp, Homo sapiens
tgtctctctgcccccattgctc

SEQ ID NO: 9199961 - DNA, 22 bp, Homo sapiens
tgtctcttggctctatcactta

SEQ ID NO: 9199962 - DNA, 22 bp, Homo sapiens
tgtctcttgttaatgattacta

SEQ ID NO: 9199963 - DNA, 22 bp, Homo sapiens
tgtctctttgggttcctcttgg

SEQ ID NO: 9199964 - DNA, 22 bp, Homo sapiens
tgtcttcctcttggcttgagct

SEQ ID NO: 9199965 - DNA, 22 bp, Homo sapiens
tgtcttccatggttttgacact

SEQ ID NO: 9199966 - DNA, 22 bp, Homo sapiens
tgtgaaaagcgtgtgttctagg

SEQ ID NO: 9199967 - DNA, 22 bp, Homo sapiens
tgtgaaaagcaggctactttct

SEQ ID NO: 9199968 - DNA, 22 bp, Homo sapiens
tgtctttttactatgttcaatc

SEQ ID NO: 9199969 - DNA, 22 bp, Homo sapiens
ttccagctaactcacatccctt

SEQ ID NO: 9199970 - DNA, 22 bp, Homo sapiens
ttccagatttctacacaagacc

SEQ ID NO: 9199971 - DNA, 22 bp, Homo sapiens
ttccagatgtttaagttctgct

SEQ ID NO: 9199972 - DNA, 22 bp, Homo sapiens
ttcatgttttattcagtaatta

SEQ ID NO: 9199973 - DNA, 22 bp, Homo sapiens
ttcattaagtataaaatgtggt

SEQ ID NO: 9199974 - DNA, 22 bp, Homo sapiens
ttcattcaggtgtatttatggg

SEQ ID NO: 9199975 - DNA, 22 bp, Homo sapiens
ttcattcagcacatatttattg

SEQ ID NO: 9199976 - DNA, 22 bp, Homo sapiens
ttcattcatgtattgtctatgg

SEQ ID NO: 9199977 - DNA, 22 bp, Homo sapiens
ttcattgatagttttatgtatg

SEQ ID NO: 9199978 - DNA, 19 bp, Homo sapiens
ttcaccatctcaccaaacc

SEQ ID NO: 9199979 - DNA, 22 bp, Homo sapiens
ttcaccatgggatgacaacagt

SEQ ID NO: 9199980 - DNA, 22 bp, Homo sapiens
ttatttcttgtctatgtagcca

SEQ ID NO: 9199981 - DNA, 22 bp, Homo sapiens
ttcaccatgttggccaggctgg

SEQ ID NO: 9199982 - DNA, 22 bp, Homo sapiens
ttcagcccccaaagcctcattc

SEQ ID NO: 9199983 - DNA, 22 bp, Homo sapiens
ttcagcctgtctgcagacccct

SEQ ID NO: 9199984 - DNA, 22 bp, Homo sapiens
ttacattaagccaatggattct

SEQ ID NO: 9199985 - DNA, 22 bp, Homo sapiens
ttacattagacccactttcatg

SEQ ID NO: 9199986 - DNA, 22 bp, Homo sapiens
ttacattaagccaatggattct

SEQ ID NO: 9199987 - DNA, 22 bp, Homo sapiens
ttacatgcaggtcagactgcat

SEQ ID NO: 9199988 - DNA, 22 bp, Homo sapiens
ttacagatggggttgcaataaa

SEQ ID NO: 9199989 - DNA, 22 bp, Homo sapiens
ttacagatggatctagcaaaat

SEQ ID NO: 9199990 - DNA, 22 bp, Homo sapiens
ttacagatactttgtaggcaag

SEQ ID NO: 9199991 - DNA, 22 bp, Homo sapiens
ttaaagagtaatcataggtcaa

SEQ ID NO: 9199992 - DNA, 22 bp, Homo sapiens
ttaaagcagtttgtatacatgg

SEQ ID NO: 9199993 - DNA, 19 bp, Homo sapiens
ttattcttaaagtagctta

SEQ ID NO: 9199994 - DNA, 22 bp, Homo sapiens
ttatttcattgatttctaagac

SEQ ID NO: 9199995 - DNA, 22 bp, Homo sapiens
ttagtgatgggttgaagttaac

SEQ ID NO: 9199996 - DNA, 22 bp, Homo sapiens
ttagtcctggatctcagagttc

SEQ ID NO: 9199997 - DNA, 22 bp, Homo sapiens
ttagaagcactaattactcaca

SEQ ID NO: 9199998 - DNA, 22 bp, Homo sapiens
ttagggacaaatttgcagaacc

SEQ ID NO: 9199999 - DNA, 21 bp, Homo sapiens
ttaggtctgagaactgagaga

SEQ ID NO: 9200000 - DNA, 22 bp, Homo sapiens
ttagatttatatgtgagaatgg

SEQ ID NO: 9200001 - DNA, 22 bp, Homo sapiens
ttccaggaaaacagttggaagt

SEQ ID NO: 9200002 - DNA, 22 bp, Homo sapiens
aaaggcaggactgcagcatagg

SEQ ID NO: 9200003 - DNA, 22 bp, Homo sapiens
aagagggaggtgcgggtgcaga

SEQ ID NO: 9200004 - DNA, 22 bp, Homo sapiens
aagagggaagtcacctggaggt

SEQ ID NO: 9200005 - DNA, 22 bp, Homo sapiens
aagagggagggcaaaggcactg

SEQ ID NO: 9200006 - DNA, 19 bp, Homo sapiens
aagagggaaagtgctatgc

SEQ ID NO: 9200007 - DNA, 22 bp, Homo sapiens
aagcaggcattccagagacaat

SEQ ID NO: 9200008 - DNA, 22 bp, Homo sapiens
aaggaaagacaggacggaattc

SEQ ID NO: 9200009 - DNA, 22 bp, Homo sapiens
aaggctgggtttgggatgtgat

SEQ ID NO: 9200010 - DNA, 22 bp, Homo sapiens
aaggctggtggattatgaggtc

SEQ ID NO: 9200011 - DNA, 18 bp, Homo sapiens
aagcagacagcagacagt

SEQ ID NO: 9200012 - DNA, 22 bp, Homo sapiens
aatgtgagccaatgcccgtggg

SEQ ID NO: 9200013 - DNA, 22 bp, Homo sapiens
acaacaaaatgaggaagtggtc

SEQ ID NO: 9200014 - DNA, 22 bp, Homo sapiens
aagctcaggctggacctggctt

SEQ ID NO: 9200015 - DNA, 21 bp, Homo sapiens
accaggcttgtgggagggagc

SEQ ID NO: 9200016 - DNA, 22 bp, Homo sapiens
accaggcttgatgatttgctta

SEQ ID NO: 9200017 - DNA, 22 bp, Homo sapiens
accaggcttgataccaagaaat

SEQ ID NO: 9200018 - DNA, 19 bp, Homo sapiens
accaggcttatggtcagtg

SEQ ID NO: 9200019 - DNA, 22 bp, Homo sapiens
accaggcttaatcctttgctat

SEQ ID NO: 9200020 - DNA, 22 bp, Homo sapiens
accaggctgttgggcccagtgt

SEQ ID NO: 9200021 - DNA, 22 bp, Homo sapiens
aggcagcatccagaggagaatg

SEQ ID NO: 9200022 - DNA, 22 bp, Homo sapiens
aggaggaactcagaaagaaggt

SEQ ID NO: 9200023 - DNA, 20 bp, Homo sapiens
aggaggaaaaaatgacgagc

SEQ ID NO: 9200024 - DNA, 18 bp, Homo sapiens
acaggctgtgggaatggt

SEQ ID NO: 9200025 - DNA, 22 bp, Homo sapiens
acaggctgtacttctaatcatc

SEQ ID NO: 9200026 - DNA, 22 bp, Homo sapiens
acaggctggtttgtaaaagatg

SEQ ID NO: 9200027 - DNA, 22 bp, Homo sapiens
acaggctgccacttgcatccaa

SEQ ID NO: 9200028 - DNA, 22 bp, Homo sapiens
acaggctgcctaccaagtatca

SEQ ID NO: 9200029 - DNA, 22 bp, Homo sapiens
acaggctgctgagccatttgct

SEQ ID NO: 9200030 - DNA, 22 bp, Homo sapiens
acaggctgcccgctccccacct

SEQ ID NO: 9200031 - DNA, 22 bp, Homo sapiens
acaggctgctgggctccgtgct

SEQ ID NO: 9200032 - DNA, 22 bp, Homo sapiens
acaggctggaggaggaccaaga

SEQ ID NO: 9200033 - DNA, 22 bp, Homo sapiens
acaggctggtggtcctggccat

SEQ ID NO: 9200034 - DNA, 22 bp, Homo sapiens
acaggctgggcgcttcctgcgg

SEQ ID NO: 9200035 - DNA, 18 bp, Homo sapiens
aggctgcactgtcttaaa

SEQ ID NO: 9200036 - DNA, 22 bp, Homo sapiens
acatgaggaactcaggagtcac

SEQ ID NO: 9200037 - DNA, 22 bp, Homo sapiens
aggctggcagccacctcagcag

SEQ ID NO: 9200038 - DNA, 22 bp, Homo sapiens
aggctggatctctgttgccttc

SEQ ID NO: 9200039 - DNA, 22 bp, Homo sapiens
agggaatgtagcaagatgccaa

SEQ ID NO: 9200040 - DNA, 22 bp, Homo sapiens
accaggcccaccgcatgctcct

SEQ ID NO: 9200041 - DNA, 22 bp, Homo sapiens
accaggagttgggggtgggacc

SEQ ID NO: 9200042 - DNA, 18 bp, Homo sapiens
acccaggctcatggtcct

SEQ ID NO: 9200043 - DNA, 17 bp, Homo sapiens
acccaggctctatcttg

SEQ ID NO: 9200044 - DNA, 22 bp, Homo sapiens
acccaggctgcttctcagtggc

SEQ ID NO: 9200045 - DNA, 22 bp, Homo sapiens
agggcatgaaatgggcagaagc

SEQ ID NO: 9200046 - DNA, 23 bp, Homo sapiens
acctggctgctcaacctgcaggg

SEQ ID NO: 9200047 - DNA, 19 bp, Homo sapiens
actcagggaaaggagaatt

SEQ ID NO: 9200048 - DNA, 22 bp, Homo sapiens
actcatttgcatgatgtgctat

SEQ ID NO: 9200049 - DNA, 22 bp, Homo sapiens
actcatttttactgcaattgag

SEQ ID NO: 9200050 - DNA, 22 bp, Homo sapiens
actccaggatgtagaatcagag

SEQ ID NO: 9200051 - DNA, 22 bp, Homo sapiens
actccaggaaacttaggggaaa

SEQ ID NO: 9200052 - DNA, 22 bp, Homo sapiens
actccagggaggtgagtgtgcg

SEQ ID NO: 9200053 - DNA, 19 bp, Homo sapiens
actccagggatgacagaag

SEQ ID NO: 9200054 - DNA, 22 bp, Homo sapiens
actccaggcatctgcttctgct

SEQ ID NO: 9200055 - DNA, 22 bp, Homo sapiens
actccagggctccaccccagat

SEQ ID NO: 9200056 - DNA, 22 bp, Homo sapiens
actccagggctccatcccttgt

SEQ ID NO: 9200057 - DNA, 22 bp, Homo sapiens
actccagggctgaacgaggccc

SEQ ID NO: 9200058 - DNA, 22 bp, Homo sapiens
actccagggcttctatgatggt

SEQ ID NO: 9200059 - DNA, 22 bp, Homo sapiens
agaagagaaatagtgccactgt

SEQ ID NO: 9200060 - DNA, 21 bp, Homo sapiens
agaagagaagcaggaccctct

SEQ ID NO: 9200061 - DNA, 20 bp, Homo sapiens
agaaggcattcctcattctt

SEQ ID NO: 9200062 - DNA, 22 bp, Homo sapiens
agaatgtgttattagagaagga

SEQ ID NO: 9200063 - DNA, 22 bp, Homo sapiens
agaatgtgggggaaaagagtgt

SEQ ID NO: 9200064 - DNA, 22 bp, Homo sapiens
agaatgtgtgattgaagctctt

SEQ ID NO: 9200065 - DNA, 22 bp, Homo sapiens
agaatgtgtgcaagcaagtgtg

SEQ ID NO: 9200066 - DNA, 17 bp, Homo sapiens
agaatgcaaagcaggct

SEQ ID NO: 9200067 - DNA, 22 bp, Homo sapiens
agccaggcagactctctttctt

SEQ ID NO: 9200068 - DNA, 22 bp, Homo sapiens
cagaagcagtgagagatgtgca

SEQ ID NO: 9200069 - DNA, 22 bp, Homo sapiens
cagagagggcggccctggcttc

SEQ ID NO: 9200070 - DNA, 22 bp, Homo sapiens
cagcaggaggtgagatgtgacc

SEQ ID NO: 9200071 - DNA, 22 bp, Homo sapiens
cagcaggaccattgaggcatca

SEQ ID NO: 9200072 - DNA, 22 bp, Homo sapiens
agcacagagaaactaagacatt

SEQ ID NO: 9200073 - DNA, 22 bp, Homo sapiens
agcacagagttgcagagagcgt

SEQ ID NO: 9200074 - DNA, 22 bp, Homo sapiens
agcacagaggtggaagtgtata

SEQ ID NO: 9200075 - DNA, 17 bp, Homo sapiens
agcagaagtcagaggga

SEQ ID NO: 9200076 - DNA, 22 bp, Homo sapiens
agcagaagaaagccacatgact

SEQ ID NO: 9200077 - DNA, 22 bp, Homo sapiens
atggctggatttgatccatggg

SEQ ID NO: 9200078 - DNA, 22 bp, Homo sapiens
atggaagacagataaggcagaa

SEQ ID NO: 9200079 - DNA, 23 bp, Homo sapiens
atgcaggacttataaggtaaggt

SEQ ID NO: 9200080 - DNA, 22 bp, Homo sapiens
atgaaacatgagaaatggagag

SEQ ID NO: 9200081 - DNA, 22 bp, Homo sapiens
atgaaacagtgtgtatagcaaa

SEQ ID NO: 9200082 - DNA, 22 bp, Homo sapiens
gctcaggatcagccacctcttt

SEQ ID NO: 9200083 - DNA, 22 bp, Homo sapiens
gctcaggcaggagtgcagtggc

SEQ ID NO: 9200084 - DNA, 22 bp, Homo sapiens
gctcaggactggaggagcgggg

SEQ ID NO: 9200085 - DNA, 22 bp, Homo sapiens
gctcaggaaggctcaaccagga

SEQ ID NO: 9200086 - DNA, 22 bp, Homo sapiens
gcctggctgaggcctctgctaa

SEQ ID NO: 9200087 - DNA, 22 bp, Homo sapiens
ggatgggaacttggtagggcat

SEQ ID NO: 9200088 - DNA, 22 bp, Homo sapiens
ggagggagtcagctgattagaa

SEQ ID NO: 9200089 - DNA, 22 bp, Homo sapiens
ggaggcggaggctgcagtgagc

SEQ ID NO: 9200090 - DNA, 22 bp, Homo sapiens
ggatgtagtgcaaggagtgaat

SEQ ID NO: 9200091 - DNA, 22 bp, Homo sapiens
ggatgtgaatctgggctgagac

SEQ ID NO: 9200092 - DNA, 22 bp, Homo sapiens
ggaggcggagcttgcagtgagc

SEQ ID NO: 9200093 - DNA, 22 bp, Homo sapiens
ggaggcggaagttgcagtgagc

SEQ ID NO: 9200094 - DNA, 23 bp, Homo sapiens
ggcctcctggtctaggctagact

SEQ ID NO: 9200095 - DNA, 22 bp, Homo sapiens
caagagggaacctaagatgtat

SEQ ID NO: 9200096 - DNA, 22 bp, Homo sapiens
cagacaggctagccagactcac

SEQ ID NO: 9200097 - DNA, 22 bp, Homo sapiens
cagagccctgcatgctccatct

SEQ ID NO: 9200098 - DNA, 22 bp, Homo sapiens
cagagcccagggcctacgtccc

SEQ ID NO: 9200099 - DNA, 22 bp, Homo sapiens
cagcaggatttgaaaggaagag

SEQ ID NO: 9200100 - DNA, 22 bp, Homo sapiens
catgccagggcttgctgcctgg

SEQ ID NO: 9200101 - DNA, 22 bp, Homo sapiens
catgcctgtatttctgatctat

SEQ ID NO: 9200102 - DNA, 22 bp, Homo sapiens
aggcagcagaaaacaaatggtt

SEQ ID NO: 9200103 - DNA, 22 bp, Homo sapiens
aggagaggcatcaagaaaatcg

SEQ ID NO: 9200104 - DNA, 22 bp, Homo sapiens
aggagagaatgttccaggcttg

SEQ ID NO: 9200105 - DNA, 22 bp, Homo sapiens
aggaggaagggaagacaagtaa

SEQ ID NO: 9200106 - DNA, 22 bp, Homo sapiens
aggaggaatacaatccagcagc

SEQ ID NO: 9200107 - DNA, 22 bp, Homo sapiens
aggaggaattgacacagaagcc

SEQ ID NO: 9200108 - DNA, 22 bp, Homo sapiens
aggagaagccaagttgtgagca

SEQ ID NO: 9200109 - DNA, 22 bp, Homo sapiens
aggagacactgagacttcacca

SEQ ID NO: 9200110 - DNA, 18 bp, Homo sapiens
aggaaagacgaagagggc

SEQ ID NO: 9200111 - DNA, 22 bp, Homo sapiens
aggaaagatggaaggaggataa

SEQ ID NO: 9200112 - DNA, 22 bp, Homo sapiens
agggaagaagctggtagtaggt

SEQ ID NO: 9200113 - DNA, 22 bp, Homo sapiens
agggaagtgataggacgtctct

SEQ ID NO: 9200114 - DNA, 19 bp, Homo sapiens
agggaatccggctgaggga

SEQ ID NO: 9200115 - DNA, 22 bp, Homo sapiens
cccagcctctgtttgctcctct

SEQ ID NO: 9200116 - DNA, 21 bp, Homo sapiens
cctcagagacagatacgggtg

SEQ ID NO: 9200117 - DNA, 22 bp, Homo sapiens
cctcagagcctccagaaggaat

SEQ ID NO: 9200118 - DNA, 22 bp, Homo sapiens
cctccaggaacttgagagacac

SEQ ID NO: 9200119 - DNA, 22 bp, Homo sapiens
cctccaggctgaatatctagaa

SEQ ID NO: 9200120 - DNA, 22 bp, Homo sapiens
agggcagagggtgcctcacctg

SEQ ID NO: 9200121 - DNA, 22 bp, Homo sapiens
aggctccttgctcacaggctca

SEQ ID NO: 9200122 - DNA, 22 bp, Homo sapiens
ccaggctctgagaggaatgtga

SEQ ID NO: 9200123 - DNA, 22 bp, Homo sapiens
ccaggctctgcaaaatcaggct

SEQ ID NO: 9200124 - DNA, 22 bp, Homo sapiens
ccaggctctatccctccttctt

SEQ ID NO: 9200125 - DNA, 22 bp, Homo sapiens
ctcagaggtcaagagcagagct

SEQ ID NO: 9200126 - DNA, 22 bp, Homo sapiens
ctcagtgtctggggccccaggg

SEQ ID NO: 9200127 - DNA, 20 bp, Homo sapiens
ctcagtgtattctgggtgct

SEQ ID NO: 9200128 - DNA, 22 bp, Homo sapiens
ctcagtgtgaatgctcagtaaa

SEQ ID NO: 9200129 - DNA, 20 bp, Homo sapiens
ctcagtgtggcctgagtgtt

SEQ ID NO: 9200130 - DNA, 23 bp, Homo sapiens
ctcagtgtgtgacccatggcctc

SEQ ID NO: 9200131 - DNA, 22 bp, Homo sapiens
ctcagtgtgagtgagaagtgca

SEQ ID NO: 9200132 - DNA, 22 bp, Homo sapiens
ctcagtgttaaagactttccag

SEQ ID NO: 9200133 - DNA, 22 bp, Homo sapiens
ctctcccagtcaggctcaggat

SEQ ID NO: 9200134 - DNA, 22 bp, Homo sapiens
cctggccacagggctctgcatt

SEQ ID NO: 9200135 - DNA, 22 bp, Homo sapiens
ctgtcctccggccacctacagt

SEQ ID NO: 9200136 - DNA, 22 bp, Homo sapiens
catggctgaacactcagtgact

SEQ ID NO: 9200137 - DNA, 22 bp, Homo sapiens
catggctgcgagaagagtgggt

SEQ ID NO: 9200138 - DNA, 19 bp, Homo sapiens
catggctgctgcttgggag

SEQ ID NO: 9200139 - DNA, 22 bp, Homo sapiens
catccagggcagccatggcctg

SEQ ID NO: 9200140 - DNA, 22 bp, Homo sapiens
cagtctcctgggggctgttgtt

SEQ ID NO: 9200141 - DNA, 22 bp, Homo sapiens
tctgatagataccatgaggcaa

SEQ ID NO: 9200142 - DNA, 22 bp, Homo sapiens
ccaggaggcagaagttgcagtg

SEQ ID NO: 9200143 - DNA, 22 bp, Homo sapiens
tctcccaagtgaccaggaaaga

SEQ ID NO: 9200144 - DNA, 22 bp, Homo sapiens
cagctgctgttcagttttgttt

SEQ ID NO: 9200145 - DNA, 22 bp, Homo sapiens
cagctgtctggggagtgctcgc

SEQ ID NO: 9200146 - DNA, 22 bp, Homo sapiens
cagctgtctaagttgagcagga

SEQ ID NO: 9200147 - DNA, 19 bp, Homo sapiens
caggaacatggagggaggg

SEQ ID NO: 9200148 - DNA, 22 bp, Homo sapiens
caggaagattgtggaggtggtt

SEQ ID NO: 9200149 - DNA, 22 bp, Homo sapiens
caggaaagccgagtgccatagg

SEQ ID NO: 9200150 - DNA, 22 bp, Homo sapiens
caggaaagggatgggctgccac

SEQ ID NO: 9200151 - DNA, 22 bp, Homo sapiens
caggaaaggtagtcacaatgta

SEQ ID NO: 9200152 - DNA, 22 bp, Homo sapiens
caggaaagtctgtaaaggaacc

SEQ ID NO: 9200153 - DNA, 22 bp, Homo sapiens
caggaaaggtgtgtcatgatgg

SEQ ID NO: 9200154 - DNA, 21 bp, Homo sapiens
caggaaagaaaacgtacatat

SEQ ID NO: 9200155 - DNA, 22 bp, Homo sapiens
caggaaagagagctattcactt

SEQ ID NO: 9200156 - DNA, 22 bp, Homo sapiens
caggaaagaaatgagaacacca

SEQ ID NO: 9200157 - DNA, 22 bp, Homo sapiens
caggaaagagctgccaggcagg

SEQ ID NO: 9200158 - DNA, 22 bp, Homo sapiens
caggatgcttctggggccaggc

SEQ ID NO: 9200159 - DNA, 22 bp, Homo sapiens
caggatgaggtagaggcagata

SEQ ID NO: 9200160 - DNA, 22 bp, Homo sapiens
taaggcagatgtggaatcaatt

SEQ ID NO: 9200161 - DNA, 22 bp, Homo sapiens
caggcacagtggggtcctctct

SEQ ID NO: 9200162 - DNA, 22 bp, Homo sapiens
caggcagggagccactgtataa

SEQ ID NO: 9200163 - DNA, 23 bp, Homo sapiens
caggcaggatgaggactacactc

SEQ ID NO: 9200164 - DNA, 22 bp, Homo sapiens
caggaagctcttagcagtcacc

SEQ ID NO: 9200165 - DNA, 22 bp, Homo sapiens
ctaggctgttcatgctcagacc

SEQ ID NO: 9200166 - DNA, 22 bp, Homo sapiens
ctctccagaattattactatta

SEQ ID NO: 9200167 - DNA, 22 bp, Homo sapiens
ttgtatttctccactttctgtt

SEQ ID NO: 9200168 - DNA, 22 bp, Homo sapiens
ctccaggcgccgcttttgcagt

SEQ ID NO: 9200169 - DNA, 23 bp, Homo sapiens
ctggactcaggggatgtgaagga

SEQ ID NO: 9200170 - DNA, 22 bp, Homo sapiens
ctggccaggcggcccctgcatg

SEQ ID NO: 9200171 - DNA, 22 bp, Homo sapiens
tgccaggcgtggtggtgcgcac

SEQ ID NO: 9200172 - DNA, 22 bp, Homo sapiens
tgccaggcctcaggagtctcca

SEQ ID NO: 9200173 - DNA, 22 bp, Homo sapiens
cccagctgaacttgcattccaa

SEQ ID NO: 9200174 - DNA, 22 bp, Homo sapiens
tgctggagatcattaatgttca

SEQ ID NO: 9200175 - DNA, 22 bp, Homo sapiens
cccctcctggccacactgtcag

SEQ ID NO: 9200176 - DNA, 22 bp, Homo sapiens
cccaggctcctactgtattctg

SEQ ID NO: 9200177 - DNA, 22 bp, Homo sapiens
cccaggctcctagaggcccaga

SEQ ID NO: 9200178 - DNA, 22 bp, Homo sapiens
cccaggctcctgctgtgttgac

SEQ ID NO: 9200179 - DNA, 22 bp, Homo sapiens
cccaggctcctgactcattcta

SEQ ID NO: 9200180 - DNA, 21 bp, Homo sapiens
cccaggctgaattaaaaatat

SEQ ID NO: 9200181 - DNA, 22 bp, Homo sapiens
cccaggctcttatgtgacttgc

SEQ ID NO: 9200182 - DNA, 22 bp, Homo sapiens
tggcccctgaggagcatcagcc

SEQ ID NO: 9200183 - DNA, 22 bp, Homo sapiens
cctctgtagtaagagaacatat

SEQ ID NO: 9200184 - DNA, 22 bp, Homo sapiens
cctggctgtggcggtgctctca

SEQ ID NO: 9200185 - DNA, 22 bp, Homo sapiens
cctggccaggcatggagtcaca

SEQ ID NO: 9200186 - DNA, 22 bp, Homo sapiens
cctggccatagggcccaggaaa

SEQ ID NO: 9200187 - DNA, 22 bp, Homo sapiens
cctggccagcgccggctgctcg

SEQ ID NO: 9200188 - DNA, 22 bp, Homo sapiens
cctggctcccggaacagggtct

SEQ ID NO: 9200189 - DNA, 22 bp, Homo sapiens
cctggctccctgcacagggctc

SEQ ID NO: 9200190 - DNA, 22 bp, Homo sapiens
cctggagacctgatggcagcgg

SEQ ID NO: 9200191 - DNA, 22 bp, Homo sapiens
tgtatgtgcaatgtttatatgt

SEQ ID NO: 9200192 - DNA, 22 bp, Homo sapiens
tgtatgtgtcctaattcaagca

SEQ ID NO: 9200193 - DNA, 22 bp, Homo sapiens
gagagtccttagtttgcaggta

SEQ ID NO: 9200194 - DNA, 22 bp, Homo sapiens
gagagtccaggtctgggtcctt

SEQ ID NO: 9200195 - DNA, 22 bp, Homo sapiens
gagaggtaatttgaagtgcaaa

SEQ ID NO: 9200196 - DNA, 22 bp, Homo sapiens
gagacacagttatcaggcatac

SEQ ID NO: 9200197 - DNA, 22 bp, Homo sapiens
gagacacaggcacagaagaggc

SEQ ID NO: 9200198 - DNA, 22 bp, Homo sapiens
gagacacacattctggagagaa

SEQ ID NO: 9200199 - DNA, 22 bp, Homo sapiens
gagacacacacaggaggtggca

SEQ ID NO: 9200200 - DNA, 22 bp, Homo sapiens
gaagggaaattcagatcttcag

SEQ ID NO: 9200201 - DNA, 22 bp, Homo sapiens
gaaagggagtggacaacaggca

SEQ ID NO: 9200202 - DNA, 18 bp, Homo sapiens
ctttagctgtcatctttg

SEQ ID NO: 9200203 - DNA, 16 bp, Homo sapiens
gagggcagaggcggaa

SEQ ID NO: 9200204 - DNA, 22 bp, Homo sapiens
gagggcagagtctaatgatgca

SEQ ID NO: 9200205 - DNA, 22 bp, Homo sapiens
gaggggaaagtgtgaggctgcg

SEQ ID NO: 9200206 - DNA, 22 bp, Homo sapiens
gaggaatgttattaaaggagct

SEQ ID NO: 9200207 - DNA, 22 bp, Homo sapiens
gagagtggaaagcaagctgagt

SEQ ID NO: 9200208 - DNA, 23 bp, Homo sapiens
gaggagggtctgacaagtgtagc

SEQ ID NO: 9200209 - DNA, 21 bp, Homo sapiens
gctgctcgagatccagtgctt

SEQ ID NO: 9200210 - DNA, 22 bp, Homo sapiens
gctggccttgtgtctgaggaag

SEQ ID NO: 9200211 - DNA, 22 bp, Homo sapiens
gctccaggaggatgaccttcct

SEQ ID NO: 9200212 - DNA, 22 bp, Homo sapiens
gctccaggagctcacagctcgc

SEQ ID NO: 9200213 - DNA, 22 bp, Homo sapiens
gctccaggagagggaagcagat

SEQ ID NO: 9200214 - DNA, 22 bp, Homo sapiens
gctgagagtgtgagatcagatt

SEQ ID NO: 9200215 - DNA, 22 bp, Homo sapiens
gctcctggcttcactgacatca

SEQ ID NO: 9200216 - DNA, 19 bp, Homo sapiens
gctcctgggcctcactcat

SEQ ID NO: 9200217 - DNA, 22 bp, Homo sapiens
gccaggctgtttttattactgt

SEQ ID NO: 9200218 - DNA, 22 bp, Homo sapiens
gccaggctgtggggaacttgaa

SEQ ID NO: 9200219 - DNA, 22 bp, Homo sapiens
gccaggctggttatttaatgag

SEQ ID NO: 9200220 - DNA, 22 bp, Homo sapiens
gccaggctggtgtcacaactct

SEQ ID NO: 9200221 - DNA, 22 bp, Homo sapiens
gccaggctgctccagggaggcc

SEQ ID NO: 9200222 - DNA, 22 bp, Homo sapiens
gccaggctgccttatctctagc

SEQ ID NO: 9200223 - DNA, 22 bp, Homo sapiens
gccaggctgaggctctggaaga

SEQ ID NO: 9200224 - DNA, 22 bp, Homo sapiens
gccaggctgactcccccggcct

SEQ ID NO: 9200225 - DNA, 22 bp, Homo sapiens
gccaggctcttggttatgtttt

SEQ ID NO: 9200226 - DNA, 22 bp, Homo sapiens
gccaggctcttccatttgggtc

SEQ ID NO: 9200227 - DNA, 19 bp, Homo sapiens
gccaggctcttattctgtg

SEQ ID NO: 9200228 - DNA, 22 bp, Homo sapiens
gccaggctctcagtgactgccc

SEQ ID NO: 9200229 - DNA, 22 bp, Homo sapiens
gcccaggctggagtgcagtggc

SEQ ID NO: 9200230 - DNA, 22 bp, Homo sapiens
gcaggctgccctcttgtgttga

SEQ ID NO: 9200231 - DNA, 22 bp, Homo sapiens
gcaggctgctgagatccttagg

SEQ ID NO: 9200232 - DNA, 22 bp, Homo sapiens
gcaggctggaggctgttctggg

SEQ ID NO: 9200233 - DNA, 22 bp, Homo sapiens
gcaggctggtctgaccatccct

SEQ ID NO: 9200234 - DNA, 22 bp, Homo sapiens
gcaggctggggtagccccactt

SEQ ID NO: 9200235 - DNA, 21 bp, Homo sapiens
gcaggctggtcaaacctcagt

SEQ ID NO: 9200236 - DNA, 22 bp, Homo sapiens
gcaggagaaatgaagattgggt

SEQ ID NO: 9200237 - DNA, 22 bp, Homo sapiens
gcagaagctgggcagcgaggtg

SEQ ID NO: 9200238 - DNA, 22 bp, Homo sapiens
gcagaacatttcacagtatctt

SEQ ID NO: 9200239 - DNA, 22 bp, Homo sapiens
gcagaagcagggcaggggcaaa

SEQ ID NO: 9200240 - DNA, 22 bp, Homo sapiens
gcagaagcagcagatgggcgca

SEQ ID NO: 9200241 - DNA, 22 bp, Homo sapiens
gcagaagctgggagaagggatt

SEQ ID NO: 9200242 - DNA, 22 bp, Homo sapiens
ggctcaggtttaaagtgcttta

SEQ ID NO: 9200243 - DNA, 22 bp, Homo sapiens
ggcccctggcaccaggctgatt

SEQ ID NO: 9200244 - DNA, 22 bp, Homo sapiens
ggcccctgcggactgcctagag

SEQ ID NO: 9200245 - DNA, 22 bp, Homo sapiens
ggctgcaggaacgacggagggg

SEQ ID NO: 9200246 - DNA, 22 bp, Homo sapiens
gggctgagaagttgatcccaag

SEQ ID NO: 9200247 - DNA, 22 bp, Homo sapiens
ggagggacccactgcggtgacc

SEQ ID NO: 9200248 - DNA, 22 bp, Homo sapiens
ggaggcggaggttgcagtgagt

SEQ ID NO: 9200249 - DNA, 22 bp, Homo sapiens
ggaggcggaggttgcagtgagc

SEQ ID NO: 9200250 - DNA, 22 bp, Homo sapiens
ggagaaggaatattggagtagg

SEQ ID NO: 9200251 - DNA, 18 bp, Homo sapiens
ggaagtaggaagaggaag

SEQ ID NO: 9200252 - DNA, 23 bp, Homo sapiens
ggagaggggtgtgggcatcttta

SEQ ID NO: 9200253 - DNA, 22 bp, Homo sapiens
ggaactgaggaacgaactggga

SEQ ID NO: 9200254 - DNA, 22 bp, Homo sapiens
ggaaagagcccagcagtgcttg

SEQ ID NO: 9200255 - DNA, 23 bp, Homo sapiens
ggaaagagaggagttgtgcatag

SEQ ID NO: 9200256 - DNA, 19 bp, Homo sapiens
ggaactcacttagagaaac

SEQ ID NO: 9200257 - DNA, 22 bp, Homo sapiens
ggaactcagacgatcctatgtt

SEQ ID NO: 9200258 - DNA, 22 bp, Homo sapiens
ggaactcagtatcagactccag

SEQ ID NO: 9200259 - DNA, 22 bp, Homo sapiens
ggaaagaggatagtgggtaggt

SEQ ID NO: 9200260 - DNA, 22 bp, Homo sapiens
gtgtcctgcaggccaggaatgg

SEQ ID NO: 9200261 - DNA, 22 bp, Homo sapiens
gtggaggacaaaagaagccttt

SEQ ID NO: 9200262 - DNA, 22 bp, Homo sapiens
gtcaggagagatcaggacagca

SEQ ID NO: 9200263 - DNA, 20 bp, Homo sapiens
ttatctgtcaatctgtctca

SEQ ID NO: 9200264 - DNA, 22 bp, Homo sapiens
tgtgctcatggtccagcatggt

SEQ ID NO: 9200265 - DNA, 22 bp, Homo sapiens
tgtgagaggagaaatgcattaa

SEQ ID NO: 9200266 - DNA, 22 bp, Homo sapiens
tgtgagagagtgcatttgcata

SEQ ID NO: 9200267 - DNA, 22 bp, Homo sapiens
tgtattgttataatttgtatgt

SEQ ID NO: 9200268 - DNA, 22 bp, Homo sapiens
tggtttctcagactctttgcag

SEQ ID NO: 9200269 - DNA, 22 bp, Homo sapiens
tgctcagagctccagctctcct

SEQ ID NO: 9200270 - DNA, 22 bp, Homo sapiens
tgctcctgaattacactactac

SEQ ID NO: 9200271 - DNA, 22 bp, Homo sapiens
tgctcctgaacacagccctatg

SEQ ID NO: 9200272 - DNA, 22 bp, Homo sapiens
tgctccagcctatgctctccgg

SEQ ID NO: 9200273 - DNA, 23 bp, Homo sapiens
tgctggagaagcaaagttctgag

SEQ ID NO: 9200274 - DNA, 22 bp, Homo sapiens
tgctggagtgagattatgagtt

SEQ ID NO: 9200275 - DNA, 22 bp, Homo sapiens
tggagggatacaaagatgaaaa

SEQ ID NO: 9200276 - DNA, 22 bp, Homo sapiens
tggagagaaagttgaatggagg

SEQ ID NO: 9200277 - DNA, 22 bp, Homo sapiens
tggagagaaaaaagacagttct

SEQ ID NO: 9200278 - DNA, 22 bp, Homo sapiens
tggagaggttgaataacttgtc

SEQ ID NO: 9200279 - DNA, 22 bp, Homo sapiens
tggagcaggaagtctatggctg

SEQ ID NO: 9200280 - DNA, 22 bp, Homo sapiens
tggaatgaaaatggagatcttg

SEQ ID NO: 9200281 - DNA, 19 bp, Homo sapiens
tggaagaggaagggaaata

SEQ ID NO: 9200282 - DNA, 23 bp, Homo sapiens
tgggagataagcagaagcctggt

SEQ ID NO: 9200283 - DNA, 23 bp, Homo sapiens
tgggaatgacatctagagcagag

SEQ ID NO: 9200284 - DNA, 22 bp, Homo sapiens
tgggaatgctgatttcaggaac

SEQ ID NO: 9200285 - DNA, 22 bp, Homo sapiens
tgggaatgggcctagaaggctg

SEQ ID NO: 9200286 - DNA, 22 bp, Homo sapiens
tggctgggagctggaactgggc

SEQ ID NO: 9200287 - DNA, 22 bp, Homo sapiens
tggctccaccgccgcggagctc

SEQ ID NO: 9200288 - DNA, 22 bp, Homo sapiens
tggctcaggtgtgagctgaaga

SEQ ID NO: 9200289 - DNA, 22 bp, Homo sapiens
tggctcagtgaagagataactt

SEQ ID NO: 9200290 - DNA, 22 bp, Homo sapiens
tggctcaggatctaagcagaat

SEQ ID NO: 9200291 - DNA, 22 bp, Homo sapiens
tggctcagagagggagtgtgga

SEQ ID NO: 9200292 - DNA, 22 bp, Homo sapiens
tggctcagaagaaaaggtaaac

SEQ ID NO: 9200293 - DNA, 17 bp, Homo sapiens
tggctctgaggctgaat

SEQ ID NO: 9200294 - DNA, 22 bp, Homo sapiens
tggccctgtgtgcaggctgcac

SEQ ID NO: 9200295 - DNA, 22 bp, Homo sapiens
tggccctgtctgcacacaggat

SEQ ID NO: 9200296 - DNA, 22 bp, Homo sapiens
tgaatgtgatgctaaacatatg

SEQ ID NO: 9200297 - DNA, 22 bp, Homo sapiens
tctttgcatgagttccctctgt

SEQ ID NO: 9200298 - DNA, 22 bp, Homo sapiens
tcttttagagcatttctgattc

SEQ ID NO: 9200299 - DNA, 22 bp, Homo sapiens
tgaaagagtgcaagtcaaggag

SEQ ID NO: 9200300 - DNA, 22 bp, Homo sapiens
tgaagcaggaaccagcagcatt

SEQ ID NO: 9200301 - DNA, 22 bp, Homo sapiens
tgagtaggtggttaagcatgga

SEQ ID NO: 9200302 - DNA, 22 bp, Homo sapiens
tgagggaatattgatagatccg

SEQ ID NO: 9200303 - DNA, 22 bp, Homo sapiens
tgagggagagggcgaaaatgaa

SEQ ID NO: 9200304 - DNA, 22 bp, Homo sapiens
tgagcagagcagtaacaggagc

SEQ ID NO: 9200305 - DNA, 22 bp, Homo sapiens
tgagcagaggagtgacgtaggt

SEQ ID NO: 9200306 - DNA, 22 bp, Homo sapiens
tgagaggaacaggcagtaggtt

SEQ ID NO: 9200307 - DNA, 22 bp, Homo sapiens
tgagaagagcaaggaactggtt

SEQ ID NO: 9200308 - DNA, 22 bp, Homo sapiens
tgcctggcactcctggagctca

SEQ ID NO: 9200309 - DNA, 22 bp, Homo sapiens
tgccaggccacgtagcttcaag

SEQ ID NO: 9200310 - DNA, 22 bp, Homo sapiens
tgccaggccaattctatttgac

SEQ ID NO: 9200311 - DNA, 22 bp, Homo sapiens
tgccaggcatttgacagacact

SEQ ID NO: 9200312 - DNA, 22 bp, Homo sapiens
tgccaggcccagctccagagct

SEQ ID NO: 9200313 - DNA, 22 bp, Homo sapiens
tgccaggccctcccacagatta

SEQ ID NO: 9200314 - DNA, 21 bp, Homo sapiens
tgcagagatatctgaagcaga

SEQ ID NO: 9200315 - DNA, 22 bp, Homo sapiens
tgcagagatcctggactgagcg

SEQ ID NO: 9200316 - DNA, 22 bp, Homo sapiens
tgcagagattgaacaagaagga

SEQ ID NO: 9200317 - DNA, 22 bp, Homo sapiens
tgcaggaacagaactcactccc

SEQ ID NO: 9200318 - DNA, 22 bp, Homo sapiens
tgcaggaaaaccaacacgcctt

SEQ ID NO: 9200319 - DNA, 19 bp, Homo sapiens
tgcaggaggactgagcaga

SEQ ID NO: 9200320 - DNA, 17 bp, Homo sapiens
tctccaggacgagctca

SEQ ID NO: 9200321 - DNA, 22 bp, Homo sapiens
tctccaggactgagctccagcc

SEQ ID NO: 9200322 - DNA, 22 bp, Homo sapiens
tctccaggcccactgatttata

SEQ ID NO: 9200323 - DNA, 22 bp, Homo sapiens
tctccaggagaaatatgaagga

SEQ ID NO: 9200324 - DNA, 22 bp, Homo sapiens
tctccagggaggtagcccagtg

SEQ ID NO: 9200325 - DNA, 22 bp, Homo sapiens
tctccagggcagagaatagcaa

SEQ ID NO: 9200326 - DNA, 22 bp, Homo sapiens
tctccagggactgaggctggag

SEQ ID NO: 9200327 - DNA, 23 bp, Homo sapiens
tctccaggccttactccaggcct

SEQ ID NO: 9200328 - DNA, 22 bp, Homo sapiens
tctccaggcttaatctcagctt

SEQ ID NO: 9200329 - DNA, 19 bp, Homo sapiens
tctccaggtgccccaaaca

SEQ ID NO: 9200330 - DNA, 22 bp, Homo sapiens
tctccaggtgagggtggttaga

SEQ ID NO: 9200331 - DNA, 22 bp, Homo sapiens
tctccaggtagatatgtcagga

SEQ ID NO: 9200332 - DNA, 22 bp, Homo sapiens
tctccaggtgaaacttgcaggg

SEQ ID NO: 9200333 - DNA, 22 bp, Homo sapiens
tctcctgggtgctttatcagaa

SEQ ID NO: 9200334 - DNA, 22 bp, Homo sapiens
tctctgtgactgcagctttgca

SEQ ID NO: 9200335 - DNA, 22 bp, Homo sapiens
tctctgtgtctcatgttcctat

SEQ ID NO: 9200336 - DNA, 22 bp, Homo sapiens
tctctgtgcttgactttcccat

SEQ ID NO: 9200337 - DNA, 22 bp, Homo sapiens
tctgtcctccggagctcccagt

SEQ ID NO: 9200338 - DNA, 18 bp, Homo sapiens
tctgtccttccattcttc

SEQ ID NO: 9200339 - DNA, 22 bp, Homo sapiens
tctgtcctgtttcctcctgaca

SEQ ID NO: 9200340 - DNA, 22 bp, Homo sapiens
tctgtcctctccctgaccacaa

SEQ ID NO: 9200341 - DNA, 22 bp, Homo sapiens
tctgtgtctcaatcccatgctg

SEQ ID NO: 9200342 - DNA, 22 bp, Homo sapiens
tctgctgttctcatgctgattt

SEQ ID NO: 9200343 - DNA, 22 bp, Homo sapiens
tctggagaggaggatgtggaca

SEQ ID NO: 9200344 - DNA, 22 bp, Homo sapiens
acaggctgatagaccataaata

SEQ ID NO: 9200345 - DNA, 22 bp, Homo sapiens
acaggctgttggggtccagggt

SEQ ID NO: 9200346 - DNA, 22 bp, Homo sapiens
acaggctgagcgtccatcttca

SEQ ID NO: 9200347 - DNA, 22 bp, Homo sapiens
acaggctgacttcctgccatgt

SEQ ID NO: 9200348 - DNA, 22 bp, Homo sapiens
acaggctgaggatgattgcatc

SEQ ID NO: 9200349 - DNA, 22 bp, Homo sapiens
acaggctgaaagttaagttctg

SEQ ID NO: 9200350 - DNA, 23 bp, Homo sapiens
acaggctcttaatcagtgctcct

SEQ ID NO: 9200351 - DNA, 22 bp, Homo sapiens
acaggaaccaggcaggtcgatt

SEQ ID NO: 9200352 - DNA, 22 bp, Homo sapiens
acaggctctggggcaggatggc

SEQ ID NO: 9200353 - DNA, 22 bp, Homo sapiens
acctggcttctaatcatggctc

SEQ ID NO: 9200354 - DNA, 21 bp, Homo sapiens
actcatctttttggagaccag

SEQ ID NO: 9200355 - DNA, 22 bp, Homo sapiens
agccaggctactccttgctgac

SEQ ID NO: 9200356 - DNA, 22 bp, Homo sapiens
agccaggcgggtctttgctcct

SEQ ID NO: 9200357 - DNA, 22 bp, Homo sapiens
agccaggctaaatgagccatga

SEQ ID NO: 9200358 - DNA, 22 bp, Homo sapiens
agccaggcgcagtggcttatgc

SEQ ID NO: 9200359 - DNA, 22 bp, Homo sapiens
agctcattgaagtcatgacctg

SEQ ID NO: 9200360 - DNA, 22 bp, Homo sapiens
agcaggagctgtgggaagatgg

SEQ ID NO: 9200361 - DNA, 20 bp, Homo sapiens
agagagcacaggcaggaaag

SEQ ID NO: 9200362 - DNA, 22 bp, Homo sapiens
agagagcaggacttcactgagc

SEQ ID NO: 9200363 - DNA, 22 bp, Homo sapiens
agagagaggggcgagcaaacac

SEQ ID NO: 9200364 - DNA, 20 bp, Homo sapiens
agagagaggtaaattgagca

SEQ ID NO: 9200365 - DNA, 22 bp, Homo sapiens
agagggctaactgggaagcagg

SEQ ID NO: 9200366 - DNA, 22 bp, Homo sapiens
aaacttgagccaagggcttggg

SEQ ID NO: 9200367 - DNA, 22 bp, Homo sapiens
aagagagagttcctaggcaaaa

SEQ ID NO: 9200368 - DNA, 22 bp, Homo sapiens
aagaggaagtctccatggagag

SEQ ID NO: 9200369 - DNA, 22 bp, Homo sapiens
aagcagaaagaacaactgagtg

SEQ ID NO: 9200370 - DNA, 22 bp, Homo sapiens
aagaggaactgggggctgagtc

SEQ ID NO: 9200371 - DNA, 22 bp, Homo sapiens
aactcagtgtgtttcttagtat

SEQ ID NO: 9200372 - DNA, 22 bp, Homo sapiens
aactccagcaggaaggtgagaa

SEQ ID NO: 9200373 - DNA, 22 bp, Homo sapiens
aactccagctcacacagtgacc

SEQ ID NO: 9200374 - DNA, 22 bp, Homo sapiens
aactccagggtcaccattcaca

SEQ ID NO: 9200375 - DNA, 22 bp, Homo sapiens
aacaaatgtgtggcagtgtggg

SEQ ID NO: 9200376 - DNA, 22 bp, Homo sapiens
agccaggcagggctctcgctct

SEQ ID NO: 9200377 - DNA, 22 bp, Homo sapiens
agcaggaagtcctctcaggaga

SEQ ID NO: 9200378 - DNA, 22 bp, Homo sapiens
agcaggaatctgttctgtataa

SEQ ID NO: 9200379 - DNA, 22 bp, Homo sapiens
agcaggaagtagtctgtaagca

SEQ ID NO: 9200380 - DNA, 20 bp, Homo sapiens
agcaggaatgatgctttcat

SEQ ID NO: 9200381 - DNA, 22 bp, Homo sapiens
agcaggaaggggcctagcctgg

SEQ ID NO: 9200382 - DNA, 22 bp, Homo sapiens
agcaggaaggggatgatgggca

SEQ ID NO: 9200383 - DNA, 22 bp, Homo sapiens
agcaggaaggtctgtgtgagtc

SEQ ID NO: 9200384 - DNA, 22 bp, Homo sapiens
agcaggaactgacaccaagcca

SEQ ID NO: 9200385 - DNA, 22 bp, Homo sapiens
agagggcttccctaggagtgag

SEQ ID NO: 9200386 - DNA, 22 bp, Homo sapiens
agaggggagagctaagcaattc

SEQ ID NO: 9200387 - DNA, 22 bp, Homo sapiens
agaggggaagtaatgaatgata

SEQ ID NO: 9200388 - DNA, 22 bp, Homo sapiens
agaggggaggcgaaccagagtc

SEQ ID NO: 9200389 - DNA, 22 bp, Homo sapiens
attggccatttgcatgtattat

SEQ ID NO: 9200390 - DNA, 20 bp, Homo sapiens
agcaagagtaaggacagcga

SEQ ID NO: 9200391 - DNA, 22 bp, Homo sapiens
agagagggcatagaaaaaggga

SEQ ID NO: 9200392 - DNA, 21 bp, Homo sapiens
agagagggagatgaaacatcc

SEQ ID NO: 9200393 - DNA, 19 bp, Homo sapiens
agagaggctgtgtgaggga

SEQ ID NO: 9200394 - DNA, 22 bp, Homo sapiens
agagacaatgccaatgcacacg

SEQ ID NO: 9200395 - DNA, 22 bp, Homo sapiens
agagagaagcaatcagtggcca

SEQ ID NO: 9200396 - DNA, 22 bp, Homo sapiens
agagcccagtgacatcagcaca

SEQ ID NO: 9200397 - DNA, 22 bp, Homo sapiens
agagcagatttcaaatattggc

SEQ ID NO: 9200398 - DNA, 22 bp, Homo sapiens
agaaggagtgtacaggtcatgc

SEQ ID NO: 9200399 - DNA, 22 bp, Homo sapiens
agaaagaggatgcagatctcat

SEQ ID NO: 9200400 - DNA, 22 bp, Homo sapiens
agtgctcctttcattgctgccc

SEQ ID NO: 9200401 - DNA, 22 bp, Homo sapiens
actccaggggttgctatttaca

SEQ ID NO: 9200402 - DNA, 22 bp, Homo sapiens
actccagggtgactctgtctga

SEQ ID NO: 9200403 - DNA, 22 bp, Homo sapiens
actccagggttttgcacctgga

SEQ ID NO: 9200404 - DNA, 22 bp, Homo sapiens
actcctggaaaagaacgcaggg

SEQ ID NO: 9200405 - DNA, 22 bp, Homo sapiens
accaggaggcctggagcacaaa

SEQ ID NO: 9200406 - DNA, 22 bp, Homo sapiens
accaggagccacaggaggagcc

SEQ ID NO: 9200407 - DNA, 22 bp, Homo sapiens
accagctctttcttttcactat

SEQ ID NO: 9200408 - DNA, 22 bp, Homo sapiens
accaggctgtgaagtgagacta

SEQ ID NO: 9200409 - DNA, 22 bp, Homo sapiens
accagggcttacagcagtagct

SEQ ID NO: 9200410 - DNA, 22 bp, Homo sapiens
aggctccagcagccagaggaag

SEQ ID NO: 9200411 - DNA, 22 bp, Homo sapiens
aggcttcccagctgagctcagc

SEQ ID NO: 9200412 - DNA, 22 bp, Homo sapiens
aggaagagcattcacatggtag

SEQ ID NO: 9200413 - DNA, 18 bp, Homo sapiens
aggaaagaaaggcaggtg

SEQ ID NO: 9200414 - DNA, 22 bp, Homo sapiens
aggaagggatacataggatagt

SEQ ID NO: 9200415 - DNA, 22 bp, Homo sapiens
aggaaaagtgtgaagtatggag

SEQ ID NO: 9200416 - DNA, 22 bp, Homo sapiens
aggaatgtttagaatgtcagaa

SEQ ID NO: 9200417 - DNA, 22 bp, Homo sapiens
aggaagggtggatagtaacgtg

SEQ ID NO: 9200418 - DNA, 22 bp, Homo sapiens
caggtcccctcccctaccaggc

SEQ ID NO: 9200419 - DNA, 22 bp, Homo sapiens
ccaggctggtctgaatttctag

SEQ ID NO: 9200420 - DNA, 22 bp, Homo sapiens
ccaggctggagtatagtggcgc

SEQ ID NO: 9200421 - DNA, 22 bp, Homo sapiens
ccaggctgctttattactctgt

SEQ ID NO: 9200422 - DNA, 22 bp, Homo sapiens
ccaggctggaatcaatattctg

SEQ ID NO: 9200423 - DNA, 22 bp, Homo sapiens
ccaggctgcttagccttatctt

SEQ ID NO: 9200424 - DNA, 22 bp, Homo sapiens
ccaggctgggctacaagttgag

SEQ ID NO: 9200425 - DNA, 15 bp, Homo sapiens
ccaggctgggtgagc

SEQ ID NO: 9200426 - DNA, 22 bp, Homo sapiens
ccaggctgggcggggaacctgg

SEQ ID NO: 9200427 - DNA, 21 bp, Homo sapiens
ccaggctgggagggcagttcc

SEQ ID NO: 9200428 - DNA, 22 bp, Homo sapiens
ccaggctctgcgctggacatgg

SEQ ID NO: 9200429 - DNA, 22 bp, Homo sapiens
ccaggctgctgttggtgtccgc

SEQ ID NO: 9200430 - DNA, 22 bp, Homo sapiens
aggctggggaattgaatttgct

SEQ ID NO: 9200431 - DNA, 22 bp, Homo sapiens
aggctggagtgcagttgcatga

SEQ ID NO: 9200432 - DNA, 22 bp, Homo sapiens
ccagctctggcttcttgctggg

SEQ ID NO: 9200433 - DNA, 22 bp, Homo sapiens
ccagagcctggcatctgcataa

SEQ ID NO: 9200434 - DNA, 22 bp, Homo sapiens
ccagagctaaacacacaggctg

SEQ ID NO: 9200435 - DNA, 22 bp, Homo sapiens
cccaggctgatgttcagcgggt

SEQ ID NO: 9200436 - DNA, 22 bp, Homo sapiens
cccaggctgccacgattactgc

SEQ ID NO: 9200437 - DNA, 22 bp, Homo sapiens
cccaggctgcatgagtccatgg

SEQ ID NO: 9200438 - DNA, 22 bp, Homo sapiens
cccaggctgatgggatgggcca

SEQ ID NO: 9200439 - DNA, 22 bp, Homo sapiens
cccaggcttttctcttgcccca

SEQ ID NO: 9200440 - DNA, 22 bp, Homo sapiens
cccaggcttttaagttagacag

SEQ ID NO: 9200441 - DNA, 22 bp, Homo sapiens
cccaggctgtgcaaacttcaaa

SEQ ID NO: 9200442 - DNA, 22 bp, Homo sapiens
cccaggcttcccaatcagaagg

SEQ ID NO: 9200443 - DNA, 18 bp, Homo sapiens
cccaggctttgtgggtct

SEQ ID NO: 9200444 - DNA, 22 bp, Homo sapiens
cccaggctgtctgtcctttgct

SEQ ID NO: 9200445 - DNA, 22 bp, Homo sapiens
cccaggctgcgtatccacaata

SEQ ID NO: 9200446 - DNA, 22 bp, Homo sapiens
cccaggctggtcctgaactcct

SEQ ID NO: 9200447 - DNA, 22 bp, Homo sapiens
cctgaaacatcttctgtaaata

SEQ ID NO: 9200448 - DNA, 22 bp, Homo sapiens
agggctggcatctctaatgctg

SEQ ID NO: 9200449 - DNA, 22 bp, Homo sapiens
agggctggctaggtgcgttccc

SEQ ID NO: 9200450 - DNA, 20 bp, Homo sapiens
ctggccagaacgcctacaca

SEQ ID NO: 9200451 - DNA, 22 bp, Homo sapiens
ctggcctcacagaggctaagcc

SEQ ID NO: 9200452 - DNA, 22 bp, Homo sapiens
ctggcctaaaaatacagaacaa

SEQ ID NO: 9200453 - DNA, 22 bp, Homo sapiens
atctgtggctggtgagaggcag

SEQ ID NO: 9200454 - DNA, 22 bp, Homo sapiens
atctgtggccaaaagactgttg

SEQ ID NO: 9200455 - DNA, 22 bp, Homo sapiens
atctgtggcagtgatgagtctt

SEQ ID NO: 9200456 - DNA, 22 bp, Homo sapiens
ctggtccctggacctccctgga

SEQ ID NO: 9200457 - DNA, 22 bp, Homo sapiens
agtgaggggattcaggcaaggt

SEQ ID NO: 9200458 - DNA, 22 bp, Homo sapiens
agtgtgagtaattcagggaggg

SEQ ID NO: 9200459 - DNA, 22 bp, Homo sapiens
agtgtgagctaatagcagagcc

SEQ ID NO: 9200460 - DNA, 22 bp, Homo sapiens
agtgtcccctacagaggcattc

SEQ ID NO: 9200461 - DNA, 22 bp, Homo sapiens
ctgagctgctcccgctgcagcg

SEQ ID NO: 9200462 - DNA, 22 bp, Homo sapiens
agtaggaggcgggagcatgaag

SEQ ID NO: 9200463 - DNA, 22 bp, Homo sapiens
gcctggctcacagagcagcctt

SEQ ID NO: 9200464 - DNA, 22 bp, Homo sapiens
gcctggctccctctgcagctcc

SEQ ID NO: 9200465 - DNA, 22 bp, Homo sapiens
gcctggctcgggcactcgccag

SEQ ID NO: 9200466 - DNA, 22 bp, Homo sapiens
gctccaggcgagctggaccaga

SEQ ID NO: 9200467 - DNA, 17 bp, Homo sapiens
gctccaggcgtgagtga

SEQ ID NO: 9200468 - DNA, 22 bp, Homo sapiens
gctccaggccccagcgttccgc

SEQ ID NO: 9200469 - DNA, 22 bp, Homo sapiens
gctccaggcagcatagtggatg

SEQ ID NO: 9200470 - DNA, 22 bp, Homo sapiens
gcagaagggaataaggagcttt

SEQ ID NO: 9200471 - DNA, 22 bp, Homo sapiens
gcaggctgtggtatgttgggca

SEQ ID NO: 9200472 - DNA, 22 bp, Homo sapiens
gcaggctgtagacaccaaacta

SEQ ID NO: 9200473 - DNA, 22 bp, Homo sapiens
gcaggctgtctaaagttagagt

SEQ ID NO: 9200474 - DNA, 22 bp, Homo sapiens
gcaggctgtgaggctcagatgg

SEQ ID NO: 9200475 - DNA, 22 bp, Homo sapiens
gaggaagatggttgagtggtcc

SEQ ID NO: 9200476 - DNA, 22 bp, Homo sapiens
gtgcctgggcatgagcttgttg

SEQ ID NO: 9200477 - DNA, 22 bp, Homo sapiens
gtgcaggagctcccgcagtggt

SEQ ID NO: 9200478 - DNA, 16 bp, Homo sapiens
cagagaggacagaggc

SEQ ID NO: 9200479 - DNA, 22 bp, Homo sapiens
cagagagcacataggatacttt

SEQ ID NO: 9200480 - DNA, 22 bp, Homo sapiens
cacagcagggatgaatggagtg

SEQ ID NO: 9200481 - DNA, 22 bp, Homo sapiens
cacagagaatactgctcttgct

SEQ ID NO: 9200482 - DNA, 22 bp, Homo sapiens
ggaacaggaaaggagggatgct

SEQ ID NO: 9200483 - DNA, 22 bp, Homo sapiens
ggaagagaaatgagtcaagact

SEQ ID NO: 9200484 - DNA, 19 bp, Homo sapiens
ggaagagaggaaaggtgga

SEQ ID NO: 9200485 - DNA, 22 bp, Homo sapiens
ggaagagaatgatggctatggg

SEQ ID NO: 9200486 - DNA, 22 bp, Homo sapiens
cagaacagtacctagcacatag

SEQ ID NO: 9200487 - DNA, 22 bp, Homo sapiens
cagaacagacttaacagggctg

SEQ ID NO: 9200488 - DNA, 22 bp, Homo sapiens
ggctcctgggggtgctcctgcc

SEQ ID NO: 9200489 - DNA, 22 bp, Homo sapiens
ggagtgagcaaatagagatttg

SEQ ID NO: 9200490 - DNA, 22 bp, Homo sapiens
ggagtgactcacagctgggaca

SEQ ID NO: 9200491 - DNA, 22 bp, Homo sapiens
ggatcagaggatcagggacagt

SEQ ID NO: 9200492 - DNA, 22 bp, Homo sapiens
ggcaggaagtagcagtctgagc

SEQ ID NO: 9200493 - DNA, 22 bp, Homo sapiens
caggctgcagcagcagtggccc

SEQ ID NO: 9200494 - DNA, 22 bp, Homo sapiens
cagggcagtgaagaacacacgt

SEQ ID NO: 9200495 - DNA, 22 bp, Homo sapiens
caggctccctgcaggccagtga

SEQ ID NO: 9200496 - DNA, 22 bp, Homo sapiens
caggctccctgggcagtggcag

SEQ ID NO: 9200497 - DNA, 23 bp, Homo sapiens
caggctcccggaccaggatccgc

SEQ ID NO: 9200498 - DNA, 20 bp, Homo sapiens
caggctccgcaggactaggg

SEQ ID NO: 9200499 - DNA, 22 bp, Homo sapiens
caggctcctcactcatgctccc

SEQ ID NO: 9200500 - DNA, 22 bp, Homo sapiens
caggctccagcttcctgctcag

SEQ ID NO: 9200501 - DNA, 22 bp, Homo sapiens
caggctccactgtaggcagctc

SEQ ID NO: 9200502 - DNA, 22 bp, Homo sapiens
tctcaggcattcccacatagaa

SEQ ID NO: 9200503 - DNA, 23 bp, Homo sapiens
tctcaggcaaaccaggacaagtt

SEQ ID NO: 9200504 - DNA, 22 bp, Homo sapiens
tctcaggagccacagcgggagt

SEQ ID NO: 9200505 - DNA, 22 bp, Homo sapiens
tctcaggactcctctggccata

SEQ ID NO: 9200506 - DNA, 22 bp, Homo sapiens
tctcaggaatagagtggcagca

SEQ ID NO: 9200507 - DNA, 22 bp, Homo sapiens
tctcagctgcctgccctgctcc

SEQ ID NO: 9200508 - DNA, 22 bp, Homo sapiens
ccagagcccctgagcttccctg

SEQ ID NO: 9200509 - DNA, 22 bp, Homo sapiens
ccacaggctgctgcaggtcccg

SEQ ID NO: 9200510 - DNA, 22 bp, Homo sapiens
tccaggctttggggcaggagcg

SEQ ID NO: 9200511 - DNA, 22 bp, Homo sapiens
tccaggcttgagaccaggctct

SEQ ID NO: 9200512 - DNA, 22 bp, Homo sapiens
tccaggcttcacgtctgccctc

SEQ ID NO: 9200513 - DNA, 22 bp, Homo sapiens
tccaggctgtgcgcaccgtgtg

SEQ ID NO: 9200514 - DNA, 22 bp, Homo sapiens
tccaggctgtgcatgagtttag

SEQ ID NO: 9200515 - DNA, 20 bp, Homo sapiens
tccaggctcctccacttagt

SEQ ID NO: 9200516 - DNA, 22 bp, Homo sapiens
tccaggctgggctgaagggtgc

SEQ ID NO: 9200517 - DNA, 22 bp, Homo sapiens
tcaggctgcccgttcagggctc

SEQ ID NO: 9200518 - DNA, 22 bp, Homo sapiens
tcaggctgcatctgtaagggtg

SEQ ID NO: 9200519 - DNA, 18 bp, Homo sapiens
tcaggctgccctgtgtct

SEQ ID NO: 9200520 - DNA, 22 bp, Homo sapiens
tcaggctgatttcttttgaggg

SEQ ID NO: 9200521 - DNA, 22 bp, Homo sapiens
tcaggctgcagtggcaaaagac

SEQ ID NO: 9200522 - DNA, 22 bp, Homo sapiens
tcaggctgcagctgtcagcagc

SEQ ID NO: 9200523 - DNA, 22 bp, Homo sapiens
tcaggaggctcaagacctggca

SEQ ID NO: 9200524 - DNA, 22 bp, Homo sapiens
cagtgtcctcagccagcagcta

SEQ ID NO: 9200525 - DNA, 22 bp, Homo sapiens
ccctcctcaactctggcttcca

SEQ ID NO: 9200526 - DNA, 22 bp, Homo sapiens
cctccaggtgttacatatgact

SEQ ID NO: 9200527 - DNA, 21 bp, Homo sapiens
cctccaggtgattccgtgctc

SEQ ID NO: 9200528 - DNA, 22 bp, Homo sapiens
cctccagggcccctctcactgg

SEQ ID NO: 9200529 - DNA, 22 bp, Homo sapiens
cctccaggctggttatcagctg

SEQ ID NO: 9200530 - DNA, 22 bp, Homo sapiens
tgcagagaaagtgtagacaggc

SEQ ID NO: 9200531 - DNA, 22 bp, Homo sapiens
tgcaggaatagctacagagctg

SEQ ID NO: 9200532 - DNA, 22 bp, Homo sapiens
tgcaggcattggtgagagaagc

SEQ ID NO: 9200533 - DNA, 22 bp, Homo sapiens
tgagtcctgtctttgtcactta

SEQ ID NO: 9200534 - DNA, 22 bp, Homo sapiens
ccaggctgttttcaaacttggg

SEQ ID NO: 9200535 - DNA, 22 bp, Homo sapiens
ccaggctgtggtttagatagag

SEQ ID NO: 9200536 - DNA, 22 bp, Homo sapiens
ccaggctgtgcttttcataaat

SEQ ID NO: 9200537 - DNA, 22 bp, Homo sapiens
ccaggctgtaagagtgatgttg

SEQ ID NO: 9200538 - DNA, 22 bp, Homo sapiens
ccaggaggcggaggttgcagtg

SEQ ID NO: 9200539 - DNA, 22 bp, Homo sapiens
ccaggcaggcgatggtgcagtg

SEQ ID NO: 9200540 - DNA, 22 bp, Homo sapiens
ccaggaggcggaggttgcagcg

SEQ ID NO: 9200541 - DNA, 22 bp, Homo sapiens
gaaaggaacttgtgagtgggag

SEQ ID NO: 9200542 - DNA, 18 bp, Homo sapiens
gaaaggagagacagtagg

SEQ ID NO: 9200543 - DNA, 22 bp, Homo sapiens
gaaaggagagggttaaggagct

SEQ ID NO: 9200544 - DNA, 22 bp, Homo sapiens
gaaaggagggaaacagagcggt

SEQ ID NO: 9200545 - DNA, 22 bp, Homo sapiens
gacagaaggcatctagggcacg

SEQ ID NO: 9200546 - DNA, 22 bp, Homo sapiens
gacagacaggaggcattcaggg

SEQ ID NO: 9200547 - DNA, 22 bp, Homo sapiens
gactccaggtgtccaggcctcc

SEQ ID NO: 9200548 - DNA, 22 bp, Homo sapiens
gaccaggagatttgagctaggc

SEQ ID NO: 9200549 - DNA, 22 bp, Homo sapiens
gacagagattgaatcaggaaat

SEQ ID NO: 9200550 - DNA, 22 bp, Homo sapiens
gacagagaggctgagcagtaca

SEQ ID NO: 9200551 - DNA, 21 bp, Homo sapiens
gagagggcattataggaagtg

SEQ ID NO: 9200552 - DNA, 22 bp, Homo sapiens
gagagggccagggtgagaacta

SEQ ID NO: 9200553 - DNA, 18 bp, Homo sapiens
gagagggatccctcagga

SEQ ID NO: 9200554 - DNA, 22 bp, Homo sapiens
gagagaaaggcttgcaggctgt

SEQ ID NO: 9200555 - DNA, 22 bp, Homo sapiens
gaggagagatggtagattgggt

SEQ ID NO: 9200556 - DNA, 22 bp, Homo sapiens
gaggcagggtgttgattacaga

SEQ ID NO: 9200557 - DNA, 22 bp, Homo sapiens
gagggctgcaatgagacagaga

SEQ ID NO: 9200558 - DNA, 22 bp, Homo sapiens
gagggagagtgatggaccattg

SEQ ID NO: 9200559 - DNA, 22 bp, Homo sapiens
gagcagtggtcacagggaggga

SEQ ID NO: 9200560 - DNA, 22 bp, Homo sapiens
gagagggctgcctggtgtgagg

SEQ ID NO: 9200561 - DNA, 22 bp, Homo sapiens
gaggaagaaagcataggtgggg

SEQ ID NO: 9200562 - DNA, 22 bp, Homo sapiens
gaggaagaatcagggtggtgag

SEQ ID NO: 9200563 - DNA, 22 bp, Homo sapiens
gaggaaagctggtttaaagtat

SEQ ID NO: 9200564 - DNA, 22 bp, Homo sapiens
gaggaaagagtcaaatctgaag

SEQ ID NO: 9200565 - DNA, 23 bp, Homo sapiens
gaggaaagaatatagatgcaatc

SEQ ID NO: 9200566 - DNA, 22 bp, Homo sapiens
gaggaaagaaccccagtcaata

SEQ ID NO: 9200567 - DNA, 22 bp, Homo sapiens
ctgggagatatgaggatctgga

SEQ ID NO: 9200568 - DNA, 22 bp, Homo sapiens
ctgtctgtcaagttcatctcca

SEQ ID NO: 9200569 - DNA, 22 bp, Homo sapiens
gaaagagaggggctgagatgca

SEQ ID NO: 9200570 - DNA, 22 bp, Homo sapiens
ctcaggcttgggaggaggccca

SEQ ID NO: 9200571 - DNA, 22 bp, Homo sapiens
cctgctcctatctgggctcatt

SEQ ID NO: 9200572 - DNA, 22 bp, Homo sapiens
tatctttgcaaatatctctaag

SEQ ID NO: 9200573 - DNA, 22 bp, Homo sapiens
tagtggatgttcagagatttga

SEQ ID NO: 9200574 - DNA, 22 bp, Homo sapiens
taggaaagcagtagagccagga

SEQ ID NO: 9200575 - DNA, 22 bp, Homo sapiens
taggaaagaaatgagtagtgat

SEQ ID NO: 9200576 - DNA, 22 bp, Homo sapiens
gtttctgttgctcagataatgc

SEQ ID NO: 9200577 - DNA, 22 bp, Homo sapiens
gtttctgtgttagatgagtctt

SEQ ID NO: 9200578 - DNA, 22 bp, Homo sapiens
tcatgtgtcctagttcatataa

SEQ ID NO: 9200579 - DNA, 22 bp, Homo sapiens
tccaggacagcggcaggcagat

SEQ ID NO: 9200580 - DNA, 21 bp, Homo sapiens
tcccagctgggtcagtgctgc

SEQ ID NO: 9200581 - DNA, 23 bp, Homo sapiens
tcagagagctgttgagagctgcc

SEQ ID NO: 9200582 - DNA, 22 bp, Homo sapiens
tcagagagctggtgggcagagg

SEQ ID NO: 9200583 - DNA, 22 bp, Homo sapiens
tcagagagcctcaggcactgcc

SEQ ID NO: 9200584 - DNA, 22 bp, Homo sapiens
tcagctgtgtatcccagggcct

SEQ ID NO: 9200585 - DNA, 23 bp, Homo sapiens
tcagctgttcttttccctgggac

SEQ ID NO: 9200586 - DNA, 22 bp, Homo sapiens
tcagctgttatcactgtctgtc

SEQ ID NO: 9200587 - DNA, 19 bp, Homo sapiens
tcaggaggtcgacctggca

SEQ ID NO: 9200588 - DNA, 22 bp, Homo sapiens
tcagggctgccgggcagaccgt

SEQ ID NO: 9200589 - DNA, 22 bp, Homo sapiens
tcaggctgagaaaatctggacc

SEQ ID NO: 9200590 - DNA, 22 bp, Homo sapiens
tcaggctgaccaggttttgctc

SEQ ID NO: 9200591 - DNA, 22 bp, Homo sapiens
tcaggctgaaaggactccagtt

SEQ ID NO: 9200592 - DNA, 22 bp, Homo sapiens
tcaggctgaatcatcctagctt

SEQ ID NO: 9200593 - DNA, 22 bp, Homo sapiens
tcaggctgaaggaggcctatct

SEQ ID NO: 9200594 - DNA, 17 bp, Homo sapiens
gcctactcctatactcc

SEQ ID NO: 9200595 - DNA, 22 bp, Homo sapiens
gcccaggctggagtgcagtggt

SEQ ID NO: 9200596 - DNA, 22 bp, Homo sapiens
gcaggctgatgactggagttgg

SEQ ID NO: 9200597 - DNA, 22 bp, Homo sapiens
gcaggctgatagaggattccat

SEQ ID NO: 9200598 - DNA, 22 bp, Homo sapiens
gcaggctgccaccttctgagtt

SEQ ID NO: 9200599 - DNA, 22 bp, Homo sapiens
gcaggctgaaactcggggtcta

SEQ ID NO: 9200600 - DNA, 22 bp, Homo sapiens
gcaggctgagagtccaagaagg

SEQ ID NO: 9200601 - DNA, 22 bp, Homo sapiens
gcaggctgagtattaccctagt

SEQ ID NO: 9200602 - DNA, 22 bp, Homo sapiens
gcaggctgagttgggaaaccaa

SEQ ID NO: 9200603 - DNA, 22 bp, Homo sapiens
gcagaggacacaggagggcaag

SEQ ID NO: 9200604 - DNA, 22 bp, Homo sapiens
gcacagcatgaagagaggaagc

SEQ ID NO: 9200605 - DNA, 22 bp, Homo sapiens
gcctggctaagcagaaggaccc

SEQ ID NO: 9200606 - DNA, 22 bp, Homo sapiens
gcctggctgctcagccactcac

SEQ ID NO: 9200607 - DNA, 22 bp, Homo sapiens
gcctggctagttagtgtcaggt

SEQ ID NO: 9200608 - DNA, 21 bp, Homo sapiens
gcctggctagaagctcctagc

SEQ ID NO: 9200609 - DNA, 19 bp, Homo sapiens
gcctggctgggatgagccc

SEQ ID NO: 9200610 - DNA, 22 bp, Homo sapiens
gcctggctgcttagcctacttc

SEQ ID NO: 9200611 - DNA, 22 bp, Homo sapiens
gcctggctggtcactgcctggc

SEQ ID NO: 9200612 - DNA, 22 bp, Homo sapiens
gcctggcttggggctcagtggt

SEQ ID NO: 9200613 - DNA, 22 bp, Homo sapiens
gctcctggtctggagcttcaag

SEQ ID NO: 9200614 - DNA, 22 bp, Homo sapiens
gctcaggctggattgcagtggc

SEQ ID NO: 9200615 - DNA, 22 bp, Homo sapiens
gctcctgtgaggacacagccgc

SEQ ID NO: 9200616 - DNA, 22 bp, Homo sapiens
gctggctcagggactagagttt

SEQ ID NO: 9200617 - DNA, 22 bp, Homo sapiens
gctggcacatggctcagggcct

SEQ ID NO: 9200618 - DNA, 21 bp, Homo sapiens
gctggctctctgacgtgcttt

SEQ ID NO: 9200619 - DNA, 22 bp, Homo sapiens
ggaaggaagtgaccaggatatc

SEQ ID NO: 9200620 - DNA, 22 bp, Homo sapiens
ggaaaggagatattggagagtg

SEQ ID NO: 9200621 - DNA, 22 bp, Homo sapiens
ggagaggagctattgggggctc

SEQ ID NO: 9200622 - DNA, 22 bp, Homo sapiens
ggctcctgaggaccaggcacag

SEQ ID NO: 9200623 - DNA, 21 bp, Homo sapiens
ggctggacatcccaggagact

SEQ ID NO: 9200624 - DNA, 21 bp, Homo sapiens
gggagggatggaaatgatgtt

SEQ ID NO: 9200625 - DNA, 22 bp, Homo sapiens
ggccaggaagggaagatcagca

SEQ ID NO: 9200626 - DNA, 22 bp, Homo sapiens
ggccaggagcaagccaggctct

SEQ ID NO: 9200627 - DNA, 22 bp, Homo sapiens
ggcagaaggcctcccagctcct

SEQ ID NO: 9200628 - DNA, 22 bp, Homo sapiens
gtcagtgtagcaggtgcaagcc

SEQ ID NO: 9200629 - DNA, 22 bp, Homo sapiens
gtcagtgtgagttgattccata

SEQ ID NO: 9200630 - DNA, 22 bp, Homo sapiens
gtctcctgagactgcagtcacc

SEQ ID NO: 9200631 - DNA, 22 bp, Homo sapiens
gtctcctgtcctgcaggatgga

SEQ ID NO: 9200632 - DNA, 22 bp, Homo sapiens
ggtgggagtggaacgtggaaga

SEQ ID NO: 9200633 - DNA, 22 bp, Homo sapiens
gggctccagccagctccttgtg

SEQ ID NO: 9200634 - DNA, 22 bp, Homo sapiens
gggcatcaccaagaaggaggac

SEQ ID NO: 9200635 - DNA, 22 bp, Homo sapiens
tttgtcttatccaatctctcag

SEQ ID NO: 9200636 - DNA, 22 bp, Homo sapiens
ttttggctctgtctgtatcttt

SEQ ID NO: 9200637 - DNA, 19 bp, Homo sapiens
ttgagaattatctgagtca

SEQ ID NO: 9200638 - DNA, 22 bp, Homo sapiens
ttgagaataaattagcagacat

SEQ ID NO: 9200639 - DNA, 22 bp, Homo sapiens
cagagggacagtgtaatgcata

SEQ ID NO: 9200640 - DNA, 22 bp, Homo sapiens
cagagggaccagaacatactgt

SEQ ID NO: 9200641 - DNA, 22 bp, Homo sapiens
cagagggagccctccaggagca

SEQ ID NO: 9200642 - DNA, 22 bp, Homo sapiens
cagagggacagtatgatgaaag

SEQ ID NO: 9200643 - DNA, 22 bp, Homo sapiens
cagagggagtttctgaggttgc

SEQ ID NO: 9200644 - DNA, 22 bp, Homo sapiens
cagagggatcatcttcctgaag

SEQ ID NO: 9200645 - DNA, 22 bp, Homo sapiens
caagcagagaggtcaactaata

SEQ ID NO: 9200646 - DNA, 22 bp, Homo sapiens
agcagcaggctagggaactgct

SEQ ID NO: 9200647 - DNA, 22 bp, Homo sapiens
agcaggctgagcacccaggggg

SEQ ID NO: 9200648 - DNA, 22 bp, Homo sapiens
agcaggcactatgccaggatct

SEQ ID NO: 9200649 - DNA, 22 bp, Homo sapiens
cacctagggtttcgcctttctt

SEQ ID NO: 9200650 - DNA, 22 bp, Homo sapiens
agagggaaggacagatgtttca

SEQ ID NO: 9200651 - DNA, 22 bp, Homo sapiens
agagggaaatccaggagtgctt

SEQ ID NO: 9200652 - DNA, 17 bp, Homo sapiens
agagggaaaatgcggtt

SEQ ID NO: 9200653 - DNA, 22 bp, Homo sapiens
agagggaaaaactcatgtcatt

SEQ ID NO: 9200654 - DNA, 22 bp, Homo sapiens
agaggtcagatttctcctggtg

SEQ ID NO: 9200655 - DNA, 22 bp, Homo sapiens
agagaaggaaagctgacatggg

SEQ ID NO: 9200656 - DNA, 22 bp, Homo sapiens
agggagacacatgaggaagtca

SEQ ID NO: 9200657 - DNA, 22 bp, Homo sapiens
accagctctctagccctggtcc

SEQ ID NO: 9200658 - DNA, 22 bp, Homo sapiens
accagctcataattttcaaaac

SEQ ID NO: 9200659 - DNA, 22 bp, Homo sapiens
acccaggctggcagaggctcct

SEQ ID NO: 9200660 - DNA, 22 bp, Homo sapiens
agggggagtttcagttagaaag

SEQ ID NO: 9200661 - DNA, 22 bp, Homo sapiens
accaggctggagtgcagtggcg

SEQ ID NO: 9200662 - DNA, 22 bp, Homo sapiens
accaggctctgccagtgtttac

SEQ ID NO: 9200663 - DNA, 22 bp, Homo sapiens
accaggctccccttggatcctg

SEQ ID NO: 9200664 - DNA, 22 bp, Homo sapiens
aggccaggcctttctccattcc

SEQ ID NO: 9200665 - DNA, 22 bp, Homo sapiens
aggatgagattccagggtcaat

SEQ ID NO: 9200666 - DNA, 22 bp, Homo sapiens
aggagcaaatgatgagacagca

SEQ ID NO: 9200667 - DNA, 22 bp, Homo sapiens
agaaaaggttgaaagtaggatt

SEQ ID NO: 9200668 - DNA, 22 bp, Homo sapiens
acctggctgagaacgtgcagct

SEQ ID NO: 9200669 - DNA, 22 bp, Homo sapiens
actcaggaaatgagaggctctc

SEQ ID NO: 9200670 - DNA, 22 bp, Homo sapiens
actcagcttgcacacatcaatg

SEQ ID NO: 9200671 - DNA, 22 bp, Homo sapiens
agtccaggcgggtatagaggct

SEQ ID NO: 9200672 - DNA, 23 bp, Homo sapiens
agcaggaaaccgagggtgatgtt

SEQ ID NO: 9200673 - DNA, 21 bp, Homo sapiens
agcaccctcccttctggaggg

SEQ ID NO: 9200674 - DNA, 20 bp, Homo sapiens
agcaggaaaagtgccagtct

SEQ ID NO: 9200675 - DNA, 22 bp, Homo sapiens
agcagcagtacatataagacta

SEQ ID NO: 9200676 - DNA, 22 bp, Homo sapiens
acagagcagtaagaacacagct

SEQ ID NO: 9200677 - DNA, 22 bp, Homo sapiens
aagccagggattcctgagggag

SEQ ID NO: 9200678 - DNA, 22 bp, Homo sapiens
acaggcaggttgagaaacattt

SEQ ID NO: 9200679 - DNA, 22 bp, Homo sapiens
aaggaaagacatataaatgact

SEQ ID NO: 9200680 - DNA, 22 bp, Homo sapiens
aaggaaaggatgagcatgcatt

SEQ ID NO: 9200681 - DNA, 22 bp, Homo sapiens
aaggaaagattctctctctaga

SEQ ID NO: 9200682 - DNA, 22 bp, Homo sapiens
aaggaaagagtatgcaccttgt

SEQ ID NO: 9200683 - DNA, 22 bp, Homo sapiens
aaggaaagctgtggttctgaga

SEQ ID NO: 9200684 - DNA, 22 bp, Homo sapiens
aaggcagggaaagtggattagg

SEQ ID NO: 9200685 - DNA, 22 bp, Homo sapiens
aaggcaggatgcggacccatct

SEQ ID NO: 9200686 - DNA, 22 bp, Homo sapiens
aaggctggtttccttgatgttt

SEQ ID NO: 9200687 - DNA, 22 bp, Homo sapiens
aaggctgggaaacatgcaggcc

SEQ ID NO: 9200688 - DNA, 22 bp, Homo sapiens
agaagggaactcagagatgatt

SEQ ID NO: 9200689 - DNA, 22 bp, Homo sapiens
actccaggttttctctcaagtt

SEQ ID NO: 9200690 - DNA, 22 bp, Homo sapiens
actccaggttttttcactgaag

SEQ ID NO: 9200691 - DNA, 22 bp, Homo sapiens
actccaggtgtgttggactcta

SEQ ID NO: 9200692 - DNA, 20 bp, Homo sapiens
actccaggtggcatgaggac

SEQ ID NO: 9200693 - DNA, 22 bp, Homo sapiens
actccaggtaggcacattgaca

SEQ ID NO: 9200694 - DNA, 22 bp, Homo sapiens
aagagaggggttgcatggaaat

SEQ ID NO: 9200695 - DNA, 22 bp, Homo sapiens
aagagaggacatggtgaacctg

SEQ ID NO: 9200696 - DNA, 17 bp, Homo sapiens
aagagaggctgagctgg

SEQ ID NO: 9200697 - DNA, 22 bp, Homo sapiens
gctccagggaacagaatgtact

SEQ ID NO: 9200698 - DNA, 22 bp, Homo sapiens
gcaggcaggagcccaactgcct

SEQ ID NO: 9200699 - DNA, 22 bp, Homo sapiens
gatgtgaggactcatgtggagg

SEQ ID NO: 9200700 - DNA, 22 bp, Homo sapiens
atggctccagcttggcttcacc

SEQ ID NO: 9200701 - DNA, 22 bp, Homo sapiens
gagccccttctgcagtcaggtt

SEQ ID NO: 9200702 - DNA, 22 bp, Homo sapiens
gaggagggagctggaagctctt

SEQ ID NO: 9200703 - DNA, 22 bp, Homo sapiens
atgagagactgtgtgttgggag

SEQ ID NO: 9200704 - DNA, 22 bp, Homo sapiens
atgcaggaggactaaagggatg

SEQ ID NO: 9200705 - DNA, 22 bp, Homo sapiens
gaaggagggagcggcgcggatt

SEQ ID NO: 9200706 - DNA, 21 bp, Homo sapiens
gaagagagtcctcatcctgag

SEQ ID NO: 9200707 - DNA, 22 bp, Homo sapiens
atgagcaggaagagcacaaaga

SEQ ID NO: 9200708 - DNA, 22 bp, Homo sapiens
gaagagagccgcgggacatcag

SEQ ID NO: 9200709 - DNA, 22 bp, Homo sapiens
gaagagagagtggggttctgcg

SEQ ID NO: 9200710 - DNA, 22 bp, Homo sapiens
gaagagagcagcaaactggagt

SEQ ID NO: 9200711 - DNA, 22 bp, Homo sapiens
gacaggaaacaagaaggcagga

SEQ ID NO: 9200712 - DNA, 22 bp, Homo sapiens
ggctggcactgaggagagctct

SEQ ID NO: 9200713 - DNA, 22 bp, Homo sapiens
ggctggcaagtgtctgctcatg

SEQ ID NO: 9200714 - DNA, 22 bp, Homo sapiens
ggctggcacgaagccctgctgg

SEQ ID NO: 9200715 - DNA, 22 bp, Homo sapiens
cagagccaacgccacctgccca

SEQ ID NO: 9200716 - DNA, 22 bp, Homo sapiens
cagagacaacctggtagagaaa

SEQ ID NO: 9200717 - DNA, 22 bp, Homo sapiens
gggatgagagctgggacagaag

SEQ ID NO: 9200718 - DNA, 22 bp, Homo sapiens
gggttcagtccctcttgctact

SEQ ID NO: 9200719 - DNA, 22 bp, Homo sapiens
caccaggctggagtgcagaggt

SEQ ID NO: 9200720 - DNA, 22 bp, Homo sapiens
caccaggctgcccaggacaggg

SEQ ID NO: 9200721 - DNA, 22 bp, Homo sapiens
caccaggcacagctctcctgct

SEQ ID NO: 9200722 - DNA, 22 bp, Homo sapiens
ggccaggctgctgggaccccgc

SEQ ID NO: 9200723 - DNA, 22 bp, Homo sapiens
ggccaggctgccctgggagcag

SEQ ID NO: 9200724 - DNA, 22 bp, Homo sapiens
ggccaggctggtctcagacttc

SEQ ID NO: 9200725 - DNA, 22 bp, Homo sapiens
caacacagccattcccctagaa

SEQ ID NO: 9200726 - DNA, 22 bp, Homo sapiens
caaggctgcttcagactagtga

SEQ ID NO: 9200727 - DNA, 22 bp, Homo sapiens
caaggctgcaaaactacatggg

SEQ ID NO: 9200728 - DNA, 22 bp, Homo sapiens
ctggccagtgactgctcacccg

SEQ ID NO: 9200729 - DNA, 22 bp, Homo sapiens
ctggccaggcttgggacagaca

SEQ ID NO: 9200730 - DNA, 22 bp, Homo sapiens
ctggccagaggttcctctgccc

SEQ ID NO: 9200731 - DNA, 22 bp, Homo sapiens
ctcaggagttggaggctacagt

SEQ ID NO: 9200732 - DNA, 22 bp, Homo sapiens
cctggctcaaggcgaggactcc

SEQ ID NO: 9200733 - DNA, 22 bp, Homo sapiens
cctggctcaggcacgcatggct

SEQ ID NO: 9200734 - DNA, 22 bp, Homo sapiens
agggccccatagtcactgcccg

SEQ ID NO: 9200735 - DNA, 22 bp, Homo sapiens
agggaactccatgaggccagag

SEQ ID NO: 9200736 - DNA, 22 bp, Homo sapiens
aggcaggggagctggaagggta

SEQ ID NO: 9200737 - DNA, 22 bp, Homo sapiens
aggctcagtcccggcccgcgcc

SEQ ID NO: 9200738 - DNA, 22 bp, Homo sapiens
ccaggctgtaaacaccttcaaa

SEQ ID NO: 9200739 - DNA, 22 bp, Homo sapiens
aggctcagttcacgtcaacttt

SEQ ID NO: 9200740 - DNA, 20 bp, Homo sapiens
aggctcctgtacctgaggaa

SEQ ID NO: 9200741 - DNA, 22 bp, Homo sapiens
cccagagccggtggtgctcaca

SEQ ID NO: 9200742 - DNA, 22 bp, Homo sapiens
caggctggagtgcagttgtgca

SEQ ID NO: 9200743 - DNA, 22 bp, Homo sapiens
caggctgctgtccacaaagcat

SEQ ID NO: 9200744 - DNA, 22 bp, Homo sapiens
caggctgctgcctagaatgaca

SEQ ID NO: 9200745 - DNA, 22 bp, Homo sapiens
caggctcactgtaaggtcagct

SEQ ID NO: 9200746 - DNA, 22 bp, Homo sapiens
caggctcagctctggccagtgc

SEQ ID NO: 9200747 - DNA, 22 bp, Homo sapiens
caggctcagatgccctgcgctg

SEQ ID NO: 9200748 - DNA, 22 bp, Homo sapiens
cagggctccccagagagcctct

SEQ ID NO: 9200749 - DNA, 22 bp, Homo sapiens
caggggctccctgggtgccagt

SEQ ID NO: 9200750 - DNA, 22 bp, Homo sapiens
aggagggagcttaagccaggca

SEQ ID NO: 9200751 - DNA, 22 bp, Homo sapiens
aggagaagtaaggctagatgat

SEQ ID NO: 9200752 - DNA, 21 bp, Homo sapiens
aggcagcaggatccagggaca

SEQ ID NO: 9200753 - DNA, 19 bp, Homo sapiens
aggcagcaggccagggatg

SEQ ID NO: 9200754 - DNA, 22 bp, Homo sapiens
catctttgtttcatctgtccag

SEQ ID NO: 9200755 - DNA, 19 bp, Homo sapiens
tccagactgtccaggctat

SEQ ID NO: 9200756 - DNA, 22 bp, Homo sapiens
tccagactgttcacattggcat

SEQ ID NO: 9200757 - DNA, 22 bp, Homo sapiens
tccagactggggccatgtctgc

SEQ ID NO: 9200758 - DNA, 22 bp, Homo sapiens
tccagctcttcagttctgcaaa

SEQ ID NO: 9200759 - DNA, 18 bp, Homo sapiens
tccaggctccaggctaac

SEQ ID NO: 9200760 - DNA, 22 bp, Homo sapiens
tccaggctcagtcaagcacttc

SEQ ID NO: 9200761 - DNA, 19 bp, Homo sapiens
tccaggctccattggcaga

SEQ ID NO: 9200762 - DNA, 22 bp, Homo sapiens
tccaggctcccctgcgtgctcc

SEQ ID NO: 9200763 - DNA, 22 bp, Homo sapiens
tccaggctccctcaggatgcac

SEQ ID NO: 9200764 - DNA, 20 bp, Homo sapiens
tcacaggagggaaggcaggt

SEQ ID NO: 9200765 - DNA, 22 bp, Homo sapiens
ccctgtcctgctaggccctggt

SEQ ID NO: 9200766 - DNA, 22 bp, Homo sapiens
ccctactctgccactttttctg

SEQ ID NO: 9200767 - DNA, 22 bp, Homo sapiens
ccctactccatagtcaattcat

SEQ ID NO: 9200768 - DNA, 22 bp, Homo sapiens
tgagcagaatgttcagataaat

SEQ ID NO: 9200769 - DNA, 22 bp, Homo sapiens
tgaccaggatactgcagggatg

SEQ ID NO: 9200770 - DNA, 22 bp, Homo sapiens
ccaggctcaggcctgctcgttg

SEQ ID NO: 9200771 - DNA, 22 bp, Homo sapiens
ccaggctcagcgcgcacgtctg

SEQ ID NO: 9200772 - DNA, 17 bp, Homo sapiens
ccaggctccatcactgt

SEQ ID NO: 9200773 - DNA, 22 bp, Homo sapiens
ccaggctcacagcatcccagga

SEQ ID NO: 9200774 - DNA, 22 bp, Homo sapiens
ccaggctgctcacaagctgccc

SEQ ID NO: 9200775 - DNA, 22 bp, Homo sapiens
ccaggctgcagtcaaggggcat

SEQ ID NO: 9200776 - DNA, 22 bp, Homo sapiens
ccaggctgccgaggaaagaaag

SEQ ID NO: 9200777 - DNA, 22 bp, Homo sapiens
ccaggctgagcatgattggagc

SEQ ID NO: 9200778 - DNA, 22 bp, Homo sapiens
cccaggaggcagaagttgcagt

SEQ ID NO: 9200779 - DNA, 22 bp, Homo sapiens
ctccaggacagattcagggcca

SEQ ID NO: 9200780 - DNA, 22 bp, Homo sapiens
ctcagggatggtgaagcaccca

SEQ ID NO: 9200781 - DNA, 22 bp, Homo sapiens
ctcaggaggtttcctgtctagg

SEQ ID NO: 9200782 - DNA, 22 bp, Homo sapiens
ctcaggaggatgactgccttgg

SEQ ID NO: 9200783 - DNA, 22 bp, Homo sapiens
ctcaggaaggaagcagggagcc

SEQ ID NO: 9200784 - DNA, 17 bp, Homo sapiens
ctcagagagggtaagta

SEQ ID NO: 9200785 - DNA, 22 bp, Homo sapiens
ctcagagaacctaagcggagga

SEQ ID NO: 9200786 - DNA, 22 bp, Homo sapiens
cgggctggctgcagctgctgga

SEQ ID NO: 9200787 - DNA, 22 bp, Homo sapiens
ctgctgtcccagcctcctcaca

SEQ ID NO: 9200788 - DNA, 22 bp, Homo sapiens
ctgcaggacagggaggagcaag

SEQ ID NO: 9200789 - DNA, 22 bp, Homo sapiens
ctgcaggactgaaagatgaggt

SEQ ID NO: 9200790 - DNA, 22 bp, Homo sapiens
ctgcaggagtgaaagcaggcct

SEQ ID NO: 9200791 - DNA, 22 bp, Homo sapiens
ctccaggagtggcctggacacc

SEQ ID NO: 9200792 - DNA, 18 bp, Homo sapiens
ctgggctcgagagatcct

SEQ ID NO: 9200793 - DNA, 22 bp, Homo sapiens
gaggctggttctgaagtactgt

SEQ ID NO: 9200794 - DNA, 22 bp, Homo sapiens
gagggaatggtgtgcaagaggt

SEQ ID NO: 9200795 - DNA, 17 bp, Homo sapiens
gaggacagggaagtagg

SEQ ID NO: 9200796 - DNA, 22 bp, Homo sapiens
gaggagagaagctaacggtgct

SEQ ID NO: 9200797 - DNA, 22 bp, Homo sapiens
gagctcagcccaaagagcagtg

SEQ ID NO: 9200798 - DNA, 22 bp, Homo sapiens
gagcaggacgtgggaatgggaa

SEQ ID NO: 9200799 - DNA, 22 bp, Homo sapiens
gagcaggaactgaaaatgagac

SEQ ID NO: 9200800 - DNA, 22 bp, Homo sapiens
gagcaggaaggccagaagggtc

SEQ ID NO: 9200801 - DNA, 22 bp, Homo sapiens
gagaaagggaacttacagagtg

SEQ ID NO: 9200802 - DNA, 22 bp, Homo sapiens
gagaaggaagttgagccagcat

SEQ ID NO: 9200803 - DNA, 22 bp, Homo sapiens
gagagagaaggcctgtgggtgt

SEQ ID NO: 9200804 - DNA, 22 bp, Homo sapiens
gacagcaggtgcttgggaaagg

SEQ ID NO: 9200805 - DNA, 22 bp, Homo sapiens
gacagcaggatgtgaggggatg

SEQ ID NO: 9200806 - DNA, 22 bp, Homo sapiens
tcagggctgcatacaggagata

SEQ ID NO: 9200807 - DNA, 22 bp, Homo sapiens
tcaggctgtaaatggtgtgggt

SEQ ID NO: 9200808 - DNA, 22 bp, Homo sapiens
tcaggctggtggtcagatggct

SEQ ID NO: 9200809 - DNA, 22 bp, Homo sapiens
tcaggctggtccccacagtgga

SEQ ID NO: 9200810 - DNA, 20 bp, Homo sapiens
tcaggctggtgggctttccc

SEQ ID NO: 9200811 - DNA, 17 bp, Homo sapiens
tcaggctgggtgcagtg

SEQ ID NO: 9200812 - DNA, 22 bp, Homo sapiens
tcaggctgttcctgtccaaaat

SEQ ID NO: 9200813 - DNA, 22 bp, Homo sapiens
tcaggctgtagggcccctggag

SEQ ID NO: 9200814 - DNA, 22 bp, Homo sapiens
tcaggctgttagccacctcctc

SEQ ID NO: 9200815 - DNA, 22 bp, Homo sapiens
tccaggctttttcatgctgtct

SEQ ID NO: 9200816 - DNA, 23 bp, Homo sapiens
tccaggctgggacttcaactggc

SEQ ID NO: 9200817 - DNA, 22 bp, Homo sapiens
tccaggctaattttgcattgtt

SEQ ID NO: 9200818 - DNA, 18 bp, Homo sapiens
tccaggctggattgatga

SEQ ID NO: 9200819 - DNA, 22 bp, Homo sapiens
tccaggctggagtgcagtggcg

SEQ ID NO: 9200820 - DNA, 22 bp, Homo sapiens
tccaggctggcctcgcgtgaca

SEQ ID NO: 9200821 - DNA, 22 bp, Homo sapiens
tccaggctggctcttcaaaatt

SEQ ID NO: 9200822 - DNA, 22 bp, Homo sapiens
tccaggctggacatgaggcggg

SEQ ID NO: 9200823 - DNA, 22 bp, Homo sapiens
tccaggctggagtgcagtggca

SEQ ID NO: 9200824 - DNA, 21 bp, Homo sapiens
tccaggctggaaggggcgttg

SEQ ID NO: 9200825 - DNA, 22 bp, Homo sapiens
tccaggctagcctggtagagaa

SEQ ID NO: 9200826 - DNA, 22 bp, Homo sapiens
tccaggctagagtgcagtggcc

SEQ ID NO: 9200827 - DNA, 22 bp, Homo sapiens
tccaggctacttggattcctgg

SEQ ID NO: 9200828 - DNA, 22 bp, Homo sapiens
tccaggctagaagtcacaggcc

SEQ ID NO: 9200829 - DNA, 22 bp, Homo sapiens
taccaggcagctgcacagaggc

SEQ ID NO: 9200830 - DNA, 22 bp, Homo sapiens
gggctcagcctcctcacttcga

SEQ ID NO: 9200831 - DNA, 22 bp, Homo sapiens
ggtgagaggcctgagagctgga

SEQ ID NO: 9200832 - DNA, 22 bp, Homo sapiens
gtcctggaatcctagaacagtg

SEQ ID NO: 9200833 - DNA, 22 bp, Homo sapiens
gtgagcagttgtataaagactt

SEQ ID NO: 9200834 - DNA, 22 bp, Homo sapiens
gtgagcagtttgttccagaatc

SEQ ID NO: 9200835 - DNA, 22 bp, Homo sapiens
gtgcaggagtaggagagggctt

SEQ ID NO: 9200836 - DNA, 23 bp, Homo sapiens
gccaggctccggtctgtggccac

SEQ ID NO: 9200837 - DNA, 22 bp, Homo sapiens
gccaggctccccggatccctgg

SEQ ID NO: 9200838 - DNA, 22 bp, Homo sapiens
gccaggctccaggccctcctga

SEQ ID NO: 9200839 - DNA, 19 bp, Homo sapiens
gccaggctccatagccggc

SEQ ID NO: 9200840 - DNA, 22 bp, Homo sapiens
gccaggctcagtagcgattcct

SEQ ID NO: 9200841 - DNA, 22 bp, Homo sapiens
gccaggctcagcagtcaacctg

SEQ ID NO: 9200842 - DNA, 22 bp, Homo sapiens
gccaggctaagaaaggtgtgat

SEQ ID NO: 9200843 - DNA, 22 bp, Homo sapiens
gcccctgggagcagagccacca

SEQ ID NO: 9200844 - DNA, 22 bp, Homo sapiens
gcagacacttttattctgcata

SEQ ID NO: 9200845 - DNA, 22 bp, Homo sapiens
gcagaaggatccgcaggtgcaa

SEQ ID NO: 9200846 - DNA, 22 bp, Homo sapiens
gcagacagggctacagaggtac

SEQ ID NO: 9200847 - DNA, 22 bp, Homo sapiens
gctctctgaggtgctggcagag

SEQ ID NO: 9200848 - DNA, 22 bp, Homo sapiens
gctcagtgcatcattccaggct

SEQ ID NO: 9200849 - DNA, 22 bp, Homo sapiens
gctcagtgttcatctgtatgca

SEQ ID NO: 9200850 - DNA, 22 bp, Homo sapiens
ggagaagaggagctggaagcct

SEQ ID NO: 9200851 - DNA, 22 bp, Homo sapiens
ggagctggctacagagaactcc

SEQ ID NO: 9200852 - DNA, 22 bp, Homo sapiens
gctgtccaacctgcactcgcgt

SEQ ID NO: 9200853 - DNA, 22 bp, Homo sapiens
gctgtcctcgtctctcacgcaa

SEQ ID NO: 9200854 - DNA, 22 bp, Homo sapiens
gctgtcctctgatctctggagg

SEQ ID NO: 9200855 - DNA, 22 bp, Homo sapiens
ttttctgtattattgtgcttca

SEQ ID NO: 9200856 - DNA, 20 bp, Homo sapiens
ttttctgtgccaagaaaact

SEQ ID NO: 9200857 - DNA, 22 bp, Homo sapiens
ttttctgtttgcttcaagacat

SEQ ID NO: 9200858 - DNA, 22 bp, Homo sapiens
ttctgtgtgggtagctcctgtt

SEQ ID NO: 9200859 - DNA, 22 bp, Homo sapiens
ttctgtgtgctgtcttggcttt

SEQ ID NO: 9200860 - DNA, 22 bp, Homo sapiens
ttattctttaaacatatatgtt

SEQ ID NO: 9200861 - DNA, 22 bp, Homo sapiens
ttgcagaacttaaagacagagt

SEQ ID NO: 9200862 - DNA, 22 bp, Homo sapiens
ttggccatctaagcccagccac

SEQ ID NO: 9200863 - DNA, 22 bp, Homo sapiens
agaaggaagccaggagggtgca

SEQ ID NO: 9200864 - DNA, 18 bp, Homo sapiens
actgcaggagaggtgagg

SEQ ID NO: 9200865 - DNA, 21 bp, Homo sapiens
aaggaatgaatggatggatga

SEQ ID NO: 9200866 - DNA, 22 bp, Homo sapiens
acccaggcagcaggagctaaag

SEQ ID NO: 9200867 - DNA, 22 bp, Homo sapiens
aagtcagtgaaaaggcatcatc

SEQ ID NO: 9200868 - DNA, 22 bp, Homo sapiens
acagagggtgtggaggaagacg

SEQ ID NO: 9200869 - DNA, 22 bp, Homo sapiens
acagagggtctgggcacaggac

SEQ ID NO: 9200870 - DNA, 19 bp, Homo sapiens
acagagggcaactgagaaa

SEQ ID NO: 9200871 - DNA, 22 bp, Homo sapiens
acagaaggacttgagaaagaca

SEQ ID NO: 9200872 - DNA, 22 bp, Homo sapiens
acagaaggcggggacaaggcgg

SEQ ID NO: 9200873 - DNA, 22 bp, Homo sapiens
agagaaggggtaaagagtcctg

SEQ ID NO: 9200874 - DNA, 22 bp, Homo sapiens
agagaagggggaaagatctcac

SEQ ID NO: 9200875 - DNA, 22 bp, Homo sapiens
agagcaagtgacagaaacaggg

SEQ ID NO: 9200876 - DNA, 22 bp, Homo sapiens
agaggatgattttaaggacact

SEQ ID NO: 9200877 - DNA, 22 bp, Homo sapiens
agaggatggttgaggaagacct

SEQ ID NO: 9200878 - DNA, 22 bp, Homo sapiens
agaggaatttctggaaggaggc

SEQ ID NO: 9200879 - DNA, 22 bp, Homo sapiens
aagaagagaactggcatcctaa

SEQ ID NO: 9200880 - DNA, 22 bp, Homo sapiens
aagagagaagtctctctggttc

SEQ ID NO: 9200881 - DNA, 22 bp, Homo sapiens
aagagagacaataggtagcatt

SEQ ID NO: 9200882 - DNA, 22 bp, Homo sapiens
aagagagaccatgggggacagg

SEQ ID NO: 9200883 - DNA, 22 bp, Homo sapiens
agcagacaggtaggaggataaa

SEQ ID NO: 9200884 - DNA, 21 bp, Homo sapiens
agcagacagcccaagaaaatc

SEQ ID NO: 9200885 - DNA, 22 bp, Homo sapiens
agccaggctcaaggcctgctcc

SEQ ID NO: 9200886 - DNA, 22 bp, Homo sapiens
agccaggccttttctcaaggtt

SEQ ID NO: 9200887 - DNA, 22 bp, Homo sapiens
cagagccaggcctgccctcttt

SEQ ID NO: 9200888 - DNA, 22 bp, Homo sapiens
agagctatgatcaaggcagggt

SEQ ID NO: 9200889 - DNA, 22 bp, Homo sapiens
aggctgggaaatgtagtcttcc

SEQ ID NO: 9200890 - DNA, 22 bp, Homo sapiens
aggctcagggactccctccctc

SEQ ID NO: 9200891 - DNA, 22 bp, Homo sapiens
aggctcagggacggggcccctt

SEQ ID NO: 9200892 - DNA, 22 bp, Homo sapiens
aggaaaggggtaggtgtggacg

SEQ ID NO: 9200893 - DNA, 22 bp, Homo sapiens
agtgagcagtacttactcctgc

SEQ ID NO: 9200894 - DNA, 22 bp, Homo sapiens
agtgagagtattaatgtgaact

SEQ ID NO: 9200895 - DNA, 22 bp, Homo sapiens
actcagcttcctacagctagaa

SEQ ID NO: 9200896 - DNA, 22 bp, Homo sapiens
actcagctcaggagctggctgg

SEQ ID NO: 9200897 - DNA, 22 bp, Homo sapiens
agaaaaggattgatggatcaga

SEQ ID NO: 9200898 - DNA, 22 bp, Homo sapiens
agaaagagctcgggattaacag

SEQ ID NO: 9200899 - DNA, 22 bp, Homo sapiens
ggctgggaggatgacttgctac

SEQ ID NO: 9200900 - DNA, 18 bp, Homo sapiens
ggctccagtcttcagtgg

SEQ ID NO: 9200901 - DNA, 22 bp, Homo sapiens
ggctccaggtgcatgccaggct

SEQ ID NO: 9200902 - DNA, 22 bp, Homo sapiens
ggctccagggtctctccttgtg

SEQ ID NO: 9200903 - DNA, 22 bp, Homo sapiens
cacaggcttttttggctgatgt

SEQ ID NO: 9200904 - DNA, 22 bp, Homo sapiens
cacaggctgggaagcctaggcc

SEQ ID NO: 9200905 - DNA, 22 bp, Homo sapiens
cacaggcttgtcagcatgaggc

SEQ ID NO: 9200906 - DNA, 22 bp, Homo sapiens
caagccagtcagctcagtagat

SEQ ID NO: 9200907 - DNA, 22 bp, Homo sapiens
caagccagctcctgccacagag

SEQ ID NO: 9200908 - DNA, 22 bp, Homo sapiens
cagcaggaaacttaaaggtaat

SEQ ID NO: 9200909 - DNA, 22 bp, Homo sapiens
cagagggaaaaggggagtaata

SEQ ID NO: 9200910 - DNA, 22 bp, Homo sapiens
cagagtccaattgctcagagcg

SEQ ID NO: 9200911 - DNA, 22 bp, Homo sapiens
cagagacagcctgggagggaca

SEQ ID NO: 9200912 - DNA, 22 bp, Homo sapiens
gccaggctggtgcaaggatatt

SEQ ID NO: 9200913 - DNA, 22 bp, Homo sapiens
gccaggctggtcttgaactcct

SEQ ID NO: 9200914 - DNA, 22 bp, Homo sapiens
gccaggctggccagcaccttct

SEQ ID NO: 9200915 - DNA, 22 bp, Homo sapiens
gccaggctggggggagatgtct

SEQ ID NO: 9200916 - DNA, 22 bp, Homo sapiens
gccaggctggcaaaaggaaacc

SEQ ID NO: 9200917 - DNA, 22 bp, Homo sapiens
gccaggctggaaagaacagaca

SEQ ID NO: 9200918 - DNA, 22 bp, Homo sapiens
gccaggctgctggctgctgtcc

SEQ ID NO: 9200919 - DNA, 22 bp, Homo sapiens
caaagaggttttgagggcagct

SEQ ID NO: 9200920 - DNA, 22 bp, Homo sapiens
gcagcagagtttgggagatggt

SEQ ID NO: 9200921 - DNA, 22 bp, Homo sapiens
gcagcagagaccccaggaagga

SEQ ID NO: 9200922 - DNA, 22 bp, Homo sapiens
gcagcagaagtagaagtacagg

SEQ ID NO: 9200923 - DNA, 20 bp, Homo sapiens
atgggctggttaggaagtgt

SEQ ID NO: 9200924 - DNA, 22 bp, Homo sapiens
gaggagaagctattggaaggac

SEQ ID NO: 9200925 - DNA, 22 bp, Homo sapiens
gaggagaagggcacggagaaaa

SEQ ID NO: 9200926 - DNA, 22 bp, Homo sapiens
atggagggtggtaagacagaga

SEQ ID NO: 9200927 - DNA, 22 bp, Homo sapiens
atggagggaaaagtggagagcc

SEQ ID NO: 9200928 - DNA, 22 bp, Homo sapiens
gagagagaggtgctgccaggca

SEQ ID NO: 9200929 - DNA, 22 bp, Homo sapiens
atgaaacagagtacttaatata

SEQ ID NO: 9200930 - DNA, 22 bp, Homo sapiens
atgaaacagtgaattagtcaag

SEQ ID NO: 9200931 - DNA, 22 bp, Homo sapiens
ctggctcacaggtgagatgcat

SEQ ID NO: 9200932 - DNA, 22 bp, Homo sapiens
ctggcttccatgctgtagtggc

SEQ ID NO: 9200933 - DNA, 22 bp, Homo sapiens
ctccaggaaaatagggaatgag

SEQ ID NO: 9200934 - DNA, 22 bp, Homo sapiens
ctcattgcagttaatgagatgt

SEQ ID NO: 9200935 - DNA, 22 bp, Homo sapiens
aggtaggatagataggaagacc

SEQ ID NO: 9200936 - DNA, 22 bp, Homo sapiens
ccaggcacaggtgggcctcaga

SEQ ID NO: 9200937 - DNA, 22 bp, Homo sapiens
ccaggcacggtggctcatgcct

SEQ ID NO: 9200938 - DNA, 22 bp, Homo sapiens
aggctcagagagctgtgtccat

SEQ ID NO: 9200939 - DNA, 22 bp, Homo sapiens
ccaggaggtggagattgcagtg

SEQ ID NO: 9200940 - DNA, 21 bp, Homo sapiens
aggctcagcaggtgtataaag

SEQ ID NO: 9200941 - DNA, 22 bp, Homo sapiens
aggctcagatccttgtgtcctg

SEQ ID NO: 9200942 - DNA, 22 bp, Homo sapiens
cctcgacctccccaggctcagg

SEQ ID NO: 9200943 - DNA, 22 bp, Homo sapiens
caggcccatgagggcagccaca

SEQ ID NO: 9200944 - DNA, 22 bp, Homo sapiens
caggcccagtgatcagggctct

SEQ ID NO: 9200945 - DNA, 22 bp, Homo sapiens
caggcaggtgcagattcctctt

SEQ ID NO: 9200946 - DNA, 22 bp, Homo sapiens
caggcagggagctggaaaggat

SEQ ID NO: 9200947 - DNA, 22 bp, Homo sapiens
caggacctgaagacaggcaggt

SEQ ID NO: 9200948 - DNA, 22 bp, Homo sapiens
caggactgaagggcacagggaa

SEQ ID NO: 9200949 - DNA, 22 bp, Homo sapiens
cagctgtcagccggtgcaggct

SEQ ID NO: 9200950 - DNA, 22 bp, Homo sapiens
aggaaaggcctcagcagaaacc

SEQ ID NO: 9200951 - DNA, 22 bp, Homo sapiens
aggaagagctggaccagaggac

SEQ ID NO: 9200952 - DNA, 22 bp, Homo sapiens
cagggctggatttcatttctag

SEQ ID NO: 9200953 - DNA, 22 bp, Homo sapiens
aggacaagacaaggaccagaga

SEQ ID NO: 9200954 - DNA, 22 bp, Homo sapiens
aggacagacctaggactggagc

SEQ ID NO: 9200955 - DNA, 22 bp, Homo sapiens
aggacagagcctgtgcagaccg

SEQ ID NO: 9200956 - DNA, 22 bp, Homo sapiens
aggcaaggtgctacagacagtg

SEQ ID NO: 9200957 - DNA, 22 bp, Homo sapiens
aggcaagattaggaccagaaga

SEQ ID NO: 9200958 - DNA, 22 bp, Homo sapiens
aggagctgtgaatgggaggggt

SEQ ID NO: 9200959 - DNA, 22 bp, Homo sapiens
aggatgagagatacatggagca

SEQ ID NO: 9200960 - DNA, 22 bp, Homo sapiens
ccattgtaaattctgtggaagt

SEQ ID NO: 9200961 - DNA, 22 bp, Homo sapiens
ccatgcctggactccactctca

SEQ ID NO: 9200962 - DNA, 22 bp, Homo sapiens
ccatgccttcctttccctggaa

SEQ ID NO: 9200963 - DNA, 22 bp, Homo sapiens
ccaggctggagtgcagtggcac

SEQ ID NO: 9200964 - DNA, 22 bp, Homo sapiens
ccaggctggagtgcaatggtgc

SEQ ID NO: 9200965 - DNA, 22 bp, Homo sapiens
ccaggctggagtgcagtagtgt

SEQ ID NO: 9200966 - DNA, 22 bp, Homo sapiens
ccaggctggattttgcagttca

SEQ ID NO: 9200967 - DNA, 22 bp, Homo sapiens
ccaggctggagtgtagtcgcat

SEQ ID NO: 9200968 - DNA, 21 bp, Homo sapiens
ccaggctggccatggtattga

SEQ ID NO: 9200969 - DNA, 20 bp, Homo sapiens
ccaggctggcaaatgggggc

SEQ ID NO: 9200970 - DNA, 22 bp, Homo sapiens
tgagaaggctcaggcttagaga

SEQ ID NO: 9200971 - DNA, 22 bp, Homo sapiens
ccaggaggttgaggctgcagtg

SEQ ID NO: 9200972 - DNA, 22 bp, Homo sapiens
ccaggctgaatatgttccaggg

SEQ ID NO: 9200973 - DNA, 23 bp, Homo sapiens
ccaggctctttcacctgctattc

SEQ ID NO: 9200974 - DNA, 22 bp, Homo sapiens
ccaggctctgtgtgggctagag

SEQ ID NO: 9200975 - DNA, 21 bp, Homo sapiens
ccaggctcctgaggctggtca

SEQ ID NO: 9200976 - DNA, 22 bp, Homo sapiens
ccaggctggagtgcaatggcat

SEQ ID NO: 9200977 - DNA, 22 bp, Homo sapiens
ccaggctggagtgcaatggcgt

SEQ ID NO: 9200978 - DNA, 22 bp, Homo sapiens
cctcagagttggccacgagagc

SEQ ID NO: 9200979 - DNA, 18 bp, Homo sapiens
cctcagaggcaaattgtt

SEQ ID NO: 9200980 - DNA, 22 bp, Homo sapiens
cctcagaggtgaacatcagtgc

SEQ ID NO: 9200981 - DNA, 18 bp, Homo sapiens
ccctctcctgctagtggg

SEQ ID NO: 9200982 - DNA, 22 bp, Homo sapiens
cccaggctgggaacgattctag

SEQ ID NO: 9200983 - DNA, 22 bp, Homo sapiens
cccaggctggggctcctccagc

SEQ ID NO: 9200984 - DNA, 22 bp, Homo sapiens
cccaggctggcctccgcagtgc

SEQ ID NO: 9200985 - DNA, 22 bp, Homo sapiens
cccaggctggcactgctgaagt

SEQ ID NO: 9200986 - DNA, 22 bp, Homo sapiens
cccaggctggagtgtaatggtg

SEQ ID NO: 9200987 - DNA, 22 bp, Homo sapiens
cccaggctggatttcggtggca

SEQ ID NO: 9200988 - DNA, 22 bp, Homo sapiens
cccaggctggaattccaggcct

SEQ ID NO: 9200989 - DNA, 22 bp, Homo sapiens
cccaggctgagttagaggtgtc

SEQ ID NO: 9200990 - DNA, 22 bp, Homo sapiens
cccaggctggagtgcaatggtg

SEQ ID NO: 9200991 - DNA, 22 bp, Homo sapiens
cccaggctggagtgcagtggcg

SEQ ID NO: 9200992 - DNA, 22 bp, Homo sapiens
cccaggctggagtgcaatggca

SEQ ID NO: 9200993 - DNA, 22 bp, Homo sapiens
cccaggctggagggcagtgtca

SEQ ID NO: 9200994 - DNA, 23 bp, Homo sapiens
cccaggctacaaattatgctctg

SEQ ID NO: 9200995 - DNA, 22 bp, Homo sapiens
tgcccagccaatttgttatgtt

SEQ ID NO: 9200996 - DNA, 22 bp, Homo sapiens
cccaggctagaaaggccaacaa

SEQ ID NO: 9200997 - DNA, 19 bp, Homo sapiens
cccaggctacatggagagg

SEQ ID NO: 9200998 - DNA, 22 bp, Homo sapiens
cccaggctagtatgatatcagt

SEQ ID NO: 9200999 - DNA, 22 bp, Homo sapiens
cccaggctcagactggcttgtt

SEQ ID NO: 9201000 - DNA, 22 bp, Homo sapiens
cccaggctcactgtccgcttcc

SEQ ID NO: 9201001 - DNA, 22 bp, Homo sapiens
cccaggctcccaggtgggacaa

SEQ ID NO: 9201002 - DNA, 22 bp, Homo sapiens
tcaggctgtatatcttgcactc

SEQ ID NO: 9201003 - DNA, 22 bp, Homo sapiens
tcaggctgcctatcagactgtg

SEQ ID NO: 9201004 - DNA, 17 bp, Homo sapiens
tcaggctgtgcctggta

SEQ ID NO: 9201005 - DNA, 21 bp, Homo sapiens
tcaggctgtctgctggttcca

SEQ ID NO: 9201006 - DNA, 22 bp, Homo sapiens
tcaggctgtggcttcagttctt

SEQ ID NO: 9201007 - DNA, 22 bp, Homo sapiens
tcaggctgtggctttgaccgca

SEQ ID NO: 9201008 - DNA, 22 bp, Homo sapiens
tcaggctgtgtctttaaacaat

SEQ ID NO: 9201009 - DNA, 22 bp, Homo sapiens
tcaggctgtgggcactggccat

SEQ ID NO: 9201010 - DNA, 22 bp, Homo sapiens
catctcttcattagcattattg

SEQ ID NO: 9201011 - DNA, 22 bp, Homo sapiens
catggcattgcataacggggct

SEQ ID NO: 9201012 - DNA, 22 bp, Homo sapiens
catttattcatgatctgtagct

SEQ ID NO: 9201013 - DNA, 18 bp, Homo sapiens
tcctggcagtcagagagg

SEQ ID NO: 9201014 - DNA, 20 bp, Homo sapiens
tcctactcttttaatatgtg

SEQ ID NO: 9201015 - DNA, 22 bp, Homo sapiens
cagggctccatgcagggactcc

SEQ ID NO: 9201016 - DNA, 22 bp, Homo sapiens
cagggctcttccggagcaggga

SEQ ID NO: 9201017 - DNA, 22 bp, Homo sapiens
cagggctgtaaattagtgctga

SEQ ID NO: 9201018 - DNA, 22 bp, Homo sapiens
caggcatggagaggcagagact

SEQ ID NO: 9201019 - DNA, 22 bp, Homo sapiens
caggcccacgaggcacacagag

SEQ ID NO: 9201020 - DNA, 22 bp, Homo sapiens
caggctgccgaggctgcagaat

SEQ ID NO: 9201021 - DNA, 22 bp, Homo sapiens
caggctgtccaggctcctttgg

SEQ ID NO: 9201022 - DNA, 22 bp, Homo sapiens
caggcccagcccttagccaggt

SEQ ID NO: 9201023 - DNA, 22 bp, Homo sapiens
caggcctcgaggagacagctac

SEQ ID NO: 9201024 - DNA, 22 bp, Homo sapiens
ctctccagtcatattctcagtc

SEQ ID NO: 9201025 - DNA, 22 bp, Homo sapiens
ctctccagggaagcagtgtact

SEQ ID NO: 9201026 - DNA, 22 bp, Homo sapiens
gaagaggatgacaggagccggt

SEQ ID NO: 9201027 - DNA, 22 bp, Homo sapiens
gagaaggactacggaaaacaga

SEQ ID NO: 9201028 - DNA, 22 bp, Homo sapiens
gagaatgggaatgaaagtagca

SEQ ID NO: 9201029 - DNA, 22 bp, Homo sapiens
gagagggagccagccaggaacc

SEQ ID NO: 9201030 - DNA, 22 bp, Homo sapiens
gagagggatactgagttttggt

SEQ ID NO: 9201031 - DNA, 22 bp, Homo sapiens
ctggccagctgacagcagggct

SEQ ID NO: 9201032 - DNA, 23 bp, Homo sapiens
ctggctcatcctggttgcagtgg

SEQ ID NO: 9201033 - DNA, 22 bp, Homo sapiens
ctggctcattttagcatcaggt

SEQ ID NO: 9201034 - DNA, 22 bp, Homo sapiens
ctggctcacctccgctccagca

SEQ ID NO: 9201035 - DNA, 22 bp, Homo sapiens
ctggctcaggaaagttgctgct

SEQ ID NO: 9201036 - DNA, 22 bp, Homo sapiens
ctgttgtccctgggagctcagc

SEQ ID NO: 9201037 - DNA, 22 bp, Homo sapiens
ctgtgccatcctagggctgctg

SEQ ID NO: 9201038 - DNA, 22 bp, Homo sapiens
ctgtgccacctgagggactcta

SEQ ID NO: 9201039 - DNA, 22 bp, Homo sapiens
ctgtgccagcctgtcccaggag

SEQ ID NO: 9201040 - DNA, 22 bp, Homo sapiens
ctgtgcatggccatcagtgccc

SEQ ID NO: 9201041 - DNA, 22 bp, Homo sapiens
gcctcctgcccagatgagtgat

SEQ ID NO: 9201042 - DNA, 22 bp, Homo sapiens
gcaggcagaggtggaggagaca

SEQ ID NO: 9201043 - DNA, 19 bp, Homo sapiens
gcagacaggtccagagagg

SEQ ID NO: 9201044 - DNA, 22 bp, Homo sapiens
gcagagcaggaaggaagtcagg

SEQ ID NO: 9201045 - DNA, 22 bp, Homo sapiens
gctccagggtcagctcagaact

SEQ ID NO: 9201046 - DNA, 22 bp, Homo sapiens
gctccagggtggatgacaattc

SEQ ID NO: 9201047 - DNA, 22 bp, Homo sapiens
gctccagggacccaagagaaaa

SEQ ID NO: 9201048 - DNA, 20 bp, Homo sapiens
gctccaggtcagagaggacg

SEQ ID NO: 9201049 - DNA, 22 bp, Homo sapiens
gctccaggtgaatcctctcacc

SEQ ID NO: 9201050 - DNA, 22 bp, Homo sapiens
gctccaggtgtcccaggtaaaa

SEQ ID NO: 9201051 - DNA, 22 bp, Homo sapiens
gctgagagcacatagaaggggc

SEQ ID NO: 9201052 - DNA, 22 bp, Homo sapiens
ggagagaaattgaggtagcaag

SEQ ID NO: 9201053 - DNA, 22 bp, Homo sapiens
ggaagaggctctcattgagggc

SEQ ID NO: 9201054 - DNA, 22 bp, Homo sapiens
ggaagaggaggagccaggcttt

SEQ ID NO: 9201055 - DNA, 22 bp, Homo sapiens
ggaagagggaaccacgactgta

SEQ ID NO: 9201056 - DNA, 22 bp, Homo sapiens
ggaatgagctcggagcagaagg

SEQ ID NO: 9201057 - DNA, 22 bp, Homo sapiens
ggaatgtgcgtactcagtgtca

SEQ ID NO: 9201058 - DNA, 22 bp, Homo sapiens
gggacagcagaaagaaggcaag

SEQ ID NO: 9201059 - DNA, 22 bp, Homo sapiens
gggacagccatgtgcagatgcc

SEQ ID NO: 9201060 - DNA, 22 bp, Homo sapiens
gggagaggttacccgagcaact

SEQ ID NO: 9201061 - DNA, 22 bp, Homo sapiens
gggaggaaggcttgggtgagta

SEQ ID NO: 9201062 - DNA, 22 bp, Homo sapiens
gggaggaaatgtgcagcgaatt

SEQ ID NO: 9201063 - DNA, 22 bp, Homo sapiens
ggcgggaggctgaggagttggt

SEQ ID NO: 9201064 - DNA, 22 bp, Homo sapiens
ggctccaggaacctcctctcct

SEQ ID NO: 9201065 - DNA, 22 bp, Homo sapiens
ggctccagccctggctcttcac

SEQ ID NO: 9201066 - DNA, 22 bp, Homo sapiens
ggagtgagtactggagtagctg

SEQ ID NO: 9201067 - DNA, 23 bp, Homo sapiens
gtgagcagcccactaggaatgcc

SEQ ID NO: 9201068 - DNA, 22 bp, Homo sapiens
gtgagagaaattggagggaatg

SEQ ID NO: 9201069 - DNA, 22 bp, Homo sapiens
tacaggctgaactcaatgatga

SEQ ID NO: 9201070 - DNA, 22 bp, Homo sapiens
taaggcagtgagaagaaacagg

SEQ ID NO: 9201071 - DNA, 22 bp, Homo sapiens
tagagggaaggaagaatggatt

SEQ ID NO: 9201072 - DNA, 22 bp, Homo sapiens
tagcagaggaaaagagaacatt

SEQ ID NO: 9201073 - DNA, 20 bp, Homo sapiens
tccagctccgtgttcttcct

SEQ ID NO: 9201074 - DNA, 17 bp, Homo sapiens
tccagctcctcattgtt

SEQ ID NO: 9201075 - DNA, 18 bp, Homo sapiens
tccagctctgccacttac

SEQ ID NO: 9201076 - DNA, 22 bp, Homo sapiens
tccagctctgcttcacagtctc

SEQ ID NO: 9201077 - DNA, 20 bp, Homo sapiens
tccagggccctggctcctct

SEQ ID NO: 9201078 - DNA, 22 bp, Homo sapiens
tccaggctgcagtcttgccctc

SEQ ID NO: 9201079 - DNA, 22 bp, Homo sapiens
tccaggctgccacagtgcaacg

SEQ ID NO: 9201080 - DNA, 22 bp, Homo sapiens
tccaggctggaaatgtcaaact

SEQ ID NO: 9201081 - DNA, 22 bp, Homo sapiens
tccaggctcagcacttgctact

SEQ ID NO: 9201082 - DNA, 22 bp, Homo sapiens
tccaggctcctgactttttggg

SEQ ID NO: 9201083 - DNA, 22 bp, Homo sapiens
tccaggctctaggctgctctcc

SEQ ID NO: 9201084 - DNA, 22 bp, Homo sapiens
tccaggctaggtttacaggaca

SEQ ID NO: 9201085 - DNA, 22 bp, Homo sapiens
tccaggctgcaaggccacaggg

SEQ ID NO: 9201086 - DNA, 21 bp, Homo sapiens
tccaggctgatgatgtcaact

SEQ ID NO: 9201087 - DNA, 19 bp, Homo sapiens
tccaggctgagagtcagct

SEQ ID NO: 9201088 - DNA, 22 bp, Homo sapiens
tccaggctgatccatgaagaat

SEQ ID NO: 9201089 - DNA, 22 bp, Homo sapiens
tccaggctgacgcagctattta

SEQ ID NO: 9201090 - DNA, 22 bp, Homo sapiens
tccaggctctcaggtgtcagca

SEQ ID NO: 9201091 - DNA, 23 bp, Homo sapiens
tccaggctgaaggagcagatttt

SEQ ID NO: 9201092 - DNA, 22 bp, Homo sapiens
tccaggcatcccccaggacaga

SEQ ID NO: 9201093 - DNA, 20 bp, Homo sapiens
tccaggcagctcagagtgtc

SEQ ID NO: 9201094 - DNA, 22 bp, Homo sapiens
tcaggctgggctcctctcccca

SEQ ID NO: 9201095 - DNA, 22 bp, Homo sapiens
tcaggctggggtgctaaggtgt

SEQ ID NO: 9201096 - DNA, 22 bp, Homo sapiens
tcaggctgggagacaatcactg

SEQ ID NO: 9201097 - DNA, 18 bp, Homo sapiens
tcaggctgggcctccttc

SEQ ID NO: 9201098 - DNA, 22 bp, Homo sapiens
tcaggctgaggtcatctgcatc

SEQ ID NO: 9201099 - DNA, 22 bp, Homo sapiens
tcaggctgataggaggaactga

SEQ ID NO: 9201100 - DNA, 21 bp, Homo sapiens
tcaggctgatgtcgatgttag

SEQ ID NO: 9201101 - DNA, 22 bp, Homo sapiens
tcaggctgctggccagcaggct

SEQ ID NO: 9201102 - DNA, 22 bp, Homo sapiens
tcaggctggagtgcagtggcgc

SEQ ID NO: 9201103 - DNA, 22 bp, Homo sapiens
tcaggctggaatgcagtggggc

SEQ ID NO: 9201104 - DNA, 22 bp, Homo sapiens
tcaggctgctgtactgtgaatg

SEQ ID NO: 9201105 - DNA, 22 bp, Homo sapiens
tcaggctgctttcatgcttaga

SEQ ID NO: 9201106 - DNA, 18 bp, Homo sapiens
tcaggctggaagtttgcc

SEQ ID NO: 9201107 - DNA, 22 bp, Homo sapiens
tcagtgatttctggggtgaggg

SEQ ID NO: 9201108 - DNA, 20 bp, Homo sapiens
tcagtgattatctctgagtg

SEQ ID NO: 9201109 - DNA, 22 bp, Homo sapiens
tcagtgtccggagcctgagtgc

SEQ ID NO: 9201110 - DNA, 22 bp, Homo sapiens
tcacaagggccctgcagtccac

SEQ ID NO: 9201111 - DNA, 23 bp, Homo sapiens
tcagagaggccccctgcagagat

SEQ ID NO: 9201112 - DNA, 22 bp, Homo sapiens
ttcctcatctgtgcacctcact

SEQ ID NO: 9201113 - DNA, 22 bp, Homo sapiens
ttcaggagaattccaagaagta

SEQ ID NO: 9201114 - DNA, 22 bp, Homo sapiens
ttcaggaggtgagcaagaaggg

SEQ ID NO: 9201115 - DNA, 20 bp, Homo sapiens
tgtgtcttcctttctttatg

SEQ ID NO: 9201116 - DNA, 22 bp, Homo sapiens
tttctcatggaacatagctcct

SEQ ID NO: 9201117 - DNA, 22 bp, Homo sapiens
aggatgagagatacatggagca

SEQ ID NO: 9201118 - DNA, 22 bp, Homo sapiens
aggatgggcctgggatatgctt

SEQ ID NO: 9201119 - DNA, 22 bp, Homo sapiens
aggatggggtctgcagcctggt

SEQ ID NO: 9201120 - DNA, 22 bp, Homo sapiens
aggatggggtctgcagcctggt

SEQ ID NO: 9201121 - DNA, 22 bp, Homo sapiens
aggatgggtcagctagagtcca

SEQ ID NO: 9201122 - DNA, 23 bp, Homo sapiens
aggatgggtggcaatagaaagac

SEQ ID NO: 9201123 - DNA, 22 bp, Homo sapiens
catcttcaggtgttttccatca

SEQ ID NO: 9201124 - DNA, 22 bp, Homo sapiens
catgagagatccttcatgagag

SEQ ID NO: 9201125 - DNA, 22 bp, Homo sapiens
catgagctgctgggagcctgtc

SEQ ID NO: 9201126 - DNA, 22 bp, Homo sapiens
catgagcattttggtctagttt

SEQ ID NO: 9201127 - DNA, 22 bp, Homo sapiens
catcttcaggggctacatctgt

SEQ ID NO: 9201128 - DNA, 22 bp, Homo sapiens
aggaggcctgtgtttgtctgta

SEQ ID NO: 9201129 - DNA, 22 bp, Homo sapiens
aggaggcctgcagctgccattc

SEQ ID NO: 9201130 - DNA, 22 bp, Homo sapiens
aggaggccgctgatgggctccc

SEQ ID NO: 9201131 - DNA, 22 bp, Homo sapiens
aggaggccgggattctggagat

SEQ ID NO: 9201132 - DNA, 23 bp, Homo sapiens
aggaggcctgaaactgaggctga

SEQ ID NO: 9201133 - DNA, 22 bp, Homo sapiens
aggagctgtcatttgattcaca

SEQ ID NO: 9201134 - DNA, 22 bp, Homo sapiens
aggagctgtcagagtgccagag

SEQ ID NO: 9201135 - DNA, 17 bp, Homo sapiens
aggagctgggggtggtg

SEQ ID NO: 9201136 - DNA, 22 bp, Homo sapiens
cataacttgctttggagcccgg

SEQ ID NO: 9201137 - DNA, 22 bp, Homo sapiens
cataactttaaagacagtgtgg

SEQ ID NO: 9201138 - DNA, 22 bp, Homo sapiens
cataacttggtgttggaaactg

SEQ ID NO: 9201139 - DNA, 22 bp, Homo sapiens
aggagccatccccatgagaggt

SEQ ID NO: 9201140 - DNA, 22 bp, Homo sapiens
cataacatgtacatataaatgc

SEQ ID NO: 9201141 - DNA, 22 bp, Homo sapiens
cataacatccttgctactttga

SEQ ID NO: 9201142 - DNA, 22 bp, Homo sapiens
cagtatttgttccctatcaatg

SEQ ID NO: 9201143 - DNA, 22 bp, Homo sapiens
cagtccagagcccaccagagga

SEQ ID NO: 9201144 - DNA, 22 bp, Homo sapiens
cagtccagctcatcagtggcac

SEQ ID NO: 9201145 - DNA, 22 bp, Homo sapiens
cagtccagccccctgctaaaag

SEQ ID NO: 9201146 - DNA, 20 bp, Homo sapiens
cagtccaggctagaaaacaa

SEQ ID NO: 9201147 - DNA, 22 bp, Homo sapiens
cagtgtggcttagggaataggc

SEQ ID NO: 9201148 - DNA, 22 bp, Homo sapiens
cagtgtgggtttgggaggagta

SEQ ID NO: 9201149 - DNA, 22 bp, Homo sapiens
cagtgtggctgagacagaggct

SEQ ID NO: 9201150 - DNA, 22 bp, Homo sapiens
cagtgtggctgagacagaggct

SEQ ID NO: 9201151 - DNA, 22 bp, Homo sapiens
cagtgtggcttagggaataggc

SEQ ID NO: 9201152 - DNA, 22 bp, Homo sapiens
cagtgtggagggagagagcctg

SEQ ID NO: 9201153 - DNA, 22 bp, Homo sapiens
cagtgtggagggagagagcctg

SEQ ID NO: 9201154 - DNA, 22 bp, Homo sapiens
aggagccaggaaacctgctctg

SEQ ID NO: 9201155 - DNA, 21 bp, Homo sapiens
cagtgtggtgaccagggtctc

SEQ ID NO: 9201156 - DNA, 22 bp, Homo sapiens
cagtgtggtgagattccaggtg

SEQ ID NO: 9201157 - DNA, 22 bp, Homo sapiens
aggcaagcagtcagtctatgag

SEQ ID NO: 9201158 - DNA, 22 bp, Homo sapiens
aggcaagcccccagtgaggctc

SEQ ID NO: 9201159 - DNA, 20 bp, Homo sapiens
aggcaaggtagatgtctgct

SEQ ID NO: 9201160 - DNA, 22 bp, Homo sapiens
aggcaactcatcatgaaagact

SEQ ID NO: 9201161 - DNA, 22 bp, Homo sapiens
aggcaaggtgctcttgctctat

SEQ ID NO: 9201162 - DNA, 22 bp, Homo sapiens
aggcaagtgcattagaagagca

SEQ ID NO: 9201163 - DNA, 22 bp, Homo sapiens
cattgctttgtgcatatttaaa

SEQ ID NO: 9201164 - DNA, 22 bp, Homo sapiens
catttcaatacagtttgtaaat

SEQ ID NO: 9201165 - DNA, 22 bp, Homo sapiens
aggcactttacaatgtgtgaca

SEQ ID NO: 9201166 - DNA, 22 bp, Homo sapiens
aggcactttaggatcaggttga

SEQ ID NO: 9201167 - DNA, 22 bp, Homo sapiens
aggcacttaacctactaactga

SEQ ID NO: 9201168 - DNA, 22 bp, Homo sapiens
aggcacttggaggtctctgccc

SEQ ID NO: 9201169 - DNA, 22 bp, Homo sapiens
aggcacttgcattgatgaggtc

SEQ ID NO: 9201170 - DNA, 21 bp, Homo sapiens
aggcacttaaccaatgttagc

SEQ ID NO: 9201171 - DNA, 22 bp, Homo sapiens
cattggaatgatcgttttgctg

SEQ ID NO: 9201172 - DNA, 22 bp, Homo sapiens
ccacggccacccgctcatgggc

SEQ ID NO: 9201173 - DNA, 19 bp, Homo sapiens
ccacgaggttagcagccac

SEQ ID NO: 9201174 - DNA, 17 bp, Homo sapiens
ccactcagtaatttctc

SEQ ID NO: 9201175 - DNA, 22 bp, Homo sapiens
ccactcagcacagtggatgcag

SEQ ID NO: 9201176 - DNA, 20 bp, Homo sapiens
ccactcagctgtattctcag

SEQ ID NO: 9201177 - DNA, 22 bp, Homo sapiens
ccacccagcagaggaggcaaga

SEQ ID NO: 9201178 - DNA, 22 bp, Homo sapiens
ccacccagccagatgcaggaag

SEQ ID NO: 9201179 - DNA, 22 bp, Homo sapiens
ccacccagaccagggatctggg

SEQ ID NO: 9201180 - DNA, 22 bp, Homo sapiens
ccacctgtgcttggtactccat

SEQ ID NO: 9201181 - DNA, 22 bp, Homo sapiens
ccacccagccagatgcaggaag

SEQ ID NO: 9201182 - DNA, 22 bp, Homo sapiens
ccacccagccagatgcaggaag

SEQ ID NO: 9201183 - DNA, 22 bp, Homo sapiens
ccacagtttcttcatctataaa

SEQ ID NO: 9201184 - DNA, 22 bp, Homo sapiens
ccacagtgttttgtcacattag

SEQ ID NO: 9201185 - DNA, 23 bp, Homo sapiens
ccacagttcatcgttcactcacc

SEQ ID NO: 9201186 - DNA, 22 bp, Homo sapiens
ccacagtggttctcaaccaggg

SEQ ID NO: 9201187 - DNA, 22 bp, Homo sapiens
ccacagtgtggcataaactgta

SEQ ID NO: 9201188 - DNA, 20 bp, Homo sapiens
ccacagtggagactggagac

SEQ ID NO: 9201189 - DNA, 22 bp, Homo sapiens
ccacagtgggcacagcaggact

SEQ ID NO: 9201190 - DNA, 22 bp, Homo sapiens
ccaccaggcactcacagggaag

SEQ ID NO: 9201191 - DNA, 22 bp, Homo sapiens
ccacagaattctgtctccagga

SEQ ID NO: 9201192 - DNA, 22 bp, Homo sapiens
ccacagagactctgcaggactg

SEQ ID NO: 9201193 - DNA, 22 bp, Homo sapiens
aggcaggaaaatcgcttgaacc

SEQ ID NO: 9201194 - DNA, 17 bp, Homo sapiens
aggcaggagattggaga

SEQ ID NO: 9201195 - DNA, 22 bp, Homo sapiens
aggcaggagcaagccctacaag

SEQ ID NO: 9201196 - DNA, 22 bp, Homo sapiens
aggcaggagtgaccctgacagg

SEQ ID NO: 9201197 - DNA, 22 bp, Homo sapiens
aggcaggaggatcatggatgca

SEQ ID NO: 9201198 - DNA, 23 bp, Homo sapiens
ccacaggcacagaggcttgcatc

SEQ ID NO: 9201199 - DNA, 23 bp, Homo sapiens
ccacaggcacagaggcttgcatc

SEQ ID NO: 9201200 - DNA, 18 bp, Homo sapiens
aggcaggatcctggcctc

SEQ ID NO: 9201201 - DNA, 22 bp, Homo sapiens
aggcaggagtgaccctgacagg

SEQ ID NO: 9201202 - DNA, 22 bp, Homo sapiens
cagggcttcgctcctggtgcac

SEQ ID NO: 9201203 - DNA, 22 bp, Homo sapiens
cagggcttcttggcatttgctg

SEQ ID NO: 9201204 - DNA, 22 bp, Homo sapiens
cagggcttctataccaattcat

SEQ ID NO: 9201205 - DNA, 22 bp, Homo sapiens
cagggcttcgtgtctcagtgct

SEQ ID NO: 9201206 - DNA, 22 bp, Homo sapiens
cagggcttcgatggatggatgg

SEQ ID NO: 9201207 - DNA, 22 bp, Homo sapiens
cagggctgttagctgctgctct

SEQ ID NO: 9201208 - DNA, 22 bp, Homo sapiens
cagtaacatgaagagacatgga

SEQ ID NO: 9201209 - DNA, 22 bp, Homo sapiens
cagtaaacactagcattcttgg

SEQ ID NO: 9201210 - DNA, 22 bp, Homo sapiens
aggacagagggaccagagccca

SEQ ID NO: 9201211 - DNA, 22 bp, Homo sapiens
aggacagagggaccagagccca

SEQ ID NO: 9201212 - DNA, 22 bp, Homo sapiens
cagtatttcctcttcttaactt

SEQ ID NO: 9201213 - DNA, 22 bp, Homo sapiens
cagtatttaggattaggagaga

SEQ ID NO: 9201214 - DNA, 22 bp, Homo sapiens
cagtaagtattcgagtctccat

SEQ ID NO: 9201215 - DNA, 22 bp, Homo sapiens
cagtatgttcttccaggacaga

SEQ ID NO: 9201216 - DNA, 22 bp, Homo sapiens
cagggctggatttcatttctag

SEQ ID NO: 9201217 - DNA, 22 bp, Homo sapiens
cagggctggatttcatttctag

SEQ ID NO: 9201218 - DNA, 22 bp, Homo sapiens
cagggctggctgtggcaatctc

SEQ ID NO: 9201219 - DNA, 22 bp, Homo sapiens
agctttgggcagaagaggattc

SEQ ID NO: 9201220 - DNA, 22 bp, Homo sapiens
agctttgggattcaggcaggaa

SEQ ID NO: 9201221 - DNA, 22 bp, Homo sapiens
agctttgcaacctgaggccagt

SEQ ID NO: 9201222 - DNA, 22 bp, Homo sapiens
agctttgcacaacagagaggtg

SEQ ID NO: 9201223 - DNA, 22 bp, Homo sapiens
agctttgcactgagacagctca

SEQ ID NO: 9201224 - DNA, 23 bp, Homo sapiens
agctttgaggactttaaaagata

SEQ ID NO: 9201225 - DNA, 22 bp, Homo sapiens
agctttgatagtacaggggctt

SEQ ID NO: 9201226 - DNA, 22 bp, Homo sapiens
agctttgcttctgggagccaag

SEQ ID NO: 9201227 - DNA, 22 bp, Homo sapiens
agctttgaaaatccaaattaca

SEQ ID NO: 9201228 - DNA, 22 bp, Homo sapiens
cagggcagtaacgggaacatct

SEQ ID NO: 9201229 - DNA, 22 bp, Homo sapiens
cagggcaggatgctgtgattat

SEQ ID NO: 9201230 - DNA, 22 bp, Homo sapiens
caggctgacaactgagcatttt

SEQ ID NO: 9201231 - DNA, 22 bp, Homo sapiens
caggctgaagtgcagtggtgtg

SEQ ID NO: 9201232 - DNA, 22 bp, Homo sapiens
aggaagagctggaccagaggac

SEQ ID NO: 9201233 - DNA, 22 bp, Homo sapiens
aggaagagctggaccagaggac

SEQ ID NO: 9201234 - DNA, 22 bp, Homo sapiens
aggaagagctggaccagaggac

SEQ ID NO: 9201235 - DNA, 22 bp, Homo sapiens
aggaagagctggaccagaggac

SEQ ID NO: 9201236 - DNA, 22 bp, Homo sapiens
aggaagagcccgggtgacataa

SEQ ID NO: 9201237 - DNA, 22 bp, Homo sapiens
aggaagagcccgggtgacataa

SEQ ID NO: 9201238 - DNA, 23 bp, Homo sapiens
aggaagaggcaatttctcttaga

SEQ ID NO: 9201239 - DNA, 18 bp, Homo sapiens
cagggctgtggggtcact

SEQ ID NO: 9201240 - DNA, 22 bp, Homo sapiens
aggaagaaacctactagagttt

SEQ ID NO: 9201241 - DNA, 22 bp, Homo sapiens
cagggctggcttccaagttgtt

SEQ ID NO: 9201242 - DNA, 23 bp, Homo sapiens
cagggctgggcttggtgttaggc

SEQ ID NO: 9201243 - DNA, 22 bp, Homo sapiens
cagggctggctgtggcaatctc

SEQ ID NO: 9201244 - DNA, 22 bp, Homo sapiens
cagctgttactctgagtaaatg

SEQ ID NO: 9201245 - DNA, 22 bp, Homo sapiens
cagctgttcggggctggcatgt

SEQ ID NO: 9201246 - DNA, 22 bp, Homo sapiens
cagctgttcacatttccaaaac

SEQ ID NO: 9201247 - DNA, 22 bp, Homo sapiens
caggactgatgttcctccagcc

SEQ ID NO: 9201248 - DNA, 22 bp, Homo sapiens
caggactggaagtctcaagaga

SEQ ID NO: 9201249 - DNA, 22 bp, Homo sapiens
caggactggctcgcagtgggtg

SEQ ID NO: 9201250 - DNA, 20 bp, Homo sapiens
caggacagcgcaatcggagg

SEQ ID NO: 9201251 - DNA, 22 bp, Homo sapiens
cagctgttcttgggacagacag

SEQ ID NO: 9201252 - DNA, 22 bp, Homo sapiens
caggatggccccggggctgtgc

SEQ ID NO: 9201253 - DNA, 22 bp, Homo sapiens
caggatgggatgtagtgggccc

SEQ ID NO: 9201254 - DNA, 22 bp, Homo sapiens
caggatgggtgtcggccagcac

SEQ ID NO: 9201255 - DNA, 22 bp, Homo sapiens
caggcacaatgagcgccatctt

SEQ ID NO: 9201256 - DNA, 22 bp, Homo sapiens
caggatggtcagatgcattgtc

SEQ ID NO: 9201257 - DNA, 22 bp, Homo sapiens
caggcagagtgaggtggtctaa

SEQ ID NO: 9201258 - DNA, 20 bp, Homo sapiens
caggcacactcattcctgct

SEQ ID NO: 9201259 - DNA, 22 bp, Homo sapiens
caggcacacccactggtgcaga

SEQ ID NO: 9201260 - DNA, 22 bp, Homo sapiens
caggcacacatccgtgagagat

SEQ ID NO: 9201261 - DNA, 22 bp, Homo sapiens
caggcacacagggaatttggct

SEQ ID NO: 9201262 - DNA, 22 bp, Homo sapiens
caggatggagggagggctgtta

SEQ ID NO: 9201263 - DNA, 22 bp, Homo sapiens
caggagcccagagtcctcagct

SEQ ID NO: 9201264 - DNA, 22 bp, Homo sapiens
caggagcccagagtcctcagct

SEQ ID NO: 9201265 - DNA, 22 bp, Homo sapiens
caggagccagctgtcccaacca

SEQ ID NO: 9201266 - DNA, 22 bp, Homo sapiens
caggagccacattccaccttga

SEQ ID NO: 9201267 - DNA, 22 bp, Homo sapiens
caggagccagaggcggatggag

SEQ ID NO: 9201268 - DNA, 22 bp, Homo sapiens
caggagccacattccaccttga

SEQ ID NO: 9201269 - DNA, 22 bp, Homo sapiens
caggagccacattccaccttga

SEQ ID NO: 9201270 - DNA, 18 bp, Homo sapiens
caggagcaggagttgaac

SEQ ID NO: 9201271 - DNA, 22 bp, Homo sapiens
caggcagggagctggaaaggat

SEQ ID NO: 9201272 - DNA, 22 bp, Homo sapiens
caggcagggagctggaaaggat

SEQ ID NO: 9201273 - DNA, 22 bp, Homo sapiens
caggcagccttctcgtctcaca

SEQ ID NO: 9201274 - DNA, 22 bp, Homo sapiens
caggcagcgctcgtggcctggc

SEQ ID NO: 9201275 - DNA, 22 bp, Homo sapiens
caggcagcgctcgtggcctggc

SEQ ID NO: 9201276 - DNA, 22 bp, Homo sapiens
caggcagcgtcctgcttcctgt

SEQ ID NO: 9201277 - DNA, 22 bp, Homo sapiens
caggcaggtgcagattcctctt

SEQ ID NO: 9201278 - DNA, 22 bp, Homo sapiens
caggcaggtgcagattcctctt

SEQ ID NO: 9201279 - DNA, 22 bp, Homo sapiens
agctggtggaagggagcccaaa

SEQ ID NO: 9201280 - DNA, 22 bp, Homo sapiens
agctgtcctggctcaggctgtg

SEQ ID NO: 9201281 - DNA, 22 bp, Homo sapiens
caggcccagtgatcagggctct

SEQ ID NO: 9201282 - DNA, 22 bp, Homo sapiens
caggcccaggtgtcgatgttcc

SEQ ID NO: 9201283 - DNA, 22 bp, Homo sapiens
caggcccagggttattgggaaa

SEQ ID NO: 9201284 - DNA, 22 bp, Homo sapiens
caggcccaggggtctggcccac

SEQ ID NO: 9201285 - DNA, 22 bp, Homo sapiens
agctgtctttctgcctcctgat

SEQ ID NO: 9201286 - DNA, 22 bp, Homo sapiens
agctgtctgtctcctgaggaga

SEQ ID NO: 9201287 - DNA, 22 bp, Homo sapiens
agctgtctgtctcctgaggaga

SEQ ID NO: 9201288 - DNA, 22 bp, Homo sapiens
agctgtctgtctcctgaggaga

SEQ ID NO: 9201289 - DNA, 22 bp, Homo sapiens
caggcccatgagggcagccaca

SEQ ID NO: 9201290 - DNA, 22 bp, Homo sapiens
caggcccatgagggcagccaca

SEQ ID NO: 9201291 - DNA, 22 bp, Homo sapiens
caggcccatctgctcccaggct

SEQ ID NO: 9201292 - DNA, 22 bp, Homo sapiens
caggcccattctaggcttgcta

SEQ ID NO: 9201293 - DNA, 22 bp, Homo sapiens
agcttcctgactggtgctctta

SEQ ID NO: 9201294 - DNA, 22 bp, Homo sapiens
agcttcctcacctcagaggtct

SEQ ID NO: 9201295 - DNA, 22 bp, Homo sapiens
agcttcctcacctcagaggtct

SEQ ID NO: 9201296 - DNA, 23 bp, Homo sapiens
agcttcctagtgacctggagtct

SEQ ID NO: 9201297 - DNA, 18 bp, Homo sapiens
agcttccctctgagaggg

SEQ ID NO: 9201298 - DNA, 22 bp, Homo sapiens
agcttcctacaaccatctcaga

SEQ ID NO: 9201299 - DNA, 18 bp, Homo sapiens
agcttccctctgagaggg

SEQ ID NO: 9201300 - DNA, 22 bp, Homo sapiens
agcttccctagcagttctaaac

SEQ ID NO: 9201301 - DNA, 22 bp, Homo sapiens
agcttcccaaggttggaaggtt

SEQ ID NO: 9201302 - DNA, 22 bp, Homo sapiens
agcttcccacactctagtttcc

SEQ ID NO: 9201303 - DNA, 22 bp, Homo sapiens
agcttcccggcaggcacgtcct

SEQ ID NO: 9201304 - DNA, 22 bp, Homo sapiens
agcttcccaggagaatcaggga

SEQ ID NO: 9201305 - DNA, 21 bp, Homo sapiens
agcttcctgcagtgggaggtc

SEQ ID NO: 9201306 - DNA, 22 bp, Homo sapiens
agcttcctgatgcaagagggct

SEQ ID NO: 9201307 - DNA, 22 bp, Homo sapiens
agcttcctgatgcaagagggct

SEQ ID NO: 9201308 - DNA, 22 bp, Homo sapiens
agcttcctgtcttctgcacaaa

SEQ ID NO: 9201309 - DNA, 22 bp, Homo sapiens
agcttccttgaattctgtagaa

SEQ ID NO: 9201310 - DNA, 22 bp, Homo sapiens
agcttccttggcgctgaggcct

SEQ ID NO: 9201311 - DNA, 22 bp, Homo sapiens
agcttccttggcgctgaggcct

SEQ ID NO: 9201312 - DNA, 22 bp, Homo sapiens
agcttcctgttgagagagggag

SEQ ID NO: 9201313 - DNA, 22 bp, Homo sapiens
agcttccttgaattctgtagaa

SEQ ID NO: 9201314 - DNA, 22 bp, Homo sapiens
agcttcctgtcttctgcacaaa

SEQ ID NO: 9201315 - DNA, 22 bp, Homo sapiens
agcttcctgttgagagagggag

SEQ ID NO: 9201316 - DNA, 22 bp, Homo sapiens
agcttctcagcttcagaactgt

SEQ ID NO: 9201317 - DNA, 21 bp, Homo sapiens
caggctctgctagaggagcct

SEQ ID NO: 9201318 - DNA, 23 bp, Homo sapiens
agcttcgccttcctttctctgca

SEQ ID NO: 9201319 - DNA, 22 bp, Homo sapiens
agcttctcaagtgtttgcgggg

SEQ ID NO: 9201320 - DNA, 22 bp, Homo sapiens
agcttctcagaagagtcctgta

SEQ ID NO: 9201321 - DNA, 22 bp, Homo sapiens
agcttctcagaagagtcctgta

SEQ ID NO: 9201322 - DNA, 22 bp, Homo sapiens
agcttctcagatggactgttag

SEQ ID NO: 9201323 - DNA, 22 bp, Homo sapiens
cctcgacctccccaggctcagg

SEQ ID NO: 9201324 - DNA, 22 bp, Homo sapiens
cctccttctggggccttctgct

SEQ ID NO: 9201325 - DNA, 22 bp, Homo sapiens
cctccttcctgggacagagctg

SEQ ID NO: 9201326 - DNA, 19 bp, Homo sapiens
cctcctgtggcgggtgggg

SEQ ID NO: 9201327 - DNA, 22 bp, Homo sapiens
aggggaagattatacttttgaa

SEQ ID NO: 9201328 - DNA, 22 bp, Homo sapiens
aggggaaggccagcctgtagag

SEQ ID NO: 9201329 - DNA, 22 bp, Homo sapiens
aggggaaatgccttggtggtac

SEQ ID NO: 9201330 - DNA, 22 bp, Homo sapiens
aggggaagagccctttacatgg

SEQ ID NO: 9201331 - DNA, 21 bp, Homo sapiens
aggggaagtagagttttgatt

SEQ ID NO: 9201332 - DNA, 22 bp, Homo sapiens
cctcctggtccagcatctcttt

SEQ ID NO: 9201333 - DNA, 22 bp, Homo sapiens
aggggctcctttgtgctgcgtc

SEQ ID NO: 9201334 - DNA, 22 bp, Homo sapiens
aggggctcctttgtgctgcgtc

SEQ ID NO: 9201335 - DNA, 22 bp, Homo sapiens
aggggctctaaagatcatggaa

SEQ ID NO: 9201336 - DNA, 22 bp, Homo sapiens
cctctgtgtcctggtcattgaa

SEQ ID NO: 9201337 - DNA, 22 bp, Homo sapiens
cctctgtggtctgtctaatgca

SEQ ID NO: 9201338 - DNA, 22 bp, Homo sapiens
agggggtgatcaaggtgcggcg

SEQ ID NO: 9201339 - DNA, 22 bp, Homo sapiens
agggggtgcccagatgaaggat

SEQ ID NO: 9201340 - DNA, 22 bp, Homo sapiens
agggggtgcatttgtgaatgaa

SEQ ID NO: 9201341 - DNA, 22 bp, Homo sapiens
agggggtgctacttccagagtt

SEQ ID NO: 9201342 - DNA, 22 bp, Homo sapiens
aggggtagagattgctggtgta

SEQ ID NO: 9201343 - DNA, 22 bp, Homo sapiens
cctgagtcccctcattcactct

SEQ ID NO: 9201344 - DNA, 22 bp, Homo sapiens
aggggtgaaagagggccctcaa

SEQ ID NO: 9201345 - DNA, 22 bp, Homo sapiens
cctgagtcccataatgttgcca

SEQ ID NO: 9201346 - DNA, 22 bp, Homo sapiens
cctaattatctcccaaagatcc

SEQ ID NO: 9201347 - DNA, 22 bp, Homo sapiens
agggcctggcttcactttctca

SEQ ID NO: 9201348 - DNA, 22 bp, Homo sapiens
agggcctgtccgctcccgcccg

SEQ ID NO: 9201349 - DNA, 22 bp, Homo sapiens
agggcctgtgaattctccctgc

SEQ ID NO: 9201350 - DNA, 22 bp, Homo sapiens
agggcctgtctgtagaactgaa

SEQ ID NO: 9201351 - DNA, 22 bp, Homo sapiens
agggcccatagatcgtcagctt

SEQ ID NO: 9201352 - DNA, 22 bp, Homo sapiens
agggcccatgtgggagcacttg

SEQ ID NO: 9201353 - DNA, 19 bp, Homo sapiens
ccctggcaggcaagcctgg

SEQ ID NO: 9201354 - DNA, 22 bp, Homo sapiens
agggcctggcttcactttctca

SEQ ID NO: 9201355 - DNA, 22 bp, Homo sapiens
ccctggccagggcacagggagg

SEQ ID NO: 9201356 - DNA, 22 bp, Homo sapiens
agggctgacagtggcgtggcgt

SEQ ID NO: 9201357 - DNA, 19 bp, Homo sapiens
cctacttgtttgagggaag

SEQ ID NO: 9201358 - DNA, 22 bp, Homo sapiens
cctacttagcatattttctctt

SEQ ID NO: 9201359 - DNA, 22 bp, Homo sapiens
cctacagttatattcttgattg

SEQ ID NO: 9201360 - DNA, 22 bp, Homo sapiens
cctaccagtaggaggccagaga

SEQ ID NO: 9201361 - DNA, 22 bp, Homo sapiens
agggctgagactaaggccagat

SEQ ID NO: 9201362 - DNA, 22 bp, Homo sapiens
agggctgagcccaggcatgtag

SEQ ID NO: 9201363 - DNA, 22 bp, Homo sapiens
agggctgaggcgagggagatgc

SEQ ID NO: 9201364 - DNA, 20 bp, Homo sapiens
agggctgagaagggactagc

SEQ ID NO: 9201365 - DNA, 22 bp, Homo sapiens
agggctgagaatgacagggccg

SEQ ID NO: 9201366 - DNA, 23 bp, Homo sapiens
cctcagggtctagcagagagaag

SEQ ID NO: 9201367 - DNA, 22 bp, Homo sapiens
agggctttggccccctgctgca

SEQ ID NO: 9201368 - DNA, 22 bp, Homo sapiens
agggctttgatggcattctcat

SEQ ID NO: 9201369 - DNA, 22 bp, Homo sapiens
cctcaggtgtgggccagctgtc

SEQ ID NO: 9201370 - DNA, 22 bp, Homo sapiens
agggaaaggctgatgctgtggg

SEQ ID NO: 9201371 - DNA, 22 bp, Homo sapiens
cccagagtggacggtggcccct

SEQ ID NO: 9201372 - DNA, 22 bp, Homo sapiens
aggcttggctctcctatgagaa

SEQ ID NO: 9201373 - DNA, 22 bp, Homo sapiens
aggcttggctctcctatgagaa

SEQ ID NO: 9201374 - DNA, 22 bp, Homo sapiens
cccaggaaatgggctcttgcct

SEQ ID NO: 9201375 - DNA, 22 bp, Homo sapiens
cccaggaacagcacagaacagc

SEQ ID NO: 9201376 - DNA, 22 bp, Homo sapiens
cccaggaaatgaacttctgatt

SEQ ID NO: 9201377 - DNA, 22 bp, Homo sapiens
cccaggaaatcaggctttctag

SEQ ID NO: 9201378 - DNA, 22 bp, Homo sapiens
cccaggaaatagccaggaggtg

SEQ ID NO: 9201379 - DNA, 22 bp, Homo sapiens
cccaggaagaaattctgatttg

SEQ ID NO: 9201380 - DNA, 22 bp, Homo sapiens
cccaggaagagtgagtggcatt

SEQ ID NO: 9201381 - DNA, 22 bp, Homo sapiens
cccaggaagggatgccaaggaa

SEQ ID NO: 9201382 - DNA, 22 bp, Homo sapiens
cccaggaagcccagaattctgg

SEQ ID NO: 9201383 - DNA, 22 bp, Homo sapiens
cccaggaagcggagattgcaga

SEQ ID NO: 9201384 - DNA, 22 bp, Homo sapiens
cccaggaagttgatgcagagga

SEQ ID NO: 9201385 - DNA, 22 bp, Homo sapiens
cccaggaagggatgccaaggaa

SEQ ID NO: 9201386 - DNA, 22 bp, Homo sapiens
cccaggccctggcagagcttgt

SEQ ID NO: 9201387 - DNA, 22 bp, Homo sapiens
cccaggcctggtctgggccagt

SEQ ID NO: 9201388 - DNA, 22 bp, Homo sapiens
cccaggcctggtctgggccagt

SEQ ID NO: 9201389 - DNA, 22 bp, Homo sapiens
agggacagttacatcatcagac

SEQ ID NO: 9201390 - DNA, 22 bp, Homo sapiens
agggacatctcacaaacaactt

SEQ ID NO: 9201391 - DNA, 22 bp, Homo sapiens
agggacctgctcactgcctggc

SEQ ID NO: 9201392 - DNA, 22 bp, Homo sapiens
agggactatttacccatctcac

SEQ ID NO: 9201393 - DNA, 22 bp, Homo sapiens
agggacccatagagagaccagt

SEQ ID NO: 9201394 - DNA, 22 bp, Homo sapiens
agggaccaggggtagctgagat

SEQ ID NO: 9201395 - DNA, 22 bp, Homo sapiens
agggcagaagtacagacactta

SEQ ID NO: 9201396 - DNA, 22 bp, Homo sapiens
agggcagaccacgtgcaaggat

SEQ ID NO: 9201397 - DNA, 22 bp, Homo sapiens
cccctgccagctatccctgaac

SEQ ID NO: 9201398 - DNA, 22 bp, Homo sapiens
cccctgctggcctgctggtttc

SEQ ID NO: 9201399 - DNA, 22 bp, Homo sapiens
cccctgccatagtcaaatctaa

SEQ ID NO: 9201400 - DNA, 22 bp, Homo sapiens
cccaggtgctgaaggaggccgc

SEQ ID NO: 9201401 - DNA, 22 bp, Homo sapiens
cccaggtgctgaaggaggccgc

SEQ ID NO: 9201402 - DNA, 22 bp, Homo sapiens
cccaggtggcagaagctgcagt

SEQ ID NO: 9201403 - DNA, 22 bp, Homo sapiens
cccaggtgctgcgtgaagcctc

SEQ ID NO: 9201404 - DNA, 22 bp, Homo sapiens
cccaggtggcagaagctgcagt

SEQ ID NO: 9201405 - DNA, 22 bp, Homo sapiens
cccaggtggcagaagctgcagt

SEQ ID NO: 9201406 - DNA, 22 bp, Homo sapiens
cccaggtgggcacctcgaggaa

SEQ ID NO: 9201407 - DNA, 21 bp, Homo sapiens
cccaggtgggatggttgcctc

SEQ ID NO: 9201408 - DNA, 22 bp, Homo sapiens
cccaggtgggttggcctctgtc

SEQ ID NO: 9201409 - DNA, 22 bp, Homo sapiens
agggatggtggaggttgcaagt

SEQ ID NO: 9201410 - DNA, 22 bp, Homo sapiens
agggcagaaaccaccttgatgg

SEQ ID NO: 9201411 - DNA, 22 bp, Homo sapiens
cccaggtgtttgtggcagaggt

SEQ ID NO: 9201412 - DNA, 22 bp, Homo sapiens
cccaggtgtttgtggcagaggt

SEQ ID NO: 9201413 - DNA, 19 bp, Homo sapiens
cccaggtgtttgaggctgc

SEQ ID NO: 9201414 - DNA, 23 bp, Homo sapiens
cccaggtgtggaggcggtggcag

SEQ ID NO: 9201415 - DNA, 20 bp, Homo sapiens
cccaggtgtctgaagctctg

SEQ ID NO: 9201416 - DNA, 23 bp, Homo sapiens
agggcccaagcctggacagcagg

SEQ ID NO: 9201417 - DNA, 23 bp, Homo sapiens
agggcccaagcctggacagcagg

SEQ ID NO: 9201418 - DNA, 22 bp, Homo sapiens
ccctgatcctcctttaagtagc

SEQ ID NO: 9201419 - DNA, 22 bp, Homo sapiens
ccctgatctcagcttacccatc

SEQ ID NO: 9201420 - DNA, 22 bp, Homo sapiens
agggcccaggacagcatcaggg

SEQ ID NO: 9201421 - DNA, 20 bp, Homo sapiens
agggcccaggaagagagtta

SEQ ID NO: 9201422 - DNA, 20 bp, Homo sapiens
ccccttcatctacagcctga

SEQ ID NO: 9201423 - DNA, 20 bp, Homo sapiens
ccccttcatctacagcctga

SEQ ID NO: 9201424 - DNA, 22 bp, Homo sapiens
cccctgggtccaggcttctctg

SEQ ID NO: 9201425 - DNA, 21 bp, Homo sapiens
cccctgggagccctgtcagta

SEQ ID NO: 9201426 - DNA, 22 bp, Homo sapiens
agggcattggcacagatctgct

SEQ ID NO: 9201427 - DNA, 22 bp, Homo sapiens
agggccaagtccaggacctcgg

SEQ ID NO: 9201428 - DNA, 22 bp, Homo sapiens
agggccacagtaatgctgagta

SEQ ID NO: 9201429 - DNA, 22 bp, Homo sapiens
agggccacagtggggcctgaga

SEQ ID NO: 9201430 - DNA, 22 bp, Homo sapiens
agggccaccagagcagggcagt

SEQ ID NO: 9201431 - DNA, 22 bp, Homo sapiens
agggccactggctgacggctgc

SEQ ID NO: 9201432 - DNA, 22 bp, Homo sapiens
agggccaccagggagtctcagg

SEQ ID NO: 9201433 - DNA, 22 bp, Homo sapiens
ccaggcctttcttcttggtctg

SEQ ID NO: 9201434 - DNA, 22 bp, Homo sapiens
ccaggccttctgaggacactct

SEQ ID NO: 9201435 - DNA, 22 bp, Homo sapiens
ccaggccttccagtacgcagaa

SEQ ID NO: 9201436 - DNA, 22 bp, Homo sapiens
ccaggccttccagtacgcagaa

SEQ ID NO: 9201437 - DNA, 22 bp, Homo sapiens
ccaggcctgtgcaaggagggag

SEQ ID NO: 9201438 - DNA, 22 bp, Homo sapiens
ccaggcctcacctgcccaccta

SEQ ID NO: 9201439 - DNA, 22 bp, Homo sapiens
aggctcagattcacatttggtt

SEQ ID NO: 9201440 - DNA, 20 bp, Homo sapiens
aggctctgcctgcaggccca

SEQ ID NO: 9201441 - DNA, 22 bp, Homo sapiens
aggctctgggctctagattttg

SEQ ID NO: 9201442 - DNA, 22 bp, Homo sapiens
aggctctggtgcagctgtaact

SEQ ID NO: 9201443 - DNA, 22 bp, Homo sapiens
aggctctggttggcaagtaaag

SEQ ID NO: 9201444 - DNA, 22 bp, Homo sapiens
aggctctgggaagcagtgagtt

SEQ ID NO: 9201445 - DNA, 22 bp, Homo sapiens
ccaggttggagttcagtggcgc

SEQ ID NO: 9201446 - DNA, 22 bp, Homo sapiens
ccaggttggagttcagtggcgc

SEQ ID NO: 9201447 - DNA, 22 bp, Homo sapiens
ccaggttcaaatagctgtgtga

SEQ ID NO: 9201448 - DNA, 22 bp, Homo sapiens
ccaggtggtgaaagtgggccct

SEQ ID NO: 9201449 - DNA, 22 bp, Homo sapiens
ccaggtggtgcctctgttcgca

SEQ ID NO: 9201450 - DNA, 20 bp, Homo sapiens
ccaggtggtgcctggagagg

SEQ ID NO: 9201451 - DNA, 22 bp, Homo sapiens
ccaggtgcctccagtcacagtg

SEQ ID NO: 9201452 - DNA, 22 bp, Homo sapiens
ccaggtgggcgtgtcttcacct

SEQ ID NO: 9201453 - DNA, 22 bp, Homo sapiens
cccaagttaatttgtagctgaa

SEQ ID NO: 9201454 - DNA, 22 bp, Homo sapiens
cccaagttaaaattcagtgctc

SEQ ID NO: 9201455 - DNA, 18 bp, Homo sapiens
cccacacagcagtagctc

SEQ ID NO: 9201456 - DNA, 22 bp, Homo sapiens
aggctgccagaagccttcagga

SEQ ID NO: 9201457 - DNA, 23 bp, Homo sapiens
aggctgcagaagaatagggtcat

SEQ ID NO: 9201458 - DNA, 22 bp, Homo sapiens
aggctgcagaggtgctgccaga

SEQ ID NO: 9201459 - DNA, 22 bp, Homo sapiens
ccagtgggagggagctaggcca

SEQ ID NO: 9201460 - DNA, 22 bp, Homo sapiens
ccagtgggtaggccatggtgag

SEQ ID NO: 9201461 - DNA, 22 bp, Homo sapiens
aggctgtgcacagggcacctgc

SEQ ID NO: 9201462 - DNA, 22 bp, Homo sapiens
cccacctctcagagagccttgc

SEQ ID NO: 9201463 - DNA, 22 bp, Homo sapiens
cccaccctgggaagctaggcag

SEQ ID NO: 9201464 - DNA, 18 bp, Homo sapiens
cccaccctggctcttagt

SEQ ID NO: 9201465 - DNA, 22 bp, Homo sapiens
cccacgtcgaacttgctccaga

SEQ ID NO: 9201466 - DNA, 22 bp, Homo sapiens
cccactccctacgacacgctcc

SEQ ID NO: 9201467 - DNA, 22 bp, Homo sapiens
cccagaggttccttagggacca

SEQ ID NO: 9201468 - DNA, 20 bp, Homo sapiens
cccagaggttgcggcaggag

SEQ ID NO: 9201469 - DNA, 22 bp, Homo sapiens
cccagaggtgcttcagaggtgc

SEQ ID NO: 9201470 - DNA, 22 bp, Homo sapiens
cccagaggtgaaggaggtggga

SEQ ID NO: 9201471 - DNA, 22 bp, Homo sapiens
aggctgtggccctggtctagca

SEQ ID NO: 9201472 - DNA, 22 bp, Homo sapiens
aggctgtgggaatggctgcttg

SEQ ID NO: 9201473 - DNA, 22 bp, Homo sapiens
aggctgtggcatcacatcagga

SEQ ID NO: 9201474 - DNA, 22 bp, Homo sapiens
aggctgtgcgaggtctcagagt

SEQ ID NO: 9201475 - DNA, 22 bp, Homo sapiens
aggctgtgcgaggtctcagagt

SEQ ID NO: 9201476 - DNA, 22 bp, Homo sapiens
ccaggagggtggttactcaatc

SEQ ID NO: 9201477 - DNA, 22 bp, Homo sapiens
ccaggaggtgaaacttcaccag

SEQ ID NO: 9201478 - DNA, 22 bp, Homo sapiens
ccagctcccattcttcacctgt

SEQ ID NO: 9201479 - DNA, 23 bp, Homo sapiens
ccagctcccaggtctgaggactg

SEQ ID NO: 9201480 - DNA, 22 bp, Homo sapiens
ccagctccctgaagcctggtct

SEQ ID NO: 9201481 - DNA, 22 bp, Homo sapiens
ccagctccgggagttgctgctg

SEQ ID NO: 9201482 - DNA, 22 bp, Homo sapiens
ccagctcccgcaggctgcacag

SEQ ID NO: 9201483 - DNA, 22 bp, Homo sapiens
ccagctccattgcttagtgtaa

SEQ ID NO: 9201484 - DNA, 22 bp, Homo sapiens
ccagctccaggtagatgggcag

SEQ ID NO: 9201485 - DNA, 21 bp, Homo sapiens
aggccctggaggtcagagaaa

SEQ ID NO: 9201486 - DNA, 22 bp, Homo sapiens
aggccctggacactcaagccgg

SEQ ID NO: 9201487 - DNA, 22 bp, Homo sapiens
aggccctgctttccagagctca

SEQ ID NO: 9201488 - DNA, 22 bp, Homo sapiens
aggccctgctgaggcctccctc

SEQ ID NO: 9201489 - DNA, 21 bp, Homo sapiens
aggctcagagatcaaacagta

SEQ ID NO: 9201490 - DNA, 22 bp, Homo sapiens
aggctcagagatgagtaagcac

SEQ ID NO: 9201491 - DNA, 22 bp, Homo sapiens
aggctagaggcttctggcttca

SEQ ID NO: 9201492 - DNA, 22 bp, Homo sapiens
aggcctggtgaatgaagtatct

SEQ ID NO: 9201493 - DNA, 19 bp, Homo sapiens
aggcctggggttttgcact

SEQ ID NO: 9201494 - DNA, 22 bp, Homo sapiens
aggcctgggtctcgtgcctacc

SEQ ID NO: 9201495 - DNA, 22 bp, Homo sapiens
aggcctgggtctcgtgcctacc

SEQ ID NO: 9201496 - DNA, 22 bp, Homo sapiens
ccaggcacggtggctcatgcct

SEQ ID NO: 9201497 - DNA, 22 bp, Homo sapiens
ccaggcactcacggggcactgg

SEQ ID NO: 9201498 - DNA, 22 bp, Homo sapiens
ccaggcaccatgttcttaggac

SEQ ID NO: 9201499 - DNA, 22 bp, Homo sapiens
ccaggcactgctcgaggtgcta

SEQ ID NO: 9201500 - DNA, 20 bp, Homo sapiens
ccaggcactgtcccatgcag

SEQ ID NO: 9201501 - DNA, 22 bp, Homo sapiens
ccaggcacaggtgggcctcaga

SEQ ID NO: 9201502 - DNA, 20 bp, Homo sapiens
aggctcagagcagtagtaca

SEQ ID NO: 9201503 - DNA, 20 bp, Homo sapiens
aggctcagagcagtagtaca

SEQ ID NO: 9201504 - DNA, 22 bp, Homo sapiens
ccagccctcggtagtcccatag

SEQ ID NO: 9201505 - DNA, 22 bp, Homo sapiens
ccagccctgaaccctgctgcat

SEQ ID NO: 9201506 - DNA, 22 bp, Homo sapiens
ccagccctgaaccctgctgcat

SEQ ID NO: 9201507 - DNA, 23 bp, Homo sapiens
ccagccctccaccagctctaggc

SEQ ID NO: 9201508 - DNA, 18 bp, Homo sapiens
ccagccctgcagcacctg

SEQ ID NO: 9201509 - DNA, 18 bp, Homo sapiens
ccagccctgcagcacctg

SEQ ID NO: 9201510 - DNA, 22 bp, Homo sapiens
aggccctgcccagagctcctcg

SEQ ID NO: 9201511 - DNA, 22 bp, Homo sapiens
aggccctgcccagagctcctcg

SEQ ID NO: 9201512 - DNA, 22 bp, Homo sapiens
aggccctgacctgggagatcta

SEQ ID NO: 9201513 - DNA, 22 bp, Homo sapiens
aggccctgacctgggagatcta

SEQ ID NO: 9201514 - DNA, 22 bp, Homo sapiens
aggccctgcccagtgccacaag

SEQ ID NO: 9201515 - DNA, 22 bp, Homo sapiens
aggccctgcccagtgccacaag

SEQ ID NO: 9201516 - DNA, 22 bp, Homo sapiens
ccagccaggctggctgtggagg

SEQ ID NO: 9201517 - DNA, 22 bp, Homo sapiens
ccagccagtatattccaaagcc

SEQ ID NO: 9201518 - DNA, 22 bp, Homo sapiens
ccagccagctgcccttggggcc

SEQ ID NO: 9201519 - DNA, 22 bp, Homo sapiens
ccagccagctggttggacgcct

SEQ ID NO: 9201520 - DNA, 22 bp, Homo sapiens
ccagccagctggttggacgcct

SEQ ID NO: 9201521 - DNA, 22 bp, Homo sapiens
ccagccagccttgatctgagta

SEQ ID NO: 9201522 - DNA, 22 bp, Homo sapiens
ccagagtctatgagtcctcatt

SEQ ID NO: 9201523 - DNA, 22 bp, Homo sapiens
ccagcaggcagtcatatccttt

SEQ ID NO: 9201524 - DNA, 22 bp, Homo sapiens
ccagccagatgataagctctat

SEQ ID NO: 9201525 - DNA, 22 bp, Homo sapiens
ccagccagcaagctcccagttc

SEQ ID NO: 9201526 - DNA, 22 bp, Homo sapiens
ccagccactgggccactgccag

SEQ ID NO: 9201527 - DNA, 22 bp, Homo sapiens
ccagccagaagtccgggcttct

SEQ ID NO: 9201528 - DNA, 22 bp, Homo sapiens
ccactccccacgtgctgtcaga

SEQ ID NO: 9201529 - DNA, 20 bp, Homo sapiens
ccagagctgatggctgcccg

SEQ ID NO: 9201530 - DNA, 22 bp, Homo sapiens
ccagagtagctgccctgcacct

SEQ ID NO: 9201531 - DNA, 19 bp, Homo sapiens
ccagagtcatgtctccccc

SEQ ID NO: 9201532 - DNA, 19 bp, Homo sapiens
ccagaggtttgctgggcct

SEQ ID NO: 9201533 - DNA, 22 bp, Homo sapiens
ccagaggttccaggctagggag

SEQ ID NO: 9201534 - DNA, 22 bp, Homo sapiens
ccagaggtggtggtgtctagaa

SEQ ID NO: 9201535 - DNA, 22 bp, Homo sapiens
ccagaggtgctgggagaggtct

SEQ ID NO: 9201536 - DNA, 18 bp, Homo sapiens
ccagaggcccgggcaggc

SEQ ID NO: 9201537 - DNA, 22 bp, Homo sapiens
aggtaggatagataggaagacc

SEQ ID NO: 9201538 - DNA, 20 bp, Homo sapiens
aggtaggatcggtgtcataa

SEQ ID NO: 9201539 - DNA, 22 bp, Homo sapiens
aggtaggatgggtggagatgat

SEQ ID NO: 9201540 - DNA, 22 bp, Homo sapiens
aggtaggatgggtggagatgat

SEQ ID NO: 9201541 - DNA, 22 bp, Homo sapiens
aggtaggagttgatggatgttc

SEQ ID NO: 9201542 - DNA, 21 bp, Homo sapiens
cctgccaggaaactgagtgtc

SEQ ID NO: 9201543 - DNA, 22 bp, Homo sapiens
cctgccagcgcttatctctcgg

SEQ ID NO: 9201544 - DNA, 22 bp, Homo sapiens
cctgccagcgcttatctctcgg

SEQ ID NO: 9201545 - DNA, 22 bp, Homo sapiens
aggtagggttaatggagatata

SEQ ID NO: 9201546 - DNA, 22 bp, Homo sapiens
cctgcagagcaggagaggcatc

SEQ ID NO: 9201547 - DNA, 22 bp, Homo sapiens
cctgcagagggactggcaggaa

SEQ ID NO: 9201548 - DNA, 22 bp, Homo sapiens
cctgcagaggtcaggccagaaa

SEQ ID NO: 9201549 - DNA, 22 bp, Homo sapiens
cctgccagatcccctgagctga

SEQ ID NO: 9201550 - DNA, 22 bp, Homo sapiens
cctgccagcatggcttatctcc

SEQ ID NO: 9201551 - DNA, 22 bp, Homo sapiens
cctgccagcccgcgttcatgcc

SEQ ID NO: 9201552 - DNA, 22 bp, Homo sapiens
cctgccagcccgcgttcatgcc

SEQ ID NO: 9201553 - DNA, 22 bp, Homo sapiens
aggtccctcagaggcctcaccg

SEQ ID NO: 9201554 - DNA, 22 bp, Homo sapiens
aggtcccagtctgtgatgactc

SEQ ID NO: 9201555 - DNA, 22 bp, Homo sapiens
cctggctctgccgtaaccacca

SEQ ID NO: 9201556 - DNA, 22 bp, Homo sapiens
cctggctctgcagccactccag

SEQ ID NO: 9201557 - DNA, 22 bp, Homo sapiens
aggtcctgagggttcgtctgca

SEQ ID NO: 9201558 - DNA, 22 bp, Homo sapiens
aggtcctgactccacgttctag

SEQ ID NO: 9201559 - DNA, 22 bp, Homo sapiens
aggtcctgacgccctttgaaat

SEQ ID NO: 9201560 - DNA, 22 bp, Homo sapiens
aggtcctgaagattttactaga

SEQ ID NO: 9201561 - DNA, 23 bp, Homo sapiens
aggtaggttattgctgctacctg

SEQ ID NO: 9201562 - DNA, 22 bp, Homo sapiens
cctggattctgctggccacttt

SEQ ID NO: 9201563 - DNA, 22 bp, Homo sapiens
cctggcacaagagcagcattgg

SEQ ID NO: 9201564 - DNA, 20 bp, Homo sapiens
cctgggctccaggagccccg

SEQ ID NO: 9201565 - DNA, 20 bp, Homo sapiens
cctgggctccaggagccccg

SEQ ID NO: 9201566 - DNA, 22 bp, Homo sapiens
cctgggctcgcgcacttcaccc

SEQ ID NO: 9201567 - DNA, 22 bp, Homo sapiens
cctgggctcgcgcacttcaccc

SEQ ID NO: 9201568 - DNA, 22 bp, Homo sapiens
cctgggcttctgtctagatgtt

SEQ ID NO: 9201569 - DNA, 22 bp, Homo sapiens
cctgggcttgcatctgtgctgg

SEQ ID NO: 9201570 - DNA, 22 bp, Homo sapiens
cctgggcttggttgttgagaac

SEQ ID NO: 9201571 - DNA, 22 bp, Homo sapiens
cctgtcagttgctgtcagggat

SEQ ID NO: 9201572 - DNA, 22 bp, Homo sapiens
cctgtcagttgctgtcagggat

SEQ ID NO: 9201573 - DNA, 22 bp, Homo sapiens
cctgggctttcggcggcttcct

SEQ ID NO: 9201574 - DNA, 22 bp, Homo sapiens
cctgggctttcggcggcttcct

SEQ ID NO: 9201575 - DNA, 22 bp, Homo sapiens
cctgggctttcggcggcttcct

SEQ ID NO: 9201576 - DNA, 22 bp, Homo sapiens
cctgggctttcaaaaccagcct

SEQ ID NO: 9201577 - DNA, 22 bp, Homo sapiens
cctgggctttcaaaaccagcct

SEQ ID NO: 9201578 - DNA, 22 bp, Homo sapiens
cctgggctttcaaaaccagcct

SEQ ID NO: 9201579 - DNA, 22 bp, Homo sapiens
cctggctctggttccctcagct

SEQ ID NO: 9201580 - DNA, 22 bp, Homo sapiens
cctggctctggttccctcagct

SEQ ID NO: 9201581 - DNA, 22 bp, Homo sapiens
cctggctctggtgaggagaagt

SEQ ID NO: 9201582 - DNA, 22 bp, Homo sapiens
cctggctctgcgtgcagctccg

SEQ ID NO: 9201583 - DNA, 22 bp, Homo sapiens
cctggctctgcgtgcagctccg

SEQ ID NO: 9201584 - DNA, 22 bp, Homo sapiens
cctgggctcaggcttgggcagc

SEQ ID NO: 9201585 - DNA, 22 bp, Homo sapiens
cctgggctcaccatgccttgga

SEQ ID NO: 9201586 - DNA, 22 bp, Homo sapiens
cctgggctccactccaagagca

SEQ ID NO: 9201587 - DNA, 22 bp, Homo sapiens
cctgggctccactccaagagca

SEQ ID NO: 9201588 - DNA, 22 bp, Homo sapiens
cctgggctcaagtgatggtccc

SEQ ID NO: 9201589 - DNA, 22 bp, Homo sapiens
cctgggctcacagccaaggctc

SEQ ID NO: 9201590 - DNA, 22 bp, Homo sapiens
cctgggctcaccatgccttgga

SEQ ID NO: 9201591 - DNA, 22 bp, Homo sapiens
cctgggctcacagccaaggctc

SEQ ID NO: 9201592 - DNA, 22 bp, Homo sapiens
cctgtcccctcacaatgccact

SEQ ID NO: 9201593 - DNA, 22 bp, Homo sapiens
cctgtgccaaaatctaggcagt

SEQ ID NO: 9201594 - DNA, 22 bp, Homo sapiens
aggtggggaggagtgtctcttt

SEQ ID NO: 9201595 - DNA, 22 bp, Homo sapiens
aggtggggaggagtgtctcttt

SEQ ID NO: 9201596 - DNA, 21 bp, Homo sapiens
aggtggggctgcacctctgct

SEQ ID NO: 9201597 - DNA, 22 bp, Homo sapiens
aggtggggcccaccaatttgca

SEQ ID NO: 9201598 - DNA, 22 bp, Homo sapiens
aggtggggccaaatgctacagt

SEQ ID NO: 9201599 - DNA, 22 bp, Homo sapiens
aggtggggagtatatgtaattg

SEQ ID NO: 9201600 - DNA, 22 bp, Homo sapiens
agtacagcaccatgagcacagg

SEQ ID NO: 9201601 - DNA, 22 bp, Homo sapiens
agtacagatttagacacgatag

SEQ ID NO: 9201602 - DNA, 19 bp, Homo sapiens
agtacagaaaagagccctg

SEQ ID NO: 9201603 - DNA, 22 bp, Homo sapiens
ctaagacatgccctgcatgata

SEQ ID NO: 9201604 - DNA, 22 bp, Homo sapiens
cgggcgcactccgggcagctgt

SEQ ID NO: 9201605 - DNA, 17 bp, Homo sapiens
cctgttgttgcctttgc

SEQ ID NO: 9201606 - DNA, 22 bp, Homo sapiens
cgaggccatgcatgctgaggac

SEQ ID NO: 9201607 - DNA, 22 bp, Homo sapiens
cgaggccatgcatgctgaggac

SEQ ID NO: 9201608 - DNA, 19 bp, Homo sapiens
cgcaggagccgaggtgacc

SEQ ID NO: 9201609 - DNA, 22 bp, Homo sapiens
aggtttctgcactgtcactggt

SEQ ID NO: 9201610 - DNA, 22 bp, Homo sapiens
cgcaggctcggttcacagagca

SEQ ID NO: 9201611 - DNA, 22 bp, Homo sapiens
agtatttagagacacaagatgg

SEQ ID NO: 9201612 - DNA, 22 bp, Homo sapiens
ctaaggaattggagcatgtgtt

SEQ ID NO: 9201613 - DNA, 22 bp, Homo sapiens
ctaaggaattcaaatagttagt

SEQ ID NO: 9201614 - DNA, 22 bp, Homo sapiens
ctaagcatccatctcttcttca

SEQ ID NO: 9201615 - DNA, 22 bp, Homo sapiens
ctaccagcttctttgtctggga

SEQ ID NO: 9201616 - DNA, 20 bp, Homo sapiens
ctaccatctcccaaaccgtc

SEQ ID NO: 9201617 - DNA, 22 bp, Homo sapiens
ctagaaatattttacagtcaag

SEQ ID NO: 9201618 - DNA, 22 bp, Homo sapiens
ctagaaatctctgtttacatca

SEQ ID NO: 9201619 - DNA, 22 bp, Homo sapiens
ctacatttgttctatagctttt

SEQ ID NO: 9201620 - DNA, 22 bp, Homo sapiens
ctacattttgtgattatgaaat

SEQ ID NO: 9201621 - DNA, 22 bp, Homo sapiens
ctacatttcccagctgccttcc

SEQ ID NO: 9201622 - DNA, 22 bp, Homo sapiens
ctacatttggagagtataggaa

SEQ ID NO: 9201623 - DNA, 22 bp, Homo sapiens
ctaggtacttagtaaatattaa

SEQ ID NO: 9201624 - DNA, 22 bp, Homo sapiens
ctagggtggatttgtgcagagt

SEQ ID NO: 9201625 - DNA, 22 bp, Homo sapiens
ctagggtcaggggcctgcgtcg

SEQ ID NO: 9201626 - DNA, 22 bp, Homo sapiens
agtccatagtttacattacagc

SEQ ID NO: 9201627 - DNA, 22 bp, Homo sapiens
agtcccaacagcttacaaggaa

SEQ ID NO: 9201628 - DNA, 22 bp, Homo sapiens
agtcccagctactcaagaggct

SEQ ID NO: 9201629 - DNA, 22 bp, Homo sapiens
agtcccagctactcaagaggct

SEQ ID NO: 9201630 - DNA, 20 bp, Homo sapiens
ctagtctcacatccctggca

SEQ ID NO: 9201631 - DNA, 22 bp, Homo sapiens
ctaggtggtggtgggttgacat

SEQ ID NO: 9201632 - DNA, 22 bp, Homo sapiens
ctagtaaagtactcaaatagcc

SEQ ID NO: 9201633 - DNA, 22 bp, Homo sapiens
agtccaggtctctgagtcacaa

SEQ ID NO: 9201634 - DNA, 22 bp, Homo sapiens
agtccagggagcccaggctttg

SEQ ID NO: 9201635 - DNA, 22 bp, Homo sapiens
agtccaggtggaccttggccag

SEQ ID NO: 9201636 - DNA, 22 bp, Homo sapiens
agtccatacattgagaataaca

SEQ ID NO: 9201637 - DNA, 22 bp, Homo sapiens
ctagaacagtcaaagtgagctc

SEQ ID NO: 9201638 - DNA, 22 bp, Homo sapiens
ctagaatactcgtattattccc

SEQ ID NO: 9201639 - DNA, 22 bp, Homo sapiens
ctcattgcccagatccccacag

SEQ ID NO: 9201640 - DNA, 22 bp, Homo sapiens
ctcattgcaacctccgcctccc

SEQ ID NO: 9201641 - DNA, 22 bp, Homo sapiens
ctcatggcagagtcacctgtcc

SEQ ID NO: 9201642 - DNA, 22 bp, Homo sapiens
agtcctggccccaaggaaggat

SEQ ID NO: 9201643 - DNA, 22 bp, Homo sapiens
agtcctggctctacgggcttca

SEQ ID NO: 9201644 - DNA, 22 bp, Homo sapiens
ctcatggaagacactccttcac

SEQ ID NO: 9201645 - DNA, 22 bp, Homo sapiens
ctcatggagggagtgctcttcc

SEQ ID NO: 9201646 - DNA, 22 bp, Homo sapiens
agtcctgggtccagcaggtcct

SEQ ID NO: 9201647 - DNA, 22 bp, Homo sapiens
agtcctgggtccagcaggtcct

SEQ ID NO: 9201648 - DNA, 22 bp, Homo sapiens
agtcctgatgctctggcaggag

SEQ ID NO: 9201649 - DNA, 22 bp, Homo sapiens
agtcctggcatataggtcctca

SEQ ID NO: 9201650 - DNA, 22 bp, Homo sapiens
agtccctctgggagcaggactg

SEQ ID NO: 9201651 - DNA, 22 bp, Homo sapiens
ctccaggaaagcctgaggcccg

SEQ ID NO: 9201652 - DNA, 22 bp, Homo sapiens
ctccaggaacagcaccctgctg

SEQ ID NO: 9201653 - DNA, 22 bp, Homo sapiens
ctccaggaaagtcaggcttaga

SEQ ID NO: 9201654 - DNA, 22 bp, Homo sapiens
ctccaggcgcttaccaagcgct

SEQ ID NO: 9201655 - DNA, 22 bp, Homo sapiens
ctccaggcgggaggcggttcca

SEQ ID NO: 9201656 - DNA, 22 bp, Homo sapiens
ctccaggctggggtgcaggttg

SEQ ID NO: 9201657 - DNA, 22 bp, Homo sapiens
ctccaggctggggtgcaggttg

SEQ ID NO: 9201658 - DNA, 22 bp, Homo sapiens
ctccaggcttcaagggccggcc

SEQ ID NO: 9201659 - DNA, 22 bp, Homo sapiens
ctccaggctggatccaagtcaa

SEQ ID NO: 9201660 - DNA, 22 bp, Homo sapiens
ctccaggctggatccaagtcaa

SEQ ID NO: 9201661 - DNA, 22 bp, Homo sapiens
agtcttcatttgtgttcaagac

SEQ ID NO: 9201662 - DNA, 22 bp, Homo sapiens
agtcttccctgtgccagagtgt

SEQ ID NO: 9201663 - DNA, 22 bp, Homo sapiens
agtcttctgaataagaatcact

SEQ ID NO: 9201664 - DNA, 22 bp, Homo sapiens
agtcttctcatttcacatgctt

SEQ ID NO: 9201665 - DNA, 22 bp, Homo sapiens
agtcttcagcatagcatatggc

SEQ ID NO: 9201666 - DNA, 22 bp, Homo sapiens
ctccctccctacgtgagctcac

SEQ ID NO: 9201667 - DNA, 22 bp, Homo sapiens
ctccctctcaccggagccctgg

SEQ ID NO: 9201668 - DNA, 22 bp, Homo sapiens
ctcccaggttgattctttccct

SEQ ID NO: 9201669 - DNA, 18 bp, Homo sapiens
ctccagggaactcagtca

SEQ ID NO: 9201670 - DNA, 22 bp, Homo sapiens
ctcctggctctgccacttacta

SEQ ID NO: 9201671 - DNA, 22 bp, Homo sapiens
ctcctcagactttccttgtccg

SEQ ID NO: 9201672 - DNA, 22 bp, Homo sapiens
ctcctaggtgctcactggggtc

SEQ ID NO: 9201673 - DNA, 22 bp, Homo sapiens
ctcctcaaggtctcaggaataa

SEQ ID NO: 9201674 - DNA, 22 bp, Homo sapiens
ctccctctgtccgaggccggct

SEQ ID NO: 9201675 - DNA, 22 bp, Homo sapiens
ctctcagaagtagcacgtgggc

SEQ ID NO: 9201676 - DNA, 22 bp, Homo sapiens
agtggcagagtgcactcaggca

SEQ ID NO: 9201677 - DNA, 22 bp, Homo sapiens
ctcctgggtcattgccagcaaa

SEQ ID NO: 9201678 - DNA, 22 bp, Homo sapiens
agtggcagagtcagggtttgga

SEQ ID NO: 9201679 - DNA, 22 bp, Homo sapiens
agtggcagagtgcactcaggca

SEQ ID NO: 9201680 - DNA, 22 bp, Homo sapiens
ctcctgggcttcgaaggctccc

SEQ ID NO: 9201681 - DNA, 22 bp, Homo sapiens
ctcctggggccatggaaggaac

SEQ ID NO: 9201682 - DNA, 22 bp, Homo sapiens
ctcctgggggacagcggcaggg

SEQ ID NO: 9201683 - DNA, 22 bp, Homo sapiens
ctcctgggggacagcggcaggg

SEQ ID NO: 9201684 - DNA, 22 bp, Homo sapiens
ctcctgggtcattgccagcaaa

SEQ ID NO: 9201685 - DNA, 22 bp, Homo sapiens
ctcctgggaatttagttgtgag

SEQ ID NO: 9201686 - DNA, 22 bp, Homo sapiens
ctcctgggaaatgaaggggcag

SEQ ID NO: 9201687 - DNA, 22 bp, Homo sapiens
ctcctgggaaaggctggacaca

SEQ ID NO: 9201688 - DNA, 22 bp, Homo sapiens
ctcctgggaaaggctggacaca

SEQ ID NO: 9201689 - DNA, 22 bp, Homo sapiens
ctctgcaggcacccagggtggg

SEQ ID NO: 9201690 - DNA, 21 bp, Homo sapiens
ctctgcagtgcccaccttgcc

SEQ ID NO: 9201691 - DNA, 22 bp, Homo sapiens
ctctgctaagcatgaacaatta

SEQ ID NO: 9201692 - DNA, 22 bp, Homo sapiens
ctctgctgagccagagtcccca

SEQ ID NO: 9201693 - DNA, 22 bp, Homo sapiens
ctctgctgatatagcttttcaa

SEQ ID NO: 9201694 - DNA, 22 bp, Homo sapiens
ctctgctgatctcagctgggct

SEQ ID NO: 9201695 - DNA, 21 bp, Homo sapiens
ctctgcagtgcccaccttgcc

SEQ ID NO: 9201696 - DNA, 22 bp, Homo sapiens
ctctgcctgccactgttcaggc

SEQ ID NO: 9201697 - DNA, 22 bp, Homo sapiens
ctctgcctgtgtcgccaccaca

SEQ ID NO: 9201698 - DNA, 22 bp, Homo sapiens
ctctgcctgtctcatcctgcaa

SEQ ID NO: 9201699 - DNA, 22 bp, Homo sapiens
ctctgggacatcccttggccta

SEQ ID NO: 9201700 - DNA, 22 bp, Homo sapiens
ctctgggcttcaagtcagattt

SEQ ID NO: 9201701 - DNA, 22 bp, Homo sapiens
ctctgggcttcctttgtgggtt

SEQ ID NO: 9201702 - DNA, 20 bp, Homo sapiens
ctctgggctgcgttgcaaac

SEQ ID NO: 9201703 - DNA, 22 bp, Homo sapiens
ctctgggcttacctgcttcctg

SEQ ID NO: 9201704 - DNA, 19 bp, Homo sapiens
ctctgggctgcatcttggt

SEQ ID NO: 9201705 - DNA, 22 bp, Homo sapiens
ctctgggctgccttttagctct

SEQ ID NO: 9201706 - DNA, 22 bp, Homo sapiens
ctctggctttgctcatgcatcc

SEQ ID NO: 9201707 - DNA, 22 bp, Homo sapiens
ctctgggaattctgagcaagca

SEQ ID NO: 9201708 - DNA, 17 bp, Homo sapiens
ctctggggacagttcta

SEQ ID NO: 9201709 - DNA, 22 bp, Homo sapiens
ctctgggcttgttgacctgcac

SEQ ID NO: 9201710 - DNA, 22 bp, Homo sapiens
ctctgggcttgttgacctgcac

SEQ ID NO: 9201711 - DNA, 22 bp, Homo sapiens
ctctggggtggaggaggctgac

SEQ ID NO: 9201712 - DNA, 23 bp, Homo sapiens
ctgaaataccagaaaatcagtgt

SEQ ID NO: 9201713 - DNA, 17 bp, Homo sapiens
ctgaaatattatgataa

SEQ ID NO: 9201714 - DNA, 22 bp, Homo sapiens
ctgaaatagtttcatagaactt

SEQ ID NO: 9201715 - DNA, 22 bp, Homo sapiens
ctgaaatatagatgtgaacagt

SEQ ID NO: 9201716 - DNA, 22 bp, Homo sapiens
ctgaaatggttgcctggagaat

SEQ ID NO: 9201717 - DNA, 22 bp, Homo sapiens
ctgaaatgggcaaaagtagatt

SEQ ID NO: 9201718 - DNA, 22 bp, Homo sapiens
ctgaatgtcgatcagcttgggt

SEQ ID NO: 9201719 - DNA, 22 bp, Homo sapiens
ctgagaaaagacatttctagat

SEQ ID NO: 9201720 - DNA, 22 bp, Homo sapiens
agttagaaagtaaatcatttga

SEQ ID NO: 9201721 - DNA, 22 bp, Homo sapiens
ctgagcagcaccttcaagaaac

SEQ ID NO: 9201722 - DNA, 22 bp, Homo sapiens
ctgagcagcaccttcaagaaac

SEQ ID NO: 9201723 - DNA, 22 bp, Homo sapiens
ctgagcagcacagggcgccagg

SEQ ID NO: 9201724 - DNA, 22 bp, Homo sapiens
ctgagcagcaacccagagcctc

SEQ ID NO: 9201725 - DNA, 22 bp, Homo sapiens
ctgagctgggactcagtagcaa

SEQ ID NO: 9201726 - DNA, 22 bp, Homo sapiens
ctggcttccaccatggcccctg

SEQ ID NO: 9201727 - DNA, 22 bp, Homo sapiens
ctggctggccggaggcatccct

SEQ ID NO: 9201728 - DNA, 22 bp, Homo sapiens
ctggctgggagcgagctgctca

SEQ ID NO: 9201729 - DNA, 22 bp, Homo sapiens
ctggctgggaagtagagtaggt

SEQ ID NO: 9201730 - DNA, 22 bp, Homo sapiens
ctggctgggagcgagctgctca

SEQ ID NO: 9201731 - DNA, 21 bp, Homo sapiens
ctgggctcaagcaatcctttc

SEQ ID NO: 9201732 - DNA, 20 bp, Homo sapiens
ctgggctcaagtgagcctcc

SEQ ID NO: 9201733 - DNA, 20 bp, Homo sapiens
ctgggctcaagtgagcctcc

SEQ ID NO: 9201734 - DNA, 22 bp, Homo sapiens
ctgggctcaagtgatccaccca

SEQ ID NO: 9201735 - DNA, 20 bp, Homo sapiens
ctgggctcaagtgatcctcc

SEQ ID NO: 9201736 - DNA, 22 bp, Homo sapiens
ctgggctcaagtgatccaccca

SEQ ID NO: 9201737 - DNA, 22 bp, Homo sapiens
ctgggctcaagaagtcttccct

SEQ ID NO: 9201738 - DNA, 22 bp, Homo sapiens
ctgggctcacctgtggctggca

SEQ ID NO: 9201739 - DNA, 22 bp, Homo sapiens
ctgggctcagatgagaggaagg

SEQ ID NO: 9201740 - DNA, 22 bp, Homo sapiens
ctgggctcttcccagatccaga

SEQ ID NO: 9201741 - DNA, 22 bp, Homo sapiens
ctgggctcttctcaccctgttt

SEQ ID NO: 9201742 - DNA, 22 bp, Homo sapiens
ctgggctcttctcaccctgttt

SEQ ID NO: 9201743 - DNA, 22 bp, Homo sapiens
ctgggctctgtgtttcagtttc

SEQ ID NO: 9201744 - DNA, 22 bp, Homo sapiens
ctgggctcttcccagatccaga

SEQ ID NO: 9201745 - DNA, 22 bp, Homo sapiens
ctgggctctgcggtgtcgctct

SEQ ID NO: 9201746 - DNA, 22 bp, Homo sapiens
atatgtttttggaaagaacaca

SEQ ID NO: 9201747 - DNA, 22 bp, Homo sapiens
atattacataaacatgagtgaa

SEQ ID NO: 9201748 - DNA, 22 bp, Homo sapiens
atatttaaacagggtaccaata

SEQ ID NO: 9201749 - DNA, 22 bp, Homo sapiens
atatttaactggtcccaatata

SEQ ID NO: 9201750 - DNA, 22 bp, Homo sapiens
atattttggggtgatgtgcatc

SEQ ID NO: 9201751 - DNA, 23 bp, Homo sapiens
atcaaagtggaaatcaattatct

SEQ ID NO: 9201752 - DNA, 22 bp, Homo sapiens
atatttaaacagggtaccaata

SEQ ID NO: 9201753 - DNA, 22 bp, Homo sapiens
atattgttgactataagagtaa

SEQ ID NO: 9201754 - DNA, 22 bp, Homo sapiens
atattgttagtaatatttcgaa

SEQ ID NO: 9201755 - DNA, 22 bp, Homo sapiens
atattgtactagggttacatgt

SEQ ID NO: 9201756 - DNA, 22 bp, Homo sapiens
atattgatggaggtgttagaca

SEQ ID NO: 9201757 - DNA, 22 bp, Homo sapiens
atcagaaaaacataatgttatt

SEQ ID NO: 9201758 - DNA, 22 bp, Homo sapiens
atcagaagtgatgtgtgttatt

SEQ ID NO: 9201759 - DNA, 20 bp, Homo sapiens
atcagaagtgatattaacca

SEQ ID NO: 9201760 - DNA, 22 bp, Homo sapiens
atcagaatactatcaacagtga

SEQ ID NO: 9201761 - DNA, 22 bp, Homo sapiens
atcagaaggggaggtaaagaag

SEQ ID NO: 9201762 - DNA, 22 bp, Homo sapiens
atcagaaggggaggtaaagaag

SEQ ID NO: 9201763 - DNA, 22 bp, Homo sapiens
atcagaagcttgtagtctctct

SEQ ID NO: 9201764 - DNA, 22 bp, Homo sapiens
atcagaacaaaagaacagttta

SEQ ID NO: 9201765 - DNA, 22 bp, Homo sapiens
atcagaaactcttagagcaggg

SEQ ID NO: 9201766 - DNA, 22 bp, Homo sapiens
atcagaaatagtcatgttactt

SEQ ID NO: 9201767 - DNA, 22 bp, Homo sapiens
atcagaaagttcatcatgtttg

SEQ ID NO: 9201768 - DNA, 22 bp, Homo sapiens
atcctgggcaaagtatgctgtc

SEQ ID NO: 9201769 - DNA, 19 bp, Homo sapiens
atcctgggtcctccagctg

SEQ ID NO: 9201770 - DNA, 22 bp, Homo sapiens
ctgtgtgtcctcggacgagttt

SEQ ID NO: 9201771 - DNA, 22 bp, Homo sapiens
ctgtgtgtcctcggacgagttt

SEQ ID NO: 9201772 - DNA, 22 bp, Homo sapiens
ctgtgtgtcatttgtcaatcct

SEQ ID NO: 9201773 - DNA, 22 bp, Homo sapiens
atccaggctgctttctatgccc

SEQ ID NO: 9201774 - DNA, 22 bp, Homo sapiens
atccaggctgggtgtggctact

SEQ ID NO: 9201775 - DNA, 22 bp, Homo sapiens
atccaggcattctgacttcaag

SEQ ID NO: 9201776 - DNA, 22 bp, Homo sapiens
atccaggcattctgacttcaag

SEQ ID NO: 9201777 - DNA, 22 bp, Homo sapiens
atccaggcctgagtctggtcct

SEQ ID NO: 9201778 - DNA, 22 bp, Homo sapiens
atccaggcgaatgcagaaggcc

SEQ ID NO: 9201779 - DNA, 22 bp, Homo sapiens
atcagaatcttctgaacagtgg

SEQ ID NO: 9201780 - DNA, 22 bp, Homo sapiens
atcagaatgattagtaaccaat

SEQ ID NO: 9201781 - DNA, 22 bp, Homo sapiens
atcagaattagccagtgaggct

SEQ ID NO: 9201782 - DNA, 22 bp, Homo sapiens
atcagacactagtggactagaa

SEQ ID NO: 9201783 - DNA, 22 bp, Homo sapiens
atcagacaattgttgagtactg

SEQ ID NO: 9201784 - DNA, 22 bp, Homo sapiens
atcagacagggagttctgtgtc

SEQ ID NO: 9201785 - DNA, 22 bp, Homo sapiens
atcagacagggaattatagcag

SEQ ID NO: 9201786 - DNA, 22 bp, Homo sapiens
ctgtggagtgtagatgctgggt

SEQ ID NO: 9201787 - DNA, 22 bp, Homo sapiens
ctgtggccttggaccagcatct

SEQ ID NO: 9201788 - DNA, 21 bp, Homo sapiens
ctgtggcctggctagcaccgt

SEQ ID NO: 9201789 - DNA, 23 bp, Homo sapiens
ctgtggccctgcttcatgcagcc

SEQ ID NO: 9201790 - DNA, 22 bp, Homo sapiens
ctgtggagttccatcaggggag

SEQ ID NO: 9201791 - DNA, 18 bp, Homo sapiens
ctgtgggaagagtttggg

SEQ ID NO: 9201792 - DNA, 18 bp, Homo sapiens
ctgtgggaaggctttcta

SEQ ID NO: 9201793 - DNA, 22 bp, Homo sapiens
ctgtggctatggtgtacatact

SEQ ID NO: 9201794 - DNA, 22 bp, Homo sapiens
ctgtggctcaattgcctactga

SEQ ID NO: 9201795 - DNA, 22 bp, Homo sapiens
cttcctctagcctagtaatgcc

SEQ ID NO: 9201796 - DNA, 22 bp, Homo sapiens
cttcctctagcctagtaatgcc

SEQ ID NO: 9201797 - DNA, 22 bp, Homo sapiens
atctctgatttacagcatctct

SEQ ID NO: 9201798 - DNA, 22 bp, Homo sapiens
atctgcacttaagcgaggcctg

SEQ ID NO: 9201799 - DNA, 22 bp, Homo sapiens
atctgagtctctgacagcatgt

SEQ ID NO: 9201800 - DNA, 22 bp, Homo sapiens
atctgagactgagtttggattt

SEQ ID NO: 9201801 - DNA, 22 bp, Homo sapiens
cttcttgcaattttcatcttat

SEQ ID NO: 9201802 - DNA, 22 bp, Homo sapiens
cttcttgctgggggcctcagtg

SEQ ID NO: 9201803 - DNA, 22 bp, Homo sapiens
cttcttaatgacagattaaaat

SEQ ID NO: 9201804 - DNA, 22 bp, Homo sapiens
cttcttaatgcataaactgtgt

SEQ ID NO: 9201805 - DNA, 22 bp, Homo sapiens
cttcttggtgatggcttacctg

SEQ ID NO: 9201806 - DNA, 21 bp, Homo sapiens
cttcttggggagcagctagac

SEQ ID NO: 9201807 - DNA, 22 bp, Homo sapiens
cttccaggtgctggcctggcct

SEQ ID NO: 9201808 - DNA, 22 bp, Homo sapiens
cttcctagcttcagagtctgtt

SEQ ID NO: 9201809 - DNA, 22 bp, Homo sapiens
cttcctagtgtctactttggag

SEQ ID NO: 9201810 - DNA, 22 bp, Homo sapiens
cttcctcccggcccatgctctg

SEQ ID NO: 9201811 - DNA, 22 bp, Homo sapiens
cttcctcatgtgcaatgcaagc

SEQ ID NO: 9201812 - DNA, 22 bp, Homo sapiens
cttcctcccccacacactcact

SEQ ID NO: 9201813 - DNA, 18 bp, Homo sapiens
cttcctcatcgctctccc

SEQ ID NO: 9201814 - DNA, 22 bp, Homo sapiens
cttcccacagaattcaatcagt

SEQ ID NO: 9201815 - DNA, 22 bp, Homo sapiens
cttccaggtgctggcctggcct

SEQ ID NO: 9201816 - DNA, 22 bp, Homo sapiens
cttccaggttctggttgggaag

SEQ ID NO: 9201817 - DNA, 22 bp, Homo sapiens
ctggctccattactcagcatct

SEQ ID NO: 9201818 - DNA, 22 bp, Homo sapiens
ctggctcccgaagccctcagtg

SEQ ID NO: 9201819 - DNA, 22 bp, Homo sapiens
ctggctcccatgagctctcacg

SEQ ID NO: 9201820 - DNA, 22 bp, Homo sapiens
ctggctcccgaagccctcagtg

SEQ ID NO: 9201821 - DNA, 22 bp, Homo sapiens
ctggctcccagctttcagggag

SEQ ID NO: 9201822 - DNA, 22 bp, Homo sapiens
atagcaaattctttaggtgctt

SEQ ID NO: 9201823 - DNA, 22 bp, Homo sapiens
atagcaaatattttaatgagca

SEQ ID NO: 9201824 - DNA, 22 bp, Homo sapiens
atagcagcatttcttccaagga

SEQ ID NO: 9201825 - DNA, 22 bp, Homo sapiens
atagcagcatcagtttatctcc

SEQ ID NO: 9201826 - DNA, 19 bp, Homo sapiens
atagcagctatacccagat

SEQ ID NO: 9201827 - DNA, 22 bp, Homo sapiens
atagcagtaacactgacatttt

SEQ ID NO: 9201828 - DNA, 22 bp, Homo sapiens
atactatattaccttctcaact

SEQ ID NO: 9201829 - DNA, 22 bp, Homo sapiens
ctggccccaggcagcctgctgg

SEQ ID NO: 9201830 - DNA, 22 bp, Homo sapiens
ctggcccatggtgagctctggg

SEQ ID NO: 9201831 - DNA, 22 bp, Homo sapiens
ctggcccatggtgagctctggg

SEQ ID NO: 9201832 - DNA, 22 bp, Homo sapiens
ctggcccatggtgagctctggg

SEQ ID NO: 9201833 - DNA, 22 bp, Homo sapiens
ctggcccatggtgagctctggg

SEQ ID NO: 9201834 - DNA, 22 bp, Homo sapiens
ctggcccatggtgagctctggg

SEQ ID NO: 9201835 - DNA, 22 bp, Homo sapiens
atagcaaaagcatgtgcaatac

SEQ ID NO: 9201836 - DNA, 22 bp, Homo sapiens
atagcaaaggacaatagtcagt

SEQ ID NO: 9201837 - DNA, 21 bp, Homo sapiens
atacattctattaagcattta

SEQ ID NO: 9201838 - DNA, 22 bp, Homo sapiens
atacattcctactgactagcta

SEQ ID NO: 9201839 - DNA, 22 bp, Homo sapiens
atacattcagcagtgctcatga

SEQ ID NO: 9201840 - DNA, 22 bp, Homo sapiens
atacattcatcacttttggtcc

SEQ ID NO: 9201841 - DNA, 22 bp, Homo sapiens
atacatgtgtgtgcatacatgt

SEQ ID NO: 9201842 - DNA, 17 bp, Homo sapiens
atacagtttattttaca

SEQ ID NO: 9201843 - DNA, 22 bp, Homo sapiens
atacatagatagataatctggc

SEQ ID NO: 9201844 - DNA, 22 bp, Homo sapiens
atacagtgccccttttcacatg

SEQ ID NO: 9201845 - DNA, 22 bp, Homo sapiens
atacagtgaatacttacagtgt

SEQ ID NO: 9201846 - DNA, 22 bp, Homo sapiens
atacagtgtactatttagcagt

SEQ ID NO: 9201847 - DNA, 20 bp, Homo sapiens
atacagatggttccagctgg

SEQ ID NO: 9201848 - DNA, 22 bp, Homo sapiens
ctgctgccattagggcacagac

SEQ ID NO: 9201849 - DNA, 22 bp, Homo sapiens
ctggaagactcaatggcctgcc

SEQ ID NO: 9201850 - DNA, 18 bp, Homo sapiens
ctggaagttagtctttgg

SEQ ID NO: 9201851 - DNA, 22 bp, Homo sapiens
ctggaagtttccttcctggtca

SEQ ID NO: 9201852 - DNA, 22 bp, Homo sapiens
ataagagctacagccagttctg

SEQ ID NO: 9201853 - DNA, 22 bp, Homo sapiens
ataagaaacattattctttcca

SEQ ID NO: 9201854 - DNA, 22 bp, Homo sapiens
ataactttcttcacccttgctg

SEQ ID NO: 9201855 - DNA, 22 bp, Homo sapiens
ataaattaggatctggggttcc

SEQ ID NO: 9201856 - DNA, 23 bp, Homo sapiens
ataaattactatctccctagagc

SEQ ID NO: 9201857 - DNA, 22 bp, Homo sapiens
ataacagtgacctctcagcacc

SEQ ID NO: 9201858 - DNA, 22 bp, Homo sapiens
ctgcctctccccagagtggccc

SEQ ID NO: 9201859 - DNA, 22 bp, Homo sapiens
ctgcctctcaggtccctgagat

SEQ ID NO: 9201860 - DNA, 22 bp, Homo sapiens
ctgcctctcagcctgaccgcca

SEQ ID NO: 9201861 - DNA, 22 bp, Homo sapiens
ataaatgaacattcacagagct

SEQ ID NO: 9201862 - DNA, 22 bp, Homo sapiens
ctgaggagccccctctcagcat

SEQ ID NO: 9201863 - DNA, 22 bp, Homo sapiens
ctgcatctgcataatcaacttc

SEQ ID NO: 9201864 - DNA, 22 bp, Homo sapiens
ctgcatctgcataatcaacttc

SEQ ID NO: 9201865 - DNA, 21 bp, Homo sapiens
ctgcatctgagtcattatgcc

SEQ ID NO: 9201866 - DNA, 22 bp, Homo sapiens
ctgcatctgttagattatcacc

SEQ ID NO: 9201867 - DNA, 22 bp, Homo sapiens
ctgcatgctgagccaacagtga

SEQ ID NO: 9201868 - DNA, 23 bp, Homo sapiens
ctgcatgcttgaggtcaggtgtg

SEQ ID NO: 9201869 - DNA, 22 bp, Homo sapiens
ctgcatcttagtcaaaatctgt

SEQ ID NO: 9201870 - DNA, 22 bp, Homo sapiens
ctgcatctgttagattatcacc

SEQ ID NO: 9201871 - DNA, 22 bp, Homo sapiens
ctgcatgcaacagtgccctgga

SEQ ID NO: 9201872 - DNA, 22 bp, Homo sapiens
ctgcatcctaacctccatgcag

SEQ ID NO: 9201873 - DNA, 22 bp, Homo sapiens
ctgcatcctggaaatagctaag

SEQ ID NO: 9201874 - DNA, 20 bp, Homo sapiens
ctgcagggtgagtgggcgat

SEQ ID NO: 9201875 - DNA, 22 bp, Homo sapiens
atgaaacagtgaattagtcaag

SEQ ID NO: 9201876 - DNA, 22 bp, Homo sapiens
atgaaacaacagacttggtcaa

SEQ ID NO: 9201877 - DNA, 22 bp, Homo sapiens
atgaaaatgtacatgtgtataa

SEQ ID NO: 9201878 - DNA, 22 bp, Homo sapiens
ctttctcttcgaaaacctgccc

SEQ ID NO: 9201879 - DNA, 22 bp, Homo sapiens
atctggataggttgttttgcat

SEQ ID NO: 9201880 - DNA, 22 bp, Homo sapiens
atctggagaatgtttgtctccg

SEQ ID NO: 9201881 - DNA, 22 bp, Homo sapiens
cttctttactttctagaaataa

SEQ ID NO: 9201882 - DNA, 22 bp, Homo sapiens
cttctttaatgtatacaaaaga

SEQ ID NO: 9201883 - DNA, 22 bp, Homo sapiens
cttcttgtcaatttgccattgt

SEQ ID NO: 9201884 - DNA, 20 bp, Homo sapiens
gaaacattggcagcaactga

SEQ ID NO: 9201885 - DNA, 22 bp, Homo sapiens
gaaacattgagcagaaggagaa

SEQ ID NO: 9201886 - DNA, 22 bp, Homo sapiens
gaaacattgtgttctacagatt

SEQ ID NO: 9201887 - DNA, 22 bp, Homo sapiens
gaaacattggtctgccccttat

SEQ ID NO: 9201888 - DNA, 20 bp, Homo sapiens
gaaacattggcagcaactga

SEQ ID NO: 9201889 - DNA, 22 bp, Homo sapiens
gaaacattcagtcaacagtgtt

SEQ ID NO: 9201890 - DNA, 22 bp, Homo sapiens
gaaacattcatatgagaaacct

SEQ ID NO: 9201891 - DNA, 22 bp, Homo sapiens
gaaacatagttgagacactgct

SEQ ID NO: 9201892 - DNA, 22 bp, Homo sapiens
gaaagcagtatttagttctgtt

SEQ ID NO: 9201893 - DNA, 22 bp, Homo sapiens
atgacagcattcaagacataga

SEQ ID NO: 9201894 - DNA, 22 bp, Homo sapiens
gaaacatttgttgagtacttgc

SEQ ID NO: 9201895 - DNA, 19 bp, Homo sapiens
atgatacaggtgaaaattg

SEQ ID NO: 9201896 - DNA, 22 bp, Homo sapiens
gaaatatacatgaagtcggctg

SEQ ID NO: 9201897 - DNA, 22 bp, Homo sapiens
atgatctcattctttcaaaggg

SEQ ID NO: 9201898 - DNA, 22 bp, Homo sapiens
atgatctcattctttcaaaggg

SEQ ID NO: 9201899 - DNA, 22 bp, Homo sapiens
atgatgctgtttatcatatact

SEQ ID NO: 9201900 - DNA, 22 bp, Homo sapiens
gaaatttattatctacatcatt

SEQ ID NO: 9201901 - DNA, 22 bp, Homo sapiens
gaaagtatttacattaacatct

SEQ ID NO: 9201902 - DNA, 19 bp, Homo sapiens
gaaagtcatagagcttgtc

SEQ ID NO: 9201903 - DNA, 22 bp, Homo sapiens
gaaaggtttcatctacttttca

SEQ ID NO: 9201904 - DNA, 22 bp, Homo sapiens
gaaagtattagcctagaagtca

SEQ ID NO: 9201905 - DNA, 22 bp, Homo sapiens
gaaatagacactttctatgaat

SEQ ID NO: 9201906 - DNA, 22 bp, Homo sapiens
gaaatactgtaaagttattatt

SEQ ID NO: 9201907 - DNA, 22 bp, Homo sapiens
gaaagtcatggatgaacactac

SEQ ID NO: 9201908 - DNA, 22 bp, Homo sapiens
gaaatacagttgggaggaggta

SEQ ID NO: 9201909 - DNA, 22 bp, Homo sapiens
gaaatacagttgggaggaggta

SEQ ID NO: 9201910 - DNA, 22 bp, Homo sapiens
gaataatattgactttgcaggc

SEQ ID NO: 9201911 - DNA, 22 bp, Homo sapiens
atgcacaggctgtgggctggtt

SEQ ID NO: 9201912 - DNA, 22 bp, Homo sapiens
gaataatagcagaaattagcag

SEQ ID NO: 9201913 - DNA, 22 bp, Homo sapiens
gaataatagcagaaattagcag

SEQ ID NO: 9201914 - DNA, 22 bp, Homo sapiens
gaatcacactcgtaagtgagtt

SEQ ID NO: 9201915 - DNA, 22 bp, Homo sapiens
gacaatcagccatatccagggt

SEQ ID NO: 9201916 - DNA, 22 bp, Homo sapiens
gaaggctgctgggaagtgtggt

SEQ ID NO: 9201917 - DNA, 22 bp, Homo sapiens
gaacaagtttccaaattataac

SEQ ID NO: 9201918 - DNA, 22 bp, Homo sapiens
gaacaaacacatcccagcagtg

SEQ ID NO: 9201919 - DNA, 22 bp, Homo sapiens
gaaggctggggcatcagtgaaa

SEQ ID NO: 9201920 - DNA, 22 bp, Homo sapiens
atgcacagatccccaggaccct

SEQ ID NO: 9201921 - DNA, 22 bp, Homo sapiens
atgcacacgtaccctacaaggc

SEQ ID NO: 9201922 - DNA, 22 bp, Homo sapiens
gactgggatcagctagatgatt

SEQ ID NO: 9201923 - DNA, 22 bp, Homo sapiens
gactgggacaggacagacatct

SEQ ID NO: 9201924 - DNA, 22 bp, Homo sapiens
gactggcctggagatgcagctg

SEQ ID NO: 9201925 - DNA, 22 bp, Homo sapiens
gaccctggcagataccgtcaca

SEQ ID NO: 9201926 - DNA, 22 bp, Homo sapiens
atgctccttggcttcaaagcca

SEQ ID NO: 9201927 - DNA, 22 bp, Homo sapiens
atgctcagggcacactctggac

SEQ ID NO: 9201928 - DNA, 22 bp, Homo sapiens
atgctcagcctgaggtggggag

SEQ ID NO: 9201929 - DNA, 22 bp, Homo sapiens
atgctcagacaccgggcggggg

SEQ ID NO: 9201930 - DNA, 22 bp, Homo sapiens
gacatttattggattttacgag

SEQ ID NO: 9201931 - DNA, 22 bp, Homo sapiens
gacatttattagaaaactatca

SEQ ID NO: 9201932 - DNA, 22 bp, Homo sapiens
gacatttatgaaggagatatgc

SEQ ID NO: 9201933 - DNA, 22 bp, Homo sapiens
atgctatgtaactggcagatag

SEQ ID NO: 9201934 - DNA, 22 bp, Homo sapiens
gaccacagattcctaagtggca

SEQ ID NO: 9201935 - DNA, 22 bp, Homo sapiens
gaccacagagcacggcctgctt

SEQ ID NO: 9201936 - DNA, 22 bp, Homo sapiens
gaccacagaggtgtgggagaga

SEQ ID NO: 9201937 - DNA, 22 bp, Homo sapiens
gaccacagaagccttgataggg

SEQ ID NO: 9201938 - DNA, 22 bp, Homo sapiens
gaccaagatacagcatcataga

SEQ ID NO: 9201939 - DNA, 22 bp, Homo sapiens
gacaatgtgaggcgagtttgtt

SEQ ID NO: 9201940 - DNA, 22 bp, Homo sapiens
gacacatagatctatctcactc

SEQ ID NO: 9201941 - DNA, 22 bp, Homo sapiens
gactgggccaaggtcagcagct

SEQ ID NO: 9201942 - DNA, 22 bp, Homo sapiens
gagagcaatggggacgggcagg

SEQ ID NO: 9201943 - DNA, 22 bp, Homo sapiens
gagagagctctgtgcctgggat

SEQ ID NO: 9201944 - DNA, 18 bp, Homo sapiens
atggaggcagagagctga

SEQ ID NO: 9201945 - DNA, 22 bp, Homo sapiens
gagatgggcgagaaggtggact

SEQ ID NO: 9201946 - DNA, 21 bp, Homo sapiens
gagatggcccagtagcgggcc

SEQ ID NO: 9201947 - DNA, 22 bp, Homo sapiens
atggccaccatctctaaaacac

SEQ ID NO: 9201948 - DNA, 21 bp, Homo sapiens
atggccactatggtgcagcag

SEQ ID NO: 9201949 - DNA, 22 bp, Homo sapiens
atggccagagaaggcagggtca

SEQ ID NO: 9201950 - DNA, 22 bp, Homo sapiens
atggcttggcaccatctccttg

SEQ ID NO: 9201951 - DNA, 22 bp, Homo sapiens
atggcttgtctatgagtgctct

SEQ ID NO: 9201952 - DNA, 22 bp, Homo sapiens
atggtggaagagcatcagaaag

SEQ ID NO: 9201953 - DNA, 22 bp, Homo sapiens
gaggcacatatatacagagccc

SEQ ID NO: 9201954 - DNA, 22 bp, Homo sapiens
gaggcagcctcagtggacctcg

SEQ ID NO: 9201955 - DNA, 22 bp, Homo sapiens
gaggcagcatctatggtgggaa

SEQ ID NO: 9201956 - DNA, 22 bp, Homo sapiens
gaggcagcattcgcatagacag

SEQ ID NO: 9201957 - DNA, 22 bp, Homo sapiens
atgggctggggaagctcactcc

SEQ ID NO: 9201958 - DNA, 22 bp, Homo sapiens
atgggctggcctttcccgctct

SEQ ID NO: 9201959 - DNA, 22 bp, Homo sapiens
atgggctgcttggcttccaccc

SEQ ID NO: 9201960 - DNA, 23 bp, Homo sapiens
atggggctcaacacttagtagct

SEQ ID NO: 9201961 - DNA, 22 bp, Homo sapiens
atggggagagcctctgtcccca

SEQ ID NO: 9201962 - DNA, 22 bp, Homo sapiens
atggggagagaagggctgagct

SEQ ID NO: 9201963 - DNA, 22 bp, Homo sapiens
atgggctgtgggaccctggacc

SEQ ID NO: 9201964 - DNA, 22 bp, Homo sapiens
atgggacagcatcttggtatta

SEQ ID NO: 9201965 - DNA, 22 bp, Homo sapiens
atgggacatagatccttgaggt

SEQ ID NO: 9201966 - DNA, 22 bp, Homo sapiens
atgggacaggtactagaaaggg

SEQ ID NO: 9201967 - DNA, 22 bp, Homo sapiens
atgtttaaaggagtcagagact

SEQ ID NO: 9201968 - DNA, 22 bp, Homo sapiens
atgttgtgtttgactgttaccc

SEQ ID NO: 9201969 - DNA, 22 bp, Homo sapiens
atgttggccaggctggtcttga

SEQ ID NO: 9201970 - DNA, 22 bp, Homo sapiens
atgttggctggattttagattt

SEQ ID NO: 9201971 - DNA, 22 bp, Homo sapiens
atgttcttctatctttattaaa

SEQ ID NO: 9201972 - DNA, 22 bp, Homo sapiens
atgttctgaataatgtgcatta

SEQ ID NO: 9201973 - DNA, 19 bp, Homo sapiens
atgttctgaattactgtaa

SEQ ID NO: 9201974 - DNA, 22 bp, Homo sapiens
gaggtggcccttgctcagcctt

SEQ ID NO: 9201975 - DNA, 22 bp, Homo sapiens
gaggtggcccttgctcagcctt

SEQ ID NO: 9201976 - DNA, 22 bp, Homo sapiens
gaggtggcactgtgaggagcac

SEQ ID NO: 9201977 - DNA, 22 bp, Homo sapiens
gaggtggcctcaagcagtcttc

SEQ ID NO: 9201978 - DNA, 20 bp, Homo sapiens
atgtgaaagatcagttgtct

SEQ ID NO: 9201979 - DNA, 22 bp, Homo sapiens
atgtgaaagaggtgttcagtgg

SEQ ID NO: 9201980 - DNA, 20 bp, Homo sapiens
atgtgaagtaggaagggtgt

SEQ ID NO: 9201981 - DNA, 20 bp, Homo sapiens
gaggtagggcttaaggcaag

SEQ ID NO: 9201982 - DNA, 20 bp, Homo sapiens
gaggtagggcttaaggcaag

SEQ ID NO: 9201983 - DNA, 22 bp, Homo sapiens
gaggtggatgttgcagtgagct

SEQ ID NO: 9201984 - DNA, 22 bp, Homo sapiens
gaggtagggcagaggctgaatg

SEQ ID NO: 9201985 - DNA, 22 bp, Homo sapiens
atgtctgcggcccaggccaggg

SEQ ID NO: 9201986 - DNA, 19 bp, Homo sapiens
gagggctcatttgaacaat

SEQ ID NO: 9201987 - DNA, 22 bp, Homo sapiens
atgtagatttgcttctcctgcc

SEQ ID NO: 9201988 - DNA, 22 bp, Homo sapiens
gaggcagcggctcacagagaaa

SEQ ID NO: 9201989 - DNA, 22 bp, Homo sapiens
gaggcagcgggtcaggaccgtg

SEQ ID NO: 9201990 - DNA, 22 bp, Homo sapiens
gaggcagcgggtcaggaccgtg

SEQ ID NO: 9201991 - DNA, 22 bp, Homo sapiens
atgtcctgttttggcttgctct

SEQ ID NO: 9201992 - DNA, 22 bp, Homo sapiens
atgtcctttgttctgagggagt

SEQ ID NO: 9201993 - DNA, 22 bp, Homo sapiens
attcagacattaccctggacat

SEQ ID NO: 9201994 - DNA, 22 bp, Homo sapiens
attcagactcttgagcagtccc

SEQ ID NO: 9201995 - DNA, 22 bp, Homo sapiens
attcagaattgtgggcagtaca

SEQ ID NO: 9201996 - DNA, 22 bp, Homo sapiens
gcagcagagaccccaggaagga

SEQ ID NO: 9201997 - DNA, 20 bp, Homo sapiens
gcagcagacagacaggggac

SEQ ID NO: 9201998 - DNA, 22 bp, Homo sapiens
gcacggcaagacggggcctcct

SEQ ID NO: 9201999 - DNA, 22 bp, Homo sapiens
gcacctggggtacacagctaca

SEQ ID NO: 9202000 - DNA, 22 bp, Homo sapiens
attcaaggtttattcagtttag

SEQ ID NO: 9202001 - DNA, 22 bp, Homo sapiens
attcacaatagcagcttgcatg

SEQ ID NO: 9202002 - DNA, 22 bp, Homo sapiens
gcactagagcagctctcagaga

SEQ ID NO: 9202003 - DNA, 22 bp, Homo sapiens
gatatgtttaatgcctcagtat

SEQ ID NO: 9202004 - DNA, 22 bp, Homo sapiens
attacagttctacacatccttt

SEQ ID NO: 9202005 - DNA, 22 bp, Homo sapiens
attacatatgttggcaacattt

SEQ ID NO: 9202006 - DNA, 22 bp, Homo sapiens
attacatatgttggcaacattt

SEQ ID NO: 9202007 - DNA, 22 bp, Homo sapiens
attactatgatttgatcattac

SEQ ID NO: 9202008 - DNA, 22 bp, Homo sapiens
gatttcagagtttattaggtta

SEQ ID NO: 9202009 - DNA, 22 bp, Homo sapiens
attagaaaatacatgggctgtc

SEQ ID NO: 9202010 - DNA, 23 bp, Homo sapiens
attagaaaggctttctggtgaaa

SEQ ID NO: 9202011 - DNA, 17 bp, Homo sapiens
gatttcctgaagttctt

SEQ ID NO: 9202012 - DNA, 22 bp, Homo sapiens
attagtgtacatctcacacgca

SEQ ID NO: 9202013 - DNA, 22 bp, Homo sapiens
attagtgttcttatcttctagg

SEQ ID NO: 9202014 - DNA, 22 bp, Homo sapiens
attagtgtctgtgaataattct

SEQ ID NO: 9202015 - DNA, 22 bp, Homo sapiens
attaggcattatggggataagg

SEQ ID NO: 9202016 - DNA, 22 bp, Homo sapiens
attaggcattctgaatgaggtc

SEQ ID NO: 9202017 - DNA, 22 bp, Homo sapiens
attaggcactagaatgtcaatt

SEQ ID NO: 9202018 - DNA, 22 bp, Homo sapiens
attaggcaattctgggcatctc

SEQ ID NO: 9202019 - DNA, 22 bp, Homo sapiens
attaggattttgtccaagtagc

SEQ ID NO: 9202020 - DNA, 22 bp, Homo sapiens
attaggatgtgtatattgtgtt

SEQ ID NO: 9202021 - DNA, 22 bp, Homo sapiens
attaggatgttcctatgcacat

SEQ ID NO: 9202022 - DNA, 22 bp, Homo sapiens
attaggatttggtatggtcata

SEQ ID NO: 9202023 - DNA, 20 bp, Homo sapiens
attaggattttaggtcatca

SEQ ID NO: 9202024 - DNA, 22 bp, Homo sapiens
attagctttggtggaaaggagt

SEQ ID NO: 9202025 - DNA, 22 bp, Homo sapiens
gccaaagcccaggagacagcca

SEQ ID NO: 9202026 - DNA, 22 bp, Homo sapiens
gccaaagcagtcttgcctctgc

SEQ ID NO: 9202027 - DNA, 22 bp, Homo sapiens
attgtctttggtgcttccagga

SEQ ID NO: 9202028 - DNA, 22 bp, Homo sapiens
attgtcttctggtcttatcttt

SEQ ID NO: 9202029 - DNA, 22 bp, Homo sapiens
gccaaaggattctatggagata

SEQ ID NO: 9202030 - DNA, 22 bp, Homo sapiens
gccaacaggccttgctctgctc

SEQ ID NO: 9202031 - DNA, 22 bp, Homo sapiens
gccaagagtttccagctgcaag

SEQ ID NO: 9202032 - DNA, 21 bp, Homo sapiens
gccaagaacaagacagacatg

SEQ ID NO: 9202033 - DNA, 22 bp, Homo sapiens
gccacagggaggcgttttcagg

SEQ ID NO: 9202034 - DNA, 22 bp, Homo sapiens
gccacagggcagatgcgcagag

SEQ ID NO: 9202035 - DNA, 22 bp, Homo sapiens
gccacagggcagatgcgcagag

SEQ ID NO: 9202036 - DNA, 22 bp, Homo sapiens
attgtcattccagtcattgtta

SEQ ID NO: 9202037 - DNA, 22 bp, Homo sapiens
attgtcattggcttctatgtct

SEQ ID NO: 9202038 - DNA, 22 bp, Homo sapiens
attgtcctatctcagtgccatg

SEQ ID NO: 9202039 - DNA, 18 bp, Homo sapiens
attgtcagaagtcatgtg

SEQ ID NO: 9202040 - DNA, 22 bp, Homo sapiens
attgtatttgtacaagacatgt

SEQ ID NO: 9202041 - DNA, 22 bp, Homo sapiens
attgtcagtttaatatagtcaa

SEQ ID NO: 9202042 - DNA, 20 bp, Homo sapiens
gcagtgtgtatgaatagctg

SEQ ID NO: 9202043 - DNA, 22 bp, Homo sapiens
gcagtgttacttggtttgcaga

SEQ ID NO: 9202044 - DNA, 22 bp, Homo sapiens
gcagtgttaatgcgagtgttca

SEQ ID NO: 9202045 - DNA, 22 bp, Homo sapiens
gcagtgttacctcttcagtggg

SEQ ID NO: 9202046 - DNA, 22 bp, Homo sapiens
gcagtgttaaacaactgctgct

SEQ ID NO: 9202047 - DNA, 22 bp, Homo sapiens
gcagtgttaccttgggctggtt

SEQ ID NO: 9202048 - DNA, 22 bp, Homo sapiens
gcagtgttacttggagtactaa

SEQ ID NO: 9202049 - DNA, 22 bp, Homo sapiens
attctttaattcaattgaagga

SEQ ID NO: 9202050 - DNA, 19 bp, Homo sapiens
attcttgttaagtgtcatc

SEQ ID NO: 9202051 - DNA, 22 bp, Homo sapiens
attcttgtttaatttgcatccc

SEQ ID NO: 9202052 - DNA, 22 bp, Homo sapiens
attccttgggctgccttattat

SEQ ID NO: 9202053 - DNA, 22 bp, Homo sapiens
attccttgggaattattgaatg

SEQ ID NO: 9202054 - DNA, 22 bp, Homo sapiens
attccttggcattctggacttg

SEQ ID NO: 9202055 - DNA, 22 bp, Homo sapiens
attccttgtatatctacatgca

SEQ ID NO: 9202056 - DNA, 22 bp, Homo sapiens
attcttcttgagtcttggactc

SEQ ID NO: 9202057 - DNA, 22 bp, Homo sapiens
gcagctgctggaagttcctgcc

SEQ ID NO: 9202058 - DNA, 22 bp, Homo sapiens
gcagctgctgtggcatcaagct

SEQ ID NO: 9202059 - DNA, 22 bp, Homo sapiens
gcagctgctggagggaggcagg

SEQ ID NO: 9202060 - DNA, 22 bp, Homo sapiens
gcagctgctgggatcatttagg

SEQ ID NO: 9202061 - DNA, 19 bp, Homo sapiens
gcagctgcttgaaaagaaa

SEQ ID NO: 9202062 - DNA, 22 bp, Homo sapiens
gcagctggacccacacggctta

SEQ ID NO: 9202063 - DNA, 22 bp, Homo sapiens
attccttgcacatcagatagtt

SEQ ID NO: 9202064 - DNA, 22 bp, Homo sapiens
attccttgctctcatcaacctt

SEQ ID NO: 9202065 - DNA, 22 bp, Homo sapiens
attccttggaacagatgcgaag

SEQ ID NO: 9202066 - DNA, 22 bp, Homo sapiens
gcagctgctcacattctcacaa

SEQ ID NO: 9202067 - DNA, 22 bp, Homo sapiens
gcagctgctcccttttacagtg

SEQ ID NO: 9202068 - DNA, 22 bp, Homo sapiens
gcagctgccttcagctggatgg

SEQ ID NO: 9202069 - DNA, 22 bp, Homo sapiens
gcagctgcctattcagggcttg

SEQ ID NO: 9202070 - DNA, 22 bp, Homo sapiens
gcaggcctttatccctgcctca

SEQ ID NO: 9202071 - DNA, 22 bp, Homo sapiens
gcaggccttggcaatgagcctg

SEQ ID NO: 9202072 - DNA, 22 bp, Homo sapiens
gcagggctgatgttattgacga

SEQ ID NO: 9202073 - DNA, 22 bp, Homo sapiens
gcagggctgggacttactggta

SEQ ID NO: 9202074 - DNA, 22 bp, Homo sapiens
gcagggctgcagagggcactgt

SEQ ID NO: 9202075 - DNA, 22 bp, Homo sapiens
caaacattccgcttctcccagg

SEQ ID NO: 9202076 - DNA, 22 bp, Homo sapiens
caaacattcagatgcaatggta

SEQ ID NO: 9202077 - DNA, 22 bp, Homo sapiens
caaagcagagaactgtctcatt

SEQ ID NO: 9202078 - DNA, 22 bp, Homo sapiens
caaagcagacgcagtaagggta

SEQ ID NO: 9202079 - DNA, 22 bp, Homo sapiens
caaagcaggaagaatattgaaa

SEQ ID NO: 9202080 - DNA, 22 bp, Homo sapiens
caaagcaggaagaatattgaaa

SEQ ID NO: 9202081 - DNA, 21 bp, Homo sapiens
caaagccaggcaactctctcc

SEQ ID NO: 9202082 - DNA, 22 bp, Homo sapiens
caaagccaggctttctaatgta

SEQ ID NO: 9202083 - DNA, 22 bp, Homo sapiens
caaagccaggctttctaatgta

SEQ ID NO: 9202084 - DNA, 22 bp, Homo sapiens
caaagccatagagtagataaga

SEQ ID NO: 9202085 - DNA, 22 bp, Homo sapiens
caaagcagtgatccttaaagga

SEQ ID NO: 9202086 - DNA, 22 bp, Homo sapiens
caaagcaggcttgtcaaattgc

SEQ ID NO: 9202087 - DNA, 18 bp, Homo sapiens
caaagcaggtgacagtgt

SEQ ID NO: 9202088 - DNA, 22 bp, Homo sapiens
caaaattagggagtgagctgga

SEQ ID NO: 9202089 - DNA, 22 bp, Homo sapiens
caaaattagaaatgcagctgtt

SEQ ID NO: 9202090 - DNA, 22 bp, Homo sapiens
caaacattcaagtacaagtctt

SEQ ID NO: 9202091 - DNA, 22 bp, Homo sapiens
caaacatagtgaagcaatgaca

SEQ ID NO: 9202092 - DNA, 22 bp, Homo sapiens
attttagagaaacaaacgtagg

SEQ ID NO: 9202093 - DNA, 22 bp, Homo sapiens
attttagagaaacaaacgtagg

SEQ ID NO: 9202094 - DNA, 22 bp, Homo sapiens
attttagagctccaagtacagc

SEQ ID NO: 9202095 - DNA, 22 bp, Homo sapiens
atttttatgacaaaccatcctc

SEQ ID NO: 9202096 - DNA, 22 bp, Homo sapiens
atttttccaattaggataaaga

SEQ ID NO: 9202097 - DNA, 22 bp, Homo sapiens
atttttccatgatacttatctg

SEQ ID NO: 9202098 - DNA, 22 bp, Homo sapiens
atttttctctcacacttaccag

SEQ ID NO: 9202099 - DNA, 22 bp, Homo sapiens
atttttctctccactccattaa

SEQ ID NO: 9202100 - DNA, 22 bp, Homo sapiens
atttttctctcacacttaccag

SEQ ID NO: 9202101 - DNA, 22 bp, Homo sapiens
atttttctctccactccattaa

SEQ ID NO: 9202102 - DNA, 22 bp, Homo sapiens
atttttctctccactccattaa

SEQ ID NO: 9202103 - DNA, 22 bp, Homo sapiens
atttttctctccactccattaa

SEQ ID NO: 9202104 - DNA, 19 bp, Homo sapiens
atttttcttcctctgtgca

SEQ ID NO: 9202105 - DNA, 22 bp, Homo sapiens
atttttctctttccactgagat

SEQ ID NO: 9202106 - DNA, 22 bp, Homo sapiens
atttttctctttccactgagat

SEQ ID NO: 9202107 - DNA, 22 bp, Homo sapiens
caaaagcagttctatctgagtt

SEQ ID NO: 9202108 - DNA, 22 bp, Homo sapiens
caaaagcagttctatctgagtt

SEQ ID NO: 9202109 - DNA, 22 bp, Homo sapiens
caaaagcagttctatctgagtt

SEQ ID NO: 9202110 - DNA, 22 bp, Homo sapiens
caaatgctactaataggcaagt

SEQ ID NO: 9202111 - DNA, 22 bp, Homo sapiens
caaatgctaacttctttccaaa

SEQ ID NO: 9202112 - DNA, 22 bp, Homo sapiens
caaatgcatgagaaataagagg

SEQ ID NO: 9202113 - DNA, 22 bp, Homo sapiens
caaatgcatagtttataagaag

SEQ ID NO: 9202114 - DNA, 22 bp, Homo sapiens
gctgaaaggggtgacattcttt

SEQ ID NO: 9202115 - DNA, 22 bp, Homo sapiens
gctgacccctacaggttgtgtt

SEQ ID NO: 9202116 - DNA, 22 bp, Homo sapiens
gctcttgggggacagatggagt

SEQ ID NO: 9202117 - DNA, 18 bp, Homo sapiens
gctctggttccttcaacc

SEQ ID NO: 9202118 - DNA, 22 bp, Homo sapiens
caaaggaaatactaatctggaa

SEQ ID NO: 9202119 - DNA, 22 bp, Homo sapiens
caaagctataaattcagacaga

SEQ ID NO: 9202120 - DNA, 18 bp, Homo sapiens
caaagctcacgttccatc

SEQ ID NO: 9202121 - DNA, 22 bp, Homo sapiens
caaagcctctgatttcacttgt

SEQ ID NO: 9202122 - DNA, 22 bp, Homo sapiens
caaagctcatgctcttagccat

SEQ ID NO: 9202123 - DNA, 22 bp, Homo sapiens
caaatacaaatacgggcagctt

SEQ ID NO: 9202124 - DNA, 22 bp, Homo sapiens
caaatactacgattcttgcagt

SEQ ID NO: 9202125 - DNA, 22 bp, Homo sapiens
caaaggaagctccttgatggcg

SEQ ID NO: 9202126 - DNA, 22 bp, Homo sapiens
caaagtgctggaattacaggtg

SEQ ID NO: 9202127 - DNA, 22 bp, Homo sapiens
caaatactttatatacttcaaa

SEQ ID NO: 9202128 - DNA, 22 bp, Homo sapiens
caaatactttatatacttcaaa

SEQ ID NO: 9202129 - DNA, 22 bp, Homo sapiens
caaatactgtactgaacactgt

SEQ ID NO: 9202130 - DNA, 22 bp, Homo sapiens
gccaggctgctggctgctgtcc

SEQ ID NO: 9202131 - DNA, 22 bp, Homo sapiens
gccaggctgctggctgctgtcc

SEQ ID NO: 9202132 - DNA, 19 bp, Homo sapiens
gccaggcctggacctgcag

SEQ ID NO: 9202133 - DNA, 22 bp, Homo sapiens
gccacagtcactgctgcagggg

SEQ ID NO: 9202134 - DNA, 19 bp, Homo sapiens
gccaggcctggacctgcag

SEQ ID NO: 9202135 - DNA, 22 bp, Homo sapiens
gccacaggtgggctctgggaaa

SEQ ID NO: 9202136 - DNA, 22 bp, Homo sapiens
gccacaggtgggctctgggaaa

SEQ ID NO: 9202137 - DNA, 22 bp, Homo sapiens
gccacagtcactgctgcagggg

SEQ ID NO: 9202138 - DNA, 22 bp, Homo sapiens
gccacaggtcggctagagggtc

SEQ ID NO: 9202139 - DNA, 22 bp, Homo sapiens
gccacaggtactatgggagaga

SEQ ID NO: 9202140 - DNA, 22 bp, Homo sapiens
gccacaggtactatgggagaga

SEQ ID NO: 9202141 - DNA, 22 bp, Homo sapiens
gccacagggcgagcggaggcca

SEQ ID NO: 9202142 - DNA, 22 bp, Homo sapiens
gccaggctggaaagaacagaca

SEQ ID NO: 9202143 - DNA, 22 bp, Homo sapiens
gccaggctggcaaaaggaaacc

SEQ ID NO: 9202144 - DNA, 22 bp, Homo sapiens
gccaggctggaaagaacagaca

SEQ ID NO: 9202145 - DNA, 22 bp, Homo sapiens
gccaggctggcaaaaggaaacc

SEQ ID NO: 9202146 - DNA, 22 bp, Homo sapiens
gccaggctggccagcaccttct

SEQ ID NO: 9202147 - DNA, 22 bp, Homo sapiens
gccaggctggggggagatgtct

SEQ ID NO: 9202148 - DNA, 22 bp, Homo sapiens
gccaggctggccagcaccttct

SEQ ID NO: 9202149 - DNA, 22 bp, Homo sapiens
gccaggctggtcttgaactcct

SEQ ID NO: 9202150 - DNA, 22 bp, Homo sapiens
gccaggctggtcttgaactcct

SEQ ID NO: 9202151 - DNA, 22 bp, Homo sapiens
gccaggctggtgcaaggatatt

SEQ ID NO: 9202152 - DNA, 22 bp, Homo sapiens
gccaggctggtgcaaggatatt

SEQ ID NO: 9202153 - DNA, 22 bp, Homo sapiens
gccaggtctgggtagcagagga

SEQ ID NO: 9202154 - DNA, 19 bp, Homo sapiens
gccaggtcttgggtccagg

SEQ ID NO: 9202155 - DNA, 19 bp, Homo sapiens
gccaggtcttgggtccagg

SEQ ID NO: 9202156 - DNA, 22 bp, Homo sapiens
gccaggtgagaggactgaggct

SEQ ID NO: 9202157 - DNA, 22 bp, Homo sapiens
gccaggtgcatggctgagtctc

SEQ ID NO: 9202158 - DNA, 22 bp, Homo sapiens
gccaggtggaggttgcagtgag

SEQ ID NO: 9202159 - DNA, 22 bp, Homo sapiens
gccaggtggaggttgcagtgag

SEQ ID NO: 9202160 - DNA, 22 bp, Homo sapiens
atttctgtatcctgctgtcaga

SEQ ID NO: 9202161 - DNA, 22 bp, Homo sapiens
atttctgttatacctttctcag

SEQ ID NO: 9202162 - DNA, 22 bp, Homo sapiens
atttctgtggcttcattctcct

SEQ ID NO: 9202163 - DNA, 22 bp, Homo sapiens
atttctgtggcttcattctcct

SEQ ID NO: 9202164 - DNA, 22 bp, Homo sapiens
gccccaggttgcctgtcccagg

SEQ ID NO: 9202165 - DNA, 22 bp, Homo sapiens
gccccaggttgcctgtcccagg

SEQ ID NO: 9202166 - DNA, 17 bp, Homo sapiens
gcccacccttaggagct

SEQ ID NO: 9202167 - DNA, 17 bp, Homo sapiens
gcccacccttaggagct

SEQ ID NO: 9202168 - DNA, 22 bp, Homo sapiens
atttctgtagtccacattcttt

SEQ ID NO: 9202169 - DNA, 22 bp, Homo sapiens
atttctgtagtccacattcttt

SEQ ID NO: 9202170 - DNA, 22 bp, Homo sapiens
gcccacagttagtttgcatggc

SEQ ID NO: 9202171 - DNA, 23 bp, Homo sapiens
gcccaccctcagcgtcctcacgg

SEQ ID NO: 9202172 - DNA, 22 bp, Homo sapiens
gcccacagtgtagcaggtactc

SEQ ID NO: 9202173 - DNA, 21 bp, Homo sapiens
gcccacagtgaggaggatccc

SEQ ID NO: 9202174 - DNA, 22 bp, Homo sapiens
gcccacagtctatcagtttgcg

SEQ ID NO: 9202175 - DNA, 22 bp, Homo sapiens
gcctcaaaagtgttgtagaggg

SEQ ID NO: 9202176 - DNA, 22 bp, Homo sapiens
gcctagtgcactggcagggctc

SEQ ID NO: 9202177 - DNA, 22 bp, Homo sapiens
gcctaggtaccagcagagagcc

SEQ ID NO: 9202178 - DNA, 22 bp, Homo sapiens
gcctaggagtggggatggcggt

SEQ ID NO: 9202179 - DNA, 22 bp, Homo sapiens
gcctaggagtacagaatggttt

SEQ ID NO: 9202180 - DNA, 22 bp, Homo sapiens
gcctaggagacaagcgtgaaag

SEQ ID NO: 9202181 - DNA, 22 bp, Homo sapiens
gccccctctttggagccagcca

SEQ ID NO: 9202182 - DNA, 22 bp, Homo sapiens
gcccccagaagggccacagatt

SEQ ID NO: 9202183 - DNA, 22 bp, Homo sapiens
gccccctcaaagaggaagctct

SEQ ID NO: 9202184 - DNA, 22 bp, Homo sapiens
gccccctcaaagaggaagctct

SEQ ID NO: 9202185 - DNA, 22 bp, Homo sapiens
gcccccgtagtagatgaggcgc

SEQ ID NO: 9202186 - DNA, 22 bp, Homo sapiens
gcctgagattcccggagccgtg

SEQ ID NO: 9202187 - DNA, 22 bp, Homo sapiens
atttggaaggagctgcacagca

SEQ ID NO: 9202188 - DNA, 22 bp, Homo sapiens
gcctgagatcagccaagcccct

SEQ ID NO: 9202189 - DNA, 22 bp, Homo sapiens
gcctgagatcaggagaaagcca

SEQ ID NO: 9202190 - DNA, 22 bp, Homo sapiens
gcctgagaaggataggaagcga

SEQ ID NO: 9202191 - DNA, 22 bp, Homo sapiens
gcctggattccttgtttctcag

SEQ ID NO: 9202192 - DNA, 22 bp, Homo sapiens
gcctggattccttgtttctcag

SEQ ID NO: 9202193 - DNA, 22 bp, Homo sapiens
cagagacaggaatcagctgcag

SEQ ID NO: 9202194 - DNA, 22 bp, Homo sapiens
gggcagcagcaggaggtctctg

SEQ ID NO: 9202195 - DNA, 22 bp, Homo sapiens
gggcagtgggaccaggcaccag

SEQ ID NO: 9202196 - DNA, 20 bp, Homo sapiens
gggcagtggcgctatctcag

SEQ ID NO: 9202197 - DNA, 22 bp, Homo sapiens
gggcagtgggtggctgcagcct

SEQ ID NO: 9202198 - DNA, 22 bp, Homo sapiens
cagagacaggcttgccctccac

SEQ ID NO: 9202199 - DNA, 22 bp, Homo sapiens
cagagacaggaatcagctgcag

SEQ ID NO: 9202200 - DNA, 22 bp, Homo sapiens
cagagacaggagtgctcccagt

SEQ ID NO: 9202201 - DNA, 22 bp, Homo sapiens
cagagacaggatctcgaagact

SEQ ID NO: 9202202 - DNA, 22 bp, Homo sapiens
cagactggctgaaggccgagtg

SEQ ID NO: 9202203 - DNA, 22 bp, Homo sapiens
cagactggccacatctgcactg

SEQ ID NO: 9202204 - DNA, 22 bp, Homo sapiens
cagactggccacatctgcactg

SEQ ID NO: 9202205 - DNA, 22 bp, Homo sapiens
cagacctgggtccctggcctgt

SEQ ID NO: 9202206 - DNA, 22 bp, Homo sapiens
cagacctggggcctgggagccc

SEQ ID NO: 9202207 - DNA, 22 bp, Homo sapiens
cagacctgggtccctggcctgt

SEQ ID NO: 9202208 - DNA, 19 bp, Homo sapiens
cagacctgtccagcctgtg

SEQ ID NO: 9202209 - DNA, 22 bp, Homo sapiens
cagacctggaaaacaggcttgc

SEQ ID NO: 9202210 - DNA, 23 bp, Homo sapiens
cagacctggcagtcatcctcaac

SEQ ID NO: 9202211 - DNA, 20 bp, Homo sapiens
cagacctgcacccacttcga

SEQ ID NO: 9202212 - DNA, 22 bp, Homo sapiens
cagacctgaggagcactgagcc

SEQ ID NO: 9202213 - DNA, 22 bp, Homo sapiens
cagaccagtagggctcatccca

SEQ ID NO: 9202214 - DNA, 22 bp, Homo sapiens
cagaccagaaggaagccgacaa

SEQ ID NO: 9202215 - DNA, 22 bp, Homo sapiens
cagaccatgatggacagctctg

SEQ ID NO: 9202216 - DNA, 22 bp, Homo sapiens
cagaccccgagtttgcagagtt

SEQ ID NO: 9202217 - DNA, 22 bp, Homo sapiens
cagaccccgagtttgcagagtt

SEQ ID NO: 9202218 - DNA, 21 bp, Homo sapiens
cagaccctctagaggccacct

SEQ ID NO: 9202219 - DNA, 22 bp, Homo sapiens
ggcttagcaactcctgaggctc

SEQ ID NO: 9202220 - DNA, 22 bp, Homo sapiens
ggcttagtgtttctgctcagcc

SEQ ID NO: 9202221 - DNA, 22 bp, Homo sapiens
cagagctggctctgcatgtaca

SEQ ID NO: 9202222 - DNA, 19 bp, Homo sapiens
cagagctgctggcctcgtc

SEQ ID NO: 9202223 - DNA, 22 bp, Homo sapiens
cagagcctgcctctggctgtgg

SEQ ID NO: 9202224 - DNA, 22 bp, Homo sapiens
cagagcctccctcctctgccat

SEQ ID NO: 9202225 - DNA, 22 bp, Homo sapiens
cagagcctctcagccccttggg

SEQ ID NO: 9202226 - DNA, 22 bp, Homo sapiens
cagagcctgccacctttctccc

SEQ ID NO: 9202227 - DNA, 22 bp, Homo sapiens
cagaggcaaaagaggtggaggt

SEQ ID NO: 9202228 - DNA, 22 bp, Homo sapiens
cagaggcaaaagaggtggaggt

SEQ ID NO: 9202229 - DNA, 20 bp, Homo sapiens
cagaggcaaggagacttgga

SEQ ID NO: 9202230 - DNA, 22 bp, Homo sapiens
cagaggcaaaagaggtggaggt

SEQ ID NO: 9202231 - DNA, 22 bp, Homo sapiens
cagagcccttggctggagccca

SEQ ID NO: 9202232 - DNA, 19 bp, Homo sapiens
cagagcctcagagctagaa

SEQ ID NO: 9202233 - DNA, 22 bp, Homo sapiens
gggctctgtttagatcagagat

SEQ ID NO: 9202234 - DNA, 22 bp, Homo sapiens
gggctctgtttagatcagagat

SEQ ID NO: 9202235 - DNA, 22 bp, Homo sapiens
gggctctgtttagaccagagat

SEQ ID NO: 9202236 - DNA, 22 bp, Homo sapiens
gggccacctggattccatgtgt

SEQ ID NO: 9202237 - DNA, 22 bp, Homo sapiens
gggccacctggattccatgtgt

SEQ ID NO: 9202238 - DNA, 22 bp, Homo sapiens
gggccaccccactgcccacgct

SEQ ID NO: 9202239 - DNA, 20 bp, Homo sapiens
gggctctgcttggcagaagt

SEQ ID NO: 9202240 - DNA, 22 bp, Homo sapiens
cagagtcagtattgaattgaaa

SEQ ID NO: 9202241 - DNA, 22 bp, Homo sapiens
ggtccaaggctcggtggcgggg

SEQ ID NO: 9202242 - DNA, 22 bp, Homo sapiens
ggtcctgggaagatgctcatga

SEQ ID NO: 9202243 - DNA, 22 bp, Homo sapiens
cagagtctggactgcaggctcc

SEQ ID NO: 9202244 - DNA, 22 bp, Homo sapiens
cagagtcttgtgtgttcagccc

SEQ ID NO: 9202245 - DNA, 17 bp, Homo sapiens
cagagtctgtctgcatc

SEQ ID NO: 9202246 - DNA, 22 bp, Homo sapiens
cagagtctctgggaggctgggt

SEQ ID NO: 9202247 - DNA, 22 bp, Homo sapiens
ggtcacagggaagggctctcaa

SEQ ID NO: 9202248 - DNA, 23 bp, Homo sapiens
cagagggttccatggagcatggt

SEQ ID NO: 9202249 - DNA, 22 bp, Homo sapiens
ggtcagtgacttttttctgtgg

SEQ ID NO: 9202250 - DNA, 23 bp, Homo sapiens
ggtcagtgagttcgtttctctgg

SEQ ID NO: 9202251 - DNA, 22 bp, Homo sapiens
ggtcagtgcgatttcccactcc

SEQ ID NO: 9202252 - DNA, 22 bp, Homo sapiens
ggtcagtggcagggggtacttc

SEQ ID NO: 9202253 - DNA, 22 bp, Homo sapiens
cagagggaaaaggggagtaata

SEQ ID NO: 9202254 - DNA, 22 bp, Homo sapiens
cagagggctgccctgagttcgt

SEQ ID NO: 9202255 - DNA, 22 bp, Homo sapiens
cagaggggctgacacccttggc

SEQ ID NO: 9202256 - DNA, 22 bp, Homo sapiens
cagaggggtgtagagatcactg

SEQ ID NO: 9202257 - DNA, 21 bp, Homo sapiens
cagaggggctagcctggctgc

SEQ ID NO: 9202258 - DNA, 22 bp, Homo sapiens
cagaggggataacaggtgtaga

SEQ ID NO: 9202259 - DNA, 22 bp, Homo sapiens
cagaggcacaagaaagcaaggc

SEQ ID NO: 9202260 - DNA, 19 bp, Homo sapiens
cagaggcaccaggtataga

SEQ ID NO: 9202261 - DNA, 22 bp, Homo sapiens
cagaggcacagtgcgggccact

SEQ ID NO: 9202262 - DNA, 22 bp, Homo sapiens
cagcacagtttgcttggcagag

SEQ ID NO: 9202263 - DNA, 22 bp, Homo sapiens
cagcacagtttgcttggcagag

SEQ ID NO: 9202264 - DNA, 22 bp, Homo sapiens
cagcacataagccgaagactgt

SEQ ID NO: 9202265 - DNA, 22 bp, Homo sapiens
cagcacagtgaccagacccact

SEQ ID NO: 9202266 - DNA, 22 bp, Homo sapiens
cagcacagtgaccagacccact

SEQ ID NO: 9202267 - DNA, 22 bp, Homo sapiens
cagcacagtagagtagttgtaa

SEQ ID NO: 9202268 - DNA, 22 bp, Homo sapiens
cagcacagtcctttgcttactg

SEQ ID NO: 9202269 - DNA, 22 bp, Homo sapiens
cagcacagtttctggcccgccg

SEQ ID NO: 9202270 - DNA, 22 bp, Homo sapiens
cagcacagtttcccccatgagc

SEQ ID NO: 9202271 - DNA, 22 bp, Homo sapiens
cagcacagtttcccccatgagc

SEQ ID NO: 9202272 - DNA, 22 bp, Homo sapiens
cagcacagtacaaggcacggat

SEQ ID NO: 9202273 - DNA, 22 bp, Homo sapiens
cagcacaattttcaggagtcca

SEQ ID NO: 9202274 - DNA, 22 bp, Homo sapiens
cagcacaattttcaggagtcca

SEQ ID NO: 9202275 - DNA, 22 bp, Homo sapiens
ggtgagagaaaagaaacactgt

SEQ ID NO: 9202276 - DNA, 22 bp, Homo sapiens
cagcaaagtaagctgacatgta

SEQ ID NO: 9202277 - DNA, 22 bp, Homo sapiens
cagcaagatttttaaagcaagg

SEQ ID NO: 9202278 - DNA, 18 bp, Homo sapiens
ggtctgagatcgtttttc

SEQ ID NO: 9202279 - DNA, 22 bp, Homo sapiens
ggtgacctcacctggtcccacc

SEQ ID NO: 9202280 - DNA, 22 bp, Homo sapiens
ggtgacctcacctggtcccacc

SEQ ID NO: 9202281 - DNA, 22 bp, Homo sapiens
cagcaggaaacttaaaggtaat

SEQ ID NO: 9202282 - DNA, 22 bp, Homo sapiens
cagcaggaaaatcaattctgtg

SEQ ID NO: 9202283 - DNA, 20 bp, Homo sapiens
cagcaggaaaagtgcctcag

SEQ ID NO: 9202284 - DNA, 20 bp, Homo sapiens
cagcaggaaaagtgcctcag

SEQ ID NO: 9202285 - DNA, 22 bp, Homo sapiens
cagcaggaaagacatctgagca

SEQ ID NO: 9202286 - DNA, 22 bp, Homo sapiens
cagcaggaaggtttcccctgca

SEQ ID NO: 9202287 - DNA, 22 bp, Homo sapiens
cagcaggaaggtttcccctgca

SEQ ID NO: 9202288 - DNA, 22 bp, Homo sapiens
cagcaggaagtactagctttga

SEQ ID NO: 9202289 - DNA, 22 bp, Homo sapiens
gtcagcctgcactcagggagcg

SEQ ID NO: 9202290 - DNA, 22 bp, Homo sapiens
cagcagctgtttacggaacacc

SEQ ID NO: 9202291 - DNA, 22 bp, Homo sapiens
cagcagctggttgaatccttct

SEQ ID NO: 9202292 - DNA, 22 bp, Homo sapiens
cagcagctggttatacctgtgg

SEQ ID NO: 9202293 - DNA, 22 bp, Homo sapiens
cagcagctggtgagacacagcc

SEQ ID NO: 9202294 - DNA, 22 bp, Homo sapiens
cagcagctggtgagacacagcc

SEQ ID NO: 9202295 - DNA, 22 bp, Homo sapiens
cagcagcttctgttgatcagaa

SEQ ID NO: 9202296 - DNA, 22 bp, Homo sapiens
cagcagctttgccaagtcagcc

SEQ ID NO: 9202297 - DNA, 22 bp, Homo sapiens
cagcagctttgccaagtcagcc

SEQ ID NO: 9202298 - DNA, 22 bp, Homo sapiens
cagcagcttttgcattctcatt

SEQ ID NO: 9202299 - DNA, 22 bp, Homo sapiens
cagcagctgcgtgcccaggccg

SEQ ID NO: 9202300 - DNA, 22 bp, Homo sapiens
cagcagctgggaaggaggctga

SEQ ID NO: 9202301 - DNA, 22 bp, Homo sapiens
cagcagctgggaaggaggctga

SEQ ID NO: 9202302 - DNA, 22 bp, Homo sapiens
cagcagctgatggggaagtgat

SEQ ID NO: 9202303 - DNA, 22 bp, Homo sapiens
cagcagctgatggggaagtgat

SEQ ID NO: 9202304 - DNA, 22 bp, Homo sapiens
cagcagctgcaaatggaaacag

SEQ ID NO: 9202305 - DNA, 22 bp, Homo sapiens
cagcagctgcaaatggaaacag

SEQ ID NO: 9202306 - DNA, 23 bp, Homo sapiens
cagcagctgcctggttttttggt

SEQ ID NO: 9202307 - DNA, 22 bp, Homo sapiens
cagcagctgcctcagctgggga

SEQ ID NO: 9202308 - DNA, 22 bp, Homo sapiens
cagcagctgcctcagctgggga

SEQ ID NO: 9202309 - DNA, 22 bp, Homo sapiens
cagcagctagaggaagggcaga

SEQ ID NO: 9202310 - DNA, 22 bp, Homo sapiens
cagcagctacttggagcagcag

SEQ ID NO: 9202311 - DNA, 22 bp, Homo sapiens
cagcagctacttggagcagcag

SEQ ID NO: 9202312 - DNA, 22 bp, Homo sapiens
cagcacctgttagcattaaata

SEQ ID NO: 9202313 - DNA, 22 bp, Homo sapiens
gtcccaggcagagtcaggaggg

SEQ ID NO: 9202314 - DNA, 22 bp, Homo sapiens
gtcccaggcagagtcaggaggg

SEQ ID NO: 9202315 - DNA, 22 bp, Homo sapiens
gtcccaggaacattctggctag

SEQ ID NO: 9202316 - DNA, 22 bp, Homo sapiens
gtcccagcttcccactagcagc

SEQ ID NO: 9202317 - DNA, 22 bp, Homo sapiens
gtccagccactcaccttccagc

SEQ ID NO: 9202318 - DNA, 22 bp, Homo sapiens
gtctgtaattattaaagaaagg

SEQ ID NO: 9202319 - DNA, 22 bp, Homo sapiens
cagccctcaggtcctcagcagc

SEQ ID NO: 9202320 - DNA, 22 bp, Homo sapiens
gtctgtctgttgttgagaagca

SEQ ID NO: 9202321 - DNA, 22 bp, Homo sapiens
gtctgtctccctgtgactgaga

SEQ ID NO: 9202322 - DNA, 22 bp, Homo sapiens
cagcccctcacagagctgtcct

SEQ ID NO: 9202323 - DNA, 22 bp, Homo sapiens
cagccccttcctggcatctgga

SEQ ID NO: 9202324 - DNA, 22 bp, Homo sapiens
cagccagggtcaggcagcttct

SEQ ID NO: 9202325 - DNA, 22 bp, Homo sapiens
cagccagggtcaggcagcttct

SEQ ID NO: 9202326 - DNA, 22 bp, Homo sapiens
cagccaggtatgggcgtgcggg

SEQ ID NO: 9202327 - DNA, 22 bp, Homo sapiens
gtctggagacttgggtcatcaa

SEQ ID NO: 9202328 - DNA, 22 bp, Homo sapiens
cagccaggcctggtgaccaaag

SEQ ID NO: 9202329 - DNA, 22 bp, Homo sapiens
cagccaggcctggtgaccaaag

SEQ ID NO: 9202330 - DNA, 22 bp, Homo sapiens
gtctgcttttgttttactggta

SEQ ID NO: 9202331 - DNA, 22 bp, Homo sapiens
gtccctgggggtttaggactca

SEQ ID NO: 9202332 - DNA, 22 bp, Homo sapiens
gtccctgggtctaaggcagtaa

SEQ ID NO: 9202333 - DNA, 22 bp, Homo sapiens
gtccctggtttgcccaggacca

SEQ ID NO: 9202334 - DNA, 22 bp, Homo sapiens
gtccctgggtctaaggcagtaa

SEQ ID NO: 9202335 - DNA, 22 bp, Homo sapiens
gtccctggggaatcagctggag

SEQ ID NO: 9202336 - DNA, 19 bp, Homo sapiens
gtccctgggcagaggcacc

SEQ ID NO: 9202337 - DNA, 22 bp, Homo sapiens
gtcccaggctccatggcagcca

SEQ ID NO: 9202338 - DNA, 22 bp, Homo sapiens
gtcccaggctccatggcagcca

SEQ ID NO: 9202339 - DNA, 22 bp, Homo sapiens
cagcctgacaccagctttgggc

SEQ ID NO: 9202340 - DNA, 22 bp, Homo sapiens
cagcctgactatggctgcaggt

SEQ ID NO: 9202341 - DNA, 22 bp, Homo sapiens
cagcctgagccttctgtagcaa

SEQ ID NO: 9202342 - DNA, 22 bp, Homo sapiens
cagccctgctgacactgtctga

SEQ ID NO: 9202343 - DNA, 22 bp, Homo sapiens
cagccctgctgacactgtctga

SEQ ID NO: 9202344 - DNA, 22 bp, Homo sapiens
cagccctgctggttttgggcaa

SEQ ID NO: 9202345 - DNA, 22 bp, Homo sapiens
cagccctgcttccccgctagtt

SEQ ID NO: 9202346 - DNA, 22 bp, Homo sapiens
cagccctgcttccccgctagtt

SEQ ID NO: 9202347 - DNA, 22 bp, Homo sapiens
cagccctgccatggagcctcct

SEQ ID NO: 9202348 - DNA, 22 bp, Homo sapiens
cagcctgtggcagaggtctaat

SEQ ID NO: 9202349 - DNA, 22 bp, Homo sapiens
cagcctggtccccggctcaccc

SEQ ID NO: 9202350 - DNA, 22 bp, Homo sapiens
cagcctgtagaatacagtaaat

SEQ ID NO: 9202351 - DNA, 22 bp, Homo sapiens
cagcctggcctgggactgctga

SEQ ID NO: 9202352 - DNA, 22 bp, Homo sapiens
cagcctggcctgggactgctga

SEQ ID NO: 9202353 - DNA, 22 bp, Homo sapiens
cagcctgggctccagagtccct

SEQ ID NO: 9202354 - DNA, 21 bp, Homo sapiens
cagcctgctgctccagggcca

SEQ ID NO: 9202355 - DNA, 22 bp, Homo sapiens
cagcctgctagggcaatgcctt

SEQ ID NO: 9202356 - DNA, 21 bp, Homo sapiens
cagcctgctgctccagggcca

SEQ ID NO: 9202357 - DNA, 22 bp, Homo sapiens
cagcctggattgcagaatgcta

SEQ ID NO: 9202358 - DNA, 22 bp, Homo sapiens
cagcctggagccacagcccagg

SEQ ID NO: 9202359 - DNA, 22 bp, Homo sapiens
cagcctggagccacagcccagg

SEQ ID NO: 9202360 - DNA, 22 bp, Homo sapiens
cagcctggagccacagcccagg

SEQ ID NO: 9202361 - DNA, 22 bp, Homo sapiens
cagcctggacagcgaccagagt

SEQ ID NO: 9202362 - DNA, 22 bp, Homo sapiens
cagcctggacagcgaccagagt

SEQ ID NO: 9202363 - DNA, 22 bp, Homo sapiens
cagctaggaaaccagagggcag

SEQ ID NO: 9202364 - DNA, 22 bp, Homo sapiens
cagctaggagaaaaggtgtttt

SEQ ID NO: 9202365 - DNA, 22 bp, Homo sapiens
cagctacacttctgggtgtgtc

SEQ ID NO: 9202366 - DNA, 22 bp, Homo sapiens
cagctagctaagaaggccagag

SEQ ID NO: 9202367 - DNA, 22 bp, Homo sapiens
cagctaccatggtttgttccag

SEQ ID NO: 9202368 - DNA, 22 bp, Homo sapiens
gtgctgtgcgctttttctgtat

SEQ ID NO: 9202369 - DNA, 22 bp, Homo sapiens
gtgcccagtaaatgaaagcttt

SEQ ID NO: 9202370 - DNA, 22 bp, Homo sapiens
caagccagctcctgccacagag

SEQ ID NO: 9202371 - DNA, 22 bp, Homo sapiens
caagccagtcagctcagtagat

SEQ ID NO: 9202372 - DNA, 20 bp, Homo sapiens
caagccaggccctgctgctg

SEQ ID NO: 9202373 - DNA, 22 bp, Homo sapiens
caagcatgtcttcttaagcaat

SEQ ID NO: 9202374 - DNA, 21 bp, Homo sapiens
caagccagaccaatagcagcc

SEQ ID NO: 9202375 - DNA, 22 bp, Homo sapiens
caagcaggtttgctattttctt

SEQ ID NO: 9202376 - DNA, 22 bp, Homo sapiens
gctggaggaggaagtgtgaggg

SEQ ID NO: 9202377 - DNA, 22 bp, Homo sapiens
gctggaggatcacttgagccca

SEQ ID NO: 9202378 - DNA, 22 bp, Homo sapiens
gctggaggatcacttgagccca

SEQ ID NO: 9202379 - DNA, 22 bp, Homo sapiens
gctggaggatggactggaagaa

SEQ ID NO: 9202380 - DNA, 22 bp, Homo sapiens
gctggaggatggactggaagaa

SEQ ID NO: 9202381 - DNA, 22 bp, Homo sapiens
caagcagatattttagtcaaga

SEQ ID NO: 9202382 - DNA, 22 bp, Homo sapiens
caaatgtatcagcccagggatt

SEQ ID NO: 9202383 - DNA, 22 bp, Homo sapiens
caaatgtatgttttcctatgta

SEQ ID NO: 9202384 - DNA, 21 bp, Homo sapiens
gctggctgtcccagggaagca

SEQ ID NO: 9202385 - DNA, 21 bp, Homo sapiens
gctggctgtcccagggaagca

SEQ ID NO: 9202386 - DNA, 22 bp, Homo sapiens
gctggctgggtccctgagaggc

SEQ ID NO: 9202387 - DNA, 22 bp, Homo sapiens
gctggctggtccagcaggggct

SEQ ID NO: 9202388 - DNA, 22 bp, Homo sapiens
gctggaggcagttcagacacca

SEQ ID NO: 9202389 - DNA, 22 bp, Homo sapiens
gctggaggcagttcagacacca

SEQ ID NO: 9202390 - DNA, 22 bp, Homo sapiens
caaggccctgcaacctgacttg

SEQ ID NO: 9202391 - DNA, 22 bp, Homo sapiens
caaggtgccatgctgggcgggg

SEQ ID NO: 9202392 - DNA, 20 bp, Homo sapiens
caagggtttgcattggcttt

SEQ ID NO: 9202393 - DNA, 19 bp, Homo sapiens
gctgttaaggaccctcgga

SEQ ID NO: 9202394 - DNA, 22 bp, Homo sapiens
caagtttacaatgtgtatgtgt

SEQ ID NO: 9202395 - DNA, 18 bp, Homo sapiens
gctttgcagaaatacaga

SEQ ID NO: 9202396 - DNA, 22 bp, Homo sapiens
cacaggcttgtcagcatgaggc

SEQ ID NO: 9202397 - DNA, 22 bp, Homo sapiens
cacaggcttgtcagcatgaggc

SEQ ID NO: 9202398 - DNA, 21 bp, Homo sapiens
cacaggcttctatacacaatg

SEQ ID NO: 9202399 - DNA, 22 bp, Homo sapiens
cacaggcttgtcagcatgaggc

SEQ ID NO: 9202400 - DNA, 22 bp, Homo sapiens
cacaggcttttctgacataggc

SEQ ID NO: 9202401 - DNA, 22 bp, Homo sapiens
cacaggctgggaagcctaggcc

SEQ ID NO: 9202402 - DNA, 22 bp, Homo sapiens
cacaggcttccagtccccagct

SEQ ID NO: 9202403 - DNA, 22 bp, Homo sapiens
ggaggccaaagtgtgggcggct

SEQ ID NO: 9202404 - DNA, 22 bp, Homo sapiens
ggaggccaaggcaggcggatca

SEQ ID NO: 9202405 - DNA, 22 bp, Homo sapiens
ggaggccaaggagggcggatca

SEQ ID NO: 9202406 - DNA, 22 bp, Homo sapiens
ggaggccaaggaggagcttgcc

SEQ ID NO: 9202407 - DNA, 22 bp, Homo sapiens
ggaggccaaggaggagcttgcc

SEQ ID NO: 9202408 - DNA, 22 bp, Homo sapiens
cacaggaatcgtcacttagcgc

SEQ ID NO: 9202409 - DNA, 20 bp, Homo sapiens
ggagctggcatccagcctct

SEQ ID NO: 9202410 - DNA, 22 bp, Homo sapiens
cacaggaatgaacagggaaaga

SEQ ID NO: 9202411 - DNA, 22 bp, Homo sapiens
cacaggactcgactgcagacag

SEQ ID NO: 9202412 - DNA, 22 bp, Homo sapiens
cacaggactcgactgcagacag

SEQ ID NO: 9202413 - DNA, 22 bp, Homo sapiens
ggagccctgaagcaagaaagta

SEQ ID NO: 9202414 - DNA, 23 bp, Homo sapiens
ggagccctgagctgtccccatgc

SEQ ID NO: 9202415 - DNA, 22 bp, Homo sapiens
ggagccctgccctaggcagctc

SEQ ID NO: 9202416 - DNA, 22 bp, Homo sapiens
ggagccctgccctaggcagctc

SEQ ID NO: 9202417 - DNA, 19 bp, Homo sapiens
ggagccgccgcccttcatt

SEQ ID NO: 9202418 - DNA, 22 bp, Homo sapiens
ggagccctgccctaggcagctc

SEQ ID NO: 9202419 - DNA, 22 bp, Homo sapiens
ggagcccttgctgaccttccaa

SEQ ID NO: 9202420 - DNA, 22 bp, Homo sapiens
ggagcccttctattccatggag

SEQ ID NO: 9202421 - DNA, 22 bp, Homo sapiens
cacagaggtgatagtggtcaag

SEQ ID NO: 9202422 - DNA, 22 bp, Homo sapiens
cacagaggtgatagtggtcaag

SEQ ID NO: 9202423 - DNA, 22 bp, Homo sapiens
ggagcctgacagtgcccagcat

SEQ ID NO: 9202424 - DNA, 22 bp, Homo sapiens
ggagctggcagcgcaacccaga

SEQ ID NO: 9202425 - DNA, 22 bp, Homo sapiens
ggagctggcagcgcaacccaga

SEQ ID NO: 9202426 - DNA, 22 bp, Homo sapiens
ggagctggagagtacagagttt

SEQ ID NO: 9202427 - DNA, 22 bp, Homo sapiens
ggaaggggccttgagcaaactg

SEQ ID NO: 9202428 - DNA, 22 bp, Homo sapiens
cacagaactggttaatagcaga

SEQ ID NO: 9202429 - DNA, 22 bp, Homo sapiens
cacagaagtgtgtataactctt

SEQ ID NO: 9202430 - DNA, 22 bp, Homo sapiens
ggaaggggagctggaaagggta

SEQ ID NO: 9202431 - DNA, 22 bp, Homo sapiens
ggaaggggagctggaaagggta

SEQ ID NO: 9202432 - DNA, 20 bp, Homo sapiens
ggaaggggcaaagtgtgtga

SEQ ID NO: 9202433 - DNA, 22 bp, Homo sapiens
ggaaggggagctaaatctactg

SEQ ID NO: 9202434 - DNA, 22 bp, Homo sapiens
cacacaggaaaattggaattaa

SEQ ID NO: 9202435 - DNA, 21 bp, Homo sapiens
cacacagctgcccttaggtag

SEQ ID NO: 9202436 - DNA, 21 bp, Homo sapiens
cacacagctgcccttaggtag

SEQ ID NO: 9202437 - DNA, 22 bp, Homo sapiens
cacacagctcaggggcactgcc

SEQ ID NO: 9202438 - DNA, 22 bp, Homo sapiens
cacacagctcaggggcactgcc

SEQ ID NO: 9202439 - DNA, 22 bp, Homo sapiens
ggactgggattctggatctgct

SEQ ID NO: 9202440 - DNA, 22 bp, Homo sapiens
ggactgggcatgggtgctctgc

SEQ ID NO: 9202441 - DNA, 22 bp, Homo sapiens
ggactggggccaacacctccct

SEQ ID NO: 9202442 - DNA, 22 bp, Homo sapiens
cacagaggaaaggcagttggta

SEQ ID NO: 9202443 - DNA, 22 bp, Homo sapiens
cacagaggaaatgactttctta

SEQ ID NO: 9202444 - DNA, 22 bp, Homo sapiens
cacagaggaatgcatcagcaga

SEQ ID NO: 9202445 - DNA, 22 bp, Homo sapiens
cacagaggagtgcacactctct

SEQ ID NO: 9202446 - DNA, 22 bp, Homo sapiens
cacagagctgaacctgggtcat

SEQ ID NO: 9202447 - DNA, 22 bp, Homo sapiens
cacagagctggaaaggctgggc

SEQ ID NO: 9202448 - DNA, 22 bp, Homo sapiens
cacagaggctcaaagccaggtg

SEQ ID NO: 9202449 - DNA, 21 bp, Homo sapiens
cacagaggcgctgtatggctg

SEQ ID NO: 9202450 - DNA, 22 bp, Homo sapiens
cacagaggcatgaccctgccct

SEQ ID NO: 9202451 - DNA, 22 bp, Homo sapiens
cacagaggatttttagggcagt

SEQ ID NO: 9202452 - DNA, 22 bp, Homo sapiens
cacagaggatttttagggcagt

SEQ ID NO: 9202453 - DNA, 22 bp, Homo sapiens
cacagaggatgcccaagcgatc

SEQ ID NO: 9202454 - DNA, 22 bp, Homo sapiens
cacaggcttttttggctgatgt

SEQ ID NO: 9202455 - DNA, 22 bp, Homo sapiens
cacaggcttttttggctgatgt

SEQ ID NO: 9202456 - DNA, 22 bp, Homo sapiens
cacagggaaccaaggctgggcc

SEQ ID NO: 9202457 - DNA, 22 bp, Homo sapiens
cacagtgtgggcatggtgcctg

SEQ ID NO: 9202458 - DNA, 22 bp, Homo sapiens
cacagtgttccagagcagtggt

SEQ ID NO: 9202459 - DNA, 22 bp, Homo sapiens
ggaggtggagctggaagttcca

SEQ ID NO: 9202460 - DNA, 22 bp, Homo sapiens
ggaggtggagctggaagttcca

SEQ ID NO: 9202461 - DNA, 22 bp, Homo sapiens
cacatacattcatgttactcta

SEQ ID NO: 9202462 - DNA, 22 bp, Homo sapiens
cacatttacttttatcccttgg

SEQ ID NO: 9202463 - DNA, 22 bp, Homo sapiens
cacatatacctcttcttgagtt

SEQ ID NO: 9202464 - DNA, 22 bp, Homo sapiens
ggcaggcatcatgtggtcatta

SEQ ID NO: 9202465 - DNA, 22 bp, Homo sapiens
ggcagggagagcatgctgataa

SEQ ID NO: 9202466 - DNA, 22 bp, Homo sapiens
ggcagggaggaggtgaaagtga

SEQ ID NO: 9202467 - DNA, 22 bp, Homo sapiens
ggcaggcaggagcgtgcttggg

SEQ ID NO: 9202468 - DNA, 22 bp, Homo sapiens
ggcaggcagtgtggtgtgaaac

SEQ ID NO: 9202469 - DNA, 22 bp, Homo sapiens
cacgcacgctgggtggaggcgc

SEQ ID NO: 9202470 - DNA, 22 bp, Homo sapiens
caccttgtggcccagtcaggtt

SEQ ID NO: 9202471 - DNA, 22 bp, Homo sapiens
caccttcagaatgctccaggca

SEQ ID NO: 9202472 - DNA, 20 bp, Homo sapiens
caccttcaaatttcctggca

SEQ ID NO: 9202473 - DNA, 22 bp, Homo sapiens
ggccggggcctgctcgcctgtg

SEQ ID NO: 9202474 - DNA, 22 bp, Homo sapiens
ggccactgacctacatctgggg

SEQ ID NO: 9202475 - DNA, 22 bp, Homo sapiens
ggccactgccctggctacaccg

SEQ ID NO: 9202476 - DNA, 22 bp, Homo sapiens
ggccactgctctccagcctggg

SEQ ID NO: 9202477 - DNA, 22 bp, Homo sapiens
ggcccttcctcttgtgctggca

SEQ ID NO: 9202478 - DNA, 22 bp, Homo sapiens
ggccaccttcctgtggtctctg

SEQ ID NO: 9202479 - DNA, 22 bp, Homo sapiens
ggccaaggatggtggctctggt

SEQ ID NO: 9202480 - DNA, 22 bp, Homo sapiens
ggccaaggatggtggctctggt

SEQ ID NO: 9202481 - DNA, 23 bp, Homo sapiens
ggccactgaattttctgcatctt

SEQ ID NO: 9202482 - DNA, 22 bp, Homo sapiens
ggccactcggccacccctgccg

SEQ ID NO: 9202483 - DNA, 22 bp, Homo sapiens
ggcatttttgacaaagagcaat

SEQ ID NO: 9202484 - DNA, 22 bp, Homo sapiens
ggcatttttgacaaagagcaat

SEQ ID NO: 9202485 - DNA, 22 bp, Homo sapiens
ggccaagatcccattatacaaa

SEQ ID NO: 9202486 - DNA, 22 bp, Homo sapiens
ggcattgtctatttgcattcat

SEQ ID NO: 9202487 - DNA, 22 bp, Homo sapiens
ggcagggcaggaaagtcaggaa

SEQ ID NO: 9202488 - DNA, 22 bp, Homo sapiens
ggcagggagtggagactcccta

SEQ ID NO: 9202489 - DNA, 22 bp, Homo sapiens
ggctccagggtacccctggatg

SEQ ID NO: 9202490 - DNA, 22 bp, Homo sapiens
ggctctgggttctgcaatgcgt

SEQ ID NO: 9202491 - DNA, 22 bp, Homo sapiens
ggctctggaatgtgtagtcagg

SEQ ID NO: 9202492 - DNA, 22 bp, Homo sapiens
ggctctggtcagtgaggggcct

SEQ ID NO: 9202493 - DNA, 22 bp, Homo sapiens
ggctctggtggcaattgactgg

SEQ ID NO: 9202494 - DNA, 22 bp, Homo sapiens
ggctctggtgccctggctccca

SEQ ID NO: 9202495 - DNA, 22 bp, Homo sapiens
ggctctggtgagggtaggagat

SEQ ID NO: 9202496 - DNA, 22 bp, Homo sapiens
ggctctggtcagtgaggggcct

SEQ ID NO: 9202497 - DNA, 22 bp, Homo sapiens
ggctctggtgagggtaggagat

SEQ ID NO: 9202498 - DNA, 22 bp, Homo sapiens
ggctctggtgccctggctccca

SEQ ID NO: 9202499 - DNA, 22 bp, Homo sapiens
ggctctggtgccctggctccca

SEQ ID NO: 9202500 - DNA, 22 bp, Homo sapiens
ggctcaatgcaacttctgcctc

SEQ ID NO: 9202501 - DNA, 19 bp, Homo sapiens
ggcctgaggccacagatcc

SEQ ID NO: 9202502 - DNA, 22 bp, Homo sapiens
ggcctgaggccaccagcagccc

SEQ ID NO: 9202503 - DNA, 22 bp, Homo sapiens
ggcctgagcttgggcagcgtat

SEQ ID NO: 9202504 - DNA, 22 bp, Homo sapiens
ggcctctctccctggcttgcag

SEQ ID NO: 9202505 - DNA, 22 bp, Homo sapiens
ggcctgagcagacagcatgatg

SEQ ID NO: 9202506 - DNA, 23 bp, Homo sapiens
cagaaataaactggtttgtagat

SEQ ID NO: 9202507 - DNA, 22 bp, Homo sapiens
cagaaaggtatgtgtgcctttg

SEQ ID NO: 9202508 - DNA, 22 bp, Homo sapiens
cagaaagctctttcaatcttgc

SEQ ID NO: 9202509 - DNA, 22 bp, Homo sapiens
ggctgtcttgggagctcccccg

SEQ ID NO: 9202510 - DNA, 20 bp, Homo sapiens
ggctgtcccgcggctgccgg

SEQ ID NO: 9202511 - DNA, 22 bp, Homo sapiens
ggctgtagtcagtgacatggta

SEQ ID NO: 9202512 - DNA, 22 bp, Homo sapiens
ggctgtcaattcataggtcaga

SEQ ID NO: 9202513 - DNA, 22 bp, Homo sapiens
ggctgtcagggtgagctggctt

SEQ ID NO: 9202514 - DNA, 22 bp, Homo sapiens
cagaaaacctgactctagaact

SEQ ID NO: 9202515 - DNA, 22 bp, Homo sapiens
cacttttaacaggagaattccc

SEQ ID NO: 9202516 - DNA, 21 bp, Homo sapiens
cactttaatggatatttgttt

SEQ ID NO: 9202517 - DNA, 22 bp, Homo sapiens
cagaaaaggaagagctatgtaa

SEQ ID NO: 9202518 - DNA, 22 bp, Homo sapiens
cagaaaaggaagagctatgtaa

SEQ ID NO: 9202519 - DNA, 22 bp, Homo sapiens
cagaaaataaacatttgtggaa

SEQ ID NO: 9202520 - DNA, 22 bp, Homo sapiens
ggctgcctatagaattattagt

SEQ ID NO: 9202521 - DNA, 22 bp, Homo sapiens
ggctgcctagacttggaatttc

SEQ ID NO: 9202522 - DNA, 22 bp, Homo sapiens
ggctgcctactttcccagagtt

SEQ ID NO: 9202523 - DNA, 22 bp, Homo sapiens
ggctgcctaacccttaagtgtc

SEQ ID NO: 9202524 - DNA, 22 bp, Homo sapiens
cagaaagcgggatgcagcatgt

SEQ ID NO: 9202525 - DNA, 23 bp, Homo sapiens
cagaaagccctttccccacagta

SEQ ID NO: 9202526 - DNA, 23 bp, Homo sapiens
cagaaagccctttccccacagta

SEQ ID NO: 9202527 - DNA, 22 bp, Homo sapiens
cagaaagccctatgtacagtgg

SEQ ID NO: 9202528 - DNA, 20 bp, Homo sapiens
cagaaagcatgttccagggc

SEQ ID NO: 9202529 - DNA, 17 bp, Homo sapiens
agaaagaggatccacag

SEQ ID NO: 9202530 - DNA, 22 bp, Homo sapiens
agaaagaggatgcagatctcat

SEQ ID NO: 9202531 - DNA, 22 bp, Homo sapiens
atatagaaggtgctatttacat

SEQ ID NO: 9202532 - DNA, 22 bp, Homo sapiens
atatagaaggtgctatttacat

SEQ ID NO: 9202533 - DNA, 22 bp, Homo sapiens
agaaagaacgcacttgtgctgc

SEQ ID NO: 9202534 - DNA, 22 bp, Homo sapiens
atatagtcaaacatatatgtgt

SEQ ID NO: 9202535 - DNA, 22 bp, Homo sapiens
atatagtcacactttgcaggca

SEQ ID NO: 9202536 - DNA, 22 bp, Homo sapiens
agaaatgctcaggtcaacttaa

SEQ ID NO: 9202537 - DNA, 22 bp, Homo sapiens
agaaatgcagtctcgtcaaaag

SEQ ID NO: 9202538 - DNA, 22 bp, Homo sapiens
agaaatgcagtttcaagacaaa

SEQ ID NO: 9202539 - DNA, 20 bp, Homo sapiens
agaaatattgagttcagagg

SEQ ID NO: 9202540 - DNA, 22 bp, Homo sapiens
agaaatatgctgattagatgaa

SEQ ID NO: 9202541 - DNA, 22 bp, Homo sapiens
agaaatatgctgattagatgaa

SEQ ID NO: 9202542 - DNA, 22 bp, Homo sapiens
agaagccaaaggggccagatat

SEQ ID NO: 9202543 - DNA, 22 bp, Homo sapiens
agaagccaaaggggccagatat

SEQ ID NO: 9202544 - DNA, 22 bp, Homo sapiens
agaagcagttattttttgcaca

SEQ ID NO: 9202545 - DNA, 22 bp, Homo sapiens
agaagcactacgataggtggtc

SEQ ID NO: 9202546 - DNA, 22 bp, Homo sapiens
agaagcaggcctcacagatctg

SEQ ID NO: 9202547 - DNA, 22 bp, Homo sapiens
agaagcagggcagggaaaagca

SEQ ID NO: 9202548 - DNA, 22 bp, Homo sapiens
agaagcagggcagggaaaagca

SEQ ID NO: 9202549 - DNA, 22 bp, Homo sapiens
agaaatgtttatggctgcctat

SEQ ID NO: 9202550 - DNA, 22 bp, Homo sapiens
agaaatgttgaatacatcagga

SEQ ID NO: 9202551 - DNA, 22 bp, Homo sapiens
agaaatgttgaatacatcagga

SEQ ID NO: 9202552 - DNA, 22 bp, Homo sapiens
agaaatgttgtgggttttgtta

SEQ ID NO: 9202553 - DNA, 22 bp, Homo sapiens
agaaatgtttactcaccccctt

SEQ ID NO: 9202554 - DNA, 22 bp, Homo sapiens
agaaatgtcaggaaagaagtcc

SEQ ID NO: 9202555 - DNA, 22 bp, Homo sapiens
agaaatgtcaagtgttcttgtt

SEQ ID NO: 9202556 - DNA, 22 bp, Homo sapiens
agaaatgtattctgtatgtttt

SEQ ID NO: 9202557 - DNA, 22 bp, Homo sapiens
agaaatggtgagtgagagcccc

SEQ ID NO: 9202558 - DNA, 21 bp, Homo sapiens
agaaatgtatcattcttttcc

SEQ ID NO: 9202559 - DNA, 22 bp, Homo sapiens
agaaatgtatagtgaatttttc

SEQ ID NO: 9202560 - DNA, 22 bp, Homo sapiens
agaaatgtaggcatataaggaa

SEQ ID NO: 9202561 - DNA, 22 bp, Homo sapiens
agaaatgtacgatgttatgcag

SEQ ID NO: 9202562 - DNA, 22 bp, Homo sapiens
agaaatgtacacgacacccaga

SEQ ID NO: 9202563 - DNA, 22 bp, Homo sapiens
agaaatgtaattgcaactgtct

SEQ ID NO: 9202564 - DNA, 22 bp, Homo sapiens
agaaatgtaattgcaactgtct

SEQ ID NO: 9202565 - DNA, 22 bp, Homo sapiens
agaaatgtccagggctaggatc

SEQ ID NO: 9202566 - DNA, 20 bp, Homo sapiens
agaaatgtgaaaggctgagt

SEQ ID NO: 9202567 - DNA, 22 bp, Homo sapiens
agaaatgtgaatttcatttcct

SEQ ID NO: 9202568 - DNA, 22 bp, Homo sapiens
agaaatgtggaggaacagggct

SEQ ID NO: 9202569 - DNA, 22 bp, Homo sapiens
agaaatgtgagccccttatcaa

SEQ ID NO: 9202570 - DNA, 22 bp, Homo sapiens
agaaatgttgaatacacaaaat

SEQ ID NO: 9202571 - DNA, 22 bp, Homo sapiens
agaaatgttgaatacacaaaat

SEQ ID NO: 9202572 - DNA, 22 bp, Homo sapiens
agaaatgttcttcatttgccat

SEQ ID NO: 9202573 - DNA, 22 bp, Homo sapiens
agaaatgttacagttgttattt

SEQ ID NO: 9202574 - DNA, 22 bp, Homo sapiens
agaaatgtggatcgttttaaaa

SEQ ID NO: 9202575 - DNA, 21 bp, Homo sapiens
agaagcctgggtggaggtggg

SEQ ID NO: 9202576 - DNA, 22 bp, Homo sapiens
agaagctcgggtaagctccatt

SEQ ID NO: 9202577 - DNA, 22 bp, Homo sapiens
agaagctgacagatgcagcagg

SEQ ID NO: 9202578 - DNA, 22 bp, Homo sapiens
agaagctgacagatgcagcagg

SEQ ID NO: 9202579 - DNA, 22 bp, Homo sapiens
agaagctctgagagtggggccc

SEQ ID NO: 9202580 - DNA, 19 bp, Homo sapiens
agaagcccagatcccagcc

SEQ ID NO: 9202581 - DNA, 21 bp, Homo sapiens
agaagccatttgttaggactt

SEQ ID NO: 9202582 - DNA, 22 bp, Homo sapiens
agaagcctcatcctctctagtg

SEQ ID NO: 9202583 - DNA, 18 bp, Homo sapiens
agaagcctgcctcaatgc

SEQ ID NO: 9202584 - DNA, 22 bp, Homo sapiens
agaagccattgaagcagacctc

SEQ ID NO: 9202585 - DNA, 22 bp, Homo sapiens
agaagccattccctgtaggctc

SEQ ID NO: 9202586 - DNA, 22 bp, Homo sapiens
agaagccattccctgtaggctc

SEQ ID NO: 9202587 - DNA, 22 bp, Homo sapiens
atcctgaagcatgaatgtcaaa

SEQ ID NO: 9202588 - DNA, 20 bp, Homo sapiens
atcctggaatccaaatggag

SEQ ID NO: 9202589 - DNA, 22 bp, Homo sapiens
agaagccatagtctgggaggca

SEQ ID NO: 9202590 - DNA, 21 bp, Homo sapiens
agaagccatgccagtaaaatt

SEQ ID NO: 9202591 - DNA, 22 bp, Homo sapiens
agaagccatggtatgcaactac

SEQ ID NO: 9202592 - DNA, 22 bp, Homo sapiens
agaaaagcggtcaggaccctca

SEQ ID NO: 9202593 - DNA, 22 bp, Homo sapiens
agaaaacttgctcgagcctgtt

SEQ ID NO: 9202594 - DNA, 22 bp, Homo sapiens
agaaaacttgtcacagctctca

SEQ ID NO: 9202595 - DNA, 22 bp, Homo sapiens
atagttctggatgtacttatag

SEQ ID NO: 9202596 - DNA, 22 bp, Homo sapiens
ataggatgataaaattagaaac

SEQ ID NO: 9202597 - DNA, 22 bp, Homo sapiens
atagtgtcagaaaatcataaga

SEQ ID NO: 9202598 - DNA, 23 bp, Homo sapiens
atagttagcacacttacaactgc

SEQ ID NO: 9202599 - DNA, 22 bp, Homo sapiens
atagccagcatatagcagggag

SEQ ID NO: 9202600 - DNA, 22 bp, Homo sapiens
atagccaggagatgatggggga

SEQ ID NO: 9202601 - DNA, 22 bp, Homo sapiens
atagctttcttaaatatataaa

SEQ ID NO: 9202602 - DNA, 22 bp, Homo sapiens
atagctttcttaaatatataaa

SEQ ID NO: 9202603 - DNA, 22 bp, Homo sapiens
ataggaaagaaaattatgtagg

SEQ ID NO: 9202604 - DNA, 20 bp, Homo sapiens
atagaagtattatgtaatgt

SEQ ID NO: 9202605 - DNA, 22 bp, Homo sapiens
atagaacaaggtagacagcttt

SEQ ID NO: 9202606 - DNA, 22 bp, Homo sapiens
actttacaggcacttcaagtat

SEQ ID NO: 9202607 - DNA, 20 bp, Homo sapiens
actttacagagaagactgac

SEQ ID NO: 9202608 - DNA, 22 bp, Homo sapiens
ataaggacacccttctctttac

SEQ ID NO: 9202609 - DNA, 22 bp, Homo sapiens
ataaggcacacatagatagggt

SEQ ID NO: 9202610 - DNA, 22 bp, Homo sapiens
atacaatagtgtttgttttgag

SEQ ID NO: 9202611 - DNA, 22 bp, Homo sapiens
agttctttgtcatctctggagt

SEQ ID NO: 9202612 - DNA, 19 bp, Homo sapiens
ataaataaaaagtgggaga

SEQ ID NO: 9202613 - DNA, 22 bp, Homo sapiens
ataaattctctgatgtatagta

SEQ ID NO: 9202614 - DNA, 22 bp, Homo sapiens
ataaattatgaatggccctttt

SEQ ID NO: 9202615 - DNA, 22 bp, Homo sapiens
ataaattttcttgctgtactta

SEQ ID NO: 9202616 - DNA, 22 bp, Homo sapiens
ataaatttataattgtttcctg

SEQ ID NO: 9202617 - DNA, 22 bp, Homo sapiens
ataacagagagctactgaactg

SEQ ID NO: 9202618 - DNA, 22 bp, Homo sapiens
actcagctgatgaagcacaagt

SEQ ID NO: 9202619 - DNA, 22 bp, Homo sapiens
actcagctcaggagctggctgg

SEQ ID NO: 9202620 - DNA, 22 bp, Homo sapiens
actcagagttttacccagagac

SEQ ID NO: 9202621 - DNA, 22 bp, Homo sapiens
actcagaggaaagttgagattg

SEQ ID NO: 9202622 - DNA, 22 bp, Homo sapiens
actcagagtagaaaataggttc

SEQ ID NO: 9202623 - DNA, 22 bp, Homo sapiens
actcagcttcctacagctagaa

SEQ ID NO: 9202624 - DNA, 22 bp, Homo sapiens
agtaacatctttgacatttgtt

SEQ ID NO: 9202625 - DNA, 23 bp, Homo sapiens
agtcagtgcgggatggtcagggg

SEQ ID NO: 9202626 - DNA, 22 bp, Homo sapiens
agtcagtgacttttgctgagag

SEQ ID NO: 9202627 - DNA, 22 bp, Homo sapiens
agtcagtgggcttggcacagaa

SEQ ID NO: 9202628 - DNA, 22 bp, Homo sapiens
agtaagtgagtcactgtgctgg

SEQ ID NO: 9202629 - DNA, 22 bp, Homo sapiens
actctgggttctttcacttgac

SEQ ID NO: 9202630 - DNA, 22 bp, Homo sapiens
actctggggtgatgtctctgag

SEQ ID NO: 9202631 - DNA, 22 bp, Homo sapiens
actctgggtcctgccattcact

SEQ ID NO: 9202632 - DNA, 20 bp, Homo sapiens
actctggggctcattagggg

SEQ ID NO: 9202633 - DNA, 22 bp, Homo sapiens
actctgggccccaggtggagct

SEQ ID NO: 9202634 - DNA, 22 bp, Homo sapiens
actctggggcgctactccaact

SEQ ID NO: 9202635 - DNA, 22 bp, Homo sapiens
actctgggctgttaggagctgt

SEQ ID NO: 9202636 - DNA, 22 bp, Homo sapiens
actctgggctttgatttgttac

SEQ ID NO: 9202637 - DNA, 22 bp, Homo sapiens
agtcctggtgacactcctcttc

SEQ ID NO: 9202638 - DNA, 22 bp, Homo sapiens
agtcctgggtgtgcaaggcaga

SEQ ID NO: 9202639 - DNA, 22 bp, Homo sapiens
agtccaggcattccagccattc

SEQ ID NO: 9202640 - DNA, 22 bp, Homo sapiens
agtccaggcctcctcttttcct

SEQ ID NO: 9202641 - DNA, 22 bp, Homo sapiens
agtccaggcctccctctcctgc

SEQ ID NO: 9202642 - DNA, 18 bp, Homo sapiens
actctgggacctgttatt

SEQ ID NO: 9202643 - DNA, 22 bp, Homo sapiens
actctgggagaggacaaacaaa

SEQ ID NO: 9202644 - DNA, 22 bp, Homo sapiens
actctgggatcttgaaaagagt

SEQ ID NO: 9202645 - DNA, 22 bp, Homo sapiens
actctgggcccaccctcagagt

SEQ ID NO: 9202646 - DNA, 22 bp, Homo sapiens
actctgggatgagaaaagggtt

SEQ ID NO: 9202647 - DNA, 22 bp, Homo sapiens
actctgggattgtttctggtat

SEQ ID NO: 9202648 - DNA, 21 bp, Homo sapiens
agtccaggaggaggccaggtt

SEQ ID NO: 9202649 - DNA, 22 bp, Homo sapiens
agtccaggcattccagccattc

SEQ ID NO: 9202650 - DNA, 21 bp, Homo sapiens
agtccaggagtcacccaagcc

SEQ ID NO: 9202651 - DNA, 22 bp, Homo sapiens
agtccaggaaaataagctaggt

SEQ ID NO: 9202652 - DNA, 22 bp, Homo sapiens
agtccaggactgtttcagctga

SEQ ID NO: 9202653 - DNA, 22 bp, Homo sapiens
agtccagaccccggcagctggt

SEQ ID NO: 9202654 - DNA, 22 bp, Homo sapiens
aggttcctcttcctctggcctg

SEQ ID NO: 9202655 - DNA, 22 bp, Homo sapiens
aggttccatcacctgcagtgga

SEQ ID NO: 9202656 - DNA, 22 bp, Homo sapiens
aggttccaggttcgaatcccat

SEQ ID NO: 9202657 - DNA, 22 bp, Homo sapiens
aggttccaggtctgggttatgt

SEQ ID NO: 9202658 - DNA, 22 bp, Homo sapiens
aggttccagggattaggatgtg

SEQ ID NO: 9202659 - DNA, 20 bp, Homo sapiens
aggttccagccacaaccagc

SEQ ID NO: 9202660 - DNA, 21 bp, Homo sapiens
aggttccagcagccagagaat

SEQ ID NO: 9202661 - DNA, 22 bp, Homo sapiens
aggttctcacacgtctacaccc

SEQ ID NO: 9202662 - DNA, 22 bp, Homo sapiens
aggttctccttatcaatgaaga

SEQ ID NO: 9202663 - DNA, 23 bp, Homo sapiens
aggttctcttatcatctctgccc

SEQ ID NO: 9202664 - DNA, 22 bp, Homo sapiens
aggttcttggtgagcatttggt

SEQ ID NO: 9202665 - DNA, 22 bp, Homo sapiens
aggttcttgactctaccttcca

SEQ ID NO: 9202666 - DNA, 22 bp, Homo sapiens
actcagagcctcgagggactgc

SEQ ID NO: 9202667 - DNA, 19 bp, Homo sapiens
aggtgggtaagcagttctc

SEQ ID NO: 9202668 - DNA, 22 bp, Homo sapiens
aggtgggtatcatgagagatta

SEQ ID NO: 9202669 - DNA, 22 bp, Homo sapiens
aggtgggtatcatgagagatta

SEQ ID NO: 9202670 - DNA, 22 bp, Homo sapiens
aggtggggttcagtctcagccg

SEQ ID NO: 9202671 - DNA, 22 bp, Homo sapiens
aggtggagaagagatgggcagt

SEQ ID NO: 9202672 - DNA, 16 bp, Homo sapiens
aggtggagaagttcac

SEQ ID NO: 9202673 - DNA, 22 bp, Homo sapiens
aggtggagacccagagaaggcg

SEQ ID NO: 9202674 - DNA, 22 bp, Homo sapiens
agggtcctaagcctcagataag

SEQ ID NO: 9202675 - DNA, 22 bp, Homo sapiens
agggtcccgtccctctgcaccc

SEQ ID NO: 9202676 - DNA, 23 bp, Homo sapiens
agggtgagcaagctatggagacc

SEQ ID NO: 9202677 - DNA, 22 bp, Homo sapiens
agggtcagttctgtgaggtgtt

SEQ ID NO: 9202678 - DNA, 19 bp, Homo sapiens
agggtccaggccctgtgga

SEQ ID NO: 9202679 - DNA, 22 bp, Homo sapiens
agggtcagtgatgagggagccc

SEQ ID NO: 9202680 - DNA, 22 bp, Homo sapiens
agggtcccgaaggagacagcaa

SEQ ID NO: 9202681 - DNA, 22 bp, Homo sapiens
agggtccattctttgccttttc

SEQ ID NO: 9202682 - DNA, 19 bp, Homo sapiens
agggtccagggagcggctc

SEQ ID NO: 9202683 - DNA, 22 bp, Homo sapiens
agggtccatcaaggactgcaca

SEQ ID NO: 9202684 - DNA, 22 bp, Homo sapiens
agggtgcatgtttgcaagagtg

SEQ ID NO: 9202685 - DNA, 22 bp, Homo sapiens
aggtgccaagatgtcacagaca

SEQ ID NO: 9202686 - DNA, 22 bp, Homo sapiens
aggtgccaattttcagtgaaca

SEQ ID NO: 9202687 - DNA, 21 bp, Homo sapiens
aggtgccaaggagaagcaggc

SEQ ID NO: 9202688 - DNA, 21 bp, Homo sapiens
aggtgccaaggagaagcaggc

SEQ ID NO: 9202689 - DNA, 22 bp, Homo sapiens
aggtgccagatgcacagctgaa

SEQ ID NO: 9202690 - DNA, 22 bp, Homo sapiens
agtgagacagtatactgagcag

SEQ ID NO: 9202691 - DNA, 22 bp, Homo sapiens
agtgaatgtccccgcgggtcag

SEQ ID NO: 9202692 - DNA, 19 bp, Homo sapiens
agtgagcatccagagaggt

SEQ ID NO: 9202693 - DNA, 17 bp, Homo sapiens
agtgaggagattggaag

SEQ ID NO: 9202694 - DNA, 20 bp, Homo sapiens
agtgaggcagttcagtgggc

SEQ ID NO: 9202695 - DNA, 20 bp, Homo sapiens
agtgatttgttagtacattg

SEQ ID NO: 9202696 - DNA, 22 bp, Homo sapiens
agtgcaagctccataatcttca

SEQ ID NO: 9202697 - DNA, 20 bp, Homo sapiens
agtgcaagaaagcacagctg

SEQ ID NO: 9202698 - DNA, 22 bp, Homo sapiens
agtggggccgcggtcctgccct

SEQ ID NO: 9202699 - DNA, 22 bp, Homo sapiens
agtgggagcggcagtcggggac

SEQ ID NO: 9202700 - DNA, 20 bp, Homo sapiens
agtgggagagggcagactgc

SEQ ID NO: 9202701 - DNA, 22 bp, Homo sapiens
agtggctggaattgcaggtgcg

SEQ ID NO: 9202702 - DNA, 22 bp, Homo sapiens
agtggcagagccaagtagagcc

SEQ ID NO: 9202703 - DNA, 22 bp, Homo sapiens
agtggcagagccaagtagagcc

SEQ ID NO: 9202704 - DNA, 22 bp, Homo sapiens
agtggcagacagagacagtacc

SEQ ID NO: 9202705 - DNA, 22 bp, Homo sapiens
agtggcagacacaatgtgggca

SEQ ID NO: 9202706 - DNA, 22 bp, Homo sapiens
agtggcagagaccccagccagc

SEQ ID NO: 9202707 - DNA, 22 bp, Homo sapiens
agttatttggctatagatggta

SEQ ID NO: 9202708 - DNA, 22 bp, Homo sapiens
agttattttggaaaatgagtca

SEQ ID NO: 9202709 - DNA, 22 bp, Homo sapiens
agttcaacaccagcctgaccaa

SEQ ID NO: 9202710 - DNA, 22 bp, Homo sapiens
actggggcagtgggcagtggtt

SEQ ID NO: 9202711 - DNA, 22 bp, Homo sapiens
actggggcaggaaagtatgctg

SEQ ID NO: 9202712 - DNA, 22 bp, Homo sapiens
actggggcctcctccatgctct

SEQ ID NO: 9202713 - DNA, 22 bp, Homo sapiens
actggggcctcctccatgctct

SEQ ID NO: 9202714 - DNA, 23 bp, Homo sapiens
actgggtctatctccagagaaga

SEQ ID NO: 9202715 - DNA, 22 bp, Homo sapiens
agtgggggcagagcctctctcg

SEQ ID NO: 9202716 - DNA, 22 bp, Homo sapiens
agtggggccggtgaggccgagg

SEQ ID NO: 9202717 - DNA, 22 bp, Homo sapiens
agtgggggccaacgagggcagc

SEQ ID NO: 9202718 - DNA, 22 bp, Homo sapiens
agtgggggccaacgagggcagc

SEQ ID NO: 9202719 - DNA, 22 bp, Homo sapiens
agtgggggccaacgagggcagc

SEQ ID NO: 9202720 - DNA, 22 bp, Homo sapiens
agtgggggctggctctgtctgt

SEQ ID NO: 9202721 - DNA, 22 bp, Homo sapiens
agtgtctttatagactgacaat

SEQ ID NO: 9202722 - DNA, 22 bp, Homo sapiens
agtgtctttcatatcctccatc

SEQ ID NO: 9202723 - DNA, 22 bp, Homo sapiens
agtgtggtcgggagcgcggggc

SEQ ID NO: 9202724 - DNA, 22 bp, Homo sapiens
agtgtgtactcatatacttcca

SEQ ID NO: 9202725 - DNA, 23 bp, Homo sapiens
actgggctgaaattaaaggtgtc

SEQ ID NO: 9202726 - DNA, 23 bp, Homo sapiens
actgggctgaaatttttcatggc

SEQ ID NO: 9202727 - DNA, 17 bp, Homo sapiens
agtgtgtgaaatggtgg

SEQ ID NO: 9202728 - DNA, 22 bp, Homo sapiens
aggaaaggggtaggtgtggacg

SEQ ID NO: 9202729 - DNA, 17 bp, Homo sapiens
aggaaagtctgctgtcc

SEQ ID NO: 9202730 - DNA, 22 bp, Homo sapiens
acaggcctggtgctgctgacag

SEQ ID NO: 9202731 - DNA, 22 bp, Homo sapiens
acaggccttggtcctgacctaa

SEQ ID NO: 9202732 - DNA, 22 bp, Homo sapiens
acaggctctcagccagttggca

SEQ ID NO: 9202733 - DNA, 21 bp, Homo sapiens
acaggctctggggatgctggg

SEQ ID NO: 9202734 - DNA, 22 bp, Homo sapiens
acagggcacctgaggtaggaag

SEQ ID NO: 9202735 - DNA, 22 bp, Homo sapiens
aggacagtggcaaggcaggaca

SEQ ID NO: 9202736 - DNA, 22 bp, Homo sapiens
aggacagttagttaggaagttt

SEQ ID NO: 9202737 - DNA, 23 bp, Homo sapiens
aggacagtggaatttagggattg

SEQ ID NO: 9202738 - DNA, 22 bp, Homo sapiens
aggacagtataggctttaggag

SEQ ID NO: 9202739 - DNA, 22 bp, Homo sapiens
aggactgattgggatgccatgt

SEQ ID NO: 9202740 - DNA, 22 bp, Homo sapiens
aggactggtgtgtgatcagcat

SEQ ID NO: 9202741 - DNA, 22 bp, Homo sapiens
aggactggtgccagacaaggta

SEQ ID NO: 9202742 - DNA, 22 bp, Homo sapiens
aggactgggtgcagagggcatc

SEQ ID NO: 9202743 - DNA, 22 bp, Homo sapiens
acagggcctcagccagggcaga

SEQ ID NO: 9202744 - DNA, 23 bp, Homo sapiens
acagggctagctgacagtggtat

SEQ ID NO: 9202745 - DNA, 22 bp, Homo sapiens
acagggccttatatccagaagg

SEQ ID NO: 9202746 - DNA, 22 bp, Homo sapiens
acaggaagtgctggcacttaca

SEQ ID NO: 9202747 - DNA, 22 bp, Homo sapiens
acaggaagaaagtgcagtagat

SEQ ID NO: 9202748 - DNA, 22 bp, Homo sapiens
acaggaagctggagacccttga

SEQ ID NO: 9202749 - DNA, 22 bp, Homo sapiens
acaggaagtttggaaagcctca

SEQ ID NO: 9202750 - DNA, 22 bp, Homo sapiens
acaggacaaaaatctggatggc

SEQ ID NO: 9202751 - DNA, 22 bp, Homo sapiens
acaggaagtgggaagaaacagg

SEQ ID NO: 9202752 - DNA, 22 bp, Homo sapiens
acaggacaaggggaagaagata

SEQ ID NO: 9202753 - DNA, 22 bp, Homo sapiens
acaggacaggctgggctagact

SEQ ID NO: 9202754 - DNA, 22 bp, Homo sapiens
acagcattcaataaataataac

SEQ ID NO: 9202755 - DNA, 21 bp, Homo sapiens
acagcatgtttgtgtgtttgc

SEQ ID NO: 9202756 - DNA, 22 bp, Homo sapiens
acagcatttaaagaaaatgaac

SEQ ID NO: 9202757 - DNA, 22 bp, Homo sapiens
acagcattgctccatctcaaga

SEQ ID NO: 9202758 - DNA, 22 bp, Homo sapiens
acagccactcaaagggccgaag

SEQ ID NO: 9202759 - DNA, 22 bp, Homo sapiens
acagccagaggagccaggctgg

SEQ ID NO: 9202760 - DNA, 22 bp, Homo sapiens
acagcatgagagtagcaaaagg

SEQ ID NO: 9202761 - DNA, 22 bp, Homo sapiens
acaggacatggcttctgtgacg

SEQ ID NO: 9202762 - DNA, 22 bp, Homo sapiens
acaggacagtctagtaacagta

SEQ ID NO: 9202763 - DNA, 22 bp, Homo sapiens
agcttcttgaccaagcctgtaa

SEQ ID NO: 9202764 - DNA, 22 bp, Homo sapiens
agcttcttgaccaagcctgtaa

SEQ ID NO: 9202765 - DNA, 22 bp, Homo sapiens
agcttcttcttggtctttccca

SEQ ID NO: 9202766 - DNA, 22 bp, Homo sapiens
agcttcttctgatttgtcagtc

SEQ ID NO: 9202767 - DNA, 22 bp, Homo sapiens
acaggagaaatctggtcaaaag

SEQ ID NO: 9202768 - DNA, 22 bp, Homo sapiens
acaggcaagtcacacaacttgt

SEQ ID NO: 9202769 - DNA, 21 bp, Homo sapiens
acaggcaaattttagacaatg

SEQ ID NO: 9202770 - DNA, 22 bp, Homo sapiens
acaggcaaagggtcagtagcag

SEQ ID NO: 9202771 - DNA, 22 bp, Homo sapiens
agcttctttaattcagcatgat

SEQ ID NO: 9202772 - DNA, 22 bp, Homo sapiens
agcttctttaattcagcatgat

SEQ ID NO: 9202773 - DNA, 22 bp, Homo sapiens
agcttctttgtgggctccagaa

SEQ ID NO: 9202774 - DNA, 22 bp, Homo sapiens
acaggatgataaaggatggcca

SEQ ID NO: 9202775 - DNA, 22 bp, Homo sapiens
acaggatggagataatagaaaa

SEQ ID NO: 9202776 - DNA, 22 bp, Homo sapiens
acaggatgggcgcacagagcta

SEQ ID NO: 9202777 - DNA, 22 bp, Homo sapiens
acatctgtttgagaaaaagaag

SEQ ID NO: 9202778 - DNA, 22 bp, Homo sapiens
acatcttcactggtttctggaa

SEQ ID NO: 9202779 - DNA, 20 bp, Homo sapiens
aggcagtgtagagatgagta

SEQ ID NO: 9202780 - DNA, 22 bp, Homo sapiens
acatccatttgctttatttgct

SEQ ID NO: 9202781 - DNA, 22 bp, Homo sapiens
acatctggaaagttacttgaga

SEQ ID NO: 9202782 - DNA, 22 bp, Homo sapiens
acatatatgtaaagtactttgt

SEQ ID NO: 9202783 - DNA, 22 bp, Homo sapiens
aggcagaatgttggaaaggaag

SEQ ID NO: 9202784 - DNA, 22 bp, Homo sapiens
aggcagaagccagccagggtcc

SEQ ID NO: 9202785 - DNA, 22 bp, Homo sapiens
aggcagaaccagctgggacttt

SEQ ID NO: 9202786 - DNA, 21 bp, Homo sapiens
aggcagaaagagcccaggctg

SEQ ID NO: 9202787 - DNA, 21 bp, Homo sapiens
aggcagaaagagcccaggctg

SEQ ID NO: 9202788 - DNA, 22 bp, Homo sapiens
acagtgaataagacatgtgctt

SEQ ID NO: 9202789 - DNA, 22 bp, Homo sapiens
acagtctgtcccccaggtgcta

SEQ ID NO: 9202790 - DNA, 22 bp, Homo sapiens
acagtctggaggctgcttcatt

SEQ ID NO: 9202791 - DNA, 21 bp, Homo sapiens
acagtgagaaataaatggaaa

SEQ ID NO: 9202792 - DNA, 22 bp, Homo sapiens
acagtgaatgagaatggagaaa

SEQ ID NO: 9202793 - DNA, 22 bp, Homo sapiens
aggaggcccctcctgggttgct

SEQ ID NO: 9202794 - DNA, 22 bp, Homo sapiens
aggaggccctagagctctagag

SEQ ID NO: 9202795 - DNA, 17 bp, Homo sapiens
aggaggccctggcgttt

SEQ ID NO: 9202796 - DNA, 22 bp, Homo sapiens
acagtgcagggtgggaagaagg

SEQ ID NO: 9202797 - DNA, 22 bp, Homo sapiens
acagtgctgtctatctcactaa

SEQ ID NO: 9202798 - DNA, 22 bp, Homo sapiens
acagtgcagggcgggaagaagg

SEQ ID NO: 9202799 - DNA, 22 bp, Homo sapiens
acagtgttacttgatagtgtat

SEQ ID NO: 9202800 - DNA, 20 bp, Homo sapiens
acagtgttaggtttttcctt

SEQ ID NO: 9202801 - DNA, 22 bp, Homo sapiens
acagtgttcaaaccactaggct

SEQ ID NO: 9202802 - DNA, 22 bp, Homo sapiens
acagtgttcactaaggttagct

SEQ ID NO: 9202803 - DNA, 22 bp, Homo sapiens
acagtgttatttctgagtaatg

SEQ ID NO: 9202804 - DNA, 20 bp, Homo sapiens
acagtgttagttatcatctc

SEQ ID NO: 9202805 - DNA, 22 bp, Homo sapiens
acagtgttcacttaacaatgga

SEQ ID NO: 9202806 - DNA, 22 bp, Homo sapiens
acagtgttcctttgttgtgact

SEQ ID NO: 9202807 - DNA, 22 bp, Homo sapiens
aggcagaaaatagtcatccaaa

SEQ ID NO: 9202808 - DNA, 22 bp, Homo sapiens
aggcagaaaatagtcatccaaa

SEQ ID NO: 9202809 - DNA, 22 bp, Homo sapiens
acagtgttctcttcctgtatag

SEQ ID NO: 9202810 - DNA, 22 bp, Homo sapiens
acagtgttctgaaagttgaggg

SEQ ID NO: 9202811 - DNA, 22 bp, Homo sapiens
aggcactggtccattttctgca

SEQ ID NO: 9202812 - DNA, 22 bp, Homo sapiens
acagtggcagtattagggcaga

SEQ ID NO: 9202813 - DNA, 22 bp, Homo sapiens
aggcacagcacacctggccccc

SEQ ID NO: 9202814 - DNA, 22 bp, Homo sapiens
acagtggctcatgcctgtcatc

SEQ ID NO: 9202815 - DNA, 22 bp, Homo sapiens
aggctcaggaggagctgccgga

SEQ ID NO: 9202816 - DNA, 22 bp, Homo sapiens
acatgtgcagacagcaagcagg

SEQ ID NO: 9202817 - DNA, 22 bp, Homo sapiens
acatgtgctcttgctgtacagc

SEQ ID NO: 9202818 - DNA, 20 bp, Homo sapiens
aggctcactcaccttgtgga

SEQ ID NO: 9202819 - DNA, 22 bp, Homo sapiens
aggctcaagcactgatattttt

SEQ ID NO: 9202820 - DNA, 22 bp, Homo sapiens
acatgtatgctttatgaagtag

SEQ ID NO: 9202821 - DNA, 22 bp, Homo sapiens
acatgtctaagtactcaacaaa

SEQ ID NO: 9202822 - DNA, 22 bp, Homo sapiens
acatggctaaattagctttact

SEQ ID NO: 9202823 - DNA, 22 bp, Homo sapiens
acatggctcagtctcatgacag

SEQ ID NO: 9202824 - DNA, 20 bp, Homo sapiens
aggctcagggtgtttaggaa

SEQ ID NO: 9202825 - DNA, 22 bp, Homo sapiens
aggctcaggtctcaggtctggc

SEQ ID NO: 9202826 - DNA, 22 bp, Homo sapiens
acattaaaatggagaattttga

SEQ ID NO: 9202827 - DNA, 22 bp, Homo sapiens
aggctccagtctcctctggcag

SEQ ID NO: 9202828 - DNA, 22 bp, Homo sapiens
acattaacactggtgctggtgt

SEQ ID NO: 9202829 - DNA, 22 bp, Homo sapiens
acattaacaccataagtgtgtt

SEQ ID NO: 9202830 - DNA, 22 bp, Homo sapiens
acattaacaccgtgagtttggt

SEQ ID NO: 9202831 - DNA, 22 bp, Homo sapiens
aggctctgaagcaaccctttga

SEQ ID NO: 9202832 - DNA, 22 bp, Homo sapiens
aggctctggagtgtggtgctgg

SEQ ID NO: 9202833 - DNA, 22 bp, Homo sapiens
aggctctgacgtcacacgtggc

SEQ ID NO: 9202834 - DNA, 22 bp, Homo sapiens
aggctctgacccatgggaccca

SEQ ID NO: 9202835 - DNA, 22 bp, Homo sapiens
aggctctgcttttctggatata

SEQ ID NO: 9202836 - DNA, 22 bp, Homo sapiens
aggctggctttggtagcatggt

SEQ ID NO: 9202837 - DNA, 22 bp, Homo sapiens
aggctgggaaacctgaagttgt

SEQ ID NO: 9202838 - DNA, 22 bp, Homo sapiens
aggctgtgagaggtggctccca

SEQ ID NO: 9202839 - DNA, 22 bp, Homo sapiens
aggctgtgagaggtggctccca

SEQ ID NO: 9202840 - DNA, 22 bp, Homo sapiens
aggctgtgagaagtccttcagt

SEQ ID NO: 9202841 - DNA, 22 bp, Homo sapiens
accagaaggaccagaggcaagg

SEQ ID NO: 9202842 - DNA, 22 bp, Homo sapiens
accacaggaattgctctgtggt

SEQ ID NO: 9202843 - DNA, 22 bp, Homo sapiens
aggctgtgatgagcctcatgga

SEQ ID NO: 9202844 - DNA, 22 bp, Homo sapiens
accactgcccatggtgaaaact

SEQ ID NO: 9202845 - DNA, 22 bp, Homo sapiens
aggctctggagttagccaggca

SEQ ID NO: 9202846 - DNA, 22 bp, Homo sapiens
aggctctggagttagccaggca

SEQ ID NO: 9202847 - DNA, 22 bp, Homo sapiens
aggctgctggcaggcgtggacg

SEQ ID NO: 9202848 - DNA, 22 bp, Homo sapiens
aggctgctggcaggcgtggacg

SEQ ID NO: 9202849 - DNA, 22 bp, Homo sapiens
acatttctccctgcatgcctgc

SEQ ID NO: 9202850 - DNA, 22 bp, Homo sapiens
aggctggcttcccaagcgtcct

SEQ ID NO: 9202851 - DNA, 22 bp, Homo sapiens
aggctggcttcccaagcgtcct

SEQ ID NO: 9202852 - DNA, 20 bp, Homo sapiens
accagagatagcaatagtgc

SEQ ID NO: 9202853 - DNA, 20 bp, Homo sapiens
accagagactggggacaagt

SEQ ID NO: 9202854 - DNA, 22 bp, Homo sapiens
accagagcccatctgctcctag

SEQ ID NO: 9202855 - DNA, 22 bp, Homo sapiens
accagagcgctcaagccttccc

SEQ ID NO: 9202856 - DNA, 18 bp, Homo sapiens
accagagccctgttctgg

SEQ ID NO: 9202857 - DNA, 22 bp, Homo sapiens
agggagctgactggctgccatt

SEQ ID NO: 9202858 - DNA, 20 bp, Homo sapiens
accagagctctcagtatgtg

SEQ ID NO: 9202859 - DNA, 22 bp, Homo sapiens
agggaggatagtagtcagttta

SEQ ID NO: 9202860 - DNA, 22 bp, Homo sapiens
agggaggatctgctccttgtct

SEQ ID NO: 9202861 - DNA, 22 bp, Homo sapiens
agggaggatctgctccttgtct

SEQ ID NO: 9202862 - DNA, 22 bp, Homo sapiens
agggcacatctgctgggaatgg

SEQ ID NO: 9202863 - DNA, 20 bp, Homo sapiens
agggaggtgctgggcctgag

SEQ ID NO: 9202864 - DNA, 22 bp, Homo sapiens
agggaggtctggctgccctgag

SEQ ID NO: 9202865 - DNA, 22 bp, Homo sapiens
agggctcaatggtgggcatgta

SEQ ID NO: 9202866 - DNA, 22 bp, Homo sapiens
agggctcaccactgtgcactcc

SEQ ID NO: 9202867 - DNA, 22 bp, Homo sapiens
agggcctggttctgtgtaggga

SEQ ID NO: 9202868 - DNA, 22 bp, Homo sapiens
agggccagttcagaggacatgg

SEQ ID NO: 9202869 - DNA, 22 bp, Homo sapiens
agggccagtaaatgtttcctca

SEQ ID NO: 9202870 - DNA, 22 bp, Homo sapiens
agggccagcagcttggccaacc

SEQ ID NO: 9202871 - DNA, 22 bp, Homo sapiens
agggccagcactcctggcagga

SEQ ID NO: 9202872 - DNA, 22 bp, Homo sapiens
agggccagcccataatgccaaa

SEQ ID NO: 9202873 - DNA, 22 bp, Homo sapiens
agggccagcccataatgccaaa

SEQ ID NO: 9202874 - DNA, 22 bp, Homo sapiens
agggccagatgaagccacaagc

SEQ ID NO: 9202875 - DNA, 22 bp, Homo sapiens
acctcaggatgtggacacagaa

SEQ ID NO: 9202876 - DNA, 22 bp, Homo sapiens
acctccagctttttagagacat

SEQ ID NO: 9202877 - DNA, 22 bp, Homo sapiens
accctttgtccaatagaaatga

SEQ ID NO: 9202878 - DNA, 21 bp, Homo sapiens
acctcaagcaacaaccaaggt

SEQ ID NO: 9202879 - DNA, 22 bp, Homo sapiens
aggggccacctgtggcaccctg

SEQ ID NO: 9202880 - DNA, 22 bp, Homo sapiens
aggggccattgttctgcccgct

SEQ ID NO: 9202881 - DNA, 22 bp, Homo sapiens
acctcccagaaagttttgcagg

SEQ ID NO: 9202882 - DNA, 22 bp, Homo sapiens
acctcccagctctgagcttggg

SEQ ID NO: 9202883 - DNA, 16 bp, Homo sapiens
acctccagtcaagggt

SEQ ID NO: 9202884 - DNA, 22 bp, Homo sapiens
agggtcagtgatgagggagccc

SEQ ID NO: 9202885 - DNA, 20 bp, Homo sapiens
agggtcagtagcacagagct

SEQ ID NO: 9202886 - DNA, 22 bp, Homo sapiens
agggctcagaacaatgagtgta

SEQ ID NO: 9202887 - DNA, 22 bp, Homo sapiens
agggctgacaaatggcagtgac

SEQ ID NO: 9202888 - DNA, 22 bp, Homo sapiens
agggctcagtaaacggtggatt

SEQ ID NO: 9202889 - DNA, 22 bp, Homo sapiens
agggctgaagggaggtgctcat

SEQ ID NO: 9202890 - DNA, 22 bp, Homo sapiens
aggggcaggtgctgcacttaga

SEQ ID NO: 9202891 - DNA, 22 bp, Homo sapiens
agagctcaagacgctcacagta

SEQ ID NO: 9202892 - DNA, 22 bp, Homo sapiens
agagctctgcagctggcctcag

SEQ ID NO: 9202893 - DNA, 22 bp, Homo sapiens
attaaggaatgtaggcaagaag

SEQ ID NO: 9202894 - DNA, 22 bp, Homo sapiens
attaaggtgtcaatgtatttgg

SEQ ID NO: 9202895 - DNA, 22 bp, Homo sapiens
atgttcagcattctataaatat

SEQ ID NO: 9202896 - DNA, 22 bp, Homo sapiens
atgttcctcactattttggccc

SEQ ID NO: 9202897 - DNA, 22 bp, Homo sapiens
atgttcctcattcttgcaaccc

SEQ ID NO: 9202898 - DNA, 22 bp, Homo sapiens
atgttcctattgcagaggatga

SEQ ID NO: 9202899 - DNA, 22 bp, Homo sapiens
atgttcctcactattttggccc

SEQ ID NO: 9202900 - DNA, 22 bp, Homo sapiens
atgttcctggtatatcatgacc

SEQ ID NO: 9202901 - DNA, 22 bp, Homo sapiens
atgttcctgatcctcgttctat

SEQ ID NO: 9202902 - DNA, 18 bp, Homo sapiens
atgttcctgaggagaggt

SEQ ID NO: 9202903 - DNA, 22 bp, Homo sapiens
agagccttgaagatctggaaaa

SEQ ID NO: 9202904 - DNA, 22 bp, Homo sapiens
atgttccttgctctcaggtaag

SEQ ID NO: 9202905 - DNA, 22 bp, Homo sapiens
atgttcctttaaaatatagatt

SEQ ID NO: 9202906 - DNA, 22 bp, Homo sapiens
atgttccttccagagagcagaa

SEQ ID NO: 9202907 - DNA, 22 bp, Homo sapiens
agagccagcatttgacactggc

SEQ ID NO: 9202908 - DNA, 22 bp, Homo sapiens
agagccagcatttgacactggc

SEQ ID NO: 9202909 - DNA, 22 bp, Homo sapiens
agagccaggactgtgtctcact

SEQ ID NO: 9202910 - DNA, 22 bp, Homo sapiens
atgtgcaacttttctgtctttt

SEQ ID NO: 9202911 - DNA, 22 bp, Homo sapiens
atgtatacgtgcaagtcacagg

SEQ ID NO: 9202912 - DNA, 21 bp, Homo sapiens
atgtagggtttgccttctcta

SEQ ID NO: 9202913 - DNA, 22 bp, Homo sapiens
agagatggcgtctcagagcctg

SEQ ID NO: 9202914 - DNA, 17 bp, Homo sapiens
atgtatattaactctga

SEQ ID NO: 9202915 - DNA, 22 bp, Homo sapiens
agagatgggaaggcagacttca

SEQ ID NO: 9202916 - DNA, 22 bp, Homo sapiens
atgtacatactgcattttcaaa

SEQ ID NO: 9202917 - DNA, 22 bp, Homo sapiens
atgggcagtaacagtggcagtc

SEQ ID NO: 9202918 - DNA, 22 bp, Homo sapiens
atgggcagtgtattggaaggaa

SEQ ID NO: 9202919 - DNA, 22 bp, Homo sapiens
atgggccaagtaaacattctca

SEQ ID NO: 9202920 - DNA, 22 bp, Homo sapiens
atgggccacacacgattgggtg

SEQ ID NO: 9202921 - DNA, 22 bp, Homo sapiens
atgggccaggcttgggatgaca

SEQ ID NO: 9202922 - DNA, 23 bp, Homo sapiens
atgggccaagcaagacccatgac

SEQ ID NO: 9202923 - DNA, 22 bp, Homo sapiens
atgggcagttaggaggccagga

SEQ ID NO: 9202924 - DNA, 18 bp, Homo sapiens
atgggaggggccaagaga

SEQ ID NO: 9202925 - DNA, 22 bp, Homo sapiens
atggacaggtggataggtggat

SEQ ID NO: 9202926 - DNA, 22 bp, Homo sapiens
atggacaggcttataacagcaa

SEQ ID NO: 9202927 - DNA, 22 bp, Homo sapiens
atggacaggtactgcagtgggt

SEQ ID NO: 9202928 - DNA, 22 bp, Homo sapiens
agagaacagcctcctagagaaa

SEQ ID NO: 9202929 - DNA, 22 bp, Homo sapiens
agagaagacttacagccacagt

SEQ ID NO: 9202930 - DNA, 22 bp, Homo sapiens
agagaacattagcaaaaacagc

SEQ ID NO: 9202931 - DNA, 19 bp, Homo sapiens
atggacagacagtttggcc

SEQ ID NO: 9202932 - DNA, 23 bp, Homo sapiens
atggacagaatgtttgtgttccc

SEQ ID NO: 9202933 - DNA, 22 bp, Homo sapiens
atggacagagctgagctccacc

SEQ ID NO: 9202934 - DNA, 22 bp, Homo sapiens
atggacagctggcctcaaggga

SEQ ID NO: 9202935 - DNA, 22 bp, Homo sapiens
atggacagctcttatgtgggca

SEQ ID NO: 9202936 - DNA, 22 bp, Homo sapiens
agacagtgctatcccatctgtg

SEQ ID NO: 9202937 - DNA, 22 bp, Homo sapiens
atgccaggctgtttggcctcag

SEQ ID NO: 9202938 - DNA, 22 bp, Homo sapiens
agacagtgtgagttcagggtgg

SEQ ID NO: 9202939 - DNA, 23 bp, Homo sapiens
atgccaggctgcctggccagcct

SEQ ID NO: 9202940 - DNA, 22 bp, Homo sapiens
atgccagcctctaagcacttta

SEQ ID NO: 9202941 - DNA, 22 bp, Homo sapiens
atgcttctcagctcaaggcaaa

SEQ ID NO: 9202942 - DNA, 22 bp, Homo sapiens
atgcttcctttttcccttaagg

SEQ ID NO: 9202943 - DNA, 22 bp, Homo sapiens
atgcttcctctacggcctctga

SEQ ID NO: 9202944 - DNA, 22 bp, Homo sapiens
atgcttctgctcatatttcatt

SEQ ID NO: 9202945 - DNA, 22 bp, Homo sapiens
atgcttctgaagaagaaaagac

SEQ ID NO: 9202946 - DNA, 22 bp, Homo sapiens
atgcttctgaagaagaaaagac

SEQ ID NO: 9202947 - DNA, 18 bp, Homo sapiens
atgcttctgatagaagca

SEQ ID NO: 9202948 - DNA, 22 bp, Homo sapiens
atgcttccaacagttctgtgaa

SEQ ID NO: 9202949 - DNA, 22 bp, Homo sapiens
atgcttccactgttctgctctc

SEQ ID NO: 9202950 - DNA, 23 bp, Homo sapiens
atgcttccacagagcttgcagcc

SEQ ID NO: 9202951 - DNA, 22 bp, Homo sapiens
atgcttccaatattctcccttt

SEQ ID NO: 9202952 - DNA, 22 bp, Homo sapiens
atgcttccctcacatatcctgg

SEQ ID NO: 9202953 - DNA, 22 bp, Homo sapiens
atgcttcccctctcatttcagc

SEQ ID NO: 9202954 - DNA, 22 bp, Homo sapiens
atgcttccatgaacgttcttgt

SEQ ID NO: 9202955 - DNA, 22 bp, Homo sapiens
atgcttctggtataagaaaaat

SEQ ID NO: 9202956 - DNA, 22 bp, Homo sapiens
atgcttctgttgcttaggaggt

SEQ ID NO: 9202957 - DNA, 22 bp, Homo sapiens
atgcttcttgagatagaaacac

SEQ ID NO: 9202958 - DNA, 22 bp, Homo sapiens
agagaaaagccatcccagccaa

SEQ ID NO: 9202959 - DNA, 22 bp, Homo sapiens
agacataggattccacatagca

SEQ ID NO: 9202960 - DNA, 22 bp, Homo sapiens
atgatttaaagtcattgtgaac

SEQ ID NO: 9202961 - DNA, 22 bp, Homo sapiens
atgattctggcaaatttattat

SEQ ID NO: 9202962 - DNA, 22 bp, Homo sapiens
atgaggagaccaaggcctgatg

SEQ ID NO: 9202963 - DNA, 22 bp, Homo sapiens
atgaggagtcaaggagtcggag

SEQ ID NO: 9202964 - DNA, 22 bp, Homo sapiens
atgaggcaaaggtggaggtggg

SEQ ID NO: 9202965 - DNA, 20 bp, Homo sapiens
atctgggcatcaattttgtg

SEQ ID NO: 9202966 - DNA, 22 bp, Homo sapiens
atctgggcagggcagcaaggcg

SEQ ID NO: 9202967 - DNA, 23 bp, Homo sapiens
atctgggcatctggagtggtcct

SEQ ID NO: 9202968 - DNA, 22 bp, Homo sapiens
atctgggcatggaggaaagaga

SEQ ID NO: 9202969 - DNA, 22 bp, Homo sapiens
atctgggccaatcctagtacca

SEQ ID NO: 9202970 - DNA, 22 bp, Homo sapiens
atctgggccagccccaagagac

SEQ ID NO: 9202971 - DNA, 22 bp, Homo sapiens
atctgggcctgttccctcacct

SEQ ID NO: 9202972 - DNA, 22 bp, Homo sapiens
atctggcttacctagggtgcct

SEQ ID NO: 9202973 - DNA, 22 bp, Homo sapiens
atctggctgagcgaggcccaca

SEQ ID NO: 9202974 - DNA, 22 bp, Homo sapiens
atctgggtcacagtggcatcta

SEQ ID NO: 9202975 - DNA, 22 bp, Homo sapiens
atctgggcgtataggtgcaagt

SEQ ID NO: 9202976 - DNA, 22 bp, Homo sapiens
atctgggctcgaatcctagctc

SEQ ID NO: 9202977 - DNA, 23 bp, Homo sapiens
atcttagcatagacttgagtccc

SEQ ID NO: 9202978 - DNA, 22 bp, Homo sapiens
atgaccagccgagataaacaga

SEQ ID NO: 9202979 - DNA, 22 bp, Homo sapiens
atgaccagccgagataaacaga

SEQ ID NO: 9202980 - DNA, 22 bp, Homo sapiens
atgaccagtttccccactgtcc

SEQ ID NO: 9202981 - DNA, 22 bp, Homo sapiens
attgtataagtctatttacaat

SEQ ID NO: 9202982 - DNA, 22 bp, Homo sapiens
attgtataagtctatttacaat

SEQ ID NO: 9202983 - DNA, 22 bp, Homo sapiens
attgagcaggcaaagtatcata

SEQ ID NO: 9202984 - DNA, 22 bp, Homo sapiens
attgaaaatgacatttgtgccc

SEQ ID NO: 9202985 - DNA, 22 bp, Homo sapiens
attgaaaaatgactattgctta

SEQ ID NO: 9202986 - DNA, 22 bp, Homo sapiens
attgaaaataaggccagaaaca

SEQ ID NO: 9202987 - DNA, 22 bp, Homo sapiens
attgtggtgtcagttataggca

SEQ ID NO: 9202988 - DNA, 22 bp, Homo sapiens
attgtggtgtcagttataggca

SEQ ID NO: 9202989 - DNA, 22 bp, Homo sapiens
attgtggtgtcagttataggca

SEQ ID NO: 9202990 - DNA, 22 bp, Homo sapiens
agatacagcctgccaggttctt

SEQ ID NO: 9202991 - DNA, 22 bp, Homo sapiens
agatacaactgtttaaacatta

SEQ ID NO: 9202992 - DNA, 22 bp, Homo sapiens
agatacaagttaagagaaagga

SEQ ID NO: 9202993 - DNA, 23 bp, Homo sapiens
agagctttctaaaatgtaaatct

SEQ ID NO: 9202994 - DNA, 22 bp, Homo sapiens
agaggccctctctgctcagtct

SEQ ID NO: 9202995 - DNA, 22 bp, Homo sapiens
agaggccagggacactgctcaa

SEQ ID NO: 9202996 - DNA, 22 bp, Homo sapiens
attattttatgtgcggcctgat

SEQ ID NO: 9202997 - DNA, 22 bp, Homo sapiens
attattttatgtgcggcctgat

SEQ ID NO: 9202998 - DNA, 22 bp, Homo sapiens
attattttatgtgcggcctgat

SEQ ID NO: 9202999 - DNA, 22 bp, Homo sapiens
agaggcctctagggcccctcag

SEQ ID NO: 9203000 - DNA, 19 bp, Homo sapiens
agaggcctcagcagctggc

SEQ ID NO: 9203001 - DNA, 22 bp, Homo sapiens
agaggccggccgagcccatggg

SEQ ID NO: 9203002 - DNA, 22 bp, Homo sapiens
agaggccggccgagcccatggg

SEQ ID NO: 9203003 - DNA, 20 bp, Homo sapiens
attctacaagaataagcatg

SEQ ID NO: 9203004 - DNA, 19 bp, Homo sapiens
attctctagtggtgcaatg

SEQ ID NO: 9203005 - DNA, 22 bp, Homo sapiens
attctctggctaaaacctgaag

SEQ ID NO: 9203006 - DNA, 22 bp, Homo sapiens
attcaaaagaccatgcagactc

SEQ ID NO: 9203007 - DNA, 22 bp, Homo sapiens
atttgaaatcccttctactgta

SEQ ID NO: 9203008 - DNA, 22 bp, Homo sapiens
atttcttgcccctgctccctga

SEQ ID NO: 9203009 - DNA, 22 bp, Homo sapiens
atttcttttcaagagggtgctt

SEQ ID NO: 9203010 - DNA, 22 bp, Homo sapiens
atttacagccttgccatctata

SEQ ID NO: 9203011 - DNA, 22 bp, Homo sapiens
atttacaggacagcttggcatt

SEQ ID NO: 9203012 - DNA, 22 bp, Homo sapiens
attttggcaacagccatgagcc

SEQ ID NO: 9203013 - DNA, 22 bp, Homo sapiens
agattccaggcctggggccaag

SEQ ID NO: 9203014 - DNA, 22 bp, Homo sapiens
agattggtgttgcagaaccatg

SEQ ID NO: 9203015 - DNA, 22 bp, Homo sapiens
agattggggtccagactcctga

SEQ ID NO: 9203016 - DNA, 22 bp, Homo sapiens
agattgggattagagatctgta

SEQ ID NO: 9203017 - DNA, 22 bp, Homo sapiens
caaacatttgacttctctcagg

SEQ ID NO: 9203018 - DNA, 22 bp, Homo sapiens
caaacatttaggaggagggagg

SEQ ID NO: 9203019 - DNA, 22 bp, Homo sapiens
caaacattgctaccagaggttt

SEQ ID NO: 9203020 - DNA, 22 bp, Homo sapiens
caaacattgggggcttcaacac

SEQ ID NO: 9203021 - DNA, 22 bp, Homo sapiens
caaacattttctacttccagga

SEQ ID NO: 9203022 - DNA, 22 bp, Homo sapiens
caaacattttaaataagggata

SEQ ID NO: 9203023 - DNA, 22 bp, Homo sapiens
caaacatttgttggaacccctg

SEQ ID NO: 9203024 - DNA, 22 bp, Homo sapiens
caaacattttgagtggtttctg

SEQ ID NO: 9203025 - DNA, 22 bp, Homo sapiens
caaagtgctgggattacaggct

SEQ ID NO: 9203026 - DNA, 22 bp, Homo sapiens
caaagtgctgggattacaggtg

SEQ ID NO: 9203027 - DNA, 22 bp, Homo sapiens
caaagtttggctctcatgacat

SEQ ID NO: 9203028 - DNA, 22 bp, Homo sapiens
agcaatgctaccgggtgattcg

SEQ ID NO: 9203029 - DNA, 22 bp, Homo sapiens
agcaatgaaatgaaatcagtct

SEQ ID NO: 9203030 - DNA, 22 bp, Homo sapiens
agcaagtggaatcatggaaaag

SEQ ID NO: 9203031 - DNA, 22 bp, Homo sapiens
agcaagtgtaagaatgcagaat

SEQ ID NO: 9203032 - DNA, 22 bp, Homo sapiens
agcaaggggcagtgaaagtgtg

SEQ ID NO: 9203033 - DNA, 22 bp, Homo sapiens
agcaaggggcagtgaaagtgtg

SEQ ID NO: 9203034 - DNA, 22 bp, Homo sapiens
attttttgttaactcaggatag

SEQ ID NO: 9203035 - DNA, 23 bp, Homo sapiens
attttttgtctttgtaactagat

SEQ ID NO: 9203036 - DNA, 22 bp, Homo sapiens
attttttcccagttagccagga

SEQ ID NO: 9203037 - DNA, 22 bp, Homo sapiens
agcaagatgaaggattcaagac

SEQ ID NO: 9203038 - DNA, 22 bp, Homo sapiens
attttttcagattgagtgttaa

SEQ ID NO: 9203039 - DNA, 21 bp, Homo sapiens
attttgtacatagaatttgtc

SEQ ID NO: 9203040 - DNA, 22 bp, Homo sapiens
cagagccaggcctgccctcttt

SEQ ID NO: 9203041 - DNA, 22 bp, Homo sapiens
cagagccagggctaggaactgg

SEQ ID NO: 9203042 - DNA, 22 bp, Homo sapiens
cagagcagtccttgtcaatcag

SEQ ID NO: 9203043 - DNA, 21 bp, Homo sapiens
cagagctgtccaaaccctgac

SEQ ID NO: 9203044 - DNA, 23 bp, Homo sapiens
cagagctggctcagagctgcctg

SEQ ID NO: 9203045 - DNA, 23 bp, Homo sapiens
cagagctggctcagagctgcctg

SEQ ID NO: 9203046 - DNA, 22 bp, Homo sapiens
cagagccatcccagcctgtggt

SEQ ID NO: 9203047 - DNA, 22 bp, Homo sapiens
cagagctgttgcggggcttggc

SEQ ID NO: 9203048 - DNA, 22 bp, Homo sapiens
agccaagaggagcctaaagcga

SEQ ID NO: 9203049 - DNA, 22 bp, Homo sapiens
agccaagaggagcctaaagcga

SEQ ID NO: 9203050 - DNA, 22 bp, Homo sapiens
agccaagaatcatgagctaata

SEQ ID NO: 9203051 - DNA, 22 bp, Homo sapiens
agccaagagatgaggctgcagg

SEQ ID NO: 9203052 - DNA, 22 bp, Homo sapiens
agccaagacatttagaaaagct

SEQ ID NO: 9203053 - DNA, 22 bp, Homo sapiens
agccaggctcaaggcctgctcc

SEQ ID NO: 9203054 - DNA, 16 bp, Homo sapiens
agccaggctgcctcgg

SEQ ID NO: 9203055 - DNA, 22 bp, Homo sapiens
agccagggctgcgagcagacag

SEQ ID NO: 9203056 - DNA, 22 bp, Homo sapiens
agccaggggagtcagctgctgg

SEQ ID NO: 9203057 - DNA, 22 bp, Homo sapiens
cagagcaccagtgggagacaag

SEQ ID NO: 9203058 - DNA, 22 bp, Homo sapiens
agccaggggagtcagctgctgg

SEQ ID NO: 9203059 - DNA, 22 bp, Homo sapiens
cagagcaggggtttcccaggtt

SEQ ID NO: 9203060 - DNA, 22 bp, Homo sapiens
agccagggacgctgcaggctac

SEQ ID NO: 9203061 - DNA, 22 bp, Homo sapiens
agccagggacgctgcaggctac

SEQ ID NO: 9203062 - DNA, 23 bp, Homo sapiens
agccagggcactggtggagattg

SEQ ID NO: 9203063 - DNA, 22 bp, Homo sapiens
cagatccatagagttctggaga

SEQ ID NO: 9203064 - DNA, 22 bp, Homo sapiens
cagatatgtggattctattagc

SEQ ID NO: 9203065 - DNA, 22 bp, Homo sapiens
agcctaggtctgggtctagcag

SEQ ID NO: 9203066 - DNA, 22 bp, Homo sapiens
agcctagggggtcctgggccac

SEQ ID NO: 9203067 - DNA, 22 bp, Homo sapiens
agcctagggggtcctgggccac

SEQ ID NO: 9203068 - DNA, 22 bp, Homo sapiens
agcccttcaagagctctgtcct

SEQ ID NO: 9203069 - DNA, 22 bp, Homo sapiens
cagatctgtttgccagatcagc

SEQ ID NO: 9203070 - DNA, 21 bp, Homo sapiens
cagatctgtaggtactaccat

SEQ ID NO: 9203071 - DNA, 22 bp, Homo sapiens
cagatctgctcctctgtccatg

SEQ ID NO: 9203072 - DNA, 22 bp, Homo sapiens
agccctgggctgtagataagca

SEQ ID NO: 9203073 - DNA, 22 bp, Homo sapiens
agccctgggctgtagataagca

SEQ ID NO: 9203074 - DNA, 20 bp, Homo sapiens
agccctcttgctttagggta

SEQ ID NO: 9203075 - DNA, 22 bp, Homo sapiens
agccctgaagctggccatgtcc

SEQ ID NO: 9203076 - DNA, 22 bp, Homo sapiens
agccctgagccagcctggtcag

SEQ ID NO: 9203077 - DNA, 22 bp, Homo sapiens
agccctcttcccagatgcctca

SEQ ID NO: 9203078 - DNA, 22 bp, Homo sapiens
agccctcttccagccagcacag

SEQ ID NO: 9203079 - DNA, 22 bp, Homo sapiens
agccctctccaccttcgaaaaa

SEQ ID NO: 9203080 - DNA, 22 bp, Homo sapiens
agccctctaagcaagagaggaa

SEQ ID NO: 9203081 - DNA, 21 bp, Homo sapiens
agccctctccaattccctttt

SEQ ID NO: 9203082 - DNA, 22 bp, Homo sapiens
agccctctctttagagatctga

SEQ ID NO: 9203083 - DNA, 22 bp, Homo sapiens
agccctctctatggccctcttg

SEQ ID NO: 9203084 - DNA, 22 bp, Homo sapiens
agccctctccctttcttcttag

SEQ ID NO: 9203085 - DNA, 22 bp, Homo sapiens
agccctctgagcctgggttgta

SEQ ID NO: 9203086 - DNA, 22 bp, Homo sapiens
agccctctgcaaacacctgata

SEQ ID NO: 9203087 - DNA, 22 bp, Homo sapiens
agccctctgagctagtcaccat

SEQ ID NO: 9203088 - DNA, 20 bp, Homo sapiens
agccctcttccagatgaagg

SEQ ID NO: 9203089 - DNA, 22 bp, Homo sapiens
agccctctgctgttctagtctc

SEQ ID NO: 9203090 - DNA, 22 bp, Homo sapiens
agccctcctggggccacgctgg

SEQ ID NO: 9203091 - DNA, 22 bp, Homo sapiens
cagagtggcgaccccctcagct

SEQ ID NO: 9203092 - DNA, 22 bp, Homo sapiens
cagagtggcgaccccctcagct

SEQ ID NO: 9203093 - DNA, 22 bp, Homo sapiens
agccctctaaaaatgataacta

SEQ ID NO: 9203094 - DNA, 22 bp, Homo sapiens
agccctcctttgttcatgctgc

SEQ ID NO: 9203095 - DNA, 22 bp, Homo sapiens
cagagtggcactctgctggatg

SEQ ID NO: 9203096 - DNA, 22 bp, Homo sapiens
cagagtggagatgtgtgtggaa

SEQ ID NO: 9203097 - DNA, 22 bp, Homo sapiens
cagagtggagatgtgtgtggaa

SEQ ID NO: 9203098 - DNA, 18 bp, Homo sapiens
cagaggagagacattcag

SEQ ID NO: 9203099 - DNA, 22 bp, Homo sapiens
cagaggtgctggagtgagtcct

SEQ ID NO: 9203100 - DNA, 22 bp, Homo sapiens
cagaggtgctggagtgagtcct

SEQ ID NO: 9203101 - DNA, 22 bp, Homo sapiens
cagcccagtgcacgcccgtttc

SEQ ID NO: 9203102 - DNA, 22 bp, Homo sapiens
cagcccagtaccaagcagttgg

SEQ ID NO: 9203103 - DNA, 22 bp, Homo sapiens
cagcccaggtggcggaggttgc

SEQ ID NO: 9203104 - DNA, 22 bp, Homo sapiens
cagcctcctgggacactcaccg

SEQ ID NO: 9203105 - DNA, 22 bp, Homo sapiens
cagcctctaagcacagcctctc

SEQ ID NO: 9203106 - DNA, 22 bp, Homo sapiens
cagccctggtgaggttggctat

SEQ ID NO: 9203107 - DNA, 22 bp, Homo sapiens
cagcccacgtcagggccactca

SEQ ID NO: 9203108 - DNA, 22 bp, Homo sapiens
cagccatcagtaaagacagctt

SEQ ID NO: 9203109 - DNA, 22 bp, Homo sapiens
cagccagctggcactgtgagta

SEQ ID NO: 9203110 - DNA, 22 bp, Homo sapiens
cagccagctggcactgtgagta

SEQ ID NO: 9203111 - DNA, 22 bp, Homo sapiens
cagccagctggcactgtgagta

SEQ ID NO: 9203112 - DNA, 22 bp, Homo sapiens
cagcagaaaatgtgggtgattt

SEQ ID NO: 9203113 - DNA, 22 bp, Homo sapiens
cagcatcagcctggctcaggcc

SEQ ID NO: 9203114 - DNA, 22 bp, Homo sapiens
cagcatggacccatcgctgagt

SEQ ID NO: 9203115 - DNA, 22 bp, Homo sapiens
cagcactgttcccagaccactg

SEQ ID NO: 9203116 - DNA, 22 bp, Homo sapiens
cagcacttgagctttcatgtaa

SEQ ID NO: 9203117 - DNA, 22 bp, Homo sapiens
cagcactggggccactggagtt

SEQ ID NO: 9203118 - DNA, 22 bp, Homo sapiens
cagcactggggccactggagtt

SEQ ID NO: 9203119 - DNA, 22 bp, Homo sapiens
cagcatggttgggttctgggga

SEQ ID NO: 9203120 - DNA, 22 bp, Homo sapiens
cagcatggggatcactgtaggc

SEQ ID NO: 9203121 - DNA, 22 bp, Homo sapiens
cagcatgggttccgggggcctg

SEQ ID NO: 9203122 - DNA, 22 bp, Homo sapiens
agcgccactgcactccagcctg

SEQ ID NO: 9203123 - DNA, 22 bp, Homo sapiens
agcgccactgcactccagcctg

SEQ ID NO: 9203124 - DNA, 22 bp, Homo sapiens
cagcctctgtggctgccacacc

SEQ ID NO: 9203125 - DNA, 22 bp, Homo sapiens
cagccttgatggatgaggaagt

SEQ ID NO: 9203126 - DNA, 22 bp, Homo sapiens
cagcctttagcattaattccaa

SEQ ID NO: 9203127 - DNA, 22 bp, Homo sapiens
cagcgctgtgggaacagggcta

SEQ ID NO: 9203128 - DNA, 22 bp, Homo sapiens
cagcgcagtgtaggtggggggc

SEQ ID NO: 9203129 - DNA, 22 bp, Homo sapiens
agctctggagccggaggatttc

SEQ ID NO: 9203130 - DNA, 22 bp, Homo sapiens
cagctgagcatcactagtctgg

SEQ ID NO: 9203131 - DNA, 22 bp, Homo sapiens
cagctggatccctgcagaactt

SEQ ID NO: 9203132 - DNA, 22 bp, Homo sapiens
cagctggcaagtggagcagggt

SEQ ID NO: 9203133 - DNA, 22 bp, Homo sapiens
cagctggcaagtggagcagggt

SEQ ID NO: 9203134 - DNA, 22 bp, Homo sapiens
cagctggcagaacctgcatcca

SEQ ID NO: 9203135 - DNA, 22 bp, Homo sapiens
cagctggcagccctggccctgc

SEQ ID NO: 9203136 - DNA, 22 bp, Homo sapiens
agctgaggaggaatgatgggta

SEQ ID NO: 9203137 - DNA, 22 bp, Homo sapiens
agctgagctcaggctgatgtaa

SEQ ID NO: 9203138 - DNA, 22 bp, Homo sapiens
agctgagctgcagatgactgta

SEQ ID NO: 9203139 - DNA, 22 bp, Homo sapiens
agctctgggagtagttccacct

SEQ ID NO: 9203140 - DNA, 22 bp, Homo sapiens
agctgagccagcagcaacagga

SEQ ID NO: 9203141 - DNA, 22 bp, Homo sapiens
agctgagcatttgatccacctc

SEQ ID NO: 9203142 - DNA, 22 bp, Homo sapiens
agctgagcatttgatccacctc

SEQ ID NO: 9203143 - DNA, 23 bp, Homo sapiens
agctctggcgttggggaggtagt

SEQ ID NO: 9203144 - DNA, 18 bp, Homo sapiens
agctctggcatacttgaa

SEQ ID NO: 9203145 - DNA, 22 bp, Homo sapiens
caaggaagacccacgcagatat

SEQ ID NO: 9203146 - DNA, 22 bp, Homo sapiens
agcagagaagacacaggcttca

SEQ ID NO: 9203147 - DNA, 22 bp, Homo sapiens
caaggcatttcgcttagagaga

SEQ ID NO: 9203148 - DNA, 22 bp, Homo sapiens
caaggcattcttgcaggtaggg

SEQ ID NO: 9203149 - DNA, 22 bp, Homo sapiens
agcaattatgataaggccgctg

SEQ ID NO: 9203150 - DNA, 22 bp, Homo sapiens
agcaattttctaagcaaaatac

SEQ ID NO: 9203151 - DNA, 22 bp, Homo sapiens
caagctggaggttggagctact

SEQ ID NO: 9203152 - DNA, 22 bp, Homo sapiens
caagcagagaggttagaacaca

SEQ ID NO: 9203153 - DNA, 22 bp, Homo sapiens
caaggaaacatgaaatgcattg

SEQ ID NO: 9203154 - DNA, 22 bp, Homo sapiens
caagcttgtttctcctgggggt

SEQ ID NO: 9203155 - DNA, 22 bp, Homo sapiens
caagtccttttcttggctcagg

SEQ ID NO: 9203156 - DNA, 22 bp, Homo sapiens
caagtccttttcttggctcagg

SEQ ID NO: 9203157 - DNA, 22 bp, Homo sapiens
caagtcctcgcttctagctgtg

SEQ ID NO: 9203158 - DNA, 22 bp, Homo sapiens
caagtcctcaaagggctctgct

SEQ ID NO: 9203159 - DNA, 22 bp, Homo sapiens
caagtccttagatggttctttg

SEQ ID NO: 9203160 - DNA, 22 bp, Homo sapiens
caattaaagaagacctgcctca

SEQ ID NO: 9203161 - DNA, 22 bp, Homo sapiens
caagggagttactgagggcggg

SEQ ID NO: 9203162 - DNA, 22 bp, Homo sapiens
caagggaattgtgtgtgagagg

SEQ ID NO: 9203163 - DNA, 22 bp, Homo sapiens
caagtccaggtgggcaaataaa

SEQ ID NO: 9203164 - DNA, 22 bp, Homo sapiens
caagtccatcagataagcaaga

SEQ ID NO: 9203165 - DNA, 22 bp, Homo sapiens
caagtccaagatcaagaagcca

SEQ ID NO: 9203166 - DNA, 22 bp, Homo sapiens
caagtccaggtcaatttaaagc

SEQ ID NO: 9203167 - DNA, 22 bp, Homo sapiens
caatttgccctgttaaattttc

SEQ ID NO: 9203168 - DNA, 22 bp, Homo sapiens
cacacatgtctctccatgctct

SEQ ID NO: 9203169 - DNA, 22 bp, Homo sapiens
cacagaaaaaggcttgaaaatc

SEQ ID NO: 9203170 - DNA, 22 bp, Homo sapiens
cacagaaaaaggcttgaaaatc

SEQ ID NO: 9203171 - DNA, 22 bp, Homo sapiens
cacacatggttccgcaggatgc

SEQ ID NO: 9203172 - DNA, 22 bp, Homo sapiens
cacacatgtctctccatgctct

SEQ ID NO: 9203173 - DNA, 22 bp, Homo sapiens
cacacatggtagcaggtacaag

SEQ ID NO: 9203174 - DNA, 22 bp, Homo sapiens
cacacatggtagcaggtacaag

SEQ ID NO: 9203175 - DNA, 22 bp, Homo sapiens
cacacatggctgccagggaggt

SEQ ID NO: 9203176 - DNA, 22 bp, Homo sapiens
cacacatgaatccctagtacct

SEQ ID NO: 9203177 - DNA, 19 bp, Homo sapiens
agcaggccacagggccagc

SEQ ID NO: 9203178 - DNA, 19 bp, Homo sapiens
cacagctggcgctgaccgc

SEQ ID NO: 9203179 - DNA, 22 bp, Homo sapiens
cacagctggggaagctgaggcc

SEQ ID NO: 9203180 - DNA, 22 bp, Homo sapiens
cacagaacaccaaagaaccttc

SEQ ID NO: 9203181 - DNA, 22 bp, Homo sapiens
cacagaacaccaaagaaccttc

SEQ ID NO: 9203182 - DNA, 22 bp, Homo sapiens
cacagaaatattgtgtcccttg

SEQ ID NO: 9203183 - DNA, 22 bp, Homo sapiens
cacagaaatattgtgtcccttg

SEQ ID NO: 9203184 - DNA, 22 bp, Homo sapiens
cacagctgccatgcagtcagtg

SEQ ID NO: 9203185 - DNA, 22 bp, Homo sapiens
cacagctgccatggctgcactt

SEQ ID NO: 9203186 - DNA, 22 bp, Homo sapiens
cacagctgccctactccatgtg

SEQ ID NO: 9203187 - DNA, 22 bp, Homo sapiens
cacagctgccatggctgcactt

SEQ ID NO: 9203188 - DNA, 22 bp, Homo sapiens
cagaaacttctggtgtcaaata

SEQ ID NO: 9203189 - DNA, 22 bp, Homo sapiens
cagaaacctccctgaatatttt

SEQ ID NO: 9203190 - DNA, 22 bp, Homo sapiens
cagaaacctgtctggagtggga

SEQ ID NO: 9203191 - DNA, 22 bp, Homo sapiens
cagaaactagatttagacacaa

SEQ ID NO: 9203192 - DNA, 22 bp, Homo sapiens
cagaaaccaaatgggatgggga

SEQ ID NO: 9203193 - DNA, 22 bp, Homo sapiens
cagaaacatgtataaagttgta

SEQ ID NO: 9203194 - DNA, 22 bp, Homo sapiens
cagaaactagatttagacacaa

SEQ ID NO: 9203195 - DNA, 22 bp, Homo sapiens
cagaaactatgtaagaaagtga

SEQ ID NO: 9203196 - DNA, 22 bp, Homo sapiens
cagaaagacctgattggcagtt

SEQ ID NO: 9203197 - DNA, 22 bp, Homo sapiens
cagaaagacctgggctcaagag

SEQ ID NO: 9203198 - DNA, 22 bp, Homo sapiens
agccaaagatcagtgtgcaagt

SEQ ID NO: 9203199 - DNA, 22 bp, Homo sapiens
agccaaagtggtatatagggaa

SEQ ID NO: 9203200 - DNA, 22 bp, Homo sapiens
agccaacagccagcatcaacca

SEQ ID NO: 9203201 - DNA, 22 bp, Homo sapiens
agccaaagatcagtgtgcaagt

SEQ ID NO: 9203202 - DNA, 20 bp, Homo sapiens
agccaaaggagaacagtgct

SEQ ID NO: 9203203 - DNA, 22 bp, Homo sapiens
cactgggtcaggatagagccca

SEQ ID NO: 9203204 - DNA, 22 bp, Homo sapiens
cactttgatgcagggctcagta

SEQ ID NO: 9203205 - DNA, 22 bp, Homo sapiens
cactggtcagcatggtagacca

SEQ ID NO: 9203206 - DNA, 22 bp, Homo sapiens
cactgggcaattctgagcctaa

SEQ ID NO: 9203207 - DNA, 22 bp, Homo sapiens
agcattttctgagagtatagat

SEQ ID NO: 9203208 - DNA, 22 bp, Homo sapiens
cactgcacaatgtagcaaagaa

SEQ ID NO: 9203209 - DNA, 22 bp, Homo sapiens
cactgcacaatgtagcaaagaa

SEQ ID NO: 9203210 - DNA, 22 bp, Homo sapiens
cactgcactccagcactccagc

SEQ ID NO: 9203211 - DNA, 22 bp, Homo sapiens
cactgcaacctctgcctcctgg

SEQ ID NO: 9203212 - DNA, 22 bp, Homo sapiens
cactgcaagctccgcctcccgg

SEQ ID NO: 9203213 - DNA, 22 bp, Homo sapiens
cactgcaagctccgcctcctgg

SEQ ID NO: 9203214 - DNA, 22 bp, Homo sapiens
cactgcaacctccgcctaccgg

SEQ ID NO: 9203215 - DNA, 22 bp, Homo sapiens
cactgcaacctccgcctcctgg

SEQ ID NO: 9203216 - DNA, 22 bp, Homo sapiens
cactgcaacctccacctcctgg

SEQ ID NO: 9203217 - DNA, 22 bp, Homo sapiens
cactgcaacctccagctctcag

SEQ ID NO: 9203218 - DNA, 22 bp, Homo sapiens
cactgcaacctccacctcctgg

SEQ ID NO: 9203219 - DNA, 22 bp, Homo sapiens
cactgcaacctccacctcctgg

SEQ ID NO: 9203220 - DNA, 22 bp, Homo sapiens
cactgcaacctccacctcctgg

SEQ ID NO: 9203221 - DNA, 22 bp, Homo sapiens
cactgcactccagcccgggcaa

SEQ ID NO: 9203222 - DNA, 22 bp, Homo sapiens
cactgcactccagcccgggcaa

SEQ ID NO: 9203223 - DNA, 22 bp, Homo sapiens
cactgcactccatcctgggaaa

SEQ ID NO: 9203224 - DNA, 22 bp, Homo sapiens
cactgcactccatcctgggaaa

SEQ ID NO: 9203225 - DNA, 22 bp, Homo sapiens
cactgcactccatcctgggaaa

SEQ ID NO: 9203226 - DNA, 22 bp, Homo sapiens
cactgcacttcagcctgggtga

SEQ ID NO: 9203227 - DNA, 22 bp, Homo sapiens
cactgcacttcagcctgggtga

SEQ ID NO: 9203228 - DNA, 22 bp, Homo sapiens
cacatttaagtgcttgttcaga

SEQ ID NO: 9203229 - DNA, 22 bp, Homo sapiens
cacctgagtgtcagtattctca

SEQ ID NO: 9203230 - DNA, 22 bp, Homo sapiens
cacctgcagggggagtcaagag

SEQ ID NO: 9203231 - DNA, 22 bp, Homo sapiens
cactagaaaggtacagattatg

SEQ ID NO: 9203232 - DNA, 22 bp, Homo sapiens
agcaggtggccacgaggaggag

SEQ ID NO: 9203233 - DNA, 22 bp, Homo sapiens
cacaggctcttctcacttgatt

SEQ ID NO: 9203234 - DNA, 22 bp, Homo sapiens
cacaggctctccagggcctgga

SEQ ID NO: 9203235 - DNA, 22 bp, Homo sapiens
cacaggctctccagggcctgga

SEQ ID NO: 9203236 - DNA, 22 bp, Homo sapiens
cacaggctgcccgcagctggga

SEQ ID NO: 9203237 - DNA, 17 bp, Homo sapiens
cacatgtctacatggat

SEQ ID NO: 9203238 - DNA, 22 bp, Homo sapiens
cacatgtcctggcgctgagccc

SEQ ID NO: 9203239 - DNA, 22 bp, Homo sapiens
cacaggctccggccttgcagcc

SEQ ID NO: 9203240 - DNA, 18 bp, Homo sapiens
cacaggctcccagtgagg

SEQ ID NO: 9203241 - DNA, 20 bp, Homo sapiens
cacaggctatatgagagcca

SEQ ID NO: 9203242 - DNA, 20 bp, Homo sapiens
cacaggctatatgagagcca

SEQ ID NO: 9203243 - DNA, 19 bp, Homo sapiens
agcaggctaggctgcctct

SEQ ID NO: 9203244 - DNA, 20 bp, Homo sapiens
cacaggctatatgagagcca

SEQ ID NO: 9203245 - DNA, 22 bp, Homo sapiens
agcaggcctcatgcaccagcta

SEQ ID NO: 9203246 - DNA, 22 bp, Homo sapiens
aagagagagcattcttctgtta

SEQ ID NO: 9203247 - DNA, 22 bp, Homo sapiens
aaatatagcaattatgcctact

SEQ ID NO: 9203248 - DNA, 22 bp, Homo sapiens
aaatatacggtccctaacagtc

SEQ ID NO: 9203249 - DNA, 22 bp, Homo sapiens
aagagtttctgggtcaaggatt

SEQ ID NO: 9203250 - DNA, 22 bp, Homo sapiens
aaatatagtgacacttatagtc

SEQ ID NO: 9203251 - DNA, 22 bp, Homo sapiens
aaatattattgcttaaggggag

SEQ ID NO: 9203252 - DNA, 22 bp, Homo sapiens
aagagttttagacaaactgatt

SEQ ID NO: 9203253 - DNA, 22 bp, Homo sapiens
aagagtttgtcagatctgcacg

SEQ ID NO: 9203254 - DNA, 22 bp, Homo sapiens
aaatacataaaggttgtaccag

SEQ ID NO: 9203255 - DNA, 22 bp, Homo sapiens
aagagagaactcccttcgccag

SEQ ID NO: 9203256 - DNA, 22 bp, Homo sapiens
aaatacatacactgtacgtggc

SEQ ID NO: 9203257 - DNA, 22 bp, Homo sapiens
aagaagtctggagcaatgcaat

SEQ ID NO: 9203258 - DNA, 22 bp, Homo sapiens
aaagttgcacaactttgtatac

SEQ ID NO: 9203259 - DNA, 22 bp, Homo sapiens
aaagttgctggctttggttcat

SEQ ID NO: 9203260 - DNA, 22 bp, Homo sapiens
aagaagcagagctgtgggtgtt

SEQ ID NO: 9203261 - DNA, 22 bp, Homo sapiens
aagaagcagctgccaggccagt

SEQ ID NO: 9203262 - DNA, 22 bp, Homo sapiens
aagaagcaggtcacagacaggg

SEQ ID NO: 9203263 - DNA, 22 bp, Homo sapiens
aagaagcaggtcacagacaggg

SEQ ID NO: 9203264 - DNA, 22 bp, Homo sapiens
aagaagcagctgccaggccagt

SEQ ID NO: 9203265 - DNA, 22 bp, Homo sapiens
aagaagcatggctgtagattcc

SEQ ID NO: 9203266 - DNA, 22 bp, Homo sapiens
aaatgcaaggcacattcctttt

SEQ ID NO: 9203267 - DNA, 22 bp, Homo sapiens
aaatgcaaggcacattcctttt

SEQ ID NO: 9203268 - DNA, 22 bp, Homo sapiens
aaatgcttgctcttgattattt

SEQ ID NO: 9203269 - DNA, 20 bp, Homo sapiens
aaatgctgtaatgtttggga

SEQ ID NO: 9203270 - DNA, 22 bp, Homo sapiens
aaatatttgtctgaggcggttg

SEQ ID NO: 9203271 - DNA, 22 bp, Homo sapiens
aaatattggtaggatgcttgtt

SEQ ID NO: 9203272 - DNA, 23 bp, Homo sapiens
aaatattcttttttagtaagtgc

SEQ ID NO: 9203273 - DNA, 22 bp, Homo sapiens
aaatgaggttaatacagtgctt

SEQ ID NO: 9203274 - DNA, 22 bp, Homo sapiens
aaagccaaatgaaagatggttc

SEQ ID NO: 9203275 - DNA, 22 bp, Homo sapiens
aaagccaaatgaaagatggttc

SEQ ID NO: 9203276 - DNA, 22 bp, Homo sapiens
aaagcattgtttcaagattaac

SEQ ID NO: 9203277 - DNA, 22 bp, Homo sapiens
aaagcatattaggactgaatta

SEQ ID NO: 9203278 - DNA, 22 bp, Homo sapiens
aaagcatagaattagagttagg

SEQ ID NO: 9203279 - DNA, 22 bp, Homo sapiens
aaagcatagttcatctgtccat

SEQ ID NO: 9203280 - DNA, 22 bp, Homo sapiens
aaagcatagttcatctgtccat

SEQ ID NO: 9203281 - DNA, 22 bp, Homo sapiens
aaagcatggcatgaagaacatg

SEQ ID NO: 9203282 - DNA, 22 bp, Homo sapiens
aaagcatgactcaagaattact

SEQ ID NO: 9203283 - DNA, 22 bp, Homo sapiens
aaagcatgttgggtccctcttt

SEQ ID NO: 9203284 - DNA, 22 bp, Homo sapiens
aaagcatgtgaatagaatatgg

SEQ ID NO: 9203285 - DNA, 22 bp, Homo sapiens
aaattcagcatcctgcactgga

SEQ ID NO: 9203286 - DNA, 22 bp, Homo sapiens
aaattgctctttaaaagtactg

SEQ ID NO: 9203287 - DNA, 22 bp, Homo sapiens
aaattgtatattccatttgtat

SEQ ID NO: 9203288 - DNA, 22 bp, Homo sapiens
aaagcagtagttttcaaatagt

SEQ ID NO: 9203289 - DNA, 22 bp, Homo sapiens
aaagcagtccttcccttaaggt

SEQ ID NO: 9203290 - DNA, 22 bp, Homo sapiens
aaagcagtgcaccttaattgat

SEQ ID NO: 9203291 - DNA, 19 bp, Homo sapiens
aaagcagtgcatcctcttt

SEQ ID NO: 9203292 - DNA, 22 bp, Homo sapiens
aacatgatggggaagaacaaga

SEQ ID NO: 9203293 - DNA, 22 bp, Homo sapiens
aacatgagtgataaaattacct

SEQ ID NO: 9203294 - DNA, 22 bp, Homo sapiens
aaaggctccttctcccatgacc

SEQ ID NO: 9203295 - DNA, 22 bp, Homo sapiens
aaagtcacatagcatcacttct

SEQ ID NO: 9203296 - DNA, 22 bp, Homo sapiens
aaagggaatgtgtaggacatgt

SEQ ID NO: 9203297 - DNA, 22 bp, Homo sapiens
aacttctgccaaacagctgtta

SEQ ID NO: 9203298 - DNA, 22 bp, Homo sapiens
aacttgaactgatgagtgttag

SEQ ID NO: 9203299 - DNA, 22 bp, Homo sapiens
aacttgaagaggctttttggca

SEQ ID NO: 9203300 - DNA, 22 bp, Homo sapiens
aacttgaatgagaacttttgcc

SEQ ID NO: 9203301 - DNA, 22 bp, Homo sapiens
aacttgaaactgttccagaaaa

SEQ ID NO: 9203302 - DNA, 22 bp, Homo sapiens
aacttcttggtcctgagctgtt

SEQ ID NO: 9203303 - DNA, 22 bp, Homo sapiens
aaagtctttattttgtatcttt

SEQ ID NO: 9203304 - DNA, 20 bp, Homo sapiens
aaagtctgtttatctctgga

SEQ ID NO: 9203305 - DNA, 22 bp, Homo sapiens
aaagtcctttttgccatgcaag

SEQ ID NO: 9203306 - DNA, 22 bp, Homo sapiens
aaagtcctgtttgaaggacctg

SEQ ID NO: 9203307 - DNA, 22 bp, Homo sapiens
aaagtcctagcgatccacagaa

SEQ ID NO: 9203308 - DNA, 22 bp, Homo sapiens
aaaatactgtggagtgttgaaa

SEQ ID NO: 9203309 - DNA, 22 bp, Homo sapiens
aaaatactactgtcttcttccc

SEQ ID NO: 9203310 - DNA, 22 bp, Homo sapiens
aaaatacacatactaggggaaa

SEQ ID NO: 9203311 - DNA, 22 bp, Homo sapiens
aaaataacttctactatttgca

SEQ ID NO: 9203312 - DNA, 22 bp, Homo sapiens
aaaagttacctctgtaatataa

SEQ ID NO: 9203313 - DNA, 22 bp, Homo sapiens
aaaagttcattagtgagcttct

SEQ ID NO: 9203314 - DNA, 21 bp, Homo sapiens
aaaaggaaggtctgtttgggg

SEQ ID NO: 9203315 - DNA, 22 bp, Homo sapiens
aaaagctctttctgctgtagat

SEQ ID NO: 9203316 - DNA, 22 bp, Homo sapiens
aaagcagcagcacctgcatttc

SEQ ID NO: 9203317 - DNA, 22 bp, Homo sapiens
aaagcagccggttccctggtct

SEQ ID NO: 9203318 - DNA, 22 bp, Homo sapiens
aaagcagggcgatgtcctcctc

SEQ ID NO: 9203319 - DNA, 22 bp, Homo sapiens
aaaatgatgctgtaatttggca

SEQ ID NO: 9203320 - DNA, 20 bp, Homo sapiens
aaaatgatgggcagggcagg

SEQ ID NO: 9203321 - DNA, 22 bp, Homo sapiens
aaaatgcatgagaatgtgctcg

SEQ ID NO: 9203322 - DNA, 22 bp, Homo sapiens
aaaacactgcaaagctgattgg

SEQ ID NO: 9203323 - DNA, 22 bp, Homo sapiens
aaaacacaagaagcagggtaca

SEQ ID NO: 9203324 - DNA, 22 bp, Homo sapiens
aaaacacaagaagcagggtaca

SEQ ID NO: 9203325 - DNA, 22 bp, Homo sapiens
aaaacagtttaggcatcacagt

SEQ ID NO: 9203326 - DNA, 22 bp, Homo sapiens
aaaacagtttttgctaactgct

SEQ ID NO: 9203327 - DNA, 22 bp, Homo sapiens
aaaacagtttaggcatcacagt

SEQ ID NO: 9203328 - DNA, 22 bp, Homo sapiens
aaaacagtttaggcatcacagt

SEQ ID NO: 9203329 - DNA, 22 bp, Homo sapiens
aaaagcaagttgcctaggttga

SEQ ID NO: 9203330 - DNA, 22 bp, Homo sapiens
aaaagcaagttgcctaggttga

SEQ ID NO: 9203331 - DNA, 22 bp, Homo sapiens
aaaagcaattgcgggttttgcc

SEQ ID NO: 9203332 - DNA, 22 bp, Homo sapiens
aaaagcaattgcgggttttgcc

SEQ ID NO: 9203333 - DNA, 22 bp, Homo sapiens
aaaagcaattgcagttcttgcc

SEQ ID NO: 9203334 - DNA, 22 bp, Homo sapiens
aaaagcaattgcagttcttgcc

SEQ ID NO: 9203335 - DNA, 22 bp, Homo sapiens
aaaagcaattgcagttcttgcc

SEQ ID NO: 9203336 - DNA, 22 bp, Homo sapiens
aaaagcagaccacgctttgtgg

SEQ ID NO: 9203337 - DNA, 22 bp, Homo sapiens
aaaagccaaggtcctcttcaga

SEQ ID NO: 9203338 - DNA, 22 bp, Homo sapiens
aaaagcaaggcagtctgtctga

SEQ ID NO: 9203339 - DNA, 22 bp, Homo sapiens
aaaagcaaggcagtctgtctga

SEQ ID NO: 9203340 - DNA, 22 bp, Homo sapiens
aaaagcaagaggctggattaaa

SEQ ID NO: 9203341 - DNA, 22 bp, Homo sapiens
aaaagcaagaggctggattaaa

SEQ ID NO: 9203342 - DNA, 22 bp, Homo sapiens
aaaagcaagaggctggattaaa

SEQ ID NO: 9203343 - DNA, 22 bp, Homo sapiens
aaaagcaaggcagtctgtctga

SEQ ID NO: 9203344 - DNA, 22 bp, Homo sapiens
aaaagagtcttaggcagtcata

SEQ ID NO: 9203345 - DNA, 22 bp, Homo sapiens
aaaacattgaattgcacactat

SEQ ID NO: 9203346 - DNA, 22 bp, Homo sapiens
aaaacattgaattgcacactat

SEQ ID NO: 9203347 - DNA, 22 bp, Homo sapiens
aaaacattttactgccatctca

SEQ ID NO: 9203348 - DNA, 22 bp, Homo sapiens
aaaacattctgtgaactctcaa

SEQ ID NO: 9203349 - DNA, 22 bp, Homo sapiens
aaatacacgtacatgtgtaaaa

SEQ ID NO: 9203350 - DNA, 22 bp, Homo sapiens
aaatacacgtacatgtgtaaaa

SEQ ID NO: 9203351 - DNA, 22 bp, Homo sapiens
aaataacagtcagggacaacat

SEQ ID NO: 9203352 - DNA, 22 bp, Homo sapiens
aaataaaggtccactttagggc

SEQ ID NO: 9203353 - DNA, 22 bp, Homo sapiens
aaataaaggaactgttttccca

SEQ ID NO: 9203354 - DNA, 22 bp, Homo sapiens
aaataaactgaagcacagagag

SEQ ID NO: 9203355 - DNA, 20 bp, Homo sapiens
aaatccagtgtgtattttac

SEQ ID NO: 9203356 - DNA, 22 bp, Homo sapiens
aaatccagtgggtcctcatgag

SEQ ID NO: 9203357 - DNA, 22 bp, Homo sapiens
aaatacagagttgcttaaaagc

SEQ ID NO: 9203358 - DNA, 22 bp, Homo sapiens
aaatccagtgttcaaagtttga

SEQ ID NO: 9203359 - DNA, 22 bp, Homo sapiens
aaagacagatggcaaggatgat

SEQ ID NO: 9203360 - DNA, 22 bp, Homo sapiens
aaagacagagctgtaggggaaa

SEQ ID NO: 9203361 - DNA, 22 bp, Homo sapiens
aaagacagtggattcaaaatcc

SEQ ID NO: 9203362 - DNA, 22 bp, Homo sapiens
aaagacatatttctaagtttat

SEQ ID NO: 9203363 - DNA, 22 bp, Homo sapiens
aaagacacacagtgcttcagtt

SEQ ID NO: 9203364 - DNA, 22 bp, Homo sapiens
aaagtacacacagagccaagaa

SEQ ID NO: 9203365 - DNA, 22 bp, Homo sapiens
aaagtacagccacatccaagta

SEQ ID NO: 9203366 - DNA, 22 bp, Homo sapiens
aaagtacaggaaagcctagcca

SEQ ID NO: 9203367 - DNA, 22 bp, Homo sapiens
aaagtcagttggccagatcact

SEQ ID NO: 9203368 - DNA, 22 bp, Homo sapiens
aaagtcagttggccagatcact

SEQ ID NO: 9203369 - DNA, 22 bp, Homo sapiens
aaagtacatagcatattccaac

SEQ ID NO: 9203370 - DNA, 22 bp, Homo sapiens
aaagtacatgagattcaagggg

SEQ ID NO: 9203371 - DNA, 22 bp, Homo sapiens
aaagtacatgcaattcttctga

SEQ ID NO: 9203372 - DNA, 22 bp, Homo sapiens
aaagttttctgccttcattaga

SEQ ID NO: 9203373 - DNA, 22 bp, Homo sapiens
aaagttttgttgattgtggaat

SEQ ID NO: 9203374 - DNA, 22 bp, Homo sapiens
aaataaactgaagcacagagag

SEQ ID NO: 9203375 - DNA, 22 bp, Homo sapiens
aaagttctaaaactctttgtga

SEQ ID NO: 9203376 - DNA, 22 bp, Homo sapiens
aaagctcacagtaatacaaggc

SEQ ID NO: 9203377 - DNA, 22 bp, Homo sapiens
aaaattttactggtgtttcctt

SEQ ID NO: 9203378 - DNA, 22 bp, Homo sapiens
aaaattttcagcttgacttgat

SEQ ID NO: 9203379 - DNA, 22 bp, Homo sapiens
aaaattgtcagaagttgatctt

SEQ ID NO: 9203380 - DNA, 22 bp, Homo sapiens
aaaattgtgaaggtttctgaaa

SEQ ID NO: 9203381 - DNA, 19 bp, Homo sapiens
aagaagcaataagctgtga

SEQ ID NO: 9203382 - DNA, 19 bp, Homo sapiens
aagaagcaataagctgtga

SEQ ID NO: 9203383 - DNA, 22 bp, Homo sapiens
acaaaaattagctgggcatggt

SEQ ID NO: 9203384 - DNA, 22 bp, Homo sapiens
acaaaacagtgttcctgcccct

SEQ ID NO: 9203385 - DNA, 22 bp, Homo sapiens
aattttatctctaagcaggctt

SEQ ID NO: 9203386 - DNA, 22 bp, Homo sapiens
aagaacaggttctagaaccatt

SEQ ID NO: 9203387 - DNA, 22 bp, Homo sapiens
aatgtacaagggttccagtttt

SEQ ID NO: 9203388 - DNA, 22 bp, Homo sapiens
aagaacattttgtagaatgaca

SEQ ID NO: 9203389 - DNA, 18 bp, Homo sapiens
aagaactgaggtcctaga

SEQ ID NO: 9203390 - DNA, 17 bp, Homo sapiens
aagaatcattagagaag

SEQ ID NO: 9203391 - DNA, 23 bp, Homo sapiens
aagaatcagtaagtaaggagacc

SEQ ID NO: 9203392 - DNA, 22 bp, Homo sapiens
aagaatatagattttttgaagt

SEQ ID NO: 9203393 - DNA, 22 bp, Homo sapiens
acaaaagcactgcagagtaagc

SEQ ID NO: 9203394 - DNA, 23 bp, Homo sapiens
aagaatctcagaattagaaatac

SEQ ID NO: 9203395 - DNA, 22 bp, Homo sapiens
aagaatctatggtacatccaag

SEQ ID NO: 9203396 - DNA, 22 bp, Homo sapiens
acaaagctagagaagagaattg

SEQ ID NO: 9203397 - DNA, 22 bp, Homo sapiens
aagaatctctgatcaggcttta

SEQ ID NO: 9203398 - DNA, 15 bp, Homo sapiens
aagaatctgaagctt

SEQ ID NO: 9203399 - DNA, 22 bp, Homo sapiens
aagaatctctctactttattac

SEQ ID NO: 9203400 - DNA, 18 bp, Homo sapiens
aagaatctctgactcttt

SEQ ID NO: 9203401 - DNA, 22 bp, Homo sapiens
aagaatctccatctgattcact

SEQ ID NO: 9203402 - DNA, 22 bp, Homo sapiens
aagaatctccattcctgtttta

SEQ ID NO: 9203403 - DNA, 22 bp, Homo sapiens
aagaatctctcaagtgtgacaa

SEQ ID NO: 9203404 - DNA, 22 bp, Homo sapiens
acaaatatttactgaatccact

SEQ ID NO: 9203405 - DNA, 22 bp, Homo sapiens
acaatgttctacatatacataa

SEQ ID NO: 9203406 - DNA, 22 bp, Homo sapiens
acacagaagctttttctattcc

SEQ ID NO: 9203407 - DNA, 22 bp, Homo sapiens
acacagagctggaactgcttca

SEQ ID NO: 9203408 - DNA, 22 bp, Homo sapiens
acacagagctggaactgcttca

SEQ ID NO: 9203409 - DNA, 22 bp, Homo sapiens
acacagagcaaatcatgacaga

SEQ ID NO: 9203410 - DNA, 22 bp, Homo sapiens
acacagctcacaacgtgtgcat

SEQ ID NO: 9203411 - DNA, 22 bp, Homo sapiens
acacagctcagtgcctccaaga

SEQ ID NO: 9203412 - DNA, 22 bp, Homo sapiens
acacagcaaggtctgactttgg

SEQ ID NO: 9203413 - DNA, 22 bp, Homo sapiens
acacagcaaggtctgactttgg

SEQ ID NO: 9203414 - DNA, 22 bp, Homo sapiens
aagataagagggaggtgcctca

SEQ ID NO: 9203415 - DNA, 22 bp, Homo sapiens
acaaatttcataggcaaatttt

SEQ ID NO: 9203416 - DNA, 22 bp, Homo sapiens
acaaattgttgggactcagccc

SEQ ID NO: 9203417 - DNA, 22 bp, Homo sapiens
acaaatttgaatcctgacttct

SEQ ID NO: 9203418 - DNA, 22 bp, Homo sapiens
acaaatttgtgtagttatggca

SEQ ID NO: 9203419 - DNA, 22 bp, Homo sapiens
acaacaaaatcactagtcttcc

SEQ ID NO: 9203420 - DNA, 22 bp, Homo sapiens
acaaatttgtgtagttatggca

SEQ ID NO: 9203421 - DNA, 22 bp, Homo sapiens
acaatagagttctcataggaca

SEQ ID NO: 9203422 - DNA, 22 bp, Homo sapiens
acaatgtgggcatgagaaacca

SEQ ID NO: 9203423 - DNA, 22 bp, Homo sapiens
acaatgtcaaaataggaaacat

SEQ ID NO: 9203424 - DNA, 22 bp, Homo sapiens
acagaaagatgatttgaaatgg

SEQ ID NO: 9203425 - DNA, 22 bp, Homo sapiens
acacttgccatgctgcacactg

SEQ ID NO: 9203426 - DNA, 22 bp, Homo sapiens
acacttgataggtcaaatcagt

SEQ ID NO: 9203427 - DNA, 22 bp, Homo sapiens
acacttctcccatctcctgttg

SEQ ID NO: 9203428 - DNA, 22 bp, Homo sapiens
acacttctattccctgcacaaa

SEQ ID NO: 9203429 - DNA, 18 bp, Homo sapiens
acacttcctggtggtgtg

SEQ ID NO: 9203430 - DNA, 22 bp, Homo sapiens
acacatatatacatatttgtgc

SEQ ID NO: 9203431 - DNA, 23 bp, Homo sapiens
acagaaatcatttgtaaggtacc

SEQ ID NO: 9203432 - DNA, 23 bp, Homo sapiens
acagaaagttctgctggacagag

SEQ ID NO: 9203433 - DNA, 18 bp, Homo sapiens
acagaaatagctgtgcct

SEQ ID NO: 9203434 - DNA, 22 bp, Homo sapiens
acagactgattcattgctcagg

SEQ ID NO: 9203435 - DNA, 22 bp, Homo sapiens
acagagcaacttgagtatcctc

SEQ ID NO: 9203436 - DNA, 22 bp, Homo sapiens
aagcccagatgtgagaactgag

SEQ ID NO: 9203437 - DNA, 22 bp, Homo sapiens
acagccaggcccagcacgcagg

SEQ ID NO: 9203438 - DNA, 22 bp, Homo sapiens
acagccaggacttggccctctt

SEQ ID NO: 9203439 - DNA, 22 bp, Homo sapiens
acagccaggacttggccctctt

SEQ ID NO: 9203440 - DNA, 22 bp, Homo sapiens
aagcccagggaatggtcgggag

SEQ ID NO: 9203441 - DNA, 22 bp, Homo sapiens
aagcccagcatccctgcaccag

SEQ ID NO: 9203442 - DNA, 22 bp, Homo sapiens
aagcccagtaccttcagtgagg

SEQ ID NO: 9203443 - DNA, 19 bp, Homo sapiens
aagcccagtgtatgctctt

SEQ ID NO: 9203444 - DNA, 22 bp, Homo sapiens
aagcccagtttcacactgagac

SEQ ID NO: 9203445 - DNA, 22 bp, Homo sapiens
acagcagggggagctgttggac

SEQ ID NO: 9203446 - DNA, 22 bp, Homo sapiens
aagcagtgcgctcatctaaggg

SEQ ID NO: 9203447 - DNA, 22 bp, Homo sapiens
aatatttatatttctcttccct

SEQ ID NO: 9203448 - DNA, 22 bp, Homo sapiens
aatattgtttcaagatcacaga

SEQ ID NO: 9203449 - DNA, 22 bp, Homo sapiens
aatattgagaaccagcatgttt

SEQ ID NO: 9203450 - DNA, 22 bp, Homo sapiens
aatccagattccagaaaatcgc

SEQ ID NO: 9203451 - DNA, 22 bp, Homo sapiens
aatatttcaaaaggaaacacag

SEQ ID NO: 9203452 - DNA, 22 bp, Homo sapiens
aatacataataagttttgtctg

SEQ ID NO: 9203453 - DNA, 22 bp, Homo sapiens
aatataattttattcctagagt

SEQ ID NO: 9203454 - DNA, 22 bp, Homo sapiens
aatatcctttccagagtacagt

SEQ ID NO: 9203455 - DNA, 22 bp, Homo sapiens
aatacagatattcagtggtact

SEQ ID NO: 9203456 - DNA, 22 bp, Homo sapiens
aataatgtacatacatatttcg

SEQ ID NO: 9203457 - DNA, 22 bp, Homo sapiens
aataatgaacatttaaaacctg

SEQ ID NO: 9203458 - DNA, 22 bp, Homo sapiens
aagttaaggaagtcatactatg

SEQ ID NO: 9203459 - DNA, 22 bp, Homo sapiens
aatgcacatgtcttggcctcac

SEQ ID NO: 9203460 - DNA, 22 bp, Homo sapiens
aatgcacctaccttgattctgc

SEQ ID NO: 9203461 - DNA, 18 bp, Homo sapiens
aatgaaatgtacaccttt

SEQ ID NO: 9203462 - DNA, 22 bp, Homo sapiens
aatgtaaagctcaggtcaggag

SEQ ID NO: 9203463 - DNA, 22 bp, Homo sapiens
aatgtaaacagcaagagaaggg

SEQ ID NO: 9203464 - DNA, 22 bp, Homo sapiens
aactttacttgaaagaacatgt

SEQ ID NO: 9203465 - DNA, 22 bp, Homo sapiens
aatgtacaaaccttctttgtag

SEQ ID NO: 9203466 - DNA, 22 bp, Homo sapiens
aactttaaagaggaggcttggg

SEQ ID NO: 9203467 - DNA, 22 bp, Homo sapiens
aactttacactgctttacatga

SEQ ID NO: 9203468 - DNA, 23 bp, Homo sapiens
aactttactattttgaataatgc

SEQ ID NO: 9203469 - DNA, 22 bp, Homo sapiens
aactttaaaaaatatgtctgtt

SEQ ID NO: 9203470 - DNA, 20 bp, Homo sapiens
aacttgttttgttttctaat

SEQ ID NO: 9203471 - DNA, 22 bp, Homo sapiens
aacttgtttcttccattcaaca

SEQ ID NO: 9203472 - DNA, 22 bp, Homo sapiens
aatgctttaattgcatgtagtg

SEQ ID NO: 9203473 - DNA, 22 bp, Homo sapiens
aagtaacttatttgcaaacagg

SEQ ID NO: 9203474 - DNA, 22 bp, Homo sapiens
aagtaactaaagatatccattt

SEQ ID NO: 9203475 - DNA, 22 bp, Homo sapiens
aagtccagtgatactggcagga

SEQ ID NO: 9203476 - DNA, 22 bp, Homo sapiens
aagggctgcaatccaaaacact

SEQ ID NO: 9203477 - DNA, 21 bp, Homo sapiens
aaggtctgtaaagtgacagga

SEQ ID NO: 9203478 - DNA, 22 bp, Homo sapiens
aaggtctggatgatgggtgtgc

SEQ ID NO: 9203479 - DNA, 22 bp, Homo sapiens
aaggtctgtattagagtttcat

SEQ ID NO: 9203480 - DNA, 22 bp, Homo sapiens
aagtctgtagaaaaacagttta

SEQ ID NO: 9203481 - DNA, 22 bp, Homo sapiens
aagtgaaacatgtatctcttta

SEQ ID NO: 9203482 - DNA, 22 bp, Homo sapiens
aagtcttttgttcaggctggca

SEQ ID NO: 9203483 - DNA, 22 bp, Homo sapiens
aacagtaacgagatgtcctaac

SEQ ID NO: 9203484 - DNA, 22 bp, Homo sapiens
aacagtgatatcaagacagaca

SEQ ID NO: 9203485 - DNA, 22 bp, Homo sapiens
aacagtgtcaggattacagata

SEQ ID NO: 9203486 - DNA, 22 bp, Homo sapiens
aacagttatctcacatatggaa

SEQ ID NO: 9203487 - DNA, 22 bp, Homo sapiens
aacagttattatcacattagtg

SEQ ID NO: 9203488 - DNA, 22 bp, Homo sapiens
aacagttacccttaagatcttt

SEQ ID NO: 9203489 - DNA, 22 bp, Homo sapiens
aacagttacccttaagatcttt

SEQ ID NO: 9203490 - DNA, 22 bp, Homo sapiens
aacagtgtttttcttcagcact

SEQ ID NO: 9203491 - DNA, 22 bp, Homo sapiens
aaatggaagaagtgcaatactg

SEQ ID NO: 9203492 - DNA, 22 bp, Homo sapiens
aaatggagatgataagagggtt

SEQ ID NO: 9203493 - DNA, 19 bp, Homo sapiens
aaatggagctaatcttgtc

SEQ ID NO: 9203494 - DNA, 22 bp, Homo sapiens
aaatggaggcaaaattggtttc

SEQ ID NO: 9203495 - DNA, 22 bp, Homo sapiens
aaatggaggcacgcagtggtta

SEQ ID NO: 9203496 - DNA, 22 bp, Homo sapiens
aaatggagttctaagtatagta

SEQ ID NO: 9203497 - DNA, 16 bp, Homo sapiens
aaggagggaagagaat

SEQ ID NO: 9203498 - DNA, 22 bp, Homo sapiens
aaggagggaaagcagtgcttct

SEQ ID NO: 9203499 - DNA, 22 bp, Homo sapiens
aaggagaagggtaatcaacaca

SEQ ID NO: 9203500 - DNA, 22 bp, Homo sapiens
aaggagtctgggccattcagag

SEQ ID NO: 9203501 - DNA, 23 bp, Homo sapiens
aaggccagagagaggctagtgtc

SEQ ID NO: 9203502 - DNA, 22 bp, Homo sapiens
aaggccaggtccctgcagtgca

SEQ ID NO: 9203503 - DNA, 22 bp, Homo sapiens
aaggccatgaccacttgctgtg

SEQ ID NO: 9203504 - DNA, 22 bp, Homo sapiens
aaggctgaaagaccttgaacct

SEQ ID NO: 9203505 - DNA, 22 bp, Homo sapiens
aaggctgaattcaagggtaggc

SEQ ID NO: 9203506 - DNA, 22 bp, Homo sapiens
aaggcccagcctggagcttgtt

SEQ ID NO: 9203507 - DNA, 22 bp, Homo sapiens
aaggcccagcgtgacctcagtg

SEQ ID NO: 9203508 - DNA, 22 bp, Homo sapiens
aagggaggccagaggttttgca

SEQ ID NO: 9203509 - DNA, 22 bp, Homo sapiens
aaggctgagacagcacaggtcc

SEQ ID NO: 9203510 - DNA, 22 bp, Homo sapiens
aaggctgacgtttgtgtttatt

SEQ ID NO: 9203511 - DNA, 21 bp, Homo sapiens
aaggctgagacaactcaggag

SEQ ID NO: 9203512 - DNA, 22 bp, Homo sapiens
aaggctgactcaacagggggcc

SEQ ID NO: 9203513 - DNA, 22 bp, Homo sapiens
aaggctgaccagtttacacttt

SEQ ID NO: 9203514 - DNA, 22 bp, Homo sapiens
aagggcaggcacccaccctcac

SEQ ID NO: 9203515 - DNA, 22 bp, Homo sapiens
aagggcaggcacccaccctcac

SEQ ID NO: 9203516 - DNA, 21 bp, Homo sapiens
agaggaagtgattggtctggc

SEQ ID NO: 9203517 - DNA, 22 bp, Homo sapiens
agaggaagtaatcaggacctgc

SEQ ID NO: 9203518 - DNA, 22 bp, Homo sapiens
agaggaagtaatcaggacctgc

SEQ ID NO: 9203519 - DNA, 22 bp, Homo sapiens
agaggaaggatgcatatccaaa

SEQ ID NO: 9203520 - DNA, 22 bp, Homo sapiens
agaggaaggatgcatatccaaa

SEQ ID NO: 9203521 - DNA, 22 bp, Homo sapiens
aatttcaattacttttgcacca

SEQ ID NO: 9203522 - DNA, 22 bp, Homo sapiens
aattacagtcggagcagcactg

SEQ ID NO: 9203523 - DNA, 22 bp, Homo sapiens
aattacagtcggagcagcactg

SEQ ID NO: 9203524 - DNA, 22 bp, Homo sapiens
agagctgaattcaagtgctggc

SEQ ID NO: 9203525 - DNA, 22 bp, Homo sapiens
agagcctggctcccagctaccg

SEQ ID NO: 9203526 - DNA, 22 bp, Homo sapiens
agagctggaagctgctcttaga

SEQ ID NO: 9203527 - DNA, 22 bp, Homo sapiens
agagcaagtgacagaaacaggg

SEQ ID NO: 9203528 - DNA, 23 bp, Homo sapiens
agagcaaggaaatgaggtgtgat

SEQ ID NO: 9203529 - DNA, 22 bp, Homo sapiens
agagcaatttcttctccaagtt

SEQ ID NO: 9203530 - DNA, 22 bp, Homo sapiens
agagcaattagcttaggtaaaa

SEQ ID NO: 9203531 - DNA, 22 bp, Homo sapiens
aatgtgtgaattgagagaagag

SEQ ID NO: 9203532 - DNA, 22 bp, Homo sapiens
agagaaggggtaaagagtcctg

SEQ ID NO: 9203533 - DNA, 19 bp, Homo sapiens
agacatgagacacaggatg

SEQ ID NO: 9203534 - DNA, 22 bp, Homo sapiens
agacatgagaaacccaccagag

SEQ ID NO: 9203535 - DNA, 22 bp, Homo sapiens
agacatgaaaattccaaacatc

SEQ ID NO: 9203536 - DNA, 22 bp, Homo sapiens
aatgccttgcctgctacaactt

SEQ ID NO: 9203537 - DNA, 22 bp, Homo sapiens
aatgccttggagagcctagagg

SEQ ID NO: 9203538 - DNA, 22 bp, Homo sapiens
agacatggagaaggagccagtg

SEQ ID NO: 9203539 - DNA, 22 bp, Homo sapiens
agacattatgctgagtgaaaga

SEQ ID NO: 9203540 - DNA, 22 bp, Homo sapiens
aatgtataaccataggaaattt

SEQ ID NO: 9203541 - DNA, 22 bp, Homo sapiens
agagtgaagttcatcgtgcagc

SEQ ID NO: 9203542 - DNA, 22 bp, Homo sapiens
agagtgtggaaatgttcagagt

SEQ ID NO: 9203543 - DNA, 22 bp, Homo sapiens
agagttatcactccatgcagct

SEQ ID NO: 9203544 - DNA, 22 bp, Homo sapiens
agagttatggacttaatgcagg

SEQ ID NO: 9203545 - DNA, 22 bp, Homo sapiens
aatttgattccctgcacctgtt

SEQ ID NO: 9203546 - DNA, 22 bp, Homo sapiens
agatctttagtgaagctaaatc

SEQ ID NO: 9203547 - DNA, 22 bp, Homo sapiens
agatgcagagtttgctgtggac

SEQ ID NO: 9203548 - DNA, 22 bp, Homo sapiens
agatgcagagtttgctgtggac

SEQ ID NO: 9203549 - DNA, 22 bp, Homo sapiens
agatgcagacttggttcaggca

SEQ ID NO: 9203550 - DNA, 21 bp, Homo sapiens
agatgcagtgacccactgggg

SEQ ID NO: 9203551 - DNA, 21 bp, Homo sapiens
agatgcagtttgcaggtgggt

SEQ ID NO: 9203552 - DNA, 21 bp, Homo sapiens
agatgcagttatgagatgcag

SEQ ID NO: 9203553 - DNA, 22 bp, Homo sapiens
acaacagagctggactgagagg

SEQ ID NO: 9203554 - DNA, 22 bp, Homo sapiens
agatgctgattgaatagatttc

SEQ ID NO: 9203555 - DNA, 22 bp, Homo sapiens
agcacagaaagcacatttgaaa

SEQ ID NO: 9203556 - DNA, 22 bp, Homo sapiens
agcacagggacaatgccaggtg

SEQ ID NO: 9203557 - DNA, 22 bp, Homo sapiens
agcacaggtaatacagagtaac

SEQ ID NO: 9203558 - DNA, 22 bp, Homo sapiens
agcacagggcccagcctaggcc

SEQ ID NO: 9203559 - DNA, 22 bp, Homo sapiens
acacaacagaagagcaattgca

SEQ ID NO: 9203560 - DNA, 22 bp, Homo sapiens
agcaaggcagtcagctggctgg

SEQ ID NO: 9203561 - DNA, 22 bp, Homo sapiens
agcaaatacttgaataaaaaga

SEQ ID NO: 9203562 - DNA, 22 bp, Homo sapiens
agcaaatacttgaataaaaaga

SEQ ID NO: 9203563 - DNA, 19 bp, Homo sapiens
agcaaatataatagtgttc

SEQ ID NO: 9203564 - DNA, 22 bp, Homo sapiens
agcaaagcttccataaagcagc

SEQ ID NO: 9203565 - DNA, 22 bp, Homo sapiens
agcaaagctgattaagagcaca

SEQ ID NO: 9203566 - DNA, 22 bp, Homo sapiens
agcaaagtcagtggaaccatcc

SEQ ID NO: 9203567 - DNA, 19 bp, Homo sapiens
acagaagcatagaaaagga

SEQ ID NO: 9203568 - DNA, 21 bp, Homo sapiens
acagaagtggcttggtctcag

SEQ ID NO: 9203569 - DNA, 22 bp, Homo sapiens
acagaagtggcttcaaagagca

SEQ ID NO: 9203570 - DNA, 22 bp, Homo sapiens
acagaagtgtgtgtgtaggaat

SEQ ID NO: 9203571 - DNA, 17 bp, Homo sapiens
acagaggcaggagtgga

SEQ ID NO: 9203572 - DNA, 22 bp, Homo sapiens
acagaggccatgagctgccacc

SEQ ID NO: 9203573 - DNA, 22 bp, Homo sapiens
acagaatgggatttgaatattt

SEQ ID NO: 9203574 - DNA, 22 bp, Homo sapiens
acagaattaacatttgatgaat

SEQ ID NO: 9203575 - DNA, 19 bp, Homo sapiens
acagagggcaactgagaaa

SEQ ID NO: 9203576 - DNA, 22 bp, Homo sapiens
acagagggtttctaaggatttg

SEQ ID NO: 9203577 - DNA, 22 bp, Homo sapiens
acagaggcctcgtaggtacaac

SEQ ID NO: 9203578 - DNA, 22 bp, Homo sapiens
acagaggctgatcttcaagccc

SEQ ID NO: 9203579 - DNA, 23 bp, Homo sapiens
acagaggcttaaatgagtggcag

SEQ ID NO: 9203580 - DNA, 22 bp, Homo sapiens
agccttagatttgggcaagaac

SEQ ID NO: 9203581 - DNA, 22 bp, Homo sapiens
agctgagaggtggcaagctgta

SEQ ID NO: 9203582 - DNA, 22 bp, Homo sapiens
acagcagcgtcaacttaaaatt

SEQ ID NO: 9203583 - DNA, 22 bp, Homo sapiens
agctgagggcaggatggggtga

SEQ ID NO: 9203584 - DNA, 21 bp, Homo sapiens
agctgaggtaaggcaagagag

SEQ ID NO: 9203585 - DNA, 22 bp, Homo sapiens
agctgagttaattcatcactta

SEQ ID NO: 9203586 - DNA, 19 bp, Homo sapiens
acagcagggatttttggag

SEQ ID NO: 9203587 - DNA, 22 bp, Homo sapiens
acagcaggcccatactggaagg

SEQ ID NO: 9203588 - DNA, 18 bp, Homo sapiens
acagcaggtttcattctt

SEQ ID NO: 9203589 - DNA, 22 bp, Homo sapiens
acagcagtggattagaggatgg

SEQ ID NO: 9203590 - DNA, 18 bp, Homo sapiens
acacagtggatgcctggt

SEQ ID NO: 9203591 - DNA, 18 bp, Homo sapiens
acacacacacctgtgtat

SEQ ID NO: 9203592 - DNA, 22 bp, Homo sapiens
acacacacaagcaggttgtgga

SEQ ID NO: 9203593 - DNA, 22 bp, Homo sapiens
acacatcatgccaagtttcacc

SEQ ID NO: 9203594 - DNA, 22 bp, Homo sapiens
agcagggactacgtgaaagtga

SEQ ID NO: 9203595 - DNA, 22 bp, Homo sapiens
agcagggaatagcggaaagaat

SEQ ID NO: 9203596 - DNA, 22 bp, Homo sapiens
agcaggcttggtccccagcctc

SEQ ID NO: 9203597 - DNA, 22 bp, Homo sapiens
agcaggctttccacagaaggag

SEQ ID NO: 9203598 - DNA, 22 bp, Homo sapiens
agccaaggtcgccccagggcaa

SEQ ID NO: 9203599 - DNA, 22 bp, Homo sapiens
agccaaggtcgccccagggcaa

SEQ ID NO: 9203600 - DNA, 22 bp, Homo sapiens
agccaaggtatcatgagaggca

SEQ ID NO: 9203601 - DNA, 22 bp, Homo sapiens
agccaaggtatcatgagaggca

SEQ ID NO: 9203602 - DNA, 22 bp, Homo sapiens
agccaagggtcagctgcacaga

SEQ ID NO: 9203603 - DNA, 22 bp, Homo sapiens
agccaagggtcagctgcacaga

SEQ ID NO: 9203604 - DNA, 22 bp, Homo sapiens
agccaagggtcagctgcacaga

SEQ ID NO: 9203605 - DNA, 22 bp, Homo sapiens
agccaaggcagctagagctctg

SEQ ID NO: 9203606 - DNA, 22 bp, Homo sapiens
agccaaggagtgcaggtggctt

SEQ ID NO: 9203607 - DNA, 22 bp, Homo sapiens
agccaaggagtgcaggtggctt

SEQ ID NO: 9203608 - DNA, 18 bp, Homo sapiens
agccaaggaggaggagga

SEQ ID NO: 9203609 - DNA, 22 bp, Homo sapiens
agccaaggactcagtggtaggc

SEQ ID NO: 9203610 - DNA, 22 bp, Homo sapiens
acacccagctgggccacctcca

SEQ ID NO: 9203611 - DNA, 22 bp, Homo sapiens
acaccaggtcccgtctgtacct

SEQ ID NO: 9203612 - DNA, 22 bp, Homo sapiens
acacccacctctttaggccatg

SEQ ID NO: 9203613 - DNA, 22 bp, Homo sapiens
acacccagattatgcacacaaa

SEQ ID NO: 9203614 - DNA, 22 bp, Homo sapiens
agccagctgtggctatggctcc

SEQ ID NO: 9203615 - DNA, 22 bp, Homo sapiens
agccagctggtgggtcagctgg

SEQ ID NO: 9203616 - DNA, 22 bp, Homo sapiens
agccagctgtactgcctgctca

SEQ ID NO: 9203617 - DNA, 22 bp, Homo sapiens
agccagctgtgtggtcaggcaa

SEQ ID NO: 9203618 - DNA, 22 bp, Homo sapiens
agccagctgtgggctcaggcgg

SEQ ID NO: 9203619 - DNA, 22 bp, Homo sapiens
agccaggaagagaggcctcacc

SEQ ID NO: 9203620 - DNA, 22 bp, Homo sapiens
agccaggaagagaggcctcacc

SEQ ID NO: 9203621 - DNA, 22 bp, Homo sapiens
agccagcttctttacggtggca

SEQ ID NO: 9203622 - DNA, 22 bp, Homo sapiens
agccagctgttctggggcagca

SEQ ID NO: 9203623 - DNA, 22 bp, Homo sapiens
agccagctgcctttcacatctg

SEQ ID NO: 9203624 - DNA, 22 bp, Homo sapiens
agccagctgcctttcacatctg

SEQ ID NO: 9203625 - DNA, 22 bp, Homo sapiens
agccagctggagaccactgttt

SEQ ID NO: 9203626 - DNA, 22 bp, Homo sapiens
agccagaggtcatgagcacagg

SEQ ID NO: 9203627 - DNA, 22 bp, Homo sapiens
agccagaggccagcctgcctca

SEQ ID NO: 9203628 - DNA, 22 bp, Homo sapiens
agccagaggaacttgatgactg

SEQ ID NO: 9203629 - DNA, 22 bp, Homo sapiens
agccagagattgagatgcaggc

SEQ ID NO: 9203630 - DNA, 22 bp, Homo sapiens
agccagagattgagatgcaggc

SEQ ID NO: 9203631 - DNA, 22 bp, Homo sapiens
agccagagcagggaattggaca

SEQ ID NO: 9203632 - DNA, 22 bp, Homo sapiens
agccacagtctgatgcctgaga

SEQ ID NO: 9203633 - DNA, 20 bp, Homo sapiens
acactgttcttcacacattt

SEQ ID NO: 9203634 - DNA, 22 bp, Homo sapiens
acactgttgctggcacagacag

SEQ ID NO: 9203635 - DNA, 22 bp, Homo sapiens
acactgttctttgcactgagaa

SEQ ID NO: 9203636 - DNA, 22 bp, Homo sapiens
aagtcatagtcgggaaagacat

SEQ ID NO: 9203637 - DNA, 22 bp, Homo sapiens
aagtccagtgatactggcagga

SEQ ID NO: 9203638 - DNA, 22 bp, Homo sapiens
acctgcctatggagccacatgg

SEQ ID NO: 9203639 - DNA, 22 bp, Homo sapiens
acctgcctatcagctgcctgct

SEQ ID NO: 9203640 - DNA, 22 bp, Homo sapiens
acctgcctagttggttctgccc

SEQ ID NO: 9203641 - DNA, 22 bp, Homo sapiens
acctgcctagttggttctgccc

SEQ ID NO: 9203642 - DNA, 22 bp, Homo sapiens
aagtccttggagaatagaaagg

SEQ ID NO: 9203643 - DNA, 22 bp, Homo sapiens
aagtccttcccaagcatgtacc

SEQ ID NO: 9203644 - DNA, 20 bp, Homo sapiens
aagtccctaagtctctggcc

SEQ ID NO: 9203645 - DNA, 22 bp, Homo sapiens
aagtccctttaatcagtgcctt

SEQ ID NO: 9203646 - DNA, 22 bp, Homo sapiens
aagtccctgtggggtggaggct

SEQ ID NO: 9203647 - DNA, 22 bp, Homo sapiens
aagtccctggttcctagcaaaa

SEQ ID NO: 9203648 - DNA, 19 bp, Homo sapiens
acccaggggtttatgtgtg

SEQ ID NO: 9203649 - DNA, 22 bp, Homo sapiens
acccaggggcgaagctggccac

SEQ ID NO: 9203650 - DNA, 22 bp, Homo sapiens
acccaggggcagccttgctgtg

SEQ ID NO: 9203651 - DNA, 22 bp, Homo sapiens
aaggtggtcttactgatggtat

SEQ ID NO: 9203652 - DNA, 22 bp, Homo sapiens
aaggtggtgatcatcttgaagg

SEQ ID NO: 9203653 - DNA, 22 bp, Homo sapiens
aaggtggtgcttctgctcctct

SEQ ID NO: 9203654 - DNA, 22 bp, Homo sapiens
aaggtggttgcaattaccataa

SEQ ID NO: 9203655 - DNA, 22 bp, Homo sapiens
aaggtggtttgattatcccact

SEQ ID NO: 9203656 - DNA, 22 bp, Homo sapiens
aaggtggttgtaggctggtctg

SEQ ID NO: 9203657 - DNA, 21 bp, Homo sapiens
acccaggggaagcagaaactg

SEQ ID NO: 9203658 - DNA, 21 bp, Homo sapiens
acccaggggaagcagaaactg

SEQ ID NO: 9203659 - DNA, 22 bp, Homo sapiens
acccagggctcaagcgtaggca

SEQ ID NO: 9203660 - DNA, 22 bp, Homo sapiens
acccagggcttaaggcggtgca

SEQ ID NO: 9203661 - DNA, 22 bp, Homo sapiens
acccagggctcaagcgtaggca

SEQ ID NO: 9203662 - DNA, 22 bp, Homo sapiens
acccagggctcaagcgtaggca

SEQ ID NO: 9203663 - DNA, 22 bp, Homo sapiens
acccaggccattggcaagagtc

SEQ ID NO: 9203664 - DNA, 22 bp, Homo sapiens
acccaggccattggcaagagtc

SEQ ID NO: 9203665 - DNA, 22 bp, Homo sapiens
acccagggagtgctcctgttct

SEQ ID NO: 9203666 - DNA, 22 bp, Homo sapiens
acccagggccacagcccgcagt

SEQ ID NO: 9203667 - DNA, 22 bp, Homo sapiens
acccagggcagccagcggggag

SEQ ID NO: 9203668 - DNA, 22 bp, Homo sapiens
acccagggcagccagcggggag

SEQ ID NO: 9203669 - DNA, 22 bp, Homo sapiens
aaggtggtttgcagacagaata

SEQ ID NO: 9203670 - DNA, 19 bp, Homo sapiens
aaggtggtttgtctctgta

SEQ ID NO: 9203671 - DNA, 22 bp, Homo sapiens
acctctgcaaccctggaatggg

SEQ ID NO: 9203672 - DNA, 22 bp, Homo sapiens
acctctggacactgcatccttc

SEQ ID NO: 9203673 - DNA, 22 bp, Homo sapiens
aagggttagttggattatttat

SEQ ID NO: 9203674 - DNA, 22 bp, Homo sapiens
aagggtggtgtaggagatcaaa

SEQ ID NO: 9203675 - DNA, 22 bp, Homo sapiens
aagggtggatttctgagctcta

SEQ ID NO: 9203676 - DNA, 22 bp, Homo sapiens
aagggtccagcacctcggctcc

SEQ ID NO: 9203677 - DNA, 22 bp, Homo sapiens
aagggtccaaggctttgcgttt

SEQ ID NO: 9203678 - DNA, 23 bp, Homo sapiens
aagggtccatagctatcattaca

SEQ ID NO: 9203679 - DNA, 22 bp, Homo sapiens
aagggtcttagaggttcatttt

SEQ ID NO: 9203680 - DNA, 22 bp, Homo sapiens
aaggggaaaaagtgttaggagt

SEQ ID NO: 9203681 - DNA, 20 bp, Homo sapiens
accagaggaaagagcagtga

SEQ ID NO: 9203682 - DNA, 22 bp, Homo sapiens
accagaggaagggaatctcaag

SEQ ID NO: 9203683 - DNA, 22 bp, Homo sapiens
accagaggaggaattaccttcc

SEQ ID NO: 9203684 - DNA, 22 bp, Homo sapiens
accagagggagacttcctcttc

SEQ ID NO: 9203685 - DNA, 22 bp, Homo sapiens
acatttcagtaagtgttaattt

SEQ ID NO: 9203686 - DNA, 22 bp, Homo sapiens
acatttcagcgtgcatgacatg

SEQ ID NO: 9203687 - DNA, 22 bp, Homo sapiens
acatttcagattcatgaagtga

SEQ ID NO: 9203688 - DNA, 22 bp, Homo sapiens
acatttcagattcatgaagtga

SEQ ID NO: 9203689 - DNA, 22 bp, Homo sapiens
aagggcagagggaatcccacat

SEQ ID NO: 9203690 - DNA, 22 bp, Homo sapiens
acatttcagatgtaatgtgatg

SEQ ID NO: 9203691 - DNA, 22 bp, Homo sapiens
aagggaggtaaagctatttaaa

SEQ ID NO: 9203692 - DNA, 22 bp, Homo sapiens
aagggaggggatgtaagcctgg

SEQ ID NO: 9203693 - DNA, 22 bp, Homo sapiens
aaggatgaacattaatacatca

SEQ ID NO: 9203694 - DNA, 22 bp, Homo sapiens
aaggatgtcagtcattttggat

SEQ ID NO: 9203695 - DNA, 22 bp, Homo sapiens
aaggatgttctagtttgctgag

SEQ ID NO: 9203696 - DNA, 22 bp, Homo sapiens
aaggatgtgactcagtcagcta

SEQ ID NO: 9203697 - DNA, 22 bp, Homo sapiens
aaggacaatgaagacagccaca

SEQ ID NO: 9203698 - DNA, 22 bp, Homo sapiens
aaggacaagtagtatttgcatc

SEQ ID NO: 9203699 - DNA, 22 bp, Homo sapiens
aaggacagagagccattccaga

SEQ ID NO: 9203700 - DNA, 22 bp, Homo sapiens
aaggacaggcacagtggtggag

SEQ ID NO: 9203701 - DNA, 22 bp, Homo sapiens
acagctggagtgaggatggagt

SEQ ID NO: 9203702 - DNA, 22 bp, Homo sapiens
aagctgtgaaatctctagtgca

SEQ ID NO: 9203703 - DNA, 22 bp, Homo sapiens
acagctggaggtctgtgagcac

SEQ ID NO: 9203704 - DNA, 22 bp, Homo sapiens
acagctggaggccccattgtcc

SEQ ID NO: 9203705 - DNA, 22 bp, Homo sapiens
acagctggacaggggagagttt

SEQ ID NO: 9203706 - DNA, 22 bp, Homo sapiens
aagctgtgtgactatttctgag

SEQ ID NO: 9203707 - DNA, 22 bp, Homo sapiens
aagctgtgtaagttgcttggtt

SEQ ID NO: 9203708 - DNA, 22 bp, Homo sapiens
aagctgtgtgcagatgatctca

SEQ ID NO: 9203709 - DNA, 22 bp, Homo sapiens
aagcttggaagtcttcctttca

SEQ ID NO: 9203710 - DNA, 21 bp, Homo sapiens
aagcttggctgatgttattgg

SEQ ID NO: 9203711 - DNA, 22 bp, Homo sapiens
aagcttgggaaccacggtaatc

SEQ ID NO: 9203712 - DNA, 22 bp, Homo sapiens
aagcttcctgaatgctcattta

SEQ ID NO: 9203713 - DNA, 22 bp, Homo sapiens
aagcttcctgcatgggactgct

SEQ ID NO: 9203714 - DNA, 23 bp, Homo sapiens
aagcttccttcacgtctcctggg

SEQ ID NO: 9203715 - DNA, 20 bp, Homo sapiens
aagcttccaggatctggtgt

SEQ ID NO: 9203716 - DNA, 21 bp, Homo sapiens
aagcttccaaactgctggact

SEQ ID NO: 9203717 - DNA, 21 bp, Homo sapiens
aagcttccaaactgctggact

SEQ ID NO: 9203718 - DNA, 23 bp, Homo sapiens
aagcttccttgactggcccctag

SEQ ID NO: 9203719 - DNA, 20 bp, Homo sapiens
aagcttcacttcatttgatc

SEQ ID NO: 9203720 - DNA, 22 bp, Homo sapiens
aaggcacacagttagatagagc

SEQ ID NO: 9203721 - DNA, 22 bp, Homo sapiens
aaggcacagaggcagggcactt

SEQ ID NO: 9203722 - DNA, 22 bp, Homo sapiens
aaggcacagccacttgatcatc

SEQ ID NO: 9203723 - DNA, 18 bp, Homo sapiens
aaggcacaggagaacatt

SEQ ID NO: 9203724 - DNA, 17 bp, Homo sapiens
aaggcacagggcactgg

SEQ ID NO: 9203725 - DNA, 22 bp, Homo sapiens
aaggcacatattgcagatcttg

SEQ ID NO: 9203726 - DNA, 22 bp, Homo sapiens
aaggcaaggcttccagctcccc

SEQ ID NO: 9203727 - DNA, 22 bp, Homo sapiens
aaggccagagtactagaggctg

SEQ ID NO: 9203728 - DNA, 22 bp, Homo sapiens
aaggccagagcgtgtcctgcct

SEQ ID NO: 9203729 - DNA, 22 bp, Homo sapiens
aaggcaccataggcaaatccag

SEQ ID NO: 9203730 - DNA, 22 bp, Homo sapiens
aaggcacatgacctaggcctgg

SEQ ID NO: 9203731 - DNA, 22 bp, Homo sapiens
aaggccagccctaatgatgctc

SEQ ID NO: 9203732 - DNA, 22 bp, Homo sapiens
aaggccagattctctctagggg

SEQ ID NO: 9203733 - DNA, 22 bp, Homo sapiens
aaggccagagttgaactgctcc

SEQ ID NO: 9203734 - DNA, 22 bp, Homo sapiens
acatgaaattctagctgaaccc

SEQ ID NO: 9203735 - DNA, 22 bp, Homo sapiens
acatgacaaaatgcacaggatt

SEQ ID NO: 9203736 - DNA, 22 bp, Homo sapiens
acatcctcccgatctactggct

SEQ ID NO: 9203737 - DNA, 20 bp, Homo sapiens
acatcctggtgactagaact

SEQ ID NO: 9203738 - DNA, 22 bp, Homo sapiens
acatgacagtgcttagcaaact

SEQ ID NO: 9203739 - DNA, 22 bp, Homo sapiens
acatgacagtgcttagcaaact

SEQ ID NO: 9203740 - DNA, 22 bp, Homo sapiens
acatgacaaaatgcacaggatt

SEQ ID NO: 9203741 - DNA, 22 bp, Homo sapiens
acatgacagtgcttagcaaact

SEQ ID NO: 9203742 - DNA, 22 bp, Homo sapiens
actgcactccagcctgggtgac

SEQ ID NO: 9203743 - DNA, 22 bp, Homo sapiens
aagttcctgggccaagtccagg

SEQ ID NO: 9203744 - DNA, 22 bp, Homo sapiens
actgcactccagcctgggtgac

SEQ ID NO: 9203745 - DNA, 22 bp, Homo sapiens
actgcactccagcctgggtgac

SEQ ID NO: 9203746 - DNA, 22 bp, Homo sapiens
actcttttataaagcatcttga

SEQ ID NO: 9203747 - DNA, 22 bp, Homo sapiens
actgaaaaagtatgattcactg

SEQ ID NO: 9203748 - DNA, 22 bp, Homo sapiens
aagttccctttctttgccagga

SEQ ID NO: 9203749 - DNA, 22 bp, Homo sapiens
aagtgtcttctgatggggtgtg

SEQ ID NO: 9203750 - DNA, 22 bp, Homo sapiens
acctgcctcagtgcagctggat

SEQ ID NO: 9203751 - DNA, 22 bp, Homo sapiens
acctgcctctaagcagcaggtg

SEQ ID NO: 9203752 - DNA, 22 bp, Homo sapiens
acctgcctcagtgcagctggat

SEQ ID NO: 9203753 - DNA, 22 bp, Homo sapiens
aagtgtgggaagttgctaaaat

SEQ ID NO: 9203754 - DNA, 22 bp, Homo sapiens
aagtgtggggtctcagagctga

SEQ ID NO: 9203755 - DNA, 22 bp, Homo sapiens
actctggctgccttgtgagcat

SEQ ID NO: 9203756 - DNA, 22 bp, Homo sapiens
actctgggaatcctcaccttcc

SEQ ID NO: 9203757 - DNA, 22 bp, Homo sapiens
actctggcttgaggaccaggtc

SEQ ID NO: 9203758 - DNA, 22 bp, Homo sapiens
aatagcaaacagacatgcacaa

SEQ ID NO: 9203759 - DNA, 22 bp, Homo sapiens
aatagcaaagttatcaaattaa

SEQ ID NO: 9203760 - DNA, 22 bp, Homo sapiens
actgtcctgaatactgcatgac

SEQ ID NO: 9203761 - DNA, 22 bp, Homo sapiens
actgtcctgaatactgcatgac

SEQ ID NO: 9203762 - DNA, 22 bp, Homo sapiens
actgtcctcgaagtacctgtgc

SEQ ID NO: 9203763 - DNA, 22 bp, Homo sapiens
actgtcctagaacctgcagctc

SEQ ID NO: 9203764 - DNA, 22 bp, Homo sapiens
actgtcctcagatattcttctg

SEQ ID NO: 9203765 - DNA, 22 bp, Homo sapiens
actgtccttttaatgcagccgt

SEQ ID NO: 9203766 - DNA, 22 bp, Homo sapiens
actgtcctggagctcacactct

SEQ ID NO: 9203767 - DNA, 22 bp, Homo sapiens
actgtcctgcaaaaatactctt

SEQ ID NO: 9203768 - DNA, 22 bp, Homo sapiens
aataaaatgaactggtagagtt

SEQ ID NO: 9203769 - DNA, 22 bp, Homo sapiens
aataaaatgaactggtagagtt

SEQ ID NO: 9203770 - DNA, 22 bp, Homo sapiens
actgggagggtcttgaagaggg

SEQ ID NO: 9203771 - DNA, 22 bp, Homo sapiens
actgggaggcatctggagctga

SEQ ID NO: 9203772 - DNA, 22 bp, Homo sapiens
aataatagcagagtttacaatc

SEQ ID NO: 9203773 - DNA, 22 bp, Homo sapiens
aataatagcagagtttacaatc

SEQ ID NO: 9203774 - DNA, 22 bp, Homo sapiens
aataataagatactaagggagt

SEQ ID NO: 9203775 - DNA, 22 bp, Homo sapiens
aataatacatgagattaatgtt

SEQ ID NO: 9203776 - DNA, 22 bp, Homo sapiens
agaaggaaggaagcattctgtt

SEQ ID NO: 9203777 - DNA, 22 bp, Homo sapiens
agaagccagcttcagctgcccg

SEQ ID NO: 9203778 - DNA, 22 bp, Homo sapiens
aatgccagtgtgttgattccag

SEQ ID NO: 9203779 - DNA, 22 bp, Homo sapiens
aatgccttcccatttatacttt

SEQ ID NO: 9203780 - DNA, 21 bp, Homo sapiens
agaactgattaaataagcagt

SEQ ID NO: 9203781 - DNA, 22 bp, Homo sapiens
agaactgatttgaaggttgggg

SEQ ID NO: 9203782 - DNA, 19 bp, Homo sapiens
agaactgggtccatggctt

SEQ ID NO: 9203783 - DNA, 22 bp, Homo sapiens
agaacctttctttagaaattca

SEQ ID NO: 9203784 - DNA, 22 bp, Homo sapiens
agaagccactggaggttgagat

SEQ ID NO: 9203785 - DNA, 22 bp, Homo sapiens
agaagccaccagctgaggaaga

SEQ ID NO: 9203786 - DNA, 22 bp, Homo sapiens
agaagcagctttcaaggtgatt

SEQ ID NO: 9203787 - DNA, 22 bp, Homo sapiens
acttttcaaatgggaaactcag

SEQ ID NO: 9203788 - DNA, 22 bp, Homo sapiens
actttgttttcatgaaacagct

SEQ ID NO: 9203789 - DNA, 22 bp, Homo sapiens
aataggaagcaccaaattctcc

SEQ ID NO: 9203790 - DNA, 22 bp, Homo sapiens
agaaagggaactggcaaagcca

SEQ ID NO: 9203791 - DNA, 22 bp, Homo sapiens
agaaagggaactggcaaagcca

SEQ ID NO: 9203792 - DNA, 22 bp, Homo sapiens
agaaagggagagccagcacacg

SEQ ID NO: 9203793 - DNA, 22 bp, Homo sapiens
agaaagggagagccagcacacg

SEQ ID NO: 9203794 - DNA, 22 bp, Homo sapiens
aatctagattcggatcaaaggg

SEQ ID NO: 9203795 - DNA, 22 bp, Homo sapiens
aatctagagttcccagcataaa

SEQ ID NO: 9203796 - DNA, 22 bp, Homo sapiens
agaaaggaggaagaatgacctc

SEQ ID NO: 9203797 - DNA, 22 bp, Homo sapiens
aatcacaaatttagacagagct

SEQ ID NO: 9203798 - DNA, 22 bp, Homo sapiens
tcagagcactggtgctaccttg

SEQ ID NO: 9203799 - DNA, 22 bp, Homo sapiens
tcagagcattcgggtgacaaat

SEQ ID NO: 9203800 - DNA, 22 bp, Homo sapiens
tcagagctaaggggagagcaaa

SEQ ID NO: 9203801 - DNA, 22 bp, Homo sapiens
tcagagctttggagaccaggaa

SEQ ID NO: 9203802 - DNA, 22 bp, Homo sapiens
tcagagctgcccatgcaagggg

SEQ ID NO: 9203803 - DNA, 22 bp, Homo sapiens
tcagaggaagcatcaagttctc

SEQ ID NO: 9203804 - DNA, 22 bp, Homo sapiens
tcagcaaggctgcattctcatc

SEQ ID NO: 9203805 - DNA, 22 bp, Homo sapiens
tcagcaagcagggggatgttca

SEQ ID NO: 9203806 - DNA, 22 bp, Homo sapiens
tcagcaaggcagaagggaggta

SEQ ID NO: 9203807 - DNA, 20 bp, Homo sapiens
tcagcacagctgacaaggtt

SEQ ID NO: 9203808 - DNA, 22 bp, Homo sapiens
tcagcaagtggaccatcctggg

SEQ ID NO: 9203809 - DNA, 22 bp, Homo sapiens
tcacttttgatccctatgcagt

SEQ ID NO: 9203810 - DNA, 22 bp, Homo sapiens
tcagacagtcatcagagcttgt

SEQ ID NO: 9203811 - DNA, 22 bp, Homo sapiens
tcagacagtttgcagtgtgcct

SEQ ID NO: 9203812 - DNA, 22 bp, Homo sapiens
tcagagaactccacaccttagg

SEQ ID NO: 9203813 - DNA, 22 bp, Homo sapiens
tcagagaagctgccaggcgagc

SEQ ID NO: 9203814 - DNA, 22 bp, Homo sapiens
tcagagaactgcagcccttcct

SEQ ID NO: 9203815 - DNA, 20 bp, Homo sapiens
tcagagaaggagctttcctg

SEQ ID NO: 9203816 - DNA, 20 bp, Homo sapiens
tcagagaaggagctttcctg

SEQ ID NO: 9203817 - DNA, 22 bp, Homo sapiens
tcaccactgaacagacctttgg

SEQ ID NO: 9203818 - DNA, 22 bp, Homo sapiens
tcacattttatctgagattgac

SEQ ID NO: 9203819 - DNA, 22 bp, Homo sapiens
tcacattttatctattttaagt

SEQ ID NO: 9203820 - DNA, 22 bp, Homo sapiens
tcacccagccttggcgggtttg

SEQ ID NO: 9203821 - DNA, 22 bp, Homo sapiens
tcacccagccttggcgggtttg

SEQ ID NO: 9203822 - DNA, 22 bp, Homo sapiens
tcactagcattgttgaaggact

SEQ ID NO: 9203823 - DNA, 22 bp, Homo sapiens
tcacccaggctggactgcagtg

SEQ ID NO: 9203824 - DNA, 22 bp, Homo sapiens
tcactacaacctccgcctcctg

SEQ ID NO: 9203825 - DNA, 22 bp, Homo sapiens
tcactctgacttggcctccaac

SEQ ID NO: 9203826 - DNA, 22 bp, Homo sapiens
tcactctgagaggtcactggaa

SEQ ID NO: 9203827 - DNA, 22 bp, Homo sapiens
tcactctgagaggtcactggaa

SEQ ID NO: 9203828 - DNA, 20 bp, Homo sapiens
tcactctgatgctagggtgg

SEQ ID NO: 9203829 - DNA, 21 bp, Homo sapiens
tcactctgattaggtgtctct

SEQ ID NO: 9203830 - DNA, 22 bp, Homo sapiens
tcactctgatagataagctaac

SEQ ID NO: 9203831 - DNA, 22 bp, Homo sapiens
tcactctggagtccgctaccag

SEQ ID NO: 9203832 - DNA, 22 bp, Homo sapiens
tcactctgctgcccgagggctg

SEQ ID NO: 9203833 - DNA, 15 bp, Homo sapiens
tcactctggaaggga

SEQ ID NO: 9203834 - DNA, 22 bp, Homo sapiens
tcactctgcctccatattacta

SEQ ID NO: 9203835 - DNA, 22 bp, Homo sapiens
tcactctgcaggaaggagcagc

SEQ ID NO: 9203836 - DNA, 22 bp, Homo sapiens
tcacttcttcagctttccttga

SEQ ID NO: 9203837 - DNA, 21 bp, Homo sapiens
tcactgaggttaaatagggtt

SEQ ID NO: 9203838 - DNA, 22 bp, Homo sapiens
tcacttgacccttctctagcct

SEQ ID NO: 9203839 - DNA, 22 bp, Homo sapiens
tcacttgaattcattctgcgaa

SEQ ID NO: 9203840 - DNA, 22 bp, Homo sapiens
tcacttgcctagcccagttcag

SEQ ID NO: 9203841 - DNA, 22 bp, Homo sapiens
tcacttgctaacagatattgag

SEQ ID NO: 9203842 - DNA, 22 bp, Homo sapiens
tcacttgactttccagtcttgg

SEQ ID NO: 9203843 - DNA, 22 bp, Homo sapiens
tcacttgactccagtttcttct

SEQ ID NO: 9203844 - DNA, 22 bp, Homo sapiens
tcactgaagactgggctctaaa

SEQ ID NO: 9203845 - DNA, 22 bp, Homo sapiens
tcactgaatacttgtctcatcc

SEQ ID NO: 9203846 - DNA, 22 bp, Homo sapiens
tcactgagaagagtaacagcag

SEQ ID NO: 9203847 - DNA, 22 bp, Homo sapiens
tcactgaggcattcatgctctg

SEQ ID NO: 9203848 - DNA, 23 bp, Homo sapiens
tcactgatgttacagcagccagt

SEQ ID NO: 9203849 - DNA, 22 bp, Homo sapiens
tcactctgggccctactgggct

SEQ ID NO: 9203850 - DNA, 22 bp, Homo sapiens
tcactctggtccatccgagagc

SEQ ID NO: 9203851 - DNA, 22 bp, Homo sapiens
tcactctgtcccccattgagat

SEQ ID NO: 9203852 - DNA, 22 bp, Homo sapiens
tcactctggcctctgcagcagt

SEQ ID NO: 9203853 - DNA, 22 bp, Homo sapiens
tcactctggcctctgcagcagt

SEQ ID NO: 9203854 - DNA, 22 bp, Homo sapiens
tcactctgggccagcgcaggta

SEQ ID NO: 9203855 - DNA, 22 bp, Homo sapiens
tcactctgttagaggaaagtgc

SEQ ID NO: 9203856 - DNA, 22 bp, Homo sapiens
tcactctgtgtttgaactcaag

SEQ ID NO: 9203857 - DNA, 22 bp, Homo sapiens
tcactctgtgtttccctgggac

SEQ ID NO: 9203858 - DNA, 22 bp, Homo sapiens
tcactctgtggcccaggcagtg

SEQ ID NO: 9203859 - DNA, 22 bp, Homo sapiens
tcactctgttttactcactgtt

SEQ ID NO: 9203860 - DNA, 22 bp, Homo sapiens
tcactctgttttactcactgtt

SEQ ID NO: 9203861 - DNA, 22 bp, Homo sapiens
tcacaaagtgaagtgtgtcatg

SEQ ID NO: 9203862 - DNA, 22 bp, Homo sapiens
tcacaaagggagggatagctgg

SEQ ID NO: 9203863 - DNA, 22 bp, Homo sapiens
tcacaaagagaattgtgggtgt

SEQ ID NO: 9203864 - DNA, 22 bp, Homo sapiens
tcacaaacaatgctttggaatt

SEQ ID NO: 9203865 - DNA, 22 bp, Homo sapiens
tcacaaagctttgataagcaga

SEQ ID NO: 9203866 - DNA, 22 bp, Homo sapiens
tcacaaagctttgataagcaga

SEQ ID NO: 9203867 - DNA, 22 bp, Homo sapiens
tcacagaaataagatagttatt

SEQ ID NO: 9203868 - DNA, 22 bp, Homo sapiens
tcacagaagaagtagattgcat

SEQ ID NO: 9203869 - DNA, 22 bp, Homo sapiens
tcacagaagagcattaagatga

SEQ ID NO: 9203870 - DNA, 22 bp, Homo sapiens
tcacagaagagatattgacaga

SEQ ID NO: 9203871 - DNA, 22 bp, Homo sapiens
tcacaggagtcataattacagt

SEQ ID NO: 9203872 - DNA, 19 bp, Homo sapiens
tcacaggcatctccccaga

SEQ ID NO: 9203873 - DNA, 19 bp, Homo sapiens
tcacaggcatctccccaga

SEQ ID NO: 9203874 - DNA, 21 bp, Homo sapiens
tcacaggctcagggagagagt

SEQ ID NO: 9203875 - DNA, 22 bp, Homo sapiens
tcacaggcctggggcagagggc

SEQ ID NO: 9203876 - DNA, 22 bp, Homo sapiens
tcacaggctaaatttatgcagg

SEQ ID NO: 9203877 - DNA, 22 bp, Homo sapiens
tcacaggcccaaaccacgctta

SEQ ID NO: 9203878 - DNA, 22 bp, Homo sapiens
tcacaggctctagggattaaga

SEQ ID NO: 9203879 - DNA, 22 bp, Homo sapiens
tcacaggctggtctccgaggac

SEQ ID NO: 9203880 - DNA, 22 bp, Homo sapiens
tcaagtttaattgagatgttta

SEQ ID NO: 9203881 - DNA, 22 bp, Homo sapiens
tcaagtttctctcagattatgg

SEQ ID NO: 9203882 - DNA, 22 bp, Homo sapiens
tcaataaaattgttttcctatc

SEQ ID NO: 9203883 - DNA, 22 bp, Homo sapiens
tcaaggttgttgaggcctgact

SEQ ID NO: 9203884 - DNA, 22 bp, Homo sapiens
tcaagtatttatttctgctggc

SEQ ID NO: 9203885 - DNA, 22 bp, Homo sapiens
tcaagtcccagctcttcactta

SEQ ID NO: 9203886 - DNA, 22 bp, Homo sapiens
tcaaggcacttcatgtctcagt

SEQ ID NO: 9203887 - DNA, 22 bp, Homo sapiens
tcaaggagacagaaagcaatgg

SEQ ID NO: 9203888 - DNA, 22 bp, Homo sapiens
tcaagggaggagacacagccct

SEQ ID NO: 9203889 - DNA, 19 bp, Homo sapiens
tcaaggctccctgagggat

SEQ ID NO: 9203890 - DNA, 22 bp, Homo sapiens
tcaaggctaaactttcagagta

SEQ ID NO: 9203891 - DNA, 22 bp, Homo sapiens
tatttcttgagactcgtcttcc

SEQ ID NO: 9203892 - DNA, 22 bp, Homo sapiens
tatttcttgagtggtcagtttc

SEQ ID NO: 9203893 - DNA, 22 bp, Homo sapiens
tcaagagattgaataataactg

SEQ ID NO: 9203894 - DNA, 22 bp, Homo sapiens
tcaagagagtgctgcttggggt

SEQ ID NO: 9203895 - DNA, 22 bp, Homo sapiens
tcaagagaagtgctccacagta

SEQ ID NO: 9203896 - DNA, 22 bp, Homo sapiens
tcaagagacaggacgtgtttca

SEQ ID NO: 9203897 - DNA, 22 bp, Homo sapiens
tcaagagaaggggaaatagact

SEQ ID NO: 9203898 - DNA, 18 bp, Homo sapiens
tcaagacatcatgaaata

SEQ ID NO: 9203899 - DNA, 22 bp, Homo sapiens
tcaagataccaccattatatgt

SEQ ID NO: 9203900 - DNA, 22 bp, Homo sapiens
tcagtgttaatcagtggtacct

SEQ ID NO: 9203901 - DNA, 22 bp, Homo sapiens
tcagtgttagacaagtttggaa

SEQ ID NO: 9203902 - DNA, 22 bp, Homo sapiens
tcagtgttacattatatagaac

SEQ ID NO: 9203903 - DNA, 22 bp, Homo sapiens
tcagtgcagggtgggagagaga

SEQ ID NO: 9203904 - DNA, 22 bp, Homo sapiens
tcagtgcaggaatctctagcca

SEQ ID NO: 9203905 - DNA, 22 bp, Homo sapiens
tcagtgcaggaatttccttaga

SEQ ID NO: 9203906 - DNA, 22 bp, Homo sapiens
tcagtgcagcggcagcagctct

SEQ ID NO: 9203907 - DNA, 22 bp, Homo sapiens
tcagtgcagcggcagcagctct

SEQ ID NO: 9203908 - DNA, 20 bp, Homo sapiens
tcagtgcagattgtccaagt

SEQ ID NO: 9203909 - DNA, 22 bp, Homo sapiens
tcagtgcagactgtaagttgga

SEQ ID NO: 9203910 - DNA, 22 bp, Homo sapiens
tcagtgcagaatagtgatgcat

SEQ ID NO: 9203911 - DNA, 22 bp, Homo sapiens
tcagtgcacaatgacggtggct

SEQ ID NO: 9203912 - DNA, 21 bp, Homo sapiens
tcagtgcaattctatggggaa

SEQ ID NO: 9203913 - DNA, 22 bp, Homo sapiens
tcagtgcacccaattctctcca

SEQ ID NO: 9203914 - DNA, 22 bp, Homo sapiens
tcagtgcacagagatttttgtt

SEQ ID NO: 9203915 - DNA, 22 bp, Homo sapiens
tcagtgcaaaaaatgggctaga

SEQ ID NO: 9203916 - DNA, 22 bp, Homo sapiens
tcagtgcaatcaaggtatgttt

SEQ ID NO: 9203917 - DNA, 23 bp, Homo sapiens
tcagtgcaaaaataggattttgg

SEQ ID NO: 9203918 - DNA, 22 bp, Homo sapiens
tcaggtgttagaagaaatttca

SEQ ID NO: 9203919 - DNA, 22 bp, Homo sapiens
tcagggaatgggcccagtccct

SEQ ID NO: 9203920 - DNA, 18 bp, Homo sapiens
tcagggaatcttggcctt

SEQ ID NO: 9203921 - DNA, 22 bp, Homo sapiens
tcatgcctggaatctcaccact

SEQ ID NO: 9203922 - DNA, 22 bp, Homo sapiens
tcatgccatccacatctgtttc

SEQ ID NO: 9203923 - DNA, 22 bp, Homo sapiens
tcatgccagctttgcttgtccc

SEQ ID NO: 9203924 - DNA, 22 bp, Homo sapiens
tcatgccacttacaaaataatg

SEQ ID NO: 9203925 - DNA, 22 bp, Homo sapiens
tcatgccaaaatccagtggctt

SEQ ID NO: 9203926 - DNA, 22 bp, Homo sapiens
tcatgccaatttctgcatggct

SEQ ID NO: 9203927 - DNA, 22 bp, Homo sapiens
tcatgccagctttgcttgtccc

SEQ ID NO: 9203928 - DNA, 22 bp, Homo sapiens
tcatgccagttaaaggctgtga

SEQ ID NO: 9203929 - DNA, 22 bp, Homo sapiens
tcatgccaaactgaacacagtt

SEQ ID NO: 9203930 - DNA, 22 bp, Homo sapiens
tcatgccaaaatccagtggctt

SEQ ID NO: 9203931 - DNA, 22 bp, Homo sapiens
tcatatatctgcaaagcagtat

SEQ ID NO: 9203932 - DNA, 22 bp, Homo sapiens
tcagtgttcgctcagggactcc

SEQ ID NO: 9203933 - DNA, 22 bp, Homo sapiens
tcagtgttattagatgaggttt

SEQ ID NO: 9203934 - DNA, 22 bp, Homo sapiens
tcagtgttcagggaccaggtcc

SEQ ID NO: 9203935 - DNA, 16 bp, Homo sapiens
tcagtgttccagaata

SEQ ID NO: 9203936 - DNA, 22 bp, Homo sapiens
tcagtgttcagcggtgtgtgca

SEQ ID NO: 9203937 - DNA, 22 bp, Homo sapiens
tcattcaggttgggcaagtgtc

SEQ ID NO: 9203938 - DNA, 20 bp, Homo sapiens
tcattacagtgctaagatgt

SEQ ID NO: 9203939 - DNA, 22 bp, Homo sapiens
tcattacagagatataatctac

SEQ ID NO: 9203940 - DNA, 22 bp, Homo sapiens
tcattacagtgtttatatgtct

SEQ ID NO: 9203941 - DNA, 22 bp, Homo sapiens
tcattacatcttggccaaaact

SEQ ID NO: 9203942 - DNA, 23 bp, Homo sapiens
tcatggaactgggcaatcttgaa

SEQ ID NO: 9203943 - DNA, 22 bp, Homo sapiens
tcatggctaatgcagtatattc

SEQ ID NO: 9203944 - DNA, 22 bp, Homo sapiens
tcatggctctaaagacatagat

SEQ ID NO: 9203945 - DNA, 22 bp, Homo sapiens
tcatggctaatgcagtatattc

SEQ ID NO: 9203946 - DNA, 18 bp, Homo sapiens
tcaggctggaagtttgcc

SEQ ID NO: 9203947 - DNA, 22 bp, Homo sapiens
tcaggctgctttcatgcttaga

SEQ ID NO: 9203948 - DNA, 22 bp, Homo sapiens
tcaggctgctgtactgtgaatg

SEQ ID NO: 9203949 - DNA, 22 bp, Homo sapiens
tcaggctggaatgcagtggggc

SEQ ID NO: 9203950 - DNA, 22 bp, Homo sapiens
tcaggctggaatgcagtggggc

SEQ ID NO: 9203951 - DNA, 22 bp, Homo sapiens
tcaggctggaatgcagtggggc

SEQ ID NO: 9203952 - DNA, 22 bp, Homo sapiens
tcaggctggagtgcagtggcgc

SEQ ID NO: 9203953 - DNA, 22 bp, Homo sapiens
tcaggctgctggccagcaggct

SEQ ID NO: 9203954 - DNA, 22 bp, Homo sapiens
tcaggctgctggccagcaggct

SEQ ID NO: 9203955 - DNA, 21 bp, Homo sapiens
tcaggctgatgtcgatgttag

SEQ ID NO: 9203956 - DNA, 22 bp, Homo sapiens
tcaggctgataggaggaactga

SEQ ID NO: 9203957 - DNA, 22 bp, Homo sapiens
tcaggctgaggtcatctgcatc

SEQ ID NO: 9203958 - DNA, 22 bp, Homo sapiens
tcaggctgaggtcatctgcatc

SEQ ID NO: 9203959 - DNA, 18 bp, Homo sapiens
tcaggctgggcctccttc

SEQ ID NO: 9203960 - DNA, 22 bp, Homo sapiens
tcaggctgggagacaatcactg

SEQ ID NO: 9203961 - DNA, 22 bp, Homo sapiens
tcaggctgggagacaatcactg

SEQ ID NO: 9203962 - DNA, 22 bp, Homo sapiens
tcaggctggagtgcagtggcgc

SEQ ID NO: 9203963 - DNA, 22 bp, Homo sapiens
tcaggctggggtgctaaggtgt

SEQ ID NO: 9203964 - DNA, 22 bp, Homo sapiens
tcaggctggggtgctaaggtgt

SEQ ID NO: 9203965 - DNA, 22 bp, Homo sapiens
tcaggctgggctcctctcccca

SEQ ID NO: 9203966 - DNA, 22 bp, Homo sapiens
tcagggaaacctaaggaagcca

SEQ ID NO: 9203967 - DNA, 22 bp, Homo sapiens
tcaggatgacttcaaggaggaa

SEQ ID NO: 9203968 - DNA, 22 bp, Homo sapiens
tcaggatgaccacgagcctcta

SEQ ID NO: 9203969 - DNA, 22 bp, Homo sapiens
tcaggatgaccacgagcctcta

SEQ ID NO: 9203970 - DNA, 22 bp, Homo sapiens
tcaggatgaagtcagaggggtc

SEQ ID NO: 9203971 - DNA, 22 bp, Homo sapiens
tcaggatccatagactcccaaa

SEQ ID NO: 9203972 - DNA, 22 bp, Homo sapiens
tcaggatcaggggcctttcctt

SEQ ID NO: 9203973 - DNA, 22 bp, Homo sapiens
tcaggagtgataccatttgtca

SEQ ID NO: 9203974 - DNA, 22 bp, Homo sapiens
tcaggatgacttcaaggaggaa

SEQ ID NO: 9203975 - DNA, 22 bp, Homo sapiens
tcaggatggagggaagcacaga

SEQ ID NO: 9203976 - DNA, 22 bp, Homo sapiens
tcaggatggtgtggaggaaata

SEQ ID NO: 9203977 - DNA, 20 bp, Homo sapiens
tcaggatgtgctgagtgaag

SEQ ID NO: 9203978 - DNA, 20 bp, Homo sapiens
tcaggcagtggggaaaggca

SEQ ID NO: 9203979 - DNA, 22 bp, Homo sapiens
tcaggccaaggtagacatgact

SEQ ID NO: 9203980 - DNA, 22 bp, Homo sapiens
tcaggccaaagaaacagcatga

SEQ ID NO: 9203981 - DNA, 22 bp, Homo sapiens
tcaggcctgagaaaaatccttt

SEQ ID NO: 9203982 - DNA, 22 bp, Homo sapiens
tcaggccacggctcactgagac

SEQ ID NO: 9203983 - DNA, 22 bp, Homo sapiens
tcaggccacttcacaggtgatt

SEQ ID NO: 9203984 - DNA, 22 bp, Homo sapiens
tcaggccacggctcactgagac

SEQ ID NO: 9203985 - DNA, 21 bp, Homo sapiens
tcagcagaaagcaaggtcagt

SEQ ID NO: 9203986 - DNA, 22 bp, Homo sapiens
tcagcctgcgtcatggtgacac

SEQ ID NO: 9203987 - DNA, 22 bp, Homo sapiens
tcagcctgctccaagtgctgcc

SEQ ID NO: 9203988 - DNA, 22 bp, Homo sapiens
tcagcctgctccaagtgctgcc

SEQ ID NO: 9203989 - DNA, 22 bp, Homo sapiens
tcagcctgctccaagtgctgcc

SEQ ID NO: 9203990 - DNA, 21 bp, Homo sapiens
tcagctcaaatgtcgcttcct

SEQ ID NO: 9203991 - DNA, 22 bp, Homo sapiens
tcagctccacagctcctctgcc

SEQ ID NO: 9203992 - DNA, 22 bp, Homo sapiens
tcagctcatctgagtgtcagcg

SEQ ID NO: 9203993 - DNA, 22 bp, Homo sapiens
tcagccttgtggccctgctcca

SEQ ID NO: 9203994 - DNA, 22 bp, Homo sapiens
tcagcctggtgattcctctgtc

SEQ ID NO: 9203995 - DNA, 22 bp, Homo sapiens
tcagcctggtgattcctctgtc

SEQ ID NO: 9203996 - DNA, 22 bp, Homo sapiens
tcagctctctgggctcgaacct

SEQ ID NO: 9203997 - DNA, 22 bp, Homo sapiens
tcagctctctgggctcgaacct

SEQ ID NO: 9203998 - DNA, 22 bp, Homo sapiens
tcagctctcacagatctcaacc

SEQ ID NO: 9203999 - DNA, 22 bp, Homo sapiens
tcagctctcacagatctcaacc

SEQ ID NO: 9204000 - DNA, 22 bp, Homo sapiens
tcagctctacctgggagctgtc

SEQ ID NO: 9204001 - DNA, 22 bp, Homo sapiens
tcagctctacctgggagctgtc

SEQ ID NO: 9204002 - DNA, 22 bp, Homo sapiens
tcagctctaagttttatgcaaa

SEQ ID NO: 9204003 - DNA, 22 bp, Homo sapiens
tcagctctacacacacctgtgt

SEQ ID NO: 9204004 - DNA, 22 bp, Homo sapiens
tcagctcctcatgcaggggata

SEQ ID NO: 9204005 - DNA, 22 bp, Homo sapiens
tcagctcctcagagcctcagtt

SEQ ID NO: 9204006 - DNA, 22 bp, Homo sapiens
tcaggaagaaattctgtatctt

SEQ ID NO: 9204007 - DNA, 22 bp, Homo sapiens
tcaggaagaagacggggcagga

SEQ ID NO: 9204008 - DNA, 22 bp, Homo sapiens
tcaggaagacaatctttggctc

SEQ ID NO: 9204009 - DNA, 22 bp, Homo sapiens
tcaggaagacaatctttggctc

SEQ ID NO: 9204010 - DNA, 22 bp, Homo sapiens
tcagctctgcaaggtcacctcc

SEQ ID NO: 9204011 - DNA, 22 bp, Homo sapiens
tcagctctgcactccactgtgg

SEQ ID NO: 9204012 - DNA, 22 bp, Homo sapiens
tcaggaagccactccacagaga

SEQ ID NO: 9204013 - DNA, 22 bp, Homo sapiens
tcaggaagcatcctgaggtgtc

SEQ ID NO: 9204014 - DNA, 22 bp, Homo sapiens
tcaggaagctcttgctgattct

SEQ ID NO: 9204015 - DNA, 22 bp, Homo sapiens
tcaggaagctactgccagcagc

SEQ ID NO: 9204016 - DNA, 21 bp, Homo sapiens
tcaggaagagccagttcatgc

SEQ ID NO: 9204017 - DNA, 21 bp, Homo sapiens
tcaggaagagcttctcccact

SEQ ID NO: 9204018 - DNA, 21 bp, Homo sapiens
tcaggaagagcttctcccact

SEQ ID NO: 9204019 - DNA, 22 bp, Homo sapiens
tcaggaagctgctctgggtggt

SEQ ID NO: 9204020 - DNA, 22 bp, Homo sapiens
tcaggaaggagctggcctgcca

SEQ ID NO: 9204021 - DNA, 22 bp, Homo sapiens
tcaggaagctgctctgggtggt

SEQ ID NO: 9204022 - DNA, 22 bp, Homo sapiens
tcaggaaggcgccccatcagga

SEQ ID NO: 9204023 - DNA, 22 bp, Homo sapiens
tcaggaaggcacttggtgtgtt

SEQ ID NO: 9204024 - DNA, 22 bp, Homo sapiens
tcaggaaggcacttggtgtgtt

SEQ ID NO: 9204025 - DNA, 22 bp, Homo sapiens
tcaggaaggcaaattgcatgat

SEQ ID NO: 9204026 - DNA, 22 bp, Homo sapiens
tcaggaggtgtaacgaatacag

SEQ ID NO: 9204027 - DNA, 22 bp, Homo sapiens
tccaggattgtcagccagaagg

SEQ ID NO: 9204028 - DNA, 22 bp, Homo sapiens
tccaggcagggcagccatcaag

SEQ ID NO: 9204029 - DNA, 22 bp, Homo sapiens
tccaggcagggcagccatcaag

SEQ ID NO: 9204030 - DNA, 22 bp, Homo sapiens
tccaggattgcaggtgcacaac

SEQ ID NO: 9204031 - DNA, 22 bp, Homo sapiens
tccaggatgcccgcttttgctt

SEQ ID NO: 9204032 - DNA, 22 bp, Homo sapiens
tccaggatggtgacggtggcca

SEQ ID NO: 9204033 - DNA, 22 bp, Homo sapiens
tccaggagtttgagactgcagt

SEQ ID NO: 9204034 - DNA, 22 bp, Homo sapiens
tccaggagtggggcagaggtct

SEQ ID NO: 9204035 - DNA, 22 bp, Homo sapiens
tccaggagtcctgggtggcccc

SEQ ID NO: 9204036 - DNA, 22 bp, Homo sapiens
tccaggagtctagcctcaggcc

SEQ ID NO: 9204037 - DNA, 22 bp, Homo sapiens
tccaggagtctagcctcaggcc

SEQ ID NO: 9204038 - DNA, 22 bp, Homo sapiens
tccaggagtcctgggagtgatt

SEQ ID NO: 9204039 - DNA, 22 bp, Homo sapiens
tccaggagtcagacagatggtg

SEQ ID NO: 9204040 - DNA, 22 bp, Homo sapiens
tccaggaggtttggaggaagca

SEQ ID NO: 9204041 - DNA, 22 bp, Homo sapiens
tccaggaggttgagtgagttcc

SEQ ID NO: 9204042 - DNA, 22 bp, Homo sapiens
tccaggaggttgagactgcagt

SEQ ID NO: 9204043 - DNA, 22 bp, Homo sapiens
tccaggaggtgaggggaccaaa

SEQ ID NO: 9204044 - DNA, 20 bp, Homo sapiens
tccaggaggttagtgtggct

SEQ ID NO: 9204045 - DNA, 22 bp, Homo sapiens
tccaggagggttttctgccttc

SEQ ID NO: 9204046 - DNA, 22 bp, Homo sapiens
tccaggcatagaaggcacgcac

SEQ ID NO: 9204047 - DNA, 22 bp, Homo sapiens
tccaggcatgtggccagtactc

SEQ ID NO: 9204048 - DNA, 22 bp, Homo sapiens
tccaggccacgacctcctggat

SEQ ID NO: 9204049 - DNA, 22 bp, Homo sapiens
tccaggccacgacctcctggat

SEQ ID NO: 9204050 - DNA, 22 bp, Homo sapiens
tccaggccaatgtagcaggccc

SEQ ID NO: 9204051 - DNA, 22 bp, Homo sapiens
tccaggccaatgtagcaggccc

SEQ ID NO: 9204052 - DNA, 22 bp, Homo sapiens
tccaggcatgttgggaagatga

SEQ ID NO: 9204053 - DNA, 22 bp, Homo sapiens
tccaggcattccagccattcca

SEQ ID NO: 9204054 - DNA, 23 bp, Homo sapiens
tccaggctgaaggagcagatttt

SEQ ID NO: 9204055 - DNA, 23 bp, Homo sapiens
tccaggctgaaggagcagatttt

SEQ ID NO: 9204056 - DNA, 22 bp, Homo sapiens
tccaggctctcaggtgtcagca

SEQ ID NO: 9204057 - DNA, 22 bp, Homo sapiens
tccaggctgacgcagctattta

SEQ ID NO: 9204058 - DNA, 22 bp, Homo sapiens
tccaggctgatccatgaagaat

SEQ ID NO: 9204059 - DNA, 19 bp, Homo sapiens
tccaggctgagagtcagct

SEQ ID NO: 9204060 - DNA, 21 bp, Homo sapiens
tccaggctgatgatgtcaact

SEQ ID NO: 9204061 - DNA, 22 bp, Homo sapiens
tccaggctgcaaggccacaggg

SEQ ID NO: 9204062 - DNA, 22 bp, Homo sapiens
tccaggctaggtttacaggaca

SEQ ID NO: 9204063 - DNA, 22 bp, Homo sapiens
tccaggccactgcagaggctct

SEQ ID NO: 9204064 - DNA, 22 bp, Homo sapiens
tccaggctctaggctgctctcc

SEQ ID NO: 9204065 - DNA, 22 bp, Homo sapiens
tccaggctcctgactttttggg

SEQ ID NO: 9204066 - DNA, 22 bp, Homo sapiens
tccaggctcagcacttgctact

SEQ ID NO: 9204067 - DNA, 22 bp, Homo sapiens
tccaggctggaaatgtcaaact

SEQ ID NO: 9204068 - DNA, 22 bp, Homo sapiens
tccaggctgccacagtgcaacg

SEQ ID NO: 9204069 - DNA, 22 bp, Homo sapiens
tccaggctgcagtcttgccctc

SEQ ID NO: 9204070 - DNA, 20 bp, Homo sapiens
tccagggccctggctcctct

SEQ ID NO: 9204071 - DNA, 20 bp, Homo sapiens
tccagggccctggctcctct

SEQ ID NO: 9204072 - DNA, 22 bp, Homo sapiens
tccagggccagtccttgtctgt

SEQ ID NO: 9204073 - DNA, 20 bp, Homo sapiens
tccagggctagggagctcat

SEQ ID NO: 9204074 - DNA, 22 bp, Homo sapiens
tccagggccttacctcttcaga

SEQ ID NO: 9204075 - DNA, 20 bp, Homo sapiens
tccagggccctggctcctct

SEQ ID NO: 9204076 - DNA, 22 bp, Homo sapiens
tccagggctccccaacatccag

SEQ ID NO: 9204077 - DNA, 22 bp, Homo sapiens
tccagggctacaaggcaccaga

SEQ ID NO: 9204078 - DNA, 20 bp, Homo sapiens
tccagggctagggagctcat

SEQ ID NO: 9204079 - DNA, 22 bp, Homo sapiens
tccagggctcattccctctgca

SEQ ID NO: 9204080 - DNA, 22 bp, Homo sapiens
tccagggctcattccctctgca

SEQ ID NO: 9204081 - DNA, 22 bp, Homo sapiens
tccagtttcatagctaaggaac

SEQ ID NO: 9204082 - DNA, 22 bp, Homo sapiens
tccagtttatttttggcagggt

SEQ ID NO: 9204083 - DNA, 22 bp, Homo sapiens
tcccaagcaatgagtcagggcc

SEQ ID NO: 9204084 - DNA, 22 bp, Homo sapiens
tcccaaggataagagagtctga

SEQ ID NO: 9204085 - DNA, 21 bp, Homo sapiens
tcccacagaaactgcgaaatt

SEQ ID NO: 9204086 - DNA, 22 bp, Homo sapiens
tcccaagtgtcttggaccaggg

SEQ ID NO: 9204087 - DNA, 22 bp, Homo sapiens
tcccaagtagatgggaatacag

SEQ ID NO: 9204088 - DNA, 22 bp, Homo sapiens
tcccacagatgctgtccagagt

SEQ ID NO: 9204089 - DNA, 22 bp, Homo sapiens
tcccacagcttcgtgcttcccc

SEQ ID NO: 9204090 - DNA, 21 bp, Homo sapiens
tcccacagcgccagctcctgt

SEQ ID NO: 9204091 - DNA, 22 bp, Homo sapiens
tcccacagagtggctcacctag

SEQ ID NO: 9204092 - DNA, 22 bp, Homo sapiens
tccatctgtctttcccatccac

SEQ ID NO: 9204093 - DNA, 22 bp, Homo sapiens
tccatctggtggcttccttttg

SEQ ID NO: 9204094 - DNA, 19 bp, Homo sapiens
tccagctggtatgcccaga

SEQ ID NO: 9204095 - DNA, 22 bp, Homo sapiens
tccagctgtactttgtcctggc

SEQ ID NO: 9204096 - DNA, 22 bp, Homo sapiens
tccagctgtagtggatttgaga

SEQ ID NO: 9204097 - DNA, 22 bp, Homo sapiens
tccagctggggacatgggcttc

SEQ ID NO: 9204098 - DNA, 22 bp, Homo sapiens
tccagctggggcagtggctggg

SEQ ID NO: 9204099 - DNA, 22 bp, Homo sapiens
tccaggaaacagcatctcagca

SEQ ID NO: 9204100 - DNA, 22 bp, Homo sapiens
tccaggaaacagcatctcagca

SEQ ID NO: 9204101 - DNA, 22 bp, Homo sapiens
tccaggaaacactcaagccatg

SEQ ID NO: 9204102 - DNA, 22 bp, Homo sapiens
tccaggaaacactcaagccatg

SEQ ID NO: 9204103 - DNA, 22 bp, Homo sapiens
tccagctttgagattttatgga

SEQ ID NO: 9204104 - DNA, 22 bp, Homo sapiens
tccaggaaagcactgggctggg

SEQ ID NO: 9204105 - DNA, 22 bp, Homo sapiens
tccaggaaaaggcttgcagggg

SEQ ID NO: 9204106 - DNA, 21 bp, Homo sapiens
tccaggaaagttttaagagtg

SEQ ID NO: 9204107 - DNA, 21 bp, Homo sapiens
tccaggaaagttttaagagtg

SEQ ID NO: 9204108 - DNA, 22 bp, Homo sapiens
tccaggaaacatctccgcctaa

SEQ ID NO: 9204109 - DNA, 22 bp, Homo sapiens
tccaggaaagtgggatgtgtgt

SEQ ID NO: 9204110 - DNA, 22 bp, Homo sapiens
tccaggaaagtgggatgtgtgt

SEQ ID NO: 9204111 - DNA, 22 bp, Homo sapiens
tccaggaggcctcatttcctgt

SEQ ID NO: 9204112 - DNA, 22 bp, Homo sapiens
tccaggaggctctggttgacgt

SEQ ID NO: 9204113 - DNA, 22 bp, Homo sapiens
tccagctgttgatattctaggt

SEQ ID NO: 9204114 - DNA, 22 bp, Homo sapiens
tccagctgttccatcagctctt

SEQ ID NO: 9204115 - DNA, 22 bp, Homo sapiens
tccagctgtgctccaggaggtg

SEQ ID NO: 9204116 - DNA, 19 bp, Homo sapiens
tccagctgttttgagtcac

SEQ ID NO: 9204117 - DNA, 19 bp, Homo sapiens
tccagctgttttgagtcac

SEQ ID NO: 9204118 - DNA, 22 bp, Homo sapiens
tccagcttataggtagatttaa

SEQ ID NO: 9204119 - DNA, 22 bp, Homo sapiens
tccagcttcttgacttggtggt

SEQ ID NO: 9204120 - DNA, 22 bp, Homo sapiens
tccagcttgacaaatgatttta

SEQ ID NO: 9204121 - DNA, 22 bp, Homo sapiens
tccagcttgcctggtcttttgg

SEQ ID NO: 9204122 - DNA, 23 bp, Homo sapiens
tccagctcccttcaatggcactg

SEQ ID NO: 9204123 - DNA, 22 bp, Homo sapiens
tccagctcccactctcactgct

SEQ ID NO: 9204124 - DNA, 22 bp, Homo sapiens
tccagctcagggttggctcaag

SEQ ID NO: 9204125 - DNA, 22 bp, Homo sapiens
tccagctcagggttggctcaag

SEQ ID NO: 9204126 - DNA, 18 bp, Homo sapiens
tccagctcacagatgggc

SEQ ID NO: 9204127 - DNA, 22 bp, Homo sapiens
tccagctcaaagtgctcctgtc

SEQ ID NO: 9204128 - DNA, 22 bp, Homo sapiens
tccagcatgactagttccccat

SEQ ID NO: 9204129 - DNA, 22 bp, Homo sapiens
tccagcattcttagacctctat

SEQ ID NO: 9204130 - DNA, 22 bp, Homo sapiens
tccagccaactgcctagggagc

SEQ ID NO: 9204131 - DNA, 22 bp, Homo sapiens
tccagccaatcagagctgaggc

SEQ ID NO: 9204132 - DNA, 22 bp, Homo sapiens
tccagcctttctactcactgag

SEQ ID NO: 9204133 - DNA, 22 bp, Homo sapiens
tccagcagtccatgtgagacac

SEQ ID NO: 9204134 - DNA, 22 bp, Homo sapiens
tccagcagtccatgtgagacac

SEQ ID NO: 9204135 - DNA, 20 bp, Homo sapiens
tccagcatataaactcctct

SEQ ID NO: 9204136 - DNA, 22 bp, Homo sapiens
tccagcagtgctcaggactcac

SEQ ID NO: 9204137 - DNA, 22 bp, Homo sapiens
tccagacattttatagcagtct

SEQ ID NO: 9204138 - DNA, 20 bp, Homo sapiens
tccagagagtggcaaagctc

SEQ ID NO: 9204139 - DNA, 19 bp, Homo sapiens
tccagaagtccctgagcgg

SEQ ID NO: 9204140 - DNA, 22 bp, Homo sapiens
tccagagccccagtctagtggg

SEQ ID NO: 9204141 - DNA, 22 bp, Homo sapiens
tccagagcatgcagatcatcaa

SEQ ID NO: 9204142 - DNA, 22 bp, Homo sapiens
tccagagcaggtggtcagaagg

SEQ ID NO: 9204143 - DNA, 22 bp, Homo sapiens
tccagagcaggtggtcagaagg

SEQ ID NO: 9204144 - DNA, 17 bp, Homo sapiens
tccagagcacagagctc

SEQ ID NO: 9204145 - DNA, 22 bp, Homo sapiens
tccagagctaattcagcagctg

SEQ ID NO: 9204146 - DNA, 22 bp, Homo sapiens
tccagagctaattcagcagctg

SEQ ID NO: 9204147 - DNA, 22 bp, Homo sapiens
tccagagcctttccacccactt

SEQ ID NO: 9204148 - DNA, 22 bp, Homo sapiens
tccagagcctgcgcactggctg

SEQ ID NO: 9204149 - DNA, 22 bp, Homo sapiens
tccagagcctgcgcactggctg

SEQ ID NO: 9204150 - DNA, 22 bp, Homo sapiens
tccagagctctgggcatagctg

SEQ ID NO: 9204151 - DNA, 22 bp, Homo sapiens
tccagagctgggtctgtgctca

SEQ ID NO: 9204152 - DNA, 22 bp, Homo sapiens
tccagagctgagggtcagtaga

SEQ ID NO: 9204153 - DNA, 22 bp, Homo sapiens
tccagaggggcagccctgtgct

SEQ ID NO: 9204154 - DNA, 22 bp, Homo sapiens
tccagagggcgatggctggggg

SEQ ID NO: 9204155 - DNA, 22 bp, Homo sapiens
tccagaggctccaaagggagat

SEQ ID NO: 9204156 - DNA, 22 bp, Homo sapiens
tccagaggctctgagggagagt

SEQ ID NO: 9204157 - DNA, 22 bp, Homo sapiens
tccagcaggtgtttgccaactt

SEQ ID NO: 9204158 - DNA, 18 bp, Homo sapiens
tccagcaggtctgaggtg

SEQ ID NO: 9204159 - DNA, 22 bp, Homo sapiens
tccagcaggtccgagacaagtt

SEQ ID NO: 9204160 - DNA, 22 bp, Homo sapiens
tccagcagccacacctctggac

SEQ ID NO: 9204161 - DNA, 23 bp, Homo sapiens
tccagcagccaagaagggtagaa

SEQ ID NO: 9204162 - DNA, 23 bp, Homo sapiens
tccagcagagccttccaggaggg

SEQ ID NO: 9204163 - DNA, 22 bp, Homo sapiens
tccagcagactcatcagcaagg

SEQ ID NO: 9204164 - DNA, 22 bp, Homo sapiens
tccccacacagatacagagtag

SEQ ID NO: 9204165 - DNA, 19 bp, Homo sapiens
tccccaagagttctagctc

SEQ ID NO: 9204166 - DNA, 22 bp, Homo sapiens
tccccacatctctgcatcaggc

SEQ ID NO: 9204167 - DNA, 22 bp, Homo sapiens
tccccaggaaattctgattctt

SEQ ID NO: 9204168 - DNA, 22 bp, Homo sapiens
tccccaggaaggcccttcctgg

SEQ ID NO: 9204169 - DNA, 22 bp, Homo sapiens
tccccaggaaattctgattctt

SEQ ID NO: 9204170 - DNA, 22 bp, Homo sapiens
tccccaggaatcaggtggttgc

SEQ ID NO: 9204171 - DNA, 22 bp, Homo sapiens
tccccaggactaagttgcaatc

SEQ ID NO: 9204172 - DNA, 22 bp, Homo sapiens
tccccaggagcaatgattcagt

SEQ ID NO: 9204173 - DNA, 22 bp, Homo sapiens
tccccaggaaggcccttcctgg

SEQ ID NO: 9204174 - DNA, 22 bp, Homo sapiens
tccccaggaatcaggtggttgc

SEQ ID NO: 9204175 - DNA, 22 bp, Homo sapiens
tccccaggaaggcccttcctgg

SEQ ID NO: 9204176 - DNA, 22 bp, Homo sapiens
tccccaggaatcaggtggttgc

SEQ ID NO: 9204177 - DNA, 22 bp, Homo sapiens
tccccacctacacactgctcct

SEQ ID NO: 9204178 - DNA, 22 bp, Homo sapiens
tccccaccccagaactactagg

SEQ ID NO: 9204179 - DNA, 22 bp, Homo sapiens
tccccacctaagatacccatct

SEQ ID NO: 9204180 - DNA, 20 bp, Homo sapiens
tccccagggcatcaggagca

SEQ ID NO: 9204181 - DNA, 20 bp, Homo sapiens
tccccagggcatcaggagca

SEQ ID NO: 9204182 - DNA, 22 bp, Homo sapiens
tccccagggctgcagagggtgt

SEQ ID NO: 9204183 - DNA, 22 bp, Homo sapiens
tccccaggagttttactttgca

SEQ ID NO: 9204184 - DNA, 22 bp, Homo sapiens
tccccaggagcaatgattcagt

SEQ ID NO: 9204185 - DNA, 22 bp, Homo sapiens
tccccaggagttttactttgca

SEQ ID NO: 9204186 - DNA, 22 bp, Homo sapiens
tccccaggagcaatgattcagt

SEQ ID NO: 9204187 - DNA, 22 bp, Homo sapiens
tccccaggggcctgggcacagt

SEQ ID NO: 9204188 - DNA, 22 bp, Homo sapiens
tccccagggtccctgcttccat

SEQ ID NO: 9204189 - DNA, 22 bp, Homo sapiens
tccccaggggcctgggcacagt

SEQ ID NO: 9204190 - DNA, 22 bp, Homo sapiens
tccccaggggcatctctctgct

SEQ ID NO: 9204191 - DNA, 22 bp, Homo sapiens
tccccaggggcatctctctgct

SEQ ID NO: 9204192 - DNA, 22 bp, Homo sapiens
tccccaggggcatctctctgct

SEQ ID NO: 9204193 - DNA, 22 bp, Homo sapiens
tccccagggtccctgcttccat

SEQ ID NO: 9204194 - DNA, 22 bp, Homo sapiens
tcccaggttccaccatccaggg

SEQ ID NO: 9204195 - DNA, 22 bp, Homo sapiens
tcccatctccaacatttttctt

SEQ ID NO: 9204196 - DNA, 21 bp, Homo sapiens
tcccagggtcttatgggatgt

SEQ ID NO: 9204197 - DNA, 22 bp, Homo sapiens
tcccagggtgaaatgcagtagg

SEQ ID NO: 9204198 - DNA, 22 bp, Homo sapiens
tcccagggtcctcttctggaat

SEQ ID NO: 9204199 - DNA, 22 bp, Homo sapiens
tcccagggattaggacatggat

SEQ ID NO: 9204200 - DNA, 22 bp, Homo sapiens
tcccagggatcctccgggtcgc

SEQ ID NO: 9204201 - DNA, 22 bp, Homo sapiens
tcccagggtgcgcctgccctcg

SEQ ID NO: 9204202 - DNA, 22 bp, Homo sapiens
tcccagggtgcgcctgccctcg

SEQ ID NO: 9204203 - DNA, 22 bp, Homo sapiens
tcccagggttacagccagggca

SEQ ID NO: 9204204 - DNA, 22 bp, Homo sapiens
tcccagggttacagccagggca

SEQ ID NO: 9204205 - DNA, 22 bp, Homo sapiens
tcccaggtctttgggttcctca

SEQ ID NO: 9204206 - DNA, 22 bp, Homo sapiens
tcccacaggaaagtagacattg

SEQ ID NO: 9204207 - DNA, 22 bp, Homo sapiens
tcccacaggagcctgagtccca

SEQ ID NO: 9204208 - DNA, 22 bp, Homo sapiens
tcccacagggcttctctgtaca

SEQ ID NO: 9204209 - DNA, 22 bp, Homo sapiens
tcccagggactgggctaggctt

SEQ ID NO: 9204210 - DNA, 22 bp, Homo sapiens
tcccagggactggatgatgcag

SEQ ID NO: 9204211 - DNA, 22 bp, Homo sapiens
tcccacaggtggagcttgcagt

SEQ ID NO: 9204212 - DNA, 22 bp, Homo sapiens
tagcagaggaaaagagaacatt

SEQ ID NO: 9204213 - DNA, 22 bp, Homo sapiens
tagcagagcagggatcagagcc

SEQ ID NO: 9204214 - DNA, 22 bp, Homo sapiens
tagcagctacctggctaagagt

SEQ ID NO: 9204215 - DNA, 22 bp, Homo sapiens
tagcagcaggggaaacagctgt

SEQ ID NO: 9204216 - DNA, 22 bp, Homo sapiens
tagaggggaatctgcctcctct

SEQ ID NO: 9204217 - DNA, 20 bp, Homo sapiens
tagaggggacaatcattgcc

SEQ ID NO: 9204218 - DNA, 22 bp, Homo sapiens
tagaggggaaaatgcgtattaa

SEQ ID NO: 9204219 - DNA, 18 bp, Homo sapiens
tagaggggaagaccttta

SEQ ID NO: 9204220 - DNA, 18 bp, Homo sapiens
tagagggggcctgggcat

SEQ ID NO: 9204221 - DNA, 22 bp, Homo sapiens
tagaggtgagatattttatttt

SEQ ID NO: 9204222 - DNA, 22 bp, Homo sapiens
tagctcctggtgagcctactct

SEQ ID NO: 9204223 - DNA, 22 bp, Homo sapiens
tagctcctggtgagcctactct

SEQ ID NO: 9204224 - DNA, 22 bp, Homo sapiens
tagctctgaccaagagactgag

SEQ ID NO: 9204225 - DNA, 22 bp, Homo sapiens
tagcccaggctggagtgcaggg

SEQ ID NO: 9204226 - DNA, 22 bp, Homo sapiens
tagcccaggctgtagtgcagtg

SEQ ID NO: 9204227 - DNA, 22 bp, Homo sapiens
tagcccagcttggcctatttct

SEQ ID NO: 9204228 - DNA, 22 bp, Homo sapiens
tagcccaggctggagggcagtg

SEQ ID NO: 9204229 - DNA, 22 bp, Homo sapiens
tagcccagcatgagcagagctg

SEQ ID NO: 9204230 - DNA, 22 bp, Homo sapiens
tagcagctccatttctctggca

SEQ ID NO: 9204231 - DNA, 22 bp, Homo sapiens
tagcagctatgccattttgaca

SEQ ID NO: 9204232 - DNA, 22 bp, Homo sapiens
tagcagctcacagcctcccatt

SEQ ID NO: 9204233 - DNA, 22 bp, Homo sapiens
tagcagctcactaactctgcgt

SEQ ID NO: 9204234 - DNA, 21 bp, Homo sapiens
tagcccttctccacctcgccc

SEQ ID NO: 9204235 - DNA, 19 bp, Homo sapiens
tagccctggccatcatgag

SEQ ID NO: 9204236 - DNA, 22 bp, Homo sapiens
tagccccagctactcggaagct

SEQ ID NO: 9204237 - DNA, 22 bp, Homo sapiens
taggatggtacaaggcaggggt

SEQ ID NO: 9204238 - DNA, 22 bp, Homo sapiens
taggatgaggggtggccaagta

SEQ ID NO: 9204239 - DNA, 21 bp, Homo sapiens
taggatgaaagtgagtgagaa

SEQ ID NO: 9204240 - DNA, 22 bp, Homo sapiens
taggagtcatttggtccctctt

SEQ ID NO: 9204241 - DNA, 22 bp, Homo sapiens
taggatacaaattctgtaattt

SEQ ID NO: 9204242 - DNA, 22 bp, Homo sapiens
tagctttgcctgaagtaatcag

SEQ ID NO: 9204243 - DNA, 22 bp, Homo sapiens
tagctttgcccgtgctggattt

SEQ ID NO: 9204244 - DNA, 22 bp, Homo sapiens
tagctttgctggcaagcatgtc

SEQ ID NO: 9204245 - DNA, 22 bp, Homo sapiens
tagctttgcctgttaatcacaa

SEQ ID NO: 9204246 - DNA, 22 bp, Homo sapiens
tagctttggattctttggggaa

SEQ ID NO: 9204247 - DNA, 22 bp, Homo sapiens
tagctttgggaatgctctcctg

SEQ ID NO: 9204248 - DNA, 22 bp, Homo sapiens
tagctttgaagttatttaacag

SEQ ID NO: 9204249 - DNA, 22 bp, Homo sapiens
tagctttgacagttgcaggcag

SEQ ID NO: 9204250 - DNA, 22 bp, Homo sapiens
tagctttgaacttctgggctca

SEQ ID NO: 9204251 - DNA, 22 bp, Homo sapiens
tagctttgccacacatgtagat

SEQ ID NO: 9204252 - DNA, 22 bp, Homo sapiens
tagctttgccatctgtcacata

SEQ ID NO: 9204253 - DNA, 22 bp, Homo sapiens
tagctttgaccaacgactggtc

SEQ ID NO: 9204254 - DNA, 22 bp, Homo sapiens
tagctttgcaaaggaagtttta

SEQ ID NO: 9204255 - DNA, 22 bp, Homo sapiens
tagctttagtgaaaaatatcag

SEQ ID NO: 9204256 - DNA, 22 bp, Homo sapiens
tagctttgttagaatgtcttca

SEQ ID NO: 9204257 - DNA, 22 bp, Homo sapiens
tagctttgtgtcctgatttagc

SEQ ID NO: 9204258 - DNA, 16 bp, Homo sapiens
tagctttgtgttgtgg

SEQ ID NO: 9204259 - DNA, 22 bp, Homo sapiens
tagctttgtgtatgatgtctgt

SEQ ID NO: 9204260 - DNA, 22 bp, Homo sapiens
tagctttgtgaagtttacagac

SEQ ID NO: 9204261 - DNA, 22 bp, Homo sapiens
tagctttgtcctccaccctcag

SEQ ID NO: 9204262 - DNA, 22 bp, Homo sapiens
tagctttgtattatcagcattg

SEQ ID NO: 9204263 - DNA, 22 bp, Homo sapiens
tagctttgtttatcaaggggca

SEQ ID NO: 9204264 - DNA, 22 bp, Homo sapiens
taggaaaagtctagattgatga

SEQ ID NO: 9204265 - DNA, 22 bp, Homo sapiens
taggaaaagtctagattgatga

SEQ ID NO: 9204266 - DNA, 22 bp, Homo sapiens
tagggaggagggttttcaaatc

SEQ ID NO: 9204267 - DNA, 22 bp, Homo sapiens
tagggaggctacttcttgtagg

SEQ ID NO: 9204268 - DNA, 22 bp, Homo sapiens
taggcactggttgtggatagtt

SEQ ID NO: 9204269 - DNA, 22 bp, Homo sapiens
tagggacactgctcatgagttc

SEQ ID NO: 9204270 - DNA, 22 bp, Homo sapiens
taggcacaagaccatgcaaagg

SEQ ID NO: 9204271 - DNA, 22 bp, Homo sapiens
taggcacaaaatgaaaatggca

SEQ ID NO: 9204272 - DNA, 22 bp, Homo sapiens
taggcactgaccttctcagatt

SEQ ID NO: 9204273 - DNA, 22 bp, Homo sapiens
taggcaagttgcccaatctctc

SEQ ID NO: 9204274 - DNA, 22 bp, Homo sapiens
taggcaagtggaccagaggttt

SEQ ID NO: 9204275 - DNA, 22 bp, Homo sapiens
tagaggcataagagggaagcag

SEQ ID NO: 9204276 - DNA, 22 bp, Homo sapiens
tagaggcataagagggaagcag

SEQ ID NO: 9204277 - DNA, 22 bp, Homo sapiens
tagacagatgttttctggctgt

SEQ ID NO: 9204278 - DNA, 21 bp, Homo sapiens
tagaggcaggagggactgcag

SEQ ID NO: 9204279 - DNA, 21 bp, Homo sapiens
tagaggcaggagggactgcag

SEQ ID NO: 9204280 - DNA, 22 bp, Homo sapiens
tagaaatggagaacagattaat

SEQ ID NO: 9204281 - DNA, 22 bp, Homo sapiens
tagaattgggcctaacttccat

SEQ ID NO: 9204282 - DNA, 22 bp, Homo sapiens
tagacaatatttgaaagtagtg

SEQ ID NO: 9204283 - DNA, 22 bp, Homo sapiens
tagaaagtaaatcagttttatt

SEQ ID NO: 9204284 - DNA, 22 bp, Homo sapiens
tagaaagccctgtgttcactgc

SEQ ID NO: 9204285 - DNA, 19 bp, Homo sapiens
tagaaagccagaaaacaga

SEQ ID NO: 9204286 - DNA, 22 bp, Homo sapiens
tagaaagcgttaaatctacaga

SEQ ID NO: 9204287 - DNA, 22 bp, Homo sapiens
tagaaagctgagtaatacattt

SEQ ID NO: 9204288 - DNA, 22 bp, Homo sapiens
tagaaatgattggttgagctct

SEQ ID NO: 9204289 - DNA, 22 bp, Homo sapiens
tagaaatgaatgtttaaaagtc

SEQ ID NO: 9204290 - DNA, 22 bp, Homo sapiens
tagaaatgattgagctgtaata

SEQ ID NO: 9204291 - DNA, 22 bp, Homo sapiens
tagaaacattcagttgcagtcc

SEQ ID NO: 9204292 - DNA, 22 bp, Homo sapiens
tagaaacatatgtttgagacat

SEQ ID NO: 9204293 - DNA, 22 bp, Homo sapiens
tagaaaccatctcactgctcag

SEQ ID NO: 9204294 - DNA, 22 bp, Homo sapiens
tagaaacccaggatttgtattt

SEQ ID NO: 9204295 - DNA, 22 bp, Homo sapiens
tagaaaccctgccttagtagct

SEQ ID NO: 9204296 - DNA, 22 bp, Homo sapiens
tagaaacccatgtttattcagt

SEQ ID NO: 9204297 - DNA, 22 bp, Homo sapiens
tagaaacccatgtttattcagt

SEQ ID NO: 9204298 - DNA, 22 bp, Homo sapiens
tagaaacctcagggaaatcttt

SEQ ID NO: 9204299 - DNA, 22 bp, Homo sapiens
tagaaactactagaataagaga

SEQ ID NO: 9204300 - DNA, 22 bp, Homo sapiens
tagaaacagaaaactgtaatag

SEQ ID NO: 9204301 - DNA, 22 bp, Homo sapiens
tagaaacagaatatgagtgaga

SEQ ID NO: 9204302 - DNA, 22 bp, Homo sapiens
tagaaacagcatatattagccc

SEQ ID NO: 9204303 - DNA, 22 bp, Homo sapiens
tagaaacagaatatgagtgaga

SEQ ID NO: 9204304 - DNA, 22 bp, Homo sapiens
tagaaacagaatatgagtgaga

SEQ ID NO: 9204305 - DNA, 22 bp, Homo sapiens
tacatttgttatagaaatgaag

SEQ ID NO: 9204306 - DNA, 22 bp, Homo sapiens
tacattttctaggggaccaaga

SEQ ID NO: 9204307 - DNA, 22 bp, Homo sapiens
tacttttaaaattcacaggtat

SEQ ID NO: 9204308 - DNA, 19 bp, Homo sapiens
tactttttcaggacagagt

SEQ ID NO: 9204309 - DNA, 22 bp, Homo sapiens
tagaaaagataacattctgtgc

SEQ ID NO: 9204310 - DNA, 22 bp, Homo sapiens
tagaaaagaattttatttgata

SEQ ID NO: 9204311 - DNA, 22 bp, Homo sapiens
tactttttatgataagaactga

SEQ ID NO: 9204312 - DNA, 20 bp, Homo sapiens
tatttacaacttagagcctc

SEQ ID NO: 9204313 - DNA, 21 bp, Homo sapiens
tatttattaatttgtaaggct

SEQ ID NO: 9204314 - DNA, 22 bp, Homo sapiens
tattctctccccaatcttgctt

SEQ ID NO: 9204315 - DNA, 19 bp, Homo sapiens
tattctgttaacctttgtc

SEQ ID NO: 9204316 - DNA, 22 bp, Homo sapiens
tattgaattagaccctaaaatg

SEQ ID NO: 9204317 - DNA, 19 bp, Homo sapiens
tattatttgtagcaaggcc

SEQ ID NO: 9204318 - DNA, 22 bp, Homo sapiens
tattcaaagtaccttcattgcc

SEQ ID NO: 9204319 - DNA, 22 bp, Homo sapiens
tattcatgagataggcagtttt

SEQ ID NO: 9204320 - DNA, 22 bp, Homo sapiens
tattccttggcaaaaaatatat

SEQ ID NO: 9204321 - DNA, 22 bp, Homo sapiens
tatgtcttttgcttgcaaatag

SEQ ID NO: 9204322 - DNA, 19 bp, Homo sapiens
tatgtgtgcatttgtgcat

SEQ ID NO: 9204323 - DNA, 22 bp, Homo sapiens
tattagaaagcttaatatcgtg

SEQ ID NO: 9204324 - DNA, 22 bp, Homo sapiens
tatgtacagggatagaacttga

SEQ ID NO: 9204325 - DNA, 22 bp, Homo sapiens
tatgtacagtccttaacttaaa

SEQ ID NO: 9204326 - DNA, 22 bp, Homo sapiens
tatgtacataacatgaaatgca

SEQ ID NO: 9204327 - DNA, 22 bp, Homo sapiens
tatgtacagggatagaacttga

SEQ ID NO: 9204328 - DNA, 22 bp, Homo sapiens
tatgtcctgctactctctcatg

SEQ ID NO: 9204329 - DNA, 22 bp, Homo sapiens
tatgaggtaggtattatactta

SEQ ID NO: 9204330 - DNA, 22 bp, Homo sapiens
tatacacacctccaaagcagga

SEQ ID NO: 9204331 - DNA, 22 bp, Homo sapiens
tatacacatttttacctatagt

SEQ ID NO: 9204332 - DNA, 22 bp, Homo sapiens
tatagcaaggacataatatgct

SEQ ID NO: 9204333 - DNA, 17 bp, Homo sapiens
tatacacagacagactg

SEQ ID NO: 9204334 - DNA, 22 bp, Homo sapiens
tatacacatcctccaaagatag

SEQ ID NO: 9204335 - DNA, 22 bp, Homo sapiens
taggtggtgggatatgagcatc

SEQ ID NO: 9204336 - DNA, 22 bp, Homo sapiens
taggtggtgtgcgaagagcgtg

SEQ ID NO: 9204337 - DNA, 22 bp, Homo sapiens
tatctaagaattccagagaaag

SEQ ID NO: 9204338 - DNA, 22 bp, Homo sapiens
tatctaagaattccagagaaag

SEQ ID NO: 9204339 - DNA, 22 bp, Homo sapiens
tatctaaggtatatgaggaatc

SEQ ID NO: 9204340 - DNA, 22 bp, Homo sapiens
tatatatatgcacacacaccta

SEQ ID NO: 9204341 - DNA, 20 bp, Homo sapiens
tatagtcccttttatgaagg

SEQ ID NO: 9204342 - DNA, 22 bp, Homo sapiens
tatagcaattcagaatacatgt

SEQ ID NO: 9204343 - DNA, 22 bp, Homo sapiens
tatccaattcaccattgatggg

SEQ ID NO: 9204344 - DNA, 22 bp, Homo sapiens
tatccatggccaatcaaataca

SEQ ID NO: 9204345 - DNA, 22 bp, Homo sapiens
tatccattatgttggctagtct

SEQ ID NO: 9204346 - DNA, 22 bp, Homo sapiens
tatccatttattttctaggcaa

SEQ ID NO: 9204347 - DNA, 22 bp, Homo sapiens
tatccattaggtctatggtcaa

SEQ ID NO: 9204348 - DNA, 22 bp, Homo sapiens
tatccatagtttatagatcaag

SEQ ID NO: 9204349 - DNA, 22 bp, Homo sapiens
taaggcaagagcagggtctttg

SEQ ID NO: 9204350 - DNA, 22 bp, Homo sapiens
taaggcaaagtgatttcttaaa

SEQ ID NO: 9204351 - DNA, 22 bp, Homo sapiens
taaggccaccgttatagaacca

SEQ ID NO: 9204352 - DNA, 22 bp, Homo sapiens
taaggcccgtgagtttcatatc

SEQ ID NO: 9204353 - DNA, 22 bp, Homo sapiens
taagggttcagaatgcagtggt

SEQ ID NO: 9204354 - DNA, 22 bp, Homo sapiens
taatacatcattcatctaagga

SEQ ID NO: 9204355 - DNA, 22 bp, Homo sapiens
taataatagcagtagctgccac

SEQ ID NO: 9204356 - DNA, 22 bp, Homo sapiens
taatacattacctaacctctct

SEQ ID NO: 9204357 - DNA, 22 bp, Homo sapiens
taatacatgtattccagagagt

SEQ ID NO: 9204358 - DNA, 22 bp, Homo sapiens
taagtacatttgggaccacctg

SEQ ID NO: 9204359 - DNA, 18 bp, Homo sapiens
tacaaactccttgaaggc

SEQ ID NO: 9204360 - DNA, 22 bp, Homo sapiens
tacaaactccgaagtttgtacc

SEQ ID NO: 9204361 - DNA, 22 bp, Homo sapiens
tacaaactctttatatttcata

SEQ ID NO: 9204362 - DNA, 22 bp, Homo sapiens
tacaaactgtccagcccagagg

SEQ ID NO: 9204363 - DNA, 22 bp, Homo sapiens
tacaaactgttattattattgt

SEQ ID NO: 9204364 - DNA, 20 bp, Homo sapiens
tacaaagagcccctctcttc

SEQ ID NO: 9204365 - DNA, 22 bp, Homo sapiens
taatagaatagtggaaacattg

SEQ ID NO: 9204366 - DNA, 22 bp, Homo sapiens
taatagaaaggtattttttgca

SEQ ID NO: 9204367 - DNA, 22 bp, Homo sapiens
taatagaaaggtattttttgca

SEQ ID NO: 9204368 - DNA, 17 bp, Homo sapiens
tacaggagagcaggaac

SEQ ID NO: 9204369 - DNA, 22 bp, Homo sapiens
tacattctcttcccattgtctc

SEQ ID NO: 9204370 - DNA, 22 bp, Homo sapiens
tacattctggaaaggcacagac

SEQ ID NO: 9204371 - DNA, 22 bp, Homo sapiens
tacattctggaaaggcacagac

SEQ ID NO: 9204372 - DNA, 16 bp, Homo sapiens
tacattctgatcactg

SEQ ID NO: 9204373 - DNA, 22 bp, Homo sapiens
tacattctgaaataaatggttt

SEQ ID NO: 9204374 - DNA, 22 bp, Homo sapiens
tacattctatatctgttacatc

SEQ ID NO: 9204375 - DNA, 22 bp, Homo sapiens
tacattctactttttcactccc

SEQ ID NO: 9204376 - DNA, 23 bp, Homo sapiens
tacattctgtatttttatagagt

SEQ ID NO: 9204377 - DNA, 22 bp, Homo sapiens
tacattctggtggagaaagtaa

SEQ ID NO: 9204378 - DNA, 22 bp, Homo sapiens
tacatttgctttgattttcagc

SEQ ID NO: 9204379 - DNA, 21 bp, Homo sapiens
tacattgactacaaataaagc

SEQ ID NO: 9204380 - DNA, 22 bp, Homo sapiens
tacatatagacagttactctag

SEQ ID NO: 9204381 - DNA, 22 bp, Homo sapiens
tacatatactgagtgatttgct

SEQ ID NO: 9204382 - DNA, 22 bp, Homo sapiens
tacatagctcctagtgatgcat

SEQ ID NO: 9204383 - DNA, 22 bp, Homo sapiens
tacatctatctagatgctcaga

SEQ ID NO: 9204384 - DNA, 18 bp, Homo sapiens
tacagaactggagtagaa

SEQ ID NO: 9204385 - DNA, 22 bp, Homo sapiens
tacagaaatacagtcaggccta

SEQ ID NO: 9204386 - DNA, 22 bp, Homo sapiens
tacagaaatacagtcaggccta

SEQ ID NO: 9204387 - DNA, 22 bp, Homo sapiens
tacagaaatcacatcgctttga

SEQ ID NO: 9204388 - DNA, 22 bp, Homo sapiens
tacagaaattgccaccagctct

SEQ ID NO: 9204389 - DNA, 22 bp, Homo sapiens
tacagagtgttattacagaatc

SEQ ID NO: 9204390 - DNA, 20 bp, Homo sapiens
tacaacaagtagagacatac

SEQ ID NO: 9204391 - DNA, 20 bp, Homo sapiens
tacagaaacaggacttttgg

SEQ ID NO: 9204392 - DNA, 22 bp, Homo sapiens
tacagaaagggatgattgatct

SEQ ID NO: 9204393 - DNA, 22 bp, Homo sapiens
tacagaaaaactggcattgaag

SEQ ID NO: 9204394 - DNA, 22 bp, Homo sapiens
tacagaaacagcgtggttagaa

SEQ ID NO: 9204395 - DNA, 22 bp, Homo sapiens
gtttcagagtagaacctcaagg

SEQ ID NO: 9204396 - DNA, 22 bp, Homo sapiens
gtttcataattcaatcaaatga

SEQ ID NO: 9204397 - DNA, 22 bp, Homo sapiens
gtttcatagcatatacgtgtgt

SEQ ID NO: 9204398 - DNA, 22 bp, Homo sapiens
gtttcatagctacgattttggg

SEQ ID NO: 9204399 - DNA, 22 bp, Homo sapiens
gtttcatacagattattcatgg

SEQ ID NO: 9204400 - DNA, 22 bp, Homo sapiens
gtttcatatgcagttaacagca

SEQ ID NO: 9204401 - DNA, 22 bp, Homo sapiens
gtttcataggcatgtgacctat

SEQ ID NO: 9204402 - DNA, 22 bp, Homo sapiens
gtttcatatatagtaactgaaa

SEQ ID NO: 9204403 - DNA, 22 bp, Homo sapiens
gtttcatataccaagcacttga

SEQ ID NO: 9204404 - DNA, 22 bp, Homo sapiens
gttgctcaggcaggagtacagt

SEQ ID NO: 9204405 - DNA, 22 bp, Homo sapiens
gttggggaaggtgggagaatgt

SEQ ID NO: 9204406 - DNA, 22 bp, Homo sapiens
gttgcaggaagcacacacatgt

SEQ ID NO: 9204407 - DNA, 22 bp, Homo sapiens
gttcagaaaacattggaataca

SEQ ID NO: 9204408 - DNA, 22 bp, Homo sapiens
gttcagaaattaggagaataaa

SEQ ID NO: 9204409 - DNA, 22 bp, Homo sapiens
gttacaaaggactgggggccac

SEQ ID NO: 9204410 - DNA, 22 bp, Homo sapiens
gttacaaaggtcataaaagtgt

SEQ ID NO: 9204411 - DNA, 22 bp, Homo sapiens
gttcaagtttctgagctttaat

SEQ ID NO: 9204412 - DNA, 22 bp, Homo sapiens
gttcaatttcagcatccattga

SEQ ID NO: 9204413 - DNA, 22 bp, Homo sapiens
gttcaattaagttacaaattta

SEQ ID NO: 9204414 - DNA, 22 bp, Homo sapiens
gttcacatcccagaaagagcat

SEQ ID NO: 9204415 - DNA, 22 bp, Homo sapiens
gttgaggtgatgccagccctgc

SEQ ID NO: 9204416 - DNA, 22 bp, Homo sapiens
gttgagtgggttaggatgctga

SEQ ID NO: 9204417 - DNA, 22 bp, Homo sapiens
gttcatattctaagtaactggc

SEQ ID NO: 9204418 - DNA, 22 bp, Homo sapiens
gtgtgggaaggctaggatgctg

SEQ ID NO: 9204419 - DNA, 22 bp, Homo sapiens
gttacaaagcacttcaagtgaa

SEQ ID NO: 9204420 - DNA, 22 bp, Homo sapiens
gttacaaactcaggtgccaaaa

SEQ ID NO: 9204421 - DNA, 22 bp, Homo sapiens
gttacaaaggaagcttcactgc

SEQ ID NO: 9204422 - DNA, 22 bp, Homo sapiens
gtgctccctccttcctcaagga

SEQ ID NO: 9204423 - DNA, 22 bp, Homo sapiens
gtgctccctccttcctcaagga

SEQ ID NO: 9204424 - DNA, 22 bp, Homo sapiens
gtgctcagaaacttgctcattt

SEQ ID NO: 9204425 - DNA, 22 bp, Homo sapiens
gtgctcaggaagctgttcctgc

SEQ ID NO: 9204426 - DNA, 22 bp, Homo sapiens
gtgtgcagtgagcaaaagatct

SEQ ID NO: 9204427 - DNA, 21 bp, Homo sapiens
gtgctctgggcagcagagggc

SEQ ID NO: 9204428 - DNA, 22 bp, Homo sapiens
gtgtgccactgcctgaggaccc

SEQ ID NO: 9204429 - DNA, 22 bp, Homo sapiens
gtgtgccaggaactggctgctg

SEQ ID NO: 9204430 - DNA, 22 bp, Homo sapiens
taactctttactatacatttat

SEQ ID NO: 9204431 - DNA, 22 bp, Homo sapiens
taacctttggtgaaatattaac

SEQ ID NO: 9204432 - DNA, 22 bp, Homo sapiens
taacctttgttcaatgtaagat

SEQ ID NO: 9204433 - DNA, 22 bp, Homo sapiens
taactaagtgactcaagtgatc

SEQ ID NO: 9204434 - DNA, 22 bp, Homo sapiens
taacattaaaagagataattga

SEQ ID NO: 9204435 - DNA, 22 bp, Homo sapiens
taacattacagacaccttgtgt

SEQ ID NO: 9204436 - DNA, 22 bp, Homo sapiens
taacattaaaagagataattga

SEQ ID NO: 9204437 - DNA, 22 bp, Homo sapiens
taacattacggacatctgtcag

SEQ ID NO: 9204438 - DNA, 22 bp, Homo sapiens
taacattacagacaccttgtgt

SEQ ID NO: 9204439 - DNA, 22 bp, Homo sapiens
taaattcactcctggtagacct

SEQ ID NO: 9204440 - DNA, 22 bp, Homo sapiens
taaattgcataagtacaaatga

SEQ ID NO: 9204441 - DNA, 22 bp, Homo sapiens
taaatttacccaaggaacatgt

SEQ ID NO: 9204442 - DNA, 22 bp, Homo sapiens
taaattagggactttagttaat

SEQ ID NO: 9204443 - DNA, 20 bp, Homo sapiens
taaattagccttgaagatta

SEQ ID NO: 9204444 - DNA, 22 bp, Homo sapiens
taaattagagccaggtaagttt

SEQ ID NO: 9204445 - DNA, 22 bp, Homo sapiens
taaaggttgaaaactgactgcc

SEQ ID NO: 9204446 - DNA, 22 bp, Homo sapiens
taaacaagctggactgataagt

SEQ ID NO: 9204447 - DNA, 22 bp, Homo sapiens
taaacagaatgcgtaagaagtg

SEQ ID NO: 9204448 - DNA, 22 bp, Homo sapiens
taaacagaatgcgtaagaagtg

SEQ ID NO: 9204449 - DNA, 22 bp, Homo sapiens
taaaattgcggtgaatatttcc

SEQ ID NO: 9204450 - DNA, 22 bp, Homo sapiens
taaaatttgtccctgagtgttg

SEQ ID NO: 9204451 - DNA, 22 bp, Homo sapiens
taaaatgtttgcaagagaccag

SEQ ID NO: 9204452 - DNA, 22 bp, Homo sapiens
gtttttattgtgtaaatgtggg

SEQ ID NO: 9204453 - DNA, 22 bp, Homo sapiens
gtttttatctaatagcagttat

SEQ ID NO: 9204454 - DNA, 22 bp, Homo sapiens
gtttttacagcagcaaaatact

SEQ ID NO: 9204455 - DNA, 22 bp, Homo sapiens
gtttttatatcctgtggagtgt

SEQ ID NO: 9204456 - DNA, 19 bp, Homo sapiens
taaaatgtctgtggtcagt

SEQ ID NO: 9204457 - DNA, 22 bp, Homo sapiens
gttttgtgaggcacccacaggt

SEQ ID NO: 9204458 - DNA, 18 bp, Homo sapiens
gttttgaattgtcttaca

SEQ ID NO: 9204459 - DNA, 22 bp, Homo sapiens
gtttcccaggctgtggggccct

SEQ ID NO: 9204460 - DNA, 23 bp, Homo sapiens
gtgagcagcccactaggaatgcc

SEQ ID NO: 9204461 - DNA, 22 bp, Homo sapiens
gtgagacacgtgtgtgacctgg

SEQ ID NO: 9204462 - DNA, 22 bp, Homo sapiens
gtgagacacccaagagtcagat

SEQ ID NO: 9204463 - DNA, 22 bp, Homo sapiens
gtgagcagcctcacctgagggt

SEQ ID NO: 9204464 - DNA, 23 bp, Homo sapiens
gtgagcagcccactaggaatgcc

SEQ ID NO: 9204465 - DNA, 22 bp, Homo sapiens
gtgagcagctcagggtggtctc

SEQ ID NO: 9204466 - DNA, 22 bp, Homo sapiens
gtgagcaggataggggctccct

SEQ ID NO: 9204467 - DNA, 22 bp, Homo sapiens
gtgagacaagatttgtaggcag

SEQ ID NO: 9204468 - DNA, 22 bp, Homo sapiens
gtgcactgtctggtcaagagca

SEQ ID NO: 9204469 - DNA, 22 bp, Homo sapiens
gtgcagagaaatgagaagtcga

SEQ ID NO: 9204470 - DNA, 22 bp, Homo sapiens
gtgcagtgaccctggagagctg

SEQ ID NO: 9204471 - DNA, 22 bp, Homo sapiens
gtgcagtgaccctggagagctg

SEQ ID NO: 9204472 - DNA, 22 bp, Homo sapiens
gtgcagtgaccctggagagctg

SEQ ID NO: 9204473 - DNA, 22 bp, Homo sapiens
gtgcagtgagcagtgcagcacc

SEQ ID NO: 9204474 - DNA, 22 bp, Homo sapiens
gtgcagaggtcacaaaagtgaa

SEQ ID NO: 9204475 - DNA, 22 bp, Homo sapiens
gtgcagagaggtggagggactt

SEQ ID NO: 9204476 - DNA, 22 bp, Homo sapiens
gtgcagtgtgtaatccaggaac

SEQ ID NO: 9204477 - DNA, 22 bp, Homo sapiens
gtgctaggattacaggcatggg

SEQ ID NO: 9204478 - DNA, 22 bp, Homo sapiens
gtgaaaataaggctggttcttg

SEQ ID NO: 9204479 - DNA, 22 bp, Homo sapiens
gtgaaacagaagctcctggaat

SEQ ID NO: 9204480 - DNA, 22 bp, Homo sapiens
gtctggagtggggcctgagaat

SEQ ID NO: 9204481 - DNA, 22 bp, Homo sapiens
gtctggagggaagagatgtcag

SEQ ID NO: 9204482 - DNA, 18 bp, Homo sapiens
gtctggaggtcaggagct

SEQ ID NO: 9204483 - DNA, 17 bp, Homo sapiens
gtctggagtggccttca

SEQ ID NO: 9204484 - DNA, 22 bp, Homo sapiens
gtgaagcctcggaaccaagctc

SEQ ID NO: 9204485 - DNA, 22 bp, Homo sapiens
gtgaagccacagagccacgccg

SEQ ID NO: 9204486 - DNA, 22 bp, Homo sapiens
gtctgctggcacgtcacagata

SEQ ID NO: 9204487 - DNA, 22 bp, Homo sapiens
gtctgctgcagtcgtggctcta

SEQ ID NO: 9204488 - DNA, 22 bp, Homo sapiens
gtctggaggcccgtcagcccta

SEQ ID NO: 9204489 - DNA, 22 bp, Homo sapiens
gtctggaggcactttctcatga

SEQ ID NO: 9204490 - DNA, 22 bp, Homo sapiens
gtctggagcctgggtccctgct

SEQ ID NO: 9204491 - DNA, 22 bp, Homo sapiens
gtcctgggggcagctgtgtcca

SEQ ID NO: 9204492 - DNA, 22 bp, Homo sapiens
gtcctgggggcagctgtgtcca

SEQ ID NO: 9204493 - DNA, 22 bp, Homo sapiens
gtcctgggggcagctgtgtcca

SEQ ID NO: 9204494 - DNA, 22 bp, Homo sapiens
gtcctggggatacagaagtgaa

SEQ ID NO: 9204495 - DNA, 22 bp, Homo sapiens
gtcctggggaatacagaagccg

SEQ ID NO: 9204496 - DNA, 22 bp, Homo sapiens
gtcctgggcctgctgaggctga

SEQ ID NO: 9204497 - DNA, 22 bp, Homo sapiens
gtagaatatatggttagtattg

SEQ ID NO: 9204498 - DNA, 22 bp, Homo sapiens
gtagaaatgtaaccaggagata

SEQ ID NO: 9204499 - DNA, 23 bp, Homo sapiens
gtagacagatgggccaaggtaat

SEQ ID NO: 9204500 - DNA, 22 bp, Homo sapiens
gtattagaagaaattataggta

SEQ ID NO: 9204501 - DNA, 22 bp, Homo sapiens
gtacatttcatttaaatgatgt

SEQ ID NO: 9204502 - DNA, 22 bp, Homo sapiens
gtacatttatttttgcagcata

SEQ ID NO: 9204503 - DNA, 23 bp, Homo sapiens
gtaaaatacgcagtgcagtgtga

SEQ ID NO: 9204504 - DNA, 22 bp, Homo sapiens
gtaaaactgcagaacttggagg

SEQ ID NO: 9204505 - DNA, 22 bp, Homo sapiens
gtaccagtctctgtgggcacct

SEQ ID NO: 9204506 - DNA, 22 bp, Homo sapiens
gtacattttgaggttaaaacaa

SEQ ID NO: 9204507 - DNA, 22 bp, Homo sapiens
gtaccctgtggccagccagcca

SEQ ID NO: 9204508 - DNA, 22 bp, Homo sapiens
gtacatttctcccaacactaaa

SEQ ID NO: 9204509 - DNA, 22 bp, Homo sapiens
gtacattttactttgtttgaat

SEQ ID NO: 9204510 - DNA, 22 bp, Homo sapiens
gtaaaacatgttttaactagga

SEQ ID NO: 9204511 - DNA, 22 bp, Homo sapiens
gtaaaacatgttttaactagga

SEQ ID NO: 9204512 - DNA, 22 bp, Homo sapiens
gtaaaacaagctttatggttcc

SEQ ID NO: 9204513 - DNA, 23 bp, Homo sapiens
gtatttcagcattctcagttaaa

SEQ ID NO: 9204514 - DNA, 22 bp, Homo sapiens
gtccacagctctgaggtctccc

SEQ ID NO: 9204515 - DNA, 22 bp, Homo sapiens
gtccacagctggccagggcctc

SEQ ID NO: 9204516 - DNA, 18 bp, Homo sapiens
gtccacagccctcacagc

SEQ ID NO: 9204517 - DNA, 23 bp, Homo sapiens
gtccagaacccaggctggggtgg

SEQ ID NO: 9204518 - DNA, 22 bp, Homo sapiens
gtccagaaagggcagtgatttg

SEQ ID NO: 9204519 - DNA, 22 bp, Homo sapiens
gtccagaagcagtgcacatcac

SEQ ID NO: 9204520 - DNA, 22 bp, Homo sapiens
gtccctctgcctgtggttctct

SEQ ID NO: 9204521 - DNA, 22 bp, Homo sapiens
gtccctctgggccatcaggtcc

SEQ ID NO: 9204522 - DNA, 22 bp, Homo sapiens
gtccctctgctctagagagcca

SEQ ID NO: 9204523 - DNA, 22 bp, Homo sapiens
gtccctctgtgtccctgcagtc

SEQ ID NO: 9204524 - DNA, 22 bp, Homo sapiens
gtccctctcaaatttatatgct

SEQ ID NO: 9204525 - DNA, 22 bp, Homo sapiens
gtcccgcattgggcattcctgg

SEQ ID NO: 9204526 - DNA, 22 bp, Homo sapiens
gtcccctcagccacccatgggg

SEQ ID NO: 9204527 - DNA, 22 bp, Homo sapiens
gtccccagctgtgacgagagcc

SEQ ID NO: 9204528 - DNA, 22 bp, Homo sapiens
gtccccagctgtgacgagagcc

SEQ ID NO: 9204529 - DNA, 22 bp, Homo sapiens
gtcctgggaaggaagccaggga

SEQ ID NO: 9204530 - DNA, 22 bp, Homo sapiens
gtcctgggagatgggaccctga

SEQ ID NO: 9204531 - DNA, 22 bp, Homo sapiens
gtcctgggaactggacagctaa

SEQ ID NO: 9204532 - DNA, 22 bp, Homo sapiens
gtcctgggaactggacagctaa

SEQ ID NO: 9204533 - DNA, 22 bp, Homo sapiens
gtccctgcatctgcaggccatg

SEQ ID NO: 9204534 - DNA, 17 bp, Homo sapiens
gtcctgggaggagagag

SEQ ID NO: 9204535 - DNA, 20 bp, Homo sapiens
gtcctgggagccacagcaca

SEQ ID NO: 9204536 - DNA, 20 bp, Homo sapiens
gtcctgggagccacagcaca

SEQ ID NO: 9204537 - DNA, 22 bp, Homo sapiens
gtcctgggaggggctggtcctg

SEQ ID NO: 9204538 - DNA, 22 bp, Homo sapiens
gtcctgggcccaggggctgcct

SEQ ID NO: 9204539 - DNA, 22 bp, Homo sapiens
ggtctctgttgcctccatcaag

SEQ ID NO: 9204540 - DNA, 22 bp, Homo sapiens
ggtctggcactcatgcagcagg

SEQ ID NO: 9204541 - DNA, 22 bp, Homo sapiens
ggtctggccaatagacagcccc

SEQ ID NO: 9204542 - DNA, 22 bp, Homo sapiens
ggtctggcaggtgaggactcag

SEQ ID NO: 9204543 - DNA, 22 bp, Homo sapiens
ggtggcctcggtggtgcacagg

SEQ ID NO: 9204544 - DNA, 22 bp, Homo sapiens
ggtgtgggagagattctttcct

SEQ ID NO: 9204545 - DNA, 22 bp, Homo sapiens
ggtgtgggccctgatgtcagca

SEQ ID NO: 9204546 - DNA, 22 bp, Homo sapiens
ggtgtgggaactacaggttttt

SEQ ID NO: 9204547 - DNA, 22 bp, Homo sapiens
ggtgtgggggcaagtttgagat

SEQ ID NO: 9204548 - DNA, 22 bp, Homo sapiens
ggtgtggggaggttctgcttct

SEQ ID NO: 9204549 - DNA, 22 bp, Homo sapiens
ggtgtgggggcagctctgatat

SEQ ID NO: 9204550 - DNA, 22 bp, Homo sapiens
ggtgtgggtccttgtgcttgct

SEQ ID NO: 9204551 - DNA, 19 bp, Homo sapiens
ggtgtgtgctggggcctgt

SEQ ID NO: 9204552 - DNA, 22 bp, Homo sapiens
ggtgtgtgaggagtcacttagt

SEQ ID NO: 9204553 - DNA, 22 bp, Homo sapiens
ggtctccattccttcatctcac

SEQ ID NO: 9204554 - DNA, 22 bp, Homo sapiens
ggtctcctgaggctgccacacc

SEQ ID NO: 9204555 - DNA, 22 bp, Homo sapiens
ggtctcctgaggctgccacacc

SEQ ID NO: 9204556 - DNA, 22 bp, Homo sapiens
ggtctctgctcagatgccactt

SEQ ID NO: 9204557 - DNA, 22 bp, Homo sapiens
ggtctctggccttggagattga

SEQ ID NO: 9204558 - DNA, 22 bp, Homo sapiens
ggtctctgacttagagatggat

SEQ ID NO: 9204559 - DNA, 22 bp, Homo sapiens
ggtcagcaatttggactgggct

SEQ ID NO: 9204560 - DNA, 22 bp, Homo sapiens
ggtcagcaggtccagccagtgc

SEQ ID NO: 9204561 - DNA, 22 bp, Homo sapiens
ggtcagcagtgcagggcagagc

SEQ ID NO: 9204562 - DNA, 18 bp, Homo sapiens
ggtcctgggcctggctca

SEQ ID NO: 9204563 - DNA, 22 bp, Homo sapiens
ggtcctgtctgacatcactgct

SEQ ID NO: 9204564 - DNA, 18 bp, Homo sapiens
ggtcctgggcctggctca

SEQ ID NO: 9204565 - DNA, 22 bp, Homo sapiens
gggtggcacaggtgcagagggt

SEQ ID NO: 9204566 - DNA, 22 bp, Homo sapiens
gggtggcaggattggcaggagt

SEQ ID NO: 9204567 - DNA, 22 bp, Homo sapiens
gggtggcaggattggcaggagt

SEQ ID NO: 9204568 - DNA, 20 bp, Homo sapiens
gggtggagttgcggtctgtg

SEQ ID NO: 9204569 - DNA, 22 bp, Homo sapiens
gggtggcacaggtgcagagggt

SEQ ID NO: 9204570 - DNA, 22 bp, Homo sapiens
ggtagggcaaagtagggcacct

SEQ ID NO: 9204571 - DNA, 22 bp, Homo sapiens
ggtcagagggtgggctgcctgt

SEQ ID NO: 9204572 - DNA, 22 bp, Homo sapiens
ggtcagaattaggtctagagta

SEQ ID NO: 9204573 - DNA, 22 bp, Homo sapiens
ggtcagaagtgcaaaatcagtt

SEQ ID NO: 9204574 - DNA, 22 bp, Homo sapiens
ggtcagaaggattctgggaaat

SEQ ID NO: 9204575 - DNA, 22 bp, Homo sapiens
ggtcacatggttgagcttgatc

SEQ ID NO: 9204576 - DNA, 22 bp, Homo sapiens
gggtaggagaggtgtctgtgtg

SEQ ID NO: 9204577 - DNA, 22 bp, Homo sapiens
gggtaggagaggtgtctgtgtg

SEQ ID NO: 9204578 - DNA, 22 bp, Homo sapiens
gggtaggatggtagaagggacc

SEQ ID NO: 9204579 - DNA, 22 bp, Homo sapiens
gggtaggatggtagaagggacc

SEQ ID NO: 9204580 - DNA, 22 bp, Homo sapiens
gggtagggtgacttaggctggc

SEQ ID NO: 9204581 - DNA, 22 bp, Homo sapiens
gggtggagtagaaagatgaatt

SEQ ID NO: 9204582 - DNA, 22 bp, Homo sapiens
gggtggagtgtgaaatctggct

SEQ ID NO: 9204583 - DNA, 22 bp, Homo sapiens
gggtggaggtgggttttgagat

SEQ ID NO: 9204584 - DNA, 22 bp, Homo sapiens
gggtggaggagaacaggcccca

SEQ ID NO: 9204585 - DNA, 22 bp, Homo sapiens
gggtggagcttggacaccagta

SEQ ID NO: 9204586 - DNA, 22 bp, Homo sapiens
ggggtgggcgtgcagggacacc

SEQ ID NO: 9204587 - DNA, 22 bp, Homo sapiens
ggggtgggcgtgcagggacacc

SEQ ID NO: 9204588 - DNA, 22 bp, Homo sapiens
ggggtgggcgtgcagggacacc

SEQ ID NO: 9204589 - DNA, 22 bp, Homo sapiens
ggggtggggttactcattgtgc

SEQ ID NO: 9204590 - DNA, 22 bp, Homo sapiens
ggggtggggttactcattgtgc

SEQ ID NO: 9204591 - DNA, 22 bp, Homo sapiens
ggggtgtgagtagagctgggga

SEQ ID NO: 9204592 - DNA, 22 bp, Homo sapiens
gggtaggaaatccagaggtggc

SEQ ID NO: 9204593 - DNA, 22 bp, Homo sapiens
ggggctgacgggcatgtggctt

SEQ ID NO: 9204594 - DNA, 22 bp, Homo sapiens
ggggaagacctggcactacagc

SEQ ID NO: 9204595 - DNA, 22 bp, Homo sapiens
ggggaagatggccctccatgtg

SEQ ID NO: 9204596 - DNA, 22 bp, Homo sapiens
gggcttggtggagagaatgctg

SEQ ID NO: 9204597 - DNA, 22 bp, Homo sapiens
ggggaagaatggcagaaaacat

SEQ ID NO: 9204598 - DNA, 22 bp, Homo sapiens
ggggccgaccgcggttcaggcc

SEQ ID NO: 9204599 - DNA, 22 bp, Homo sapiens
gggcttcttgccatggggacgg

SEQ ID NO: 9204600 - DNA, 22 bp, Homo sapiens
gggcttggagtaggctgatgaa

SEQ ID NO: 9204601 - DNA, 20 bp, Homo sapiens
gggcttggaggactcgaggg

SEQ ID NO: 9204602 - DNA, 22 bp, Homo sapiens
gggcttggccccagaagagcta

SEQ ID NO: 9204603 - DNA, 22 bp, Homo sapiens
gggcttggctcataagtggatg

SEQ ID NO: 9204604 - DNA, 19 bp, Homo sapiens
gggcttggggctgaagcct

SEQ ID NO: 9204605 - DNA, 22 bp, Homo sapiens
gggcttgggtattgtgagaggt

SEQ ID NO: 9204606 - DNA, 22 bp, Homo sapiens
gggctgagtgtcccaggccgaa

SEQ ID NO: 9204607 - DNA, 22 bp, Homo sapiens
gggctgagttcctgcctcactc

SEQ ID NO: 9204608 - DNA, 22 bp, Homo sapiens
gggctgagagctggaatctgag

SEQ ID NO: 9204609 - DNA, 18 bp, Homo sapiens
gggcatggatgcagcatc

SEQ ID NO: 9204610 - DNA, 22 bp, Homo sapiens
gggcatggccaggtgaggggtc

SEQ ID NO: 9204611 - DNA, 22 bp, Homo sapiens
gggcatggccaggtgaggggtc

SEQ ID NO: 9204612 - DNA, 22 bp, Homo sapiens
gggcatggtgagggatatgaag

SEQ ID NO: 9204613 - DNA, 22 bp, Homo sapiens
gggcatggggcggacctggttc

SEQ ID NO: 9204614 - DNA, 22 bp, Homo sapiens
gggcatggtgctggtgttcatg

SEQ ID NO: 9204615 - DNA, 22 bp, Homo sapiens
gggcatggtgatgtgcacctgt

SEQ ID NO: 9204616 - DNA, 22 bp, Homo sapiens
gggcatggtggcaggcacctgt

SEQ ID NO: 9204617 - DNA, 22 bp, Homo sapiens
gggcatgtagtgtgcatagaga

SEQ ID NO: 9204618 - DNA, 22 bp, Homo sapiens
gggcatgttttcgtaaactcag

SEQ ID NO: 9204619 - DNA, 22 bp, Homo sapiens
gggccacacagggcagctccct

SEQ ID NO: 9204620 - DNA, 22 bp, Homo sapiens
gggccacacagaacctcctggt

SEQ ID NO: 9204621 - DNA, 22 bp, Homo sapiens
gggccacacagaacctcctggt

SEQ ID NO: 9204622 - DNA, 22 bp, Homo sapiens
gggccaaggggagctggaaggg

SEQ ID NO: 9204623 - DNA, 22 bp, Homo sapiens
gggccaagggtgcgtggcagga

SEQ ID NO: 9204624 - DNA, 22 bp, Homo sapiens
ggagtgagtggccttgtcactg

SEQ ID NO: 9204625 - DNA, 23 bp, Homo sapiens
ggagtgcaatggcgccatctcgg

SEQ ID NO: 9204626 - DNA, 23 bp, Homo sapiens
ggagtgcaatggcgccatctcgg

SEQ ID NO: 9204627 - DNA, 22 bp, Homo sapiens
ggcaaagccctgcctggttcaa

SEQ ID NO: 9204628 - DNA, 22 bp, Homo sapiens
ggcaaacagacttgaccatctt

SEQ ID NO: 9204629 - DNA, 22 bp, Homo sapiens
ggcaaaaacagcaatgactttt

SEQ ID NO: 9204630 - DNA, 22 bp, Homo sapiens
ggcaaaaaccacaattactttt

SEQ ID NO: 9204631 - DNA, 22 bp, Homo sapiens
ggcaaaaaccgcaataacttct

SEQ ID NO: 9204632 - DNA, 22 bp, Homo sapiens
ggcaaaaaccataattactttt

SEQ ID NO: 9204633 - DNA, 22 bp, Homo sapiens
ggcaaagcggccctgtggccag

SEQ ID NO: 9204634 - DNA, 22 bp, Homo sapiens
ggcaaagccttccagctgttac

SEQ ID NO: 9204635 - DNA, 22 bp, Homo sapiens
ggcaagaaggcttcaggtagct

SEQ ID NO: 9204636 - DNA, 22 bp, Homo sapiens
ggcaagatccaaggggctagga

SEQ ID NO: 9204637 - DNA, 22 bp, Homo sapiens
ggcaagagtgaggagtgtctct

SEQ ID NO: 9204638 - DNA, 22 bp, Homo sapiens
ggcaagaggtccaagaggtctc

SEQ ID NO: 9204639 - DNA, 22 bp, Homo sapiens
ggagccagagggatgcagttga

SEQ ID NO: 9204640 - DNA, 22 bp, Homo sapiens
ggagccagagtctgcagtgtaa

SEQ ID NO: 9204641 - DNA, 22 bp, Homo sapiens
ggagccagcagggtgacactga

SEQ ID NO: 9204642 - DNA, 19 bp, Homo sapiens
ggagccagctgtggaaggc

SEQ ID NO: 9204643 - DNA, 22 bp, Homo sapiens
ggagtattgtagcttccagttc

SEQ ID NO: 9204644 - DNA, 22 bp, Homo sapiens
ggagtcagactttgattagtag

SEQ ID NO: 9204645 - DNA, 22 bp, Homo sapiens
ggagtctgatactgagttcctc

SEQ ID NO: 9204646 - DNA, 19 bp, Homo sapiens
ggagtctgagcccaggtat

SEQ ID NO: 9204647 - DNA, 22 bp, Homo sapiens
ggagtctgagtcctcatagaca

SEQ ID NO: 9204648 - DNA, 22 bp, Homo sapiens
ggagtctgagcttgtgtcctgg

SEQ ID NO: 9204649 - DNA, 22 bp, Homo sapiens
ggagtctgactctgaccctgga

SEQ ID NO: 9204650 - DNA, 22 bp, Homo sapiens
ggagtcccagcaaagccttccc

SEQ ID NO: 9204651 - DNA, 17 bp, Homo sapiens
ggcaccagacggagagt

SEQ ID NO: 9204652 - DNA, 22 bp, Homo sapiens
ggcacaggaatctgtgaagtgc

SEQ ID NO: 9204653 - DNA, 22 bp, Homo sapiens
ggcacagctgatgcagacacac

SEQ ID NO: 9204654 - DNA, 22 bp, Homo sapiens
ggcacagctcaggtcccagctc

SEQ ID NO: 9204655 - DNA, 22 bp, Homo sapiens
ggcacagctcaggtcccagctc

SEQ ID NO: 9204656 - DNA, 22 bp, Homo sapiens
ggcacagctcaggtcccagctc

SEQ ID NO: 9204657 - DNA, 22 bp, Homo sapiens
ggcacagccactttggagaact

SEQ ID NO: 9204658 - DNA, 22 bp, Homo sapiens
ggcacagcaggagctatgtgaa

SEQ ID NO: 9204659 - DNA, 22 bp, Homo sapiens
ggcacagccctctctgtggaca

SEQ ID NO: 9204660 - DNA, 22 bp, Homo sapiens
ggcacagccctctctgtggaca

SEQ ID NO: 9204661 - DNA, 22 bp, Homo sapiens
ggcacagcgactaccatcgaaa

SEQ ID NO: 9204662 - DNA, 21 bp, Homo sapiens
ggcacagcctgaaatgcctca

SEQ ID NO: 9204663 - DNA, 22 bp, Homo sapiens
ggcacagctacttgctcactct

SEQ ID NO: 9204664 - DNA, 22 bp, Homo sapiens
ggcagaggagctggaaacatgg

SEQ ID NO: 9204665 - DNA, 22 bp, Homo sapiens
ggcagaggagctggaaacatgg

SEQ ID NO: 9204666 - DNA, 22 bp, Homo sapiens
ggcagaggagctggaaacatgg

SEQ ID NO: 9204667 - DNA, 22 bp, Homo sapiens
ggcaggcagaaaaatagaatat

SEQ ID NO: 9204668 - DNA, 22 bp, Homo sapiens
ggcaggcactgtgctaggcgct

SEQ ID NO: 9204669 - DNA, 22 bp, Homo sapiens
ggcaggcaccagctcagcaata

SEQ ID NO: 9204670 - DNA, 22 bp, Homo sapiens
ggcaggcacatttgggggccgt

SEQ ID NO: 9204671 - DNA, 22 bp, Homo sapiens
ggcaggcaatgaggatgggaag

SEQ ID NO: 9204672 - DNA, 22 bp, Homo sapiens
ggcaggaggtgagtggcgggtg

SEQ ID NO: 9204673 - DNA, 22 bp, Homo sapiens
ggcaggaggtgagtggcgggtg

SEQ ID NO: 9204674 - DNA, 22 bp, Homo sapiens
ggcaggcaacggaccactagtc

SEQ ID NO: 9204675 - DNA, 22 bp, Homo sapiens
ggcaggcaagtctgctctgtga

SEQ ID NO: 9204676 - DNA, 22 bp, Homo sapiens
ggcaggcaaggcagcctggtga

SEQ ID NO: 9204677 - DNA, 22 bp, Homo sapiens
ggcaggaggtgagtggcgggtg

SEQ ID NO: 9204678 - DNA, 22 bp, Homo sapiens
ggcaggaggtgagtggcgggtg

SEQ ID NO: 9204679 - DNA, 22 bp, Homo sapiens
ggcaggaggtgagtggcgggtg

SEQ ID NO: 9204680 - DNA, 20 bp, Homo sapiens
ggcagagggcctgggagaag

SEQ ID NO: 9204681 - DNA, 22 bp, Homo sapiens
ggcagaggtagctggaaccagg

SEQ ID NO: 9204682 - DNA, 22 bp, Homo sapiens
ggcagaggtagctggaaccagg

SEQ ID NO: 9204683 - DNA, 22 bp, Homo sapiens
ggcagtgaaaaagtatgtttcc

SEQ ID NO: 9204684 - DNA, 22 bp, Homo sapiens
ggcagtgaatctgagagcctgg

SEQ ID NO: 9204685 - DNA, 22 bp, Homo sapiens
ggcagtgaatgaaacagaggct

SEQ ID NO: 9204686 - DNA, 22 bp, Homo sapiens
ggcatgggccgaggtgcctcct

SEQ ID NO: 9204687 - DNA, 22 bp, Homo sapiens
ggcatgggccgaggtgcctcct

SEQ ID NO: 9204688 - DNA, 22 bp, Homo sapiens
ggcatgggccgaggtgcctcct

SEQ ID NO: 9204689 - DNA, 22 bp, Homo sapiens
ggcatggggtgtatgtggcacg

SEQ ID NO: 9204690 - DNA, 22 bp, Homo sapiens
ggcatggggtgtatgtggcacg

SEQ ID NO: 9204691 - DNA, 22 bp, Homo sapiens
ggcaggcagaggctgagacagg

SEQ ID NO: 9204692 - DNA, 22 bp, Homo sapiens
ggccaaggtgttctgatatgcc

SEQ ID NO: 9204693 - DNA, 22 bp, Homo sapiens
ggccaaggtgttctgatatgcc

SEQ ID NO: 9204694 - DNA, 22 bp, Homo sapiens
ggccaaggtgttctgatatgcc

SEQ ID NO: 9204695 - DNA, 22 bp, Homo sapiens
ggccacaacttgctcctagccc

SEQ ID NO: 9204696 - DNA, 21 bp, Homo sapiens
ggccacaagcggaggagccgc

SEQ ID NO: 9204697 - DNA, 22 bp, Homo sapiens
ggccacacagatgactgctttc

SEQ ID NO: 9204698 - DNA, 22 bp, Homo sapiens
ggccacactctggtagaggtga

SEQ ID NO: 9204699 - DNA, 22 bp, Homo sapiens
ggccacagaacagctacaggac

SEQ ID NO: 9204700 - DNA, 22 bp, Homo sapiens
ggccacagaacagctacaggac

SEQ ID NO: 9204701 - DNA, 22 bp, Homo sapiens
ggcatgttgtttatgtttctgg

SEQ ID NO: 9204702 - DNA, 22 bp, Homo sapiens
ggccaaggctcttgagggctga

SEQ ID NO: 9204703 - DNA, 22 bp, Homo sapiens
ggccaaggtggagaaggcactg

SEQ ID NO: 9204704 - DNA, 20 bp, Homo sapiens
ggcatgggtggggctcccag

SEQ ID NO: 9204705 - DNA, 19 bp, Homo sapiens
ggccaggctgactgtggtc

SEQ ID NO: 9204706 - DNA, 22 bp, Homo sapiens
ggccagggcctggggactgtcc

SEQ ID NO: 9204707 - DNA, 22 bp, Homo sapiens
ggccagtcccctaatccagggc

SEQ ID NO: 9204708 - DNA, 22 bp, Homo sapiens
ggccagtcccctaatccagggc

SEQ ID NO: 9204709 - DNA, 22 bp, Homo sapiens
ggccagtctgggccacggtcgg

SEQ ID NO: 9204710 - DNA, 22 bp, Homo sapiens
ggcctgaggcgtcccagctgtg

SEQ ID NO: 9204711 - DNA, 22 bp, Homo sapiens
ggcctgagggtgggctctcagt

SEQ ID NO: 9204712 - DNA, 22 bp, Homo sapiens
ggcctgaaataaagtagcagaa

SEQ ID NO: 9204713 - DNA, 22 bp, Homo sapiens
ggcctgaaatagctctgaggtt

SEQ ID NO: 9204714 - DNA, 22 bp, Homo sapiens
ggcctcttctgctcatactttc

SEQ ID NO: 9204715 - DNA, 22 bp, Homo sapiens
ggcctgaatgcctgagtgtggg

SEQ ID NO: 9204716 - DNA, 22 bp, Homo sapiens
ggcctgcacagaggtggctcta

SEQ ID NO: 9204717 - DNA, 22 bp, Homo sapiens
ggccttgggatgtggctgcagc

SEQ ID NO: 9204718 - DNA, 22 bp, Homo sapiens
ggccttgggcagacacgtcaca

SEQ ID NO: 9204719 - DNA, 18 bp, Homo sapiens
ggcctgcagtgaagcaag

SEQ ID NO: 9204720 - DNA, 22 bp, Homo sapiens
ggcctgagtcacatcaggagag

SEQ ID NO: 9204721 - DNA, 21 bp, Homo sapiens
ggcctgagtataggacaggcc

SEQ ID NO: 9204722 - DNA, 22 bp, Homo sapiens
ggcctttgcgtccacgccgctt

SEQ ID NO: 9204723 - DNA, 22 bp, Homo sapiens
ggccttggttctgtcacagccg

SEQ ID NO: 9204724 - DNA, 22 bp, Homo sapiens
ggccttggtgccatggccagtt

SEQ ID NO: 9204725 - DNA, 22 bp, Homo sapiens
ggccttggtactgtaaaccgag

SEQ ID NO: 9204726 - DNA, 20 bp, Homo sapiens
ggccttgggtttcgcctgtt

SEQ ID NO: 9204727 - DNA, 22 bp, Homo sapiens
ggccttgggcgagtccctcagt

SEQ ID NO: 9204728 - DNA, 17 bp, Homo sapiens
ggccttggggcctcagt

SEQ ID NO: 9204729 - DNA, 22 bp, Homo sapiens
ggccttggggtggccttgtccc

SEQ ID NO: 9204730 - DNA, 22 bp, Homo sapiens
ggcctcagtttcttcaactgta

SEQ ID NO: 9204731 - DNA, 22 bp, Homo sapiens
ggcctcagtttctccatgggtt

SEQ ID NO: 9204732 - DNA, 22 bp, Homo sapiens
ggcctcagtgggccgctgcagg

SEQ ID NO: 9204733 - DNA, 22 bp, Homo sapiens
ggcctcagtgggccgctgcagg

SEQ ID NO: 9204734 - DNA, 22 bp, Homo sapiens
ggcctcttatctggctcctgca

SEQ ID NO: 9204735 - DNA, 22 bp, Homo sapiens
ggcctctggttcgtggtgacct

SEQ ID NO: 9204736 - DNA, 22 bp, Homo sapiens
ggcctcagaccggagctggcca

SEQ ID NO: 9204737 - DNA, 21 bp, Homo sapiens
ggcctcagccacctggctctg

SEQ ID NO: 9204738 - DNA, 22 bp, Homo sapiens
ggctccagccctggctcttcac

SEQ ID NO: 9204739 - DNA, 22 bp, Homo sapiens
ggctccagccctggctcttcac

SEQ ID NO: 9204740 - DNA, 22 bp, Homo sapiens
ggctccagatgtctcctggcaa

SEQ ID NO: 9204741 - DNA, 22 bp, Homo sapiens
ggctccagatgtcccctggcaa

SEQ ID NO: 9204742 - DNA, 22 bp, Homo sapiens
ggctctgggccagagttggctt

SEQ ID NO: 9204743 - DNA, 22 bp, Homo sapiens
ggctgagaaggagtgggtgagg

SEQ ID NO: 9204744 - DNA, 22 bp, Homo sapiens
ggctgagaagacagtggggtgg

SEQ ID NO: 9204745 - DNA, 22 bp, Homo sapiens
ggctctggcaaggggaggctac

SEQ ID NO: 9204746 - DNA, 22 bp, Homo sapiens
ggctctggagcacagacgtctg

SEQ ID NO: 9204747 - DNA, 22 bp, Homo sapiens
ggctctggagatgtccgacctg

SEQ ID NO: 9204748 - DNA, 22 bp, Homo sapiens
ggctctggagatgtccgacctg

SEQ ID NO: 9204749 - DNA, 22 bp, Homo sapiens
ggctctggagacatgtggagag

SEQ ID NO: 9204750 - DNA, 22 bp, Homo sapiens
ggctctggagacatgtggagag

SEQ ID NO: 9204751 - DNA, 19 bp, Homo sapiens
ggctctggcggctgtagcc

SEQ ID NO: 9204752 - DNA, 22 bp, Homo sapiens
ggctctggctactccaccctgt

SEQ ID NO: 9204753 - DNA, 22 bp, Homo sapiens
ggctctggcgtccaatggagcg

SEQ ID NO: 9204754 - DNA, 22 bp, Homo sapiens
ggctctgggcatagaaggaagc

SEQ ID NO: 9204755 - DNA, 22 bp, Homo sapiens
ggctctgggaaatggtcttcct

SEQ ID NO: 9204756 - DNA, 22 bp, Homo sapiens
ggctctgggaaatggtcttcct

SEQ ID NO: 9204757 - DNA, 22 bp, Homo sapiens
ggctggcttggtgagctgtcac

SEQ ID NO: 9204758 - DNA, 22 bp, Homo sapiens
ggctggcttgcggagtcacaga

SEQ ID NO: 9204759 - DNA, 22 bp, Homo sapiens
ggctggcttggtgagctgtcac

SEQ ID NO: 9204760 - DNA, 22 bp, Homo sapiens
ggctggcttggtgagctgtcac

SEQ ID NO: 9204761 - DNA, 22 bp, Homo sapiens
ggctggcttgccaagctcaggg

SEQ ID NO: 9204762 - DNA, 22 bp, Homo sapiens
ggctgggcaggtctgcacaggg

SEQ ID NO: 9204763 - DNA, 22 bp, Homo sapiens
ggctgggcatccatccatgaga

SEQ ID NO: 9204764 - DNA, 22 bp, Homo sapiens
ggctgggctcgctgattggctg

SEQ ID NO: 9204765 - DNA, 22 bp, Homo sapiens
ggctgggctccgggagcatgcg

SEQ ID NO: 9204766 - DNA, 22 bp, Homo sapiens
ggctgggctgctgggtcagagc

SEQ ID NO: 9204767 - DNA, 22 bp, Homo sapiens
ggcttctcccctttgagtcttc

SEQ ID NO: 9204768 - DNA, 22 bp, Homo sapiens
ggcttctctcccccagctccac

SEQ ID NO: 9204769 - DNA, 22 bp, Homo sapiens
ggcttctctcttcacatggctt

SEQ ID NO: 9204770 - DNA, 22 bp, Homo sapiens
ggcttctgtcctctggatctgt

SEQ ID NO: 9204771 - DNA, 18 bp, Homo sapiens
ggcttctgggacatttta

SEQ ID NO: 9204772 - DNA, 22 bp, Homo sapiens
gggatggggagctggaaagggg

SEQ ID NO: 9204773 - DNA, 22 bp, Homo sapiens
gggaggagcttggagattcact

SEQ ID NO: 9204774 - DNA, 22 bp, Homo sapiens
gggcacagcccagtggggtccc

SEQ ID NO: 9204775 - DNA, 19 bp, Homo sapiens
gggcacagcctccccccag

SEQ ID NO: 9204776 - DNA, 22 bp, Homo sapiens
gggcacagcctaactatggaga

SEQ ID NO: 9204777 - DNA, 22 bp, Homo sapiens
gggcacagcctaactatggaga

SEQ ID NO: 9204778 - DNA, 19 bp, Homo sapiens
gggcacagcctccccccag

SEQ ID NO: 9204779 - DNA, 22 bp, Homo sapiens
gggatggggtcgggaccctgct

SEQ ID NO: 9204780 - DNA, 22 bp, Homo sapiens
gggcaggagaaggtggatgtcc

SEQ ID NO: 9204781 - DNA, 22 bp, Homo sapiens
gggcaggagagggccacctgga

SEQ ID NO: 9204782 - DNA, 22 bp, Homo sapiens
gggcaggagagaacagtcatgg

SEQ ID NO: 9204783 - DNA, 23 bp, Homo sapiens
gggcatggagtgtaggtggaagg

SEQ ID NO: 9204784 - DNA, 19 bp, Homo sapiens
gggcatggatgagcttacc

SEQ ID NO: 9204785 - DNA, 22 bp, Homo sapiens
gggcatgcctgcgcagtgcatg

SEQ ID NO: 9204786 - DNA, 22 bp, Homo sapiens
gggcagctctcacagcagccaa

SEQ ID NO: 9204787 - DNA, 22 bp, Homo sapiens
gggcacaggaatttgggatgtg

SEQ ID NO: 9204788 - DNA, 22 bp, Homo sapiens
gggcacaggaatttgggatgtg

SEQ ID NO: 9204789 - DNA, 22 bp, Homo sapiens
gggcacagctgctacccagtgc

SEQ ID NO: 9204790 - DNA, 22 bp, Homo sapiens
gggcagctgccagaggccatgg

SEQ ID NO: 9204791 - DNA, 22 bp, Homo sapiens
gggcagctgtatctgagcttat

SEQ ID NO: 9204792 - DNA, 22 bp, Homo sapiens
gggagaggttacccgagcaact

SEQ ID NO: 9204793 - DNA, 22 bp, Homo sapiens
gggagctggcggattccccagg

SEQ ID NO: 9204794 - DNA, 22 bp, Homo sapiens
gggagctgtaagggacaggtag

SEQ ID NO: 9204795 - DNA, 22 bp, Homo sapiens
gggagacaaggagaaccaaaga

SEQ ID NO: 9204796 - DNA, 22 bp, Homo sapiens
ggcttgggagcaggcatgtgac

SEQ ID NO: 9204797 - DNA, 22 bp, Homo sapiens
ggcttcttaatcatgagagtga

SEQ ID NO: 9204798 - DNA, 22 bp, Homo sapiens
gggagaagtggaaatctcatta

SEQ ID NO: 9204799 - DNA, 23 bp, Homo sapiens
gggaccagctagggctgtgacct

SEQ ID NO: 9204800 - DNA, 17 bp, Homo sapiens
ggacacagctcatggct

SEQ ID NO: 9204801 - DNA, 17 bp, Homo sapiens
ggacacagctcatggct

SEQ ID NO: 9204802 - DNA, 18 bp, Homo sapiens
ggacacagataggtacag

SEQ ID NO: 9204803 - DNA, 22 bp, Homo sapiens
ggaagagggaaccacgactgta

SEQ ID NO: 9204804 - DNA, 22 bp, Homo sapiens
ggaagaggctggtagtgcccgt

SEQ ID NO: 9204805 - DNA, 22 bp, Homo sapiens
ggaagatgagaagtggggctcc

SEQ ID NO: 9204806 - DNA, 22 bp, Homo sapiens
ggaagcagcctgaagccaaggg

SEQ ID NO: 9204807 - DNA, 22 bp, Homo sapiens
ggaagaggaggagccaggcttt

SEQ ID NO: 9204808 - DNA, 22 bp, Homo sapiens
ggaagaggaggagccaggcttt

SEQ ID NO: 9204809 - DNA, 22 bp, Homo sapiens
ggaagaggctgagccaggtccc

SEQ ID NO: 9204810 - DNA, 22 bp, Homo sapiens
ggaagaggctctcattgagggc

SEQ ID NO: 9204811 - DNA, 22 bp, Homo sapiens
ggaagaggctgaggccatgctg

SEQ ID NO: 9204812 - DNA, 22 bp, Homo sapiens
ggaagaggctgagccaggtccc

SEQ ID NO: 9204813 - DNA, 17 bp, Homo sapiens
gctttccttgcccctcc

SEQ ID NO: 9204814 - DNA, 22 bp, Homo sapiens
gctttcagggtcactgtcaaca

SEQ ID NO: 9204815 - DNA, 22 bp, Homo sapiens
gctttcctggccctgtccctgc

SEQ ID NO: 9204816 - DNA, 20 bp, Homo sapiens
gctttctatgagatggactg

SEQ ID NO: 9204817 - DNA, 22 bp, Homo sapiens
gctttctgattgcgaaaacaaa

SEQ ID NO: 9204818 - DNA, 22 bp, Homo sapiens
ggagacccaggttaggaagtaa

SEQ ID NO: 9204819 - DNA, 18 bp, Homo sapiens
ggagactaaactgttgac

SEQ ID NO: 9204820 - DNA, 22 bp, Homo sapiens
ggagacagtgacttagagactg

SEQ ID NO: 9204821 - DNA, 22 bp, Homo sapiens
ggagcagggaattacagcgcag

SEQ ID NO: 9204822 - DNA, 22 bp, Homo sapiens
ggagcagcactgccacacagag

SEQ ID NO: 9204823 - DNA, 22 bp, Homo sapiens
ggagcagatgtcttcatggcct

SEQ ID NO: 9204824 - DNA, 22 bp, Homo sapiens
ggagcaggctctgtggtttcca

SEQ ID NO: 9204825 - DNA, 22 bp, Homo sapiens
ggagagagacctccatgcccag

SEQ ID NO: 9204826 - DNA, 22 bp, Homo sapiens
ggaccatgaggagatgggcctc

SEQ ID NO: 9204827 - DNA, 22 bp, Homo sapiens
ggaccagtttcaaactgtacca

SEQ ID NO: 9204828 - DNA, 22 bp, Homo sapiens
ggacacaggcagctgggtgggt

SEQ ID NO: 9204829 - DNA, 22 bp, Homo sapiens
ggacacagctgcagccacaccc

SEQ ID NO: 9204830 - DNA, 23 bp, Homo sapiens
ggacacaggccttgtctgcgcct

SEQ ID NO: 9204831 - DNA, 22 bp, Homo sapiens
ggacacagtggaagacagcttg

SEQ ID NO: 9204832 - DNA, 22 bp, Homo sapiens
ggacacagtggaagacagcttg

SEQ ID NO: 9204833 - DNA, 22 bp, Homo sapiens
ggacagtccacctcagtgaaga

SEQ ID NO: 9204834 - DNA, 19 bp, Homo sapiens
ggacagtctcagcctcatg

SEQ ID NO: 9204835 - DNA, 20 bp, Homo sapiens
gcttgctttgtctgatgggc

SEQ ID NO: 9204836 - DNA, 18 bp, Homo sapiens
gctttatttcttggggaa

SEQ ID NO: 9204837 - DNA, 17 bp, Homo sapiens
gcttgccttgtcttcct

SEQ ID NO: 9204838 - DNA, 22 bp, Homo sapiens
gcttgcctatctggtggtcgtt

SEQ ID NO: 9204839 - DNA, 22 bp, Homo sapiens
gcttgcctatctggtggtcgtt

SEQ ID NO: 9204840 - DNA, 22 bp, Homo sapiens
gcttgcctggcatttctggggc

SEQ ID NO: 9204841 - DNA, 23 bp, Homo sapiens
gcttgcctggtgtgtggctgacc

SEQ ID NO: 9204842 - DNA, 22 bp, Homo sapiens
gcttgagttttgggacaaagcc

SEQ ID NO: 9204843 - DNA, 22 bp, Homo sapiens
gcttgagttttgggacaaagcc

SEQ ID NO: 9204844 - DNA, 22 bp, Homo sapiens
gcttctttggcaaccctgacat

SEQ ID NO: 9204845 - DNA, 22 bp, Homo sapiens
gctgtgtatcagatgccacggg

SEQ ID NO: 9204846 - DNA, 22 bp, Homo sapiens
gctgtgtatcagatgccacggg

SEQ ID NO: 9204847 - DNA, 22 bp, Homo sapiens
gctgtgggtttccaatcctgga

SEQ ID NO: 9204848 - DNA, 22 bp, Homo sapiens
gctgtggctgtacagagaccat

SEQ ID NO: 9204849 - DNA, 22 bp, Homo sapiens
gctgggcttggtttccctgctt

SEQ ID NO: 9204850 - DNA, 22 bp, Homo sapiens
gctgggcttctcaatgctgcct

SEQ ID NO: 9204851 - DNA, 22 bp, Homo sapiens
gctgggcttctcaatgctgcct

SEQ ID NO: 9204852 - DNA, 19 bp, Homo sapiens
gctgggcttgggtttgtag

SEQ ID NO: 9204853 - DNA, 22 bp, Homo sapiens
gctgggcttggtttccctgctt

SEQ ID NO: 9204854 - DNA, 22 bp, Homo sapiens
gctggggctgggctgaggaaga

SEQ ID NO: 9204855 - DNA, 22 bp, Homo sapiens
gctggggctgggctgaggaaga

SEQ ID NO: 9204856 - DNA, 19 bp, Homo sapiens
gctgtgcccctgccgcttg

SEQ ID NO: 9204857 - DNA, 20 bp, Homo sapiens
gctgtgcctccagctggtgg

SEQ ID NO: 9204858 - DNA, 22 bp, Homo sapiens
gctgtgctgattcattccctgc

SEQ ID NO: 9204859 - DNA, 22 bp, Homo sapiens
gctggggcctgaacagtcagct

SEQ ID NO: 9204860 - DNA, 19 bp, Homo sapiens
gctggggcctgaccagaca

SEQ ID NO: 9204861 - DNA, 22 bp, Homo sapiens
gctggctggaggtgaggaagaa

SEQ ID NO: 9204862 - DNA, 22 bp, Homo sapiens
gctggctggaggtgaggaagaa

SEQ ID NO: 9204863 - DNA, 22 bp, Homo sapiens
gctggctggagtaaggagggag

SEQ ID NO: 9204864 - DNA, 22 bp, Homo sapiens
gctggctggagtgagctaccct

SEQ ID NO: 9204865 - DNA, 22 bp, Homo sapiens
gctggctggaggagggaggttg

SEQ ID NO: 9204866 - DNA, 19 bp, Homo sapiens
gctggctggaggagggaca

SEQ ID NO: 9204867 - DNA, 22 bp, Homo sapiens
gctggctggaatgggagaagaa

SEQ ID NO: 9204868 - DNA, 22 bp, Homo sapiens
gctggctgcgtcatcacagggc

SEQ ID NO: 9204869 - DNA, 22 bp, Homo sapiens
gctggagagataggcatggggt

SEQ ID NO: 9204870 - DNA, 22 bp, Homo sapiens
gctgggctggccgccgagatcg

SEQ ID NO: 9204871 - DNA, 22 bp, Homo sapiens
gctgggctgtagtttgctgacc

SEQ ID NO: 9204872 - DNA, 22 bp, Homo sapiens
gctgggctgtagtttgctgacc

SEQ ID NO: 9204873 - DNA, 23 bp, Homo sapiens
gctgggcttactctttcagtgag

SEQ ID NO: 9204874 - DNA, 22 bp, Homo sapiens
gctgggcttcacagagccttta

SEQ ID NO: 9204875 - DNA, 23 bp, Homo sapiens
gctgggcttactctttcagtgag

SEQ ID NO: 9204876 - DNA, 22 bp, Homo sapiens
gctgggcttcacctccagagtt

SEQ ID NO: 9204877 - DNA, 22 bp, Homo sapiens
gctgggcttcacctccagagtt

SEQ ID NO: 9204878 - DNA, 22 bp, Homo sapiens
gctgggcttctcaatgctgcct

SEQ ID NO: 9204879 - DNA, 22 bp, Homo sapiens
gctgggcttcacagagccttta

SEQ ID NO: 9204880 - DNA, 22 bp, Homo sapiens
gctgggcttcacagagccttta

SEQ ID NO: 9204881 - DNA, 22 bp, Homo sapiens
gctggctttatggggcttgtgg

SEQ ID NO: 9204882 - DNA, 22 bp, Homo sapiens
gctggctttatcgtcagactcc

SEQ ID NO: 9204883 - DNA, 21 bp, Homo sapiens
gctggctttattctgcgtttg

SEQ ID NO: 9204884 - DNA, 22 bp, Homo sapiens
gctggctttgcactgggtgcat

SEQ ID NO: 9204885 - DNA, 22 bp, Homo sapiens
gctggctttgatcttcccatct

SEQ ID NO: 9204886 - DNA, 22 bp, Homo sapiens
gctggctttgtcaagggcagca

SEQ ID NO: 9204887 - DNA, 22 bp, Homo sapiens
gctgggctggaaggccaaggca

SEQ ID NO: 9204888 - DNA, 22 bp, Homo sapiens
gctgggctggccgccgagatcg

SEQ ID NO: 9204889 - DNA, 22 bp, Homo sapiens
gctgggctggaaggccaaggca

SEQ ID NO: 9204890 - DNA, 22 bp, Homo sapiens
gctgggctggaaggccaaggca

SEQ ID NO: 9204891 - DNA, 22 bp, Homo sapiens
gctggcttttgaagtctagcta

SEQ ID NO: 9204892 - DNA, 22 bp, Homo sapiens
gctggctttgtggtctctcctc

SEQ ID NO: 9204893 - DNA, 22 bp, Homo sapiens
gctggcttaatagggatgggct

SEQ ID NO: 9204894 - DNA, 21 bp, Homo sapiens
gctggcttcctgagggctgag

SEQ ID NO: 9204895 - DNA, 22 bp, Homo sapiens
gctggcttccatcagagggtga

SEQ ID NO: 9204896 - DNA, 22 bp, Homo sapiens
gctggcttccctacctgcacct

SEQ ID NO: 9204897 - DNA, 22 bp, Homo sapiens
gctggcttgatagtttctgctt

SEQ ID NO: 9204898 - DNA, 22 bp, Homo sapiens
gctggcttgtcccaggacaaag

SEQ ID NO: 9204899 - DNA, 22 bp, Homo sapiens
gctggcttccttctgcagctag

SEQ ID NO: 9204900 - DNA, 22 bp, Homo sapiens
gctggcttgacagaggcctggg

SEQ ID NO: 9204901 - DNA, 17 bp, Homo sapiens
gctggcttctccttgct

SEQ ID NO: 9204902 - DNA, 22 bp, Homo sapiens
gctggctgtgttccttctgcca

SEQ ID NO: 9204903 - DNA, 22 bp, Homo sapiens
gctgagagcaaggacaaagcat

SEQ ID NO: 9204904 - DNA, 22 bp, Homo sapiens
gctgagagtccaggaaaacatc

SEQ ID NO: 9204905 - DNA, 22 bp, Homo sapiens
gctgagactgacatgaagaggt

SEQ ID NO: 9204906 - DNA, 22 bp, Homo sapiens
gctgagacttccactgccatct

SEQ ID NO: 9204907 - DNA, 22 bp, Homo sapiens
gctgaggccccagggtgatggg

SEQ ID NO: 9204908 - DNA, 22 bp, Homo sapiens
gctgaggctcaagtcatgggtc

SEQ ID NO: 9204909 - DNA, 22 bp, Homo sapiens
gctcctctattccccacatttt

SEQ ID NO: 9204910 - DNA, 22 bp, Homo sapiens
gctcctccctgtgcagacccag

SEQ ID NO: 9204911 - DNA, 22 bp, Homo sapiens
gctctggctagttacctcttac

SEQ ID NO: 9204912 - DNA, 22 bp, Homo sapiens
gctccctgttctcagccatgat

SEQ ID NO: 9204913 - DNA, 22 bp, Homo sapiens
gctccctgttctcagccatgat

SEQ ID NO: 9204914 - DNA, 22 bp, Homo sapiens
gctctgggaactgactgccttc

SEQ ID NO: 9204915 - DNA, 22 bp, Homo sapiens
gctctgggaagtcctttaccat

SEQ ID NO: 9204916 - DNA, 22 bp, Homo sapiens
gctctgggaaggatcgtagtga

SEQ ID NO: 9204917 - DNA, 22 bp, Homo sapiens
gctctgggaactgactgccttc

SEQ ID NO: 9204918 - DNA, 22 bp, Homo sapiens
gctctggcttggggcactcgtc

SEQ ID NO: 9204919 - DNA, 22 bp, Homo sapiens
gctctggctcaaaccaccggct

SEQ ID NO: 9204920 - DNA, 22 bp, Homo sapiens
gctctggctcaaaccaccggct

SEQ ID NO: 9204921 - DNA, 18 bp, Homo sapiens
gctctggctcacctccag

SEQ ID NO: 9204922 - DNA, 18 bp, Homo sapiens
gctctggctcacctccag

SEQ ID NO: 9204923 - DNA, 22 bp, Homo sapiens
gctctggggcccagggatcaca

SEQ ID NO: 9204924 - DNA, 22 bp, Homo sapiens
gctctggggatgcttctgccgt

SEQ ID NO: 9204925 - DNA, 22 bp, Homo sapiens
gctctggggcccagggatcaca

SEQ ID NO: 9204926 - DNA, 22 bp, Homo sapiens
gctctggggatgcttctgccgt

SEQ ID NO: 9204927 - DNA, 22 bp, Homo sapiens
gctctgggctgccctctggaca

SEQ ID NO: 9204928 - DNA, 22 bp, Homo sapiens
gctctgggctgaatcatttatc

SEQ ID NO: 9204929 - DNA, 22 bp, Homo sapiens
gctctgggctgccctctggaca

SEQ ID NO: 9204930 - DNA, 22 bp, Homo sapiens
gctctgggccgggcaccagcct

SEQ ID NO: 9204931 - DNA, 22 bp, Homo sapiens
gctctgggccgggcaccagcct

SEQ ID NO: 9204932 - DNA, 22 bp, Homo sapiens
gctctgggccatcctggccggg

SEQ ID NO: 9204933 - DNA, 22 bp, Homo sapiens
gctctgggccatcctggccggg

SEQ ID NO: 9204934 - DNA, 22 bp, Homo sapiens
gctctgggaattcagaaagcct

SEQ ID NO: 9204935 - DNA, 22 bp, Homo sapiens
gctctgggaattcagaaagcct

SEQ ID NO: 9204936 - DNA, 20 bp, Homo sapiens
gctctgggagggatgtgatg

SEQ ID NO: 9204937 - DNA, 22 bp, Homo sapiens
gctctgggattaccagccttag

SEQ ID NO: 9204938 - DNA, 22 bp, Homo sapiens
gctctgggattaccagccttag

SEQ ID NO: 9204939 - DNA, 22 bp, Homo sapiens
gctgctaagcgtttctgttcca

SEQ ID NO: 9204940 - DNA, 22 bp, Homo sapiens
gctgccttccaaagagttttat

SEQ ID NO: 9204941 - DNA, 22 bp, Homo sapiens
gctgccttcagttctgattcat

SEQ ID NO: 9204942 - DNA, 22 bp, Homo sapiens
gctgccttatgtctattagtat

SEQ ID NO: 9204943 - DNA, 20 bp, Homo sapiens
gctgcctgtttctgtaagta

SEQ ID NO: 9204944 - DNA, 20 bp, Homo sapiens
gctgcctgtttctgtaagta

SEQ ID NO: 9204945 - DNA, 22 bp, Homo sapiens
gctgcctgttgaagggtctgtg

SEQ ID NO: 9204946 - DNA, 22 bp, Homo sapiens
gctgcctgtgcgggtcgctagg

SEQ ID NO: 9204947 - DNA, 19 bp, Homo sapiens
gctgcctgtcttagccagt

SEQ ID NO: 9204948 - DNA, 22 bp, Homo sapiens
gctgcctgtgtggccactcact

SEQ ID NO: 9204949 - DNA, 22 bp, Homo sapiens
gctgcctgtggcccttctgggt

SEQ ID NO: 9204950 - DNA, 22 bp, Homo sapiens
gctgcctgtgtggccactcact

SEQ ID NO: 9204951 - DNA, 22 bp, Homo sapiens
gctgctcagtgggcctgagcct

SEQ ID NO: 9204952 - DNA, 22 bp, Homo sapiens
gctgcttcagggacgtgccagc

SEQ ID NO: 9204953 - DNA, 22 bp, Homo sapiens
gctgcttcctttcctgctgacc

SEQ ID NO: 9204954 - DNA, 22 bp, Homo sapiens
gctgcttctctgatggagtcca

SEQ ID NO: 9204955 - DNA, 22 bp, Homo sapiens
gctgcttcctttcctgctgacc

SEQ ID NO: 9204956 - DNA, 22 bp, Homo sapiens
gctgagggcatgtgtggcgact

SEQ ID NO: 9204957 - DNA, 22 bp, Homo sapiens
gctgagggctgtaacagcagag

SEQ ID NO: 9204958 - DNA, 22 bp, Homo sapiens
gctgcctgtcctgaggagtccg

SEQ ID NO: 9204959 - DNA, 22 bp, Homo sapiens
gctgcctgtcctgaggagtccg

SEQ ID NO: 9204960 - DNA, 22 bp, Homo sapiens
gctgcctagtctgctgagcaga

SEQ ID NO: 9204961 - DNA, 22 bp, Homo sapiens
gctgccctagaagtacagagag

SEQ ID NO: 9204962 - DNA, 22 bp, Homo sapiens
gctccaggtgtcccaggtaaaa

SEQ ID NO: 9204963 - DNA, 22 bp, Homo sapiens
gctccaggtgtcccaggtaaaa

SEQ ID NO: 9204964 - DNA, 22 bp, Homo sapiens
gctcccacaaccttcttgctcc

SEQ ID NO: 9204965 - DNA, 22 bp, Homo sapiens
gctccaggtgaatcctctcacc

SEQ ID NO: 9204966 - DNA, 20 bp, Homo sapiens
gctccaggtcagagaggacg

SEQ ID NO: 9204967 - DNA, 22 bp, Homo sapiens
gctcccacgcaattcttttcag

SEQ ID NO: 9204968 - DNA, 22 bp, Homo sapiens
gctcccactgcagccctgagcc

SEQ ID NO: 9204969 - DNA, 22 bp, Homo sapiens
gctcccaccttaaccttcacat

SEQ ID NO: 9204970 - DNA, 22 bp, Homo sapiens
gctcccacctttgctatcagta

SEQ ID NO: 9204971 - DNA, 22 bp, Homo sapiens
gctcccacctccagcctgagtt

SEQ ID NO: 9204972 - DNA, 22 bp, Homo sapiens
gctcccaccgccgctatgggta

SEQ ID NO: 9204973 - DNA, 22 bp, Homo sapiens
gctcccaccaggcagacctacc

SEQ ID NO: 9204974 - DNA, 22 bp, Homo sapiens
gctccctgcatttcccaccctt

SEQ ID NO: 9204975 - DNA, 22 bp, Homo sapiens
gctccctgcactctgcagccct

SEQ ID NO: 9204976 - DNA, 22 bp, Homo sapiens
gctccctgcactctgcagccct

SEQ ID NO: 9204977 - DNA, 22 bp, Homo sapiens
gctccctgcactctgcagccct

SEQ ID NO: 9204978 - DNA, 22 bp, Homo sapiens
gctccctgactcagttcctgag

SEQ ID NO: 9204979 - DNA, 17 bp, Homo sapiens
gctccctgaggacagct

SEQ ID NO: 9204980 - DNA, 17 bp, Homo sapiens
gctccctgaggacagct

SEQ ID NO: 9204981 - DNA, 22 bp, Homo sapiens
gctccctggtagccatgctctc

SEQ ID NO: 9204982 - DNA, 22 bp, Homo sapiens
gctccctggtagccatgctctc

SEQ ID NO: 9204983 - DNA, 22 bp, Homo sapiens
gctccctggtattgctgccact

SEQ ID NO: 9204984 - DNA, 22 bp, Homo sapiens
gctccctggtattgctgccact

SEQ ID NO: 9204985 - DNA, 23 bp, Homo sapiens
gctccctgtgctccaggagatgc

SEQ ID NO: 9204986 - DNA, 23 bp, Homo sapiens
gctccctgtccctgcacttaggc

SEQ ID NO: 9204987 - DNA, 21 bp, Homo sapiens
gctccctgctcagctcctggg

SEQ ID NO: 9204988 - DNA, 22 bp, Homo sapiens
gctccagggacccaagagaaaa

SEQ ID NO: 9204989 - DNA, 22 bp, Homo sapiens
gctccagggtggatgacaattc

SEQ ID NO: 9204990 - DNA, 22 bp, Homo sapiens
gctccagggtcagctcagaact

SEQ ID NO: 9204991 - DNA, 22 bp, Homo sapiens
gctcagctacttacaggtggct

SEQ ID NO: 9204992 - DNA, 22 bp, Homo sapiens
gctcagctgagcgaaggacatg

SEQ ID NO: 9204993 - DNA, 22 bp, Homo sapiens
gctccaggcagagcctctttcg

SEQ ID NO: 9204994 - DNA, 22 bp, Homo sapiens
gctccaggcagagcctctttcg

SEQ ID NO: 9204995 - DNA, 21 bp, Homo sapiens
gctcagcaaaggtgaggtgca

SEQ ID NO: 9204996 - DNA, 23 bp, Homo sapiens
gctcagatgccctaggaggtggc

SEQ ID NO: 9204997 - DNA, 22 bp, Homo sapiens
gctcagagttaaatatagtgct

SEQ ID NO: 9204998 - DNA, 22 bp, Homo sapiens
gctcagctacttacaggtggct

SEQ ID NO: 9204999 - DNA, 18 bp, Homo sapiens
gctcagctatgggaggtt

SEQ ID NO: 9205000 - DNA, 18 bp, Homo sapiens
gctcagctatgggaggtt

SEQ ID NO: 9205001 - DNA, 22 bp, Homo sapiens
gctcagccgaacttcagagcag

SEQ ID NO: 9205002 - DNA, 23 bp, Homo sapiens
gctcagcctcagcaggcccagga

SEQ ID NO: 9205003 - DNA, 22 bp, Homo sapiens
gctcagaggagcatcataagga

SEQ ID NO: 9205004 - DNA, 22 bp, Homo sapiens
gctcagaggccaagtgcccgcc

SEQ ID NO: 9205005 - DNA, 22 bp, Homo sapiens
gctcagagggttttggccaagt

SEQ ID NO: 9205006 - DNA, 19 bp, Homo sapiens
gctcagagggccctgtgct

SEQ ID NO: 9205007 - DNA, 22 bp, Homo sapiens
gctcagagtggcctggctaggg

SEQ ID NO: 9205008 - DNA, 17 bp, Homo sapiens
gctcagagtacacgtgt

SEQ ID NO: 9205009 - DNA, 22 bp, Homo sapiens
gcgggtggatcatgaggtcagg

SEQ ID NO: 9205010 - DNA, 22 bp, Homo sapiens
gcctctgtcatagctcatgtga

SEQ ID NO: 9205011 - DNA, 18 bp, Homo sapiens
gcctctgttgcttgcctg

SEQ ID NO: 9205012 - DNA, 19 bp, Homo sapiens
gcctgagccagccatgcaa

SEQ ID NO: 9205013 - DNA, 22 bp, Homo sapiens
gcctgagcaggcgtggaccatg

SEQ ID NO: 9205014 - DNA, 22 bp, Homo sapiens
gcctgagcaggcgtggaccatg

SEQ ID NO: 9205015 - DNA, 22 bp, Homo sapiens
gcctctgggttggtgacaggct

SEQ ID NO: 9205016 - DNA, 20 bp, Homo sapiens
gcctgagctattgccaggat

SEQ ID NO: 9205017 - DNA, 22 bp, Homo sapiens
gcctgagccgcctgagcggcgg

SEQ ID NO: 9205018 - DNA, 21 bp, Homo sapiens
gccttgccacatgtgccacag

SEQ ID NO: 9205019 - DNA, 22 bp, Homo sapiens
gccttggagatcactgctcatg

SEQ ID NO: 9205020 - DNA, 21 bp, Homo sapiens
gccttgccgtgaaagcccttt

SEQ ID NO: 9205021 - DNA, 22 bp, Homo sapiens
gccttgcctcagccatggaaac

SEQ ID NO: 9205022 - DNA, 22 bp, Homo sapiens
gccttgggggtgaaagaggcta

SEQ ID NO: 9205023 - DNA, 19 bp, Homo sapiens
gccttggcattctctgctt

SEQ ID NO: 9205024 - DNA, 22 bp, Homo sapiens
gccttggctgccaagctgctga

SEQ ID NO: 9205025 - DNA, 22 bp, Homo sapiens
gccttggctgttggagcttgat

SEQ ID NO: 9205026 - DNA, 22 bp, Homo sapiens
gcagaggcagggccctcctcca

SEQ ID NO: 9205027 - DNA, 22 bp, Homo sapiens
gcagaggcacagccccagatga

SEQ ID NO: 9205028 - DNA, 22 bp, Homo sapiens
gcagatggactgtatgacctga

SEQ ID NO: 9205029 - DNA, 22 bp, Homo sapiens
gcagagtggtttcagagttgag

SEQ ID NO: 9205030 - DNA, 22 bp, Homo sapiens
gcagaggccaggccaccagcaa

SEQ ID NO: 9205031 - DNA, 22 bp, Homo sapiens
gcagaggtcctagccaggagtc

SEQ ID NO: 9205032 - DNA, 22 bp, Homo sapiens
gcagactgcgagcgtgctggtg

SEQ ID NO: 9205033 - DNA, 22 bp, Homo sapiens
gcagagattggtgcactgatga

SEQ ID NO: 9205034 - DNA, 22 bp, Homo sapiens
gcagagaagatgcccaggcttc

SEQ ID NO: 9205035 - DNA, 22 bp, Homo sapiens
gcagagcaccctgcagtggtat

SEQ ID NO: 9205036 - DNA, 22 bp, Homo sapiens
gcagagaagatgcccaggcttc

SEQ ID NO: 9205037 - DNA, 22 bp, Homo sapiens
gcagagaacccagcagattggc

SEQ ID NO: 9205038 - DNA, 22 bp, Homo sapiens
gcagagaaagttttgtcctcag

SEQ ID NO: 9205039 - DNA, 22 bp, Homo sapiens
gcagagaaagttttgtcctcag

SEQ ID NO: 9205040 - DNA, 22 bp, Homo sapiens
gcagagaaagttttgtcctcag

SEQ ID NO: 9205041 - DNA, 22 bp, Homo sapiens
gcacatacgtcagtggctgtca

SEQ ID NO: 9205042 - DNA, 22 bp, Homo sapiens
gcacatatgctgtaagcacatg

SEQ ID NO: 9205043 - DNA, 19 bp, Homo sapiens
gcacacagtagggctggca

SEQ ID NO: 9205044 - DNA, 22 bp, Homo sapiens
gcacacagtatatgctcattaa

SEQ ID NO: 9205045 - DNA, 22 bp, Homo sapiens
gcacacagaatcagtgggcata

SEQ ID NO: 9205046 - DNA, 22 bp, Homo sapiens
gcacacagaacatttggatcct

SEQ ID NO: 9205047 - DNA, 22 bp, Homo sapiens
gcaaatattcaagacttttcca

SEQ ID NO: 9205048 - DNA, 22 bp, Homo sapiens
gcacacagtagggattcaatga

SEQ ID NO: 9205049 - DNA, 22 bp, Homo sapiens
gcacacagtactatatgctaca

SEQ ID NO: 9205050 - DNA, 22 bp, Homo sapiens
gcacacttaatactcactgtgc

SEQ ID NO: 9205051 - DNA, 22 bp, Homo sapiens
gcacactgcggtgatgtgagtc

SEQ ID NO: 9205052 - DNA, 19 bp, Homo sapiens
gcacaccctgcaccaccat

SEQ ID NO: 9205053 - DNA, 22 bp, Homo sapiens
gcacaccctctcaccagcactg

SEQ ID NO: 9205054 - DNA, 19 bp, Homo sapiens
gcacaccctgcaccaccat

SEQ ID NO: 9205055 - DNA, 22 bp, Homo sapiens
gcacagggctgccaggcggctt

SEQ ID NO: 9205056 - DNA, 22 bp, Homo sapiens
gcacaggctccggaggagagct

SEQ ID NO: 9205057 - DNA, 22 bp, Homo sapiens
gcaaagcaagattcagatgtag

SEQ ID NO: 9205058 - DNA, 22 bp, Homo sapiens
gcaaagcaagattcagatgtag

SEQ ID NO: 9205059 - DNA, 22 bp, Homo sapiens
gcaaagcaagctgtcagcctca

SEQ ID NO: 9205060 - DNA, 22 bp, Homo sapiens
gcaaagcaaatgcctgaaggcg

SEQ ID NO: 9205061 - DNA, 22 bp, Homo sapiens
gcaaagcaatcaggagtagcat

SEQ ID NO: 9205062 - DNA, 22 bp, Homo sapiens
gcaaagcacaccctcagagttt

SEQ ID NO: 9205063 - DNA, 22 bp, Homo sapiens
gcaaagcacaccctcagagttt

SEQ ID NO: 9205064 - DNA, 22 bp, Homo sapiens
gcaaagcaagctgtcagcctca

SEQ ID NO: 9205065 - DNA, 22 bp, Homo sapiens
gcaaagcaatcaggagtagcat

SEQ ID NO: 9205066 - DNA, 22 bp, Homo sapiens
gcaaagcaatcaggagtagcat

SEQ ID NO: 9205067 - DNA, 22 bp, Homo sapiens
gcaaagctgggtgtgaatgcac

SEQ ID NO: 9205068 - DNA, 22 bp, Homo sapiens
gcaaagcattctgtggagtcta

SEQ ID NO: 9205069 - DNA, 22 bp, Homo sapiens
gcaaagcatcagtagaaatgtt

SEQ ID NO: 9205070 - DNA, 22 bp, Homo sapiens
gcaaagcatcagtagaaatgtt

SEQ ID NO: 9205071 - DNA, 22 bp, Homo sapiens
gcaaagcagtcttctgtgccta

SEQ ID NO: 9205072 - DNA, 22 bp, Homo sapiens
gcaaagcagaaccctctctatc

SEQ ID NO: 9205073 - DNA, 22 bp, Homo sapiens
gcaaagcagtcttctgtgccta

SEQ ID NO: 9205074 - DNA, 22 bp, Homo sapiens
gcaaagcacactggagatgtcg

SEQ ID NO: 9205075 - DNA, 22 bp, Homo sapiens
gcaaagcacactggagatgtcg

SEQ ID NO: 9205076 - DNA, 22 bp, Homo sapiens
gcaaagcagaaccctctctatc

SEQ ID NO: 9205077 - DNA, 22 bp, Homo sapiens
gcaaagtattaagtattaagtt

SEQ ID NO: 9205078 - DNA, 22 bp, Homo sapiens
gcaaagtaaaaatagattctga

SEQ ID NO: 9205079 - DNA, 22 bp, Homo sapiens
gaggccataagaagttcttggg

SEQ ID NO: 9205080 - DNA, 22 bp, Homo sapiens
gaggcccagagaggttgcatga

SEQ ID NO: 9205081 - DNA, 22 bp, Homo sapiens
gaggcccaaggactctgtcccg

SEQ ID NO: 9205082 - DNA, 22 bp, Homo sapiens
gcaaactgttggagtagagtct

SEQ ID NO: 9205083 - DNA, 22 bp, Homo sapiens
gaggcccagcagcgcaggtctt

SEQ ID NO: 9205084 - DNA, 22 bp, Homo sapiens
gcaaactggcaaacctgtctgt

SEQ ID NO: 9205085 - DNA, 22 bp, Homo sapiens
gcaaagacaaattagaactcct

SEQ ID NO: 9205086 - DNA, 16 bp, Homo sapiens
gcaggcagatcacatg

SEQ ID NO: 9205087 - DNA, 22 bp, Homo sapiens
gcaggcagatcacctgtcagga

SEQ ID NO: 9205088 - DNA, 21 bp, Homo sapiens
gcagggacaaagcttcaggag

SEQ ID NO: 9205089 - DNA, 22 bp, Homo sapiens
gcagggaagacccggagcagcg

SEQ ID NO: 9205090 - DNA, 22 bp, Homo sapiens
gcaggcaggtggcatcttgtga

SEQ ID NO: 9205091 - DNA, 19 bp, Homo sapiens
gcaggcagtggcattcgga

SEQ ID NO: 9205092 - DNA, 19 bp, Homo sapiens
gcaggcagtggcattcgga

SEQ ID NO: 9205093 - DNA, 22 bp, Homo sapiens
gcagggaagacccggagcagcg

SEQ ID NO: 9205094 - DNA, 22 bp, Homo sapiens
gcagggctggggctgctcctga

SEQ ID NO: 9205095 - DNA, 22 bp, Homo sapiens
gcagggctgtaatttgagcctg

SEQ ID NO: 9205096 - DNA, 22 bp, Homo sapiens
gcagggctgggtgggagacaga

SEQ ID NO: 9205097 - DNA, 22 bp, Homo sapiens
gcagggctgttcaggagggtgg

SEQ ID NO: 9205098 - DNA, 22 bp, Homo sapiens
gcagggctgtggacactttggt

SEQ ID NO: 9205099 - DNA, 22 bp, Homo sapiens
gcagggcttagaaatggtggct

SEQ ID NO: 9205100 - DNA, 22 bp, Homo sapiens
gcagggacagggcagggccttt

SEQ ID NO: 9205101 - DNA, 22 bp, Homo sapiens
gcagggacatctttgtctagta

SEQ ID NO: 9205102 - DNA, 18 bp, Homo sapiens
gcagggacacagggtcac

SEQ ID NO: 9205103 - DNA, 22 bp, Homo sapiens
gcagggacctatgacgatggaa

SEQ ID NO: 9205104 - DNA, 22 bp, Homo sapiens
gcagggctctgctgtagtccta

SEQ ID NO: 9205105 - DNA, 22 bp, Homo sapiens
gcagggaccaaaagaggcagta

SEQ ID NO: 9205106 - DNA, 20 bp, Homo sapiens
gcagcctcaacaggcacagc

SEQ ID NO: 9205107 - DNA, 22 bp, Homo sapiens
gcagcctcagggcactcagatg

SEQ ID NO: 9205108 - DNA, 22 bp, Homo sapiens
gcagcctcaaactccccagctc

SEQ ID NO: 9205109 - DNA, 22 bp, Homo sapiens
gcagccctggcctggcctactt

SEQ ID NO: 9205110 - DNA, 22 bp, Homo sapiens
gcagccctgcaggcagctccag

SEQ ID NO: 9205111 - DNA, 22 bp, Homo sapiens
gcagccctttctgggcagggga

SEQ ID NO: 9205112 - DNA, 20 bp, Homo sapiens
gcagccgtggagactaggag

SEQ ID NO: 9205113 - DNA, 22 bp, Homo sapiens
gcagcccttcaggtgaggggca

SEQ ID NO: 9205114 - DNA, 22 bp, Homo sapiens
gcagcctctgatgatggccgta

SEQ ID NO: 9205115 - DNA, 22 bp, Homo sapiens
gcagcctcagggcactcagatg

SEQ ID NO: 9205116 - DNA, 22 bp, Homo sapiens
gcagcctcagggcactcagatg

SEQ ID NO: 9205117 - DNA, 22 bp, Homo sapiens
gcaggaagcatagaagaatgcc

SEQ ID NO: 9205118 - DNA, 22 bp, Homo sapiens
gcaggaagggaaaggttgactc

SEQ ID NO: 9205119 - DNA, 22 bp, Homo sapiens
gcaggaagggaaaggttgactc

SEQ ID NO: 9205120 - DNA, 22 bp, Homo sapiens
gcaggaagatgagctcaggtaa

SEQ ID NO: 9205121 - DNA, 22 bp, Homo sapiens
gcagctttgtggagaggcccat

SEQ ID NO: 9205122 - DNA, 22 bp, Homo sapiens
gcagctttttggatgtcagtta

SEQ ID NO: 9205123 - DNA, 21 bp, Homo sapiens
gcagatgggagtcatcaggct

SEQ ID NO: 9205124 - DNA, 22 bp, Homo sapiens
gcagatggctcagacactgggg

SEQ ID NO: 9205125 - DNA, 23 bp, Homo sapiens
gcagatggccccagagtgctgcc

SEQ ID NO: 9205126 - DNA, 21 bp, Homo sapiens
gcagatgggaagagacgaggc

SEQ ID NO: 9205127 - DNA, 23 bp, Homo sapiens
gcagatggccccagagtgctgcc

SEQ ID NO: 9205128 - DNA, 22 bp, Homo sapiens
gcagatggatgtggacggcgcc

SEQ ID NO: 9205129 - DNA, 22 bp, Homo sapiens
gcagatggcagcccaggctggg

SEQ ID NO: 9205130 - DNA, 22 bp, Homo sapiens
gcagatggtgggggaggagtac

SEQ ID NO: 9205131 - DNA, 22 bp, Homo sapiens
gcagccctcttggtcactaggc

SEQ ID NO: 9205132 - DNA, 22 bp, Homo sapiens
gcagccctcgggtactcacgtg

SEQ ID NO: 9205133 - DNA, 22 bp, Homo sapiens
gcagccctgcagctccacaccg

SEQ ID NO: 9205134 - DNA, 22 bp, Homo sapiens
gcagccctcgctagctctcccc

SEQ ID NO: 9205135 - DNA, 22 bp, Homo sapiens
gcagccctccctgggtgtgtct

SEQ ID NO: 9205136 - DNA, 22 bp, Homo sapiens
gcagccctaacctgtcatagtg

SEQ ID NO: 9205137 - DNA, 22 bp, Homo sapiens
gcagccctagcgacaaattgat

SEQ ID NO: 9205138 - DNA, 22 bp, Homo sapiens
gcctcctgcccagatgagtgat

SEQ ID NO: 9205139 - DNA, 22 bp, Homo sapiens
gcctcctggattttagtgccat

SEQ ID NO: 9205140 - DNA, 22 bp, Homo sapiens
gcctcctgagaagccacaggct

SEQ ID NO: 9205141 - DNA, 22 bp, Homo sapiens
gcctcctgggttcatgccattc

SEQ ID NO: 9205142 - DNA, 22 bp, Homo sapiens
gcctcctggggtgccatcatct

SEQ ID NO: 9205143 - DNA, 22 bp, Homo sapiens
gcctcctaccacaccctcagtc

SEQ ID NO: 9205144 - DNA, 22 bp, Homo sapiens
gccctgtgtatcccctgtgctt

SEQ ID NO: 9205145 - DNA, 22 bp, Homo sapiens
gccctgtgtgtttgcactgatt

SEQ ID NO: 9205146 - DNA, 22 bp, Homo sapiens
gcctcccttggtgtctcccggg

SEQ ID NO: 9205147 - DNA, 22 bp, Homo sapiens
gccccagcctcccgagtagctg

SEQ ID NO: 9205148 - DNA, 22 bp, Homo sapiens
gccccagccaaggtgacacgaa

SEQ ID NO: 9205149 - DNA, 22 bp, Homo sapiens
gccccagccaaggtgacacgaa

SEQ ID NO: 9205150 - DNA, 22 bp, Homo sapiens
gccccaggggaggtgccctgca

SEQ ID NO: 9205151 - DNA, 17 bp, Homo sapiens
gccctggagccaggcta

SEQ ID NO: 9205152 - DNA, 22 bp, Homo sapiens
gccctggagggccagcgactgg

SEQ ID NO: 9205153 - DNA, 17 bp, Homo sapiens
gccctggagccaggcta

SEQ ID NO: 9205154 - DNA, 22 bp, Homo sapiens
gccctggagctagactaggaca

SEQ ID NO: 9205155 - DNA, 15 bp, Homo sapiens
gccccaggaatcaaa

SEQ ID NO: 9205156 - DNA, 22 bp, Homo sapiens
gccccaggataaatttgtaaga

SEQ ID NO: 9205157 - DNA, 22 bp, Homo sapiens
gccctggatggcaggagccatc

SEQ ID NO: 9205158 - DNA, 22 bp, Homo sapiens
gccctggatgtacaggcatgtt

SEQ ID NO: 9205159 - DNA, 22 bp, Homo sapiens
gccctggatgtacaggcatgtt

SEQ ID NO: 9205160 - DNA, 22 bp, Homo sapiens
gccctggatggcaggagccatc

SEQ ID NO: 9205161 - DNA, 22 bp, Homo sapiens
gccctggatgctcatggcatca

SEQ ID NO: 9205162 - DNA, 22 bp, Homo sapiens
gccctggatgctcatggcatca

SEQ ID NO: 9205163 - DNA, 22 bp, Homo sapiens
gccctggagggccagcgactgg

SEQ ID NO: 9205164 - DNA, 22 bp, Homo sapiens
gccctgggattgggtggaggct

SEQ ID NO: 9205165 - DNA, 22 bp, Homo sapiens
gccctggcctcctggaacaggc

SEQ ID NO: 9205166 - DNA, 22 bp, Homo sapiens
gccctgtggacccaggaactct

SEQ ID NO: 9205167 - DNA, 22 bp, Homo sapiens
gccctgggcaaggttctggcca

SEQ ID NO: 9205168 - DNA, 22 bp, Homo sapiens
gccctgtgccagtcacgctgtg

SEQ ID NO: 9205169 - DNA, 17 bp, Homo sapiens
gcccaggaaggacggcc

SEQ ID NO: 9205170 - DNA, 22 bp, Homo sapiens
gcccagctggcttccagcacat

SEQ ID NO: 9205171 - DNA, 22 bp, Homo sapiens
gcccagctttttgaggcaggca

SEQ ID NO: 9205172 - DNA, 22 bp, Homo sapiens
gccccaccgagggtgcagtcct

SEQ ID NO: 9205173 - DNA, 22 bp, Homo sapiens
gccccaccgagggtgcagtcct

SEQ ID NO: 9205174 - DNA, 22 bp, Homo sapiens
gccccaccttgagagcagaaac

SEQ ID NO: 9205175 - DNA, 22 bp, Homo sapiens
gccccacctgctaccttccagc

SEQ ID NO: 9205176 - DNA, 22 bp, Homo sapiens
gccagggggtcagcaggcactt

SEQ ID NO: 9205177 - DNA, 22 bp, Homo sapiens
gccagggttcaagctattctcc

SEQ ID NO: 9205178 - DNA, 22 bp, Homo sapiens
gccagggtgagggctgagaggt

SEQ ID NO: 9205179 - DNA, 22 bp, Homo sapiens
gccagggtcctgaagaccaagt

SEQ ID NO: 9205180 - DNA, 22 bp, Homo sapiens
gcccagcacattgctgaggacc

SEQ ID NO: 9205181 - DNA, 22 bp, Homo sapiens
gcccagcacattgctgaggacc

SEQ ID NO: 9205182 - DNA, 22 bp, Homo sapiens
gcccagcacagctggaagagtc

SEQ ID NO: 9205183 - DNA, 22 bp, Homo sapiens
gcccagcacagctggaagagtc

SEQ ID NO: 9205184 - DNA, 22 bp, Homo sapiens
gcccagcacatctggccttgaa

SEQ ID NO: 9205185 - DNA, 22 bp, Homo sapiens
gcccagcacatctggccttgaa

SEQ ID NO: 9205186 - DNA, 22 bp, Homo sapiens
gccagggttgccaatgggggca

SEQ ID NO: 9205187 - DNA, 22 bp, Homo sapiens
gccagggttcgaatccgtatgg

SEQ ID NO: 9205188 - DNA, 21 bp, Homo sapiens
gcccagcaaggtgagaaggcc

SEQ ID NO: 9205189 - DNA, 21 bp, Homo sapiens
gcccagcaaggtgagaaggcc

SEQ ID NO: 9205190 - DNA, 22 bp, Homo sapiens
gcccagcagctggtggagaagg

SEQ ID NO: 9205191 - DNA, 22 bp, Homo sapiens
gcccagcagctggtggagaagg

SEQ ID NO: 9205192 - DNA, 22 bp, Homo sapiens
gcccagcagatctcagtgtctc

SEQ ID NO: 9205193 - DNA, 22 bp, Homo sapiens
gcccagcacctctctcagggtt

SEQ ID NO: 9205194 - DNA, 22 bp, Homo sapiens
gcccagcacctctctcagggtt

SEQ ID NO: 9205195 - DNA, 22 bp, Homo sapiens
gcccagcacctctctcagggtt

SEQ ID NO: 9205196 - DNA, 22 bp, Homo sapiens
gcccagcactcctctctgacat

SEQ ID NO: 9205197 - DNA, 22 bp, Homo sapiens
gcccagcactaaaagctttgct

SEQ ID NO: 9205198 - DNA, 22 bp, Homo sapiens
gcccagcactaaaagctttgct

SEQ ID NO: 9205199 - DNA, 22 bp, Homo sapiens
gcccagcactaaaagctttgct

SEQ ID NO: 9205200 - DNA, 22 bp, Homo sapiens
gcccagctccattcttggtgag

SEQ ID NO: 9205201 - DNA, 22 bp, Homo sapiens
gcccagcctccaagctccaagg

SEQ ID NO: 9205202 - DNA, 22 bp, Homo sapiens
gcatgcatgtgtgcagacagtc

SEQ ID NO: 9205203 - DNA, 22 bp, Homo sapiens
gcatggccaggaaaggtagaaa

SEQ ID NO: 9205204 - DNA, 22 bp, Homo sapiens
gcatggctggtgtcctgaggga

SEQ ID NO: 9205205 - DNA, 22 bp, Homo sapiens
gcatggctctggcctcagtgtg

SEQ ID NO: 9205206 - DNA, 22 bp, Homo sapiens
gcatggctattatgaggcagaa

SEQ ID NO: 9205207 - DNA, 22 bp, Homo sapiens
gcatggctcctgtcttactccc

SEQ ID NO: 9205208 - DNA, 22 bp, Homo sapiens
gcatggctgttgaagtcagctc

SEQ ID NO: 9205209 - DNA, 22 bp, Homo sapiens
gccaccagtagctaacaacagt

SEQ ID NO: 9205210 - DNA, 22 bp, Homo sapiens
gccaccagtgggggcctgggca

SEQ ID NO: 9205211 - DNA, 22 bp, Homo sapiens
gccaccagccccatgcgctgtg

SEQ ID NO: 9205212 - DNA, 22 bp, Homo sapiens
gccacatgcaattgcagcacgt

SEQ ID NO: 9205213 - DNA, 22 bp, Homo sapiens
gccaccagcagaaaaggggcca

SEQ ID NO: 9205214 - DNA, 20 bp, Homo sapiens
gccacagttttctcactgca

SEQ ID NO: 9205215 - DNA, 22 bp, Homo sapiens
gccacaggcttaggagggaggt

SEQ ID NO: 9205216 - DNA, 22 bp, Homo sapiens
gccacaggcttaggagggaggt

SEQ ID NO: 9205217 - DNA, 22 bp, Homo sapiens
gcatgcactgtatttaagtatc

SEQ ID NO: 9205218 - DNA, 22 bp, Homo sapiens
gcagtgggaaggttggcacatg

SEQ ID NO: 9205219 - DNA, 22 bp, Homo sapiens
gcagtggccacatggaggagga

SEQ ID NO: 9205220 - DNA, 22 bp, Homo sapiens
gcaggggagtggcaggcccgga

SEQ ID NO: 9205221 - DNA, 22 bp, Homo sapiens
gcagtggcagagacagcaccaa

SEQ ID NO: 9205222 - DNA, 22 bp, Homo sapiens
gcagtggcatgatgtgggctca

SEQ ID NO: 9205223 - DNA, 18 bp, Homo sapiens
gccaggcagggtggggaa

SEQ ID NO: 9205224 - DNA, 18 bp, Homo sapiens
gccaggcagggtggggaa

SEQ ID NO: 9205225 - DNA, 22 bp, Homo sapiens
gccaggcagctgggagggtgcc

SEQ ID NO: 9205226 - DNA, 22 bp, Homo sapiens
gccaggcagatatgtgagctta

SEQ ID NO: 9205227 - DNA, 22 bp, Homo sapiens
gccaggcagcagcgaggatggt

SEQ ID NO: 9205228 - DNA, 17 bp, Homo sapiens
gccagggagaggaagcc

SEQ ID NO: 9205229 - DNA, 22 bp, Homo sapiens
gccagggctgtgcaggtttgtt

SEQ ID NO: 9205230 - DNA, 22 bp, Homo sapiens
gccagggcaggggagcatctgc

SEQ ID NO: 9205231 - DNA, 22 bp, Homo sapiens
gccagggcaggggagcatctgc

SEQ ID NO: 9205232 - DNA, 21 bp, Homo sapiens
gccagggagttaaagagtctt

SEQ ID NO: 9205233 - DNA, 22 bp, Homo sapiens
gccagctccgcaggatggcgcg

SEQ ID NO: 9205234 - DNA, 22 bp, Homo sapiens
gccagctcccaagtgagcccct

SEQ ID NO: 9205235 - DNA, 22 bp, Homo sapiens
gccagctcagtttcaaagtagg

SEQ ID NO: 9205236 - DNA, 22 bp, Homo sapiens
gccagctctcattgtataggct

SEQ ID NO: 9205237 - DNA, 22 bp, Homo sapiens
gccagctctcattgtataggct

SEQ ID NO: 9205238 - DNA, 22 bp, Homo sapiens
gccagctctgtggctgtacttg

SEQ ID NO: 9205239 - DNA, 22 bp, Homo sapiens
gccagctctgtggctgtacttg

SEQ ID NO: 9205240 - DNA, 22 bp, Homo sapiens
gccagctcttgatgggtgggta

SEQ ID NO: 9205241 - DNA, 23 bp, Homo sapiens
gccagccttgctctcctgcagcc

SEQ ID NO: 9205242 - DNA, 22 bp, Homo sapiens
gccagctcagatgcaggaagga

SEQ ID NO: 9205243 - DNA, 22 bp, Homo sapiens
gccagctcagatgcaggaagga

SEQ ID NO: 9205244 - DNA, 22 bp, Homo sapiens
gccagctgaagccctggtggaa

SEQ ID NO: 9205245 - DNA, 22 bp, Homo sapiens
gccagctgaatttccaactgtt

SEQ ID NO: 9205246 - DNA, 22 bp, Homo sapiens
gccagctgaagggaagctcctg

SEQ ID NO: 9205247 - DNA, 22 bp, Homo sapiens
gccagctgaagggaagctcctg

SEQ ID NO: 9205248 - DNA, 22 bp, Homo sapiens
gccagccttctgtggcctgcaa

SEQ ID NO: 9205249 - DNA, 22 bp, Homo sapiens
gccagccttctgtggcctgcaa

SEQ ID NO: 9205250 - DNA, 22 bp, Homo sapiens
gccagcctgtgcttggccaggc

SEQ ID NO: 9205251 - DNA, 22 bp, Homo sapiens
gccagcctgtgggggctctgtg

SEQ ID NO: 9205252 - DNA, 22 bp, Homo sapiens
gccagcctgtgcttggccaggc

SEQ ID NO: 9205253 - DNA, 22 bp, Homo sapiens
gccagcctgtgggggctctgtg

SEQ ID NO: 9205254 - DNA, 22 bp, Homo sapiens
gccaccccaacctccctaagtt

SEQ ID NO: 9205255 - DNA, 22 bp, Homo sapiens
gccaccatgtagcccattagag

SEQ ID NO: 9205256 - DNA, 22 bp, Homo sapiens
gccaccatcttcccatgccaac

SEQ ID NO: 9205257 - DNA, 22 bp, Homo sapiens
ctgtgcattgtcttgtctgtag

SEQ ID NO: 9205258 - DNA, 22 bp, Homo sapiens
ctgtgccactgggggccggcaa

SEQ ID NO: 9205259 - DNA, 22 bp, Homo sapiens
ctgtgccactgccccaggcctc

SEQ ID NO: 9205260 - DNA, 22 bp, Homo sapiens
ctgtgagggccagagtcagggc

SEQ ID NO: 9205261 - DNA, 22 bp, Homo sapiens
ctgtgagggccagagtcagggc

SEQ ID NO: 9205262 - DNA, 22 bp, Homo sapiens
ctgtcctgtgcattgtcagatg

SEQ ID NO: 9205263 - DNA, 22 bp, Homo sapiens
ctgtgccatcctagggctgctg

SEQ ID NO: 9205264 - DNA, 22 bp, Homo sapiens
ctgtgccagcctgtcccaggag

SEQ ID NO: 9205265 - DNA, 22 bp, Homo sapiens
ctgtgccattctttgtagcatg

SEQ ID NO: 9205266 - DNA, 22 bp, Homo sapiens
ctgtgccattctttgtagcatg

SEQ ID NO: 9205267 - DNA, 22 bp, Homo sapiens
ctgtgcccacctggctctgagg

SEQ ID NO: 9205268 - DNA, 22 bp, Homo sapiens
ctgtcctgaagttttcatgaga

SEQ ID NO: 9205269 - DNA, 22 bp, Homo sapiens
ctgtcctgagttcttggaggtc

SEQ ID NO: 9205270 - DNA, 20 bp, Homo sapiens
ctgtcctgatcttttcagaa

SEQ ID NO: 9205271 - DNA, 22 bp, Homo sapiens
ctgtcctgcccaccctgcaggg

SEQ ID NO: 9205272 - DNA, 22 bp, Homo sapiens
ctgtcctgcccaccctgcaggg

SEQ ID NO: 9205273 - DNA, 21 bp, Homo sapiens
ctgtcctggtctagaggcaca

SEQ ID NO: 9205274 - DNA, 22 bp, Homo sapiens
ctgtcctggtactttgaggttc

SEQ ID NO: 9205275 - DNA, 22 bp, Homo sapiens
ctgggtctttttcttccattga

SEQ ID NO: 9205276 - DNA, 22 bp, Homo sapiens
ctgggtcttcagcagcaggcgg

SEQ ID NO: 9205277 - DNA, 19 bp, Homo sapiens
ctgggtcttattctgtgaa

SEQ ID NO: 9205278 - DNA, 22 bp, Homo sapiens
ctgggtctgtgcccagggacct

SEQ ID NO: 9205279 - DNA, 22 bp, Homo sapiens
ctgggtctgtcactagataaat

SEQ ID NO: 9205280 - DNA, 22 bp, Homo sapiens
ctgtccctgagcaactcctgtt

SEQ ID NO: 9205281 - DNA, 22 bp, Homo sapiens
ctgggtgcgtgagcgcatgcgt

SEQ ID NO: 9205282 - DNA, 22 bp, Homo sapiens
ctgtcctctgtcctcagcagga

SEQ ID NO: 9205283 - DNA, 22 bp, Homo sapiens
ctgtcctctgtcctcagcagga

SEQ ID NO: 9205284 - DNA, 23 bp, Homo sapiens
ctgtgtctatgcagccatatcca

SEQ ID NO: 9205285 - DNA, 22 bp, Homo sapiens
ctgtggtgggccctgggcttca

SEQ ID NO: 9205286 - DNA, 22 bp, Homo sapiens
ctgtggctgtatttggccagag

SEQ ID NO: 9205287 - DNA, 22 bp, Homo sapiens
ctgtggctccagtgaaccaatg

SEQ ID NO: 9205288 - DNA, 22 bp, Homo sapiens
ctgttcttatcgtcttaatatc

SEQ ID NO: 9205289 - DNA, 22 bp, Homo sapiens
ctgtgtctgcctgggatccatt

SEQ ID NO: 9205290 - DNA, 22 bp, Homo sapiens
ctgttgtcttcattgtcatatc

SEQ ID NO: 9205291 - DNA, 22 bp, Homo sapiens
cttattttgctgatgacccagg

SEQ ID NO: 9205292 - DNA, 22 bp, Homo sapiens
cttattttgctgatgacccagg

SEQ ID NO: 9205293 - DNA, 22 bp, Homo sapiens
cttattttaagtcagtttgggt

SEQ ID NO: 9205294 - DNA, 22 bp, Homo sapiens
cttcctctgtggccagagtgta

SEQ ID NO: 9205295 - DNA, 22 bp, Homo sapiens
cttcctctgtgtcctgggcttc

SEQ ID NO: 9205296 - DNA, 22 bp, Homo sapiens
cttcctctgtgtcctgggcttc

SEQ ID NO: 9205297 - DNA, 16 bp, Homo sapiens
cttcctcttcactggc

SEQ ID NO: 9205298 - DNA, 22 bp, Homo sapiens
cttcctctgtgtcctgggcttg

SEQ ID NO: 9205299 - DNA, 22 bp, Homo sapiens
cttcctctgtgtcctgggcttg

SEQ ID NO: 9205300 - DNA, 22 bp, Homo sapiens
cttcctctgcctcccgtgctca

SEQ ID NO: 9205301 - DNA, 22 bp, Homo sapiens
cttcctctgcggcgccgggcgc

SEQ ID NO: 9205302 - DNA, 22 bp, Homo sapiens
cttccgtgtcagttccaggtgg

SEQ ID NO: 9205303 - DNA, 22 bp, Homo sapiens
cttcaggagtagttacctagca

SEQ ID NO: 9205304 - DNA, 20 bp, Homo sapiens
cttcaggacccatcctcccc

SEQ ID NO: 9205305 - DNA, 22 bp, Homo sapiens
cttcaggattaatttggggcct

SEQ ID NO: 9205306 - DNA, 22 bp, Homo sapiens
cttcaggaaaatctctaaggat

SEQ ID NO: 9205307 - DNA, 22 bp, Homo sapiens
cttcagctacctctgatgcaag

SEQ ID NO: 9205308 - DNA, 22 bp, Homo sapiens
cttcaggatttaggaagatgaa

SEQ ID NO: 9205309 - DNA, 22 bp, Homo sapiens
cttcagtgacagccacccaggc

SEQ ID NO: 9205310 - DNA, 22 bp, Homo sapiens
cttcagtgacattccttccctc

SEQ ID NO: 9205311 - DNA, 22 bp, Homo sapiens
cttgccaaattaacatacagaa

SEQ ID NO: 9205312 - DNA, 22 bp, Homo sapiens
cttgccaatggtacaaacgatt

SEQ ID NO: 9205313 - DNA, 22 bp, Homo sapiens
cttgccagcacttggccagctg

SEQ ID NO: 9205314 - DNA, 22 bp, Homo sapiens
cttgccagtgttgcagaagctc

SEQ ID NO: 9205315 - DNA, 20 bp, Homo sapiens
cttgccagttccctggcaga

SEQ ID NO: 9205316 - DNA, 20 bp, Homo sapiens
cttgccagttccctggcaga

SEQ ID NO: 9205317 - DNA, 20 bp, Homo sapiens
cttgtacatgataaagattt

SEQ ID NO: 9205318 - DNA, 22 bp, Homo sapiens
cttgtacatagagaagaagcct

SEQ ID NO: 9205319 - DNA, 22 bp, Homo sapiens
cttgtattcagagtggacatga

SEQ ID NO: 9205320 - DNA, 22 bp, Homo sapiens
cttgtattcccctatctctaaa

SEQ ID NO: 9205321 - DNA, 22 bp, Homo sapiens
cttgtattgcaaactggccagg

SEQ ID NO: 9205322 - DNA, 22 bp, Homo sapiens
cttgtcagccaattgtggattt

SEQ ID NO: 9205323 - DNA, 22 bp, Homo sapiens
cttgtcactctggctccagagc

SEQ ID NO: 9205324 - DNA, 22 bp, Homo sapiens
cttgtctgggcagcttgggagt

SEQ ID NO: 9205325 - DNA, 22 bp, Homo sapiens
cttgtcctttacttgagactca

SEQ ID NO: 9205326 - DNA, 22 bp, Homo sapiens
cttcctgcattgtgccagagtt

SEQ ID NO: 9205327 - DNA, 22 bp, Homo sapiens
cttcctgcaacacctgtgttgc

SEQ ID NO: 9205328 - DNA, 22 bp, Homo sapiens
cttcctgcaacacctgtgttgc

SEQ ID NO: 9205329 - DNA, 22 bp, Homo sapiens
cttcctgcatggagtctgaatg

SEQ ID NO: 9205330 - DNA, 22 bp, Homo sapiens
cttcctgcaggacagccatctg

SEQ ID NO: 9205331 - DNA, 22 bp, Homo sapiens
cttcctgctcccctgccaattc

SEQ ID NO: 9205332 - DNA, 22 bp, Homo sapiens
cttcctggccattgccatggca

SEQ ID NO: 9205333 - DNA, 22 bp, Homo sapiens
cttcctggctcggtgcctcacc

SEQ ID NO: 9205334 - DNA, 22 bp, Homo sapiens
cttcctggctcggtgcctcacc

SEQ ID NO: 9205335 - DNA, 22 bp, Homo sapiens
cttgcaggattttgctgctgta

SEQ ID NO: 9205336 - DNA, 22 bp, Homo sapiens
cttgatctacatagtgaaaccc

SEQ ID NO: 9205337 - DNA, 22 bp, Homo sapiens
ctggctcagacagctgtgcagt

SEQ ID NO: 9205338 - DNA, 22 bp, Homo sapiens
ctggctcagacagctgtgcagt

SEQ ID NO: 9205339 - DNA, 22 bp, Homo sapiens
ctggccctgtaggatgtgagtt

SEQ ID NO: 9205340 - DNA, 22 bp, Homo sapiens
ctggcctggtctggcctctcca

SEQ ID NO: 9205341 - DNA, 22 bp, Homo sapiens
ctggcctggtctggcctctcca

SEQ ID NO: 9205342 - DNA, 22 bp, Homo sapiens
ctggccctggtaaggacaccca

SEQ ID NO: 9205343 - DNA, 23 bp, Homo sapiens
ctggccctggctctgtgatcatg

SEQ ID NO: 9205344 - DNA, 22 bp, Homo sapiens
ctggccctggctggagcccagg

SEQ ID NO: 9205345 - DNA, 22 bp, Homo sapiens
ctggccctgcctaatgtacttg

SEQ ID NO: 9205346 - DNA, 22 bp, Homo sapiens
ctggccctggagggctgtgcga

SEQ ID NO: 9205347 - DNA, 22 bp, Homo sapiens
ctggccctcggagtccagctgc

SEQ ID NO: 9205348 - DNA, 22 bp, Homo sapiens
ctggccctcggagtccagctgc

SEQ ID NO: 9205349 - DNA, 22 bp, Homo sapiens
ctggccctcagactcatgggca

SEQ ID NO: 9205350 - DNA, 22 bp, Homo sapiens
ctggccctcagactcatgggca

SEQ ID NO: 9205351 - DNA, 22 bp, Homo sapiens
ctggcccagtctcagagtgtca

SEQ ID NO: 9205352 - DNA, 22 bp, Homo sapiens
ctggcccaggtggtcgttgagg

SEQ ID NO: 9205353 - DNA, 22 bp, Homo sapiens
ctggccaggccccttgcagggc

SEQ ID NO: 9205354 - DNA, 19 bp, Homo sapiens
ctggccaggccaggggccc

SEQ ID NO: 9205355 - DNA, 22 bp, Homo sapiens
ctggccaggccccttgcagggc

SEQ ID NO: 9205356 - DNA, 19 bp, Homo sapiens
ctggccaggccaggggccc

SEQ ID NO: 9205357 - DNA, 22 bp, Homo sapiens
ctggctcattttagcatcaggt

SEQ ID NO: 9205358 - DNA, 22 bp, Homo sapiens
ctggctccaaattctgatgttc

SEQ ID NO: 9205359 - DNA, 22 bp, Homo sapiens
ctggctcttgcgactcagcttg

SEQ ID NO: 9205360 - DNA, 23 bp, Homo sapiens
ctggctcatcctggttgcagtgg

SEQ ID NO: 9205361 - DNA, 22 bp, Homo sapiens
ctggctcatgtgatgagggcaa

SEQ ID NO: 9205362 - DNA, 22 bp, Homo sapiens
ctggctcagtgccttcagaagt

SEQ ID NO: 9205363 - DNA, 22 bp, Homo sapiens
ctggctgcgctagtccagaaga

SEQ ID NO: 9205364 - DNA, 22 bp, Homo sapiens
ctggctggagctgttgtaggct

SEQ ID NO: 9205365 - DNA, 22 bp, Homo sapiens
ctggctgtgcagtcttccagaa

SEQ ID NO: 9205366 - DNA, 22 bp, Homo sapiens
ctggccagctgacagcagggct

SEQ ID NO: 9205367 - DNA, 22 bp, Homo sapiens
ctggccagctgacagcagggct

SEQ ID NO: 9205368 - DNA, 22 bp, Homo sapiens
ctggccaggaggtaaccagatg

SEQ ID NO: 9205369 - DNA, 22 bp, Homo sapiens
ctggccagctgacagcagggct

SEQ ID NO: 9205370 - DNA, 22 bp, Homo sapiens
ctggccagcctgtcgatgccct

SEQ ID NO: 9205371 - DNA, 22 bp, Homo sapiens
ctggccagcctgtcgatgccct

SEQ ID NO: 9205372 - DNA, 22 bp, Homo sapiens
ctggccagcctcccaggtaccc

SEQ ID NO: 9205373 - DNA, 22 bp, Homo sapiens
ctggccagcctcccaggtaccc

SEQ ID NO: 9205374 - DNA, 22 bp, Homo sapiens
ctggccagagttggagggtgtg

SEQ ID NO: 9205375 - DNA, 21 bp, Homo sapiens
ctggccactgcacctcttcct

SEQ ID NO: 9205376 - DNA, 22 bp, Homo sapiens
ctggccagcatttttgctttag

SEQ ID NO: 9205377 - DNA, 22 bp, Homo sapiens
ctggccagcatggctgaagtac

SEQ ID NO: 9205378 - DNA, 22 bp, Homo sapiens
ctggccagcatggctgaagtac

SEQ ID NO: 9205379 - DNA, 22 bp, Homo sapiens
ctggccagatgttacgtccaat

SEQ ID NO: 9205380 - DNA, 22 bp, Homo sapiens
ctggcaggcagacttctgcaag

SEQ ID NO: 9205381 - DNA, 22 bp, Homo sapiens
ctggcaggcggaggttgcagtg

SEQ ID NO: 9205382 - DNA, 22 bp, Homo sapiens
ctggcaggcggcagagcccagg

SEQ ID NO: 9205383 - DNA, 22 bp, Homo sapiens
ctggcaggatctaaccagggaa

SEQ ID NO: 9205384 - DNA, 22 bp, Homo sapiens
ctggcaggcactcatgaaataa

SEQ ID NO: 9205385 - DNA, 22 bp, Homo sapiens
ctggcaggcaaattggtgggag

SEQ ID NO: 9205386 - DNA, 22 bp, Homo sapiens
ctggcaggagcattcacagagg

SEQ ID NO: 9205387 - DNA, 22 bp, Homo sapiens
ctggcaggagttgggattttga

SEQ ID NO: 9205388 - DNA, 22 bp, Homo sapiens
ctggcaggagctgtggccgtag

SEQ ID NO: 9205389 - DNA, 22 bp, Homo sapiens
ctgccagcaagctaccctggca

SEQ ID NO: 9205390 - DNA, 22 bp, Homo sapiens
ctgccagcaatgtgaccatgct

SEQ ID NO: 9205391 - DNA, 22 bp, Homo sapiens
ctgccagccaggccaggtaggc

SEQ ID NO: 9205392 - DNA, 22 bp, Homo sapiens
ctgccagcagaggccagcgctg

SEQ ID NO: 9205393 - DNA, 22 bp, Homo sapiens
ctgccagcagaggccagcgctg

SEQ ID NO: 9205394 - DNA, 22 bp, Homo sapiens
ctgccagctcaccggctcagac

SEQ ID NO: 9205395 - DNA, 22 bp, Homo sapiens
ctgccagctcaaagcgcagcta

SEQ ID NO: 9205396 - DNA, 22 bp, Homo sapiens
ctggcaggaagttagatggtaa

SEQ ID NO: 9205397 - DNA, 22 bp, Homo sapiens
ctggcaggaagttagatggtaa

SEQ ID NO: 9205398 - DNA, 22 bp, Homo sapiens
ctggcaggaagaggaaaggtca

SEQ ID NO: 9205399 - DNA, 22 bp, Homo sapiens
ctggcagcttcaggacactcgg

SEQ ID NO: 9205400 - DNA, 22 bp, Homo sapiens
ctgccactttggagtgctcaga

SEQ ID NO: 9205401 - DNA, 22 bp, Homo sapiens
ctgccagagatctgggcagagt

SEQ ID NO: 9205402 - DNA, 22 bp, Homo sapiens
ctgggaggcactattcaggagg

SEQ ID NO: 9205403 - DNA, 22 bp, Homo sapiens
ctgggaggcagaggttgtagtg

SEQ ID NO: 9205404 - DNA, 22 bp, Homo sapiens
ctgggaggcagaggttgcagtg

SEQ ID NO: 9205405 - DNA, 22 bp, Homo sapiens
ctgggaggcccacgttgggaag

SEQ ID NO: 9205406 - DNA, 22 bp, Homo sapiens
ctgggaggcagtctctctagaa

SEQ ID NO: 9205407 - DNA, 22 bp, Homo sapiens
ctgggaggcagtctctctagaa

SEQ ID NO: 9205408 - DNA, 22 bp, Homo sapiens
ctgggaggcggagcttgcagtg

SEQ ID NO: 9205409 - DNA, 22 bp, Homo sapiens
ctgggcaggagaggtggttgga

SEQ ID NO: 9205410 - DNA, 22 bp, Homo sapiens
ctgggccacatcagatgaagac

SEQ ID NO: 9205411 - DNA, 22 bp, Homo sapiens
ctgggccacaagcctgtgtgat

SEQ ID NO: 9205412 - DNA, 22 bp, Homo sapiens
ctgggccacaagcctgtgtgat

SEQ ID NO: 9205413 - DNA, 19 bp, Homo sapiens
ctgggccagaatcagctca

SEQ ID NO: 9205414 - DNA, 22 bp, Homo sapiens
ctgggccagaagacatttagga

SEQ ID NO: 9205415 - DNA, 22 bp, Homo sapiens
ctgggccacttcctcaggggaa

SEQ ID NO: 9205416 - DNA, 22 bp, Homo sapiens
ctgggccactccagatgcccac

SEQ ID NO: 9205417 - DNA, 22 bp, Homo sapiens
ctgggccacatcagatgaagac

SEQ ID NO: 9205418 - DNA, 22 bp, Homo sapiens
ctgggccaaaagaagtgttctt

SEQ ID NO: 9205419 - DNA, 22 bp, Homo sapiens
ctgggccacaaaaaactcctgt

SEQ ID NO: 9205420 - DNA, 22 bp, Homo sapiens
ctggcttgttttaagaatacaa

SEQ ID NO: 9205421 - DNA, 22 bp, Homo sapiens
ctggcttgggtctacctgcctt

SEQ ID NO: 9205422 - DNA, 22 bp, Homo sapiens
ctggctttaatgtcatctttct

SEQ ID NO: 9205423 - DNA, 22 bp, Homo sapiens
ctggctttccttgtctgcatcc

SEQ ID NO: 9205424 - DNA, 22 bp, Homo sapiens
ctggctttctgaacatcagtga

SEQ ID NO: 9205425 - DNA, 22 bp, Homo sapiens
ctggctttgaggatcccctctt

SEQ ID NO: 9205426 - DNA, 22 bp, Homo sapiens
ctggctttggtcccctgtgcct

SEQ ID NO: 9205427 - DNA, 22 bp, Homo sapiens
ctgggagctgaggctgacgctg

SEQ ID NO: 9205428 - DNA, 22 bp, Homo sapiens
ctgggaggattcattgaggtga

SEQ ID NO: 9205429 - DNA, 22 bp, Homo sapiens
ctgggaggcaccgcgtcgtgct

SEQ ID NO: 9205430 - DNA, 19 bp, Homo sapiens
ctgggccagagctgtcctc

SEQ ID NO: 9205431 - DNA, 18 bp, Homo sapiens
ctgggccagagtttctgc

SEQ ID NO: 9205432 - DNA, 22 bp, Homo sapiens
ctgggctctgcagttgatgttt

SEQ ID NO: 9205433 - DNA, 22 bp, Homo sapiens
ctgggctctaggaaccattcct

SEQ ID NO: 9205434 - DNA, 22 bp, Homo sapiens
ctgggctctaggaaccattcct

SEQ ID NO: 9205435 - DNA, 18 bp, Homo sapiens
ctgggccagagtttctgc

SEQ ID NO: 9205436 - DNA, 22 bp, Homo sapiens
ctgggctgcagcgggagcgacg

SEQ ID NO: 9205437 - DNA, 22 bp, Homo sapiens
ctgggctgcaggagtggggcaa

SEQ ID NO: 9205438 - DNA, 20 bp, Homo sapiens
ctggggaggaggatgtgttc

SEQ ID NO: 9205439 - DNA, 22 bp, Homo sapiens
ctggggctcactttggtcaggc

SEQ ID NO: 9205440 - DNA, 22 bp, Homo sapiens
ctggggctcactccagccctgg

SEQ ID NO: 9205441 - DNA, 22 bp, Homo sapiens
ctggggctcactccagccctgg

SEQ ID NO: 9205442 - DNA, 22 bp, Homo sapiens
ctggggctcactccagccctgg

SEQ ID NO: 9205443 - DNA, 22 bp, Homo sapiens
ctggggcccatcgagggctgag

SEQ ID NO: 9205444 - DNA, 22 bp, Homo sapiens
ctggggccagtgaggaggcttt

SEQ ID NO: 9205445 - DNA, 22 bp, Homo sapiens
ctggggctgcagcgatcttcat

SEQ ID NO: 9205446 - DNA, 22 bp, Homo sapiens
ctggggctgcagcgatcttcat

SEQ ID NO: 9205447 - DNA, 22 bp, Homo sapiens
ctgggtctcttaccatgtgact

SEQ ID NO: 9205448 - DNA, 22 bp, Homo sapiens
ctgggtctccggcagcctcggg

SEQ ID NO: 9205449 - DNA, 22 bp, Homo sapiens
ctgggtctggaggccaagggtg

SEQ ID NO: 9205450 - DNA, 22 bp, Homo sapiens
ctgggtctctttagggtgccgt

SEQ ID NO: 9205451 - DNA, 22 bp, Homo sapiens
ctgggtctgggcctcctggagt

SEQ ID NO: 9205452 - DNA, 22 bp, Homo sapiens
ctgggtctggtgtcaggcgacg

SEQ ID NO: 9205453 - DNA, 22 bp, Homo sapiens
ctgggtctggctactgcttcct

SEQ ID NO: 9205454 - DNA, 22 bp, Homo sapiens
ctgggtctggccacaggaagta

SEQ ID NO: 9205455 - DNA, 22 bp, Homo sapiens
gagagggagccagccaggaacc

SEQ ID NO: 9205456 - DNA, 22 bp, Homo sapiens
gagaggcttgtgtgaagaacaa

SEQ ID NO: 9205457 - DNA, 22 bp, Homo sapiens
gagaggctgggttggagatcga

SEQ ID NO: 9205458 - DNA, 22 bp, Homo sapiens
gagaggctgggttggagatcga

SEQ ID NO: 9205459 - DNA, 22 bp, Homo sapiens
gagaggccatggggtgggatgc

SEQ ID NO: 9205460 - DNA, 22 bp, Homo sapiens
gagacacaaacatttattccac

SEQ ID NO: 9205461 - DNA, 22 bp, Homo sapiens
gagaatttgtcttgaattttaa

SEQ ID NO: 9205462 - DNA, 22 bp, Homo sapiens
gagaaggcttccaaattctgtg

SEQ ID NO: 9205463 - DNA, 18 bp, Homo sapiens
gagaaggccacttgtttt

SEQ ID NO: 9205464 - DNA, 22 bp, Homo sapiens
gacctcttgcaccctggctctt

SEQ ID NO: 9205465 - DNA, 22 bp, Homo sapiens
gagaaggagtagctgacctggg

SEQ ID NO: 9205466 - DNA, 22 bp, Homo sapiens
gacctcatgatccacctgcctt

SEQ ID NO: 9205467 - DNA, 22 bp, Homo sapiens
gacctccagcggccctgcagag

SEQ ID NO: 9205468 - DNA, 22 bp, Homo sapiens
gacctccagcggccctgcagag

SEQ ID NO: 9205469 - DNA, 22 bp, Homo sapiens
gacctcagtattgttcaggatg

SEQ ID NO: 9205470 - DNA, 22 bp, Homo sapiens
gacctcagattttcccaggcca

SEQ ID NO: 9205471 - DNA, 22 bp, Homo sapiens
gacctcagtgaatggtcatgta

SEQ ID NO: 9205472 - DNA, 22 bp, Homo sapiens
gagatggagtctttttctgtca

SEQ ID NO: 9205473 - DNA, 22 bp, Homo sapiens
gagcagcaggtggggctggctt

SEQ ID NO: 9205474 - DNA, 18 bp, Homo sapiens
gagcagcaggatcaagaa

SEQ ID NO: 9205475 - DNA, 22 bp, Homo sapiens
gagcagcactgagttagcagct

SEQ ID NO: 9205476 - DNA, 23 bp, Homo sapiens
gagatttagcagacaaagctctt

SEQ ID NO: 9205477 - DNA, 22 bp, Homo sapiens
gagcagctggaggccttgttgg

SEQ ID NO: 9205478 - DNA, 22 bp, Homo sapiens
gagcagctggacaggcctccct

SEQ ID NO: 9205479 - DNA, 22 bp, Homo sapiens
gagcagctggacaggcctccct

SEQ ID NO: 9205480 - DNA, 22 bp, Homo sapiens
gagcagctgcagtgcagaccct

SEQ ID NO: 9205481 - DNA, 22 bp, Homo sapiens
gagcagctgtccccaaagcttc

SEQ ID NO: 9205482 - DNA, 22 bp, Homo sapiens
gagcagctgtccccaaagcttc

SEQ ID NO: 9205483 - DNA, 22 bp, Homo sapiens
gagcagctggctgtattggttt

SEQ ID NO: 9205484 - DNA, 22 bp, Homo sapiens
gagcagctggtaggtgaaccca

SEQ ID NO: 9205485 - DNA, 22 bp, Homo sapiens
gagcagctgttctgacttgtct

SEQ ID NO: 9205486 - DNA, 20 bp, Homo sapiens
gagcagctgtttgcattgca

SEQ ID NO: 9205487 - DNA, 22 bp, Homo sapiens
gagcagctgtggggttgaccat

SEQ ID NO: 9205488 - DNA, 22 bp, Homo sapiens
gagccacagcaacctcaaagga

SEQ ID NO: 9205489 - DNA, 22 bp, Homo sapiens
gagcagcttatgtcaagccaga

SEQ ID NO: 9205490 - DNA, 22 bp, Homo sapiens
gagcagcttatgtcaagccaga

SEQ ID NO: 9205491 - DNA, 22 bp, Homo sapiens
gagccaagcaccacattaagtt

SEQ ID NO: 9205492 - DNA, 22 bp, Homo sapiens
gagccaagcaatatacccaacc

SEQ ID NO: 9205493 - DNA, 22 bp, Homo sapiens
gagccaagggcgtgctggagag

SEQ ID NO: 9205494 - DNA, 22 bp, Homo sapiens
gagccagggtttgaaactagac

SEQ ID NO: 9205495 - DNA, 22 bp, Homo sapiens
gagccagcagccggcaccacca

SEQ ID NO: 9205496 - DNA, 22 bp, Homo sapiens
gagccagcagccggcaccacca

SEQ ID NO: 9205497 - DNA, 22 bp, Homo sapiens
gagccagagatccaggatggct

SEQ ID NO: 9205498 - DNA, 22 bp, Homo sapiens
gagccaccttcaactcaggaat

SEQ ID NO: 9205499 - DNA, 17 bp, Homo sapiens
gagccaccctgtgcgag

SEQ ID NO: 9205500 - DNA, 22 bp, Homo sapiens
gagcttggacaagctctgaagg

SEQ ID NO: 9205501 - DNA, 22 bp, Homo sapiens
gagcttggacaccttggcaggt

SEQ ID NO: 9205502 - DNA, 22 bp, Homo sapiens
gagcttggatgtcttttgttca

SEQ ID NO: 9205503 - DNA, 22 bp, Homo sapiens
gagcttggcagtgtcactaggg

SEQ ID NO: 9205504 - DNA, 22 bp, Homo sapiens
gagcttggcctcttgaacgtgg

SEQ ID NO: 9205505 - DNA, 22 bp, Homo sapiens
gagcttggctggacctcacgga

SEQ ID NO: 9205506 - DNA, 22 bp, Homo sapiens
gagcttcttgtttcttcatctg

SEQ ID NO: 9205507 - DNA, 22 bp, Homo sapiens
gagcttggaagcagatcctcac

SEQ ID NO: 9205508 - DNA, 22 bp, Homo sapiens
gagcttcctcagcctttctcac

SEQ ID NO: 9205509 - DNA, 22 bp, Homo sapiens
gagcttcctgcaggtcactgtg

SEQ ID NO: 9205510 - DNA, 22 bp, Homo sapiens
gagcttcctttttctgcatgac

SEQ ID NO: 9205511 - DNA, 22 bp, Homo sapiens
gagcttcctttttctgcatgac

SEQ ID NO: 9205512 - DNA, 22 bp, Homo sapiens
gagcttccatccttactgtgtg

SEQ ID NO: 9205513 - DNA, 22 bp, Homo sapiens
gagcttccagagacatcagagt

SEQ ID NO: 9205514 - DNA, 22 bp, Homo sapiens
gagcttccctctgcagtccctg

SEQ ID NO: 9205515 - DNA, 22 bp, Homo sapiens
gagcttccatggacgccatctg

SEQ ID NO: 9205516 - DNA, 22 bp, Homo sapiens
gagctgtgttcatgaggagaaa

SEQ ID NO: 9205517 - DNA, 22 bp, Homo sapiens
gagctgtgttcatgaggagaaa

SEQ ID NO: 9205518 - DNA, 18 bp, Homo sapiens
gagctgagaagaggatgc

SEQ ID NO: 9205519 - DNA, 22 bp, Homo sapiens
gagcctcgtggcggccactgcg

SEQ ID NO: 9205520 - DNA, 22 bp, Homo sapiens
gagcctcagggttttgttgaca

SEQ ID NO: 9205521 - DNA, 22 bp, Homo sapiens
gagcctgcccagccctgtccac

SEQ ID NO: 9205522 - DNA, 22 bp, Homo sapiens
gagccctgttcaggcctcctca

SEQ ID NO: 9205523 - DNA, 22 bp, Homo sapiens
gagcctggacatctcaggccca

SEQ ID NO: 9205524 - DNA, 22 bp, Homo sapiens
gagcctggagctggaacgaagc

SEQ ID NO: 9205525 - DNA, 22 bp, Homo sapiens
gagctactgaaatattgatttt

SEQ ID NO: 9205526 - DNA, 22 bp, Homo sapiens
gagctagagtttgtagggtaga

SEQ ID NO: 9205527 - DNA, 22 bp, Homo sapiens
gagctctgatgtttagtggaga

SEQ ID NO: 9205528 - DNA, 22 bp, Homo sapiens
gagctctgtgtagcctgagggt

SEQ ID NO: 9205529 - DNA, 22 bp, Homo sapiens
gagctctgtgtggcttgggtgg

SEQ ID NO: 9205530 - DNA, 22 bp, Homo sapiens
gagctctgttctcgtcctgctg

SEQ ID NO: 9205531 - DNA, 22 bp, Homo sapiens
gaggcaaggccgcacgtctcag

SEQ ID NO: 9205532 - DNA, 22 bp, Homo sapiens
gaggcacatcacttggtgcatt

SEQ ID NO: 9205533 - DNA, 22 bp, Homo sapiens
gaggcacatcacttggtgcatt

SEQ ID NO: 9205534 - DNA, 22 bp, Homo sapiens
gaggcagaagttgcagtgagca

SEQ ID NO: 9205535 - DNA, 22 bp, Homo sapiens
gaggcagaagttgcagtgagca

SEQ ID NO: 9205536 - DNA, 22 bp, Homo sapiens
gaggcagaagttgcagtgagca

SEQ ID NO: 9205537 - DNA, 22 bp, Homo sapiens
gaggccaggaagcccaagatca

SEQ ID NO: 9205538 - DNA, 19 bp, Homo sapiens
gaggaggaaaactagtgta

SEQ ID NO: 9205539 - DNA, 22 bp, Homo sapiens
gaggaggaagttctctgtaggc

SEQ ID NO: 9205540 - DNA, 22 bp, Homo sapiens
gaggaggaggaagtggaaccca

SEQ ID NO: 9205541 - DNA, 22 bp, Homo sapiens
gaggaggaggaagtggaaccca

SEQ ID NO: 9205542 - DNA, 22 bp, Homo sapiens
gaggaggctaagtgggctctgg

SEQ ID NO: 9205543 - DNA, 19 bp, Homo sapiens
gaggcaaggagtttaagcc

SEQ ID NO: 9205544 - DNA, 22 bp, Homo sapiens
gaggcaagagaagccagctttc

SEQ ID NO: 9205545 - DNA, 22 bp, Homo sapiens
gaggagcttcagaggaatctta

SEQ ID NO: 9205546 - DNA, 22 bp, Homo sapiens
gaggagcttcagaggaatctta

SEQ ID NO: 9205547 - DNA, 22 bp, Homo sapiens
gaggagcttgaggctaggagcc

SEQ ID NO: 9205548 - DNA, 22 bp, Homo sapiens
gaggagcttgcatttaagtgcc

SEQ ID NO: 9205549 - DNA, 22 bp, Homo sapiens
gaggagcttgaggctaggagcc

SEQ ID NO: 9205550 - DNA, 22 bp, Homo sapiens
gaggagccctgttccccaggcc

SEQ ID NO: 9205551 - DNA, 22 bp, Homo sapiens
gaggagccctgttccccaggcc

SEQ ID NO: 9205552 - DNA, 22 bp, Homo sapiens
gaggagcctggccccacatcca

SEQ ID NO: 9205553 - DNA, 22 bp, Homo sapiens
gaggagcctggccccacatcca

SEQ ID NO: 9205554 - DNA, 18 bp, Homo sapiens
gaggagccgtccctacta

SEQ ID NO: 9205555 - DNA, 19 bp, Homo sapiens
gaggagctatcggagacag

SEQ ID NO: 9205556 - DNA, 19 bp, Homo sapiens
gaggagctatcggagacag

SEQ ID NO: 9205557 - DNA, 22 bp, Homo sapiens
gaggagctgttccctcacctct

SEQ ID NO: 9205558 - DNA, 22 bp, Homo sapiens
gagcttggctggacctcacgga

SEQ ID NO: 9205559 - DNA, 20 bp, Homo sapiens
gaggaaaagctgccaggcct

SEQ ID NO: 9205560 - DNA, 22 bp, Homo sapiens
gaagaggactgtggcatcctag

SEQ ID NO: 9205561 - DNA, 22 bp, Homo sapiens
gaagagctgtcagaaaagctaa

SEQ ID NO: 9205562 - DNA, 22 bp, Homo sapiens
gaagagctatgtccagggagca

SEQ ID NO: 9205563 - DNA, 22 bp, Homo sapiens
gaagagctgcagtttcctgggc

SEQ ID NO: 9205564 - DNA, 22 bp, Homo sapiens
gaagagctgcacactggggact

SEQ ID NO: 9205565 - DNA, 21 bp, Homo sapiens
gaacatttgggttgtttctac

SEQ ID NO: 9205566 - DNA, 22 bp, Homo sapiens
gaacatttggcatgagaatttg

SEQ ID NO: 9205567 - DNA, 22 bp, Homo sapiens
gaagaccccagagcgaggtaag

SEQ ID NO: 9205568 - DNA, 22 bp, Homo sapiens
gaagacatgtttttaatatgta

SEQ ID NO: 9205569 - DNA, 22 bp, Homo sapiens
gaagccagatttggggcatatc

SEQ ID NO: 9205570 - DNA, 22 bp, Homo sapiens
gaagccagattatcacaagcca

SEQ ID NO: 9205571 - DNA, 22 bp, Homo sapiens
gaagattttctcctttaaatga

SEQ ID NO: 9205572 - DNA, 22 bp, Homo sapiens
gaagatttgaaacacatagaca

SEQ ID NO: 9205573 - DNA, 22 bp, Homo sapiens
gaagatttgcccatgcactttt

SEQ ID NO: 9205574 - DNA, 22 bp, Homo sapiens
gaagccaggggcctgacaggca

SEQ ID NO: 9205575 - DNA, 22 bp, Homo sapiens
gaagccctaagagaatagagct

SEQ ID NO: 9205576 - DNA, 22 bp, Homo sapiens
gaagccccatggatatatgtga

SEQ ID NO: 9205577 - DNA, 22 bp, Homo sapiens
gaagccccaaaccctcgccatc

SEQ ID NO: 9205578 - DNA, 22 bp, Homo sapiens
gaagccctggggtcagtgtcgt

SEQ ID NO: 9205579 - DNA, 22 bp, Homo sapiens
gaagccctatcctctcctggga

SEQ ID NO: 9205580 - DNA, 22 bp, Homo sapiens
gaagatttataaggaccttatt

SEQ ID NO: 9205581 - DNA, 22 bp, Homo sapiens
gaagatttaagcacaatagtct

SEQ ID NO: 9205582 - DNA, 22 bp, Homo sapiens
gaagaggctttcctagggcaag

SEQ ID NO: 9205583 - DNA, 22 bp, Homo sapiens
gaagaggctttcctagggcaag

SEQ ID NO: 9205584 - DNA, 22 bp, Homo sapiens
gaagaggtagcattggcaggtg

SEQ ID NO: 9205585 - DNA, 22 bp, Homo sapiens
gaagatgggaatgatgagtggg

SEQ ID NO: 9205586 - DNA, 22 bp, Homo sapiens
gaaatgcagaacctgagaccat

SEQ ID NO: 9205587 - DNA, 22 bp, Homo sapiens
gaaatcattagcaaagatatgt

SEQ ID NO: 9205588 - DNA, 22 bp, Homo sapiens
gaaatcatctgagtaataatct

SEQ ID NO: 9205589 - DNA, 22 bp, Homo sapiens
gaacagcttcttgggagctggg

SEQ ID NO: 9205590 - DNA, 22 bp, Homo sapiens
gaacagcttcttgggagctggg

SEQ ID NO: 9205591 - DNA, 22 bp, Homo sapiens
gaacagctgctagagatctgtg

SEQ ID NO: 9205592 - DNA, 22 bp, Homo sapiens
gaacatttggatttgtaaattt

SEQ ID NO: 9205593 - DNA, 22 bp, Homo sapiens
gaaatcagttctgaaatttaca

SEQ ID NO: 9205594 - DNA, 22 bp, Homo sapiens
ctttcatagttaaaatagtttg

SEQ ID NO: 9205595 - DNA, 22 bp, Homo sapiens
ctttccaactctagtgaaattt

SEQ ID NO: 9205596 - DNA, 22 bp, Homo sapiens
ctttcacagcttgaaaagtatt

SEQ ID NO: 9205597 - DNA, 22 bp, Homo sapiens
ctttcactttaatctgacacct

SEQ ID NO: 9205598 - DNA, 22 bp, Homo sapiens
ctttcagtcagttaactcagaa

SEQ ID NO: 9205599 - DNA, 22 bp, Homo sapiens
ctttcagttaatgactccatag

SEQ ID NO: 9205600 - DNA, 22 bp, Homo sapiens
ctttcagttagtacctagtggc

SEQ ID NO: 9205601 - DNA, 22 bp, Homo sapiens
gaagcctcaacatctctgcgtc

SEQ ID NO: 9205602 - DNA, 22 bp, Homo sapiens
gaagcctcattgacctccactg

SEQ ID NO: 9205603 - DNA, 22 bp, Homo sapiens
gaatacatatcagatgtgtttc

SEQ ID NO: 9205604 - DNA, 22 bp, Homo sapiens
gaatacatatcagatgtgtttc

SEQ ID NO: 9205605 - DNA, 22 bp, Homo sapiens
gaatacatgatacatgaactgc

SEQ ID NO: 9205606 - DNA, 22 bp, Homo sapiens
gaatacatgaaccctcctgtgg

SEQ ID NO: 9205607 - DNA, 22 bp, Homo sapiens
gaatacatccagagcagggctg

SEQ ID NO: 9205608 - DNA, 22 bp, Homo sapiens
gaatacatctgaaggctatgaa

SEQ ID NO: 9205609 - DNA, 22 bp, Homo sapiens
gaatatatttctcttaccttta

SEQ ID NO: 9205610 - DNA, 22 bp, Homo sapiens
gaatatcccgctatgcaaagta

SEQ ID NO: 9205611 - DNA, 22 bp, Homo sapiens
gaatagataagtgactatttgg

SEQ ID NO: 9205612 - DNA, 22 bp, Homo sapiens
gaatacttttgttaggaaaacg

SEQ ID NO: 9205613 - DNA, 22 bp, Homo sapiens
gaatatattggtgaaaatagtt

SEQ ID NO: 9205614 - DNA, 22 bp, Homo sapiens
gaatatattattcagcttttca

SEQ ID NO: 9205615 - DNA, 22 bp, Homo sapiens
gaatacatttgccgtggttctc

SEQ ID NO: 9205616 - DNA, 22 bp, Homo sapiens
gaatacatgttgtttccctgga

SEQ ID NO: 9205617 - DNA, 22 bp, Homo sapiens
gaatacattggaaatcagaata

SEQ ID NO: 9205618 - DNA, 22 bp, Homo sapiens
gaatacatgcacgacacggggg

SEQ ID NO: 9205619 - DNA, 22 bp, Homo sapiens
gaatacatgattaaagtttgat

SEQ ID NO: 9205620 - DNA, 22 bp, Homo sapiens
gaatacatgtgtgtatagaggt

SEQ ID NO: 9205621 - DNA, 22 bp, Homo sapiens
gaatacatggcagggagtcatc

SEQ ID NO: 9205622 - DNA, 22 bp, Homo sapiens
gacaggcttagggagggtgctc

SEQ ID NO: 9205623 - DNA, 22 bp, Homo sapiens
gacaggcttcatcctcagagtt

SEQ ID NO: 9205624 - DNA, 22 bp, Homo sapiens
gacagtcccccagcagcaaacc

SEQ ID NO: 9205625 - DNA, 22 bp, Homo sapiens
gaccctggcaggtagcctcaca

SEQ ID NO: 9205626 - DNA, 22 bp, Homo sapiens
gaccctggtgggcactggcacc

SEQ ID NO: 9205627 - DNA, 22 bp, Homo sapiens
gaccctggctggagctggcctg

SEQ ID NO: 9205628 - DNA, 22 bp, Homo sapiens
gaccctggtgtccaggtcctgc

SEQ ID NO: 9205629 - DNA, 22 bp, Homo sapiens
gaccctggtgggcactggcacc

SEQ ID NO: 9205630 - DNA, 22 bp, Homo sapiens
gacagggtacgggctaggcaca

SEQ ID NO: 9205631 - DNA, 22 bp, Homo sapiens
ctctccagggcatgagttccac

SEQ ID NO: 9205632 - DNA, 22 bp, Homo sapiens
ctctccaggggtagatgccttc

SEQ ID NO: 9205633 - DNA, 22 bp, Homo sapiens
ctctccaggggtagatgccttc

SEQ ID NO: 9205634 - DNA, 22 bp, Homo sapiens
tttcctcacttcatgagagttt

SEQ ID NO: 9205635 - DNA, 22 bp, Homo sapiens
tttcctcacacagaagatcttg

SEQ ID NO: 9205636 - DNA, 22 bp, Homo sapiens
tttcctcactcatgtcatcagt

SEQ ID NO: 9205637 - DNA, 22 bp, Homo sapiens
tttcctcactcatgtcatcagt

SEQ ID NO: 9205638 - DNA, 22 bp, Homo sapiens
tttcctcaactgtcaaatgggg

SEQ ID NO: 9205639 - DNA, 22 bp, Homo sapiens
ctctccaggagctcagagtcta

SEQ ID NO: 9205640 - DNA, 22 bp, Homo sapiens
ctctccaggcgaggtcctactg

SEQ ID NO: 9205641 - DNA, 22 bp, Homo sapiens
ctctctgctgtatccttaggct

SEQ ID NO: 9205642 - DNA, 22 bp, Homo sapiens
tttccttgttattatttgtcct

SEQ ID NO: 9205643 - DNA, 18 bp, Homo sapiens
tttccttgtatgaacata

SEQ ID NO: 9205644 - DNA, 22 bp, Homo sapiens
ctctctggaagggggagctgat

SEQ ID NO: 9205645 - DNA, 22 bp, Homo sapiens
tttccttgcctcctgtccttct

SEQ ID NO: 9205646 - DNA, 22 bp, Homo sapiens
tttccttgggtctcttagtggc

SEQ ID NO: 9205647 - DNA, 22 bp, Homo sapiens
tttcctagagtctctagaagaa

SEQ ID NO: 9205648 - DNA, 22 bp, Homo sapiens
tttcacataaatattatgccta

SEQ ID NO: 9205649 - DNA, 22 bp, Homo sapiens
tttcacataaatggagtaaaga

SEQ ID NO: 9205650 - DNA, 22 bp, Homo sapiens
tttcacaaagcatagcacttta

SEQ ID NO: 9205651 - DNA, 22 bp, Homo sapiens
tttcaatttccaggctagaatt

SEQ ID NO: 9205652 - DNA, 22 bp, Homo sapiens
tttcaattccaccaaagcgccc

SEQ ID NO: 9205653 - DNA, 22 bp, Homo sapiens
ctcctggccctgagctcccagg

SEQ ID NO: 9205654 - DNA, 22 bp, Homo sapiens
ctccccattgtgacctcatcca

SEQ ID NO: 9205655 - DNA, 22 bp, Homo sapiens
ctccccatggcaacagttatgg

SEQ ID NO: 9205656 - DNA, 22 bp, Homo sapiens
ctccccattatgcagtcattat

SEQ ID NO: 9205657 - DNA, 22 bp, Homo sapiens
ctccccatccaggcagcaggtg

SEQ ID NO: 9205658 - DNA, 22 bp, Homo sapiens
ctccccatccaggcagcaggtg

SEQ ID NO: 9205659 - DNA, 22 bp, Homo sapiens
tttaatcataagaaggaaaata

SEQ ID NO: 9205660 - DNA, 23 bp, Homo sapiens
ctccccagtgtcctcatgcatct

SEQ ID NO: 9205661 - DNA, 20 bp, Homo sapiens
ctcccctctacagagggctg

SEQ ID NO: 9205662 - DNA, 18 bp, Homo sapiens
ctcctccacagcccctgc

SEQ ID NO: 9205663 - DNA, 22 bp, Homo sapiens
ctcctccacagacctactgaat

SEQ ID NO: 9205664 - DNA, 22 bp, Homo sapiens
tttattgttgttagtcataagt

SEQ ID NO: 9205665 - DNA, 22 bp, Homo sapiens
tttattgttgggtcttaagctg

SEQ ID NO: 9205666 - DNA, 22 bp, Homo sapiens
tttattctaacttgctgctcta

SEQ ID NO: 9205667 - DNA, 22 bp, Homo sapiens
tttattccatgtgtctatgacc

SEQ ID NO: 9205668 - DNA, 22 bp, Homo sapiens
ctcctccagtgggtccctcagg

SEQ ID NO: 9205669 - DNA, 22 bp, Homo sapiens
ctcctccagtgggtccctcagg

SEQ ID NO: 9205670 - DNA, 22 bp, Homo sapiens
ctcctggcactcagtgtggaag

SEQ ID NO: 9205671 - DNA, 22 bp, Homo sapiens
ctcctggcactgtcttgaccca

SEQ ID NO: 9205672 - DNA, 22 bp, Homo sapiens
ctcctggcaggctgagtgaaat

SEQ ID NO: 9205673 - DNA, 17 bp, Homo sapiens
ctcctggcagcctcagg

SEQ ID NO: 9205674 - DNA, 22 bp, Homo sapiens
ctcctggccccagatcccaatc

SEQ ID NO: 9205675 - DNA, 22 bp, Homo sapiens
ctcctggccacgttcttgctgg

SEQ ID NO: 9205676 - DNA, 22 bp, Homo sapiens
ctcctggcagttccccttgtca

SEQ ID NO: 9205677 - DNA, 17 bp, Homo sapiens
ctcctggccacccctct

SEQ ID NO: 9205678 - DNA, 22 bp, Homo sapiens
ctcccaggccatgctctagcca

SEQ ID NO: 9205679 - DNA, 22 bp, Homo sapiens
ctcccaggcagggctgcccact

SEQ ID NO: 9205680 - DNA, 22 bp, Homo sapiens
ctcccaggcagggctgcccact

SEQ ID NO: 9205681 - DNA, 22 bp, Homo sapiens
ctcccaggcacagggaggagcc

SEQ ID NO: 9205682 - DNA, 22 bp, Homo sapiens
tttaatatccagtggatacaaa

SEQ ID NO: 9205683 - DNA, 22 bp, Homo sapiens
ctccattgttcgcgcagctgca

SEQ ID NO: 9205684 - DNA, 22 bp, Homo sapiens
ctcccaaggggtaagggagctg

SEQ ID NO: 9205685 - DNA, 22 bp, Homo sapiens
ctcccactcctggctcaccaca

SEQ ID NO: 9205686 - DNA, 22 bp, Homo sapiens
ctcccagccttcgccagtctga

SEQ ID NO: 9205687 - DNA, 20 bp, Homo sapiens
ctccagcccctgccctggtc

SEQ ID NO: 9205688 - DNA, 22 bp, Homo sapiens
ctccagccagagtgcctctgtt

SEQ ID NO: 9205689 - DNA, 21 bp, Homo sapiens
ttgtgaaagtccaggaacaac

SEQ ID NO: 9205690 - DNA, 18 bp, Homo sapiens
ttgtgaaatattggagtc

SEQ ID NO: 9205691 - DNA, 22 bp, Homo sapiens
ttgtgaaacattcatggatttg

SEQ ID NO: 9205692 - DNA, 22 bp, Homo sapiens
ttgtggggaggatttgatgaga

SEQ ID NO: 9205693 - DNA, 22 bp, Homo sapiens
ttgtggggcaacagcaggtgaa

SEQ ID NO: 9205694 - DNA, 22 bp, Homo sapiens
ttgaaatactgcattgttcagt

SEQ ID NO: 9205695 - DNA, 22 bp, Homo sapiens
ttgaaataaggaagctcgaaat

SEQ ID NO: 9205696 - DNA, 22 bp, Homo sapiens
ttgaaatactgcattgttcagt

SEQ ID NO: 9205697 - DNA, 20 bp, Homo sapiens
ctccacacctgttcgcaggc

SEQ ID NO: 9205698 - DNA, 22 bp, Homo sapiens
ctccaagtccgagggctctcaa

SEQ ID NO: 9205699 - DNA, 22 bp, Homo sapiens
ctccacaggtgtactgtacctt

SEQ ID NO: 9205700 - DNA, 22 bp, Homo sapiens
ctccacaggtgtactgtacctt

SEQ ID NO: 9205701 - DNA, 22 bp, Homo sapiens
ctccacagcccctccagtggca

SEQ ID NO: 9205702 - DNA, 22 bp, Homo sapiens
ttgtacaagtattatgtgaaca

SEQ ID NO: 9205703 - DNA, 22 bp, Homo sapiens
ctccagattccgtttattcagg

SEQ ID NO: 9205704 - DNA, 22 bp, Homo sapiens
ttgtacaacgttttaaatttga

SEQ ID NO: 9205705 - DNA, 22 bp, Homo sapiens
ttggtcagctaataaggacagg

SEQ ID NO: 9205706 - DNA, 22 bp, Homo sapiens
ttgtacaaataggaacctctga

SEQ ID NO: 9205707 - DNA, 22 bp, Homo sapiens
ttttaagttaatataattgagg

SEQ ID NO: 9205708 - DNA, 22 bp, Homo sapiens
ttttagaatcaggttgtctggg

SEQ ID NO: 9205709 - DNA, 22 bp, Homo sapiens
tttgttctattttagagatgaa

SEQ ID NO: 9205710 - DNA, 22 bp, Homo sapiens
tttgttctattttagagatgaa

SEQ ID NO: 9205711 - DNA, 22 bp, Homo sapiens
tttgtacatatataaaatctgt

SEQ ID NO: 9205712 - DNA, 22 bp, Homo sapiens
ttttaagatgctagtatttcag

SEQ ID NO: 9205713 - DNA, 22 bp, Homo sapiens
tttgttctgaaaactcaagtcc

SEQ ID NO: 9205714 - DNA, 22 bp, Homo sapiens
tttgtacacaggtcattcaggg

SEQ ID NO: 9205715 - DNA, 22 bp, Homo sapiens
tttgtacaggtgcaggcatttg

SEQ ID NO: 9205716 - DNA, 22 bp, Homo sapiens
ctcttcaaaagtctaatcctta

SEQ ID NO: 9205717 - DNA, 22 bp, Homo sapiens
ctcttcagtaaatgacactgtt

SEQ ID NO: 9205718 - DNA, 22 bp, Homo sapiens
ctcttcaggatggcttgtgatg

SEQ ID NO: 9205719 - DNA, 22 bp, Homo sapiens
ctcttcaggaatatgtcagtca

SEQ ID NO: 9205720 - DNA, 22 bp, Homo sapiens
ctcttcaaatgatttccttagg

SEQ ID NO: 9205721 - DNA, 22 bp, Homo sapiens
ctcttcaacagagcagaaggct

SEQ ID NO: 9205722 - DNA, 21 bp, Homo sapiens
ctcttgtgtcagagccagagg

SEQ ID NO: 9205723 - DNA, 22 bp, Homo sapiens
ctcttcttggaatgctgactgt

SEQ ID NO: 9205724 - DNA, 22 bp, Homo sapiens
ttttcagttatagaatggtaga

SEQ ID NO: 9205725 - DNA, 22 bp, Homo sapiens
ttttcagttactgtttatgtga

SEQ ID NO: 9205726 - DNA, 22 bp, Homo sapiens
ttttcagttactgtttatgtga

SEQ ID NO: 9205727 - DNA, 22 bp, Homo sapiens
ttttcagtggtatctttgtaaa

SEQ ID NO: 9205728 - DNA, 22 bp, Homo sapiens
ttttcagtgggcaatgatgtga

SEQ ID NO: 9205729 - DNA, 22 bp, Homo sapiens
ttttcagttactgtttatgtga

SEQ ID NO: 9205730 - DNA, 22 bp, Homo sapiens
ttttcagaattagcataccatt

SEQ ID NO: 9205731 - DNA, 22 bp, Homo sapiens
ttttcaccatagacactggtcc

SEQ ID NO: 9205732 - DNA, 22 bp, Homo sapiens
ttttcaggtgcagtaatcatat

SEQ ID NO: 9205733 - DNA, 19 bp, Homo sapiens
ctctgccctacagaaagct

SEQ ID NO: 9205734 - DNA, 20 bp, Homo sapiens
ctctgcccccagactgacag

SEQ ID NO: 9205735 - DNA, 19 bp, Homo sapiens
ctctgcctccctcctgggt

SEQ ID NO: 9205736 - DNA, 22 bp, Homo sapiens
ctctgccaccatgcttcctgac

SEQ ID NO: 9205737 - DNA, 22 bp, Homo sapiens
ctctgcagaggcccaaggctga

SEQ ID NO: 9205738 - DNA, 22 bp, Homo sapiens
tttccttgttcatttgccctat

SEQ ID NO: 9205739 - DNA, 22 bp, Homo sapiens
ctctgccatctcactgggtcct

SEQ ID NO: 9205740 - DNA, 22 bp, Homo sapiens
ctctgccagtttctggcctcag

SEQ ID NO: 9205741 - DNA, 22 bp, Homo sapiens
ctctgccagtttctggcctcag

SEQ ID NO: 9205742 - DNA, 22 bp, Homo sapiens
ctctgccagccaaagtcatcac

SEQ ID NO: 9205743 - DNA, 22 bp, Homo sapiens
ctctgccactcgaagtcaagga

SEQ ID NO: 9205744 - DNA, 22 bp, Homo sapiens
ctctgccatcttggagctcaag

SEQ ID NO: 9205745 - DNA, 22 bp, Homo sapiens
tttgggaagaggaatctctgga

SEQ ID NO: 9205746 - DNA, 19 bp, Homo sapiens
tttgggaagcccagagtgt

SEQ ID NO: 9205747 - DNA, 22 bp, Homo sapiens
tttgggaagtgggagcaaggtg

SEQ ID NO: 9205748 - DNA, 22 bp, Homo sapiens
ctctggaattaaggaagcctgt

SEQ ID NO: 9205749 - DNA, 22 bp, Homo sapiens
ctctggaatgtttacatgccct

SEQ ID NO: 9205750 - DNA, 22 bp, Homo sapiens
ctctggaatgggtgtttctaac

SEQ ID NO: 9205751 - DNA, 20 bp, Homo sapiens
ctctgctttccacctttcag

SEQ ID NO: 9205752 - DNA, 20 bp, Homo sapiens
ctctgctttaggagagtcag

SEQ ID NO: 9205753 - DNA, 22 bp, Homo sapiens
ctctgctttttagggagcctag

SEQ ID NO: 9205754 - DNA, 22 bp, Homo sapiens
ctctgcttttatgtgccggcgc

SEQ ID NO: 9205755 - DNA, 22 bp, Homo sapiens
ctctggaaaaccactagcagga

SEQ ID NO: 9205756 - DNA, 22 bp, Homo sapiens
tttgcctctcagagtctacaca

SEQ ID NO: 9205757 - DNA, 22 bp, Homo sapiens
tttgctataaaagggtcacacg

SEQ ID NO: 9205758 - DNA, 20 bp, Homo sapiens
tttgctatgcatatctgacc

SEQ ID NO: 9205759 - DNA, 22 bp, Homo sapiens
ctctttcctcagccacagtcta

SEQ ID NO: 9205760 - DNA, 20 bp, Homo sapiens
ctctttgaaatgctcttggg

SEQ ID NO: 9205761 - DNA, 22 bp, Homo sapiens
ctgacaggttggtagctttgga

SEQ ID NO: 9205762 - DNA, 22 bp, Homo sapiens
ctgaccagggtagaggtgagag

SEQ ID NO: 9205763 - DNA, 22 bp, Homo sapiens
ctgacagctgctgccgccgcat

SEQ ID NO: 9205764 - DNA, 22 bp, Homo sapiens
ctgacagctgttgcagtgaatg

SEQ ID NO: 9205765 - DNA, 22 bp, Homo sapiens
ctgacagcagcaaatggagata

SEQ ID NO: 9205766 - DNA, 22 bp, Homo sapiens
ctgacagccatgttttagagaa

SEQ ID NO: 9205767 - DNA, 22 bp, Homo sapiens
ctgacagcgagagagttgcccc

SEQ ID NO: 9205768 - DNA, 22 bp, Homo sapiens
ctgacagcaaaggccagtggct

SEQ ID NO: 9205769 - DNA, 22 bp, Homo sapiens
ctgacagctatttttgtagata

SEQ ID NO: 9205770 - DNA, 22 bp, Homo sapiens
ctgacagctctggctagtagaa

SEQ ID NO: 9205771 - DNA, 22 bp, Homo sapiens
ctgacagctgaagggtcccaga

SEQ ID NO: 9205772 - DNA, 19 bp, Homo sapiens
ctgacagcgcctgataaga

SEQ ID NO: 9205773 - DNA, 22 bp, Homo sapiens
ctgacagctcctagtgctcact

SEQ ID NO: 9205774 - DNA, 22 bp, Homo sapiens
ctgagccaaccacagcaggagc

SEQ ID NO: 9205775 - DNA, 19 bp, Homo sapiens
ctgacctggctcagcaaag

SEQ ID NO: 9205776 - DNA, 22 bp, Homo sapiens
ctgagccaaccacagcaggagc

SEQ ID NO: 9205777 - DNA, 22 bp, Homo sapiens
ctgagccaaccacagcaggagc

SEQ ID NO: 9205778 - DNA, 22 bp, Homo sapiens
ctgagccagtagtcagggacaa

SEQ ID NO: 9205779 - DNA, 22 bp, Homo sapiens
ctgagccatccataccagctta

SEQ ID NO: 9205780 - DNA, 22 bp, Homo sapiens
ctgagccataagggaggctggg

SEQ ID NO: 9205781 - DNA, 22 bp, Homo sapiens
ctgagccataagggaggctggg

SEQ ID NO: 9205782 - DNA, 22 bp, Homo sapiens
ctgagccatgagcctgcgccca

SEQ ID NO: 9205783 - DNA, 22 bp, Homo sapiens
ctgagccatgagcctgcgccca

SEQ ID NO: 9205784 - DNA, 22 bp, Homo sapiens
ctgagccatgggtctaagcact

SEQ ID NO: 9205785 - DNA, 22 bp, Homo sapiens
ctgagccatgggtctaagcact

SEQ ID NO: 9205786 - DNA, 22 bp, Homo sapiens
ctgagccatgagcctgcgccca

SEQ ID NO: 9205787 - DNA, 22 bp, Homo sapiens
ctgaggcagagggcagaccaga

SEQ ID NO: 9205788 - DNA, 17 bp, Homo sapiens
ctgagccccgggcagct

SEQ ID NO: 9205789 - DNA, 22 bp, Homo sapiens
ctgcactgtgtattccttggct

SEQ ID NO: 9205790 - DNA, 22 bp, Homo sapiens
ctgcaggcatctaactgtgggc

SEQ ID NO: 9205791 - DNA, 22 bp, Homo sapiens
ctgcaggcatttattcatgcaa

SEQ ID NO: 9205792 - DNA, 22 bp, Homo sapiens
ctgcactgagctctcccagccc

SEQ ID NO: 9205793 - DNA, 22 bp, Homo sapiens
ctgcactgctgatcccaggtct

SEQ ID NO: 9205794 - DNA, 22 bp, Homo sapiens
ctgcactgtgtaacagataact

SEQ ID NO: 9205795 - DNA, 18 bp, Homo sapiens
ctgcactgtgggtagctc

SEQ ID NO: 9205796 - DNA, 19 bp, Homo sapiens
ctgcactgagaaaaggagg

SEQ ID NO: 9205797 - DNA, 22 bp, Homo sapiens
ctgcactgagaccctctttgct

SEQ ID NO: 9205798 - DNA, 22 bp, Homo sapiens
ctgcactgagcatctaacctta

SEQ ID NO: 9205799 - DNA, 22 bp, Homo sapiens
ctgcactgacttccccggctgc

SEQ ID NO: 9205800 - DNA, 22 bp, Homo sapiens
ctgcacatagtaagtactcaat

SEQ ID NO: 9205801 - DNA, 22 bp, Homo sapiens
ctgcaccatctggagcacctcc

SEQ ID NO: 9205802 - DNA, 22 bp, Homo sapiens
ctgcaccacagcctgaggcagc

SEQ ID NO: 9205803 - DNA, 22 bp, Homo sapiens
ctgaggccggagcactgaagag

SEQ ID NO: 9205804 - DNA, 22 bp, Homo sapiens
ctgcacagaggtcggtctgcca

SEQ ID NO: 9205805 - DNA, 22 bp, Homo sapiens
ctgcacacatcgcactgcccgt

SEQ ID NO: 9205806 - DNA, 22 bp, Homo sapiens
ctgcacacatatggcttctctc

SEQ ID NO: 9205807 - DNA, 22 bp, Homo sapiens
ctgcacacatatggcttctctc

SEQ ID NO: 9205808 - DNA, 22 bp, Homo sapiens
ctgcacagctggccagggagag

SEQ ID NO: 9205809 - DNA, 22 bp, Homo sapiens
ctgcacagctgggcaagatata

SEQ ID NO: 9205810 - DNA, 22 bp, Homo sapiens
ctgcacagctgggcaagatata

SEQ ID NO: 9205811 - DNA, 22 bp, Homo sapiens
ctgcacagctggccagggagag

SEQ ID NO: 9205812 - DNA, 22 bp, Homo sapiens
ctgcacaggggatgagggcagt

SEQ ID NO: 9205813 - DNA, 22 bp, Homo sapiens
ctgcacaggggatgagggcagt

SEQ ID NO: 9205814 - DNA, 22 bp, Homo sapiens
ctgcacagtaagcttcagagat

SEQ ID NO: 9205815 - DNA, 22 bp, Homo sapiens
ctgaggccagctgcagagctct

SEQ ID NO: 9205816 - DNA, 22 bp, Homo sapiens
ctgaggccagctgcagagctct

SEQ ID NO: 9205817 - DNA, 22 bp, Homo sapiens
ctgaggccagctgcagagctct

SEQ ID NO: 9205818 - DNA, 17 bp, Homo sapiens
ctgaggcccagggccca

SEQ ID NO: 9205819 - DNA, 17 bp, Homo sapiens
ctgaggcccagggccca

SEQ ID NO: 9205820 - DNA, 18 bp, Homo sapiens
ctgaggcccagagagggc

SEQ ID NO: 9205821 - DNA, 18 bp, Homo sapiens
ctgaggcccagagagggc

SEQ ID NO: 9205822 - DNA, 19 bp, Homo sapiens
ctgaggcccatgtaccatg

SEQ ID NO: 9205823 - DNA, 22 bp, Homo sapiens
ctgaggcccctctcttgagctt

SEQ ID NO: 9205824 - DNA, 22 bp, Homo sapiens
ctgaggcccctcttgtgagcat

SEQ ID NO: 9205825 - DNA, 22 bp, Homo sapiens
ctgaggccagctgcagagctct

SEQ ID NO: 9205826 - DNA, 22 bp, Homo sapiens
ctgaggccagagtgggcctctt

SEQ ID NO: 9205827 - DNA, 18 bp, Homo sapiens
ctgaggccaactacactg

SEQ ID NO: 9205828 - DNA, 22 bp, Homo sapiens
ctgaggcatgttacaggacata

SEQ ID NO: 9205829 - DNA, 22 bp, Homo sapiens
ctgaggccagaacccgaccctg

SEQ ID NO: 9205830 - DNA, 22 bp, Homo sapiens
ctgaggcatgggaagttgggtg

SEQ ID NO: 9205831 - DNA, 21 bp, Homo sapiens
ctgaggcatgcaggcctgggc

SEQ ID NO: 9205832 - DNA, 21 bp, Homo sapiens
ctgaggcatgcaggcctgggc

SEQ ID NO: 9205833 - DNA, 22 bp, Homo sapiens
cctgtctgcatgatccctgcca

SEQ ID NO: 9205834 - DNA, 22 bp, Homo sapiens
cctgtctggaacatggcctgtt

SEQ ID NO: 9205835 - DNA, 23 bp, Homo sapiens
cctgtctgtgctgggtggacaca

SEQ ID NO: 9205836 - DNA, 22 bp, Homo sapiens
cctgtctgtcctttgcattctt

SEQ ID NO: 9205837 - DNA, 19 bp, Homo sapiens
cctgtctgtcttcagctag

SEQ ID NO: 9205838 - DNA, 19 bp, Homo sapiens
cctgtctgtcttcagctag

SEQ ID NO: 9205839 - DNA, 17 bp, Homo sapiens
ttaaaggatgctctctc

SEQ ID NO: 9205840 - DNA, 22 bp, Homo sapiens
ttaaaggaattgagtttcttgt

SEQ ID NO: 9205841 - DNA, 19 bp, Homo sapiens
cctgtgctaggagctgacc

SEQ ID NO: 9205842 - DNA, 22 bp, Homo sapiens
cctgtgccctcagcctggctct

SEQ ID NO: 9205843 - DNA, 22 bp, Homo sapiens
cctgtggtttacgtacagctcc

SEQ ID NO: 9205844 - DNA, 21 bp, Homo sapiens
cctgtggtctggagggagcac

SEQ ID NO: 9205845 - DNA, 22 bp, Homo sapiens
ttaaagtaatctgtgtgaattt

SEQ ID NO: 9205846 - DNA, 22 bp, Homo sapiens
cctgtggcttccacgacctaat

SEQ ID NO: 9205847 - DNA, 22 bp, Homo sapiens
ccttctagcaaatcaacataaa

SEQ ID NO: 9205848 - DNA, 22 bp, Homo sapiens
ccttcctttcagggctatgcct

SEQ ID NO: 9205849 - DNA, 22 bp, Homo sapiens
ccttccttgagaagcaattcct

SEQ ID NO: 9205850 - DNA, 23 bp, Homo sapiens
ttacttttgcaccaacctaatat

SEQ ID NO: 9205851 - DNA, 22 bp, Homo sapiens
ttactaagttttatgcaactta

SEQ ID NO: 9205852 - DNA, 23 bp, Homo sapiens
ttagacaatcctcaaaaggtaat

SEQ ID NO: 9205853 - DNA, 22 bp, Homo sapiens
ttagaaaaatgttcagtagttt

SEQ ID NO: 9205854 - DNA, 22 bp, Homo sapiens
ttagaaaacataagtggtaaag

SEQ ID NO: 9205855 - DNA, 22 bp, Homo sapiens
ttagaaaatttgcttctttgga

SEQ ID NO: 9205856 - DNA, 19 bp, Homo sapiens
ccttccccttcagcctctg

SEQ ID NO: 9205857 - DNA, 22 bp, Homo sapiens
ccttcccaggctagaccaacat

SEQ ID NO: 9205858 - DNA, 17 bp, Homo sapiens
ccttcctcatctccttc

SEQ ID NO: 9205859 - DNA, 22 bp, Homo sapiens
ccttccctaaagcgtcgcttag

SEQ ID NO: 9205860 - DNA, 22 bp, Homo sapiens
ccttcctcatccatttctcttg

SEQ ID NO: 9205861 - DNA, 22 bp, Homo sapiens
ccttcctggctgtccgcctgat

SEQ ID NO: 9205862 - DNA, 22 bp, Homo sapiens
cctgtgtcttccccactggtgt

SEQ ID NO: 9205863 - DNA, 22 bp, Homo sapiens
ccttcaggtcatatatgtcaga

SEQ ID NO: 9205864 - DNA, 20 bp, Homo sapiens
cctgtgtggtttgcactaca

SEQ ID NO: 9205865 - DNA, 22 bp, Homo sapiens
cctgtgtgtaggccaggggagt

SEQ ID NO: 9205866 - DNA, 22 bp, Homo sapiens
cctgtgtggccgcactgctccc

SEQ ID NO: 9205867 - DNA, 22 bp, Homo sapiens
tgttccagattcggcgtgggac

SEQ ID NO: 9205868 - DNA, 20 bp, Homo sapiens
tgttccaggaggccagggct

SEQ ID NO: 9205869 - DNA, 22 bp, Homo sapiens
tgttccagggcgcgaaggtggt

SEQ ID NO: 9205870 - DNA, 23 bp, Homo sapiens
tgttccagatacgccttttcctc

SEQ ID NO: 9205871 - DNA, 22 bp, Homo sapiens
tgttccagaggcagagatagga

SEQ ID NO: 9205872 - DNA, 23 bp, Homo sapiens
tgttccagatacgccttttcctc

SEQ ID NO: 9205873 - DNA, 22 bp, Homo sapiens
cctggtggcttctgggtggacg

SEQ ID NO: 9205874 - DNA, 22 bp, Homo sapiens
cctggtggagaggggcggagcg

SEQ ID NO: 9205875 - DNA, 22 bp, Homo sapiens
cctggtggaaggtgagtgaggc

SEQ ID NO: 9205876 - DNA, 22 bp, Homo sapiens
cctgggctgctcatggggatga

SEQ ID NO: 9205877 - DNA, 22 bp, Homo sapiens
cctgggctggagtacagcagtg

SEQ ID NO: 9205878 - DNA, 22 bp, Homo sapiens
cctgggctggagtacagcagtg

SEQ ID NO: 9205879 - DNA, 22 bp, Homo sapiens
cctgggctggagtacagcagtg

SEQ ID NO: 9205880 - DNA, 22 bp, Homo sapiens
cctgggctgcatgatggcattt

SEQ ID NO: 9205881 - DNA, 22 bp, Homo sapiens
cctgggctgaagtcaagtgtgg

SEQ ID NO: 9205882 - DNA, 22 bp, Homo sapiens
cctgggctctgtcagaattggg

SEQ ID NO: 9205883 - DNA, 16 bp, Homo sapiens
cctgggctctgttgga

SEQ ID NO: 9205884 - DNA, 22 bp, Homo sapiens
cctgggctctgtcagaattggg

SEQ ID NO: 9205885 - DNA, 22 bp, Homo sapiens
cctgggctcaagtgatcctcct

SEQ ID NO: 9205886 - DNA, 22 bp, Homo sapiens
cctgggctcaagtgatcctcct

SEQ ID NO: 9205887 - DNA, 22 bp, Homo sapiens
cctgggctcgcgcacttcaccc

SEQ ID NO: 9205888 - DNA, 22 bp, Homo sapiens
cctgggctctgaggagggagtc

SEQ ID NO: 9205889 - DNA, 22 bp, Homo sapiens
cctgggctctatcctgacccag

SEQ ID NO: 9205890 - DNA, 22 bp, Homo sapiens
cctgggctctatcctgacccag

SEQ ID NO: 9205891 - DNA, 22 bp, Homo sapiens
cctgggctctatcctgacccag

SEQ ID NO: 9205892 - DNA, 22 bp, Homo sapiens
tgtgttctgaaggagaagagtg

SEQ ID NO: 9205893 - DNA, 22 bp, Homo sapiens
tgttacaaactgttgtttctat

SEQ ID NO: 9205894 - DNA, 22 bp, Homo sapiens
tgttacaaggaagaatgtaggt

SEQ ID NO: 9205895 - DNA, 22 bp, Homo sapiens
cctgggctgtacctgtgcgcgg

SEQ ID NO: 9205896 - DNA, 21 bp, Homo sapiens
cctgggctgtggtttggagac

SEQ ID NO: 9205897 - DNA, 22 bp, Homo sapiens
cctgggctgggcgtctcatggg

SEQ ID NO: 9205898 - DNA, 22 bp, Homo sapiens
cctgggctgggcgtctcatggg

SEQ ID NO: 9205899 - DNA, 22 bp, Homo sapiens
cctgggctgttgcatcatcctt

SEQ ID NO: 9205900 - DNA, 22 bp, Homo sapiens
cctgggctgttgcatcatcctt

SEQ ID NO: 9205901 - DNA, 22 bp, Homo sapiens
cctgggcttacgacctctgact

SEQ ID NO: 9205902 - DNA, 22 bp, Homo sapiens
cctgggcttacgacctctgact

SEQ ID NO: 9205903 - DNA, 22 bp, Homo sapiens
tgtgtctgaactagttgctctc

SEQ ID NO: 9205904 - DNA, 22 bp, Homo sapiens
tgtgtctgcactgagtcctcac

SEQ ID NO: 9205905 - DNA, 22 bp, Homo sapiens
cctgggatttcctgagcactct

SEQ ID NO: 9205906 - DNA, 22 bp, Homo sapiens
cctgggatttgcgccagacctt

SEQ ID NO: 9205907 - DNA, 22 bp, Homo sapiens
cctgggatgaaagcagcccact

SEQ ID NO: 9205908 - DNA, 22 bp, Homo sapiens
cctgggatgctgtcctcatcta

SEQ ID NO: 9205909 - DNA, 22 bp, Homo sapiens
cctgggagtgtgccatctctgt

SEQ ID NO: 9205910 - DNA, 22 bp, Homo sapiens
cctgggagtggcactcacagca

SEQ ID NO: 9205911 - DNA, 22 bp, Homo sapiens
cctgggagtggcactcacagca

SEQ ID NO: 9205912 - DNA, 21 bp, Homo sapiens
tgggggagaattggttgcttt

SEQ ID NO: 9205913 - DNA, 21 bp, Homo sapiens
tgggggagaattggttgcttt

SEQ ID NO: 9205914 - DNA, 21 bp, Homo sapiens
tgggggagaattggttgcttt

SEQ ID NO: 9205915 - DNA, 22 bp, Homo sapiens
tggggcttctcctgtaggctca

SEQ ID NO: 9205916 - DNA, 22 bp, Homo sapiens
tggggctgtggattctcacgaa

SEQ ID NO: 9205917 - DNA, 22 bp, Homo sapiens
tggggctgtgagactacaggat

SEQ ID NO: 9205918 - DNA, 23 bp, Homo sapiens
tggggccaagtgaggaagggtct

SEQ ID NO: 9205919 - DNA, 22 bp, Homo sapiens
tggggcagtggcttttcaccct

SEQ ID NO: 9205920 - DNA, 22 bp, Homo sapiens
tggggcagggatgggaaactat

SEQ ID NO: 9205921 - DNA, 22 bp, Homo sapiens
tggggcagctccatctattcca

SEQ ID NO: 9205922 - DNA, 22 bp, Homo sapiens
tggggcagctccatctattcca

SEQ ID NO: 9205923 - DNA, 22 bp, Homo sapiens
tggggcagccacatagacaaca

SEQ ID NO: 9205924 - DNA, 22 bp, Homo sapiens
ttccaggagaggaaacctgatt

SEQ ID NO: 9205925 - DNA, 22 bp, Homo sapiens
ttccaggagccacacaggggcg

SEQ ID NO: 9205926 - DNA, 22 bp, Homo sapiens
ttccaggacttcatggctctga

SEQ ID NO: 9205927 - DNA, 22 bp, Homo sapiens
ttccaggagacttccagaaata

SEQ ID NO: 9205928 - DNA, 22 bp, Homo sapiens
ttccaggactgggtgtttgaag

SEQ ID NO: 9205929 - DNA, 22 bp, Homo sapiens
ttccaggactcgttctggctca

SEQ ID NO: 9205930 - DNA, 22 bp, Homo sapiens
ttccaggactcgttctggctca

SEQ ID NO: 9205931 - DNA, 22 bp, Homo sapiens
ttccaggactgggtgtttgaag

SEQ ID NO: 9205932 - DNA, 22 bp, Homo sapiens
ttccaggacttcatggctctga

SEQ ID NO: 9205933 - DNA, 22 bp, Homo sapiens
ttccaggactcgttctggctca

SEQ ID NO: 9205934 - DNA, 22 bp, Homo sapiens
ttccaggaccaggaagagggga

SEQ ID NO: 9205935 - DNA, 22 bp, Homo sapiens
ttccaggaccaggaagagggga

SEQ ID NO: 9205936 - DNA, 22 bp, Homo sapiens
ttccaggacaagatgtttcagg

SEQ ID NO: 9205937 - DNA, 22 bp, Homo sapiens
ttccaggaattcagctctcagt

SEQ ID NO: 9205938 - DNA, 22 bp, Homo sapiens
ttccaggaattcagctctcagt

SEQ ID NO: 9205939 - DNA, 22 bp, Homo sapiens
ttccaggaggcactgacagagg

SEQ ID NO: 9205940 - DNA, 22 bp, Homo sapiens
ttccaggaggcattcttagttt

SEQ ID NO: 9205941 - DNA, 22 bp, Homo sapiens
ttccaggaggcattcttagttt

SEQ ID NO: 9205942 - DNA, 22 bp, Homo sapiens
ttccaggaggaggtactagagg

SEQ ID NO: 9205943 - DNA, 22 bp, Homo sapiens
ttccaggaggaggtactagagg

SEQ ID NO: 9205944 - DNA, 22 bp, Homo sapiens
ttccaggaggaaagtttgggtg

SEQ ID NO: 9205945 - DNA, 22 bp, Homo sapiens
ttccaggatagctttcaggaat

SEQ ID NO: 9205946 - DNA, 22 bp, Homo sapiens
ttccaggatagctttcaggaat

SEQ ID NO: 9205947 - DNA, 22 bp, Homo sapiens
ttccaggaggtcaaaggcctgt

SEQ ID NO: 9205948 - DNA, 22 bp, Homo sapiens
ttccaggaggcttggcgggagg

SEQ ID NO: 9205949 - DNA, 22 bp, Homo sapiens
ttccaggatgctgctgcttttt

SEQ ID NO: 9205950 - DNA, 22 bp, Homo sapiens
ttccaggatgctgctgcttttt

SEQ ID NO: 9205951 - DNA, 22 bp, Homo sapiens
ttccaggatggagacactagta

SEQ ID NO: 9205952 - DNA, 22 bp, Homo sapiens
ttccaggatgctgctgcttttt

SEQ ID NO: 9205953 - DNA, 22 bp, Homo sapiens
ctacagagaactcagctgccct

SEQ ID NO: 9205954 - DNA, 22 bp, Homo sapiens
ttccaggatggcaataatgaat

SEQ ID NO: 9205955 - DNA, 22 bp, Homo sapiens
ttcctgggcaggacgagagtct

SEQ ID NO: 9205956 - DNA, 22 bp, Homo sapiens
ctacaggtatgtgcatgacatc

SEQ ID NO: 9205957 - DNA, 22 bp, Homo sapiens
ctacaggtcaagcagtagctct

SEQ ID NO: 9205958 - DNA, 22 bp, Homo sapiens
ctacaggaaggatcttgctcaa

SEQ ID NO: 9205959 - DNA, 22 bp, Homo sapiens
ctacagcagagctacactaact

SEQ ID NO: 9205960 - DNA, 22 bp, Homo sapiens
ctacagcagagaccagccacat

SEQ ID NO: 9205961 - DNA, 22 bp, Homo sapiens
ctacagagtgaatgcagaaaat

SEQ ID NO: 9205962 - DNA, 22 bp, Homo sapiens
ctacatttcatccagggagagc

SEQ ID NO: 9205963 - DNA, 22 bp, Homo sapiens
ctacccttaagtttctgtgggg

SEQ ID NO: 9205964 - DNA, 22 bp, Homo sapiens
ctacttctgtgatgaaactaca

SEQ ID NO: 9205965 - DNA, 21 bp, Homo sapiens
ctacttaagtaggggattagg

SEQ ID NO: 9205966 - DNA, 22 bp, Homo sapiens
ctacttctgtgatgaaactaca

SEQ ID NO: 9205967 - DNA, 19 bp, Homo sapiens
ttctctggactagatgctg

SEQ ID NO: 9205968 - DNA, 22 bp, Homo sapiens
ttctctggactatttgcactcc

SEQ ID NO: 9205969 - DNA, 22 bp, Homo sapiens
ttctctaaagagttaggccaag

SEQ ID NO: 9205970 - DNA, 21 bp, Homo sapiens
ttctctggataggccagtcct

SEQ ID NO: 9205971 - DNA, 20 bp, Homo sapiens
ttctctggatagccagatgt

SEQ ID NO: 9205972 - DNA, 22 bp, Homo sapiens
ttctctggagggctgcccggcc

SEQ ID NO: 9205973 - DNA, 22 bp, Homo sapiens
ttctctggagagtatcttctta

SEQ ID NO: 9205974 - DNA, 22 bp, Homo sapiens
ctcacaggagaaagtcatggtc

SEQ ID NO: 9205975 - DNA, 22 bp, Homo sapiens
ctcacagggttctatcgaagag

SEQ ID NO: 9205976 - DNA, 22 bp, Homo sapiens
ctcacaggttagttgtgtggat

SEQ ID NO: 9205977 - DNA, 22 bp, Homo sapiens
ctcacaggtcatgtggtggctt

SEQ ID NO: 9205978 - DNA, 22 bp, Homo sapiens
ctcacagatacggctattcctg

SEQ ID NO: 9205979 - DNA, 22 bp, Homo sapiens
ctcacagagcctctgtgtcttc

SEQ ID NO: 9205980 - DNA, 22 bp, Homo sapiens
ctcacacacgaagcccttggcc

SEQ ID NO: 9205981 - DNA, 22 bp, Homo sapiens
ctcacagatgtcctggcacttc

SEQ ID NO: 9205982 - DNA, 22 bp, Homo sapiens
ctcacagatgctgtgggtcagg

SEQ ID NO: 9205983 - DNA, 22 bp, Homo sapiens
ctcacagatatttgcttcaggt

SEQ ID NO: 9205984 - DNA, 22 bp, Homo sapiens
ctcacagatctgtgcctgaacc

SEQ ID NO: 9205985 - DNA, 21 bp, Homo sapiens
ttctctggcttctgtagctgg

SEQ ID NO: 9205986 - DNA, 22 bp, Homo sapiens
ttctctggcgcgctgtgctatg

SEQ ID NO: 9205987 - DNA, 22 bp, Homo sapiens
ttctctggcggtgtgttttcct

SEQ ID NO: 9205988 - DNA, 22 bp, Homo sapiens
ttctctggcctgaggcgaggcc

SEQ ID NO: 9205989 - DNA, 22 bp, Homo sapiens
ttctctggcctgaggcgaggcc

SEQ ID NO: 9205990 - DNA, 22 bp, Homo sapiens
ttctctggccatagctggctag

SEQ ID NO: 9205991 - DNA, 22 bp, Homo sapiens
ttctctggatgtttctcagtca

SEQ ID NO: 9205992 - DNA, 22 bp, Homo sapiens
ctagccagatttaaagagagac

SEQ ID NO: 9205993 - DNA, 22 bp, Homo sapiens
ctagcatctcactgatttactg

SEQ ID NO: 9205994 - DNA, 22 bp, Homo sapiens
ctagccagatgattcccaaata

SEQ ID NO: 9205995 - DNA, 22 bp, Homo sapiens
ctagccagactcaagggccacc

SEQ ID NO: 9205996 - DNA, 22 bp, Homo sapiens
ctagcagcatcacaggaagact

SEQ ID NO: 9205997 - DNA, 22 bp, Homo sapiens
ctagcagcatcacaggaagact

SEQ ID NO: 9205998 - DNA, 22 bp, Homo sapiens
ctagcagcattcttctagttag

SEQ ID NO: 9205999 - DNA, 22 bp, Homo sapiens
ctagcagctctgatatttacaa

SEQ ID NO: 9206000 - DNA, 22 bp, Homo sapiens
ctagcagggattgggcactggg

SEQ ID NO: 9206001 - DNA, 22 bp, Homo sapiens
ctatgtatgcgattagaatttt

SEQ ID NO: 9206002 - DNA, 22 bp, Homo sapiens
ttcacacagaatctgaggagct

SEQ ID NO: 9206003 - DNA, 22 bp, Homo sapiens
ttcacacagaatctgaggagct

SEQ ID NO: 9206004 - DNA, 22 bp, Homo sapiens
ttcacacagcaactgtatgaat

SEQ ID NO: 9206005 - DNA, 20 bp, Homo sapiens
ttcaagttgggtctctggct

SEQ ID NO: 9206006 - DNA, 22 bp, Homo sapiens
cgcccagggcaggaggccgctc

SEQ ID NO: 9206007 - DNA, 22 bp, Homo sapiens
cgcccaggctggagtgcagtgg

SEQ ID NO: 9206008 - DNA, 22 bp, Homo sapiens
cgcccagggcaggaggccgctc

SEQ ID NO: 9206009 - DNA, 20 bp, Homo sapiens
cgcccaggagggcccatgtg

SEQ ID NO: 9206010 - DNA, 22 bp, Homo sapiens
cgcccaggctggagagcagtgg

SEQ ID NO: 9206011 - DNA, 20 bp, Homo sapiens
cgcccaggagggcccatgtg

SEQ ID NO: 9206012 - DNA, 22 bp, Homo sapiens
cgcccaggctggagagcagtgg

SEQ ID NO: 9206013 - DNA, 22 bp, Homo sapiens
cgcccaggctggagtgcagtga

SEQ ID NO: 9206014 - DNA, 22 bp, Homo sapiens
cgcccccagggcctcgagcatg

SEQ ID NO: 9206015 - DNA, 22 bp, Homo sapiens
cgccccagtctgtaggtgcccc

SEQ ID NO: 9206016 - DNA, 22 bp, Homo sapiens
cgcccctcagcgacccaccagc

SEQ ID NO: 9206017 - DNA, 22 bp, Homo sapiens
cgccgcctgctgcagcagctgt

SEQ ID NO: 9206018 - DNA, 22 bp, Homo sapiens
ttaggagtccagatgtcttggg

SEQ ID NO: 9206019 - DNA, 22 bp, Homo sapiens
cgccaggcttggtagctcatgc

SEQ ID NO: 9206020 - DNA, 22 bp, Homo sapiens
cgccaggcttggtagctcatgc

SEQ ID NO: 9206021 - DNA, 22 bp, Homo sapiens
ttcagataatgacaggtcagga

SEQ ID NO: 9206022 - DNA, 22 bp, Homo sapiens
ttcacagaagaggtcacatttc

SEQ ID NO: 9206023 - DNA, 20 bp, Homo sapiens
ttcagagtcagcaaatgcag

SEQ ID NO: 9206024 - DNA, 22 bp, Homo sapiens
ttcatgaatgttccatgtgagt

SEQ ID NO: 9206025 - DNA, 22 bp, Homo sapiens
ctaaaattacctaccagtttag

SEQ ID NO: 9206026 - DNA, 17 bp, Homo sapiens
ctaaatacttgcgtttc

SEQ ID NO: 9206027 - DNA, 22 bp, Homo sapiens
ctaaataatccctctggtctta

SEQ ID NO: 9206028 - DNA, 22 bp, Homo sapiens
ctaaagcaactgagacacatag

SEQ ID NO: 9206029 - DNA, 22 bp, Homo sapiens
ctaaagaagctagcaatctata

SEQ ID NO: 9206030 - DNA, 22 bp, Homo sapiens
ctaaagaattttgcttgaccag

SEQ ID NO: 9206031 - DNA, 22 bp, Homo sapiens
cgtaggtggctcagcacctggg

SEQ ID NO: 9206032 - DNA, 22 bp, Homo sapiens
cgtagacaactgaaatgcacag

SEQ ID NO: 9206033 - DNA, 22 bp, Homo sapiens
cggtcctggcacttgcggctcc

SEQ ID NO: 9206034 - DNA, 22 bp, Homo sapiens
cggggcttggaccagccacccc

SEQ ID NO: 9206035 - DNA, 22 bp, Homo sapiens
cggtcctgtacttgatgagata

SEQ ID NO: 9206036 - DNA, 22 bp, Homo sapiens
cgtcacttcttagtctattttc

SEQ ID NO: 9206037 - DNA, 22 bp, Homo sapiens
caggcctcgaggagacagctac

SEQ ID NO: 9206038 - DNA, 22 bp, Homo sapiens
caggcccagcccttagccaggt

SEQ ID NO: 9206039 - DNA, 22 bp, Homo sapiens
caggcccagcccttagccaggt

SEQ ID NO: 9206040 - DNA, 22 bp, Homo sapiens
caggcctcctatgagcactagc

SEQ ID NO: 9206041 - DNA, 22 bp, Homo sapiens
caggcctgcttcttacccttca

SEQ ID NO: 9206042 - DNA, 22 bp, Homo sapiens
caggcctgcaggaaaggctccc

SEQ ID NO: 9206043 - DNA, 22 bp, Homo sapiens
caggcctgcaggaaaggctccc

SEQ ID NO: 9206044 - DNA, 22 bp, Homo sapiens
caggcctgagtgtggaagtctt

SEQ ID NO: 9206045 - DNA, 22 bp, Homo sapiens
caggcctgatacactgaactct

SEQ ID NO: 9206046 - DNA, 22 bp, Homo sapiens
caggcctgaccctgagcttcac

SEQ ID NO: 9206047 - DNA, 22 bp, Homo sapiens
caggcctgaccctgagcttcac

SEQ ID NO: 9206048 - DNA, 22 bp, Homo sapiens
caggcctgagacatctgagata

SEQ ID NO: 9206049 - DNA, 22 bp, Homo sapiens
caggcctgagacatctgagata

SEQ ID NO: 9206050 - DNA, 18 bp, Homo sapiens
caggcctcttgatcttcc

SEQ ID NO: 9206051 - DNA, 22 bp, Homo sapiens
tacatttcagagctcctctctg

SEQ ID NO: 9206052 - DNA, 22 bp, Homo sapiens
tacatttataaggcttctctgt

SEQ ID NO: 9206053 - DNA, 22 bp, Homo sapiens
caggcctttgcagggagagaga

SEQ ID NO: 9206054 - DNA, 22 bp, Homo sapiens
caggccttgtcaagaaaatgcc

SEQ ID NO: 9206055 - DNA, 22 bp, Homo sapiens
caggcggccatgatctggcagg

SEQ ID NO: 9206056 - DNA, 22 bp, Homo sapiens
caggcgggcaggtgcggcccct

SEQ ID NO: 9206057 - DNA, 22 bp, Homo sapiens
tactttagaaggaaataagttc

SEQ ID NO: 9206058 - DNA, 22 bp, Homo sapiens
tacttgttttgtgttcctaaac

SEQ ID NO: 9206059 - DNA, 22 bp, Homo sapiens
caggctagattggggccagtag

SEQ ID NO: 9206060 - DNA, 22 bp, Homo sapiens
caggctacatttgctctgagaa

SEQ ID NO: 9206061 - DNA, 22 bp, Homo sapiens
caggctagcagggcccagggca

SEQ ID NO: 9206062 - DNA, 22 bp, Homo sapiens
caggctgtctgaatggaggccc

SEQ ID NO: 9206063 - DNA, 22 bp, Homo sapiens
tagaaacaaagacctgggtgct

SEQ ID NO: 9206064 - DNA, 22 bp, Homo sapiens
caggcttggagggcagtggcat

SEQ ID NO: 9206065 - DNA, 22 bp, Homo sapiens
caggcttgctgctagagcactt

SEQ ID NO: 9206066 - DNA, 22 bp, Homo sapiens
caggctgtctgaatggaggccc

SEQ ID NO: 9206067 - DNA, 22 bp, Homo sapiens
caggcttggcagggaggctggt

SEQ ID NO: 9206068 - DNA, 22 bp, Homo sapiens
caggcttgggagcagagccact

SEQ ID NO: 9206069 - DNA, 22 bp, Homo sapiens
caggcttggttggggcgaggga

SEQ ID NO: 9206070 - DNA, 22 bp, Homo sapiens
caggcttttgcatagcactggg

SEQ ID NO: 9206071 - DNA, 22 bp, Homo sapiens
cagggacagcactaaactcttg

SEQ ID NO: 9206072 - DNA, 22 bp, Homo sapiens
cagggacagagactgcaccttg

SEQ ID NO: 9206073 - DNA, 22 bp, Homo sapiens
cagggacagagactgcaccttg

SEQ ID NO: 9206074 - DNA, 22 bp, Homo sapiens
cagggacagagactgcaccttg

SEQ ID NO: 9206075 - DNA, 22 bp, Homo sapiens
cagggacaaggaataagattag

SEQ ID NO: 9206076 - DNA, 22 bp, Homo sapiens
cagggacaatggcagagcctga

SEQ ID NO: 9206077 - DNA, 22 bp, Homo sapiens
cagggacaaacaaggttgggga

SEQ ID NO: 9206078 - DNA, 22 bp, Homo sapiens
caggctgccgaggctgcagaat

SEQ ID NO: 9206079 - DNA, 22 bp, Homo sapiens
caggctgcagtgcagtggctat

SEQ ID NO: 9206080 - DNA, 22 bp, Homo sapiens
caggctgcatggaggggtacag

SEQ ID NO: 9206081 - DNA, 22 bp, Homo sapiens
caggctgccaaggctggggagg

SEQ ID NO: 9206082 - DNA, 22 bp, Homo sapiens
caggctggagttcagtggtgtg

SEQ ID NO: 9206083 - DNA, 22 bp, Homo sapiens
caggctggagttcagtggtgtg

SEQ ID NO: 9206084 - DNA, 22 bp, Homo sapiens
caggctgccgtgaagcaggcct

SEQ ID NO: 9206085 - DNA, 22 bp, Homo sapiens
caggctgccgtggggtccaggc

SEQ ID NO: 9206086 - DNA, 22 bp, Homo sapiens
caggctggcaatgcgtcaagca

SEQ ID NO: 9206087 - DNA, 22 bp, Homo sapiens
caggctggcaatgcgtcaagca

SEQ ID NO: 9206088 - DNA, 22 bp, Homo sapiens
caggctgggaacgccacccgct

SEQ ID NO: 9206089 - DNA, 22 bp, Homo sapiens
caggctgggaacgccacccgct

SEQ ID NO: 9206090 - DNA, 22 bp, Homo sapiens
caggctgggactgacccctgct

SEQ ID NO: 9206091 - DNA, 22 bp, Homo sapiens
tagaaaagtatgggactgacat

SEQ ID NO: 9206092 - DNA, 22 bp, Homo sapiens
tagaaaatggccaagcaggact

SEQ ID NO: 9206093 - DNA, 22 bp, Homo sapiens
tagaaacaaaatctgatgactc

SEQ ID NO: 9206094 - DNA, 22 bp, Homo sapiens
caggcccacgaggcacacagag

SEQ ID NO: 9206095 - DNA, 22 bp, Homo sapiens
caggcccactgcttgtctagtc

SEQ ID NO: 9206096 - DNA, 19 bp, Homo sapiens
caggccagtgtcagggggc

SEQ ID NO: 9206097 - DNA, 22 bp, Homo sapiens
caggccagtgtgcttcccaggc

SEQ ID NO: 9206098 - DNA, 22 bp, Homo sapiens
caggccagggttgagaagagaa

SEQ ID NO: 9206099 - DNA, 20 bp, Homo sapiens
tacaaacctccacactggtg

SEQ ID NO: 9206100 - DNA, 20 bp, Homo sapiens
tacaaacctccacactggtg

SEQ ID NO: 9206101 - DNA, 22 bp, Homo sapiens
tacaaaacagtgctctggtcct

SEQ ID NO: 9206102 - DNA, 22 bp, Homo sapiens
tacaaaaaattgatactgacga

SEQ ID NO: 9206103 - DNA, 22 bp, Homo sapiens
tacaaaaaattgatactgacga

SEQ ID NO: 9206104 - DNA, 22 bp, Homo sapiens
tacaaaaaattgatactgacga

SEQ ID NO: 9206105 - DNA, 22 bp, Homo sapiens
caggcatttaactctctaatgg

SEQ ID NO: 9206106 - DNA, 22 bp, Homo sapiens
caggcatggagaggcagagact

SEQ ID NO: 9206107 - DNA, 22 bp, Homo sapiens
caggcatggagaggcagagact

SEQ ID NO: 9206108 - DNA, 22 bp, Homo sapiens
caggcatggagaggcagagact

SEQ ID NO: 9206109 - DNA, 22 bp, Homo sapiens
caggcatggaaaagcccagagg

SEQ ID NO: 9206110 - DNA, 22 bp, Homo sapiens
caggcatggaaaagcccagagg

SEQ ID NO: 9206111 - DNA, 22 bp, Homo sapiens
caggcatgagccaggcccctcc

SEQ ID NO: 9206112 - DNA, 22 bp, Homo sapiens
caggcatgatcataggagttta

SEQ ID NO: 9206113 - DNA, 22 bp, Homo sapiens
taatgttacactgcatggttca

SEQ ID NO: 9206114 - DNA, 22 bp, Homo sapiens
taatcacaattcagatgtctta

SEQ ID NO: 9206115 - DNA, 22 bp, Homo sapiens
taatatgtgttactgacttttt

SEQ ID NO: 9206116 - DNA, 22 bp, Homo sapiens
taatatgtgttactgacttttt

SEQ ID NO: 9206117 - DNA, 22 bp, Homo sapiens
taatatttctaccctgctgcct

SEQ ID NO: 9206118 - DNA, 22 bp, Homo sapiens
taatccagcgggtgattgcaca

SEQ ID NO: 9206119 - DNA, 23 bp, Homo sapiens
cagctcagcacataggaggtact

SEQ ID NO: 9206120 - DNA, 23 bp, Homo sapiens
cagctcagagtgtgtcctgtttc

SEQ ID NO: 9206121 - DNA, 22 bp, Homo sapiens
cagctcagacgcaggtcgagca

SEQ ID NO: 9206122 - DNA, 22 bp, Homo sapiens
cagctcagacgcaggtcgagca

SEQ ID NO: 9206123 - DNA, 22 bp, Homo sapiens
gtgcttcctctgccaacactct

SEQ ID NO: 9206124 - DNA, 22 bp, Homo sapiens
gtgcttctcttcacacccaact

SEQ ID NO: 9206125 - DNA, 22 bp, Homo sapiens
gtgcttatgtgggagggagagg

SEQ ID NO: 9206126 - DNA, 22 bp, Homo sapiens
caggcagatttgctgccctcca

SEQ ID NO: 9206127 - DNA, 22 bp, Homo sapiens
caggcagatgctgacaagagtt

SEQ ID NO: 9206128 - DNA, 22 bp, Homo sapiens
caggcagatgctgacaagagtt

SEQ ID NO: 9206129 - DNA, 22 bp, Homo sapiens
caggcagatttgctgccctcca

SEQ ID NO: 9206130 - DNA, 22 bp, Homo sapiens
caggcagcagaggagtgtggga

SEQ ID NO: 9206131 - DNA, 22 bp, Homo sapiens
caggcagcagaggagtgtggga

SEQ ID NO: 9206132 - DNA, 22 bp, Homo sapiens
caggcaccccaggtgagcactg

SEQ ID NO: 9206133 - DNA, 22 bp, Homo sapiens
caggcaccccaggtgagcactg

SEQ ID NO: 9206134 - DNA, 22 bp, Homo sapiens
caggcagagttagagcaactgg

SEQ ID NO: 9206135 - DNA, 22 bp, Homo sapiens
caggcagatatgttcgctttaa

SEQ ID NO: 9206136 - DNA, 22 bp, Homo sapiens
cagggctgtaaattagtgctga

SEQ ID NO: 9206137 - DNA, 22 bp, Homo sapiens
cagggctggtttgtcgaagaaa

SEQ ID NO: 9206138 - DNA, 23 bp, Homo sapiens
cagggctggtagggaagagcgtg

SEQ ID NO: 9206139 - DNA, 22 bp, Homo sapiens
cagggctgggttaaaagcaggg

SEQ ID NO: 9206140 - DNA, 23 bp, Homo sapiens
cagggctggtagggaagagcgtg

SEQ ID NO: 9206141 - DNA, 22 bp, Homo sapiens
cagggctggatttcatttctag

SEQ ID NO: 9206142 - DNA, 22 bp, Homo sapiens
cagggctgaactgagcttgtga

SEQ ID NO: 9206143 - DNA, 22 bp, Homo sapiens
cagggctgaagaaattcaaaag

SEQ ID NO: 9206144 - DNA, 22 bp, Homo sapiens
cagggctgtgcccatcttcccc

SEQ ID NO: 9206145 - DNA, 17 bp, Homo sapiens
cagggctgtctgcctag

SEQ ID NO: 9206146 - DNA, 22 bp, Homo sapiens
cagggctgtgcccatcttcccc

SEQ ID NO: 9206147 - DNA, 22 bp, Homo sapiens
cagggggctcaaaggagagtgc

SEQ ID NO: 9206148 - DNA, 22 bp, Homo sapiens
cagggtccatctttcatcactg

SEQ ID NO: 9206149 - DNA, 22 bp, Homo sapiens
cagggtcaggaggatctggctt

SEQ ID NO: 9206150 - DNA, 22 bp, Homo sapiens
cagggtccggctgcctggctgt

SEQ ID NO: 9206151 - DNA, 22 bp, Homo sapiens
cagggtctgatggtcctcactt

SEQ ID NO: 9206152 - DNA, 22 bp, Homo sapiens
cagggtggggaaatagcgccct

SEQ ID NO: 9206153 - DNA, 22 bp, Homo sapiens
cagggtccggctgcctggctgt

SEQ ID NO: 9206154 - DNA, 22 bp, Homo sapiens
cagggtccccgggtctcctgtg

SEQ ID NO: 9206155 - DNA, 22 bp, Homo sapiens
cagggtccccgggtctcctgtg

SEQ ID NO: 9206156 - DNA, 22 bp, Homo sapiens
cagggtcccaggagctgctttc

SEQ ID NO: 9206157 - DNA, 22 bp, Homo sapiens
cagggtagacagtaggtgtctg

SEQ ID NO: 9206158 - DNA, 22 bp, Homo sapiens
caggggtattcaaggtagttta

SEQ ID NO: 9206159 - DNA, 22 bp, Homo sapiens
cagggcccatggctcaggtagg

SEQ ID NO: 9206160 - DNA, 22 bp, Homo sapiens
taggccacggaaagcaggttgc

SEQ ID NO: 9206161 - DNA, 22 bp, Homo sapiens
taggccacgaaggagatgatag

SEQ ID NO: 9206162 - DNA, 22 bp, Homo sapiens
taggccactctcctttgtctca

SEQ ID NO: 9206163 - DNA, 22 bp, Homo sapiens
taggccacagatgagacataag

SEQ ID NO: 9206164 - DNA, 22 bp, Homo sapiens
taggccaccagggttccattta

SEQ ID NO: 9206165 - DNA, 21 bp, Homo sapiens
taggccacatgggttggagat

SEQ ID NO: 9206166 - DNA, 22 bp, Homo sapiens
taggccacagagaggagatttc

SEQ ID NO: 9206167 - DNA, 22 bp, Homo sapiens
taggccacaaataagatcctgt

SEQ ID NO: 9206168 - DNA, 22 bp, Homo sapiens
tagcttggaataaaatgagaat

SEQ ID NO: 9206169 - DNA, 22 bp, Homo sapiens
tagcttcttgagaaagggtgcc

SEQ ID NO: 9206170 - DNA, 22 bp, Homo sapiens
tagcttccctgctggatcataa

SEQ ID NO: 9206171 - DNA, 21 bp, Homo sapiens
tagcttccagctcaagctgag

SEQ ID NO: 9206172 - DNA, 22 bp, Homo sapiens
tagcttccctagctaaagaggt

SEQ ID NO: 9206173 - DNA, 22 bp, Homo sapiens
taggcatgcaaataaatgtgca

SEQ ID NO: 9206174 - DNA, 22 bp, Homo sapiens
taggccaacgtggaagggtcca

SEQ ID NO: 9206175 - DNA, 22 bp, Homo sapiens
taggccaaatgacttgatgttt

SEQ ID NO: 9206176 - DNA, 22 bp, Homo sapiens
taggcattttcagtgttgttgt

SEQ ID NO: 9206177 - DNA, 22 bp, Homo sapiens
taggcattttattgaacgtaac

SEQ ID NO: 9206178 - DNA, 22 bp, Homo sapiens
taggcatttaagatggataagg

SEQ ID NO: 9206179 - DNA, 22 bp, Homo sapiens
taggcattacctaacattacct

SEQ ID NO: 9206180 - DNA, 22 bp, Homo sapiens
tagattgtaagctccttgaggg

SEQ ID NO: 9206181 - DNA, 22 bp, Homo sapiens
tagatttgatgtaagcatagtc

SEQ ID NO: 9206182 - DNA, 22 bp, Homo sapiens
tagatttgcctgggaaagctca

SEQ ID NO: 9206183 - DNA, 22 bp, Homo sapiens
tagatttgtgcaagaagggatt

SEQ ID NO: 9206184 - DNA, 22 bp, Homo sapiens
cagggagcaggctctgtccatc

SEQ ID NO: 9206185 - DNA, 22 bp, Homo sapiens
cagggccagggctatggtgaag

SEQ ID NO: 9206186 - DNA, 22 bp, Homo sapiens
cagggagccccaattccatgcc

SEQ ID NO: 9206187 - DNA, 22 bp, Homo sapiens
cagggccagttctcgcagcagt

SEQ ID NO: 9206188 - DNA, 22 bp, Homo sapiens
cagggccagttctcgcagcagt

SEQ ID NO: 9206189 - DNA, 22 bp, Homo sapiens
cagggccattggaacaaagagg

SEQ ID NO: 9206190 - DNA, 22 bp, Homo sapiens
cagggccattggaacaaagagg

SEQ ID NO: 9206191 - DNA, 22 bp, Homo sapiens
tcaagcagggtagcaagctggt

SEQ ID NO: 9206192 - DNA, 22 bp, Homo sapiens
tcaagcagcttttacagaagag

SEQ ID NO: 9206193 - DNA, 22 bp, Homo sapiens
tcaagcagcagatcaagagcta

SEQ ID NO: 9206194 - DNA, 19 bp, Homo sapiens
tcaagatggatggctccca

SEQ ID NO: 9206195 - DNA, 20 bp, Homo sapiens
tcaagatgaggtcatactgg

SEQ ID NO: 9206196 - DNA, 22 bp, Homo sapiens
tcaagatgcatgggtggcataa

SEQ ID NO: 9206197 - DNA, 22 bp, Homo sapiens
tcaagatgaaccaggacattca

SEQ ID NO: 9206198 - DNA, 22 bp, Homo sapiens
tcaagatgaaagatgtagccat

SEQ ID NO: 9206199 - DNA, 22 bp, Homo sapiens
tcaacaaatacttaaagcagag

SEQ ID NO: 9206200 - DNA, 22 bp, Homo sapiens
tcaagatgtccagtgcctataa

SEQ ID NO: 9206201 - DNA, 22 bp, Homo sapiens
tcaagcaaactctgagaaataa

SEQ ID NO: 9206202 - DNA, 22 bp, Homo sapiens
tcaaaaatgttttatattggta

SEQ ID NO: 9206203 - DNA, 22 bp, Homo sapiens
tattttatctgccagagtggag

SEQ ID NO: 9206204 - DNA, 22 bp, Homo sapiens
tattttaaagtgaagggtcttg

SEQ ID NO: 9206205 - DNA, 22 bp, Homo sapiens
tattttacagactactttagat

SEQ ID NO: 9206206 - DNA, 22 bp, Homo sapiens
cagtcagggacaccagctagga

SEQ ID NO: 9206207 - DNA, 22 bp, Homo sapiens
cagtcagggacaccagctagga

SEQ ID NO: 9206208 - DNA, 22 bp, Homo sapiens
cagtccaacctgccccttgggc

SEQ ID NO: 9206209 - DNA, 22 bp, Homo sapiens
cagtcactggaatagctgagga

SEQ ID NO: 9206210 - DNA, 22 bp, Homo sapiens
cagtcagaaggaagatgcttaa

SEQ ID NO: 9206211 - DNA, 22 bp, Homo sapiens
cagtcagagtcacagtaatttg

SEQ ID NO: 9206212 - DNA, 22 bp, Homo sapiens
cagtcagaggtcttctaaaaca

SEQ ID NO: 9206213 - DNA, 22 bp, Homo sapiens
cagtcaggaatgcctccttcct

SEQ ID NO: 9206214 - DNA, 22 bp, Homo sapiens
cagtcaggctgcgcttctctga

SEQ ID NO: 9206215 - DNA, 22 bp, Homo sapiens
cagtcaggctgcgcttctctga

SEQ ID NO: 9206216 - DNA, 19 bp, Homo sapiens
caggtggtaatctgagcct

SEQ ID NO: 9206217 - DNA, 22 bp, Homo sapiens
caggtgggtgtatgaatgcaaa

SEQ ID NO: 9206218 - DNA, 22 bp, Homo sapiens
cagtcaaacttataggcacatt

SEQ ID NO: 9206219 - DNA, 22 bp, Homo sapiens
caggtggcaaatgagtagcatt

SEQ ID NO: 9206220 - DNA, 19 bp, Homo sapiens
caggtggcgctctacaggg

SEQ ID NO: 9206221 - DNA, 18 bp, Homo sapiens
caggtgggtctcctgccc

SEQ ID NO: 9206222 - DNA, 18 bp, Homo sapiens
caggtgggtctcctgccc

SEQ ID NO: 9206223 - DNA, 22 bp, Homo sapiens
caggtgggtacatcacagagac

SEQ ID NO: 9206224 - DNA, 22 bp, Homo sapiens
tattatgtagagtaagggttaa

SEQ ID NO: 9206225 - DNA, 22 bp, Homo sapiens
tattatctagtaactgatagtg

SEQ ID NO: 9206226 - DNA, 22 bp, Homo sapiens
caggtgctgcgtggcggagctg

SEQ ID NO: 9206227 - DNA, 22 bp, Homo sapiens
caggtgccgggaatgcagcaat

SEQ ID NO: 9206228 - DNA, 22 bp, Homo sapiens
caggtcagagtccccctgtcct

SEQ ID NO: 9206229 - DNA, 18 bp, Homo sapiens
caggtcagcctggcctca

SEQ ID NO: 9206230 - DNA, 18 bp, Homo sapiens
caggtcagcctggcctca

SEQ ID NO: 9206231 - DNA, 22 bp, Homo sapiens
caggtcagctggtgccccaggt

SEQ ID NO: 9206232 - DNA, 22 bp, Homo sapiens
caggtaggaggctccctagtcc

SEQ ID NO: 9206233 - DNA, 22 bp, Homo sapiens
caggtaggaaaagggtgtcagg

SEQ ID NO: 9206234 - DNA, 22 bp, Homo sapiens
caggtagaggctgccatcagct

SEQ ID NO: 9206235 - DNA, 22 bp, Homo sapiens
caggtaggatggaagggctcaa

SEQ ID NO: 9206236 - DNA, 22 bp, Homo sapiens
cagggtttcaccatgttagcag

SEQ ID NO: 9206237 - DNA, 22 bp, Homo sapiens
caggtaagtctgtcctcacaag

SEQ ID NO: 9206238 - DNA, 22 bp, Homo sapiens
caggtagggatatgatggtgat

SEQ ID NO: 9206239 - DNA, 22 bp, Homo sapiens
caggtaggggagagctccaaca

SEQ ID NO: 9206240 - DNA, 22 bp, Homo sapiens
caggtaggcagccggtctctgg

SEQ ID NO: 9206241 - DNA, 22 bp, Homo sapiens
caggtaggccaatgttttccaa

SEQ ID NO: 9206242 - DNA, 22 bp, Homo sapiens
caggtaggttttaggctaaaca

SEQ ID NO: 9206243 - DNA, 22 bp, Homo sapiens
caggtcagaggcgcagccccca

SEQ ID NO: 9206244 - DNA, 22 bp, Homo sapiens
caggtaggtatggtgcagtctt

SEQ ID NO: 9206245 - DNA, 20 bp, Homo sapiens
tcctaataacctgaagaaat

SEQ ID NO: 9206246 - DNA, 22 bp, Homo sapiens
ccaaggagcaaggctcaacaag

SEQ ID NO: 9206247 - DNA, 22 bp, Homo sapiens
ccaaggagaatgacaccatgga

SEQ ID NO: 9206248 - DNA, 22 bp, Homo sapiens
ccaagaggttgtgaggcaggca

SEQ ID NO: 9206249 - DNA, 22 bp, Homo sapiens
ccaagaggttgaggctgcagtg

SEQ ID NO: 9206250 - DNA, 22 bp, Homo sapiens
ccaaggcatatggctgaaacca

SEQ ID NO: 9206251 - DNA, 22 bp, Homo sapiens
ccaaggcagaagatggctcttg

SEQ ID NO: 9206252 - DNA, 22 bp, Homo sapiens
ccaaggcagaagatggctcttg

SEQ ID NO: 9206253 - DNA, 22 bp, Homo sapiens
ccaaggcaacgttggtgtcagg

SEQ ID NO: 9206254 - DNA, 22 bp, Homo sapiens
ccaaggcaatgtgcagctggtg

SEQ ID NO: 9206255 - DNA, 22 bp, Homo sapiens
ccaaggaggccccaggtcagct

SEQ ID NO: 9206256 - DNA, 22 bp, Homo sapiens
ccaaggcttcccagagatgctc

SEQ ID NO: 9206257 - DNA, 22 bp, Homo sapiens
ccaaggcttcccagagatgctc

SEQ ID NO: 9206258 - DNA, 22 bp, Homo sapiens
ccaaggcttcccagagatgctc

SEQ ID NO: 9206259 - DNA, 22 bp, Homo sapiens
tcctggcagagggcggcctcga

SEQ ID NO: 9206260 - DNA, 22 bp, Homo sapiens
ccaaggctcctcagctggtctt

SEQ ID NO: 9206261 - DNA, 22 bp, Homo sapiens
ccaaggctcctcagctggtctt

SEQ ID NO: 9206262 - DNA, 22 bp, Homo sapiens
ccaaggctggagtgcagtggcg

SEQ ID NO: 9206263 - DNA, 22 bp, Homo sapiens
ccaaggctgtggggctgtgcag

SEQ ID NO: 9206264 - DNA, 22 bp, Homo sapiens
ccaaggctggagtgcagtggcg

SEQ ID NO: 9206265 - DNA, 22 bp, Homo sapiens
ccacagaaaataaagcacgatt

SEQ ID NO: 9206266 - DNA, 22 bp, Homo sapiens
tcctggcaggtcagcaggagca

SEQ ID NO: 9206267 - DNA, 22 bp, Homo sapiens
tcctggcagggtggcagcgggt

SEQ ID NO: 9206268 - DNA, 22 bp, Homo sapiens
tcctgggcttaagtgatcctcc

SEQ ID NO: 9206269 - DNA, 22 bp, Homo sapiens
tcctgggctgtgtgccactctg

SEQ ID NO: 9206270 - DNA, 22 bp, Homo sapiens
tcctggctccagcagctcttcc

SEQ ID NO: 9206271 - DNA, 22 bp, Homo sapiens
ccagagaatccggagagtccat

SEQ ID NO: 9206272 - DNA, 19 bp, Homo sapiens
ccagagacattggcatctt

SEQ ID NO: 9206273 - DNA, 22 bp, Homo sapiens
ccagagaagtcttgcctggatt

SEQ ID NO: 9206274 - DNA, 22 bp, Homo sapiens
ccagagaaccttgagctgtgag

SEQ ID NO: 9206275 - DNA, 22 bp, Homo sapiens
ccagagaaccatctgcttgagg

SEQ ID NO: 9206276 - DNA, 21 bp, Homo sapiens
tctaagccttgcagatgggtt

SEQ ID NO: 9206277 - DNA, 22 bp, Homo sapiens
tctaaggtcaggggaaagtttg

SEQ ID NO: 9206278 - DNA, 22 bp, Homo sapiens
ccactgggggctgctcccaggt

SEQ ID NO: 9206279 - DNA, 22 bp, Homo sapiens
ccactgtctgcaggcctcagca

SEQ ID NO: 9206280 - DNA, 22 bp, Homo sapiens
ccactgtcagaggggctgtgcc

SEQ ID NO: 9206281 - DNA, 22 bp, Homo sapiens
ccactgtcttttccaggctgaa

SEQ ID NO: 9206282 - DNA, 22 bp, Homo sapiens
ccactgtctgtgacatcagaaa

SEQ ID NO: 9206283 - DNA, 22 bp, Homo sapiens
tctaagccaggactgagagacg

SEQ ID NO: 9206284 - DNA, 22 bp, Homo sapiens
tctaagaaatcagatgatgagg

SEQ ID NO: 9206285 - DNA, 22 bp, Homo sapiens
ccactgttggcccgaaggggtc

SEQ ID NO: 9206286 - DNA, 22 bp, Homo sapiens
tccttggggacgctgacatcgt

SEQ ID NO: 9206287 - DNA, 22 bp, Homo sapiens
ccactgctaacttgctgcagct

SEQ ID NO: 9206288 - DNA, 22 bp, Homo sapiens
tcctgggcttagtggctaggtc

SEQ ID NO: 9206289 - DNA, 22 bp, Homo sapiens
tcctgggcttcacagactctgt

SEQ ID NO: 9206290 - DNA, 22 bp, Homo sapiens
tcctgggcttgctcctccagct

SEQ ID NO: 9206291 - DNA, 19 bp, Homo sapiens
tcctggggaggggcatggc

SEQ ID NO: 9206292 - DNA, 19 bp, Homo sapiens
tcctggggaggggcatggc

SEQ ID NO: 9206293 - DNA, 22 bp, Homo sapiens
tcctgggctttgtttctctcct

SEQ ID NO: 9206294 - DNA, 22 bp, Homo sapiens
tccttcagtcttctgagccata

SEQ ID NO: 9206295 - DNA, 22 bp, Homo sapiens
catttattcatgatctgtagct

SEQ ID NO: 9206296 - DNA, 22 bp, Homo sapiens
catttattctcagatccttgtc

SEQ ID NO: 9206297 - DNA, 22 bp, Homo sapiens
tccctctacagggaagcgcttt

SEQ ID NO: 9206298 - DNA, 22 bp, Homo sapiens
tccctcctttatcaaaaagaga

SEQ ID NO: 9206299 - DNA, 22 bp, Homo sapiens
tccctggggtatcgctgaggca

SEQ ID NO: 9206300 - DNA, 22 bp, Homo sapiens
tccctgctttcttgtgagggga

SEQ ID NO: 9206301 - DNA, 22 bp, Homo sapiens
tccctgctttcttgtgagggga

SEQ ID NO: 9206302 - DNA, 22 bp, Homo sapiens
tccctcctggtgagcaggggct

SEQ ID NO: 9206303 - DNA, 22 bp, Homo sapiens
tccctcctggtgatgatgcaaa

SEQ ID NO: 9206304 - DNA, 22 bp, Homo sapiens
tccctccttaataagaggtctg

SEQ ID NO: 9206305 - DNA, 20 bp, Homo sapiens
tccctcctgcagatagagaa

SEQ ID NO: 9206306 - DNA, 22 bp, Homo sapiens
tccctcctgcatgaggctcggc

SEQ ID NO: 9206307 - DNA, 20 bp, Homo sapiens
tccctcctgcagatagagaa

SEQ ID NO: 9206308 - DNA, 22 bp, Homo sapiens
catttacacttctaaccacaag

SEQ ID NO: 9206309 - DNA, 22 bp, Homo sapiens
catttacacacagaggtgtgct

SEQ ID NO: 9206310 - DNA, 22 bp, Homo sapiens
catttacacacagaggtgtgct

SEQ ID NO: 9206311 - DNA, 22 bp, Homo sapiens
catttacaatgtacaggttgtg

SEQ ID NO: 9206312 - DNA, 22 bp, Homo sapiens
catttacaatgtacaggttgtg

SEQ ID NO: 9206313 - DNA, 22 bp, Homo sapiens
cattgttgaacacctgctggat

SEQ ID NO: 9206314 - DNA, 22 bp, Homo sapiens
cattgtacagttattttaaaat

SEQ ID NO: 9206315 - DNA, 22 bp, Homo sapiens
cattacgagctctaaaatacta

SEQ ID NO: 9206316 - DNA, 21 bp, Homo sapiens
cattacatggttttagtgaac

SEQ ID NO: 9206317 - DNA, 22 bp, Homo sapiens
cattagattggtgcaaaaataa

SEQ ID NO: 9206318 - DNA, 22 bp, Homo sapiens
cattagaactaagatgtccagg

SEQ ID NO: 9206319 - DNA, 22 bp, Homo sapiens
cattagaacctataaaaagcat

SEQ ID NO: 9206320 - DNA, 22 bp, Homo sapiens
cattcttgaaccaggcactgtg

SEQ ID NO: 9206321 - DNA, 22 bp, Homo sapiens
tcccacattaccctgactgaca

SEQ ID NO: 9206322 - DNA, 22 bp, Homo sapiens
tcccacccatcctgcatctctt

SEQ ID NO: 9206323 - DNA, 22 bp, Homo sapiens
tcccaccccttgactctttaag

SEQ ID NO: 9206324 - DNA, 22 bp, Homo sapiens
tcccaccccggtcaagggctga

SEQ ID NO: 9206325 - DNA, 22 bp, Homo sapiens
tcccaccccctccaaggaggaa

SEQ ID NO: 9206326 - DNA, 19 bp, Homo sapiens
tccaggagcaaagccagtt

SEQ ID NO: 9206327 - DNA, 22 bp, Homo sapiens
tccaggagatacactgcaccag

SEQ ID NO: 9206328 - DNA, 22 bp, Homo sapiens
tccaggagcatccaggtgaagc

SEQ ID NO: 9206329 - DNA, 22 bp, Homo sapiens
catgggaggtctgcaaggtgct

SEQ ID NO: 9206330 - DNA, 22 bp, Homo sapiens
tccaggagatacactgcaccag

SEQ ID NO: 9206331 - DNA, 22 bp, Homo sapiens
tccaggagattcattaggtcat

SEQ ID NO: 9206332 - DNA, 22 bp, Homo sapiens
tccaggagaggcctgaccaggt

SEQ ID NO: 9206333 - DNA, 17 bp, Homo sapiens
tccaggagaggcaatgg

SEQ ID NO: 9206334 - DNA, 22 bp, Homo sapiens
tccattttagagatgaagaaac

SEQ ID NO: 9206335 - DNA, 22 bp, Homo sapiens
catgggcagttggcagggctca

SEQ ID NO: 9206336 - DNA, 22 bp, Homo sapiens
catggcagggctgtgggcaggt

SEQ ID NO: 9206337 - DNA, 22 bp, Homo sapiens
catggcaggaaggacatgcact

SEQ ID NO: 9206338 - DNA, 20 bp, Homo sapiens
tccagctgggaacagctgat

SEQ ID NO: 9206339 - DNA, 20 bp, Homo sapiens
tccagctgggaacagctgat

SEQ ID NO: 9206340 - DNA, 22 bp, Homo sapiens
tccaggagaaggccatccagcg

SEQ ID NO: 9206341 - DNA, 22 bp, Homo sapiens
tccaggagaaggccatccagcg

SEQ ID NO: 9206342 - DNA, 22 bp, Homo sapiens
catggccaaggatgctcaacca

SEQ ID NO: 9206343 - DNA, 22 bp, Homo sapiens
catggccacatctagctgcaag

SEQ ID NO: 9206344 - DNA, 22 bp, Homo sapiens
catggccagcccccagttcctc

SEQ ID NO: 9206345 - DNA, 22 bp, Homo sapiens
catggcaggaaaatgaacaggc

SEQ ID NO: 9206346 - DNA, 22 bp, Homo sapiens
catggcaggaaaatgaacaggc

SEQ ID NO: 9206347 - DNA, 22 bp, Homo sapiens
catggcaggaaggacatgcact

SEQ ID NO: 9206348 - DNA, 22 bp, Homo sapiens
catgaccccccaaggcctgcag

SEQ ID NO: 9206349 - DNA, 22 bp, Homo sapiens
catgacatcctgaagctgcaca

SEQ ID NO: 9206350 - DNA, 22 bp, Homo sapiens
catgcacacacgtgcatgtacg

SEQ ID NO: 9206351 - DNA, 22 bp, Homo sapiens
catgcacacacgtgcatgtacg

SEQ ID NO: 9206352 - DNA, 22 bp, Homo sapiens
catgcaggtctggagcttgggg

SEQ ID NO: 9206353 - DNA, 22 bp, Homo sapiens
catgcaggtctggagcttgggg

SEQ ID NO: 9206354 - DNA, 22 bp, Homo sapiens
catgcaggttatatgtgcttct

SEQ ID NO: 9206355 - DNA, 20 bp, Homo sapiens
tcagtgctcaggcaccaggt

SEQ ID NO: 9206356 - DNA, 22 bp, Homo sapiens
tcagtcccaaggtcctgaggtg

SEQ ID NO: 9206357 - DNA, 22 bp, Homo sapiens
tcagtccctcgcaccctgccat

SEQ ID NO: 9206358 - DNA, 22 bp, Homo sapiens
tcagtgcattctaccaaaaggc

SEQ ID NO: 9206359 - DNA, 22 bp, Homo sapiens
tcagtgcattgttcattgtagg

SEQ ID NO: 9206360 - DNA, 22 bp, Homo sapiens
tcagtcagtgcgcaagtggtta

SEQ ID NO: 9206361 - DNA, 22 bp, Homo sapiens
tcagtcaacataaatccaaggt

SEQ ID NO: 9206362 - DNA, 22 bp, Homo sapiens
tcagtcaatgccttcctgggca

SEQ ID NO: 9206363 - DNA, 22 bp, Homo sapiens
tcagtcaatgtgtcagctctcc

SEQ ID NO: 9206364 - DNA, 22 bp, Homo sapiens
tcagggagatttggggactcaa

SEQ ID NO: 9206365 - DNA, 22 bp, Homo sapiens
tcagggagggacctgaggctgg

SEQ ID NO: 9206366 - DNA, 22 bp, Homo sapiens
tcagggagtagtttgtgctatg

SEQ ID NO: 9206367 - DNA, 22 bp, Homo sapiens
catgaaaataacattgttgtga

SEQ ID NO: 9206368 - DNA, 22 bp, Homo sapiens
catgaagatcctgtatgttttt

SEQ ID NO: 9206369 - DNA, 22 bp, Homo sapiens
catgaacaccaggcatgaacaa

SEQ ID NO: 9206370 - DNA, 22 bp, Homo sapiens
catctgtagctccatgacaatt

SEQ ID NO: 9206371 - DNA, 19 bp, Homo sapiens
catctgtaaggacagaaac

SEQ ID NO: 9206372 - DNA, 22 bp, Homo sapiens
catctgggttctcagatggata

SEQ ID NO: 9206373 - DNA, 19 bp, Homo sapiens
catctggatgattctcctg

SEQ ID NO: 9206374 - DNA, 22 bp, Homo sapiens
tcaggctgtgggcactggccat

SEQ ID NO: 9206375 - DNA, 22 bp, Homo sapiens
tcaggctgtgtctttaaacaat

SEQ ID NO: 9206376 - DNA, 22 bp, Homo sapiens
tcaggctgttagccacctcctc

SEQ ID NO: 9206377 - DNA, 22 bp, Homo sapiens
tcagggagagtgacccatccac

SEQ ID NO: 9206378 - DNA, 22 bp, Homo sapiens
tcagggagaggtgagagcctgt

SEQ ID NO: 9206379 - DNA, 22 bp, Homo sapiens
tcaggctgtggctttgaccgca

SEQ ID NO: 9206380 - DNA, 22 bp, Homo sapiens
tcaggctgtggcttcagttctt

SEQ ID NO: 9206381 - DNA, 22 bp, Homo sapiens
tcaggctgtgggcactggccat

SEQ ID NO: 9206382 - DNA, 21 bp, Homo sapiens
tcaggctgtctgctggttcca

SEQ ID NO: 9206383 - DNA, 17 bp, Homo sapiens
tcaggctgtgcctggta

SEQ ID NO: 9206384 - DNA, 17 bp, Homo sapiens
tcaggctgtgcctggta

SEQ ID NO: 9206385 - DNA, 22 bp, Homo sapiens
tcaggctgcctatcagactgtg

SEQ ID NO: 9206386 - DNA, 22 bp, Homo sapiens
tcaggctgtatatcttgcactc

SEQ ID NO: 9206387 - DNA, 22 bp, Homo sapiens
tcaggctgcctatcagactgtg

SEQ ID NO: 9206388 - DNA, 22 bp, Homo sapiens
tcaggccccatcccagacttat

SEQ ID NO: 9206389 - DNA, 22 bp, Homo sapiens
tcaggcccttctcccaggactc

SEQ ID NO: 9206390 - DNA, 22 bp, Homo sapiens
catagaaaagagtaggtaatgt

SEQ ID NO: 9206391 - DNA, 22 bp, Homo sapiens
catagaaactgagacaaggatt

SEQ ID NO: 9206392 - DNA, 22 bp, Homo sapiens
catagaaatcaggtgagaatct

SEQ ID NO: 9206393 - DNA, 18 bp, Homo sapiens
cataattttctttcttta

SEQ ID NO: 9206394 - DNA, 22 bp, Homo sapiens
tcaggcccagagtcacggatcc

SEQ ID NO: 9206395 - DNA, 22 bp, Homo sapiens
tcaggcagagtggaagctgcaa

SEQ ID NO: 9206396 - DNA, 22 bp, Homo sapiens
tcaggccaggagatcagattga

SEQ ID NO: 9206397 - DNA, 18 bp, Homo sapiens
cataattttctttcttta

SEQ ID NO: 9206398 - DNA, 22 bp, Homo sapiens
cagttttggtcctttctaggta

SEQ ID NO: 9206399 - DNA, 22 bp, Homo sapiens
tcagatctggtgaagttatagt

SEQ ID NO: 9206400 - DNA, 23 bp, Homo sapiens
cataaaatattagtatggtagca

SEQ ID NO: 9206401 - DNA, 22 bp, Homo sapiens
tcagagttggcctttctgtatt

SEQ ID NO: 9206402 - DNA, 22 bp, Homo sapiens
tcagagtttctagtcaaatcca

SEQ ID NO: 9206403 - DNA, 22 bp, Homo sapiens
tcagagtttctgatttagtagg

SEQ ID NO: 9206404 - DNA, 22 bp, Homo sapiens
tcagaggagcaaaagaggggat

SEQ ID NO: 9206405 - DNA, 22 bp, Homo sapiens
cagttggtcttcccttggagca

SEQ ID NO: 9206406 - DNA, 22 bp, Homo sapiens
cagttggtgatgaggctagtag

SEQ ID NO: 9206407 - DNA, 22 bp, Homo sapiens
tcagagcaaattcctgtgagcc

SEQ ID NO: 9206408 - DNA, 22 bp, Homo sapiens
tcaatagcaatcaagccttcca

SEQ ID NO: 9206409 - DNA, 22 bp, Homo sapiens
cagttctggaggctccacatct

SEQ ID NO: 9206410 - DNA, 22 bp, Homo sapiens
cagttctggtttgcagatatat

SEQ ID NO: 9206411 - DNA, 22 bp, Homo sapiens
tcaatgaaagagcatgcatttt

SEQ ID NO: 9206412 - DNA, 22 bp, Homo sapiens
cccaggctcccaggtgggacaa

SEQ ID NO: 9206413 - DNA, 22 bp, Homo sapiens
tgccctgggctttgctatgact

SEQ ID NO: 9206414 - DNA, 22 bp, Homo sapiens
tgccctggggagcccagccagg

SEQ ID NO: 9206415 - DNA, 22 bp, Homo sapiens
tgccctggggagcccagccagg

SEQ ID NO: 9206416 - DNA, 22 bp, Homo sapiens
cccaggctcactgtccgcttcc

SEQ ID NO: 9206417 - DNA, 22 bp, Homo sapiens
cccaggctcactgtccgcttcc

SEQ ID NO: 9206418 - DNA, 22 bp, Homo sapiens
cccaggctcagactggcttgtt

SEQ ID NO: 9206419 - DNA, 22 bp, Homo sapiens
cccaggctcagactggcttgtt

SEQ ID NO: 9206420 - DNA, 22 bp, Homo sapiens
cccaggctcagactggcttgtt

SEQ ID NO: 9206421 - DNA, 22 bp, Homo sapiens
cccaggctagtatgatatcagt

SEQ ID NO: 9206422 - DNA, 22 bp, Homo sapiens
cccaggctagtatgatatcagt

SEQ ID NO: 9206423 - DNA, 19 bp, Homo sapiens
cccaggctacatggagagg

SEQ ID NO: 9206424 - DNA, 22 bp, Homo sapiens
cccaggctagaaaggccaacaa

SEQ ID NO: 9206425 - DNA, 22 bp, Homo sapiens
tgccatagcaatggtaagctga

SEQ ID NO: 9206426 - DNA, 22 bp, Homo sapiens
tgccatattattgagcatatta

SEQ ID NO: 9206427 - DNA, 22 bp, Homo sapiens
tgccatattgcaaagtgtctgc

SEQ ID NO: 9206428 - DNA, 22 bp, Homo sapiens
tgccatattgcaaagtgtctgc

SEQ ID NO: 9206429 - DNA, 22 bp, Homo sapiens
tgccagtgtggaactaggaaga

SEQ ID NO: 9206430 - DNA, 23 bp, Homo sapiens
cccaggctacaaattatgctctg

SEQ ID NO: 9206431 - DNA, 22 bp, Homo sapiens
cccaggcagtgtgtgcatgcgt

SEQ ID NO: 9206432 - DNA, 22 bp, Homo sapiens
tgcccagctgtcaaagtagata

SEQ ID NO: 9206433 - DNA, 22 bp, Homo sapiens
tgccaggagagtgcatgcaggg

SEQ ID NO: 9206434 - DNA, 22 bp, Homo sapiens
tgccaggaggaggtgggacaga

SEQ ID NO: 9206435 - DNA, 22 bp, Homo sapiens
tgccagcttcttacggctgcct

SEQ ID NO: 9206436 - DNA, 22 bp, Homo sapiens
tgccagcttctaaggacccagg

SEQ ID NO: 9206437 - DNA, 22 bp, Homo sapiens
tgccagcttgtggtcagaggct

SEQ ID NO: 9206438 - DNA, 22 bp, Homo sapiens
tgccagcttgtggtcagaggct

SEQ ID NO: 9206439 - DNA, 22 bp, Homo sapiens
tgccagcttttgactatcttag

SEQ ID NO: 9206440 - DNA, 22 bp, Homo sapiens
tgccagcttttgactatcttag

SEQ ID NO: 9206441 - DNA, 22 bp, Homo sapiens
tgccagctcctgcagctcctgt

SEQ ID NO: 9206442 - DNA, 22 bp, Homo sapiens
tgccagctgacagcagagacaa

SEQ ID NO: 9206443 - DNA, 21 bp, Homo sapiens
tgccagctgctgcatctgtct

SEQ ID NO: 9206444 - DNA, 22 bp, Homo sapiens
tgcacagagagatgagacacgt

SEQ ID NO: 9206445 - DNA, 22 bp, Homo sapiens
tgcacagagggaggcataaaat

SEQ ID NO: 9206446 - DNA, 19 bp, Homo sapiens
tgccacagataaaaactga

SEQ ID NO: 9206447 - DNA, 22 bp, Homo sapiens
tgccacagaggtgaagcccact

SEQ ID NO: 9206448 - DNA, 22 bp, Homo sapiens
tgccagctccgaggagctgcag

SEQ ID NO: 9206449 - DNA, 22 bp, Homo sapiens
tgccagctcccttttctcctcc

SEQ ID NO: 9206450 - DNA, 22 bp, Homo sapiens
tgccacagcagtgctttgacag

SEQ ID NO: 9206451 - DNA, 22 bp, Homo sapiens
tgccagctccgaggagctgcag

SEQ ID NO: 9206452 - DNA, 22 bp, Homo sapiens
tgccaggagtgtagagtggttt

SEQ ID NO: 9206453 - DNA, 22 bp, Homo sapiens
tgccaggatataagagtgcgat

SEQ ID NO: 9206454 - DNA, 22 bp, Homo sapiens
cccaggagacatatagaaggac

SEQ ID NO: 9206455 - DNA, 22 bp, Homo sapiens
cccaggagacctgtgaaaggac

SEQ ID NO: 9206456 - DNA, 22 bp, Homo sapiens
cccaggagagaggggataaagc

SEQ ID NO: 9206457 - DNA, 22 bp, Homo sapiens
cccaggagagaggccagttggc

SEQ ID NO: 9206458 - DNA, 22 bp, Homo sapiens
cccaggagagaggccagttggc

SEQ ID NO: 9206459 - DNA, 22 bp, Homo sapiens
tgccaggctaagtggaggactt

SEQ ID NO: 9206460 - DNA, 22 bp, Homo sapiens
cccaggctggagggcagtgtca

SEQ ID NO: 9206461 - DNA, 22 bp, Homo sapiens
cccaggctggagggcagtgtca

SEQ ID NO: 9206462 - DNA, 22 bp, Homo sapiens
cccaggctggagtgcaatggca

SEQ ID NO: 9206463 - DNA, 22 bp, Homo sapiens
cccaggctggagtgcaatggca

SEQ ID NO: 9206464 - DNA, 22 bp, Homo sapiens
cccaggctggagtgcaatggca

SEQ ID NO: 9206465 - DNA, 22 bp, Homo sapiens
cccaggctggagtgcagtggcg

SEQ ID NO: 9206466 - DNA, 22 bp, Homo sapiens
cccaggctggagtgcagtggcg

SEQ ID NO: 9206467 - DNA, 22 bp, Homo sapiens
cccaggctggagtgcagtggcg

SEQ ID NO: 9206468 - DNA, 22 bp, Homo sapiens
cccaggctggagtgcaatggtg

SEQ ID NO: 9206469 - DNA, 22 bp, Homo sapiens
cccaggctggagtgcaatggtg

SEQ ID NO: 9206470 - DNA, 22 bp, Homo sapiens
cccaggctggagtgcaatggtg

SEQ ID NO: 9206471 - DNA, 22 bp, Homo sapiens
cccaggctggaattccaggcct

SEQ ID NO: 9206472 - DNA, 22 bp, Homo sapiens
cccaggctggaattccaggcct

SEQ ID NO: 9206473 - DNA, 22 bp, Homo sapiens
cccaggctggagggcagtgtca

SEQ ID NO: 9206474 - DNA, 22 bp, Homo sapiens
tgccctggtgaagtgctctcct

SEQ ID NO: 9206475 - DNA, 22 bp, Homo sapiens
cccaggctggatttcggtggca

SEQ ID NO: 9206476 - DNA, 22 bp, Homo sapiens
cccaggctggatttcggtggca

SEQ ID NO: 9206477 - DNA, 22 bp, Homo sapiens
cccaggctggcactgctgaagt

SEQ ID NO: 9206478 - DNA, 22 bp, Homo sapiens
cccaggctggcactgctgaagt

SEQ ID NO: 9206479 - DNA, 22 bp, Homo sapiens
cccaggctggagtgtaatggtg

SEQ ID NO: 9206480 - DNA, 22 bp, Homo sapiens
cccaggctggagtgtaatggtg

SEQ ID NO: 9206481 - DNA, 22 bp, Homo sapiens
cccaggctggcactgctgaagt

SEQ ID NO: 9206482 - DNA, 22 bp, Homo sapiens
cccaggctggcactgctgaagt

SEQ ID NO: 9206483 - DNA, 22 bp, Homo sapiens
cccaggctggcctccgcagtgc

SEQ ID NO: 9206484 - DNA, 22 bp, Homo sapiens
cccaggctggggctcctccagc

SEQ ID NO: 9206485 - DNA, 22 bp, Homo sapiens
cccaggctggggctcctccagc

SEQ ID NO: 9206486 - DNA, 22 bp, Homo sapiens
cccaggctgggaacgattctag

SEQ ID NO: 9206487 - DNA, 22 bp, Homo sapiens
cccagggaatgactctggcctt

SEQ ID NO: 9206488 - DNA, 22 bp, Homo sapiens
cccagggaagggctacctgagg

SEQ ID NO: 9206489 - DNA, 21 bp, Homo sapiens
cccagggaagccgcagtcacc

SEQ ID NO: 9206490 - DNA, 22 bp, Homo sapiens
cccaggctggtcctgaactcct

SEQ ID NO: 9206491 - DNA, 22 bp, Homo sapiens
cccaggctggtcctgaactcct

SEQ ID NO: 9206492 - DNA, 22 bp, Homo sapiens
tgcctgttgcccacctgataaa

SEQ ID NO: 9206493 - DNA, 22 bp, Homo sapiens
tgcctgttattgttggcttagt

SEQ ID NO: 9206494 - DNA, 22 bp, Homo sapiens
tgccttcctgctttgagttctg

SEQ ID NO: 9206495 - DNA, 22 bp, Homo sapiens
cccagggacagatgggcagcta

SEQ ID NO: 9206496 - DNA, 22 bp, Homo sapiens
cccagggtaatcatgtgaagcc

SEQ ID NO: 9206497 - DNA, 23 bp, Homo sapiens
cccaggtagccctctagagcctg

SEQ ID NO: 9206498 - DNA, 20 bp, Homo sapiens
cccaggtaggtgccatgagt

SEQ ID NO: 9206499 - DNA, 19 bp, Homo sapiens
cccagggtttcctctctcc

SEQ ID NO: 9206500 - DNA, 22 bp, Homo sapiens
cccaggtaaggatgctcctcat

SEQ ID NO: 9206501 - DNA, 19 bp, Homo sapiens
cccagggtttcctctctcc

SEQ ID NO: 9206502 - DNA, 22 bp, Homo sapiens
cccagggtggatgcaagcagca

SEQ ID NO: 9206503 - DNA, 22 bp, Homo sapiens
cccagggtggatgcaagcagca

SEQ ID NO: 9206504 - DNA, 22 bp, Homo sapiens
cccagggttgcctgcctctgct

SEQ ID NO: 9206505 - DNA, 22 bp, Homo sapiens
cccagggttgcctgcctctgct

SEQ ID NO: 9206506 - DNA, 22 bp, Homo sapiens
cccagggtccggataaccctgg

SEQ ID NO: 9206507 - DNA, 22 bp, Homo sapiens
cccagggtccctgctctctgtg

SEQ ID NO: 9206508 - DNA, 22 bp, Homo sapiens
cccagggtgcggccctggctgg

SEQ ID NO: 9206509 - DNA, 22 bp, Homo sapiens
cccagggtgctaattaaatatg

SEQ ID NO: 9206510 - DNA, 22 bp, Homo sapiens
cccagggtagctgagctggcag

SEQ ID NO: 9206511 - DNA, 22 bp, Homo sapiens
cccagggtccctgctctctgtg

SEQ ID NO: 9206512 - DNA, 22 bp, Homo sapiens
cccagggtccctgctctctgtg

SEQ ID NO: 9206513 - DNA, 22 bp, Homo sapiens
cccagggtagctgagctggcag

SEQ ID NO: 9206514 - DNA, 18 bp, Homo sapiens
ccctctcctgctagtggg

SEQ ID NO: 9206515 - DNA, 22 bp, Homo sapiens
ccctctcagtcagagccagata

SEQ ID NO: 9206516 - DNA, 22 bp, Homo sapiens
ccctcttgctgactcttaaagg

SEQ ID NO: 9206517 - DNA, 19 bp, Homo sapiens
ccctcttgcacaaagcaaa

SEQ ID NO: 9206518 - DNA, 22 bp, Homo sapiens
ccctctctcaggctgacagcct

SEQ ID NO: 9206519 - DNA, 22 bp, Homo sapiens
ccctctctcaggctgacagcct

SEQ ID NO: 9206520 - DNA, 22 bp, Homo sapiens
ccctgaacaaagcccaggctct

SEQ ID NO: 9206521 - DNA, 22 bp, Homo sapiens
ccctgagaagatcattgccacg

SEQ ID NO: 9206522 - DNA, 20 bp, Homo sapiens
ccctgagacgactgagctcc

SEQ ID NO: 9206523 - DNA, 20 bp, Homo sapiens
ccctgagacgactgagctcc

SEQ ID NO: 9206524 - DNA, 20 bp, Homo sapiens
ccctgagaccagagagcagc

SEQ ID NO: 9206525 - DNA, 20 bp, Homo sapiens
ccctgagacaaaggaggggc

SEQ ID NO: 9206526 - DNA, 20 bp, Homo sapiens
ccctgagacaaaggaggggc

SEQ ID NO: 9206527 - DNA, 22 bp, Homo sapiens
ccctgagagtgagtgccacctt

SEQ ID NO: 9206528 - DNA, 22 bp, Homo sapiens
ccctgagagtgagtgccacctt

SEQ ID NO: 9206529 - DNA, 22 bp, Homo sapiens
ccctgagatgcctcaccctagt

SEQ ID NO: 9206530 - DNA, 22 bp, Homo sapiens
ccctgagatgcctcaccctagt

SEQ ID NO: 9206531 - DNA, 22 bp, Homo sapiens
ccctgagcccatagttgacatt

SEQ ID NO: 9206532 - DNA, 22 bp, Homo sapiens
tggagcaggactgctgccctca

SEQ ID NO: 9206533 - DNA, 22 bp, Homo sapiens
tggagcaagctggagagaacat

SEQ ID NO: 9206534 - DNA, 22 bp, Homo sapiens
tggaagggagctggaatttgga

SEQ ID NO: 9206535 - DNA, 22 bp, Homo sapiens
tggaagggagctggaatttgga

SEQ ID NO: 9206536 - DNA, 22 bp, Homo sapiens
tggaatggaaacaaactgagga

SEQ ID NO: 9206537 - DNA, 18 bp, Homo sapiens
cccggctaatttttggta

SEQ ID NO: 9206538 - DNA, 22 bp, Homo sapiens
tgctgtggattcagagatgaaa

SEQ ID NO: 9206539 - DNA, 22 bp, Homo sapiens
tgctgtggttcccagagtggat

SEQ ID NO: 9206540 - DNA, 22 bp, Homo sapiens
tggaatggggactttgggacat

SEQ ID NO: 9206541 - DNA, 22 bp, Homo sapiens
ccctcctctccctaagagtcac

SEQ ID NO: 9206542 - DNA, 22 bp, Homo sapiens
tgctggccaagcagaggtcaat

SEQ ID NO: 9206543 - DNA, 22 bp, Homo sapiens
ccccacccacctaagagaaact

SEQ ID NO: 9206544 - DNA, 22 bp, Homo sapiens
ccccaccctcgctccatttcgg

SEQ ID NO: 9206545 - DNA, 21 bp, Homo sapiens
tgctggccatgtgctgggcat

SEQ ID NO: 9206546 - DNA, 21 bp, Homo sapiens
tgctggccatgtgctgggcat

SEQ ID NO: 9206547 - DNA, 22 bp, Homo sapiens
tgctggccaatggcagaggcgg

SEQ ID NO: 9206548 - DNA, 22 bp, Homo sapiens
ccccaccagcaccctctctatc

SEQ ID NO: 9206549 - DNA, 22 bp, Homo sapiens
ccccacacctgccgggcagcag

SEQ ID NO: 9206550 - DNA, 22 bp, Homo sapiens
ccccaaggtgctcactgtctgg

SEQ ID NO: 9206551 - DNA, 20 bp, Homo sapiens
ccccacactattgagcactt

SEQ ID NO: 9206552 - DNA, 22 bp, Homo sapiens
ccccacagcttgtggagagaat

SEQ ID NO: 9206553 - DNA, 22 bp, Homo sapiens
ccccacaggtgtctgaggcagg

SEQ ID NO: 9206554 - DNA, 22 bp, Homo sapiens
ccccacagtccgtgaggagcca

SEQ ID NO: 9206555 - DNA, 16 bp, Homo sapiens
cccaggtatccaaggg

SEQ ID NO: 9206556 - DNA, 22 bp, Homo sapiens
cccaggtccccacctgtctgct

SEQ ID NO: 9206557 - DNA, 22 bp, Homo sapiens
cccaggtagttggaagagacaa

SEQ ID NO: 9206558 - DNA, 21 bp, Homo sapiens
cccaggtcgtggtcttcccag

SEQ ID NO: 9206559 - DNA, 22 bp, Homo sapiens
cccaggtctccctgcagccctg

SEQ ID NO: 9206560 - DNA, 22 bp, Homo sapiens
cccagttgttgccggctctgga

SEQ ID NO: 9206561 - DNA, 22 bp, Homo sapiens
cccagttgttgccggctctgga

SEQ ID NO: 9206562 - DNA, 22 bp, Homo sapiens
cccattccctttactgttgcat

SEQ ID NO: 9206563 - DNA, 22 bp, Homo sapiens
cccattcatcctcgcttccttc

SEQ ID NO: 9206564 - DNA, 22 bp, Homo sapiens
cccattcatcctcgcttccttc

SEQ ID NO: 9206565 - DNA, 21 bp, Homo sapiens
tgctggccatgtgctgggcat

SEQ ID NO: 9206566 - DNA, 22 bp, Homo sapiens
tgctggccggccaggtgctgag

SEQ ID NO: 9206567 - DNA, 22 bp, Homo sapiens
tgctggcccatgaagacgcagt

SEQ ID NO: 9206568 - DNA, 22 bp, Homo sapiens
tgctggccctggctcagggaac

SEQ ID NO: 9206569 - DNA, 22 bp, Homo sapiens
tgctggcctcggcgctgggcct

SEQ ID NO: 9206570 - DNA, 22 bp, Homo sapiens
tgctggcctcggcgctgggcct

SEQ ID NO: 9206571 - DNA, 22 bp, Homo sapiens
tgctggcctggttagaaagggg

SEQ ID NO: 9206572 - DNA, 22 bp, Homo sapiens
tgctggcctcggcgctgggcct

SEQ ID NO: 9206573 - DNA, 23 bp, Homo sapiens
tgctggctaagaatctgcatttt

SEQ ID NO: 9206574 - DNA, 22 bp, Homo sapiens
tgctggcctgtccacgggctgt

SEQ ID NO: 9206575 - DNA, 22 bp, Homo sapiens
tgctggctacattattgctgtc

SEQ ID NO: 9206576 - DNA, 22 bp, Homo sapiens
tgctggctaatggaaaccagat

SEQ ID NO: 9206577 - DNA, 23 bp, Homo sapiens
tgctggctaagaatctgcatttt

SEQ ID NO: 9206578 - DNA, 22 bp, Homo sapiens
tgctggctttaaggttaaagtg

SEQ ID NO: 9206579 - DNA, 22 bp, Homo sapiens
tgctggctttaaggttaaagtg

SEQ ID NO: 9206580 - DNA, 22 bp, Homo sapiens
tgctggctttagtgattggggt

SEQ ID NO: 9206581 - DNA, 23 bp, Homo sapiens
tgctggcttttatctggtcccta

SEQ ID NO: 9206582 - DNA, 23 bp, Homo sapiens
tgctggcttttatctggtcccta

SEQ ID NO: 9206583 - DNA, 22 bp, Homo sapiens
tgctggcttttccttcaggcag

SEQ ID NO: 9206584 - DNA, 22 bp, Homo sapiens
tgctggcttttccttcaggcag

SEQ ID NO: 9206585 - DNA, 22 bp, Homo sapiens
tgctggctttgcgagatgcatt

SEQ ID NO: 9206586 - DNA, 22 bp, Homo sapiens
tgctggctttctgtccctggca

SEQ ID NO: 9206587 - DNA, 22 bp, Homo sapiens
tgctggctttctgtccctggca

SEQ ID NO: 9206588 - DNA, 22 bp, Homo sapiens
tgctggctttttgtgtcaaaga

SEQ ID NO: 9206589 - DNA, 22 bp, Homo sapiens
tgctggctttttggtccttgct

SEQ ID NO: 9206590 - DNA, 22 bp, Homo sapiens
tgctggctttttggtccttgct

SEQ ID NO: 9206591 - DNA, 22 bp, Homo sapiens
cccctcttggcattgagtgcca

SEQ ID NO: 9206592 - DNA, 22 bp, Homo sapiens
ccccttccttcctcagacagcc

SEQ ID NO: 9206593 - DNA, 22 bp, Homo sapiens
cccggccccgtggcaggtaacg

SEQ ID NO: 9206594 - DNA, 22 bp, Homo sapiens
cctcagaggtgtggcatctctg

SEQ ID NO: 9206595 - DNA, 19 bp, Homo sapiens
cctaggcattgtccaaggg

SEQ ID NO: 9206596 - DNA, 22 bp, Homo sapiens
cctaggcacccgagttatgttc

SEQ ID NO: 9206597 - DNA, 19 bp, Homo sapiens
cctagagcagtacctggta

SEQ ID NO: 9206598 - DNA, 22 bp, Homo sapiens
cctagagccgcacctcctccac

SEQ ID NO: 9206599 - DNA, 22 bp, Homo sapiens
cctagagctctgctttatctaa

SEQ ID NO: 9206600 - DNA, 22 bp, Homo sapiens
cctagagctctgctttatctaa

SEQ ID NO: 9206601 - DNA, 22 bp, Homo sapiens
cctagaggctgcaaggagaggc

SEQ ID NO: 9206602 - DNA, 22 bp, Homo sapiens
cctagatgggatggcggccggg

SEQ ID NO: 9206603 - DNA, 19 bp, Homo sapiens
cctagagggaaggcaggac

SEQ ID NO: 9206604 - DNA, 22 bp, Homo sapiens
tggcagaggtaattcaaatccc

SEQ ID NO: 9206605 - DNA, 22 bp, Homo sapiens
cctaagaattaatgaatacacc

SEQ ID NO: 9206606 - DNA, 22 bp, Homo sapiens
ccctgcagccttgcatgccttc

SEQ ID NO: 9206607 - DNA, 22 bp, Homo sapiens
ccctgcagccttgcatgccttc

SEQ ID NO: 9206608 - DNA, 22 bp, Homo sapiens
tggagcagggcatcactgtgcg

SEQ ID NO: 9206609 - DNA, 21 bp, Homo sapiens
ccctgcaggccagggctgagc

SEQ ID NO: 9206610 - DNA, 22 bp, Homo sapiens
ccctgcaggctcagactggagt

SEQ ID NO: 9206611 - DNA, 22 bp, Homo sapiens
ccctgcaggggacctgcagcct

SEQ ID NO: 9206612 - DNA, 22 bp, Homo sapiens
tggcagaggagaattaagatta

SEQ ID NO: 9206613 - DNA, 22 bp, Homo sapiens
cccttctctttcactcactatt

SEQ ID NO: 9206614 - DNA, 22 bp, Homo sapiens
cccttccttgtgactggtgggg

SEQ ID NO: 9206615 - DNA, 21 bp, Homo sapiens
cccttcttgggtcaaagtata

SEQ ID NO: 9206616 - DNA, 22 bp, Homo sapiens
cctcagcatcctcatgctcagt

SEQ ID NO: 9206617 - DNA, 22 bp, Homo sapiens
cctcagcatcctcctgctcagt

SEQ ID NO: 9206618 - DNA, 22 bp, Homo sapiens
cctcagagtaggtctcagctgt

SEQ ID NO: 9206619 - DNA, 22 bp, Homo sapiens
cctcagagtaggtctcagctgt

SEQ ID NO: 9206620 - DNA, 17 bp, Homo sapiens
cctcagcttctttcctc

SEQ ID NO: 9206621 - DNA, 20 bp, Homo sapiens
tggcccagcacgacgaggac

SEQ ID NO: 9206622 - DNA, 22 bp, Homo sapiens
tggcccagagcactgctgggca

SEQ ID NO: 9206623 - DNA, 22 bp, Homo sapiens
tggcccagatctctgaccttga

SEQ ID NO: 9206624 - DNA, 22 bp, Homo sapiens
cctcaggcttacgggcaatgga

SEQ ID NO: 9206625 - DNA, 22 bp, Homo sapiens
cctcaggcctgccagagcccca

SEQ ID NO: 9206626 - DNA, 22 bp, Homo sapiens
cctcaggctagctactgtccct

SEQ ID NO: 9206627 - DNA, 22 bp, Homo sapiens
cctcaggctgggctgcccctgg

SEQ ID NO: 9206628 - DNA, 22 bp, Homo sapiens
cctcattaacacaatgtcattt

SEQ ID NO: 9206629 - DNA, 22 bp, Homo sapiens
cctcattaacacaatgtcattt

SEQ ID NO: 9206630 - DNA, 22 bp, Homo sapiens
tggcctggctgccctgtctgga

SEQ ID NO: 9206631 - DNA, 22 bp, Homo sapiens
cctccaagctggtcctctgtgt

SEQ ID NO: 9206632 - DNA, 22 bp, Homo sapiens
cctccaaggctgagttaatgaa

SEQ ID NO: 9206633 - DNA, 22 bp, Homo sapiens
cctccaagcttcatctcaacca

SEQ ID NO: 9206634 - DNA, 22 bp, Homo sapiens
cctccaaggtgagagaggatgg

SEQ ID NO: 9206635 - DNA, 22 bp, Homo sapiens
cctccaagtgagagatggtaca

SEQ ID NO: 9206636 - DNA, 18 bp, Homo sapiens
cctccaagtccccagcct

SEQ ID NO: 9206637 - DNA, 22 bp, Homo sapiens
tggctctggtgcgggctcctgc

SEQ ID NO: 9206638 - DNA, 22 bp, Homo sapiens
tggctctgtcaaactgcacaca

SEQ ID NO: 9206639 - DNA, 21 bp, Homo sapiens
tggctctgggtaggagagtgc

SEQ ID NO: 9206640 - DNA, 22 bp, Homo sapiens
tggctctggtaacattgggtag

SEQ ID NO: 9206641 - DNA, 22 bp, Homo sapiens
tggctctgaccaggtagaggag

SEQ ID NO: 9206642 - DNA, 22 bp, Homo sapiens
tggcctggggaagaccatgggc

SEQ ID NO: 9206643 - DNA, 22 bp, Homo sapiens
tggcctgggccggcagatatac

SEQ ID NO: 9206644 - DNA, 22 bp, Homo sapiens
tggcctgggcatgaagcatcgt

SEQ ID NO: 9206645 - DNA, 17 bp, Homo sapiens
cctcttcctctcagctg

SEQ ID NO: 9206646 - DNA, 19 bp, Homo sapiens
cctcttcctctgacactat

SEQ ID NO: 9206647 - DNA, 22 bp, Homo sapiens
cctcttctaggacgtccttgtg

SEQ ID NO: 9206648 - DNA, 19 bp, Homo sapiens
tgggagtggggaaggtcct

SEQ ID NO: 9206649 - DNA, 22 bp, Homo sapiens
tgggagtgttcttggcttgctt

SEQ ID NO: 9206650 - DNA, 18 bp, Homo sapiens
tgggagtgggagtggata

SEQ ID NO: 9206651 - DNA, 22 bp, Homo sapiens
cctgagattggctagtatgagt

SEQ ID NO: 9206652 - DNA, 22 bp, Homo sapiens
cctgagatttcattgtctggcc

SEQ ID NO: 9206653 - DNA, 22 bp, Homo sapiens
cctgagcctgagtggtgcaggg

SEQ ID NO: 9206654 - DNA, 22 bp, Homo sapiens
tgggctgctgttacaggggctg

SEQ ID NO: 9206655 - DNA, 22 bp, Homo sapiens
cctgagctcaaagggtgcctgg

SEQ ID NO: 9206656 - DNA, 22 bp, Homo sapiens
tgggccccagcacgtctgggga

SEQ ID NO: 9206657 - DNA, 22 bp, Homo sapiens
tgggcccatcattgctgtgggc

SEQ ID NO: 9206658 - DNA, 22 bp, Homo sapiens
tgggcccatcattgctgtgggc

SEQ ID NO: 9206659 - DNA, 21 bp, Homo sapiens
tgggcccagctctgtctgttt

SEQ ID NO: 9206660 - DNA, 22 bp, Homo sapiens
tgggcccaagtgcaatgcagtg

SEQ ID NO: 9206661 - DNA, 22 bp, Homo sapiens
tgggcccaggtcctgggagaag

SEQ ID NO: 9206662 - DNA, 22 bp, Homo sapiens
tgggaaggacgtgtcagtggca

SEQ ID NO: 9206663 - DNA, 22 bp, Homo sapiens
tgggaaggacgtgtcagtggca

SEQ ID NO: 9206664 - DNA, 22 bp, Homo sapiens
tgggaaggaactgcctttagct

SEQ ID NO: 9206665 - DNA, 22 bp, Homo sapiens
tgggaagctgcattttaacaag

SEQ ID NO: 9206666 - DNA, 22 bp, Homo sapiens
cctctgcctgcacatcatcctg

SEQ ID NO: 9206667 - DNA, 22 bp, Homo sapiens
cctctgcctgcacatcatcctg

SEQ ID NO: 9206668 - DNA, 22 bp, Homo sapiens
tggcttccactgtgtgccccct

SEQ ID NO: 9206669 - DNA, 22 bp, Homo sapiens
tggcttccaaattatccctaga

SEQ ID NO: 9206670 - DNA, 22 bp, Homo sapiens
tggcttccagaactgagcaaca

SEQ ID NO: 9206671 - DNA, 22 bp, Homo sapiens
tggcttccagtaatcaggattt

SEQ ID NO: 9206672 - DNA, 22 bp, Homo sapiens
cctctgctccctggtgtctgag

SEQ ID NO: 9206673 - DNA, 22 bp, Homo sapiens
cctctgctgctgttgagcaccg

SEQ ID NO: 9206674 - DNA, 19 bp, Homo sapiens
cctctgcgctgtcctgctc

SEQ ID NO: 9206675 - DNA, 20 bp, Homo sapiens
cctctgcctttctagtctga

SEQ ID NO: 9206676 - DNA, 22 bp, Homo sapiens
tggctgagaccatcagggtgta

SEQ ID NO: 9206677 - DNA, 22 bp, Homo sapiens
tggctgagaccatcagggtgta

SEQ ID NO: 9206678 - DNA, 22 bp, Homo sapiens
tggctgctagccagagcttcag

SEQ ID NO: 9206679 - DNA, 16 bp, Homo sapiens
tggctgagagagggtt

SEQ ID NO: 9206680 - DNA, 22 bp, Homo sapiens
tggctgagagaagacggggaag

SEQ ID NO: 9206681 - DNA, 22 bp, Homo sapiens
tggcttcattctcctgtgaata

SEQ ID NO: 9206682 - DNA, 22 bp, Homo sapiens
tggctggctgtcaaggaaagcc

SEQ ID NO: 9206683 - DNA, 22 bp, Homo sapiens
ccaggctggagtgcaatggcgt

SEQ ID NO: 9206684 - DNA, 22 bp, Homo sapiens
ccaggctggagtgcaatggtgc

SEQ ID NO: 9206685 - DNA, 22 bp, Homo sapiens
ccaggctggagtgcaatggcat

SEQ ID NO: 9206686 - DNA, 22 bp, Homo sapiens
ccaggctgctgttggtgtccgc

SEQ ID NO: 9206687 - DNA, 22 bp, Homo sapiens
tctttggggcatctgggagatt

SEQ ID NO: 9206688 - DNA, 21 bp, Homo sapiens
ccaggctcctgaggctggtca

SEQ ID NO: 9206689 - DNA, 22 bp, Homo sapiens
ccaggctctgcgctggacatgg

SEQ ID NO: 9206690 - DNA, 22 bp, Homo sapiens
ccaggctctgtctggtcagaag

SEQ ID NO: 9206691 - DNA, 21 bp, Homo sapiens
ccaggctcctgaggctggtca

SEQ ID NO: 9206692 - DNA, 21 bp, Homo sapiens
ccaggctcctgaggctggtca

SEQ ID NO: 9206693 - DNA, 22 bp, Homo sapiens
ccaggcctggaccatgccaggg

SEQ ID NO: 9206694 - DNA, 22 bp, Homo sapiens
ccaggcctggaccatgccaggg

SEQ ID NO: 9206695 - DNA, 22 bp, Homo sapiens
ccaggcctggacgggtggcctg

SEQ ID NO: 9206696 - DNA, 22 bp, Homo sapiens
ccaggctctgtgtgggctagag

SEQ ID NO: 9206697 - DNA, 22 bp, Homo sapiens
ccaggctgaatatgttccaggg

SEQ ID NO: 9206698 - DNA, 22 bp, Homo sapiens
ccaggctgaatatgttccaggg

SEQ ID NO: 9206699 - DNA, 22 bp, Homo sapiens
ccaggctgaatatgttccaggg

SEQ ID NO: 9206700 - DNA, 22 bp, Homo sapiens
ccaggccagtgtttggtccagg

SEQ ID NO: 9206701 - DNA, 22 bp, Homo sapiens
ccaggccaggagagcgaggttt

SEQ ID NO: 9206702 - DNA, 22 bp, Homo sapiens
ccaggccagtgtttggtccagg

SEQ ID NO: 9206703 - DNA, 22 bp, Homo sapiens
ccaggccagtgtttggtccagg

SEQ ID NO: 9206704 - DNA, 22 bp, Homo sapiens
ccaggccagggctgcagcgagc

SEQ ID NO: 9206705 - DNA, 22 bp, Homo sapiens
ccaggcccaccttggccactta

SEQ ID NO: 9206706 - DNA, 22 bp, Homo sapiens
ccaggcctgcatctgctgcgca

SEQ ID NO: 9206707 - DNA, 19 bp, Homo sapiens
ccaggcctgcgggcgttgg

SEQ ID NO: 9206708 - DNA, 22 bp, Homo sapiens
tctttcttggtataaagcaggg

SEQ ID NO: 9206709 - DNA, 22 bp, Homo sapiens
tctttcttggtataaagcaggg

SEQ ID NO: 9206710 - DNA, 22 bp, Homo sapiens
tctttcttggtattctgagcta

SEQ ID NO: 9206711 - DNA, 22 bp, Homo sapiens
tctttcttattatgctcaatgt

SEQ ID NO: 9206712 - DNA, 22 bp, Homo sapiens
tctttcttcctggagcccaaca

SEQ ID NO: 9206713 - DNA, 22 bp, Homo sapiens
tctttcttgcaaggatgcagga

SEQ ID NO: 9206714 - DNA, 22 bp, Homo sapiens
ccaggaggttgaggctgcagtg

SEQ ID NO: 9206715 - DNA, 22 bp, Homo sapiens
ccaggagtcaataaaggaagct

SEQ ID NO: 9206716 - DNA, 22 bp, Homo sapiens
tcttcactgatgtctctcaaat

SEQ ID NO: 9206717 - DNA, 22 bp, Homo sapiens
tcttcacatggaacatgaagct

SEQ ID NO: 9206718 - DNA, 22 bp, Homo sapiens
ccaggatctgatattgggctcc

SEQ ID NO: 9206719 - DNA, 22 bp, Homo sapiens
ccaggatactgctctctgctgc

SEQ ID NO: 9206720 - DNA, 22 bp, Homo sapiens
ccaggatctgtacacctctgag

SEQ ID NO: 9206721 - DNA, 22 bp, Homo sapiens
ccaggatctgggtccatgggac

SEQ ID NO: 9206722 - DNA, 22 bp, Homo sapiens
ccaggagttggaggctgcagtg

SEQ ID NO: 9206723 - DNA, 22 bp, Homo sapiens
ccaggagtttgaggctgcagtg

SEQ ID NO: 9206724 - DNA, 22 bp, Homo sapiens
tcttccagtctgtaggactagg

SEQ ID NO: 9206725 - DNA, 22 bp, Homo sapiens
tcttccagtctgtaggactagg

SEQ ID NO: 9206726 - DNA, 19 bp, Homo sapiens
tcttccagtcacataacaa

SEQ ID NO: 9206727 - DNA, 22 bp, Homo sapiens
tcttccaggtatgtttctagtt

SEQ ID NO: 9206728 - DNA, 20 bp, Homo sapiens
tcttccaggtacagtctgca

SEQ ID NO: 9206729 - DNA, 22 bp, Homo sapiens
tcttccagtgctgtgtagagct

SEQ ID NO: 9206730 - DNA, 22 bp, Homo sapiens
tcttccagtgctgtgtagagct

SEQ ID NO: 9206731 - DNA, 22 bp, Homo sapiens
tcttccagtgtagacatctgcc

SEQ ID NO: 9206732 - DNA, 22 bp, Homo sapiens
tcttccagtgtagacatctgcc

SEQ ID NO: 9206733 - DNA, 22 bp, Homo sapiens
tcttcccaatgcaaagtaggac

SEQ ID NO: 9206734 - DNA, 22 bp, Homo sapiens
tcttcccagaggaggtgccagc

SEQ ID NO: 9206735 - DNA, 22 bp, Homo sapiens
tcttcccagctgctgcgatgcc

SEQ ID NO: 9206736 - DNA, 22 bp, Homo sapiens
ccaggccagcaggcacacctgc

SEQ ID NO: 9206737 - DNA, 22 bp, Homo sapiens
ccaggccagagtgcagtggcac

SEQ ID NO: 9206738 - DNA, 22 bp, Homo sapiens
ccaggccagagtgcagtggcac

SEQ ID NO: 9206739 - DNA, 22 bp, Homo sapiens
ccaggccagagtgcagtggcac

SEQ ID NO: 9206740 - DNA, 22 bp, Homo sapiens
tcttcctagttacatatgcaca

SEQ ID NO: 9206741 - DNA, 22 bp, Homo sapiens
ccaggcaggcgatggtgcagtg

SEQ ID NO: 9206742 - DNA, 22 bp, Homo sapiens
tcttcctagaaggaagaaatct

SEQ ID NO: 9206743 - DNA, 22 bp, Homo sapiens
tcttcccccgtgctccagtgca

SEQ ID NO: 9206744 - DNA, 21 bp, Homo sapiens
tcttcccattatgttccaatt

SEQ ID NO: 9206745 - DNA, 22 bp, Homo sapiens
tcttcccattagtaatgaagtg

SEQ ID NO: 9206746 - DNA, 21 bp, Homo sapiens
tcttccctcaggatgtcctgc

SEQ ID NO: 9206747 - DNA, 22 bp, Homo sapiens
ccagctctgcagggcctggggt

SEQ ID NO: 9206748 - DNA, 22 bp, Homo sapiens
ccagctctgcatgtttcccttg

SEQ ID NO: 9206749 - DNA, 22 bp, Homo sapiens
ccagctctctgtcctccccaca

SEQ ID NO: 9206750 - DNA, 22 bp, Homo sapiens
ccagctctctgtcctccccaca

SEQ ID NO: 9206751 - DNA, 22 bp, Homo sapiens
ccagctctctttgaagcataaa

SEQ ID NO: 9206752 - DNA, 22 bp, Homo sapiens
ccagctctgattttgacctcca

SEQ ID NO: 9206753 - DNA, 22 bp, Homo sapiens
ccagctctctttgaagcataaa

SEQ ID NO: 9206754 - DNA, 22 bp, Homo sapiens
ccagctgattcggtggtggttg

SEQ ID NO: 9206755 - DNA, 20 bp, Homo sapiens
ccagctgagccaaggggaga

SEQ ID NO: 9206756 - DNA, 22 bp, Homo sapiens
ccagctgaggcagccacacagg

SEQ ID NO: 9206757 - DNA, 22 bp, Homo sapiens
ccagctgcaggtgttccagatg

SEQ ID NO: 9206758 - DNA, 22 bp, Homo sapiens
ccagctgcaggggagcagtgga

SEQ ID NO: 9206759 - DNA, 22 bp, Homo sapiens
ccagctgctgacatgggcaggt

SEQ ID NO: 9206760 - DNA, 22 bp, Homo sapiens
ccagctgctctcttctccgcca

SEQ ID NO: 9206761 - DNA, 22 bp, Homo sapiens
ccagctgctgcaccgtgcatgg

SEQ ID NO: 9206762 - DNA, 22 bp, Homo sapiens
ccagctgctgtgcagggaggct

SEQ ID NO: 9206763 - DNA, 22 bp, Homo sapiens
ccagctgctatcatgccatttc

SEQ ID NO: 9206764 - DNA, 22 bp, Homo sapiens
ccagctgctaacacaaaggagt

SEQ ID NO: 9206765 - DNA, 22 bp, Homo sapiens
ccagctgcggtctcccaaagtt

SEQ ID NO: 9206766 - DNA, 18 bp, Homo sapiens
ccagctgcgctgaaccga

SEQ ID NO: 9206767 - DNA, 22 bp, Homo sapiens
ccagctgcgggcatcgagagtt

SEQ ID NO: 9206768 - DNA, 22 bp, Homo sapiens
ccagctgcccaagaggcatcct

SEQ ID NO: 9206769 - DNA, 22 bp, Homo sapiens
ccagctgcctaagcaatccata

SEQ ID NO: 9206770 - DNA, 22 bp, Homo sapiens
tctcagaattgtgtccactggg

SEQ ID NO: 9206771 - DNA, 22 bp, Homo sapiens
tctcagaatccttgcccaggtg

SEQ ID NO: 9206772 - DNA, 22 bp, Homo sapiens
tctcagagaaatgtgtcaccat

SEQ ID NO: 9206773 - DNA, 22 bp, Homo sapiens
tctcagactatagtagagattc

SEQ ID NO: 9206774 - DNA, 23 bp, Homo sapiens
tctcagacccgaagccagaggaa

SEQ ID NO: 9206775 - DNA, 19 bp, Homo sapiens
tctcagactgtgcttctgt

SEQ ID NO: 9206776 - DNA, 22 bp, Homo sapiens
ccagagagaaaatggagggcca

SEQ ID NO: 9206777 - DNA, 22 bp, Homo sapiens
tctcagaagtgatcaggatgtt

SEQ ID NO: 9206778 - DNA, 22 bp, Homo sapiens
tctgctttcaaattcacttagt

SEQ ID NO: 9206779 - DNA, 22 bp, Homo sapiens
tctgctttatggctcagagact

SEQ ID NO: 9206780 - DNA, 22 bp, Homo sapiens
tctgcttgtgtctgtccagcct

SEQ ID NO: 9206781 - DNA, 22 bp, Homo sapiens
ccagctctcagcgggagactca

SEQ ID NO: 9206782 - DNA, 22 bp, Homo sapiens
ccagctctctgcagaaaggact

SEQ ID NO: 9206783 - DNA, 22 bp, Homo sapiens
tctgggagcagctcagcagatt

SEQ ID NO: 9206784 - DNA, 22 bp, Homo sapiens
tctggtaacctttatccctcct

SEQ ID NO: 9206785 - DNA, 21 bp, Homo sapiens
ccaggactccatggggtctct

SEQ ID NO: 9206786 - DNA, 21 bp, Homo sapiens
ccaggactccatggggtctct

SEQ ID NO: 9206787 - DNA, 22 bp, Homo sapiens
ccaggactcaatgaccacaggg

SEQ ID NO: 9206788 - DNA, 22 bp, Homo sapiens
ccaggactcagtggggaaaggg

SEQ ID NO: 9206789 - DNA, 22 bp, Homo sapiens
ccaggactcaatgaccacaggg

SEQ ID NO: 9206790 - DNA, 22 bp, Homo sapiens
tctgggagcagatgatggtata

SEQ ID NO: 9206791 - DNA, 22 bp, Homo sapiens
tctggtgtcagtattctttgaa

SEQ ID NO: 9206792 - DNA, 22 bp, Homo sapiens
tctggtgtcagtattctttgaa

SEQ ID NO: 9206793 - DNA, 20 bp, Homo sapiens
tctggtccaggtcttcatgg

SEQ ID NO: 9206794 - DNA, 22 bp, Homo sapiens
tctggtccccattccaggtggg

SEQ ID NO: 9206795 - DNA, 22 bp, Homo sapiens
tctggtccctgctcacttcttg

SEQ ID NO: 9206796 - DNA, 22 bp, Homo sapiens
tctggtcccttttcctgcagtc

SEQ ID NO: 9206797 - DNA, 22 bp, Homo sapiens
tctggtcccttttcctgcagtc

SEQ ID NO: 9206798 - DNA, 22 bp, Homo sapiens
tctggtcctctctgtgatgcta

SEQ ID NO: 9206799 - DNA, 22 bp, Homo sapiens
ccaggactgcagggggcgagga

SEQ ID NO: 9206800 - DNA, 20 bp, Homo sapiens
ccaggactgctggggactct

SEQ ID NO: 9206801 - DNA, 22 bp, Homo sapiens
ccaggactttaagtccagcact

SEQ ID NO: 9206802 - DNA, 22 bp, Homo sapiens
ccaggactttaagtccagcact

SEQ ID NO: 9206803 - DNA, 22 bp, Homo sapiens
ccaggacttcgaggctacagtg

SEQ ID NO: 9206804 - DNA, 22 bp, Homo sapiens
ccaggagaagcatctgagtgta

SEQ ID NO: 9206805 - DNA, 18 bp, Homo sapiens
ccaggacaggcaaaaggt

SEQ ID NO: 9206806 - DNA, 22 bp, Homo sapiens
ccaggacagtgaacatgtaaga

SEQ ID NO: 9206807 - DNA, 22 bp, Homo sapiens
ccaggacagtgaacatgtaaga

SEQ ID NO: 9206808 - DNA, 17 bp, Homo sapiens
tctggccttcctgaact

SEQ ID NO: 9206809 - DNA, 22 bp, Homo sapiens
tctggctagattgatgagtccc

SEQ ID NO: 9206810 - DNA, 22 bp, Homo sapiens
tctggctcaaaatacgtactct

SEQ ID NO: 9206811 - DNA, 22 bp, Homo sapiens
tctggctcagggctctgaggga

SEQ ID NO: 9206812 - DNA, 22 bp, Homo sapiens
tctggctcaggagctgtgttca

SEQ ID NO: 9206813 - DNA, 22 bp, Homo sapiens
tctggctcacttcaggcttcac

SEQ ID NO: 9206814 - DNA, 18 bp, Homo sapiens
tctggctcaggactgaac

SEQ ID NO: 9206815 - DNA, 22 bp, Homo sapiens
ccaggacactgcttcacagcag

SEQ ID NO: 9206816 - DNA, 21 bp, Homo sapiens
ccaggaaggactgagctccct

SEQ ID NO: 9206817 - DNA, 22 bp, Homo sapiens
tctggccctgctgctgtgagca

SEQ ID NO: 9206818 - DNA, 22 bp, Homo sapiens
tctggcctcttgggatgctccc

SEQ ID NO: 9206819 - DNA, 22 bp, Homo sapiens
tctggccttatctgtccaagcc

SEQ ID NO: 9206820 - DNA, 22 bp, Homo sapiens
tgagaaggctcaggcttagaga

SEQ ID NO: 9206821 - DNA, 22 bp, Homo sapiens
tgagaatactgcattgttagga

SEQ ID NO: 9206822 - DNA, 22 bp, Homo sapiens
tgagaataagagatagtttatt

SEQ ID NO: 9206823 - DNA, 22 bp, Homo sapiens
tgagaataactgatttaaatgc

SEQ ID NO: 9206824 - DNA, 22 bp, Homo sapiens
ccaggggctgcagatccatggt

SEQ ID NO: 9206825 - DNA, 22 bp, Homo sapiens
ccaggggctgcagatccatggt

SEQ ID NO: 9206826 - DNA, 22 bp, Homo sapiens
ccaggggctggtgctgagctgg

SEQ ID NO: 9206827 - DNA, 19 bp, Homo sapiens
ccaggtggaactgaggtag

SEQ ID NO: 9206828 - DNA, 22 bp, Homo sapiens
ccaggtggaaggtctgtgctct

SEQ ID NO: 9206829 - DNA, 22 bp, Homo sapiens
ccaggtggacaaggctttcaca

SEQ ID NO: 9206830 - DNA, 17 bp, Homo sapiens
ccaggtctccttgcttt

SEQ ID NO: 9206831 - DNA, 17 bp, Homo sapiens
ccaggtctccttgcttt

SEQ ID NO: 9206832 - DNA, 22 bp, Homo sapiens
ccagggtcacaaataactgcag

SEQ ID NO: 9206833 - DNA, 21 bp, Homo sapiens
ccagggtccagctgccatggt

SEQ ID NO: 9206834 - DNA, 22 bp, Homo sapiens
ccaggtgtaagacatggtccta

SEQ ID NO: 9206835 - DNA, 17 bp, Homo sapiens
ccaggtgggaggtgggg

SEQ ID NO: 9206836 - DNA, 22 bp, Homo sapiens
tgagacagttctgcagctgggt

SEQ ID NO: 9206837 - DNA, 22 bp, Homo sapiens
ccaggtgtgccagcagggactg

SEQ ID NO: 9206838 - DNA, 22 bp, Homo sapiens
ccaggtgtgatttggcagtgtc

SEQ ID NO: 9206839 - DNA, 22 bp, Homo sapiens
ccaggtgtgctctgcagtggat

SEQ ID NO: 9206840 - DNA, 22 bp, Homo sapiens
tgaggcagagtaagatacatga

SEQ ID NO: 9206841 - DNA, 22 bp, Homo sapiens
tgaggcagatatttattgggtt

SEQ ID NO: 9206842 - DNA, 22 bp, Homo sapiens
tgaggcagatatttattgggtt

SEQ ID NO: 9206843 - DNA, 22 bp, Homo sapiens
tgaggcagaaaatagcagttca

SEQ ID NO: 9206844 - DNA, 20 bp, Homo sapiens
ccaggctggcaaatgggggc

SEQ ID NO: 9206845 - DNA, 21 bp, Homo sapiens
ccaggctggccatggtattga

SEQ ID NO: 9206846 - DNA, 20 bp, Homo sapiens
ccaggctggcaaatgggggc

SEQ ID NO: 9206847 - DNA, 22 bp, Homo sapiens
ccaggctggagtgtagtcgcat

SEQ ID NO: 9206848 - DNA, 22 bp, Homo sapiens
ccaggctggagtgtagtcgcat

SEQ ID NO: 9206849 - DNA, 22 bp, Homo sapiens
ccaggctggattttgcagttca

SEQ ID NO: 9206850 - DNA, 22 bp, Homo sapiens
ccaggctggattttgcagttca

SEQ ID NO: 9206851 - DNA, 22 bp, Homo sapiens
ccaggctggagtgcagtagtgt

SEQ ID NO: 9206852 - DNA, 22 bp, Homo sapiens
ccaggctggagtgcaatggtgc

SEQ ID NO: 9206853 - DNA, 22 bp, Homo sapiens
ccaggctggagtgcaatggtgc

SEQ ID NO: 9206854 - DNA, 22 bp, Homo sapiens
ccaggctggagtgcagtggcac

SEQ ID NO: 9206855 - DNA, 22 bp, Homo sapiens
ccaggctggagtgcagtggcac

SEQ ID NO: 9206856 - DNA, 21 bp, Homo sapiens
tgaatgcttcgtcatcctggc

SEQ ID NO: 9206857 - DNA, 22 bp, Homo sapiens
ccagggctgctgtgggactcca

SEQ ID NO: 9206858 - DNA, 22 bp, Homo sapiens
ccagggctgctgtgggactcca

SEQ ID NO: 9206859 - DNA, 22 bp, Homo sapiens
ccaggggaaacagggagcactc

SEQ ID NO: 9206860 - DNA, 22 bp, Homo sapiens
ccatgcctcgggaagagtctgt

SEQ ID NO: 9206861 - DNA, 22 bp, Homo sapiens
ccatgctggagtccctagctgt

SEQ ID NO: 9206862 - DNA, 22 bp, Homo sapiens
ccatgctgaccctgtgcaggca

SEQ ID NO: 9206863 - DNA, 22 bp, Homo sapiens
ccatgccagctgctaggtcaca

SEQ ID NO: 9206864 - DNA, 19 bp, Homo sapiens
ccatgccatcattttaaag

SEQ ID NO: 9206865 - DNA, 22 bp, Homo sapiens
ccatgccatactggccacccgg

SEQ ID NO: 9206866 - DNA, 22 bp, Homo sapiens
ccatgccccaatacaggacacc

SEQ ID NO: 9206867 - DNA, 22 bp, Homo sapiens
ccagtgtttgatgggattttca

SEQ ID NO: 9206868 - DNA, 22 bp, Homo sapiens
ccagtgttttcatcctcccttg

SEQ ID NO: 9206869 - DNA, 22 bp, Homo sapiens
ccagtgtttccccagaagagag

SEQ ID NO: 9206870 - DNA, 22 bp, Homo sapiens
ccagtgtttccgtcagtacacg

SEQ ID NO: 9206871 - DNA, 22 bp, Homo sapiens
tgaggtagggaaggctggtatt

SEQ ID NO: 9206872 - DNA, 22 bp, Homo sapiens
ccatgtggctagcgtgcctgca

SEQ ID NO: 9206873 - DNA, 22 bp, Homo sapiens
ccatgtggggtcagtgtttggg

SEQ ID NO: 9206874 - DNA, 22 bp, Homo sapiens
tgaggtcacctggaggcagcct

SEQ ID NO: 9206875 - DNA, 19 bp, Homo sapiens
ccagtcctctttgggcctg

SEQ ID NO: 9206876 - DNA, 22 bp, Homo sapiens
ccagtgttgaacagtatttgga

SEQ ID NO: 9206877 - DNA, 22 bp, Homo sapiens
ccagtgttctggtgttcatttc

SEQ ID NO: 9206878 - DNA, 22 bp, Homo sapiens
ccagtgttccatggagtgatta

SEQ ID NO: 9206879 - DNA, 22 bp, Homo sapiens
ccagtgttccctcgggttcatg

SEQ ID NO: 9206880 - DNA, 22 bp, Homo sapiens
ccagtgttccagagagctgatg

SEQ ID NO: 9206881 - DNA, 22 bp, Homo sapiens
ccagtgtttaggaataaaatgt

SEQ ID NO: 9206882 - DNA, 22 bp, Homo sapiens
ccagtgttggaggatggcttgc

SEQ ID NO: 9206883 - DNA, 22 bp, Homo sapiens
ccagtgtttacagttgaacaaa

SEQ ID NO: 9206884 - DNA, 22 bp, Homo sapiens
ccagtgttgcataggatgggga

SEQ ID NO: 9206885 - DNA, 22 bp, Homo sapiens
tgagggctgcttccagagctag

SEQ ID NO: 9206886 - DNA, 22 bp, Homo sapiens
tgagggctccccgctgctgtgt

SEQ ID NO: 9206887 - DNA, 22 bp, Homo sapiens
tgagggcaaagtggtgctgagg

SEQ ID NO: 9206888 - DNA, 22 bp, Homo sapiens
tgagggcagagcactggggagc

SEQ ID NO: 9206889 - DNA, 20 bp, Homo sapiens
tgatttctcttctattcctt

SEQ ID NO: 9206890 - DNA, 22 bp, Homo sapiens
tgatttctcttggcaatatgtt

SEQ ID NO: 9206891 - DNA, 22 bp, Homo sapiens
tgatttctctccgttatttcag

SEQ ID NO: 9206892 - DNA, 22 bp, Homo sapiens
tgatttcttccttgtcattaga

SEQ ID NO: 9206893 - DNA, 21 bp, Homo sapiens
tgatttctgccaagttcacta

SEQ ID NO: 9206894 - DNA, 22 bp, Homo sapiens
tgatttcttctaatttccatca

SEQ ID NO: 9206895 - DNA, 22 bp, Homo sapiens
ccattggagagttttaagaagg

SEQ ID NO: 9206896 - DNA, 22 bp, Homo sapiens
ccattggagccaagagttttac

SEQ ID NO: 9206897 - DNA, 22 bp, Homo sapiens
ccatgttgtcaaacttagagta

SEQ ID NO: 9206898 - DNA, 22 bp, Homo sapiens
ccattaaaatggaatgtagtga

SEQ ID NO: 9206899 - DNA, 22 bp, Homo sapiens
ccattaaagcaccactgtaata

SEQ ID NO: 9206900 - DNA, 22 bp, Homo sapiens
tgcaaataggggacaactcttt

SEQ ID NO: 9206901 - DNA, 22 bp, Homo sapiens
cccactgtgttgctgttaatct

SEQ ID NO: 9206902 - DNA, 22 bp, Homo sapiens
cccactgtgttgcagtctagtg

SEQ ID NO: 9206903 - DNA, 22 bp, Homo sapiens
cccactgtgttgcagtctagtg

SEQ ID NO: 9206904 - DNA, 22 bp, Homo sapiens
cccactgtggaagaaaggggag

SEQ ID NO: 9206905 - DNA, 22 bp, Homo sapiens
cccactgttgcctcaaatatca

SEQ ID NO: 9206906 - DNA, 22 bp, Homo sapiens
cccactgtttccctgaggctct

SEQ ID NO: 9206907 - DNA, 22 bp, Homo sapiens
tgcaaagccacaatgaaatcag

SEQ ID NO: 9206908 - DNA, 23 bp, Homo sapiens
tgcaaagcacttaagaggccctg

SEQ ID NO: 9206909 - DNA, 22 bp, Homo sapiens
tgcaaaggaggatgggaaagaa

SEQ ID NO: 9206910 - DNA, 22 bp, Homo sapiens
tgcaaatacaaaatggtacagc

SEQ ID NO: 9206911 - DNA, 22 bp, Homo sapiens
tgcacacatatgagcatgtgtg

SEQ ID NO: 9206912 - DNA, 22 bp, Homo sapiens
tgcacacatgtttacaagcatc

SEQ ID NO: 9206913 - DNA, 22 bp, Homo sapiens
tgcacacatgtttacaagcatc

SEQ ID NO: 9206914 - DNA, 22 bp, Homo sapiens
tgcacacattaaggatacacag

SEQ ID NO: 9206915 - DNA, 22 bp, Homo sapiens
tgcacacctctccaccactctc

SEQ ID NO: 9206916 - DNA, 22 bp, Homo sapiens
tgcacacctctccaccactctc

SEQ ID NO: 9206917 - DNA, 22 bp, Homo sapiens
cccagacagtcaagaggcctgc

SEQ ID NO: 9206918 - DNA, 22 bp, Homo sapiens
cccagacataacagcagagagg

SEQ ID NO: 9206919 - DNA, 20 bp, Homo sapiens
tttctcccaagtgcaagggt

SEQ ID NO: 9206920 - DNA, 22 bp, Homo sapiens
tttctactttggaatgcactga

SEQ ID NO: 9206921 - DNA, 19 bp, Homo sapiens
tttctcaggaagtttgtgt

SEQ ID NO: 9206922 - DNA, 22 bp, Homo sapiens
tttctcagctcagcatctgggt

SEQ ID NO: 9206923 - DNA, 22 bp, Homo sapiens
tttctcagcgttcttagggctc

SEQ ID NO: 9206924 - DNA, 22 bp, Homo sapiens
tttctcagcctccttgctggag

SEQ ID NO: 9206925 - DNA, 22 bp, Homo sapiens
tttctcagtaatgtcctggaat

SEQ ID NO: 9206926 - DNA, 22 bp, Homo sapiens
tttctcagtagtaatggcagtc

SEQ ID NO: 9206927 - DNA, 22 bp, Homo sapiens
tttctcagggaggagtcaagcc

SEQ ID NO: 9206928 - DNA, 22 bp, Homo sapiens
tttctcagggaggagtcaagcc

SEQ ID NO: 9206929 - DNA, 22 bp, Homo sapiens
tttctcagtgtagcttttcaag

SEQ ID NO: 9206930 - DNA, 22 bp, Homo sapiens
tttctcagtcacatgaaccaat

SEQ ID NO: 9206931 - DNA, 22 bp, Homo sapiens
tttctcagttctctgcaaggag

SEQ ID NO: 9206932 - DNA, 22 bp, Homo sapiens
tttccttctcagggagcttcaa

SEQ ID NO: 9206933 - DNA, 22 bp, Homo sapiens
tttcctgttctagttgttgcca

SEQ ID NO: 9206934 - DNA, 22 bp, Homo sapiens
tttcctgttgccatcaagaatg

SEQ ID NO: 9206935 - DNA, 22 bp, Homo sapiens
tttcctctttgtaccttgacta

SEQ ID NO: 9206936 - DNA, 22 bp, Homo sapiens
tttcctctttgtgacacagctg

SEQ ID NO: 9206937 - DNA, 22 bp, Homo sapiens
tttctacatttgtaaccagatt

SEQ ID NO: 9206938 - DNA, 22 bp, Homo sapiens
tttctactgttatgacactggg

SEQ ID NO: 9206939 - DNA, 22 bp, Homo sapiens
tttccaaaagtttgttctgtgc

SEQ ID NO: 9206940 - DNA, 22 bp, Homo sapiens
tttccaaacccagcgagctaca

SEQ ID NO: 9206941 - DNA, 22 bp, Homo sapiens
tttccaaaatgaatctaatgca

SEQ ID NO: 9206942 - DNA, 22 bp, Homo sapiens
tttcctctgctgccattgcccc

SEQ ID NO: 9206943 - DNA, 22 bp, Homo sapiens
tttcctctgtcatgacagctga

SEQ ID NO: 9206944 - DNA, 22 bp, Homo sapiens
tttcctctgtcatgacagctga

SEQ ID NO: 9206945 - DNA, 22 bp, Homo sapiens
tttcctctgggccctgccaccc

SEQ ID NO: 9206946 - DNA, 22 bp, Homo sapiens
tttcctctgggccctgccaccc

SEQ ID NO: 9206947 - DNA, 22 bp, Homo sapiens
tttcctcttcttcccatgtcat

SEQ ID NO: 9206948 - DNA, 22 bp, Homo sapiens
tttcctcttcttcccatgtcat

SEQ ID NO: 9206949 - DNA, 22 bp, Homo sapiens
tttccaaaggaggaaccagttt

SEQ ID NO: 9206950 - DNA, 22 bp, Homo sapiens
tttccaaagctgagttgagcaa

SEQ ID NO: 9206951 - DNA, 16 bp, Homo sapiens
tttccaaagggcagct

SEQ ID NO: 9206952 - DNA, 22 bp, Homo sapiens
tttccaaaggctaaactcagtt

SEQ ID NO: 9206953 - DNA, 22 bp, Homo sapiens
tttccaaaggagtaccacgcat

SEQ ID NO: 9206954 - DNA, 22 bp, Homo sapiens
tttccaaagttgccataagctt

SEQ ID NO: 9206955 - DNA, 22 bp, Homo sapiens
tttccaaaggtggcaggaacaa

SEQ ID NO: 9206956 - DNA, 22 bp, Homo sapiens
tttcagctttaccattccatga

SEQ ID NO: 9206957 - DNA, 22 bp, Homo sapiens
tttcaggagagaccagaaatga

SEQ ID NO: 9206958 - DNA, 22 bp, Homo sapiens
tttcaggattagtttaagcagg

SEQ ID NO: 9206959 - DNA, 19 bp, Homo sapiens
tttcaggagctatgcaggg

SEQ ID NO: 9206960 - DNA, 22 bp, Homo sapiens
tttcagggaagtgttgaaaagg

SEQ ID NO: 9206961 - DNA, 17 bp, Homo sapiens
tttcaaagcagtcagga

SEQ ID NO: 9206962 - DNA, 20 bp, Homo sapiens
tttcaaaggcacctatgaag

SEQ ID NO: 9206963 - DNA, 22 bp, Homo sapiens
tttctcttcactgtgtgcctca

SEQ ID NO: 9206964 - DNA, 22 bp, Homo sapiens
tttctctttcaatctgcagtac

SEQ ID NO: 9206965 - DNA, 22 bp, Homo sapiens
tttctctttgacaggaatcaga

SEQ ID NO: 9206966 - DNA, 22 bp, Homo sapiens
tttctctagctattcattaaat

SEQ ID NO: 9206967 - DNA, 22 bp, Homo sapiens
tttctctaaatagggaggctta

SEQ ID NO: 9206968 - DNA, 22 bp, Homo sapiens
tttctcttaatgtctctgtgct

SEQ ID NO: 9206969 - DNA, 22 bp, Homo sapiens
tttctcttaatgtctctgtgct

SEQ ID NO: 9206970 - DNA, 20 bp, Homo sapiens
tttctgtagctcagtattca

SEQ ID NO: 9206971 - DNA, 22 bp, Homo sapiens
tttctgtaaggacttaatgcaa

SEQ ID NO: 9206972 - DNA, 22 bp, Homo sapiens
tttctggcagcgggacaggggt

SEQ ID NO: 9206973 - DNA, 22 bp, Homo sapiens
tttctgctcgctctcaatcagg

SEQ ID NO: 9206974 - DNA, 22 bp, Homo sapiens
tttcttccttaccttactagag

SEQ ID NO: 9206975 - DNA, 22 bp, Homo sapiens
tttcttctaagatttcaaacta

SEQ ID NO: 9206976 - DNA, 22 bp, Homo sapiens
tttcttctaagatttcaaacta

SEQ ID NO: 9206977 - DNA, 22 bp, Homo sapiens
tttcttctaggactaataagag

SEQ ID NO: 9206978 - DNA, 22 bp, Homo sapiens
tttcttctaggactaataagag

SEQ ID NO: 9206979 - DNA, 22 bp, Homo sapiens
tttcttctcatccctgaaatca

SEQ ID NO: 9206980 - DNA, 22 bp, Homo sapiens
tttcttctcacccaggacagag

SEQ ID NO: 9206981 - DNA, 22 bp, Homo sapiens
tttcttctcacccaggacagag

SEQ ID NO: 9206982 - DNA, 22 bp, Homo sapiens
tttcttgtgcctaattttgggc

SEQ ID NO: 9206983 - DNA, 22 bp, Homo sapiens
tttcttctgagatcagggagaa

SEQ ID NO: 9206984 - DNA, 22 bp, Homo sapiens
tttcttctgagatcagggagaa

SEQ ID NO: 9206985 - DNA, 22 bp, Homo sapiens
tttcttcagtaacacaaaccat

SEQ ID NO: 9206986 - DNA, 22 bp, Homo sapiens
tttcttcagccttcacaacctg

SEQ ID NO: 9206987 - DNA, 22 bp, Homo sapiens
tttcttcagccactccaaactg

SEQ ID NO: 9206988 - DNA, 22 bp, Homo sapiens
tttcttcccaagcagtttcaga

SEQ ID NO: 9206989 - DNA, 22 bp, Homo sapiens
tttctgtagtgtggtatgtagg

SEQ ID NO: 9206990 - DNA, 21 bp, Homo sapiens
tttctgtcctttccatcagct

SEQ ID NO: 9206991 - DNA, 21 bp, Homo sapiens
tttctgtctctgccactagtt

SEQ ID NO: 9206992 - DNA, 23 bp, Homo sapiens
tttaaaagttgtaatgtaggctt

SEQ ID NO: 9206993 - DNA, 22 bp, Homo sapiens
ttgtttttaaacatgtgactga

SEQ ID NO: 9206994 - DNA, 23 bp, Homo sapiens
ttgtttttagaggtggcatgaga

SEQ ID NO: 9206995 - DNA, 22 bp, Homo sapiens
ttgtttttagagaagccctgaa

SEQ ID NO: 9206996 - DNA, 23 bp, Homo sapiens
ttgtttttagaggtggcatgaga

SEQ ID NO: 9206997 - DNA, 23 bp, Homo sapiens
ttgtttttagaggtggcatgaga

SEQ ID NO: 9206998 - DNA, 22 bp, Homo sapiens
tttaaacaaataggattgccta

SEQ ID NO: 9206999 - DNA, 22 bp, Homo sapiens
tttaattgcatttaaagatgga

SEQ ID NO: 9207000 - DNA, 22 bp, Homo sapiens
tttagaaattcatctatggcct

SEQ ID NO: 9207001 - DNA, 22 bp, Homo sapiens
tttacaagtacacctaacagct

SEQ ID NO: 9207002 - DNA, 22 bp, Homo sapiens
tttacaagaaatcatgatgcta

SEQ ID NO: 9207003 - DNA, 22 bp, Homo sapiens
tttacaaggatcaagggatctc

SEQ ID NO: 9207004 - DNA, 22 bp, Homo sapiens
tttactaagtacttgtatccct

SEQ ID NO: 9207005 - DNA, 22 bp, Homo sapiens
tttactacttgtgataactgaa

SEQ ID NO: 9207006 - DNA, 22 bp, Homo sapiens
tttaccatctgccacagatatg

SEQ ID NO: 9207007 - DNA, 22 bp, Homo sapiens
tttataaacagtaccacggtgc

SEQ ID NO: 9207008 - DNA, 22 bp, Homo sapiens
tttataaaatagactgggtcta

SEQ ID NO: 9207009 - DNA, 22 bp, Homo sapiens
tttatttggcatctctgccaag

SEQ ID NO: 9207010 - DNA, 22 bp, Homo sapiens
tttattatccagtgttgtcatg

SEQ ID NO: 9207011 - DNA, 22 bp, Homo sapiens
ttgttttatctttctacagact

SEQ ID NO: 9207012 - DNA, 22 bp, Homo sapiens
ttgtttttaaacatgtgactga

SEQ ID NO: 9207013 - DNA, 20 bp, Homo sapiens
ttgtttctgctattttctaa

SEQ ID NO: 9207014 - DNA, 22 bp, Homo sapiens
ttgtgtttctggccaagatgga

SEQ ID NO: 9207015 - DNA, 22 bp, Homo sapiens
ttgtgtttcccttgcatattcc

SEQ ID NO: 9207016 - DNA, 22 bp, Homo sapiens
ttgtgttaaggtgcatctagtg

SEQ ID NO: 9207017 - DNA, 21 bp, Homo sapiens
ttgtgtttccccagtcacttt

SEQ ID NO: 9207018 - DNA, 22 bp, Homo sapiens
ttgtgtgtttgtagaaaatcca

SEQ ID NO: 9207019 - DNA, 22 bp, Homo sapiens
ttgtgtgtgtaactttatgaga

SEQ ID NO: 9207020 - DNA, 22 bp, Homo sapiens
ttgtgtgtcttcttcactgccc

SEQ ID NO: 9207021 - DNA, 22 bp, Homo sapiens
ttgtgtgtgagccttcaccaca

SEQ ID NO: 9207022 - DNA, 19 bp, Homo sapiens
ttgtgtgtcagtcagagtt

SEQ ID NO: 9207023 - DNA, 22 bp, Homo sapiens
ttgtttaaaatgtagcaagaaa

SEQ ID NO: 9207024 - DNA, 22 bp, Homo sapiens
ttgttacagcagtgatttcaga

SEQ ID NO: 9207025 - DNA, 22 bp, Homo sapiens
ttgttacatacagcagaacata

SEQ ID NO: 9207026 - DNA, 20 bp, Homo sapiens
ttgttagaggaatgccatag

SEQ ID NO: 9207027 - DNA, 22 bp, Homo sapiens
ttgcaacattgtaagtttatat

SEQ ID NO: 9207028 - DNA, 22 bp, Homo sapiens
ttgcaatgcccgtagcatccta

SEQ ID NO: 9207029 - DNA, 18 bp, Homo sapiens
ttggggtgaggccaggaa

SEQ ID NO: 9207030 - DNA, 22 bp, Homo sapiens
ttgcaagttccttatgagaatc

SEQ ID NO: 9207031 - DNA, 22 bp, Homo sapiens
ttgcaaggtttctctctgccta

SEQ ID NO: 9207032 - DNA, 22 bp, Homo sapiens
ttgcaagttccttatgagaatc

SEQ ID NO: 9207033 - DNA, 22 bp, Homo sapiens
ttgcaaggagccactctgcctg

SEQ ID NO: 9207034 - DNA, 22 bp, Homo sapiens
ttgcaagatgttaccattgtta

SEQ ID NO: 9207035 - DNA, 22 bp, Homo sapiens
ttggtgagcctcttagcagcag

SEQ ID NO: 9207036 - DNA, 22 bp, Homo sapiens
ttggtgagtgctatgtaccaca

SEQ ID NO: 9207037 - DNA, 22 bp, Homo sapiens
ttgtctctggaaggaaaaagca

SEQ ID NO: 9207038 - DNA, 22 bp, Homo sapiens
ttgtgaaatcgtgtttggaagc

SEQ ID NO: 9207039 - DNA, 22 bp, Homo sapiens
ttgtcctgtttagggataagga

SEQ ID NO: 9207040 - DNA, 22 bp, Homo sapiens
ttggttttgggatgtacaaagg

SEQ ID NO: 9207041 - DNA, 22 bp, Homo sapiens
ttggttttgggatgtacaaagg

SEQ ID NO: 9207042 - DNA, 22 bp, Homo sapiens
ttggttttgaaatagcttattg

SEQ ID NO: 9207043 - DNA, 21 bp, Homo sapiens
ttggttttctgagtctgtaca

SEQ ID NO: 9207044 - DNA, 22 bp, Homo sapiens
ttggttttctcagctggaccat

SEQ ID NO: 9207045 - DNA, 22 bp, Homo sapiens
ttggttttctatcctctgcaat

SEQ ID NO: 9207046 - DNA, 22 bp, Homo sapiens
ttggtttgttcaccatcaagca

SEQ ID NO: 9207047 - DNA, 22 bp, Homo sapiens
ttggttttatcttaagattctt

SEQ ID NO: 9207048 - DNA, 22 bp, Homo sapiens
ttggttttcatagctccactct

SEQ ID NO: 9207049 - DNA, 22 bp, Homo sapiens
ttttatacttaagacagagttt

SEQ ID NO: 9207050 - DNA, 22 bp, Homo sapiens
ttttataagcaagaaagggaaa

SEQ ID NO: 9207051 - DNA, 22 bp, Homo sapiens
ttttataagcaagaaagggaaa

SEQ ID NO: 9207052 - DNA, 22 bp, Homo sapiens
ttttatcaatcattaagacatt

SEQ ID NO: 9207053 - DNA, 22 bp, Homo sapiens
ttttatcaatcattaagacatt

SEQ ID NO: 9207054 - DNA, 22 bp, Homo sapiens
tttgttttcaatgtgtcattca

SEQ ID NO: 9207055 - DNA, 22 bp, Homo sapiens
tttgttttgaactagctcagaa

SEQ ID NO: 9207056 - DNA, 22 bp, Homo sapiens
tttgttttctgtaggcctttcc

SEQ ID NO: 9207057 - DNA, 22 bp, Homo sapiens
tttgttttcaatgtgtcattca

SEQ ID NO: 9207058 - DNA, 22 bp, Homo sapiens
tttgttttcaatgtgtcattca

SEQ ID NO: 9207059 - DNA, 22 bp, Homo sapiens
tttgtatttttcccagctagct

SEQ ID NO: 9207060 - DNA, 22 bp, Homo sapiens
tttgtcaaagatcagatgcttt

SEQ ID NO: 9207061 - DNA, 22 bp, Homo sapiens
tttgttctgcatcacagaaaaa

SEQ ID NO: 9207062 - DNA, 22 bp, Homo sapiens
tttgttctgcatcacagaaaaa

SEQ ID NO: 9207063 - DNA, 22 bp, Homo sapiens
tttgttctgaagcaagtaggga

SEQ ID NO: 9207064 - DNA, 22 bp, Homo sapiens
tttgttctgaagcaagtaggga

SEQ ID NO: 9207065 - DNA, 22 bp, Homo sapiens
tttgttcttgcaacagttatta

SEQ ID NO: 9207066 - DNA, 22 bp, Homo sapiens
tttgttgtgaacagaataatat

SEQ ID NO: 9207067 - DNA, 22 bp, Homo sapiens
tttgcagaagaaaacatgaaca

SEQ ID NO: 9207068 - DNA, 22 bp, Homo sapiens
tttgcaaattagccaccctgtt

SEQ ID NO: 9207069 - DNA, 22 bp, Homo sapiens
tttgcaaattcttgtctagcct

SEQ ID NO: 9207070 - DNA, 22 bp, Homo sapiens
tttgcaagaagaatggcacaaa

SEQ ID NO: 9207071 - DNA, 22 bp, Homo sapiens
tttgcaagaagaatggcacaaa

SEQ ID NO: 9207072 - DNA, 23 bp, Homo sapiens
tttgcaaattttcctgactactc

SEQ ID NO: 9207073 - DNA, 22 bp, Homo sapiens
tttgcaaatttcgtctcctcag

SEQ ID NO: 9207074 - DNA, 22 bp, Homo sapiens
tttgcaagtatcaaacatgtca

SEQ ID NO: 9207075 - DNA, 22 bp, Homo sapiens
tttgatttactggatattctca

SEQ ID NO: 9207076 - DNA, 22 bp, Homo sapiens
tttgcaaataaataagtgctcg

SEQ ID NO: 9207077 - DNA, 22 bp, Homo sapiens
tttctttctcgtaaacttagtt

SEQ ID NO: 9207078 - DNA, 17 bp, Homo sapiens
tttgtacaacattttaa

SEQ ID NO: 9207079 - DNA, 19 bp, Homo sapiens
tttggcaggagataggatg

SEQ ID NO: 9207080 - DNA, 22 bp, Homo sapiens
tttggcaggtggcagctctggg

SEQ ID NO: 9207081 - DNA, 22 bp, Homo sapiens
tttggcagcacccgccatctat

SEQ ID NO: 9207082 - DNA, 22 bp, Homo sapiens
tttggcagatgaccctcaagtt

SEQ ID NO: 9207083 - DNA, 22 bp, Homo sapiens
tttggcacctccaaggactcgc

SEQ ID NO: 9207084 - DNA, 22 bp, Homo sapiens
tttggcaaacttttaggacttt

SEQ ID NO: 9207085 - DNA, 22 bp, Homo sapiens
tttggcaaaggtcagagactcc

SEQ ID NO: 9207086 - DNA, 22 bp, Homo sapiens
tttggcaacctcaatggctcta

SEQ ID NO: 9207087 - DNA, 22 bp, Homo sapiens
tttggcaaacataagcctttct

SEQ ID NO: 9207088 - DNA, 22 bp, Homo sapiens
tttggagagatgaagttctgtg

SEQ ID NO: 9207089 - DNA, 22 bp, Homo sapiens
tttggacaaatgtctgactttc

SEQ ID NO: 9207090 - DNA, 19 bp, Homo sapiens
tttggacagagtgtccagg

SEQ ID NO: 9207091 - DNA, 22 bp, Homo sapiens
tttggacatgttgagtctgata

SEQ ID NO: 9207092 - DNA, 22 bp, Homo sapiens
tttttgaaggctgatgtgatta

SEQ ID NO: 9207093 - DNA, 22 bp, Homo sapiens
tttttctactgcccacattgta

SEQ ID NO: 9207094 - DNA, 22 bp, Homo sapiens
tttttctaatggcttaggatgt

SEQ ID NO: 9207095 - DNA, 22 bp, Homo sapiens
ttttttgtcttgaagaaatggt

SEQ ID NO: 9207096 - DNA, 22 bp, Homo sapiens
tttttggcccttagctctgtat

SEQ ID NO: 9207097 - DNA, 22 bp, Homo sapiens
tttttggcagctcagaaacttc

SEQ ID NO: 9207098 - DNA, 22 bp, Homo sapiens
ttttgacaatgctaatctcaat

SEQ ID NO: 9207099 - DNA, 22 bp, Homo sapiens
ttttgatatcatgatgaacaga

SEQ ID NO: 9207100 - DNA, 22 bp, Homo sapiens
ttttgaaagccaggtttgtatg

SEQ ID NO: 9207101 - DNA, 21 bp, Homo sapiens
ttttggcaaggtgcatgtttc

SEQ ID NO: 9207102 - DNA, 22 bp, Homo sapiens
ttttggcaagctgggagatatt

SEQ ID NO: 9207103 - DNA, 22 bp, Homo sapiens
ttttggcaaaggcattctcttt

SEQ ID NO: 9207104 - DNA, 22 bp, Homo sapiens
ttttgcaatatgttcctgaata

SEQ ID NO: 9207105 - DNA, 22 bp, Homo sapiens
tttttcctagcgatttgtcagc

SEQ ID NO: 9207106 - DNA, 22 bp, Homo sapiens
ttttggcatcacttgccatcta

SEQ ID NO: 9207107 - DNA, 22 bp, Homo sapiens
ttttggcaggatatgcaccagc

SEQ ID NO: 9207108 - DNA, 22 bp, Homo sapiens
ttttggcagcaggtatggggca

SEQ ID NO: 9207109 - DNA, 22 bp, Homo sapiens
ttttggcagattacttaatatg

SEQ ID NO: 9207110 - DNA, 22 bp, Homo sapiens
ttttggcagattacttaatatg

SEQ ID NO: 9207111 - DNA, 22 bp, Homo sapiens
ttttgaaagagtcctgctacag

SEQ ID NO: 9207112 - DNA, 22 bp, Homo sapiens
ttttcttctacctgctgtccaa

SEQ ID NO: 9207113 - DNA, 22 bp, Homo sapiens
ttttctattaactcattttgca

SEQ ID NO: 9207114 - DNA, 23 bp, Homo sapiens
ttttcctttggacaggctgtatt

SEQ ID NO: 9207115 - DNA, 22 bp, Homo sapiens
ttttctaacatctagtaatttg

SEQ ID NO: 9207116 - DNA, 22 bp, Homo sapiens
ttttctaacatctagtaatttg

SEQ ID NO: 9207117 - DNA, 22 bp, Homo sapiens
ttttccttctgatactccattt

SEQ ID NO: 9207118 - DNA, 22 bp, Homo sapiens
ttttcctttgattcccagatgt

SEQ ID NO: 9207119 - DNA, 22 bp, Homo sapiens
ttttatctacctatgctcattt

SEQ ID NO: 9207120 - DNA, 22 bp, Homo sapiens
tgtgtcttacataattacatgt

SEQ ID NO: 9207121 - DNA, 22 bp, Homo sapiens
tgtgtctgttttgctcaccatt

SEQ ID NO: 9207122 - DNA, 22 bp, Homo sapiens
tgtgtgaaggagccactgttca

SEQ ID NO: 9207123 - DNA, 22 bp, Homo sapiens
tgtgtgattgcaggagatgtgg

SEQ ID NO: 9207124 - DNA, 22 bp, Homo sapiens
tgtggtggggtctggtattcca

SEQ ID NO: 9207125 - DNA, 18 bp, Homo sapiens
tgtggtggagctgccttc

SEQ ID NO: 9207126 - DNA, 22 bp, Homo sapiens
tgtggtggctattctggtctca

SEQ ID NO: 9207127 - DNA, 22 bp, Homo sapiens
tgtggtggtaatgagccagatg

SEQ ID NO: 9207128 - DNA, 22 bp, Homo sapiens
tgtggtggtaatgagccagatg

SEQ ID NO: 9207129 - DNA, 22 bp, Homo sapiens
tgtgtacaaactaacaacatat

SEQ ID NO: 9207130 - DNA, 22 bp, Homo sapiens
tgtgggtttaagaggcagcatg

SEQ ID NO: 9207131 - DNA, 19 bp, Homo sapiens
tgtggggagtcagggggct

SEQ ID NO: 9207132 - DNA, 18 bp, Homo sapiens
tgtggtggagctgccttc

SEQ ID NO: 9207133 - DNA, 22 bp, Homo sapiens
tgtggcctcctgttcctgggta

SEQ ID NO: 9207134 - DNA, 22 bp, Homo sapiens
tgtggcacatacacaggagggc

SEQ ID NO: 9207135 - DNA, 22 bp, Homo sapiens
tgtggcagaactgggactcaaa

SEQ ID NO: 9207136 - DNA, 22 bp, Homo sapiens
tgtggcagaactgggactcaaa

SEQ ID NO: 9207137 - DNA, 22 bp, Homo sapiens
tgtggcagaaccagaattcaaa

SEQ ID NO: 9207138 - DNA, 22 bp, Homo sapiens
tgtggaggtttaagtaatggga

SEQ ID NO: 9207139 - DNA, 22 bp, Homo sapiens
tgtggcagagtaaggacccagt

SEQ ID NO: 9207140 - DNA, 21 bp, Homo sapiens
tgtggcagatgttgggaggca

SEQ ID NO: 9207141 - DNA, 22 bp, Homo sapiens
tgtggcagattttataaattgc

SEQ ID NO: 9207142 - DNA, 21 bp, Homo sapiens
tgtggcagagacaatgctagt

SEQ ID NO: 9207143 - DNA, 22 bp, Homo sapiens
tgtggccaggaaaaggagatgg

SEQ ID NO: 9207144 - DNA, 22 bp, Homo sapiens
tgtggccagggggccatgtccc

SEQ ID NO: 9207145 - DNA, 22 bp, Homo sapiens
tgtggccaggcccctgatggtg

SEQ ID NO: 9207146 - DNA, 19 bp, Homo sapiens
tgtggccatggttcagctg

SEQ ID NO: 9207147 - DNA, 22 bp, Homo sapiens
tgtggcagtaaaattgggcaac

SEQ ID NO: 9207148 - DNA, 22 bp, Homo sapiens
tgtggccaaaataaaatgaggt

SEQ ID NO: 9207149 - DNA, 22 bp, Homo sapiens
tgtggccaccagagctgctatt

SEQ ID NO: 9207150 - DNA, 22 bp, Homo sapiens
tccccagtaagcctgcactgtg

SEQ ID NO: 9207151 - DNA, 22 bp, Homo sapiens
tccccaggtcctgtcggctcct

SEQ ID NO: 9207152 - DNA, 22 bp, Homo sapiens
tccccagggtccctgcttccat

SEQ ID NO: 9207153 - DNA, 22 bp, Homo sapiens
tccccaggtcctgtcggctcct

SEQ ID NO: 9207154 - DNA, 22 bp, Homo sapiens
tcccccaggctggagtgcagtg

SEQ ID NO: 9207155 - DNA, 22 bp, Homo sapiens
tcccccactctaaaggagcctt

SEQ ID NO: 9207156 - DNA, 17 bp, Homo sapiens
tcccccagggctctctc

SEQ ID NO: 9207157 - DNA, 22 bp, Homo sapiens
tcccccagtctgggcgtggtca

SEQ ID NO: 9207158 - DNA, 22 bp, Homo sapiens
tcccctccaactccaactatgg

SEQ ID NO: 9207159 - DNA, 22 bp, Homo sapiens
tcccctgcagcgcctgcttcta

SEQ ID NO: 9207160 - DNA, 22 bp, Homo sapiens
tcccctcctgcctttgcggtgg

SEQ ID NO: 9207161 - DNA, 22 bp, Homo sapiens
tcccctctggttgacccaggag

SEQ ID NO: 9207162 - DNA, 22 bp, Homo sapiens
tcccctctggaggctgcagggg

SEQ ID NO: 9207163 - DNA, 22 bp, Homo sapiens
tcccctctttctggaaacacaa

SEQ ID NO: 9207164 - DNA, 22 bp, Homo sapiens
tcccctgagacccctcagcact

SEQ ID NO: 9207165 - DNA, 22 bp, Homo sapiens
tgtggagatgtgagcaagggga

SEQ ID NO: 9207166 - DNA, 22 bp, Homo sapiens
tgtggagcccccaggagtgggg

SEQ ID NO: 9207167 - DNA, 22 bp, Homo sapiens
tgttccttgaatatatcagacg

SEQ ID NO: 9207168 - DNA, 23 bp, Homo sapiens
tgttcctgtcaaattttcttccc

SEQ ID NO: 9207169 - DNA, 22 bp, Homo sapiens
tgttctatcaatttaagggaaa

SEQ ID NO: 9207170 - DNA, 22 bp, Homo sapiens
tgtttaagctgatgaggtatcg

SEQ ID NO: 9207171 - DNA, 20 bp, Homo sapiens
tgttctgtcgtctttcttca

SEQ ID NO: 9207172 - DNA, 17 bp, Homo sapiens
tgttctcttcagaaatc

SEQ ID NO: 9207173 - DNA, 22 bp, Homo sapiens
tgtttgaaaagtggagatttat

SEQ ID NO: 9207174 - DNA, 20 bp, Homo sapiens
tgtttcttttaatgagcggc

SEQ ID NO: 9207175 - DNA, 22 bp, Homo sapiens
tgtttcttgataaagcagaaaa

SEQ ID NO: 9207176 - DNA, 22 bp, Homo sapiens
tgtttcttgagagtattaccct

SEQ ID NO: 9207177 - DNA, 22 bp, Homo sapiens
tgtttacatgcataagcttaag

SEQ ID NO: 9207178 - DNA, 22 bp, Homo sapiens
tgtttcactgaaagccttacta

SEQ ID NO: 9207179 - DNA, 17 bp, Homo sapiens
tgtttcacttggggaaa

SEQ ID NO: 9207180 - DNA, 22 bp, Homo sapiens
tgtttcagtccacttaggcagc

SEQ ID NO: 9207181 - DNA, 22 bp, Homo sapiens
tgttcactggaacacagctgta

SEQ ID NO: 9207182 - DNA, 22 bp, Homo sapiens
tgttcagaacaaaggtaaatga

SEQ ID NO: 9207183 - DNA, 22 bp, Homo sapiens
tgttcagaacaaaggtaaatga

SEQ ID NO: 9207184 - DNA, 22 bp, Homo sapiens
tgttcagaacaaaggtaaatga

SEQ ID NO: 9207185 - DNA, 22 bp, Homo sapiens
tgttcccattttctgcataatc

SEQ ID NO: 9207186 - DNA, 22 bp, Homo sapiens
tgttatttgggaaagttgtaca

SEQ ID NO: 9207187 - DNA, 22 bp, Homo sapiens
tgttatttatctgagcatttat

SEQ ID NO: 9207188 - DNA, 22 bp, Homo sapiens
tgtgttgtgacattcttggatg

SEQ ID NO: 9207189 - DNA, 21 bp, Homo sapiens
tgtgtttgagactatgtttcc

SEQ ID NO: 9207190 - DNA, 21 bp, Homo sapiens
tgtgttttaatgatattctgt

SEQ ID NO: 9207191 - DNA, 22 bp, Homo sapiens
tgtgttttggaaggaacatgca

SEQ ID NO: 9207192 - DNA, 22 bp, Homo sapiens
tgtgtgcaggcactgtgccaga

SEQ ID NO: 9207193 - DNA, 22 bp, Homo sapiens
tgtgttaattttccctttctct

SEQ ID NO: 9207194 - DNA, 22 bp, Homo sapiens
tgtgttgtgacattcttggatg

SEQ ID NO: 9207195 - DNA, 22 bp, Homo sapiens
tgtgttcttaaaagcagtgata

SEQ ID NO: 9207196 - DNA, 21 bp, Homo sapiens
tgtgttcttctaggtcagcta

SEQ ID NO: 9207197 - DNA, 22 bp, Homo sapiens
ttagagaattccaaatgactac

SEQ ID NO: 9207198 - DNA, 22 bp, Homo sapiens
ttagaggactgtaggtgggaat

SEQ ID NO: 9207199 - DNA, 21 bp, Homo sapiens
ttagaagctaatgcagctggt

SEQ ID NO: 9207200 - DNA, 22 bp, Homo sapiens
ttagaaagctttccatagtcaa

SEQ ID NO: 9207201 - DNA, 21 bp, Homo sapiens
ttagaaagctcactacagtta

SEQ ID NO: 9207202 - DNA, 19 bp, Homo sapiens
ttagaaactgttgacactg

SEQ ID NO: 9207203 - DNA, 20 bp, Homo sapiens
ttagaaagagcgtgataaga

SEQ ID NO: 9207204 - DNA, 22 bp, Homo sapiens
ttagaaagagtataccagaaac

SEQ ID NO: 9207205 - DNA, 22 bp, Homo sapiens
ttagaaagaactttagatatca

SEQ ID NO: 9207206 - DNA, 22 bp, Homo sapiens
ttagaaagaactttagatatca

SEQ ID NO: 9207207 - DNA, 22 bp, Homo sapiens
ttacttgatgatgtataaagtc

SEQ ID NO: 9207208 - DNA, 22 bp, Homo sapiens
ttacttgaaggcagaaaagttt

SEQ ID NO: 9207209 - DNA, 22 bp, Homo sapiens
ttaccaaatgaaatagagattt

SEQ ID NO: 9207210 - DNA, 22 bp, Homo sapiens
ttaccaaatcccgtgcacattc

SEQ ID NO: 9207211 - DNA, 22 bp, Homo sapiens
ttactaggccagttttcacttt

SEQ ID NO: 9207212 - DNA, 22 bp, Homo sapiens
ttactagtggagaaactgaggc

SEQ ID NO: 9207213 - DNA, 22 bp, Homo sapiens
ttactcagtctcccatacattg

SEQ ID NO: 9207214 - DNA, 20 bp, Homo sapiens
ttactcagttcctgccatgc

SEQ ID NO: 9207215 - DNA, 22 bp, Homo sapiens
ttacatattatccaaaactgct

SEQ ID NO: 9207216 - DNA, 22 bp, Homo sapiens
ttacatcattgagacatacata

SEQ ID NO: 9207217 - DNA, 19 bp, Homo sapiens
ttacatctgcaacactggt

SEQ ID NO: 9207218 - DNA, 22 bp, Homo sapiens
ttacatattatccaaaactgct

SEQ ID NO: 9207219 - DNA, 22 bp, Homo sapiens
ttacagtaatcgagtgttgtgg

SEQ ID NO: 9207220 - DNA, 22 bp, Homo sapiens
ttacagtagctttatttggagt

SEQ ID NO: 9207221 - DNA, 22 bp, Homo sapiens
ttacagtagattttgaatgtgg

SEQ ID NO: 9207222 - DNA, 22 bp, Homo sapiens
ttacacaattactcactcctgg

SEQ ID NO: 9207223 - DNA, 22 bp, Homo sapiens
ttacaaactgtcatatagtatt

SEQ ID NO: 9207224 - DNA, 22 bp, Homo sapiens
ttacaaactgtcatatagtatt

SEQ ID NO: 9207225 - DNA, 22 bp, Homo sapiens
ttacacaacagtgcatcagcag

SEQ ID NO: 9207226 - DNA, 22 bp, Homo sapiens
ttacacaaagttagctcttgca

SEQ ID NO: 9207227 - DNA, 22 bp, Homo sapiens
ttacacaaacacattccagata

SEQ ID NO: 9207228 - DNA, 22 bp, Homo sapiens
ttacacaatatatggtacttgg

SEQ ID NO: 9207229 - DNA, 22 bp, Homo sapiens
ttacaaacaacagacatttatt

SEQ ID NO: 9207230 - DNA, 22 bp, Homo sapiens
ttaacatacatcatgaacaatg

SEQ ID NO: 9207231 - DNA, 22 bp, Homo sapiens
ttaacagtggctaagactgagg

SEQ ID NO: 9207232 - DNA, 22 bp, Homo sapiens
ttaagaatggaatgaggaattt

SEQ ID NO: 9207233 - DNA, 22 bp, Homo sapiens
ttaagaatgtgccttttggttg

SEQ ID NO: 9207234 - DNA, 22 bp, Homo sapiens
ttaagaatgtgccttttggttg

SEQ ID NO: 9207235 - DNA, 22 bp, Homo sapiens
ttaacttttatttctgctcgcc

SEQ ID NO: 9207236 - DNA, 20 bp, Homo sapiens
ttaagaaaagcacatcctgc

SEQ ID NO: 9207237 - DNA, 18 bp, Homo sapiens
ttaaggataagcagacta

SEQ ID NO: 9207238 - DNA, 22 bp, Homo sapiens
ttaattactaagcacaatgcaa

SEQ ID NO: 9207239 - DNA, 22 bp, Homo sapiens
ttaatttatacataatcacagg

SEQ ID NO: 9207240 - DNA, 22 bp, Homo sapiens
ttaaatattatgttgtctgcaa

SEQ ID NO: 9207241 - DNA, 22 bp, Homo sapiens
ttaaatattttcagcagggtca

SEQ ID NO: 9207242 - DNA, 22 bp, Homo sapiens
tgttttgtgcatttacaacatg

SEQ ID NO: 9207243 - DNA, 22 bp, Homo sapiens
tgttttctgtgtagagatcaca

SEQ ID NO: 9207244 - DNA, 22 bp, Homo sapiens
ttaacaatagagtttcttcagg

SEQ ID NO: 9207245 - DNA, 22 bp, Homo sapiens
ttaaatgagatgttcagatatt

SEQ ID NO: 9207246 - DNA, 22 bp, Homo sapiens
ttaaatgaacgagatatgcaac

SEQ ID NO: 9207247 - DNA, 22 bp, Homo sapiens
ttaaatgatgcatatcatttag

SEQ ID NO: 9207248 - DNA, 22 bp, Homo sapiens
ttaaatgctcacataaaggtag

SEQ ID NO: 9207249 - DNA, 22 bp, Homo sapiens
ttaaatgagatgttcagatatt

SEQ ID NO: 9207250 - DNA, 22 bp, Homo sapiens
ttcagtagggccctcacacagt

SEQ ID NO: 9207251 - DNA, 22 bp, Homo sapiens
ttcacagtggccctctctgagt

SEQ ID NO: 9207252 - DNA, 22 bp, Homo sapiens
ttcacagtggctaagttctgca

SEQ ID NO: 9207253 - DNA, 22 bp, Homo sapiens
ttcacagtggctaagttctgca

SEQ ID NO: 9207254 - DNA, 20 bp, Homo sapiens
ttcatgggagcaaagaggcc

SEQ ID NO: 9207255 - DNA, 22 bp, Homo sapiens
ttcatgttggattcactgtgag

SEQ ID NO: 9207256 - DNA, 22 bp, Homo sapiens
ttcatggatcatgccttttgtg

SEQ ID NO: 9207257 - DNA, 22 bp, Homo sapiens
ttcatggcaggagtcagaagct

SEQ ID NO: 9207258 - DNA, 22 bp, Homo sapiens
ttcagtggtttgatgatgtata

SEQ ID NO: 9207259 - DNA, 22 bp, Homo sapiens
ttcaatgttaagaagaatatgt

SEQ ID NO: 9207260 - DNA, 22 bp, Homo sapiens
ttcaagaagcccaaagactagc

SEQ ID NO: 9207261 - DNA, 22 bp, Homo sapiens
ttcacagtgagctatgtcttgt

SEQ ID NO: 9207262 - DNA, 22 bp, Homo sapiens
ttcacagtgccagggggcaggc

SEQ ID NO: 9207263 - DNA, 22 bp, Homo sapiens
ttagagtttttgtaagtacaat

SEQ ID NO: 9207264 - DNA, 23 bp, Homo sapiens
ttcaaagcttaagctctttccac

SEQ ID NO: 9207265 - DNA, 22 bp, Homo sapiens
ttagagttttatcattgcctta

SEQ ID NO: 9207266 - DNA, 21 bp, Homo sapiens
ttagagttgccattatatgta

SEQ ID NO: 9207267 - DNA, 18 bp, Homo sapiens
ttcctccacagagcgctg

SEQ ID NO: 9207268 - DNA, 22 bp, Homo sapiens
ttcctctggaggctctaggaga

SEQ ID NO: 9207269 - DNA, 22 bp, Homo sapiens
ttcctctggggccaggccaaca

SEQ ID NO: 9207270 - DNA, 22 bp, Homo sapiens
ttcctctgtatgctttgctgct

SEQ ID NO: 9207271 - DNA, 22 bp, Homo sapiens
ttcctctgtagttgctgatgaa

SEQ ID NO: 9207272 - DNA, 22 bp, Homo sapiens
ttcctcagggcggatgggcagg

SEQ ID NO: 9207273 - DNA, 20 bp, Homo sapiens
ttcctcaggagaggatgtta

SEQ ID NO: 9207274 - DNA, 22 bp, Homo sapiens
ttcctcagccaaggctgggatc

SEQ ID NO: 9207275 - DNA, 22 bp, Homo sapiens
ttcctagggcagagccgctggg

SEQ ID NO: 9207276 - DNA, 22 bp, Homo sapiens
ttcctaggatggtgaagcagga

SEQ ID NO: 9207277 - DNA, 22 bp, Homo sapiens
ttccagaattgggagccttgag

SEQ ID NO: 9207278 - DNA, 22 bp, Homo sapiens
ttccagaattttgttctgcttg

SEQ ID NO: 9207279 - DNA, 22 bp, Homo sapiens
ttccagaagatggcagcaaagg

SEQ ID NO: 9207280 - DNA, 22 bp, Homo sapiens
ttccagaagcctccatattact

SEQ ID NO: 9207281 - DNA, 22 bp, Homo sapiens
ttccctggggaaggtgaccttt

SEQ ID NO: 9207282 - DNA, 22 bp, Homo sapiens
ttccctggcatgagtgtaagat

SEQ ID NO: 9207283 - DNA, 22 bp, Homo sapiens
ttcctaagtcctgccagcagtc

SEQ ID NO: 9207284 - DNA, 22 bp, Homo sapiens
ttccagaaatctttcagctcaa

SEQ ID NO: 9207285 - DNA, 22 bp, Homo sapiens
ttccagaacaatgtggacgtat

SEQ ID NO: 9207286 - DNA, 22 bp, Homo sapiens
ttccagaactcaagaaatgccc

SEQ ID NO: 9207287 - DNA, 22 bp, Homo sapiens
ttctagatagagtgcaaattat

SEQ ID NO: 9207288 - DNA, 22 bp, Homo sapiens
ttctagaggggagatactagta

SEQ ID NO: 9207289 - DNA, 22 bp, Homo sapiens
ttctagcagagggcatctgctg

SEQ ID NO: 9207290 - DNA, 22 bp, Homo sapiens
ttctagggaatgggatgaggat

SEQ ID NO: 9207291 - DNA, 22 bp, Homo sapiens
ttctagaaactggagcaaacag

SEQ ID NO: 9207292 - DNA, 22 bp, Homo sapiens
ttctagaatgttttgaaaggga

SEQ ID NO: 9207293 - DNA, 22 bp, Homo sapiens
ttctacaaatatttactgttcc

SEQ ID NO: 9207294 - DNA, 22 bp, Homo sapiens
ttctacaatatgaataatgaag

SEQ ID NO: 9207295 - DNA, 22 bp, Homo sapiens
ttctaatcccagctctactact

SEQ ID NO: 9207296 - DNA, 22 bp, Homo sapiens
ttccttctcagccctcgaggat

SEQ ID NO: 9207297 - DNA, 22 bp, Homo sapiens
ttctaagaatgctttgcaaaat

SEQ ID NO: 9207298 - DNA, 22 bp, Homo sapiens
ttcctgttgtgttagagtcaat

SEQ ID NO: 9207299 - DNA, 19 bp, Homo sapiens
ttctgggcagcacatgaat

SEQ ID NO: 9207300 - DNA, 22 bp, Homo sapiens
ttctgggcagagctggagctgc

SEQ ID NO: 9207301 - DNA, 20 bp, Homo sapiens
ttctgggcagccatgtactt

SEQ ID NO: 9207302 - DNA, 19 bp, Homo sapiens
ttctgggcattcatattta

SEQ ID NO: 9207303 - DNA, 22 bp, Homo sapiens
ttctgggccaatctcttaatct

SEQ ID NO: 9207304 - DNA, 22 bp, Homo sapiens
ttctgggcatgttacattctgt

SEQ ID NO: 9207305 - DNA, 22 bp, Homo sapiens
ttctgggcaggactggggaccc

SEQ ID NO: 9207306 - DNA, 22 bp, Homo sapiens
ttctgggcagttggaaatttca

SEQ ID NO: 9207307 - DNA, 22 bp, Homo sapiens
ttctgggcacacaggccctggt

SEQ ID NO: 9207308 - DNA, 22 bp, Homo sapiens
ttctgggcaccaccacagactt

SEQ ID NO: 9207309 - DNA, 22 bp, Homo sapiens
ttctgctttcagttcttctggg

SEQ ID NO: 9207310 - DNA, 22 bp, Homo sapiens
ttctgcttttctctgtctgagt

SEQ ID NO: 9207311 - DNA, 22 bp, Homo sapiens
ttctgcttttattgccagagtt

SEQ ID NO: 9207312 - DNA, 20 bp, Homo sapiens
ttctgcttgcaaatatcaag

SEQ ID NO: 9207313 - DNA, 22 bp, Homo sapiens
ttctcttttgtgatgtgagatg

SEQ ID NO: 9207314 - DNA, 22 bp, Homo sapiens
ttctcttttcaccagttgctaa

SEQ ID NO: 9207315 - DNA, 22 bp, Homo sapiens
ttctcttttagaggctccatga

SEQ ID NO: 9207316 - DNA, 22 bp, Homo sapiens
ttctataagactcatatttctt

SEQ ID NO: 9207317 - DNA, 22 bp, Homo sapiens
ttctataaatgaatgtgtatat

SEQ ID NO: 9207318 - DNA, 22 bp, Homo sapiens
ttctgagatacttttggcacca

SEQ ID NO: 9207319 - DNA, 22 bp, Homo sapiens
ttctggtatgggaaatttcaag

SEQ ID NO: 9207320 - DNA, 21 bp, Homo sapiens
ttctgggccatgctgcttctc

SEQ ID NO: 9207321 - DNA, 22 bp, Homo sapiens
ttctgggcccaaccctagagtg

SEQ ID NO: 9207322 - DNA, 21 bp, Homo sapiens
ttctgggccggagaaggggcg

SEQ ID NO: 9207323 - DNA, 22 bp, Homo sapiens
ttctgggcccactgtagcatcc

SEQ ID NO: 9207324 - DNA, 22 bp, Homo sapiens
ttctgggctaccttcccggcag

SEQ ID NO: 9207325 - DNA, 22 bp, Homo sapiens
ttctgggcctcctaggacaggc

SEQ ID NO: 9207326 - DNA, 22 bp, Homo sapiens
ttctgggctcacagagcagcag

SEQ ID NO: 9207327 - DNA, 22 bp, Homo sapiens
ttctgggcctcctaggacaggc

SEQ ID NO: 9207328 - DNA, 22 bp, Homo sapiens
ttctgggcttgaaagtttaata

SEQ ID NO: 9207329 - DNA, 22 bp, Homo sapiens
ttctgggcttggctgtttccat

SEQ ID NO: 9207330 - DNA, 22 bp, Homo sapiens
ttctgggctctctttctgtgtg

SEQ ID NO: 9207331 - DNA, 22 bp, Homo sapiens
ttctgggctcccacatatttca

SEQ ID NO: 9207332 - DNA, 23 bp, Homo sapiens
ttctgggctgtggaagcctcggg

SEQ ID NO: 9207333 - DNA, 22 bp, Homo sapiens
ttctgggctgtccagagggtga

SEQ ID NO: 9207334 - DNA, 22 bp, Homo sapiens
ttcttacagagtttacagagcc

SEQ ID NO: 9207335 - DNA, 22 bp, Homo sapiens
ttctgtttataatttgcagttg

SEQ ID NO: 9207336 - DNA, 22 bp, Homo sapiens
ttctggttacattgttacagct

SEQ ID NO: 9207337 - DNA, 22 bp, Homo sapiens
ttcttctttatctcagtatcct

SEQ ID NO: 9207338 - DNA, 21 bp, Homo sapiens
ttcttcttggactgttttggc

SEQ ID NO: 9207339 - DNA, 21 bp, Homo sapiens
ttcttcttggactgttttggc

SEQ ID NO: 9207340 - DNA, 22 bp, Homo sapiens
ttcttctttcctataattaatt

SEQ ID NO: 9207341 - DNA, 22 bp, Homo sapiens
ttcttctttccccctgtggtac

SEQ ID NO: 9207342 - DNA, 22 bp, Homo sapiens
ttctttaaaatagtgagaaaga

SEQ ID NO: 9207343 - DNA, 22 bp, Homo sapiens
ttctttaaatgaattctctgta

SEQ ID NO: 9207344 - DNA, 22 bp, Homo sapiens
ttctttaaaatagtgagaaaga

SEQ ID NO: 9207345 - DNA, 22 bp, Homo sapiens
ttcttgctcaatgtctgtttaa

SEQ ID NO: 9207346 - DNA, 18 bp, Homo sapiens
ttctttaattcagtttga

SEQ ID NO: 9207347 - DNA, 22 bp, Homo sapiens
ttgatttcttactcttccaagg

SEQ ID NO: 9207348 - DNA, 22 bp, Homo sapiens
ttgatttatagaatgttcaagc

SEQ ID NO: 9207349 - DNA, 22 bp, Homo sapiens
ttgcaaagagataatcctaggc

SEQ ID NO: 9207350 - DNA, 22 bp, Homo sapiens
ttgcaaagactggcttaacagt

SEQ ID NO: 9207351 - DNA, 22 bp, Homo sapiens
ttgattaaaatgagacatcatt

SEQ ID NO: 9207352 - DNA, 22 bp, Homo sapiens
ttgagtctctgccaaaacacaa

SEQ ID NO: 9207353 - DNA, 22 bp, Homo sapiens
ttgaggccaaaaagtcctatga

SEQ ID NO: 9207354 - DNA, 22 bp, Homo sapiens
ttgaagcacaatgtcttttatc

SEQ ID NO: 9207355 - DNA, 22 bp, Homo sapiens
ttgaagcatttgctatagcatt

SEQ ID NO: 9207356 - DNA, 22 bp, Homo sapiens
ttgaggagtgtgaggtctccca

SEQ ID NO: 9207357 - DNA, 22 bp, Homo sapiens
ttgaggcaaaatcaacgggaag

SEQ ID NO: 9207358 - DNA, 22 bp, Homo sapiens
ttgaagaagtaattttaagtct

SEQ ID NO: 9207359 - DNA, 22 bp, Homo sapiens
ttgaagaattaacagctgtgga

SEQ ID NO: 9207360 - DNA, 22 bp, Homo sapiens
ttgaagagcaccagcattttga

SEQ ID NO: 9207361 - DNA, 22 bp, Homo sapiens
ttgaagagcaccagcattttga

SEQ ID NO: 9207362 - DNA, 22 bp, Homo sapiens
ttgaagagaatcagaaggttga

SEQ ID NO: 9207363 - DNA, 22 bp, Homo sapiens
ttgaagagtttgatagagttga

SEQ ID NO: 9207364 - DNA, 22 bp, Homo sapiens
ttgaagattctttttgttagta

SEQ ID NO: 9207365 - DNA, 22 bp, Homo sapiens
ttctttatgttaatgaatctat

SEQ ID NO: 9207366 - DNA, 21 bp, Homo sapiens
aggcagcaggatccagggaca

SEQ ID NO: 9207367 - DNA, 22 bp, Homo sapiens
catttgaaattcttagaacaaa

SEQ ID NO: 9207368 - DNA, 22 bp, Homo sapiens
aggcactgtgctgatgtcttat

SEQ ID NO: 9207369 - DNA, 22 bp, Homo sapiens
aggcactgtgctgatgtcttat

SEQ ID NO: 9207370 - DNA, 22 bp, Homo sapiens
cattaaatatcaacctagacta

SEQ ID NO: 9207371 - DNA, 22 bp, Homo sapiens
cattaaatcttccagacctcac

SEQ ID NO: 9207372 - DNA, 22 bp, Homo sapiens
cattaaaatatctcatggtgtt

SEQ ID NO: 9207373 - DNA, 19 bp, Homo sapiens
aggcagcaggccagggatg

SEQ ID NO: 9207374 - DNA, 22 bp, Homo sapiens
ccaagctacttaggagtctgag

SEQ ID NO: 9207375 - DNA, 22 bp, Homo sapiens
ccaagctgcctgaggcaaattt

SEQ ID NO: 9207376 - DNA, 22 bp, Homo sapiens
ccaagctgactgtgctgttgtg

SEQ ID NO: 9207377 - DNA, 22 bp, Homo sapiens
ccaatacactttatagaagaaa

SEQ ID NO: 9207378 - DNA, 20 bp, Homo sapiens
ccaataaagctctataggga

SEQ ID NO: 9207379 - DNA, 23 bp, Homo sapiens
ccaagcttctaatgctgctgagc

SEQ ID NO: 9207380 - DNA, 22 bp, Homo sapiens
ccaagctggatttagctgcaca

SEQ ID NO: 9207381 - DNA, 22 bp, Homo sapiens
ccaagctgagcaccatctgatc

SEQ ID NO: 9207382 - DNA, 22 bp, Homo sapiens
ccaagctggacagcagcaagga

SEQ ID NO: 9207383 - DNA, 23 bp, Homo sapiens
ccaagcttgtccctgcctgcttt

SEQ ID NO: 9207384 - DNA, 22 bp, Homo sapiens
ccaagcttctttcctactacag

SEQ ID NO: 9207385 - DNA, 22 bp, Homo sapiens
ccaagggctatttacagaacag

SEQ ID NO: 9207386 - DNA, 22 bp, Homo sapiens
ccaagggctctggacagagtgg

SEQ ID NO: 9207387 - DNA, 22 bp, Homo sapiens
ccaagggctgctgaggtgtcca

SEQ ID NO: 9207388 - DNA, 22 bp, Homo sapiens
catggaggaccctcagggagct

SEQ ID NO: 9207389 - DNA, 22 bp, Homo sapiens
aggattgtgcctccagtcagaa

SEQ ID NO: 9207390 - DNA, 22 bp, Homo sapiens
catggcagaaacctgagctgct

SEQ ID NO: 9207391 - DNA, 22 bp, Homo sapiens
catggcagaaacctgagctgct

SEQ ID NO: 9207392 - DNA, 22 bp, Homo sapiens
aggagggatagaaaaatacttg

SEQ ID NO: 9207393 - DNA, 22 bp, Homo sapiens
catgtcaataaatataactgca

SEQ ID NO: 9207394 - DNA, 22 bp, Homo sapiens
catgtcagggaagagagtcagt

SEQ ID NO: 9207395 - DNA, 22 bp, Homo sapiens
catgtatagttggaactacatc

SEQ ID NO: 9207396 - DNA, 22 bp, Homo sapiens
catgtcaaccagttgtttgaat

SEQ ID NO: 9207397 - DNA, 22 bp, Homo sapiens
catgtagtcctaatgctggtga

SEQ ID NO: 9207398 - DNA, 22 bp, Homo sapiens
catggggatgaggctgagactt

SEQ ID NO: 9207399 - DNA, 23 bp, Homo sapiens
catggggagcagtgctcctgacc

SEQ ID NO: 9207400 - DNA, 22 bp, Homo sapiens
aggatttctgtgcctggaaaat

SEQ ID NO: 9207401 - DNA, 22 bp, Homo sapiens
catggctgaacactcagtgact

SEQ ID NO: 9207402 - DNA, 22 bp, Homo sapiens
catggctgaacactcagtgact

SEQ ID NO: 9207403 - DNA, 22 bp, Homo sapiens
aggagaagtaaggctagatgat

SEQ ID NO: 9207404 - DNA, 19 bp, Homo sapiens
aggagaagtagcagaaatt

SEQ ID NO: 9207405 - DNA, 17 bp, Homo sapiens
cagtggcctatggcttt

SEQ ID NO: 9207406 - DNA, 22 bp, Homo sapiens
cagtggcctgagccaggcttcc

SEQ ID NO: 9207407 - DNA, 22 bp, Homo sapiens
cagtgcccgccgccgttcctgg

SEQ ID NO: 9207408 - DNA, 22 bp, Homo sapiens
aggaccagaggccagagtcagc

SEQ ID NO: 9207409 - DNA, 22 bp, Homo sapiens
aggaccagaggccagagtcagc

SEQ ID NO: 9207410 - DNA, 22 bp, Homo sapiens
aggaccagaccgaactagctaa

SEQ ID NO: 9207411 - DNA, 22 bp, Homo sapiens
aggaccagtgagtctggcaagt

SEQ ID NO: 9207412 - DNA, 22 bp, Homo sapiens
aggaccagtgagtctggcaagt

SEQ ID NO: 9207413 - DNA, 22 bp, Homo sapiens
aggaccagtgagtctggcaagt

SEQ ID NO: 9207414 - DNA, 22 bp, Homo sapiens
aggacctgagagttggaaatcc

SEQ ID NO: 9207415 - DNA, 22 bp, Homo sapiens
aggacctgctaatgtgccaagt

SEQ ID NO: 9207416 - DNA, 22 bp, Homo sapiens
aggacctgactggctcctgctt

SEQ ID NO: 9207417 - DNA, 22 bp, Homo sapiens
aggacctgtacctcagcatcta

SEQ ID NO: 9207418 - DNA, 22 bp, Homo sapiens
caggtgggagcgaggagctact

SEQ ID NO: 9207419 - DNA, 22 bp, Homo sapiens
aggacatgtgcctccagggcag

SEQ ID NO: 9207420 - DNA, 22 bp, Homo sapiens
caggtgggaccatgatagggca

SEQ ID NO: 9207421 - DNA, 22 bp, Homo sapiens
caggtggcttctctgcagcctt

SEQ ID NO: 9207422 - DNA, 22 bp, Homo sapiens
aggagggagcttaagccaggca

SEQ ID NO: 9207423 - DNA, 22 bp, Homo sapiens
aggagggagcttaagccaggca

SEQ ID NO: 9207424 - DNA, 22 bp, Homo sapiens
catagttcctacctaagcataa

SEQ ID NO: 9207425 - DNA, 22 bp, Homo sapiens
catagcggtattccacgtggtt

SEQ ID NO: 9207426 - DNA, 22 bp, Homo sapiens
catagagtgatgtaaggtatgt

SEQ ID NO: 9207427 - DNA, 22 bp, Homo sapiens
cagttctgagctttcccagaag

SEQ ID NO: 9207428 - DNA, 22 bp, Homo sapiens
cagttctgactttcataatgtc

SEQ ID NO: 9207429 - DNA, 22 bp, Homo sapiens
cagtggtggaatgaggaattgt

SEQ ID NO: 9207430 - DNA, 22 bp, Homo sapiens
cagtggtgaagagcaggggctc

SEQ ID NO: 9207431 - DNA, 22 bp, Homo sapiens
cagtggcgtgatctctgctcac

SEQ ID NO: 9207432 - DNA, 22 bp, Homo sapiens
cagtggcctttcctgctgctca

SEQ ID NO: 9207433 - DNA, 22 bp, Homo sapiens
cagtttcagaatcaaaacatca

SEQ ID NO: 9207434 - DNA, 22 bp, Homo sapiens
caggggctgagaaggaacgtcc

SEQ ID NO: 9207435 - DNA, 22 bp, Homo sapiens
caggggctgtggcacatggtgt

SEQ ID NO: 9207436 - DNA, 22 bp, Homo sapiens
cagggtgcagtgtcgctgctag

SEQ ID NO: 9207437 - DNA, 22 bp, Homo sapiens
cagggtgcatacccatgcatac

SEQ ID NO: 9207438 - DNA, 22 bp, Homo sapiens
cagggtgcagtgtcgctgctag

SEQ ID NO: 9207439 - DNA, 22 bp, Homo sapiens
caggtcctttagtgtccagaac

SEQ ID NO: 9207440 - DNA, 22 bp, Homo sapiens
caggtccttgtttgtaaagcag

SEQ ID NO: 9207441 - DNA, 22 bp, Homo sapiens
cagggtgcctgtcctcagcaaa

SEQ ID NO: 9207442 - DNA, 22 bp, Homo sapiens
cagggtgcgccactcagatgta

SEQ ID NO: 9207443 - DNA, 22 bp, Homo sapiens
cagggtgcctgtcctcagcaaa

SEQ ID NO: 9207444 - DNA, 22 bp, Homo sapiens
cagggtgcctcccgctcgccgg

SEQ ID NO: 9207445 - DNA, 22 bp, Homo sapiens
cagggtgcctcccgctcgccgg

SEQ ID NO: 9207446 - DNA, 22 bp, Homo sapiens
caggtgagctctatctagggag

SEQ ID NO: 9207447 - DNA, 22 bp, Homo sapiens
caggtgagaggcggtcctgcat

SEQ ID NO: 9207448 - DNA, 20 bp, Homo sapiens
caggtgagcagatctgggtg

SEQ ID NO: 9207449 - DNA, 22 bp, Homo sapiens
caggtgaggctgaacagatgaa

SEQ ID NO: 9207450 - DNA, 22 bp, Homo sapiens
caggtgagttttcctccttggt

SEQ ID NO: 9207451 - DNA, 22 bp, Homo sapiens
cagggcttgcaggagaaagttt

SEQ ID NO: 9207452 - DNA, 22 bp, Homo sapiens
cagggatgtctctggaagggag

SEQ ID NO: 9207453 - DNA, 22 bp, Homo sapiens
cagggatgtctctggaagggag

SEQ ID NO: 9207454 - DNA, 22 bp, Homo sapiens
cagggcctccccggcagtcttt

SEQ ID NO: 9207455 - DNA, 22 bp, Homo sapiens
cagggcctgagggctgctctgc

SEQ ID NO: 9207456 - DNA, 22 bp, Homo sapiens
cagggcctgcaagagacctggg

SEQ ID NO: 9207457 - DNA, 22 bp, Homo sapiens
cagggcctcgaagcctctgggc

SEQ ID NO: 9207458 - DNA, 22 bp, Homo sapiens
caggctcagaagccagtggagc

SEQ ID NO: 9207459 - DNA, 22 bp, Homo sapiens
caggctcagaagccagtggagc

SEQ ID NO: 9207460 - DNA, 22 bp, Homo sapiens
caggctcagctctggccagtgc

SEQ ID NO: 9207461 - DNA, 22 bp, Homo sapiens
agctgtgattatccactggaat

SEQ ID NO: 9207462 - DNA, 22 bp, Homo sapiens
caggctcactgtaaggtcagct

SEQ ID NO: 9207463 - DNA, 22 bp, Homo sapiens
caggctcactgtaaggtcagct

SEQ ID NO: 9207464 - DNA, 22 bp, Homo sapiens
caggctcactttctcagtcaca

SEQ ID NO: 9207465 - DNA, 22 bp, Homo sapiens
caggctcactgtaaggtcagct

SEQ ID NO: 9207466 - DNA, 18 bp, Homo sapiens
agctggggcctctggtcc

SEQ ID NO: 9207467 - DNA, 22 bp, Homo sapiens
agctggggcatttatccactaa

SEQ ID NO: 9207468 - DNA, 22 bp, Homo sapiens
agctgtgctgccaagttgctga

SEQ ID NO: 9207469 - DNA, 22 bp, Homo sapiens
agctgtgctgtggtcatctggg

SEQ ID NO: 9207470 - DNA, 22 bp, Homo sapiens
agctgtggaagactgtcagggt

SEQ ID NO: 9207471 - DNA, 22 bp, Homo sapiens
agctgtggagtagggggttgga

SEQ ID NO: 9207472 - DNA, 19 bp, Homo sapiens
agctgtggatgtgggattt

SEQ ID NO: 9207473 - DNA, 22 bp, Homo sapiens
caggctgctccagggtaggaaa

SEQ ID NO: 9207474 - DNA, 22 bp, Homo sapiens
caggctgcggtcggctctggtc

SEQ ID NO: 9207475 - DNA, 22 bp, Homo sapiens
caggctgagctctggcctgggc

SEQ ID NO: 9207476 - DNA, 22 bp, Homo sapiens
caggctgctgcctagaatgaca

SEQ ID NO: 9207477 - DNA, 22 bp, Homo sapiens
caggctgctgacaggcttggag

SEQ ID NO: 9207478 - DNA, 22 bp, Homo sapiens
caggctgctgtccacaaagcat

SEQ ID NO: 9207479 - DNA, 22 bp, Homo sapiens
caggctggacattagatacata

SEQ ID NO: 9207480 - DNA, 22 bp, Homo sapiens
caggctggacattagatacata

SEQ ID NO: 9207481 - DNA, 22 bp, Homo sapiens
caggctggagtgcagtgtcgcc

SEQ ID NO: 9207482 - DNA, 22 bp, Homo sapiens
caggctggagtgcagtgtcgcc

SEQ ID NO: 9207483 - DNA, 22 bp, Homo sapiens
caggctggagtgcagtggtgcc

SEQ ID NO: 9207484 - DNA, 22 bp, Homo sapiens
caggctggagtgcagtggtgcc

SEQ ID NO: 9207485 - DNA, 22 bp, Homo sapiens
caggctggagtgcagttgtgca

SEQ ID NO: 9207486 - DNA, 22 bp, Homo sapiens
caggctggagtgcagttgtgca

SEQ ID NO: 9207487 - DNA, 22 bp, Homo sapiens
caggctggagttacctttaggg

SEQ ID NO: 9207488 - DNA, 22 bp, Homo sapiens
cagggagcggagtcccatgcct

SEQ ID NO: 9207489 - DNA, 22 bp, Homo sapiens
cagggagctgacaaccaaggag

SEQ ID NO: 9207490 - DNA, 22 bp, Homo sapiens
cagggagctggctggctgtgcc

SEQ ID NO: 9207491 - DNA, 22 bp, Homo sapiens
cagggatgggatggagtcagtt

SEQ ID NO: 9207492 - DNA, 22 bp, Homo sapiens
cagggatgggatggagtcagtt

SEQ ID NO: 9207493 - DNA, 22 bp, Homo sapiens
caggaaggaccgtccagatcag

SEQ ID NO: 9207494 - DNA, 22 bp, Homo sapiens
agctgcagcactccagtagccg

SEQ ID NO: 9207495 - DNA, 22 bp, Homo sapiens
caggaagagaacatggaggctg

SEQ ID NO: 9207496 - DNA, 22 bp, Homo sapiens
agctgcagattctatctagaag

SEQ ID NO: 9207497 - DNA, 22 bp, Homo sapiens
agctgcagatcaataggctcac

SEQ ID NO: 9207498 - DNA, 23 bp, Homo sapiens
agctgcagatgctcagcgggcag

SEQ ID NO: 9207499 - DNA, 20 bp, Homo sapiens
agctgcagaacccactggac

SEQ ID NO: 9207500 - DNA, 19 bp, Homo sapiens
agctgcagaccagaagtgc

SEQ ID NO: 9207501 - DNA, 22 bp, Homo sapiens
agctgcagagaaaagaggctgg

SEQ ID NO: 9207502 - DNA, 18 bp, Homo sapiens
agctgcagaccaggaggt

SEQ ID NO: 9207503 - DNA, 22 bp, Homo sapiens
agctgcagaggtttgtgcaaca

SEQ ID NO: 9207504 - DNA, 22 bp, Homo sapiens
agctgcagaggtttgtgcaaca

SEQ ID NO: 9207505 - DNA, 22 bp, Homo sapiens
caggaaggcgcggctgtgcctg

SEQ ID NO: 9207506 - DNA, 22 bp, Homo sapiens
caggaaggcgcggctgtgcctg

SEQ ID NO: 9207507 - DNA, 22 bp, Homo sapiens
caggaaggcccacctgtcctgt

SEQ ID NO: 9207508 - DNA, 22 bp, Homo sapiens
agctgcagttcgttccagctct

SEQ ID NO: 9207509 - DNA, 22 bp, Homo sapiens
agctgcagtcaagctgggccac

SEQ ID NO: 9207510 - DNA, 22 bp, Homo sapiens
agctgcagttagccccagatga

SEQ ID NO: 9207511 - DNA, 22 bp, Homo sapiens
cagctgaattcttcagactcca

SEQ ID NO: 9207512 - DNA, 22 bp, Homo sapiens
cagctctgggtgacaggagggc

SEQ ID NO: 9207513 - DNA, 22 bp, Homo sapiens
cagctctggttcctgggcccag

SEQ ID NO: 9207514 - DNA, 22 bp, Homo sapiens
cagctctgtaaattccttcatc

SEQ ID NO: 9207515 - DNA, 20 bp, Homo sapiens
cagctctgggcaggtcgagg

SEQ ID NO: 9207516 - DNA, 20 bp, Homo sapiens
cagctctgggcaggtcgagg

SEQ ID NO: 9207517 - DNA, 22 bp, Homo sapiens
cagctctggggcagagtgacta

SEQ ID NO: 9207518 - DNA, 22 bp, Homo sapiens
cagctctgggtaggaggaatct

SEQ ID NO: 9207519 - DNA, 22 bp, Homo sapiens
cagctctggtccagggagggca

SEQ ID NO: 9207520 - DNA, 22 bp, Homo sapiens
cagctctggttcctgggcccag

SEQ ID NO: 9207521 - DNA, 22 bp, Homo sapiens
cagctctggttcctgggcccag

SEQ ID NO: 9207522 - DNA, 22 bp, Homo sapiens
cagctctgggtgacaggagggc

SEQ ID NO: 9207523 - DNA, 20 bp, Homo sapiens
agctgcaacagactgtatgg

SEQ ID NO: 9207524 - DNA, 22 bp, Homo sapiens
agctgcaacatctgcttgtccc

SEQ ID NO: 9207525 - DNA, 23 bp, Homo sapiens
agctgcaagactccctgtctgag

SEQ ID NO: 9207526 - DNA, 22 bp, Homo sapiens
agctgcaaagatctgtcagtca

SEQ ID NO: 9207527 - DNA, 22 bp, Homo sapiens
cagctgagaccagaatgcaggt

SEQ ID NO: 9207528 - DNA, 22 bp, Homo sapiens
agctgattccactttttcccca

SEQ ID NO: 9207529 - DNA, 22 bp, Homo sapiens
caggcactgcactaccactttt

SEQ ID NO: 9207530 - DNA, 19 bp, Homo sapiens
agctgctggcccagggacc

SEQ ID NO: 9207531 - DNA, 22 bp, Homo sapiens
caggaggagggtacaccatcag

SEQ ID NO: 9207532 - DNA, 22 bp, Homo sapiens
caggaggagggtacaccatcag

SEQ ID NO: 9207533 - DNA, 22 bp, Homo sapiens
caggaggagggcagccgcctcc

SEQ ID NO: 9207534 - DNA, 22 bp, Homo sapiens
caggaggagctggccgcctcat

SEQ ID NO: 9207535 - DNA, 22 bp, Homo sapiens
caggaggacatactggctcaca

SEQ ID NO: 9207536 - DNA, 22 bp, Homo sapiens
caggaggacatactggctcaca

SEQ ID NO: 9207537 - DNA, 22 bp, Homo sapiens
caggaggagcattagcgtctca

SEQ ID NO: 9207538 - DNA, 22 bp, Homo sapiens
caggaggagccagcgcccttca

SEQ ID NO: 9207539 - DNA, 22 bp, Homo sapiens
caggagcccagagtcctcagct

SEQ ID NO: 9207540 - DNA, 22 bp, Homo sapiens
caggagccccaggctgacaata

SEQ ID NO: 9207541 - DNA, 22 bp, Homo sapiens
caggagccccaggctgacaata

SEQ ID NO: 9207542 - DNA, 18 bp, Homo sapiens
agctggccctggctgccg

SEQ ID NO: 9207543 - DNA, 22 bp, Homo sapiens
agctggccctcgagagccaatt

SEQ ID NO: 9207544 - DNA, 22 bp, Homo sapiens
caggccagagtccaactccaga

SEQ ID NO: 9207545 - DNA, 17 bp, Homo sapiens
aggctggctcacaggga

SEQ ID NO: 9207546 - DNA, 17 bp, Homo sapiens
aggctggctcacaggga

SEQ ID NO: 9207547 - DNA, 22 bp, Homo sapiens
cccagagcatgtgctgcctttg

SEQ ID NO: 9207548 - DNA, 22 bp, Homo sapiens
cccagagatgtcctgagtgata

SEQ ID NO: 9207549 - DNA, 22 bp, Homo sapiens
aggctgcctcttttgagagggt

SEQ ID NO: 9207550 - DNA, 22 bp, Homo sapiens
cccactgtctgttcccagggcc

SEQ ID NO: 9207551 - DNA, 16 bp, Homo sapiens
cccactgtctggtctt

SEQ ID NO: 9207552 - DNA, 18 bp, Homo sapiens
cccactgtccccacaggc

SEQ ID NO: 9207553 - DNA, 22 bp, Homo sapiens
ccatggtctctgtgaagcctgt

SEQ ID NO: 9207554 - DNA, 20 bp, Homo sapiens
aggctgcctaaggctctgca

SEQ ID NO: 9207555 - DNA, 22 bp, Homo sapiens
ccatggcttacagatggagcat

SEQ ID NO: 9207556 - DNA, 22 bp, Homo sapiens
ccatggcttacagatggagcat

SEQ ID NO: 9207557 - DNA, 22 bp, Homo sapiens
ccatggcttctttctctgccag

SEQ ID NO: 9207558 - DNA, 22 bp, Homo sapiens
ccatggcttggaaagggaggtg

SEQ ID NO: 9207559 - DNA, 22 bp, Homo sapiens
ccatggctccttgccctgtagc

SEQ ID NO: 9207560 - DNA, 22 bp, Homo sapiens
ccatggctcttaccttgttata

SEQ ID NO: 9207561 - DNA, 22 bp, Homo sapiens
ccatggctaagtatctgtagaa

SEQ ID NO: 9207562 - DNA, 22 bp, Homo sapiens
aggctgagtcgggaggatcact

SEQ ID NO: 9207563 - DNA, 22 bp, Homo sapiens
aggctgaggtaggaggatcgct

SEQ ID NO: 9207564 - DNA, 22 bp, Homo sapiens
aggctgaggtaggaggatcgct

SEQ ID NO: 9207565 - DNA, 22 bp, Homo sapiens
aggctgaggtaggaggatcgct

SEQ ID NO: 9207566 - DNA, 22 bp, Homo sapiens
aggctgagtcaagttagggtga

SEQ ID NO: 9207567 - DNA, 22 bp, Homo sapiens
aggctctgtgatccacaatgag

SEQ ID NO: 9207568 - DNA, 22 bp, Homo sapiens
aggctctgtgatccacaatgag

SEQ ID NO: 9207569 - DNA, 21 bp, Homo sapiens
aggctctgtgaatatgtttcc

SEQ ID NO: 9207570 - DNA, 22 bp, Homo sapiens
aggctctgtgacaatcaagctg

SEQ ID NO: 9207571 - DNA, 22 bp, Homo sapiens
aggctctgtgacaatcaagctg

SEQ ID NO: 9207572 - DNA, 22 bp, Homo sapiens
ccagggtcttggagaggagtgc

SEQ ID NO: 9207573 - DNA, 22 bp, Homo sapiens
aggctcctgagaggcagaggct

SEQ ID NO: 9207574 - DNA, 22 bp, Homo sapiens
ccagggtgagaaaaggctggat

SEQ ID NO: 9207575 - DNA, 22 bp, Homo sapiens
ccagggtgagaaaaggctggat

SEQ ID NO: 9207576 - DNA, 22 bp, Homo sapiens
ccagggtgaccagctggcctag

SEQ ID NO: 9207577 - DNA, 22 bp, Homo sapiens
ccagggtgaggaggctcccacg

SEQ ID NO: 9207578 - DNA, 22 bp, Homo sapiens
aggctccctgaatcgcccgttc

SEQ ID NO: 9207579 - DNA, 22 bp, Homo sapiens
ccagggaagtagttgtgagagc

SEQ ID NO: 9207580 - DNA, 22 bp, Homo sapiens
ccagggagcctggtgtgtcagc

SEQ ID NO: 9207581 - DNA, 22 bp, Homo sapiens
ccagggagcccacaggacaatg

SEQ ID NO: 9207582 - DNA, 22 bp, Homo sapiens
aggctcagtgcaaatcattctg

SEQ ID NO: 9207583 - DNA, 22 bp, Homo sapiens
aggctcagttctgtggtgagcc

SEQ ID NO: 9207584 - DNA, 22 bp, Homo sapiens
aggctcattcttgcctctgagc

SEQ ID NO: 9207585 - DNA, 22 bp, Homo sapiens
aggctcatccccacaaagcaaa

SEQ ID NO: 9207586 - DNA, 22 bp, Homo sapiens
aggctccaaattaccaagctct

SEQ ID NO: 9207587 - DNA, 22 bp, Homo sapiens
ccaggctgtaaacaccttcaaa

SEQ ID NO: 9207588 - DNA, 22 bp, Homo sapiens
ccaggctgtaaacaccttcaaa

SEQ ID NO: 9207589 - DNA, 22 bp, Homo sapiens
aggctccaccagtcaggtgcat

SEQ ID NO: 9207590 - DNA, 22 bp, Homo sapiens
aggctcagcctgggcctagagc

SEQ ID NO: 9207591 - DNA, 17 bp, Homo sapiens
ccaggagcgtgggtctc

SEQ ID NO: 9207592 - DNA, 22 bp, Homo sapiens
ccaggagctatgtacacactat

SEQ ID NO: 9207593 - DNA, 22 bp, Homo sapiens
ccaggagctatgtacacactat

SEQ ID NO: 9207594 - DNA, 22 bp, Homo sapiens
ccaggagctggagggtgcagtg

SEQ ID NO: 9207595 - DNA, 22 bp, Homo sapiens
ccaggagctggagggtgcagtg

SEQ ID NO: 9207596 - DNA, 22 bp, Homo sapiens
ccaggagctatgtacacactat

SEQ ID NO: 9207597 - DNA, 22 bp, Homo sapiens
ccaggagctggcatgtggagag

SEQ ID NO: 9207598 - DNA, 22 bp, Homo sapiens
ccaggagctggcatgtggagag

SEQ ID NO: 9207599 - DNA, 22 bp, Homo sapiens
ccaggagctggagggtgcagtg

SEQ ID NO: 9207600 - DNA, 22 bp, Homo sapiens
ccaggaggaaagaccagcccat

SEQ ID NO: 9207601 - DNA, 22 bp, Homo sapiens
ccaggaggaaattctaaaggta

SEQ ID NO: 9207602 - DNA, 22 bp, Homo sapiens
aggcaggggagctggaagggta

SEQ ID NO: 9207603 - DNA, 22 bp, Homo sapiens
aggcaggggagctggaagggta

SEQ ID NO: 9207604 - DNA, 22 bp, Homo sapiens
aggcaggggagctggaagggta

SEQ ID NO: 9207605 - DNA, 22 bp, Homo sapiens
aggcaggggagctggaagggta

SEQ ID NO: 9207606 - DNA, 22 bp, Homo sapiens
ccacaggaagttatgagtacta

SEQ ID NO: 9207607 - DNA, 22 bp, Homo sapiens
ccacaggacacaactgctgacc

SEQ ID NO: 9207608 - DNA, 22 bp, Homo sapiens
ccacagcttcgcagtctgctgc

SEQ ID NO: 9207609 - DNA, 22 bp, Homo sapiens
ccacagcttcgcagtctgctgc

SEQ ID NO: 9207610 - DNA, 21 bp, Homo sapiens
ccacagctggtctctgagccc

SEQ ID NO: 9207611 - DNA, 22 bp, Homo sapiens
ccagagagtatcatggagagta

SEQ ID NO: 9207612 - DNA, 22 bp, Homo sapiens
ccagagagtcgatgggggacac

SEQ ID NO: 9207613 - DNA, 22 bp, Homo sapiens
ccacaggacggaggtctggccg

SEQ ID NO: 9207614 - DNA, 22 bp, Homo sapiens
ccacaggaggatgttcagacaa

SEQ ID NO: 9207615 - DNA, 22 bp, Homo sapiens
ccacaggacggaggtctggccg

SEQ ID NO: 9207616 - DNA, 20 bp, Homo sapiens
ccacaggagtccagtcgacc

SEQ ID NO: 9207617 - DNA, 22 bp, Homo sapiens
ccagagaaaggtttgattcatt

SEQ ID NO: 9207618 - DNA, 22 bp, Homo sapiens
aggccagaaatttggagtatgt

SEQ ID NO: 9207619 - DNA, 22 bp, Homo sapiens
ccagcagagcatggggaggaag

SEQ ID NO: 9207620 - DNA, 22 bp, Homo sapiens
aggccagacagctagaaacagg

SEQ ID NO: 9207621 - DNA, 22 bp, Homo sapiens
ccagcagaagctcccgctgggt

SEQ ID NO: 9207622 - DNA, 22 bp, Homo sapiens
ccagcactgctctcagactgag

SEQ ID NO: 9207623 - DNA, 19 bp, Homo sapiens
ccagcagacacagctgccc

SEQ ID NO: 9207624 - DNA, 22 bp, Homo sapiens
aggcatggatggatccagggct

SEQ ID NO: 9207625 - DNA, 22 bp, Homo sapiens
ccagagcaattctcacagaact

SEQ ID NO: 9207626 - DNA, 22 bp, Homo sapiens
ccaggagagcaggcgtgcagct

SEQ ID NO: 9207627 - DNA, 22 bp, Homo sapiens
ccaggagagcagaagcccaggc

SEQ ID NO: 9207628 - DNA, 22 bp, Homo sapiens
ccaggagatgggaaagtagcag

SEQ ID NO: 9207629 - DNA, 22 bp, Homo sapiens
ccaggagatgggaaagtagcag

SEQ ID NO: 9207630 - DNA, 22 bp, Homo sapiens
ccaggagcgcgtgaacaggctg

SEQ ID NO: 9207631 - DNA, 22 bp, Homo sapiens
ccaggagcgggaaaaggaagaa

SEQ ID NO: 9207632 - DNA, 22 bp, Homo sapiens
ccaggagcgcgtgaacaggctg

SEQ ID NO: 9207633 - DNA, 22 bp, Homo sapiens
ccaggagatttttccatagcac

SEQ ID NO: 9207634 - DNA, 22 bp, Homo sapiens
aggccctgggcagttctgtagc

SEQ ID NO: 9207635 - DNA, 22 bp, Homo sapiens
aggccctggcccccagagattc

SEQ ID NO: 9207636 - DNA, 22 bp, Homo sapiens
aggccctggcactgcctgggag

SEQ ID NO: 9207637 - DNA, 22 bp, Homo sapiens
aggccctggcccccagagattc

SEQ ID NO: 9207638 - DNA, 22 bp, Homo sapiens
ccagcttttcttatcattataa

SEQ ID NO: 9207639 - DNA, 22 bp, Homo sapiens
ccagcttttcagaatctgcctg

SEQ ID NO: 9207640 - DNA, 19 bp, Homo sapiens
ccagcctctcttccacccc

SEQ ID NO: 9207641 - DNA, 22 bp, Homo sapiens
ccagcctgaaatgcctcatcct

SEQ ID NO: 9207642 - DNA, 22 bp, Homo sapiens
ccagcctgaaatgcctcatcct

SEQ ID NO: 9207643 - DNA, 22 bp, Homo sapiens
ccagcctgaaatgcctcatcct

SEQ ID NO: 9207644 - DNA, 22 bp, Homo sapiens
ccagcctgaaatgcctcatcct

SEQ ID NO: 9207645 - DNA, 22 bp, Homo sapiens
ccagcctgaaatgcctcatcct

SEQ ID NO: 9207646 - DNA, 22 bp, Homo sapiens
ccagcctcatcgcctgcctgtc

SEQ ID NO: 9207647 - DNA, 22 bp, Homo sapiens
ccagccctgccagagagagctg

SEQ ID NO: 9207648 - DNA, 22 bp, Homo sapiens
ccagcctcatcatattcctgct

SEQ ID NO: 9207649 - DNA, 22 bp, Homo sapiens
aggccagagttaaggagaacag

SEQ ID NO: 9207650 - DNA, 17 bp, Homo sapiens
aggccagatgaggcaag

SEQ ID NO: 9207651 - DNA, 22 bp, Homo sapiens
ccagcttctctctgatgcagct

SEQ ID NO: 9207652 - DNA, 19 bp, Homo sapiens
ccagctggcctgggacctc

SEQ ID NO: 9207653 - DNA, 21 bp, Homo sapiens
ccagctttcccaagtcccttt

SEQ ID NO: 9207654 - DNA, 22 bp, Homo sapiens
ccagcttgaagatgtgctggtt

SEQ ID NO: 9207655 - DNA, 22 bp, Homo sapiens
ccagcttgctcctctgcaatgg

SEQ ID NO: 9207656 - DNA, 22 bp, Homo sapiens
ccagcttggaatatgccattgt

SEQ ID NO: 9207657 - DNA, 22 bp, Homo sapiens
ccagcttgtttgaagctcgtca

SEQ ID NO: 9207658 - DNA, 22 bp, Homo sapiens
ccagcttgtttgaagctcgtca

SEQ ID NO: 9207659 - DNA, 22 bp, Homo sapiens
ccagcctggactgggtcttgtg

SEQ ID NO: 9207660 - DNA, 22 bp, Homo sapiens
ccagcctgaaatgcctcatcct

SEQ ID NO: 9207661 - DNA, 22 bp, Homo sapiens
ccagcctggactgggtcttgtg

SEQ ID NO: 9207662 - DNA, 22 bp, Homo sapiens
agggaacagtgaaaggcatcag

SEQ ID NO: 9207663 - DNA, 22 bp, Homo sapiens
cccaggatggggctgcagttat

SEQ ID NO: 9207664 - DNA, 22 bp, Homo sapiens
cccaggatgatcgagagtggga

SEQ ID NO: 9207665 - DNA, 22 bp, Homo sapiens
cccaggatcacctggtcaaggg

SEQ ID NO: 9207666 - DNA, 22 bp, Homo sapiens
cccaggagttggaggctgcagt

SEQ ID NO: 9207667 - DNA, 22 bp, Homo sapiens
cccagggaagccatttctgact

SEQ ID NO: 9207668 - DNA, 22 bp, Homo sapiens
cccagggctgcagatggaggct

SEQ ID NO: 9207669 - DNA, 22 bp, Homo sapiens
cccagggccctggacagctaca

SEQ ID NO: 9207670 - DNA, 21 bp, Homo sapiens
cccagggaagccgcagtcacc

SEQ ID NO: 9207671 - DNA, 22 bp, Homo sapiens
cccagggctgtagaatgtccaa

SEQ ID NO: 9207672 - DNA, 22 bp, Homo sapiens
cccagggcttttctcactagac

SEQ ID NO: 9207673 - DNA, 22 bp, Homo sapiens
cccaggggaggtcctcagggaa

SEQ ID NO: 9207674 - DNA, 22 bp, Homo sapiens
cccaggggtaaggcgcagcgtg

SEQ ID NO: 9207675 - DNA, 22 bp, Homo sapiens
cccaggggaggtcctcagggaa

SEQ ID NO: 9207676 - DNA, 22 bp, Homo sapiens
aggcttctctgcaagatgttaa

SEQ ID NO: 9207677 - DNA, 22 bp, Homo sapiens
aggcttctgataccatgagaga

SEQ ID NO: 9207678 - DNA, 22 bp, Homo sapiens
aggcttctggggcaccgagcga

SEQ ID NO: 9207679 - DNA, 19 bp, Homo sapiens
aggcttctaccctgtccag

SEQ ID NO: 9207680 - DNA, 19 bp, Homo sapiens
aggcttctaccctgtccag

SEQ ID NO: 9207681 - DNA, 22 bp, Homo sapiens
aggcttctacgtggtcccaggg

SEQ ID NO: 9207682 - DNA, 22 bp, Homo sapiens
aggcttctaggaaactttctgg

SEQ ID NO: 9207683 - DNA, 22 bp, Homo sapiens
aggcttctagggttggcagcgg

SEQ ID NO: 9207684 - DNA, 22 bp, Homo sapiens
aggctggctgacttctgaagca

SEQ ID NO: 9207685 - DNA, 22 bp, Homo sapiens
aggctggctgagctgcagcctg

SEQ ID NO: 9207686 - DNA, 21 bp, Homo sapiens
aggcttggatctagacaggcc

SEQ ID NO: 9207687 - DNA, 22 bp, Homo sapiens
aggcttggaagtggcagaactg

SEQ ID NO: 9207688 - DNA, 22 bp, Homo sapiens
aggcttggaggttctgtagcca

SEQ ID NO: 9207689 - DNA, 19 bp, Homo sapiens
aggcttggattgtggccaa

SEQ ID NO: 9207690 - DNA, 18 bp, Homo sapiens
aggcttcttggctcagtc

SEQ ID NO: 9207691 - DNA, 19 bp, Homo sapiens
aggcttggaacagccttat

SEQ ID NO: 9207692 - DNA, 22 bp, Homo sapiens
aggcttcttgagccccacaggc

SEQ ID NO: 9207693 - DNA, 22 bp, Homo sapiens
aggcttcttcttcctatttagt

SEQ ID NO: 9207694 - DNA, 22 bp, Homo sapiens
agggatgctgctaagtggtcta

SEQ ID NO: 9207695 - DNA, 22 bp, Homo sapiens
agggatggaagacttgaagacc

SEQ ID NO: 9207696 - DNA, 22 bp, Homo sapiens
agggaggagtcctcaaagtcat

SEQ ID NO: 9207697 - DNA, 22 bp, Homo sapiens
agggaggagtcctcaaagtcat

SEQ ID NO: 9207698 - DNA, 22 bp, Homo sapiens
agggagaaaattggatgcacaa

SEQ ID NO: 9207699 - DNA, 22 bp, Homo sapiens
agggagaagagaacaaagccct

SEQ ID NO: 9207700 - DNA, 22 bp, Homo sapiens
agggagaacagttgcagcagac

SEQ ID NO: 9207701 - DNA, 22 bp, Homo sapiens
agggagaacagttgcagcagac

SEQ ID NO: 9207702 - DNA, 22 bp, Homo sapiens
ccctggaggaccccaatgtggc

SEQ ID NO: 9207703 - DNA, 22 bp, Homo sapiens
agggcagagctgtctaaatggc

SEQ ID NO: 9207704 - DNA, 18 bp, Homo sapiens
ccctcttgcacaaagcaa

SEQ ID NO: 9207705 - DNA, 20 bp, Homo sapiens
ccctctgcacatggctgtgg

SEQ ID NO: 9207706 - DNA, 22 bp, Homo sapiens
ccctctctgctgcatagaggaa

SEQ ID NO: 9207707 - DNA, 22 bp, Homo sapiens
ccctctctcggttgctgtggtt

SEQ ID NO: 9207708 - DNA, 22 bp, Homo sapiens
ccctcccaggagtggccagaga

SEQ ID NO: 9207709 - DNA, 22 bp, Homo sapiens
ccctcccaggagtggccagaga

SEQ ID NO: 9207710 - DNA, 20 bp, Homo sapiens
ccctctgcacatggctgtgg

SEQ ID NO: 9207711 - DNA, 22 bp, Homo sapiens
ccctctgcaggctggacctgcc

SEQ ID NO: 9207712 - DNA, 22 bp, Homo sapiens
ccctctgcctctgagtaggaca

SEQ ID NO: 9207713 - DNA, 22 bp, Homo sapiens
ccctctgctcaggtgcataggc

SEQ ID NO: 9207714 - DNA, 22 bp, Homo sapiens
ccctctgcctgcgccctggtgt

SEQ ID NO: 9207715 - DNA, 22 bp, Homo sapiens
ccctctgcctgcgccctggtgt

SEQ ID NO: 9207716 - DNA, 22 bp, Homo sapiens
ccctctggctcttctcaggccg

SEQ ID NO: 9207717 - DNA, 22 bp, Homo sapiens
ccctctgctcaggtgcataggc

SEQ ID NO: 9207718 - DNA, 22 bp, Homo sapiens
agggccccatagtcactgcccg

SEQ ID NO: 9207719 - DNA, 22 bp, Homo sapiens
ccgccctcacgaggtaggtacc

SEQ ID NO: 9207720 - DNA, 22 bp, Homo sapiens
ccgcccacactaaatatgagcg

SEQ ID NO: 9207721 - DNA, 21 bp, Homo sapiens
ccgccacctctaagctgggtc

SEQ ID NO: 9207722 - DNA, 22 bp, Homo sapiens
ccgaggctggcctcagggctgt

SEQ ID NO: 9207723 - DNA, 22 bp, Homo sapiens
ccctggaggctggaggcagtag

SEQ ID NO: 9207724 - DNA, 22 bp, Homo sapiens
cctcctctgtgcagctgtgggt

SEQ ID NO: 9207725 - DNA, 22 bp, Homo sapiens
agggctcctatgccccatggac

SEQ ID NO: 9207726 - DNA, 22 bp, Homo sapiens
agggctcctatgccccatggac

SEQ ID NO: 9207727 - DNA, 22 bp, Homo sapiens
agggctcctatgatgctctgcc

SEQ ID NO: 9207728 - DNA, 22 bp, Homo sapiens
agggctccgggccaccggcctg

SEQ ID NO: 9207729 - DNA, 22 bp, Homo sapiens
agggctcctccccggcctccac

SEQ ID NO: 9207730 - DNA, 22 bp, Homo sapiens
agggccctctggcaggccaggc

SEQ ID NO: 9207731 - DNA, 21 bp, Homo sapiens
cctcctgcccgcaagctaggg

SEQ ID NO: 9207732 - DNA, 22 bp, Homo sapiens
cctcctgcactgcaagcttgag

SEQ ID NO: 9207733 - DNA, 22 bp, Homo sapiens
cctcctgcacctccaggaactc

SEQ ID NO: 9207734 - DNA, 22 bp, Homo sapiens
cctcctggaaaaattccctggc

SEQ ID NO: 9207735 - DNA, 22 bp, Homo sapiens
cctcctggaaaaattccctggc

SEQ ID NO: 9207736 - DNA, 22 bp, Homo sapiens
cctcctggagcattggtgagga

SEQ ID NO: 9207737 - DNA, 18 bp, Homo sapiens
agggctgatgagtttggg

SEQ ID NO: 9207738 - DNA, 22 bp, Homo sapiens
cctcctggaggctctagggaaa

SEQ ID NO: 9207739 - DNA, 22 bp, Homo sapiens
cctctgggccagcctggaccct

SEQ ID NO: 9207740 - DNA, 16 bp, Homo sapiens
cctctgggatgtttgc

SEQ ID NO: 9207741 - DNA, 22 bp, Homo sapiens
cctctgggagactgctactgag

SEQ ID NO: 9207742 - DNA, 22 bp, Homo sapiens
cctctgggcaggtagcagcagc

SEQ ID NO: 9207743 - DNA, 22 bp, Homo sapiens
cctctgggcctggaagggcagt

SEQ ID NO: 9207744 - DNA, 22 bp, Homo sapiens
cctctgggcggagatctgctgc

SEQ ID NO: 9207745 - DNA, 22 bp, Homo sapiens
cctctgggccagcctggaccct

SEQ ID NO: 9207746 - DNA, 16 bp, Homo sapiens
cctctgggcctgcaag

SEQ ID NO: 9207747 - DNA, 22 bp, Homo sapiens
cctctgggaagccagtcctgct

SEQ ID NO: 9207748 - DNA, 22 bp, Homo sapiens
cctctgggaagccagtcctgct

SEQ ID NO: 9207749 - DNA, 21 bp, Homo sapiens
cctctggcttgtgctgtgccc

SEQ ID NO: 9207750 - DNA, 21 bp, Homo sapiens
cctctggcttgtgctgtgccc

SEQ ID NO: 9207751 - DNA, 22 bp, Homo sapiens
cctctggcttactgttgggttt

SEQ ID NO: 9207752 - DNA, 22 bp, Homo sapiens
agggctgcaggcaagatatggc

SEQ ID NO: 9207753 - DNA, 22 bp, Homo sapiens
cctgagagtgcgtgcctcctta

SEQ ID NO: 9207754 - DNA, 22 bp, Homo sapiens
cctgagagtgagtgcctcctta

SEQ ID NO: 9207755 - DNA, 22 bp, Homo sapiens
aggggagaaaaatgccttctgt

SEQ ID NO: 9207756 - DNA, 21 bp, Homo sapiens
aggggacagagtagctccagg

SEQ ID NO: 9207757 - DNA, 22 bp, Homo sapiens
cctgaggcccctgaggatagca

SEQ ID NO: 9207758 - DNA, 22 bp, Homo sapiens
cctgaggcaaggacttggtggc

SEQ ID NO: 9207759 - DNA, 22 bp, Homo sapiens
aggggctgcctggcttggcact

SEQ ID NO: 9207760 - DNA, 22 bp, Homo sapiens
cctggctcaggcacgcatggct

SEQ ID NO: 9207761 - DNA, 22 bp, Homo sapiens
cctggctcattatgtgccccca

SEQ ID NO: 9207762 - DNA, 22 bp, Homo sapiens
cctggctcagcagctctttctc

SEQ ID NO: 9207763 - DNA, 22 bp, Homo sapiens
cctggctcagaccccagttctg

SEQ ID NO: 9207764 - DNA, 22 bp, Homo sapiens
cctggctcagagtatgtcatcg

SEQ ID NO: 9207765 - DNA, 22 bp, Homo sapiens
agggtggccatgagggagagat

SEQ ID NO: 9207766 - DNA, 22 bp, Homo sapiens
cctggagcccctctggccagcc

SEQ ID NO: 9207767 - DNA, 22 bp, Homo sapiens
cctggccagcagccccttcctc

SEQ ID NO: 9207768 - DNA, 22 bp, Homo sapiens
agggtggctgtgaagtgcttgg

SEQ ID NO: 9207769 - DNA, 22 bp, Homo sapiens
agggtggctgagtagatggaag

SEQ ID NO: 9207770 - DNA, 22 bp, Homo sapiens
agggtggctggaggaatcagaa

SEQ ID NO: 9207771 - DNA, 22 bp, Homo sapiens
agggtggctggaggaatcagaa

SEQ ID NO: 9207772 - DNA, 22 bp, Homo sapiens
agggtggcacctggaagggatg

SEQ ID NO: 9207773 - DNA, 19 bp, Homo sapiens
agggtggcaaaggagggtg

SEQ ID NO: 9207774 - DNA, 22 bp, Homo sapiens
cctgcctgcgtcctctgagggc

SEQ ID NO: 9207775 - DNA, 22 bp, Homo sapiens
aggggcttatgtttctccaggc

SEQ ID NO: 9207776 - DNA, 22 bp, Homo sapiens
cctgcctgctttctgctttgca

SEQ ID NO: 9207777 - DNA, 22 bp, Homo sapiens
cctgcctggatcagccatcctg

SEQ ID NO: 9207778 - DNA, 22 bp, Homo sapiens
cctgcctggagctgagtgtgga

SEQ ID NO: 9207779 - DNA, 22 bp, Homo sapiens
cctgcctggatcagccatcctg

SEQ ID NO: 9207780 - DNA, 22 bp, Homo sapiens
cctgcctggcacatagtactct

SEQ ID NO: 9207781 - DNA, 22 bp, Homo sapiens
cctgcctggatcagccatcctg

SEQ ID NO: 9207782 - DNA, 22 bp, Homo sapiens
cctgcctggcccaccttgccac

SEQ ID NO: 9207783 - DNA, 22 bp, Homo sapiens
cctgcctggcccaccttgccac

SEQ ID NO: 9207784 - DNA, 21 bp, Homo sapiens
cctggactaaaaccaggccac

SEQ ID NO: 9207785 - DNA, 22 bp, Homo sapiens
cctggagcaggagctgcagagg

SEQ ID NO: 9207786 - DNA, 22 bp, Homo sapiens
aggtgaggtttgggaggtgtca

SEQ ID NO: 9207787 - DNA, 22 bp, Homo sapiens
aggtgagtcctgggcacaggta

SEQ ID NO: 9207788 - DNA, 19 bp, Homo sapiens
aggtgatgtgactctagaa

SEQ ID NO: 9207789 - DNA, 22 bp, Homo sapiens
cctgggcagcctgctcaaggac

SEQ ID NO: 9207790 - DNA, 22 bp, Homo sapiens
cctgggcaggtgtggcttcccc

SEQ ID NO: 9207791 - DNA, 22 bp, Homo sapiens
cctgggcagggctggactctca

SEQ ID NO: 9207792 - DNA, 22 bp, Homo sapiens
cctgggttggagagcaatggtg

SEQ ID NO: 9207793 - DNA, 22 bp, Homo sapiens
aggtggatcacctgacgtcagg

SEQ ID NO: 9207794 - DNA, 22 bp, Homo sapiens
cctgggtgtcatgggcagctgg

SEQ ID NO: 9207795 - DNA, 22 bp, Homo sapiens
aggtggagttggctgtagttca

SEQ ID NO: 9207796 - DNA, 22 bp, Homo sapiens
aggtggagttaagtgtgaactg

SEQ ID NO: 9207797 - DNA, 21 bp, Homo sapiens
aggtggagtgcttagcatcca

SEQ ID NO: 9207798 - DNA, 22 bp, Homo sapiens
aggtggagtgtgcagggagagc

SEQ ID NO: 9207799 - DNA, 22 bp, Homo sapiens
aggtggagtgtgcagggagagc

SEQ ID NO: 9207800 - DNA, 20 bp, Homo sapiens
aggtctgattccagaatcag

SEQ ID NO: 9207801 - DNA, 23 bp, Homo sapiens
aggtctggacccttggcccctgc

SEQ ID NO: 9207802 - DNA, 22 bp, Homo sapiens
aggtctgactctttgccacata

SEQ ID NO: 9207803 - DNA, 22 bp, Homo sapiens
aggtcctgtccttggtctctga

SEQ ID NO: 9207804 - DNA, 22 bp, Homo sapiens
aggtctgggcaccactggctgc

SEQ ID NO: 9207805 - DNA, 22 bp, Homo sapiens
aggtctggtatttttctatact

SEQ ID NO: 9207806 - DNA, 22 bp, Homo sapiens
aggtctggtgggctttagattg

SEQ ID NO: 9207807 - DNA, 22 bp, Homo sapiens
aggtctggaggcggagtcagga

SEQ ID NO: 9207808 - DNA, 22 bp, Homo sapiens
aggtctggaggcggagtcagga

SEQ ID NO: 9207809 - DNA, 22 bp, Homo sapiens
aggtctggagtgggatctgaga

SEQ ID NO: 9207810 - DNA, 22 bp, Homo sapiens
aggtctggctcttctccacaga

SEQ ID NO: 9207811 - DNA, 22 bp, Homo sapiens
aggtctgtctggccccatgaat

SEQ ID NO: 9207812 - DNA, 22 bp, Homo sapiens
aggtctggtgttgggcctgaaa

SEQ ID NO: 9207813 - DNA, 22 bp, Homo sapiens
aggtctggtgttgatgaattcc

SEQ ID NO: 9207814 - DNA, 18 bp, Homo sapiens
aggtctgtggtcaccagg

SEQ ID NO: 9207815 - DNA, 19 bp, Homo sapiens
aggtgaggggcaccatgtc

SEQ ID NO: 9207816 - DNA, 22 bp, Homo sapiens
aggtgaggtttgggaggtgtca

SEQ ID NO: 9207817 - DNA, 22 bp, Homo sapiens
agtcagtgtagaaagcccaggc

SEQ ID NO: 9207818 - DNA, 22 bp, Homo sapiens
agtcataattataaacatcagt

SEQ ID NO: 9207819 - DNA, 21 bp, Homo sapiens
ctacacagctttctataggaa

SEQ ID NO: 9207820 - DNA, 22 bp, Homo sapiens
ctacagaaacactggacatgtg

SEQ ID NO: 9207821 - DNA, 22 bp, Homo sapiens
agtcagagttcttggggagaca

SEQ ID NO: 9207822 - DNA, 22 bp, Homo sapiens
agtcagagttttgaggtgtgac

SEQ ID NO: 9207823 - DNA, 22 bp, Homo sapiens
agtcagatttaaagctgtttga

SEQ ID NO: 9207824 - DNA, 22 bp, Homo sapiens
agtcagaattcgatcccaggtc

SEQ ID NO: 9207825 - DNA, 22 bp, Homo sapiens
agtcagagcaaactggacagac

SEQ ID NO: 9207826 - DNA, 22 bp, Homo sapiens
agtcagagcaaactggacagac

SEQ ID NO: 9207827 - DNA, 22 bp, Homo sapiens
agtcagagagctctcagcatag

SEQ ID NO: 9207828 - DNA, 22 bp, Homo sapiens
agtcagagaatgttttcatgga

SEQ ID NO: 9207829 - DNA, 22 bp, Homo sapiens
cgtgccactgcactctagcctg

SEQ ID NO: 9207830 - DNA, 22 bp, Homo sapiens
cggtcaggtgcagcgttggcac

SEQ ID NO: 9207831 - DNA, 22 bp, Homo sapiens
cgtggctcttttctgcatcagg

SEQ ID NO: 9207832 - DNA, 22 bp, Homo sapiens
cgtggctctgggctcctttgcc

SEQ ID NO: 9207833 - DNA, 22 bp, Homo sapiens
ctaaacaagatactaatgaggt

SEQ ID NO: 9207834 - DNA, 22 bp, Homo sapiens
ctaaaattatcaagataattcc

SEQ ID NO: 9207835 - DNA, 22 bp, Homo sapiens
cgtggccagtttcaagctacca

SEQ ID NO: 9207836 - DNA, 22 bp, Homo sapiens
cgtggcagtggaaggctgggtg

SEQ ID NO: 9207837 - DNA, 22 bp, Homo sapiens
aggttccaagaaatcatcagtg

SEQ ID NO: 9207838 - DNA, 23 bp, Homo sapiens
aggttatgattatagagcgagga

SEQ ID NO: 9207839 - DNA, 22 bp, Homo sapiens
aggtgtgggaaacgggtgacct

SEQ ID NO: 9207840 - DNA, 22 bp, Homo sapiens
aggtgtggctggggcagaggcc

SEQ ID NO: 9207841 - DNA, 22 bp, Homo sapiens
aggtgtggcttgaagtctctat

SEQ ID NO: 9207842 - DNA, 22 bp, Homo sapiens
aggtgtctggatgggtgtcctt

SEQ ID NO: 9207843 - DNA, 22 bp, Homo sapiens
cctggtgcccccaagccagctg

SEQ ID NO: 9207844 - DNA, 22 bp, Homo sapiens
agtaacagcatctccactggaa

SEQ ID NO: 9207845 - DNA, 22 bp, Homo sapiens
agtacaaatgcagccagagtag

SEQ ID NO: 9207846 - DNA, 22 bp, Homo sapiens
agtaacaggatccaaagaatgt

SEQ ID NO: 9207847 - DNA, 22 bp, Homo sapiens
agtaacaggtgtacagactatc

SEQ ID NO: 9207848 - DNA, 21 bp, Homo sapiens
agtctgttaggatgactctga

SEQ ID NO: 9207849 - DNA, 22 bp, Homo sapiens
ctcaggcacgggtcagtgagcg

SEQ ID NO: 9207850 - DNA, 22 bp, Homo sapiens
ctcaggcagttctgtagcctcc

SEQ ID NO: 9207851 - DNA, 22 bp, Homo sapiens
ctcaggcacttttgtcacagac

SEQ ID NO: 9207852 - DNA, 22 bp, Homo sapiens
agtctgtgactcattggatctc

SEQ ID NO: 9207853 - DNA, 19 bp, Homo sapiens
agtctgtctgctttccctc

SEQ ID NO: 9207854 - DNA, 22 bp, Homo sapiens
agtctgtctttggcttcaccac

SEQ ID NO: 9207855 - DNA, 22 bp, Homo sapiens
agtctctttgtggactctgcct

SEQ ID NO: 9207856 - DNA, 22 bp, Homo sapiens
agtcattttctgcctgtaatct

SEQ ID NO: 9207857 - DNA, 22 bp, Homo sapiens
agtgaccatctaacgcctgtga

SEQ ID NO: 9207858 - DNA, 22 bp, Homo sapiens
agtgaccaatcactgaatgatt

SEQ ID NO: 9207859 - DNA, 22 bp, Homo sapiens
agtgcagaggctgggaaatgct

SEQ ID NO: 9207860 - DNA, 22 bp, Homo sapiens
agtgcagatttttagtcagctt

SEQ ID NO: 9207861 - DNA, 22 bp, Homo sapiens
agtgcagagacctggtcaggca

SEQ ID NO: 9207862 - DNA, 22 bp, Homo sapiens
agtgcagagacctggtcaggca

SEQ ID NO: 9207863 - DNA, 22 bp, Homo sapiens
ctcaggcagttgtttgcatagt

SEQ ID NO: 9207864 - DNA, 20 bp, Homo sapiens
ctccagtgttcaggggagtg

SEQ ID NO: 9207865 - DNA, 22 bp, Homo sapiens
ctccagttggccccagttggtt

SEQ ID NO: 9207866 - DNA, 22 bp, Homo sapiens
ctccagttggccccagttggtt

SEQ ID NO: 9207867 - DNA, 20 bp, Homo sapiens
ctccatgacttgaattagta

SEQ ID NO: 9207868 - DNA, 22 bp, Homo sapiens
ctcctctcaaaagtaggttgac

SEQ ID NO: 9207869 - DNA, 22 bp, Homo sapiens
ctcctctcaggctggatggcgc

SEQ ID NO: 9207870 - DNA, 22 bp, Homo sapiens
ctcctcccacggtctcaggaag

SEQ ID NO: 9207871 - DNA, 22 bp, Homo sapiens
ctcctccctctttgccacacat

SEQ ID NO: 9207872 - DNA, 22 bp, Homo sapiens
ctcctccctctttgccacacat

SEQ ID NO: 9207873 - DNA, 22 bp, Homo sapiens
ctcctccctgcgattgctctgc

SEQ ID NO: 9207874 - DNA, 22 bp, Homo sapiens
ctcccaggggagtcatctgctt

SEQ ID NO: 9207875 - DNA, 22 bp, Homo sapiens
ctcccagggtagggagagacta

SEQ ID NO: 9207876 - DNA, 22 bp, Homo sapiens
ctcccagggtctaggctgctgg

SEQ ID NO: 9207877 - DNA, 22 bp, Homo sapiens
ctcccagggtctaggctgctgg

SEQ ID NO: 9207878 - DNA, 22 bp, Homo sapiens
ctcccaggttacatctgagcct

SEQ ID NO: 9207879 - DNA, 22 bp, Homo sapiens
ctcccaggtgtcccttctgcca

SEQ ID NO: 9207880 - DNA, 22 bp, Homo sapiens
ctcccaggtgtcccttctgcca

SEQ ID NO: 9207881 - DNA, 22 bp, Homo sapiens
agtgtgtgctgttccccggagg

SEQ ID NO: 9207882 - DNA, 22 bp, Homo sapiens
agtgtgggggctttggtgtcac

SEQ ID NO: 9207883 - DNA, 22 bp, Homo sapiens
agtgtgggggctttggtgtcac

SEQ ID NO: 9207884 - DNA, 18 bp, Homo sapiens
agtgtgtgccctttcagg

SEQ ID NO: 9207885 - DNA, 22 bp, Homo sapiens
agtgtgtgtttgggcggtttat

SEQ ID NO: 9207886 - DNA, 22 bp, Homo sapiens
ctgaagcaaatgaaacagctct

SEQ ID NO: 9207887 - DNA, 22 bp, Homo sapiens
ctgaagccacgatagcttccta

SEQ ID NO: 9207888 - DNA, 22 bp, Homo sapiens
agtggggacaatgagagcaggt

SEQ ID NO: 9207889 - DNA, 22 bp, Homo sapiens
agtggggaggtccaggccaccc

SEQ ID NO: 9207890 - DNA, 22 bp, Homo sapiens
agtgtctgatgcacagttgtcc

SEQ ID NO: 9207891 - DNA, 22 bp, Homo sapiens
ctcttagatatggagaattacc

SEQ ID NO: 9207892 - DNA, 22 bp, Homo sapiens
ctcttacattcttttactagca

SEQ ID NO: 9207893 - DNA, 18 bp, Homo sapiens
ctcttaagcctttgtcaa

SEQ ID NO: 9207894 - DNA, 22 bp, Homo sapiens
agtgggcaggcagggtgcgcag

SEQ ID NO: 9207895 - DNA, 22 bp, Homo sapiens
agtgggcagtgcgctcggatgc

SEQ ID NO: 9207896 - DNA, 22 bp, Homo sapiens
agtgggcaaaacagctcagagc

SEQ ID NO: 9207897 - DNA, 22 bp, Homo sapiens
agtgggcccttgtcacactgat

SEQ ID NO: 9207898 - DNA, 22 bp, Homo sapiens
agtgggccggacagcccaggcc

SEQ ID NO: 9207899 - DNA, 22 bp, Homo sapiens
agtgggcatatgaagtctcaag

SEQ ID NO: 9207900 - DNA, 22 bp, Homo sapiens
ctctgacctctagccagctctg

SEQ ID NO: 9207901 - DNA, 22 bp, Homo sapiens
ctctctgggggccatgccaaga

SEQ ID NO: 9207902 - DNA, 22 bp, Homo sapiens
ctctctgggcccagttggcacc

SEQ ID NO: 9207903 - DNA, 22 bp, Homo sapiens
ctctctgggcccagttggcacc

SEQ ID NO: 9207904 - DNA, 22 bp, Homo sapiens
ctctctggcttggcacggagat

SEQ ID NO: 9207905 - DNA, 22 bp, Homo sapiens
ctctctgggaatattttattct

SEQ ID NO: 9207906 - DNA, 22 bp, Homo sapiens
ctctctggtacatagagtttgg

SEQ ID NO: 9207907 - DNA, 18 bp, Homo sapiens
ctctctgggtgaggacaa

SEQ ID NO: 9207908 - DNA, 22 bp, Homo sapiens
ctctctgggtcctcttttatag

SEQ ID NO: 9207909 - DNA, 22 bp, Homo sapiens
ctctctggggttccagacgtgg

SEQ ID NO: 9207910 - DNA, 22 bp, Homo sapiens
agtgcaggccccaggccaggcc

SEQ ID NO: 9207911 - DNA, 22 bp, Homo sapiens
agtggcagccgagcaggagatg

SEQ ID NO: 9207912 - DNA, 22 bp, Homo sapiens
agtggcagccgagcaggagatg

SEQ ID NO: 9207913 - DNA, 22 bp, Homo sapiens
ctctctggtcccagattccaga

SEQ ID NO: 9207914 - DNA, 22 bp, Homo sapiens
agtggcagctgtcatgccctag

SEQ ID NO: 9207915 - DNA, 22 bp, Homo sapiens
agtggcaggaaagtggaagaga

SEQ ID NO: 9207916 - DNA, 22 bp, Homo sapiens
ctggccaggctctcacgtggtc

SEQ ID NO: 9207917 - DNA, 22 bp, Homo sapiens
ctggccagaggttcctctgccc

SEQ ID NO: 9207918 - DNA, 22 bp, Homo sapiens
ctggccaggctctcacgtggtc

SEQ ID NO: 9207919 - DNA, 22 bp, Homo sapiens
ctggagcttattgggagcagaa

SEQ ID NO: 9207920 - DNA, 21 bp, Homo sapiens
ctggagcttggtgagaagtgt

SEQ ID NO: 9207921 - DNA, 22 bp, Homo sapiens
ctggagctgtcttcacaggcct

SEQ ID NO: 9207922 - DNA, 17 bp, Homo sapiens
ctggagctgtgtaacct

SEQ ID NO: 9207923 - DNA, 22 bp, Homo sapiens
ctggccaggcttgggacagaca

SEQ ID NO: 9207924 - DNA, 22 bp, Homo sapiens
ctggccagggtgcgatcgtggt

SEQ ID NO: 9207925 - DNA, 22 bp, Homo sapiens
ctggccagggtgcgatcgtggt

SEQ ID NO: 9207926 - DNA, 22 bp, Homo sapiens
ctggccaggttttgaacagttg

SEQ ID NO: 9207927 - DNA, 22 bp, Homo sapiens
atagaaacagaggtcaggcatt

SEQ ID NO: 9207928 - DNA, 19 bp, Homo sapiens
atagaaagggttaaagaca

SEQ ID NO: 9207929 - DNA, 22 bp, Homo sapiens
atagaaaggtctttggcagaca

SEQ ID NO: 9207930 - DNA, 22 bp, Homo sapiens
atagtacagagggctactggtt

SEQ ID NO: 9207931 - DNA, 22 bp, Homo sapiens
atagtaagtgatagcatagact

SEQ ID NO: 9207932 - DNA, 22 bp, Homo sapiens
ataggcttggcttattcttggg

SEQ ID NO: 9207933 - DNA, 22 bp, Homo sapiens
atagcatacatgttgttacttg

SEQ ID NO: 9207934 - DNA, 22 bp, Homo sapiens
atagaatttgtacttgtagaac

SEQ ID NO: 9207935 - DNA, 22 bp, Homo sapiens
atagacaaacacgaagatgaca

SEQ ID NO: 9207936 - DNA, 22 bp, Homo sapiens
atagaatgtattatagtacaga

SEQ ID NO: 9207937 - DNA, 20 bp, Homo sapiens
atagacaaagacatgccaga

SEQ ID NO: 9207938 - DNA, 22 bp, Homo sapiens
atacatcttgtcagattcatgt

SEQ ID NO: 9207939 - DNA, 22 bp, Homo sapiens
atacatcttccttttaaaatgc

SEQ ID NO: 9207940 - DNA, 22 bp, Homo sapiens
atacatctctttgaagtgcttt

SEQ ID NO: 9207941 - DNA, 22 bp, Homo sapiens
ctggagctggtatagggacaaa

SEQ ID NO: 9207942 - DNA, 22 bp, Homo sapiens
ctggagctggcttccttccact

SEQ ID NO: 9207943 - DNA, 22 bp, Homo sapiens
ctggaagacgtttgaagccatg

SEQ ID NO: 9207944 - DNA, 22 bp, Homo sapiens
ctggaagaactccagttctgtg

SEQ ID NO: 9207945 - DNA, 22 bp, Homo sapiens
ctggaagaactccagttctgtg

SEQ ID NO: 9207946 - DNA, 22 bp, Homo sapiens
ctggaaattggagatgatgttt

SEQ ID NO: 9207947 - DNA, 21 bp, Homo sapiens
atacagaaggtggcaaagtac

SEQ ID NO: 9207948 - DNA, 22 bp, Homo sapiens
atacagaagacccctccgtcat

SEQ ID NO: 9207949 - DNA, 20 bp, Homo sapiens
ataatttaccctgcaccact

SEQ ID NO: 9207950 - DNA, 20 bp, Homo sapiens
atacacattcatagaaaaat

SEQ ID NO: 9207951 - DNA, 22 bp, Homo sapiens
ataatttacaactgcttttaat

SEQ ID NO: 9207952 - DNA, 22 bp, Homo sapiens
atacagaaaagtggatagccag

SEQ ID NO: 9207953 - DNA, 22 bp, Homo sapiens
atacagaaaatgatgcagagtt

SEQ ID NO: 9207954 - DNA, 22 bp, Homo sapiens
atacagaaaatgatgcagagtt

SEQ ID NO: 9207955 - DNA, 22 bp, Homo sapiens
atacagaagaactatagccact

SEQ ID NO: 9207956 - DNA, 22 bp, Homo sapiens
atacagaactctcagttgtata

SEQ ID NO: 9207957 - DNA, 21 bp, Homo sapiens
atacagaacattgatccaaga

SEQ ID NO: 9207958 - DNA, 23 bp, Homo sapiens
ataataattatggcagcaaagtg

SEQ ID NO: 9207959 - DNA, 23 bp, Homo sapiens
ataataattatggcagcaaagtg

SEQ ID NO: 9207960 - DNA, 22 bp, Homo sapiens
ataataatgaaagccactgtgt

SEQ ID NO: 9207961 - DNA, 22 bp, Homo sapiens
ataataatactgtgcaatggat

SEQ ID NO: 9207962 - DNA, 22 bp, Homo sapiens
ctgcctgctgcctgtggagggt

SEQ ID NO: 9207963 - DNA, 22 bp, Homo sapiens
ctgcctgctgccctccagagcc

SEQ ID NO: 9207964 - DNA, 18 bp, Homo sapiens
ctgcctgctctccagctt

SEQ ID NO: 9207965 - DNA, 22 bp, Homo sapiens
ctgcctgctgacattctttata

SEQ ID NO: 9207966 - DNA, 22 bp, Homo sapiens
ctgcctgctgattagtattgtc

SEQ ID NO: 9207967 - DNA, 22 bp, Homo sapiens
ctgcctgcttaccatgcatcag

SEQ ID NO: 9207968 - DNA, 23 bp, Homo sapiens
ctgcctgctggggagacagatct

SEQ ID NO: 9207969 - DNA, 23 bp, Homo sapiens
ctgcctgctggggagacagatct

SEQ ID NO: 9207970 - DNA, 22 bp, Homo sapiens
ctgcctgcttctgagccagagg

SEQ ID NO: 9207971 - DNA, 22 bp, Homo sapiens
ctgcctgcttctgagccagagg

SEQ ID NO: 9207972 - DNA, 22 bp, Homo sapiens
ctgcctgcttctgagccagagg

SEQ ID NO: 9207973 - DNA, 22 bp, Homo sapiens
ctgcctgcttttctgggagccg

SEQ ID NO: 9207974 - DNA, 22 bp, Homo sapiens
ctgccctgtctgcagcctggct

SEQ ID NO: 9207975 - DNA, 22 bp, Homo sapiens
ataagtttgtctttgtaaagat

SEQ ID NO: 9207976 - DNA, 22 bp, Homo sapiens
ataagcatttcacaggtgtgtt

SEQ ID NO: 9207977 - DNA, 22 bp, Homo sapiens
agttttctttcatctatcagca

SEQ ID NO: 9207978 - DNA, 22 bp, Homo sapiens
ctgccctctagggatgcactgg

SEQ ID NO: 9207979 - DNA, 18 bp, Homo sapiens
ctgcccagagcatttcat

SEQ ID NO: 9207980 - DNA, 22 bp, Homo sapiens
ctgccctcgggccctcccatag

SEQ ID NO: 9207981 - DNA, 22 bp, Homo sapiens
agtttcactaaggtctgtgtgt

SEQ ID NO: 9207982 - DNA, 22 bp, Homo sapiens
agtttcacatgcatggatgtgt

SEQ ID NO: 9207983 - DNA, 22 bp, Homo sapiens
agttttattccaatgtgcagca

SEQ ID NO: 9207984 - DNA, 22 bp, Homo sapiens
ctgagtggaacataggatgata

SEQ ID NO: 9207985 - DNA, 22 bp, Homo sapiens
agtgttcatttattcattcact

SEQ ID NO: 9207986 - DNA, 22 bp, Homo sapiens
agtttacaacagtagctatgga

SEQ ID NO: 9207987 - DNA, 19 bp, Homo sapiens
atatatgtatacaatgtgg

SEQ ID NO: 9207988 - DNA, 23 bp, Homo sapiens
atagtcatgtaaaatatttgaag

SEQ ID NO: 9207989 - DNA, 22 bp, Homo sapiens
ctgggctgtaatgtggcactga

SEQ ID NO: 9207990 - DNA, 22 bp, Homo sapiens
ctgggcctggcgttccaggctg

SEQ ID NO: 9207991 - DNA, 22 bp, Homo sapiens
ctgggcctggcgttccaggctg

SEQ ID NO: 9207992 - DNA, 22 bp, Homo sapiens
ctgggcctggacgggcagatct

SEQ ID NO: 9207993 - DNA, 22 bp, Homo sapiens
ctgggcctgccaccatcttagg

SEQ ID NO: 9207994 - DNA, 17 bp, Homo sapiens
ctgggcctctgcccttt

SEQ ID NO: 9207995 - DNA, 22 bp, Homo sapiens
ctgggccatgggccagcgaggc

SEQ ID NO: 9207996 - DNA, 22 bp, Homo sapiens
ctgggccatgggccagcgaggc

SEQ ID NO: 9207997 - DNA, 17 bp, Homo sapiens
ctgggcctctgcccttt

SEQ ID NO: 9207998 - DNA, 22 bp, Homo sapiens
ctgggccatctctctgcaagtg

SEQ ID NO: 9207999 - DNA, 22 bp, Homo sapiens
ctgggccatctctctgcaagtg

SEQ ID NO: 9208000 - DNA, 22 bp, Homo sapiens
ctgggccatggaagtctctgcc

SEQ ID NO: 9208001 - DNA, 22 bp, Homo sapiens
ctgggccatcagaggggctgga

SEQ ID NO: 9208002 - DNA, 22 bp, Homo sapiens
ctgggccatcagaggggctgga

SEQ ID NO: 9208003 - DNA, 20 bp, Homo sapiens
ctgggccatccttttacaat

SEQ ID NO: 9208004 - DNA, 22 bp, Homo sapiens
ctgggccatctcctttgtgtgg

SEQ ID NO: 9208005 - DNA, 22 bp, Homo sapiens
ctgggcagttcgctttcgtttt

SEQ ID NO: 9208006 - DNA, 22 bp, Homo sapiens
ctgggccagggaggtgtctgta

SEQ ID NO: 9208007 - DNA, 22 bp, Homo sapiens
ctgggccagtctcggccgctct

SEQ ID NO: 9208008 - DNA, 22 bp, Homo sapiens
ctgggccagggaggtgtctgta

SEQ ID NO: 9208009 - DNA, 22 bp, Homo sapiens
atatttgttgagttcttatgat

SEQ ID NO: 9208010 - DNA, 22 bp, Homo sapiens
ctgtatctgtgttggatgagtt

SEQ ID NO: 9208011 - DNA, 22 bp, Homo sapiens
ctgtaatcccagctactcggga

SEQ ID NO: 9208012 - DNA, 22 bp, Homo sapiens
atattttgaagttaataatgtg

SEQ ID NO: 9208013 - DNA, 22 bp, Homo sapiens
atattttggcaaatgtctagat

SEQ ID NO: 9208014 - DNA, 21 bp, Homo sapiens
ctgtccacatcacagagcctc

SEQ ID NO: 9208015 - DNA, 22 bp, Homo sapiens
ctgtccagcacatgtctgcccc

SEQ ID NO: 9208016 - DNA, 22 bp, Homo sapiens
ctgtccagctgaccagagcagc

SEQ ID NO: 9208017 - DNA, 22 bp, Homo sapiens
ctgtccagctgaccagagcagc

SEQ ID NO: 9208018 - DNA, 22 bp, Homo sapiens
ctgtatttagttaaaatgctaa

SEQ ID NO: 9208019 - DNA, 22 bp, Homo sapiens
ctgtattagtccatttgagctg

SEQ ID NO: 9208020 - DNA, 22 bp, Homo sapiens
ctggggcagagcccagcaattt

SEQ ID NO: 9208021 - DNA, 22 bp, Homo sapiens
ctggggcagagcccagcaattt

SEQ ID NO: 9208022 - DNA, 22 bp, Homo sapiens
ctggtcctctccagcaggcatt

SEQ ID NO: 9208023 - DNA, 22 bp, Homo sapiens
ctggggcatcatccattctttc

SEQ ID NO: 9208024 - DNA, 22 bp, Homo sapiens
ctgggctgtcaatggccctctg

SEQ ID NO: 9208025 - DNA, 23 bp, Homo sapiens
ctgggctgtcctgaggtcacctc

SEQ ID NO: 9208026 - DNA, 22 bp, Homo sapiens
ctggggagtgaaattcttaaat

SEQ ID NO: 9208027 - DNA, 22 bp, Homo sapiens
ctgtgtgtgaacacagcccagc

SEQ ID NO: 9208028 - DNA, 22 bp, Homo sapiens
ctgttattcaagacaaaggcag

SEQ ID NO: 9208029 - DNA, 18 bp, Homo sapiens
ctgttagtagatatttac

SEQ ID NO: 9208030 - DNA, 19 bp, Homo sapiens
ctgttattgtcagagctcc

SEQ ID NO: 9208031 - DNA, 19 bp, Homo sapiens
atcaggaacaaggctgatc

SEQ ID NO: 9208032 - DNA, 20 bp, Homo sapiens
atcaggaagagagactgacc

SEQ ID NO: 9208033 - DNA, 22 bp, Homo sapiens
atcaggaagcctgcactgagct

SEQ ID NO: 9208034 - DNA, 22 bp, Homo sapiens
ctgtccagcttggctcctgggg

SEQ ID NO: 9208035 - DNA, 22 bp, Homo sapiens
ctgtgcctaagatgcatgtctc

SEQ ID NO: 9208036 - DNA, 22 bp, Homo sapiens
ctgtgcctccagtctcgcttct

SEQ ID NO: 9208037 - DNA, 22 bp, Homo sapiens
ctgtgcctttgtagctgtgcct

SEQ ID NO: 9208038 - DNA, 22 bp, Homo sapiens
ctgtgccttctacttcactcta

SEQ ID NO: 9208039 - DNA, 22 bp, Homo sapiens
ctgtgccttggcgctgtgccac

SEQ ID NO: 9208040 - DNA, 22 bp, Homo sapiens
atctccagcaatggggagctct

SEQ ID NO: 9208041 - DNA, 22 bp, Homo sapiens
cttcatcagctggcttactgtt

SEQ ID NO: 9208042 - DNA, 21 bp, Homo sapiens
atctggaagaactggtaagtg

SEQ ID NO: 9208043 - DNA, 17 bp, Homo sapiens
atctggaagctagctga

SEQ ID NO: 9208044 - DNA, 22 bp, Homo sapiens
cttcacagaataaactcattat

SEQ ID NO: 9208045 - DNA, 22 bp, Homo sapiens
cttcagagagtccagggactgc

SEQ ID NO: 9208046 - DNA, 22 bp, Homo sapiens
atccttcttctgctagtgtcta

SEQ ID NO: 9208047 - DNA, 22 bp, Homo sapiens
atccttctacctaggactattt

SEQ ID NO: 9208048 - DNA, 22 bp, Homo sapiens
cttcagcagcctcttgcataaa

SEQ ID NO: 9208049 - DNA, 22 bp, Homo sapiens
cttcagcaactttggaatgttt

SEQ ID NO: 9208050 - DNA, 22 bp, Homo sapiens
caaggctgcaaaactacatggg

SEQ ID NO: 9208051 - DNA, 22 bp, Homo sapiens
caaggctgcaaaactacatggg

SEQ ID NO: 9208052 - DNA, 22 bp, Homo sapiens
caaggctgctgcgggtcgcacc

SEQ ID NO: 9208053 - DNA, 22 bp, Homo sapiens
caaggctgctgcgggtcgcacc

SEQ ID NO: 9208054 - DNA, 22 bp, Homo sapiens
gctggggagctagacctcagca

SEQ ID NO: 9208055 - DNA, 22 bp, Homo sapiens
caaggctgtctccagcttccaa

SEQ ID NO: 9208056 - DNA, 22 bp, Homo sapiens
caaggctgtctccagcttccaa

SEQ ID NO: 9208057 - DNA, 22 bp, Homo sapiens
caaggctgtgttagctgccctc

SEQ ID NO: 9208058 - DNA, 22 bp, Homo sapiens
caatagcaggtctacagagaga

SEQ ID NO: 9208059 - DNA, 22 bp, Homo sapiens
caatagaaaactcaatacttaa

SEQ ID NO: 9208060 - DNA, 22 bp, Homo sapiens
caatttcaagattctgttcttt

SEQ ID NO: 9208061 - DNA, 22 bp, Homo sapiens
caatccagtttctgtcagctac

SEQ ID NO: 9208062 - DNA, 22 bp, Homo sapiens
caatttcagacctttccttgga

SEQ ID NO: 9208063 - DNA, 18 bp, Homo sapiens
caatttcatccttaagcc

SEQ ID NO: 9208064 - DNA, 18 bp, Homo sapiens
caatttcatccttaagcc

SEQ ID NO: 9208065 - DNA, 22 bp, Homo sapiens
cacacagtggagtattactcag

SEQ ID NO: 9208066 - DNA, 22 bp, Homo sapiens
cacacagtaggcactcattaat

SEQ ID NO: 9208067 - DNA, 22 bp, Homo sapiens
ggactgggtaggagcccagggc

SEQ ID NO: 9208068 - DNA, 22 bp, Homo sapiens
cacacaggagagtgctggaggt

SEQ ID NO: 9208069 - DNA, 22 bp, Homo sapiens
cacacaggagagtgctggaggt

SEQ ID NO: 9208070 - DNA, 22 bp, Homo sapiens
cacacaggtaagcctctttcaa

SEQ ID NO: 9208071 - DNA, 22 bp, Homo sapiens
cacacagggagaaagaaagcct

SEQ ID NO: 9208072 - DNA, 22 bp, Homo sapiens
cacacaggatgaagcagcagaa

SEQ ID NO: 9208073 - DNA, 22 bp, Homo sapiens
ggagaaggtgctggtcactgtg

SEQ ID NO: 9208074 - DNA, 22 bp, Homo sapiens
ggagagaggctggccgtgatga

SEQ ID NO: 9208075 - DNA, 22 bp, Homo sapiens
ggagagaggagcccactgctgt

SEQ ID NO: 9208076 - DNA, 22 bp, Homo sapiens
ggaagcctaaagcccaggtctc

SEQ ID NO: 9208077 - DNA, 18 bp, Homo sapiens
ggacaggagacatgggtg

SEQ ID NO: 9208078 - DNA, 22 bp, Homo sapiens
ggacatttagaacagagtattt

SEQ ID NO: 9208079 - DNA, 22 bp, Homo sapiens
ggacatttcataagaccattct

SEQ ID NO: 9208080 - DNA, 22 bp, Homo sapiens
caacacagccattcccctagaa

SEQ ID NO: 9208081 - DNA, 22 bp, Homo sapiens
caacacaggttctgcaaaggaa

SEQ ID NO: 9208082 - DNA, 22 bp, Homo sapiens
caacacaggttctgcaaaggaa

SEQ ID NO: 9208083 - DNA, 22 bp, Homo sapiens
caaattttgtgtgttctctagt

SEQ ID NO: 9208084 - DNA, 22 bp, Homo sapiens
caagaaacaccaatgactgctg

SEQ ID NO: 9208085 - DNA, 22 bp, Homo sapiens
caagaaactttattctgccata

SEQ ID NO: 9208086 - DNA, 22 bp, Homo sapiens
caagaaattctgttcagatagc

SEQ ID NO: 9208087 - DNA, 22 bp, Homo sapiens
gctgcctgatgtccagcaggac

SEQ ID NO: 9208088 - DNA, 22 bp, Homo sapiens
gctgcctgatttacatagtgaa

SEQ ID NO: 9208089 - DNA, 22 bp, Homo sapiens
caagaacattgtgatcacttca

SEQ ID NO: 9208090 - DNA, 22 bp, Homo sapiens
caagaacagtttgccaaattgg

SEQ ID NO: 9208091 - DNA, 22 bp, Homo sapiens
caaagtcatggggatgcaggtc

SEQ ID NO: 9208092 - DNA, 22 bp, Homo sapiens
caaagtcagccagctagtaggt

SEQ ID NO: 9208093 - DNA, 17 bp, Homo sapiens
gctctggcacaggattg

SEQ ID NO: 9208094 - DNA, 22 bp, Homo sapiens
gctctggaccctggagtggctg

SEQ ID NO: 9208095 - DNA, 22 bp, Homo sapiens
gctctggaacctgccaggatgc

SEQ ID NO: 9208096 - DNA, 22 bp, Homo sapiens
gctctgctgtgtttgttcagca

SEQ ID NO: 9208097 - DNA, 22 bp, Homo sapiens
gctgccctgacaagctactccc

SEQ ID NO: 9208098 - DNA, 22 bp, Homo sapiens
gctgccctgactccagcagcct

SEQ ID NO: 9208099 - DNA, 22 bp, Homo sapiens
caaagtgctaggattacaggcc

SEQ ID NO: 9208100 - DNA, 22 bp, Homo sapiens
caaagtgctaggattacaggcg

SEQ ID NO: 9208101 - DNA, 22 bp, Homo sapiens
gctgctttgacagtgggaacag

SEQ ID NO: 9208102 - DNA, 22 bp, Homo sapiens
gctgctggccgcccagcttctc

SEQ ID NO: 9208103 - DNA, 22 bp, Homo sapiens
gctgcctgcctagttccacagt

SEQ ID NO: 9208104 - DNA, 22 bp, Homo sapiens
gctgcctgccctgggtcatctg

SEQ ID NO: 9208105 - DNA, 22 bp, Homo sapiens
gctgcctgcctagttccacagt

SEQ ID NO: 9208106 - DNA, 22 bp, Homo sapiens
gctgcctgcctagttccacagt

SEQ ID NO: 9208107 - DNA, 22 bp, Homo sapiens
gctgcctgcacagagctgcttt

SEQ ID NO: 9208108 - DNA, 21 bp, Homo sapiens
gctgcctgcccctcgggggct

SEQ ID NO: 9208109 - DNA, 18 bp, Homo sapiens
gctgcctgcattcctcac

SEQ ID NO: 9208110 - DNA, 18 bp, Homo sapiens
gctgcctgcattcctcac

SEQ ID NO: 9208111 - DNA, 18 bp, Homo sapiens
gctgcctgcattcctcac

SEQ ID NO: 9208112 - DNA, 22 bp, Homo sapiens
caagaattaagaattttgatgt

SEQ ID NO: 9208113 - DNA, 22 bp, Homo sapiens
caagaatgaattcaatgtgtgg

SEQ ID NO: 9208114 - DNA, 20 bp, Homo sapiens
gctggaagggctagagggct

SEQ ID NO: 9208115 - DNA, 22 bp, Homo sapiens
caagaagttgacagccaggtga

SEQ ID NO: 9208116 - DNA, 22 bp, Homo sapiens
caagaagaggtgattggtaagt

SEQ ID NO: 9208117 - DNA, 22 bp, Homo sapiens
caagaaggcatccccagtccct

SEQ ID NO: 9208118 - DNA, 22 bp, Homo sapiens
gctgggcttgtggccagctggg

SEQ ID NO: 9208119 - DNA, 22 bp, Homo sapiens
gctgggcttgtggccagctggg

SEQ ID NO: 9208120 - DNA, 20 bp, Homo sapiens
gctgggctttgactgacaca

SEQ ID NO: 9208121 - DNA, 22 bp, Homo sapiens
gctggggagcaagagtagtgag

SEQ ID NO: 9208122 - DNA, 20 bp, Homo sapiens
gctgggctttgactgacaca

SEQ ID NO: 9208123 - DNA, 22 bp, Homo sapiens
gctggggagcaagagtagtgag

SEQ ID NO: 9208124 - DNA, 22 bp, Homo sapiens
gctgggctcaccaggccactag

SEQ ID NO: 9208125 - DNA, 22 bp, Homo sapiens
gctgggctcaccaggccactag

SEQ ID NO: 9208126 - DNA, 22 bp, Homo sapiens
gctggctgagcactggtttata

SEQ ID NO: 9208127 - DNA, 17 bp, Homo sapiens
gctggctgacccatgcc

SEQ ID NO: 9208128 - DNA, 17 bp, Homo sapiens
gctggctgacccatgcc

SEQ ID NO: 9208129 - DNA, 22 bp, Homo sapiens
gctggctctttttgccgggctc

SEQ ID NO: 9208130 - DNA, 22 bp, Homo sapiens
gctggctgaggtctagctcttt

SEQ ID NO: 9208131 - DNA, 22 bp, Homo sapiens
caagccctgttaggggtctcta

SEQ ID NO: 9208132 - DNA, 22 bp, Homo sapiens
caagcccttccgggaacagttg

SEQ ID NO: 9208133 - DNA, 22 bp, Homo sapiens
ggccaggctggtctcagacttc

SEQ ID NO: 9208134 - DNA, 22 bp, Homo sapiens
cacctggatatgtttcagcttg

SEQ ID NO: 9208135 - DNA, 20 bp, Homo sapiens
caccaggcgctctgagaaca

SEQ ID NO: 9208136 - DNA, 22 bp, Homo sapiens
caccaggcacatagtaggcact

SEQ ID NO: 9208137 - DNA, 20 bp, Homo sapiens
caccaggcgctctgagaaca

SEQ ID NO: 9208138 - DNA, 22 bp, Homo sapiens
caccaggcacatagtaggcact

SEQ ID NO: 9208139 - DNA, 22 bp, Homo sapiens
caccaggagtgagaatgaaggg

SEQ ID NO: 9208140 - DNA, 22 bp, Homo sapiens
caccaggatgggcaggtaggtc

SEQ ID NO: 9208141 - DNA, 22 bp, Homo sapiens
caccaggctgcccaggacaggg

SEQ ID NO: 9208142 - DNA, 22 bp, Homo sapiens
caccaggctgaaccagagggga

SEQ ID NO: 9208143 - DNA, 22 bp, Homo sapiens
caccaggctggagtgcagaggt

SEQ ID NO: 9208144 - DNA, 22 bp, Homo sapiens
cacctgcctgctagagcctgac

SEQ ID NO: 9208145 - DNA, 22 bp, Homo sapiens
cacctgcctgctagagcctgac

SEQ ID NO: 9208146 - DNA, 22 bp, Homo sapiens
cacctgcctgcaggggctccac

SEQ ID NO: 9208147 - DNA, 22 bp, Homo sapiens
cacctgcctcatttgtccctgc

SEQ ID NO: 9208148 - DNA, 22 bp, Homo sapiens
cactcctgttccactaaatgag

SEQ ID NO: 9208149 - DNA, 22 bp, Homo sapiens
cactccctctagttgcattctg

SEQ ID NO: 9208150 - DNA, 22 bp, Homo sapiens
cactgcactccagcctggcgac

SEQ ID NO: 9208151 - DNA, 22 bp, Homo sapiens
cactctgacacatgaacttgat

SEQ ID NO: 9208152 - DNA, 22 bp, Homo sapiens
cactctgaactattaacttggg

SEQ ID NO: 9208153 - DNA, 22 bp, Homo sapiens
cactctgaactattaacttggg

SEQ ID NO: 9208154 - DNA, 22 bp, Homo sapiens
cactgcactccagcctgggaga

SEQ ID NO: 9208155 - DNA, 22 bp, Homo sapiens
cactgcactccagcctgggaga

SEQ ID NO: 9208156 - DNA, 22 bp, Homo sapiens
cactgcactccagcctgggaga

SEQ ID NO: 9208157 - DNA, 21 bp, Homo sapiens
cactcagggtatgtgccaggc

SEQ ID NO: 9208158 - DNA, 21 bp, Homo sapiens
cactatttatatatgccagct

SEQ ID NO: 9208159 - DNA, 22 bp, Homo sapiens
cactatatctctttcatctttt

SEQ ID NO: 9208160 - DNA, 22 bp, Homo sapiens
cacttgaaaatcagaggaaatt

SEQ ID NO: 9208161 - DNA, 22 bp, Homo sapiens
cacttgaaagtaatggttgtgc

SEQ ID NO: 9208162 - DNA, 22 bp, Homo sapiens
cacttgaaatattaggggtgat

SEQ ID NO: 9208163 - DNA, 22 bp, Homo sapiens
cacttgaacccgggaggctgag

SEQ ID NO: 9208164 - DNA, 22 bp, Homo sapiens
cacttgaactgtttgaatgaga

SEQ ID NO: 9208165 - DNA, 22 bp, Homo sapiens
cacttgaagtttgggggactct

SEQ ID NO: 9208166 - DNA, 22 bp, Homo sapiens
cacttgaagtgaattgctcacc

SEQ ID NO: 9208167 - DNA, 21 bp, Homo sapiens
cacttgaatggtgttttacaa

SEQ ID NO: 9208168 - DNA, 22 bp, Homo sapiens
cacttgaatgaaagagactcct

SEQ ID NO: 9208169 - DNA, 22 bp, Homo sapiens
cacttgaatggcattgttcctt

SEQ ID NO: 9208170 - DNA, 22 bp, Homo sapiens
cacttgaatgagaatttcctgg

SEQ ID NO: 9208171 - DNA, 22 bp, Homo sapiens
ggctggcaagtcagtgctgatg

SEQ ID NO: 9208172 - DNA, 22 bp, Homo sapiens
cactttaactcacatttcagct

SEQ ID NO: 9208173 - DNA, 22 bp, Homo sapiens
ggctctggaaagtgtccttgat

SEQ ID NO: 9208174 - DNA, 22 bp, Homo sapiens
ggctctggaaagtgtccttgat

SEQ ID NO: 9208175 - DNA, 22 bp, Homo sapiens
cacttaaatgttcctacagcag

SEQ ID NO: 9208176 - DNA, 20 bp, Homo sapiens
ggctctggaatctggtgggc

SEQ ID NO: 9208177 - DNA, 22 bp, Homo sapiens
cactgtgctccttccttagcac

SEQ ID NO: 9208178 - DNA, 20 bp, Homo sapiens
ggctctggaatctggtgggc

SEQ ID NO: 9208179 - DNA, 22 bp, Homo sapiens
cactgcactccagcttgggcaa

SEQ ID NO: 9208180 - DNA, 22 bp, Homo sapiens
cactgcactccagcctgggtga

SEQ ID NO: 9208181 - DNA, 22 bp, Homo sapiens
cactgcactccagcctgggtga

SEQ ID NO: 9208182 - DNA, 22 bp, Homo sapiens
cactgcactccagcctgggtga

SEQ ID NO: 9208183 - DNA, 22 bp, Homo sapiens
cactgcactccagcctgggtca

SEQ ID NO: 9208184 - DNA, 22 bp, Homo sapiens
cactgcactccagcctgggtca

SEQ ID NO: 9208185 - DNA, 22 bp, Homo sapiens
cactgcactccagcctgggtca

SEQ ID NO: 9208186 - DNA, 22 bp, Homo sapiens
cactgcactccagcctgggcaa

SEQ ID NO: 9208187 - DNA, 22 bp, Homo sapiens
cactgggagtcgtaagacacgg

SEQ ID NO: 9208188 - DNA, 22 bp, Homo sapiens
ggctctgcttcagaaggctcat

SEQ ID NO: 9208189 - DNA, 22 bp, Homo sapiens
caccactgcttcctgccatctg

SEQ ID NO: 9208190 - DNA, 22 bp, Homo sapiens
caccagctactccagggccgtg

SEQ ID NO: 9208191 - DNA, 22 bp, Homo sapiens
caccagcttgggctgtggaaat

SEQ ID NO: 9208192 - DNA, 22 bp, Homo sapiens
caccagcttctcattgcgggtc

SEQ ID NO: 9208193 - DNA, 22 bp, Homo sapiens
caccagcttacagtctcacccc

SEQ ID NO: 9208194 - DNA, 22 bp, Homo sapiens
caccagcttacagtctcacccc

SEQ ID NO: 9208195 - DNA, 22 bp, Homo sapiens
caccagctccaccagggcaggt

SEQ ID NO: 9208196 - DNA, 22 bp, Homo sapiens
caccaggagccatcaggagtcc

SEQ ID NO: 9208197 - DNA, 22 bp, Homo sapiens
caccaggagcatctaggaggcg

SEQ ID NO: 9208198 - DNA, 20 bp, Homo sapiens
caccaggaccattggctatg

SEQ ID NO: 9208199 - DNA, 22 bp, Homo sapiens
caccaggaagtggtggcctggg

SEQ ID NO: 9208200 - DNA, 22 bp, Homo sapiens
cacatgtttgctacatttttct

SEQ ID NO: 9208201 - DNA, 22 bp, Homo sapiens
cacattatgctactaccaaatg

SEQ ID NO: 9208202 - DNA, 22 bp, Homo sapiens
cacattaaaatcctaacttcca

SEQ ID NO: 9208203 - DNA, 22 bp, Homo sapiens
cacattaaaatcctaacttcca

SEQ ID NO: 9208204 - DNA, 20 bp, Homo sapiens
cacattaaggaaaacaactg

SEQ ID NO: 9208205 - DNA, 22 bp, Homo sapiens
cacatgagtgagaacatgcagt

SEQ ID NO: 9208206 - DNA, 22 bp, Homo sapiens
cacatgagtcctgccaggtatg

SEQ ID NO: 9208207 - DNA, 22 bp, Homo sapiens
cacatgagtgtaggaagaggga

SEQ ID NO: 9208208 - DNA, 22 bp, Homo sapiens
ggcagaggtgacagtgtctttt

SEQ ID NO: 9208209 - DNA, 22 bp, Homo sapiens
cacatgagacaattaaagactt

SEQ ID NO: 9208210 - DNA, 22 bp, Homo sapiens
cacatgaggtgacttccaagct

SEQ ID NO: 9208211 - DNA, 22 bp, Homo sapiens
cacatgaggtggagatgaatga

SEQ ID NO: 9208212 - DNA, 22 bp, Homo sapiens
cacatgagagcccccaagagca

SEQ ID NO: 9208213 - DNA, 19 bp, Homo sapiens
cacatgagggctgagggac

SEQ ID NO: 9208214 - DNA, 22 bp, Homo sapiens
ggcaatttggtcatttgtattg

SEQ ID NO: 9208215 - DNA, 16 bp, Homo sapiens
cacatatatttatatg

SEQ ID NO: 9208216 - DNA, 22 bp, Homo sapiens
ggcaatagttgtgggttcttta

SEQ ID NO: 9208217 - DNA, 22 bp, Homo sapiens
ggcaatgtagattctgtagatt

SEQ ID NO: 9208218 - DNA, 22 bp, Homo sapiens
cacagtgcgaaagaaacccagc

SEQ ID NO: 9208219 - DNA, 19 bp, Homo sapiens
cacagtgcagccatttctc

SEQ ID NO: 9208220 - DNA, 22 bp, Homo sapiens
ggcaaggggtcaggctgagaca

SEQ ID NO: 9208221 - DNA, 22 bp, Homo sapiens
ggcaagtcaggaagttgacatt

SEQ ID NO: 9208222 - DNA, 22 bp, Homo sapiens
ggcaagtggtagaacatctgag

SEQ ID NO: 9208223 - DNA, 22 bp, Homo sapiens
ggcaagggttgaagataaggta

SEQ ID NO: 9208224 - DNA, 22 bp, Homo sapiens
cacagtgcactaagctccgggg

SEQ ID NO: 9208225 - DNA, 22 bp, Homo sapiens
cacagtgcaatcggccacaaat

SEQ ID NO: 9208226 - DNA, 22 bp, Homo sapiens
cacagtgagctgggcatcagtt

SEQ ID NO: 9208227 - DNA, 22 bp, Homo sapiens
cacaggtgtgtcctggtcttgt

SEQ ID NO: 9208228 - DNA, 22 bp, Homo sapiens
cacaggcacccctgactgctca

SEQ ID NO: 9208229 - DNA, 22 bp, Homo sapiens
cacaggcacgcctctggccagg

SEQ ID NO: 9208230 - DNA, 22 bp, Homo sapiens
cacaggcacgcctctggccagg

SEQ ID NO: 9208231 - DNA, 23 bp, Homo sapiens
cacaggcagaaatcaagacggta

SEQ ID NO: 9208232 - DNA, 22 bp, Homo sapiens
cacaggcaggaggttctccagt

SEQ ID NO: 9208233 - DNA, 22 bp, Homo sapiens
cacaggcaggaggttctccagt

SEQ ID NO: 9208234 - DNA, 22 bp, Homo sapiens
cacaggagtgctgctattgttg

SEQ ID NO: 9208235 - DNA, 18 bp, Homo sapiens
cacaggagccacactcac

SEQ ID NO: 9208236 - DNA, 22 bp, Homo sapiens
cacaggaggttaggaagtggtc

SEQ ID NO: 9208237 - DNA, 18 bp, Homo sapiens
cacaggagccacactcac

SEQ ID NO: 9208238 - DNA, 22 bp, Homo sapiens
cacaggaggttaggaagtggtc

SEQ ID NO: 9208239 - DNA, 22 bp, Homo sapiens
cacaggccaataccctctctct

SEQ ID NO: 9208240 - DNA, 22 bp, Homo sapiens
cacaggccagtaagactgtgtt

SEQ ID NO: 9208241 - DNA, 20 bp, Homo sapiens
cacaggccccaagacctgta

SEQ ID NO: 9208242 - DNA, 22 bp, Homo sapiens
cacaggccagtaagactgtgtt

SEQ ID NO: 9208243 - DNA, 22 bp, Homo sapiens
cacaggccagtaagactgtgtt

SEQ ID NO: 9208244 - DNA, 22 bp, Homo sapiens
cacagggcaggccccaggcctc

SEQ ID NO: 9208245 - DNA, 20 bp, Homo sapiens
cacaggccttgtgagcagac

SEQ ID NO: 9208246 - DNA, 20 bp, Homo sapiens
cacaggccttgtgagcagac

SEQ ID NO: 9208247 - DNA, 22 bp, Homo sapiens
cacaggcctggggttgagcggg

SEQ ID NO: 9208248 - DNA, 22 bp, Homo sapiens
cacagggctttgatggctgagt

SEQ ID NO: 9208249 - DNA, 22 bp, Homo sapiens
cacaggggcaaactgtagggga

SEQ ID NO: 9208250 - DNA, 22 bp, Homo sapiens
cacaggtaatagcctaggctat

SEQ ID NO: 9208251 - DNA, 22 bp, Homo sapiens
gggttccaaacatagtcttcct

SEQ ID NO: 9208252 - DNA, 22 bp, Homo sapiens
gggttcttatagtatcagagct

SEQ ID NO: 9208253 - DNA, 22 bp, Homo sapiens
gggttccaatgatgagcaagag

SEQ ID NO: 9208254 - DNA, 22 bp, Homo sapiens
gggttccagtctgaaactacag

SEQ ID NO: 9208255 - DNA, 22 bp, Homo sapiens
gggttaggtccctcccttctgg

SEQ ID NO: 9208256 - DNA, 22 bp, Homo sapiens
gggtaggaaatccagaggtggc

SEQ ID NO: 9208257 - DNA, 22 bp, Homo sapiens
gggtaggaaatccagaggtggc

SEQ ID NO: 9208258 - DNA, 22 bp, Homo sapiens
gggtacagttcttccagtgtca

SEQ ID NO: 9208259 - DNA, 22 bp, Homo sapiens
gggtagcagcagggttcctatg

SEQ ID NO: 9208260 - DNA, 22 bp, Homo sapiens
gggtccaggtcttcaggcagag

SEQ ID NO: 9208261 - DNA, 22 bp, Homo sapiens
gggtgggatctgtggagcctca

SEQ ID NO: 9208262 - DNA, 18 bp, Homo sapiens
gggtcctgttcttggaag

SEQ ID NO: 9208263 - DNA, 18 bp, Homo sapiens
gggtcctgtgggagacag

SEQ ID NO: 9208264 - DNA, 21 bp, Homo sapiens
gggtcctgggatgggatccag

SEQ ID NO: 9208265 - DNA, 22 bp, Homo sapiens
gggtcctgcgtgggcccaggac

SEQ ID NO: 9208266 - DNA, 22 bp, Homo sapiens
gggtcctggaatctgcatttta

SEQ ID NO: 9208267 - DNA, 20 bp, Homo sapiens
gggtcctgacttggtctcct

SEQ ID NO: 9208268 - DNA, 22 bp, Homo sapiens
ggtcaacagaatttgtactcag

SEQ ID NO: 9208269 - DNA, 22 bp, Homo sapiens
cagatatgctgagactcctgtg

SEQ ID NO: 9208270 - DNA, 22 bp, Homo sapiens
cagatgaataaatgatgaggta

SEQ ID NO: 9208271 - DNA, 23 bp, Homo sapiens
cagatgaggttggcagcatggtc

SEQ ID NO: 9208272 - DNA, 22 bp, Homo sapiens
ggtcctggcagctctgtgtcca

SEQ ID NO: 9208273 - DNA, 22 bp, Homo sapiens
ggtcctggaagtgtaagtggca

SEQ ID NO: 9208274 - DNA, 22 bp, Homo sapiens
cagatgctaagttatcagcagg

SEQ ID NO: 9208275 - DNA, 22 bp, Homo sapiens
ggggcagatggaacagagcaca

SEQ ID NO: 9208276 - DNA, 22 bp, Homo sapiens
ggggcctctgcagtcacgctgg

SEQ ID NO: 9208277 - DNA, 21 bp, Homo sapiens
ggggcctctccacacagccgg

SEQ ID NO: 9208278 - DNA, 22 bp, Homo sapiens
ggggcctcgccgccgcctctgc

SEQ ID NO: 9208279 - DNA, 22 bp, Homo sapiens
ggggcagagtagctggggtgtg

SEQ ID NO: 9208280 - DNA, 22 bp, Homo sapiens
ggggcagagagaaggaagcttg

SEQ ID NO: 9208281 - DNA, 22 bp, Homo sapiens
ggggaggaagctctcagttcca

SEQ ID NO: 9208282 - DNA, 22 bp, Homo sapiens
ggggcagaagtagtgcccctga

SEQ ID NO: 9208283 - DNA, 22 bp, Homo sapiens
cagagccagcagtggggacagg

SEQ ID NO: 9208284 - DNA, 22 bp, Homo sapiens
gggctggaggagatccagaggc

SEQ ID NO: 9208285 - DNA, 19 bp, Homo sapiens
gggctggagggatagagcc

SEQ ID NO: 9208286 - DNA, 22 bp, Homo sapiens
gggctggaggtgagcaggacag

SEQ ID NO: 9208287 - DNA, 22 bp, Homo sapiens
gggctgtggagccgcgagggct

SEQ ID NO: 9208288 - DNA, 22 bp, Homo sapiens
gggctgtgaggtgagaacttac

SEQ ID NO: 9208289 - DNA, 22 bp, Homo sapiens
gggatgagagctgggacagaag

SEQ ID NO: 9208290 - DNA, 22 bp, Homo sapiens
gggatgagagctgggacagaag

SEQ ID NO: 9208291 - DNA, 22 bp, Homo sapiens
gggatctgtgttgcgatggatt

SEQ ID NO: 9208292 - DNA, 22 bp, Homo sapiens
gggatctgggacaacaggtggt

SEQ ID NO: 9208293 - DNA, 22 bp, Homo sapiens
gggatctggaattttggtatgt

SEQ ID NO: 9208294 - DNA, 23 bp, Homo sapiens
gggatctgtaaacctggagaacc

SEQ ID NO: 9208295 - DNA, 23 bp, Homo sapiens
gggatctgtaagttgaagacaaa

SEQ ID NO: 9208296 - DNA, 22 bp, Homo sapiens
cagagcagaagcggtcctcaca

SEQ ID NO: 9208297 - DNA, 22 bp, Homo sapiens
cagagcagaaacctgggtgatt

SEQ ID NO: 9208298 - DNA, 22 bp, Homo sapiens
cagagcacccaaggagcatttg

SEQ ID NO: 9208299 - DNA, 22 bp, Homo sapiens
cagagacaacctggtagagaaa

SEQ ID NO: 9208300 - DNA, 22 bp, Homo sapiens
cagagacaacctggtagagaaa

SEQ ID NO: 9208301 - DNA, 22 bp, Homo sapiens
gggatctgctccagagggaaaa

SEQ ID NO: 9208302 - DNA, 22 bp, Homo sapiens
gggatctgatttaggatgggag

SEQ ID NO: 9208303 - DNA, 22 bp, Homo sapiens
cagagacacttaacaggaatgg

SEQ ID NO: 9208304 - DNA, 22 bp, Homo sapiens
cagacttgacggcagctgcttt

SEQ ID NO: 9208305 - DNA, 22 bp, Homo sapiens
cagagaactccagtggctggcg

SEQ ID NO: 9208306 - DNA, 22 bp, Homo sapiens
cagacttgaaagagactcagtt

SEQ ID NO: 9208307 - DNA, 20 bp, Homo sapiens
cagagccaagagcagcatct

SEQ ID NO: 9208308 - DNA, 22 bp, Homo sapiens
cagagcattgagggtctgccaa

SEQ ID NO: 9208309 - DNA, 22 bp, Homo sapiens
cagagcatgtcaactagcttta

SEQ ID NO: 9208310 - DNA, 22 bp, Homo sapiens
cagagcagtggggttggtcaga

SEQ ID NO: 9208311 - DNA, 22 bp, Homo sapiens
cagagcagtggagagtaggtct

SEQ ID NO: 9208312 - DNA, 20 bp, Homo sapiens
cagagcagtgcccaggcggc

SEQ ID NO: 9208313 - DNA, 22 bp, Homo sapiens
cagagcaggcccactgccctcc

SEQ ID NO: 9208314 - DNA, 22 bp, Homo sapiens
cagagcagtgaggagttgtgta

SEQ ID NO: 9208315 - DNA, 22 bp, Homo sapiens
cagagcaggcccactgccctcc

SEQ ID NO: 9208316 - DNA, 22 bp, Homo sapiens
cagagcagaagcggtcctcaca

SEQ ID NO: 9208317 - DNA, 18 bp, Homo sapiens
cagagcagaggtggagcg

SEQ ID NO: 9208318 - DNA, 22 bp, Homo sapiens
ggctggcaagtgtctgctcatg

SEQ ID NO: 9208319 - DNA, 22 bp, Homo sapiens
ggctggcacagagggctggtgt

SEQ ID NO: 9208320 - DNA, 19 bp, Homo sapiens
ggctggcaagtgacagtgt

SEQ ID NO: 9208321 - DNA, 22 bp, Homo sapiens
ggctggcactgaggagagctct

SEQ ID NO: 9208322 - DNA, 22 bp, Homo sapiens
ggctggcactgaggagagctct

SEQ ID NO: 9208323 - DNA, 22 bp, Homo sapiens
cagaaacactgtatttagggaa

SEQ ID NO: 9208324 - DNA, 22 bp, Homo sapiens
cagaaaatagagtttctctgag

SEQ ID NO: 9208325 - DNA, 22 bp, Homo sapiens
cagaaacacttgtagagaagtt

SEQ ID NO: 9208326 - DNA, 22 bp, Homo sapiens
cagaatttcagtgatgttttct

SEQ ID NO: 9208327 - DNA, 22 bp, Homo sapiens
cagaatttttcactcaatcttc

SEQ ID NO: 9208328 - DNA, 22 bp, Homo sapiens
cagaatttagcacaatgtatgg

SEQ ID NO: 9208329 - DNA, 22 bp, Homo sapiens
cagaatttagcacaatgtatgg

SEQ ID NO: 9208330 - DNA, 22 bp, Homo sapiens
cagacaaagcggaaactgttta

SEQ ID NO: 9208331 - DNA, 22 bp, Homo sapiens
cagacaaagcggaaactgttta

SEQ ID NO: 9208332 - DNA, 22 bp, Homo sapiens
cagacaaccaggtctttcagtt

SEQ ID NO: 9208333 - DNA, 22 bp, Homo sapiens
cagacaactggactaagatcac

SEQ ID NO: 9208334 - DNA, 22 bp, Homo sapiens
cagaaacacttgtagagaagtt

SEQ ID NO: 9208335 - DNA, 22 bp, Homo sapiens
cagaaacagacatgacgcagta

SEQ ID NO: 9208336 - DNA, 22 bp, Homo sapiens
cagaaacagagaaatattggct

SEQ ID NO: 9208337 - DNA, 22 bp, Homo sapiens
cagaaacaggcaacgtgtgcac

SEQ ID NO: 9208338 - DNA, 22 bp, Homo sapiens
cagacactatgctaaggtacta

SEQ ID NO: 9208339 - DNA, 18 bp, Homo sapiens
cagacactctgctctgca

SEQ ID NO: 9208340 - DNA, 22 bp, Homo sapiens
cagacacagatatgcatatggc

SEQ ID NO: 9208341 - DNA, 22 bp, Homo sapiens
cagacacagatatgcatatggc

SEQ ID NO: 9208342 - DNA, 22 bp, Homo sapiens
cagacacacaagcaatctaagt

SEQ ID NO: 9208343 - DNA, 22 bp, Homo sapiens
cagacacacaccctggcctagc

SEQ ID NO: 9208344 - DNA, 22 bp, Homo sapiens
cagacagaaggaaggccaacat

SEQ ID NO: 9208345 - DNA, 22 bp, Homo sapiens
gggaggagtgaagattcacctg

SEQ ID NO: 9208346 - DNA, 22 bp, Homo sapiens
gggaggcagtgctggaggctgg

SEQ ID NO: 9208347 - DNA, 22 bp, Homo sapiens
gtcacaggaaagggtgtaaggg

SEQ ID NO: 9208348 - DNA, 22 bp, Homo sapiens
gtcacagatctcttgagtcaag

SEQ ID NO: 9208349 - DNA, 22 bp, Homo sapiens
gtcacagatctcttgagtcaag

SEQ ID NO: 9208350 - DNA, 22 bp, Homo sapiens
gtcagatctttggggatgctgt

SEQ ID NO: 9208351 - DNA, 22 bp, Homo sapiens
gtcagatctttggggatgctgt

SEQ ID NO: 9208352 - DNA, 22 bp, Homo sapiens
gtcacagggtccccatatggag

SEQ ID NO: 9208353 - DNA, 22 bp, Homo sapiens
gtcacaggaagcagcaggcact

SEQ ID NO: 9208354 - DNA, 22 bp, Homo sapiens
gtcacaggcctggatgaggggc

SEQ ID NO: 9208355 - DNA, 22 bp, Homo sapiens
gtcacaggcagtaactaggacc

SEQ ID NO: 9208356 - DNA, 22 bp, Homo sapiens
gtagggacttgttttactagta

SEQ ID NO: 9208357 - DNA, 22 bp, Homo sapiens
gtcacacagggcctccaaatca

SEQ ID NO: 9208358 - DNA, 22 bp, Homo sapiens
gtcacacaggttgaaatgcagt

SEQ ID NO: 9208359 - DNA, 21 bp, Homo sapiens
gtcacacaggcctggagctga

SEQ ID NO: 9208360 - DNA, 22 bp, Homo sapiens
gtcacacagagccctgtgctca

SEQ ID NO: 9208361 - DNA, 22 bp, Homo sapiens
gtcagattaatagcaataataa

SEQ ID NO: 9208362 - DNA, 22 bp, Homo sapiens
gtccagagaggcaggaggctac

SEQ ID NO: 9208363 - DNA, 22 bp, Homo sapiens
gtccagaggtccaggatcaagg

SEQ ID NO: 9208364 - DNA, 20 bp, Homo sapiens
gtccagagtaatgtgctgac

SEQ ID NO: 9208365 - DNA, 22 bp, Homo sapiens
gtccagagggctgcaggatgct

SEQ ID NO: 9208366 - DNA, 22 bp, Homo sapiens
gtccagagggctgcaggatgct

SEQ ID NO: 9208367 - DNA, 22 bp, Homo sapiens
cagccaggcccagatcatgctg

SEQ ID NO: 9208368 - DNA, 22 bp, Homo sapiens
cagccaggagcctctgcaacta

SEQ ID NO: 9208369 - DNA, 22 bp, Homo sapiens
cagccaggagctccccctgctc

SEQ ID NO: 9208370 - DNA, 22 bp, Homo sapiens
cagccaggagctccccctgctc

SEQ ID NO: 9208371 - DNA, 22 bp, Homo sapiens
cagccagctgtcccaagtgcct

SEQ ID NO: 9208372 - DNA, 22 bp, Homo sapiens
cagccagaacctaggatgagct

SEQ ID NO: 9208373 - DNA, 22 bp, Homo sapiens
cagattctgaagtctagctgct

SEQ ID NO: 9208374 - DNA, 22 bp, Homo sapiens
cagattctccaggggctgcaga

SEQ ID NO: 9208375 - DNA, 22 bp, Homo sapiens
cagattctgggcccagcttgtc

SEQ ID NO: 9208376 - DNA, 22 bp, Homo sapiens
cagattagttgtgctatggcct

SEQ ID NO: 9208377 - DNA, 22 bp, Homo sapiens
cagatttgccacttactcgttg

SEQ ID NO: 9208378 - DNA, 22 bp, Homo sapiens
cagattttgatgaatgtggaaa

SEQ ID NO: 9208379 - DNA, 22 bp, Homo sapiens
cagcaaaatttgaggattgcct

SEQ ID NO: 9208380 - DNA, 22 bp, Homo sapiens
cagcagccactagagggctcac

SEQ ID NO: 9208381 - DNA, 22 bp, Homo sapiens
cagcagcagattcagcgtctgg

SEQ ID NO: 9208382 - DNA, 22 bp, Homo sapiens
cagcaaaggtagaagcacagga

SEQ ID NO: 9208383 - DNA, 22 bp, Homo sapiens
cagcagccatgtaccacactca

SEQ ID NO: 9208384 - DNA, 22 bp, Homo sapiens
cagcagccactagagggctcac

SEQ ID NO: 9208385 - DNA, 19 bp, Homo sapiens
cagcagccagggggcccct

SEQ ID NO: 9208386 - DNA, 22 bp, Homo sapiens
cagcagcctacaatgcacagaa

SEQ ID NO: 9208387 - DNA, 22 bp, Homo sapiens
cagcagcctacaatgcacagaa

SEQ ID NO: 9208388 - DNA, 22 bp, Homo sapiens
cagcagccctttggctgaactg

SEQ ID NO: 9208389 - DNA, 22 bp, Homo sapiens
gtaggcagggctgtggggagaa

SEQ ID NO: 9208390 - DNA, 22 bp, Homo sapiens
gtaggcaggtggaggagtgaag

SEQ ID NO: 9208391 - DNA, 22 bp, Homo sapiens
gtaggcaggtggaggagtgaag

SEQ ID NO: 9208392 - DNA, 22 bp, Homo sapiens
gtaggcagataggagtgcagcc

SEQ ID NO: 9208393 - DNA, 22 bp, Homo sapiens
gtaggcagataggagtgcagcc

SEQ ID NO: 9208394 - DNA, 22 bp, Homo sapiens
gtaggccagtgtgaaacctggt

SEQ ID NO: 9208395 - DNA, 22 bp, Homo sapiens
gtaggcagtctctcaggtgatc

SEQ ID NO: 9208396 - DNA, 22 bp, Homo sapiens
gtaggcagtggttggaagagaa

SEQ ID NO: 9208397 - DNA, 22 bp, Homo sapiens
gtagaaatagtggttgacagga

SEQ ID NO: 9208398 - DNA, 22 bp, Homo sapiens
gtacacagatgcttgagaatct

SEQ ID NO: 9208399 - DNA, 22 bp, Homo sapiens
cagccctggtgccaaggttccc

SEQ ID NO: 9208400 - DNA, 22 bp, Homo sapiens
gtcctgtgacctgcatcctgag

SEQ ID NO: 9208401 - DNA, 22 bp, Homo sapiens
gtcctggtgctggtcattgtcg

SEQ ID NO: 9208402 - DNA, 22 bp, Homo sapiens
gtcctggtcctgcctccccatg

SEQ ID NO: 9208403 - DNA, 22 bp, Homo sapiens
gtcctggtataattgtttaaaa

SEQ ID NO: 9208404 - DNA, 22 bp, Homo sapiens
gtgagcagaataagggttgaga

SEQ ID NO: 9208405 - DNA, 23 bp, Homo sapiens
gtgagcagcaccatgaggctaga

SEQ ID NO: 9208406 - DNA, 20 bp, Homo sapiens
cagccctccagtggaggcag

SEQ ID NO: 9208407 - DNA, 22 bp, Homo sapiens
cagccctctgaagaggcgcttg

SEQ ID NO: 9208408 - DNA, 22 bp, Homo sapiens
atgctgcctcctcttcagccgc

SEQ ID NO: 9208409 - DNA, 22 bp, Homo sapiens
atgctatgtaactggcagatag

SEQ ID NO: 9208410 - DNA, 22 bp, Homo sapiens
gaattttaataaaggtttatca

SEQ ID NO: 9208411 - DNA, 22 bp, Homo sapiens
atgctaaactatgatcattttc

SEQ ID NO: 9208412 - DNA, 22 bp, Homo sapiens
atgcctggatttgggactcaaa

SEQ ID NO: 9208413 - DNA, 22 bp, Homo sapiens
atgctaaggcccaggagaaaat

SEQ ID NO: 9208414 - DNA, 22 bp, Homo sapiens
atgctaaatgttaatgttacct

SEQ ID NO: 9208415 - DNA, 22 bp, Homo sapiens
atgccactgcactccagcctag

SEQ ID NO: 9208416 - DNA, 22 bp, Homo sapiens
atgccactgcactccagcctgg

SEQ ID NO: 9208417 - DNA, 22 bp, Homo sapiens
gaatttcaagcagtgcaatgtt

SEQ ID NO: 9208418 - DNA, 22 bp, Homo sapiens
gaagtcagaaaagaattaggga

SEQ ID NO: 9208419 - DNA, 23 bp, Homo sapiens
gaagtcagccctacagagagcag

SEQ ID NO: 9208420 - DNA, 22 bp, Homo sapiens
gaagtctctctgggctcagttc

SEQ ID NO: 9208421 - DNA, 22 bp, Homo sapiens
gaagagagccgcgggacatcag

SEQ ID NO: 9208422 - DNA, 22 bp, Homo sapiens
gaagagagagccctggggtccg

SEQ ID NO: 9208423 - DNA, 19 bp, Homo sapiens
atgagcaggcaagacaagc

SEQ ID NO: 9208424 - DNA, 22 bp, Homo sapiens
atgagcagtaggttcatggctg

SEQ ID NO: 9208425 - DNA, 22 bp, Homo sapiens
atgagcatccagaacagtgcct

SEQ ID NO: 9208426 - DNA, 22 bp, Homo sapiens
atgagctgggccatccagtgat

SEQ ID NO: 9208427 - DNA, 22 bp, Homo sapiens
atgagctagaaaaccatgtgga

SEQ ID NO: 9208428 - DNA, 22 bp, Homo sapiens
gaagagcatatgaagagcatat

SEQ ID NO: 9208429 - DNA, 22 bp, Homo sapiens
gaagagcatatgaagagcatat

SEQ ID NO: 9208430 - DNA, 22 bp, Homo sapiens
atgatgtaaatagagcctaggt

SEQ ID NO: 9208431 - DNA, 22 bp, Homo sapiens
atgcagtggcagctcctggtgt

SEQ ID NO: 9208432 - DNA, 22 bp, Homo sapiens
gaagccttgaactgcaaacccc

SEQ ID NO: 9208433 - DNA, 22 bp, Homo sapiens
gaagctaaaccacagctaagaa

SEQ ID NO: 9208434 - DNA, 22 bp, Homo sapiens
gaagcctttcgtgcacctcacc

SEQ ID NO: 9208435 - DNA, 22 bp, Homo sapiens
gaagcagcaagtataggacagg

SEQ ID NO: 9208436 - DNA, 22 bp, Homo sapiens
gaagcctggtccagagctccca

SEQ ID NO: 9208437 - DNA, 22 bp, Homo sapiens
gaaggaggcgttagccctagga

SEQ ID NO: 9208438 - DNA, 22 bp, Homo sapiens
gaaggaggctccccaaagtctg

SEQ ID NO: 9208439 - DNA, 22 bp, Homo sapiens
gaaggaggcgttagccctagga

SEQ ID NO: 9208440 - DNA, 22 bp, Homo sapiens
gaagctggagaatgggtctagg

SEQ ID NO: 9208441 - DNA, 22 bp, Homo sapiens
gaagctgggtcgctgggatcct

SEQ ID NO: 9208442 - DNA, 22 bp, Homo sapiens
gaagctgacccaggagcgtgtg

SEQ ID NO: 9208443 - DNA, 22 bp, Homo sapiens
gaagctctcaaactctcccctt

SEQ ID NO: 9208444 - DNA, 22 bp, Homo sapiens
gaagctgagctgaggcatgttg

SEQ ID NO: 9208445 - DNA, 22 bp, Homo sapiens
gaagctgaggtcaggtgggtgg

SEQ ID NO: 9208446 - DNA, 22 bp, Homo sapiens
gaagctgatgaggaccagattg

SEQ ID NO: 9208447 - DNA, 22 bp, Homo sapiens
atgagaaagttaatcatcatga

SEQ ID NO: 9208448 - DNA, 22 bp, Homo sapiens
atgagaaagagttgtatctaga

SEQ ID NO: 9208449 - DNA, 22 bp, Homo sapiens
atgagcagcattgctcctctta

SEQ ID NO: 9208450 - DNA, 22 bp, Homo sapiens
ctttttcaagtcaaagagggta

SEQ ID NO: 9208451 - DNA, 22 bp, Homo sapiens
ctttttatctcttaatgatgtt

SEQ ID NO: 9208452 - DNA, 22 bp, Homo sapiens
ctttttatagctatgtcctatg

SEQ ID NO: 9208453 - DNA, 22 bp, Homo sapiens
ctttttatagctatgtcctatg

SEQ ID NO: 9208454 - DNA, 22 bp, Homo sapiens
ctttttataccgtgccagttga

SEQ ID NO: 9208455 - DNA, 22 bp, Homo sapiens
atgacagacagaagggattttt

SEQ ID NO: 9208456 - DNA, 22 bp, Homo sapiens
atgacacataaaacaaggactg

SEQ ID NO: 9208457 - DNA, 22 bp, Homo sapiens
ctttgggcaaagggccaattcg

SEQ ID NO: 9208458 - DNA, 22 bp, Homo sapiens
ctttgctgccagaacccagcag

SEQ ID NO: 9208459 - DNA, 20 bp, Homo sapiens
ctttgcctattctctgcctg

SEQ ID NO: 9208460 - DNA, 22 bp, Homo sapiens
ctttgcttctccaacctgctca

SEQ ID NO: 9208461 - DNA, 22 bp, Homo sapiens
ctttggcattagcctgtataga

SEQ ID NO: 9208462 - DNA, 22 bp, Homo sapiens
atctttcctgttttcagacagc

SEQ ID NO: 9208463 - DNA, 22 bp, Homo sapiens
cttctccctggcttctgcacac

SEQ ID NO: 9208464 - DNA, 19 bp, Homo sapiens
cttctccagcttctagaag

SEQ ID NO: 9208465 - DNA, 22 bp, Homo sapiens
cttctcctctgagtcctgggag

SEQ ID NO: 9208466 - DNA, 22 bp, Homo sapiens
ctttattcctacaagattttct

SEQ ID NO: 9208467 - DNA, 22 bp, Homo sapiens
ctttattagatgtagactttct

SEQ ID NO: 9208468 - DNA, 22 bp, Homo sapiens
cttgttttaaactgttgtggct

SEQ ID NO: 9208469 - DNA, 22 bp, Homo sapiens
atctttgcccagagactcagcc

SEQ ID NO: 9208470 - DNA, 17 bp, Homo sapiens
cttgttttccactggga

SEQ ID NO: 9208471 - DNA, 22 bp, Homo sapiens
gaggagggagctggaagctctt

SEQ ID NO: 9208472 - DNA, 22 bp, Homo sapiens
gaggagggagctggaagctctt

SEQ ID NO: 9208473 - DNA, 22 bp, Homo sapiens
gaggagctgtcaccgtgactca

SEQ ID NO: 9208474 - DNA, 22 bp, Homo sapiens
gaggagggcagttcctctttta

SEQ ID NO: 9208475 - DNA, 22 bp, Homo sapiens
gaggagggcctggtgtcccttc

SEQ ID NO: 9208476 - DNA, 22 bp, Homo sapiens
gaggagggcctggtgtcccttc

SEQ ID NO: 9208477 - DNA, 22 bp, Homo sapiens
atgggcagctgcagcagtggtg

SEQ ID NO: 9208478 - DNA, 22 bp, Homo sapiens
atgggcaggcaaggtggcgagt

SEQ ID NO: 9208479 - DNA, 22 bp, Homo sapiens
gaggagctgggtcagggagaca

SEQ ID NO: 9208480 - DNA, 22 bp, Homo sapiens
atgggcaggcactggctctcag

SEQ ID NO: 9208481 - DNA, 22 bp, Homo sapiens
atgggcagagtggggacaggaa

SEQ ID NO: 9208482 - DNA, 22 bp, Homo sapiens
gaggcacatatatacagagccc

SEQ ID NO: 9208483 - DNA, 18 bp, Homo sapiens
gaggcacatagttggggc

SEQ ID NO: 9208484 - DNA, 22 bp, Homo sapiens
gaggcacagtcccgaggcaagg

SEQ ID NO: 9208485 - DNA, 22 bp, Homo sapiens
gaggcacagtcccgaggcaagg

SEQ ID NO: 9208486 - DNA, 22 bp, Homo sapiens
gaggcacagtgtttggtcagtg

SEQ ID NO: 9208487 - DNA, 22 bp, Homo sapiens
gaggcacagtgtttggtcagtg

SEQ ID NO: 9208488 - DNA, 22 bp, Homo sapiens
gaggaggggcacttgtctccta

SEQ ID NO: 9208489 - DNA, 22 bp, Homo sapiens
gaggcacagagccctaggagct

SEQ ID NO: 9208490 - DNA, 22 bp, Homo sapiens
gaggcacagagccctaggagct

SEQ ID NO: 9208491 - DNA, 22 bp, Homo sapiens
atgtatgtttctatatatgaca

SEQ ID NO: 9208492 - DNA, 22 bp, Homo sapiens
atgtatgttagtgtattatcta

SEQ ID NO: 9208493 - DNA, 23 bp, Homo sapiens
atgtatctcatccaaggaagctc

SEQ ID NO: 9208494 - DNA, 22 bp, Homo sapiens
atgtatgtagtgtacatataca

SEQ ID NO: 9208495 - DNA, 22 bp, Homo sapiens
gaggctccagcgacacctaggc

SEQ ID NO: 9208496 - DNA, 22 bp, Homo sapiens
gaggctctggagtaggtacaca

SEQ ID NO: 9208497 - DNA, 22 bp, Homo sapiens
gaggctcttcaataggtcaatg

SEQ ID NO: 9208498 - DNA, 22 bp, Homo sapiens
gaggctccgtgctgctgccctg

SEQ ID NO: 9208499 - DNA, 22 bp, Homo sapiens
atgtcagatcctcagaaagtct

SEQ ID NO: 9208500 - DNA, 22 bp, Homo sapiens
atgtcagatgtttatctgattt

SEQ ID NO: 9208501 - DNA, 22 bp, Homo sapiens
atgtcagaagctggatgacagc

SEQ ID NO: 9208502 - DNA, 22 bp, Homo sapiens
atgtcagtttcattttaagtca

SEQ ID NO: 9208503 - DNA, 22 bp, Homo sapiens
atgtcaggaccctactgcattg

SEQ ID NO: 9208504 - DNA, 22 bp, Homo sapiens
atgtggcagtgggaggtgaatt

SEQ ID NO: 9208505 - DNA, 22 bp, Homo sapiens
atgtggcacagcacagtaagag

SEQ ID NO: 9208506 - DNA, 22 bp, Homo sapiens
atgttagaaggaatgttaaaag

SEQ ID NO: 9208507 - DNA, 22 bp, Homo sapiens
atgttagaatctctgaatgtgg

SEQ ID NO: 9208508 - DNA, 22 bp, Homo sapiens
atgttacatagtccttatttgt

SEQ ID NO: 9208509 - DNA, 22 bp, Homo sapiens
gaggttctgggggtctgcctgg

SEQ ID NO: 9208510 - DNA, 22 bp, Homo sapiens
gaggttctgggggtctgcctgg

SEQ ID NO: 9208511 - DNA, 22 bp, Homo sapiens
gagccccttctgcagtcaggtt

SEQ ID NO: 9208512 - DNA, 22 bp, Homo sapiens
gagccccttctgcagtcaggtt

SEQ ID NO: 9208513 - DNA, 22 bp, Homo sapiens
gagccccaggacagctctagtt

SEQ ID NO: 9208514 - DNA, 22 bp, Homo sapiens
gagccccagccctgcttctata

SEQ ID NO: 9208515 - DNA, 22 bp, Homo sapiens
gagcccagtctgctcctgcgcc

SEQ ID NO: 9208516 - DNA, 22 bp, Homo sapiens
gagccccaggacagctctagtt

SEQ ID NO: 9208517 - DNA, 22 bp, Homo sapiens
gagccctccatggagccaggca

SEQ ID NO: 9208518 - DNA, 22 bp, Homo sapiens
atgggcagacagggagctcacg

SEQ ID NO: 9208519 - DNA, 22 bp, Homo sapiens
gagccccaccctagacattctg

SEQ ID NO: 9208520 - DNA, 22 bp, Homo sapiens
gagcccagtctgctcctgcgcc

SEQ ID NO: 9208521 - DNA, 22 bp, Homo sapiens
atgggcagagctggtgggaggc

SEQ ID NO: 9208522 - DNA, 22 bp, Homo sapiens
atgggcagagctggtgggaggc

SEQ ID NO: 9208523 - DNA, 22 bp, Homo sapiens
gagccctctctgtaggcaagta

SEQ ID NO: 9208524 - DNA, 22 bp, Homo sapiens
gagctctgtgaatgtggggagg

SEQ ID NO: 9208525 - DNA, 21 bp, Homo sapiens
atgggcagaggcagagaggct

SEQ ID NO: 9208526 - DNA, 22 bp, Homo sapiens
gagctgccctgagctttgcatg

SEQ ID NO: 9208527 - DNA, 22 bp, Homo sapiens
atggctctatctagaattctgg

SEQ ID NO: 9208528 - DNA, 22 bp, Homo sapiens
atggccgcctgtccttcccgcc

SEQ ID NO: 9208529 - DNA, 19 bp, Homo sapiens
atggctctgatttaatgtg

SEQ ID NO: 9208530 - DNA, 22 bp, Homo sapiens
gagcacaggctttggtggacac

SEQ ID NO: 9208531 - DNA, 22 bp, Homo sapiens
atgggagggtggaaaggctctg

SEQ ID NO: 9208532 - DNA, 22 bp, Homo sapiens
gagcacagcgcagtttgtaatt

SEQ ID NO: 9208533 - DNA, 19 bp, Homo sapiens
gagcacagcggcatttggt

SEQ ID NO: 9208534 - DNA, 22 bp, Homo sapiens
gagcacagctgtcttgcaagct

SEQ ID NO: 9208535 - DNA, 22 bp, Homo sapiens
gagcacagctgtcttgcaagct

SEQ ID NO: 9208536 - DNA, 22 bp, Homo sapiens
atgctggtctcattgggttagg

SEQ ID NO: 9208537 - DNA, 22 bp, Homo sapiens
atgctggggcctcagaccagaa

SEQ ID NO: 9208538 - DNA, 22 bp, Homo sapiens
atgctggtggttgatggcagga

SEQ ID NO: 9208539 - DNA, 22 bp, Homo sapiens
atgctggtctgcagagttggga

SEQ ID NO: 9208540 - DNA, 22 bp, Homo sapiens
atgctgggaagtcctaaccaca

SEQ ID NO: 9208541 - DNA, 18 bp, Homo sapiens
gagaagtgcatacattat

SEQ ID NO: 9208542 - DNA, 22 bp, Homo sapiens
atggatctaccttcaggctctg

SEQ ID NO: 9208543 - DNA, 22 bp, Homo sapiens
gagaatacaaccagaagctgag

SEQ ID NO: 9208544 - DNA, 17 bp, Homo sapiens
gagacagcaggagcccc

SEQ ID NO: 9208545 - DNA, 22 bp, Homo sapiens
atggcacaggagaggagggctg

SEQ ID NO: 9208546 - DNA, 18 bp, Homo sapiens
atggcacagtctttccct

SEQ ID NO: 9208547 - DNA, 22 bp, Homo sapiens
atggcacagtgggaaatgacct

SEQ ID NO: 9208548 - DNA, 22 bp, Homo sapiens
atggcacagattagggtcacag

SEQ ID NO: 9208549 - DNA, 22 bp, Homo sapiens
atggcacagatgttctgattat

SEQ ID NO: 9208550 - DNA, 22 bp, Homo sapiens
atggcacacaggtctgcaaggg

SEQ ID NO: 9208551 - DNA, 23 bp, Homo sapiens
atggcacatgggacagtaagtag

SEQ ID NO: 9208552 - DNA, 22 bp, Homo sapiens
atggcacatgttgccttcgaat

SEQ ID NO: 9208553 - DNA, 22 bp, Homo sapiens
atggcacatgaccttgatggat

SEQ ID NO: 9208554 - DNA, 22 bp, Homo sapiens
atggcactgacctcccttgtaa

SEQ ID NO: 9208555 - DNA, 22 bp, Homo sapiens
atggcactaagagggagctgga

SEQ ID NO: 9208556 - DNA, 22 bp, Homo sapiens
gatgtggtgcagggcagtgctt

SEQ ID NO: 9208557 - DNA, 22 bp, Homo sapiens
gattccagtccgtgactattct

SEQ ID NO: 9208558 - DNA, 20 bp, Homo sapiens
gattccagttctatccactt

SEQ ID NO: 9208559 - DNA, 22 bp, Homo sapiens
attaacatgcagccagacacac

SEQ ID NO: 9208560 - DNA, 22 bp, Homo sapiens
gagtggggcgtggatccagcgt

SEQ ID NO: 9208561 - DNA, 22 bp, Homo sapiens
gatggagtctgaagctgggaac

SEQ ID NO: 9208562 - DNA, 22 bp, Homo sapiens
attatgcatatacatttgacta

SEQ ID NO: 9208563 - DNA, 22 bp, Homo sapiens
gcacccagaataaggacaggac

SEQ ID NO: 9208564 - DNA, 22 bp, Homo sapiens
gcacccagaataaggacaggac

SEQ ID NO: 9208565 - DNA, 22 bp, Homo sapiens
gcaccaggcagctgagcaggcc

SEQ ID NO: 9208566 - DNA, 22 bp, Homo sapiens
attatgtctttagatatttggt

SEQ ID NO: 9208567 - DNA, 22 bp, Homo sapiens
attatgtatttggtatagtttg

SEQ ID NO: 9208568 - DNA, 21 bp, Homo sapiens
gcagagaatgaactttggctt

SEQ ID NO: 9208569 - DNA, 22 bp, Homo sapiens
gcagagaggaatgaagccatcc

SEQ ID NO: 9208570 - DNA, 22 bp, Homo sapiens
gcagagatggctgcctctgagt

SEQ ID NO: 9208571 - DNA, 22 bp, Homo sapiens
gcagagatccttgctggatgac

SEQ ID NO: 9208572 - DNA, 22 bp, Homo sapiens
attatataggacttgcccttcc

SEQ ID NO: 9208573 - DNA, 22 bp, Homo sapiens
attatataaaattctggaagct

SEQ ID NO: 9208574 - DNA, 22 bp, Homo sapiens
gcacacagaatcagtgggcata

SEQ ID NO: 9208575 - DNA, 22 bp, Homo sapiens
attaagagcctactatgtgccg

SEQ ID NO: 9208576 - DNA, 22 bp, Homo sapiens
attataggcttgagccaccgtg

SEQ ID NO: 9208577 - DNA, 22 bp, Homo sapiens
attataggcttgagccaccgtg

SEQ ID NO: 9208578 - DNA, 22 bp, Homo sapiens
attataggcttgagccaccgtg

SEQ ID NO: 9208579 - DNA, 22 bp, Homo sapiens
gcacacagctagattaccattc

SEQ ID NO: 9208580 - DNA, 22 bp, Homo sapiens
gcacacagactaaccatatttc

SEQ ID NO: 9208581 - DNA, 22 bp, Homo sapiens
gcacacagaattgattcactgt

SEQ ID NO: 9208582 - DNA, 22 bp, Homo sapiens
gcacacagagaggtggtatgtc

SEQ ID NO: 9208583 - DNA, 16 bp, Homo sapiens
gcacacagccagcctt

SEQ ID NO: 9208584 - DNA, 22 bp, Homo sapiens
gcaccaggcagctgagcaggcc

SEQ ID NO: 9208585 - DNA, 22 bp, Homo sapiens
gcaccaggcagctgagcaggcc

SEQ ID NO: 9208586 - DNA, 22 bp, Homo sapiens
gcacacaggcagtttccagcca

SEQ ID NO: 9208587 - DNA, 22 bp, Homo sapiens
gcacagggccctgtgcgtaggt

SEQ ID NO: 9208588 - DNA, 22 bp, Homo sapiens
gcacagggcctggcacataaga

SEQ ID NO: 9208589 - DNA, 22 bp, Homo sapiens
gcaggcaggagcccaactgcct

SEQ ID NO: 9208590 - DNA, 19 bp, Homo sapiens
gcaggcagctggggtatcc

SEQ ID NO: 9208591 - DNA, 22 bp, Homo sapiens
gcaggcaggcttccttgaactg

SEQ ID NO: 9208592 - DNA, 22 bp, Homo sapiens
gcaggcaggagcccaactgcct

SEQ ID NO: 9208593 - DNA, 22 bp, Homo sapiens
gcagcttggtgaaaggtgatgg

SEQ ID NO: 9208594 - DNA, 22 bp, Homo sapiens
gcagcttggatttctgtagttt

SEQ ID NO: 9208595 - DNA, 22 bp, Homo sapiens
attctctgtttccaagatgaaa

SEQ ID NO: 9208596 - DNA, 22 bp, Homo sapiens
attccaaacagtgctgcagact

SEQ ID NO: 9208597 - DNA, 22 bp, Homo sapiens
attcaatcccagaaagaaactg

SEQ ID NO: 9208598 - DNA, 22 bp, Homo sapiens
gcagtaagaaagtcaagcagtt

SEQ ID NO: 9208599 - DNA, 22 bp, Homo sapiens
gcagtaagaaagtcaagcagtt

SEQ ID NO: 9208600 - DNA, 22 bp, Homo sapiens
gcatggcaagatcaggagacca

SEQ ID NO: 9208601 - DNA, 22 bp, Homo sapiens
gcatggcaaatatcgagggcag

SEQ ID NO: 9208602 - DNA, 22 bp, Homo sapiens
gcatggaattcccttatgggcc

SEQ ID NO: 9208603 - DNA, 22 bp, Homo sapiens
gcatggagaagtgggaacaggt

SEQ ID NO: 9208604 - DNA, 22 bp, Homo sapiens
attgcacatctgcactacagcc

SEQ ID NO: 9208605 - DNA, 22 bp, Homo sapiens
attgcacagctgaatattttgg

SEQ ID NO: 9208606 - DNA, 22 bp, Homo sapiens
attctgcatggtggtgtctctg

SEQ ID NO: 9208607 - DNA, 22 bp, Homo sapiens
gcagggattgtgcagggggcta

SEQ ID NO: 9208608 - DNA, 22 bp, Homo sapiens
gctccagggaacagaatgtact

SEQ ID NO: 9208609 - DNA, 22 bp, Homo sapiens
gctcccaggatgaggagccagg

SEQ ID NO: 9208610 - DNA, 22 bp, Homo sapiens
caaaagcagcaagtttatatgt

SEQ ID NO: 9208611 - DNA, 22 bp, Homo sapiens
caaaagcagcaagtttatatgt

SEQ ID NO: 9208612 - DNA, 22 bp, Homo sapiens
gctcccagggacactggccact

SEQ ID NO: 9208613 - DNA, 22 bp, Homo sapiens
gctccccaaaagctccaggaaa

SEQ ID NO: 9208614 - DNA, 22 bp, Homo sapiens
gctccccagcttagccctggct

SEQ ID NO: 9208615 - DNA, 22 bp, Homo sapiens
gctcccagtctgatggaggaga

SEQ ID NO: 9208616 - DNA, 22 bp, Homo sapiens
caaagaagagatttacagagct

SEQ ID NO: 9208617 - DNA, 22 bp, Homo sapiens
caaagacacgggaaacaacgtt

SEQ ID NO: 9208618 - DNA, 22 bp, Homo sapiens
caaagacacgggaaacaacgtt

SEQ ID NO: 9208619 - DNA, 22 bp, Homo sapiens
gctctgctgtcttcttgcaggc

SEQ ID NO: 9208620 - DNA, 22 bp, Homo sapiens
gctctgctgtggaatcctctcc

SEQ ID NO: 9208621 - DNA, 22 bp, Homo sapiens
gctctgctgggtgggcagttat

SEQ ID NO: 9208622 - DNA, 22 bp, Homo sapiens
attttgcacactatgcagcttt

SEQ ID NO: 9208623 - DNA, 22 bp, Homo sapiens
attttgctgtggtacattagga

SEQ ID NO: 9208624 - DNA, 22 bp, Homo sapiens
gctcagactgcacaccctggtc

SEQ ID NO: 9208625 - DNA, 17 bp, Homo sapiens
gccttccttcctccaca

SEQ ID NO: 9208626 - DNA, 22 bp, Homo sapiens
gccttccttttaccaccagcca

SEQ ID NO: 9208627 - DNA, 20 bp, Homo sapiens
caaaagcaatgaagttatga

SEQ ID NO: 9208628 - DNA, 22 bp, Homo sapiens
caaaagcaaagtccctgaatgt

SEQ ID NO: 9208629 - DNA, 22 bp, Homo sapiens
gctcagagaatcagcagacacc

SEQ ID NO: 9208630 - DNA, 22 bp, Homo sapiens
gctcagagaagttgtgcctggc

SEQ ID NO: 9208631 - DNA, 22 bp, Homo sapiens
gctcagagaaattataggaatt

SEQ ID NO: 9208632 - DNA, 22 bp, Homo sapiens
gctcagagagtttcacaagttt

SEQ ID NO: 9208633 - DNA, 22 bp, Homo sapiens
caaaagaagctcttggggctag

SEQ ID NO: 9208634 - DNA, 22 bp, Homo sapiens
gctcagagagaggatatgttat

SEQ ID NO: 9208635 - DNA, 22 bp, Homo sapiens
attttagagctccaagtacagc

SEQ ID NO: 9208636 - DNA, 22 bp, Homo sapiens
atttgtaccatctggtatacag

SEQ ID NO: 9208637 - DNA, 22 bp, Homo sapiens
atttgtaaagtgcttaaaagta

SEQ ID NO: 9208638 - DNA, 22 bp, Homo sapiens
atttgtacaaatttatgttagt

SEQ ID NO: 9208639 - DNA, 22 bp, Homo sapiens
atttgtaagctagagccatgat

SEQ ID NO: 9208640 - DNA, 22 bp, Homo sapiens
atttcttcctctgtcagtaact

SEQ ID NO: 9208641 - DNA, 22 bp, Homo sapiens
attttcatcatgggtttaacat

SEQ ID NO: 9208642 - DNA, 22 bp, Homo sapiens
attttcagttgaaaaagttggt

SEQ ID NO: 9208643 - DNA, 22 bp, Homo sapiens
attttccagcctttctagaact

SEQ ID NO: 9208644 - DNA, 22 bp, Homo sapiens
attttccaaaataattgttact

SEQ ID NO: 9208645 - DNA, 22 bp, Homo sapiens
gccttcctgcagctctgagcgt

SEQ ID NO: 9208646 - DNA, 22 bp, Homo sapiens
gccttccctggctaggcaagca

SEQ ID NO: 9208647 - DNA, 22 bp, Homo sapiens
gccttcccaccctgcgaggctg

SEQ ID NO: 9208648 - DNA, 17 bp, Homo sapiens
gccttccagcatgtggg

SEQ ID NO: 9208649 - DNA, 22 bp, Homo sapiens
attttcctcaagcctctggaag

SEQ ID NO: 9208650 - DNA, 22 bp, Homo sapiens
gccctgtgccagtcacgctgtg

SEQ ID NO: 9208651 - DNA, 22 bp, Homo sapiens
gccctgtgagtcatgcggcaga

SEQ ID NO: 9208652 - DNA, 22 bp, Homo sapiens
gccctgtcctcctgactgagtg

SEQ ID NO: 9208653 - DNA, 22 bp, Homo sapiens
atttcttcaggttcttctagga

SEQ ID NO: 9208654 - DNA, 22 bp, Homo sapiens
atttcttcaggtcagaaataga

SEQ ID NO: 9208655 - DNA, 22 bp, Homo sapiens
atttcttacataacaaattgtt

SEQ ID NO: 9208656 - DNA, 22 bp, Homo sapiens
gccctgtcccttggcttctagg

SEQ ID NO: 9208657 - DNA, 22 bp, Homo sapiens
gcccagtctcttctggccctgt

SEQ ID NO: 9208658 - DNA, 22 bp, Homo sapiens
gcccagtagttcaaggttgcag

SEQ ID NO: 9208659 - DNA, 22 bp, Homo sapiens
gcccagtctccaggagactctc

SEQ ID NO: 9208660 - DNA, 22 bp, Homo sapiens
gcccagggtgcttagaacccat

SEQ ID NO: 9208661 - DNA, 22 bp, Homo sapiens
gcccagggtgaagtgcagttgt

SEQ ID NO: 9208662 - DNA, 22 bp, Homo sapiens
gcccagggtgaagtgcagttgt

SEQ ID NO: 9208663 - DNA, 22 bp, Homo sapiens
gcccagggtctacaaaaatatt

SEQ ID NO: 9208664 - DNA, 22 bp, Homo sapiens
gcccaggttggagagcagtggc

SEQ ID NO: 9208665 - DNA, 22 bp, Homo sapiens
gcccaggttggagagcagtggc

SEQ ID NO: 9208666 - DNA, 22 bp, Homo sapiens
gcccaggttggagagcagtggc

SEQ ID NO: 9208667 - DNA, 22 bp, Homo sapiens
gcccaggtttcatctgctccgt

SEQ ID NO: 9208668 - DNA, 22 bp, Homo sapiens
gcccaggtgccctctgccttac

SEQ ID NO: 9208669 - DNA, 19 bp, Homo sapiens
gcccaggggcccgatgctg

SEQ ID NO: 9208670 - DNA, 22 bp, Homo sapiens
atttcaagtgttgagctcataa

SEQ ID NO: 9208671 - DNA, 22 bp, Homo sapiens
atttcaaggactacttttcaat

SEQ ID NO: 9208672 - DNA, 20 bp, Homo sapiens
gccatccagcctcccaggag

SEQ ID NO: 9208673 - DNA, 22 bp, Homo sapiens
gccatcatatcccctgtgacct

SEQ ID NO: 9208674 - DNA, 19 bp, Homo sapiens
gccatcccaagcattttgg

SEQ ID NO: 9208675 - DNA, 22 bp, Homo sapiens
gccatcctctgagcactaggca

SEQ ID NO: 9208676 - DNA, 22 bp, Homo sapiens
gccatgactctccataccaaag

SEQ ID NO: 9208677 - DNA, 22 bp, Homo sapiens
gccatgaggaactgtaagacaa

SEQ ID NO: 9208678 - DNA, 22 bp, Homo sapiens
gccatgaggctccgagaagtca

SEQ ID NO: 9208679 - DNA, 22 bp, Homo sapiens
gccatgcttggtatgctgtgag

SEQ ID NO: 9208680 - DNA, 22 bp, Homo sapiens
gccatgcatttcgctgggaggg

SEQ ID NO: 9208681 - DNA, 19 bp, Homo sapiens
atttattgtatgattccat

SEQ ID NO: 9208682 - DNA, 22 bp, Homo sapiens
atttatcaccagttagctgact

SEQ ID NO: 9208683 - DNA, 22 bp, Homo sapiens
gccagctggagtgagagtgggc

SEQ ID NO: 9208684 - DNA, 22 bp, Homo sapiens
gccagctggaaatctgcttgaa

SEQ ID NO: 9208685 - DNA, 22 bp, Homo sapiens
gccagctgctggaacagcgcga

SEQ ID NO: 9208686 - DNA, 22 bp, Homo sapiens
gccagctgcttctccagaattt

SEQ ID NO: 9208687 - DNA, 22 bp, Homo sapiens
gccagctgcttctccagaattt

SEQ ID NO: 9208688 - DNA, 22 bp, Homo sapiens
gccagccacttcccagactggc

SEQ ID NO: 9208689 - DNA, 22 bp, Homo sapiens
gccagccacttcccagactggc

SEQ ID NO: 9208690 - DNA, 23 bp, Homo sapiens
gccagccagaatttctccactgt

SEQ ID NO: 9208691 - DNA, 22 bp, Homo sapiens
gccagccagaaacgtcacactg

SEQ ID NO: 9208692 - DNA, 22 bp, Homo sapiens
gccagccagaaacgtcacactg

SEQ ID NO: 9208693 - DNA, 22 bp, Homo sapiens
gccagccaagattgagaaggta

SEQ ID NO: 9208694 - DNA, 22 bp, Homo sapiens
gccagccacttcagctatggct

SEQ ID NO: 9208695 - DNA, 22 bp, Homo sapiens
gccagccacttcagctatggct

SEQ ID NO: 9208696 - DNA, 22 bp, Homo sapiens
gccagccacttcagctatggct

SEQ ID NO: 9208697 - DNA, 22 bp, Homo sapiens
gccagccagagaggcatggtta

SEQ ID NO: 9208698 - DNA, 22 bp, Homo sapiens
gccagccagagaggcatggtta

SEQ ID NO: 9208699 - DNA, 20 bp, Homo sapiens
gccagctgcccttccaccct

SEQ ID NO: 9208700 - DNA, 22 bp, Homo sapiens
gccagctgctcgcgtagggtag

SEQ ID NO: 9208701 - DNA, 22 bp, Homo sapiens
gccagctgccctctgctggtcc

SEQ ID NO: 9208702 - DNA, 22 bp, Homo sapiens
gccagctgcatctcctgggctg

SEQ ID NO: 9208703 - DNA, 21 bp, Homo sapiens
gccagctgcagggcttccttg

SEQ ID NO: 9208704 - DNA, 22 bp, Homo sapiens
gccagccagtttgctgatggct

SEQ ID NO: 9208705 - DNA, 22 bp, Homo sapiens
gccagccagtttgctgatggct

SEQ ID NO: 9208706 - DNA, 22 bp, Homo sapiens
gccagccagtttgctgatggct

SEQ ID NO: 9208707 - DNA, 20 bp, Homo sapiens
gcatggcatgtagtgaagtg

SEQ ID NO: 9208708 - DNA, 22 bp, Homo sapiens
gcatggcattaacaagatggaa

SEQ ID NO: 9208709 - DNA, 21 bp, Homo sapiens
gcatggcaggtcactggggca

SEQ ID NO: 9208710 - DNA, 22 bp, Homo sapiens
gcatggcagtgaggatggtgct

SEQ ID NO: 9208711 - DNA, 22 bp, Homo sapiens
gccagaggttcaacaactgtct

SEQ ID NO: 9208712 - DNA, 22 bp, Homo sapiens
gccagccacaagggaggcttgt

SEQ ID NO: 9208713 - DNA, 22 bp, Homo sapiens
gccagccaagattgagaaggta

SEQ ID NO: 9208714 - DNA, 17 bp, Homo sapiens
aagagaggctgagctgg

SEQ ID NO: 9208715 - DNA, 22 bp, Homo sapiens
aagagatgatggcagccagagg

SEQ ID NO: 9208716 - DNA, 22 bp, Homo sapiens
acaaagcacgagtgccatggac

SEQ ID NO: 9208717 - DNA, 22 bp, Homo sapiens
acaaagataagtcagaaagtca

SEQ ID NO: 9208718 - DNA, 22 bp, Homo sapiens
acaaagagaccatgagccaaac

SEQ ID NO: 9208719 - DNA, 22 bp, Homo sapiens
aagacatgactgcacagccaaa

SEQ ID NO: 9208720 - DNA, 22 bp, Homo sapiens
aagacattactggaatctgact

SEQ ID NO: 9208721 - DNA, 22 bp, Homo sapiens
aagaggaaatgattgactatat

SEQ ID NO: 9208722 - DNA, 22 bp, Homo sapiens
aagaggaactgggggctgagtc

SEQ ID NO: 9208723 - DNA, 22 bp, Homo sapiens
aagagctggctcttgcagcagc

SEQ ID NO: 9208724 - DNA, 22 bp, Homo sapiens
aagagctggattgtgctgcaga

SEQ ID NO: 9208725 - DNA, 22 bp, Homo sapiens
acaaggctgaacagtgaagccg

SEQ ID NO: 9208726 - DNA, 22 bp, Homo sapiens
aagaaatggaagatccatggtg

SEQ ID NO: 9208727 - DNA, 22 bp, Homo sapiens
aagaaatgcagaaatgtgctgg

SEQ ID NO: 9208728 - DNA, 22 bp, Homo sapiens
aagaaatgcagaaatgtgctgg

SEQ ID NO: 9208729 - DNA, 22 bp, Homo sapiens
aagaaatgcacacaactgctgg

SEQ ID NO: 9208730 - DNA, 22 bp, Homo sapiens
aatgttttgcattagttttcta

SEQ ID NO: 9208731 - DNA, 22 bp, Homo sapiens
aagaagcactttcctacatgtt

SEQ ID NO: 9208732 - DNA, 22 bp, Homo sapiens
aagaagcactttcctacatgtt

SEQ ID NO: 9208733 - DNA, 22 bp, Homo sapiens
aagaatacgtatcaacaatggt

SEQ ID NO: 9208734 - DNA, 22 bp, Homo sapiens
aagacacagcgaaatgttcctg

SEQ ID NO: 9208735 - DNA, 22 bp, Homo sapiens
aagacagcagcacctctcgttt

SEQ ID NO: 9208736 - DNA, 22 bp, Homo sapiens
aattgtacaagccttgtgccat

SEQ ID NO: 9208737 - DNA, 22 bp, Homo sapiens
aattgtacaggaagttgctgga

SEQ ID NO: 9208738 - DNA, 22 bp, Homo sapiens
aattgtacataaaccatttggc

SEQ ID NO: 9208739 - DNA, 18 bp, Homo sapiens
acagacaaaatggaaatg

SEQ ID NO: 9208740 - DNA, 18 bp, Homo sapiens
acagacaaaatggaaatg

SEQ ID NO: 9208741 - DNA, 22 bp, Homo sapiens
aagcagcatgtgggttatcggg

SEQ ID NO: 9208742 - DNA, 22 bp, Homo sapiens
aagcagcatgattgtaatacta

SEQ ID NO: 9208743 - DNA, 22 bp, Homo sapiens
aagcagcattgtaaccaatgcc

SEQ ID NO: 9208744 - DNA, 22 bp, Homo sapiens
aagcagcattgtaaccaatgcc

SEQ ID NO: 9208745 - DNA, 22 bp, Homo sapiens
aagcagcattcagtgaaatgtg

SEQ ID NO: 9208746 - DNA, 22 bp, Homo sapiens
aagcagcatcctgggcagacct

SEQ ID NO: 9208747 - DNA, 22 bp, Homo sapiens
aagcagcatgattgtaatacta

SEQ ID NO: 9208748 - DNA, 22 bp, Homo sapiens
aagcagcctggcatgatgcttt

SEQ ID NO: 9208749 - DNA, 22 bp, Homo sapiens
aagcagcctggacttgggctgg

SEQ ID NO: 9208750 - DNA, 22 bp, Homo sapiens
aagcagccacctcatctccact

SEQ ID NO: 9208751 - DNA, 22 bp, Homo sapiens
aagcagccagccatcatgcccg

SEQ ID NO: 9208752 - DNA, 22 bp, Homo sapiens
aagcagctgatttcacagctca

SEQ ID NO: 9208753 - DNA, 22 bp, Homo sapiens
aagcagctgaaggattcagggt

SEQ ID NO: 9208754 - DNA, 22 bp, Homo sapiens
aagcagctgatttcacagctca

SEQ ID NO: 9208755 - DNA, 22 bp, Homo sapiens
acagcagctgccttcaggctct

SEQ ID NO: 9208756 - DNA, 22 bp, Homo sapiens
acagcagctaacccctgggcca

SEQ ID NO: 9208757 - DNA, 22 bp, Homo sapiens
acagcagctaacccctgggcca

SEQ ID NO: 9208758 - DNA, 22 bp, Homo sapiens
aagccaagtgctggccatgggc

SEQ ID NO: 9208759 - DNA, 22 bp, Homo sapiens
aagccaagttggaagactgaat

SEQ ID NO: 9208760 - DNA, 22 bp, Homo sapiens
aagccaggagcgaggcctcggc

SEQ ID NO: 9208761 - DNA, 22 bp, Homo sapiens
aagccaggagcgaggcctcggc

SEQ ID NO: 9208762 - DNA, 22 bp, Homo sapiens
aagccaggaccaaactcatcct

SEQ ID NO: 9208763 - DNA, 22 bp, Homo sapiens
acagcagctaaaggtgtctcct

SEQ ID NO: 9208764 - DNA, 22 bp, Homo sapiens
aagcatgtacaatgagtgtctc

SEQ ID NO: 9208765 - DNA, 22 bp, Homo sapiens
aagcatggtttctgacgtcatg

SEQ ID NO: 9208766 - DNA, 22 bp, Homo sapiens
aagatttaccactttattcaag

SEQ ID NO: 9208767 - DNA, 22 bp, Homo sapiens
aagatttaccactttattcaag

SEQ ID NO: 9208768 - DNA, 22 bp, Homo sapiens
aagatgttctattttcactttt

SEQ ID NO: 9208769 - DNA, 22 bp, Homo sapiens
aagatgttgactcctttgatgt

SEQ ID NO: 9208770 - DNA, 22 bp, Homo sapiens
aagaggctagccggctcactaa

SEQ ID NO: 9208771 - DNA, 22 bp, Homo sapiens
aagaggctgaatgagaaagtac

SEQ ID NO: 9208772 - DNA, 22 bp, Homo sapiens
aagaggcgccgggtacgtggcg

SEQ ID NO: 9208773 - DNA, 22 bp, Homo sapiens
aagatgttctattttcactttt

SEQ ID NO: 9208774 - DNA, 22 bp, Homo sapiens
aagaggccacagctgacagcac

SEQ ID NO: 9208775 - DNA, 22 bp, Homo sapiens
acacagtagtgtggaaaaacat

SEQ ID NO: 9208776 - DNA, 22 bp, Homo sapiens
acacagctttgtgttgctccac

SEQ ID NO: 9208777 - DNA, 22 bp, Homo sapiens
aagatttactttctttgtaata

SEQ ID NO: 9208778 - DNA, 22 bp, Homo sapiens
acactgctcacttcttcccttg

SEQ ID NO: 9208779 - DNA, 22 bp, Homo sapiens
aagcacaggatcttgaggagcg

SEQ ID NO: 9208780 - DNA, 22 bp, Homo sapiens
aagcacagggactcaggaccgg

SEQ ID NO: 9208781 - DNA, 22 bp, Homo sapiens
aagcacaggagacgcacagcca

SEQ ID NO: 9208782 - DNA, 22 bp, Homo sapiens
aagcacaggagacgcacagcca

SEQ ID NO: 9208783 - DNA, 22 bp, Homo sapiens
aagcacaggagacgcacagcca

SEQ ID NO: 9208784 - DNA, 22 bp, Homo sapiens
aagcacagggactcaggaccgg

SEQ ID NO: 9208785 - DNA, 22 bp, Homo sapiens
aagcacagggtgtctgcattca

SEQ ID NO: 9208786 - DNA, 22 bp, Homo sapiens
aagcacagtgccaagttctatt

SEQ ID NO: 9208787 - DNA, 22 bp, Homo sapiens
aagcacagtgccaagttctatt

SEQ ID NO: 9208788 - DNA, 22 bp, Homo sapiens
aagcacagtgccaagttctatt

SEQ ID NO: 9208789 - DNA, 22 bp, Homo sapiens
aagcacagtaaaagcagatttt

SEQ ID NO: 9208790 - DNA, 22 bp, Homo sapiens
aagcacagtaaaagcagatttt

SEQ ID NO: 9208791 - DNA, 22 bp, Homo sapiens
aagcacagtgggcagagcagcc

SEQ ID NO: 9208792 - DNA, 22 bp, Homo sapiens
aactacatcaccctatttctgt

SEQ ID NO: 9208793 - DNA, 22 bp, Homo sapiens
aatataatgctgttttatgcca

SEQ ID NO: 9208794 - DNA, 22 bp, Homo sapiens
aacttaaacccactcatgtaga

SEQ ID NO: 9208795 - DNA, 22 bp, Homo sapiens
aacttaaacccactcatgtaga

SEQ ID NO: 9208796 - DNA, 22 bp, Homo sapiens
aacttaaacccactcatgtaga

SEQ ID NO: 9208797 - DNA, 22 bp, Homo sapiens
aatgatatttattgaatagatg

SEQ ID NO: 9208798 - DNA, 22 bp, Homo sapiens
aactgcctggccaggctgcaac

SEQ ID NO: 9208799 - DNA, 22 bp, Homo sapiens
aactgcctgtaaaatcttgggt

SEQ ID NO: 9208800 - DNA, 22 bp, Homo sapiens
aataacttcatcttcaggatag

SEQ ID NO: 9208801 - DNA, 22 bp, Homo sapiens
aataacttgaagatctcttcca

SEQ ID NO: 9208802 - DNA, 22 bp, Homo sapiens
aataacttgtatggttattcca

SEQ ID NO: 9208803 - DNA, 22 bp, Homo sapiens
aataacttttaaaagaccctgg

SEQ ID NO: 9208804 - DNA, 22 bp, Homo sapiens
aataacttcatgtaacatttaa

SEQ ID NO: 9208805 - DNA, 22 bp, Homo sapiens
aacatttttaagaccaagtgct

SEQ ID NO: 9208806 - DNA, 21 bp, Homo sapiens
aaccagagccaggctctcagc

SEQ ID NO: 9208807 - DNA, 22 bp, Homo sapiens
aaccacagagccccctcagatg

SEQ ID NO: 9208808 - DNA, 22 bp, Homo sapiens
aaccaaggacagctagtgatgc

SEQ ID NO: 9208809 - DNA, 22 bp, Homo sapiens
aaccaccattctctcctcttcc

SEQ ID NO: 9208810 - DNA, 22 bp, Homo sapiens
aacatgcccgctgtatgccatt

SEQ ID NO: 9208811 - DNA, 22 bp, Homo sapiens
aacatgaaacccaaacagaata

SEQ ID NO: 9208812 - DNA, 22 bp, Homo sapiens
aacaggcactaagcatgtgggg

SEQ ID NO: 9208813 - DNA, 22 bp, Homo sapiens
aacaggcaatttaggactcttt

SEQ ID NO: 9208814 - DNA, 22 bp, Homo sapiens
aacaggcaaactgtgggatccc

SEQ ID NO: 9208815 - DNA, 22 bp, Homo sapiens
aacaggctggccttgaagcagt

SEQ ID NO: 9208816 - DNA, 22 bp, Homo sapiens
aacaggcttccaggagggacga

SEQ ID NO: 9208817 - DNA, 22 bp, Homo sapiens
aaattctatgtcaatgtttatt

SEQ ID NO: 9208818 - DNA, 22 bp, Homo sapiens
aaattcttcaggtaattttgat

SEQ ID NO: 9208819 - DNA, 22 bp, Homo sapiens
aacaaacctgggtggagaaagg

SEQ ID NO: 9208820 - DNA, 22 bp, Homo sapiens
aacaaaccttccctatacgtct

SEQ ID NO: 9208821 - DNA, 22 bp, Homo sapiens
aacaaagccctgcccaagagct

SEQ ID NO: 9208822 - DNA, 20 bp, Homo sapiens
aacaaactacaaaattatgt

SEQ ID NO: 9208823 - DNA, 22 bp, Homo sapiens
aaatgtgtttgataggaatatt

SEQ ID NO: 9208824 - DNA, 22 bp, Homo sapiens
aaattctaaggtcacaatgttg

SEQ ID NO: 9208825 - DNA, 22 bp, Homo sapiens
aagctgaggcccatggcaaggt

SEQ ID NO: 9208826 - DNA, 22 bp, Homo sapiens
aacagcagggatggggtggcca

SEQ ID NO: 9208827 - DNA, 22 bp, Homo sapiens
aaggtctgagttttgccaggcc

SEQ ID NO: 9208828 - DNA, 22 bp, Homo sapiens
aagtccaagatgcagttgtcag

SEQ ID NO: 9208829 - DNA, 23 bp, Homo sapiens
aagtccacacgtagtgaaacagt

SEQ ID NO: 9208830 - DNA, 22 bp, Homo sapiens
aagtccaccagtcagactagga

SEQ ID NO: 9208831 - DNA, 22 bp, Homo sapiens
aacagcatgctgggtaacattg

SEQ ID NO: 9208832 - DNA, 22 bp, Homo sapiens
aacagcatgctgggtaacattg

SEQ ID NO: 9208833 - DNA, 22 bp, Homo sapiens
aagtccagctctaaatatctga

SEQ ID NO: 9208834 - DNA, 22 bp, Homo sapiens
aaggtattttctaatgtatact

SEQ ID NO: 9208835 - DNA, 22 bp, Homo sapiens
aacaaagtttcaggaagataga

SEQ ID NO: 9208836 - DNA, 22 bp, Homo sapiens
aacactctctgttggtaaggct

SEQ ID NO: 9208837 - DNA, 22 bp, Homo sapiens
aacaccttctccttgcaggcca

SEQ ID NO: 9208838 - DNA, 19 bp, Homo sapiens
aacaccagagtcaggagtc

SEQ ID NO: 9208839 - DNA, 23 bp, Homo sapiens
aaaaaaccatgtaggcactcagt

SEQ ID NO: 9208840 - DNA, 22 bp, Homo sapiens
aaaaaatcagatctttggttaa

SEQ ID NO: 9208841 - DNA, 22 bp, Homo sapiens
aaaaaattatcatagttcctga

SEQ ID NO: 9208842 - DNA, 20 bp, Homo sapiens
aaaaacagtaatgctgaaga

SEQ ID NO: 9208843 - DNA, 20 bp, Homo sapiens
aaaaacagtaatgctgaaga

SEQ ID NO: 9208844 - DNA, 22 bp, Homo sapiens
aaaaacagaatgtgtctaactc

SEQ ID NO: 9208845 - DNA, 22 bp, Homo sapiens
aaaaacacaactgtctttctct

SEQ ID NO: 9208846 - DNA, 20 bp, Homo sapiens
aaaaacagtaatgctgaaga

SEQ ID NO: 9208847 - DNA, 22 bp, Homo sapiens
aaaatgaagcaaaggcattcag

SEQ ID NO: 9208848 - DNA, 22 bp, Homo sapiens
aaaatcttgactgtttttagaa

SEQ ID NO: 9208849 - DNA, 22 bp, Homo sapiens
aaaatcttgactgtttttagaa

SEQ ID NO: 9208850 - DNA, 22 bp, Homo sapiens
aaaagacatctatttcaggcag

SEQ ID NO: 9208851 - DNA, 22 bp, Homo sapiens
aaacagaaatttcctcatgctc

SEQ ID NO: 9208852 - DNA, 22 bp, Homo sapiens
aaacacttcctgtaacatgaca

SEQ ID NO: 9208853 - DNA, 22 bp, Homo sapiens
aaacacttcctgtaacatgaca

SEQ ID NO: 9208854 - DNA, 22 bp, Homo sapiens
aaacacttcctgtaacatgaca

SEQ ID NO: 9208855 - DNA, 22 bp, Homo sapiens
aaacacaggtactgcagaagtg

SEQ ID NO: 9208856 - DNA, 22 bp, Homo sapiens
aaaaatagaaggattgactgag

SEQ ID NO: 9208857 - DNA, 22 bp, Homo sapiens
aaaaatagcttctcttgtccct

SEQ ID NO: 9208858 - DNA, 22 bp, Homo sapiens
aaaatgaataagttaacccagg

SEQ ID NO: 9208859 - DNA, 22 bp, Homo sapiens
aaacaagtttagaataatgaat

SEQ ID NO: 9208860 - DNA, 22 bp, Homo sapiens
aaacaagtgtaaactagtctgt

SEQ ID NO: 9208861 - DNA, 22 bp, Homo sapiens
aaacaatgaaattcattcttca

SEQ ID NO: 9208862 - DNA, 22 bp, Homo sapiens
aaacaatgaaatatttttatgg

SEQ ID NO: 9208863 - DNA, 22 bp, Homo sapiens
aaaattttgccctatccttcat

SEQ ID NO: 9208864 - DNA, 22 bp, Homo sapiens
aaacaagagtcttgctccacct

SEQ ID NO: 9208865 - DNA, 22 bp, Homo sapiens
aaagacattagcttagatgtca

SEQ ID NO: 9208866 - DNA, 22 bp, Homo sapiens
aaactcagatgtggtgaagacc

SEQ ID NO: 9208867 - DNA, 22 bp, Homo sapiens
aaacccagagactagaaagacc

SEQ ID NO: 9208868 - DNA, 22 bp, Homo sapiens
aaagacatggaactagagatgg

SEQ ID NO: 9208869 - DNA, 22 bp, Homo sapiens
aaactctaagacactgtacaat

SEQ ID NO: 9208870 - DNA, 22 bp, Homo sapiens
aaaagtactattttaacaaagt

SEQ ID NO: 9208871 - DNA, 22 bp, Homo sapiens
aaaagtactattttaacaaagt

SEQ ID NO: 9208872 - DNA, 22 bp, Homo sapiens
aaagaggcaatcaatgtagcaa

SEQ ID NO: 9208873 - DNA, 22 bp, Homo sapiens
aaagaggctcaaggtgggccag

SEQ ID NO: 9208874 - DNA, 22 bp, Homo sapiens
aaagagtttacaaattaggtaa

SEQ ID NO: 9208875 - DNA, 22 bp, Homo sapiens
aaagagttgaggcagttatcca

SEQ ID NO: 9208876 - DNA, 22 bp, Homo sapiens
aaagaggggactgttaattcca

SEQ ID NO: 9208877 - DNA, 23 bp, Homo sapiens
aaactgaggcttgatgaggcggt

SEQ ID NO: 9208878 - DNA, 22 bp, Homo sapiens
aaactgagtacctctgcattca

SEQ ID NO: 9208879 - DNA, 21 bp, Homo sapiens
aaactgaggcttcaagcagtg

SEQ ID NO: 9208880 - DNA, 22 bp, Homo sapiens
aaactgaggtgaggccatcgct

SEQ ID NO: 9208881 - DNA, 22 bp, Homo sapiens
aaactgagtggcttataaacaa

SEQ ID NO: 9208882 - DNA, 16 bp, Homo sapiens
aaactgagttcagttc

SEQ ID NO: 9208883 - DNA, 22 bp, Homo sapiens
aaactgagttttctgaacccca

SEQ ID NO: 9208884 - DNA, 22 bp, Homo sapiens
aaagaatgcagtgccttccagc

SEQ ID NO: 9208885 - DNA, 22 bp, Homo sapiens
aaagaatctatatatcaccacc

SEQ ID NO: 9208886 - DNA, 22 bp, Homo sapiens
aaagaatgtctgaacagctggc

SEQ ID NO: 9208887 - DNA, 22 bp, Homo sapiens
aaagaatgtctgaacagctggc

SEQ ID NO: 9208888 - DNA, 22 bp, Homo sapiens
aaactgagaccgaaaggggtag

SEQ ID NO: 9208889 - DNA, 22 bp, Homo sapiens
aaactgagattgctgctgtctg

SEQ ID NO: 9208890 - DNA, 22 bp, Homo sapiens
aaactgagaccgaaaggggtag

SEQ ID NO: 9208891 - DNA, 22 bp, Homo sapiens
aaactgaggaacaaggaaggat

SEQ ID NO: 9208892 - DNA, 22 bp, Homo sapiens
aaactgaggaatgacagcatta

SEQ ID NO: 9208893 - DNA, 22 bp, Homo sapiens
aaactgaggaacaaggaaggat

SEQ ID NO: 9208894 - DNA, 21 bp, Homo sapiens
aaactgaggagatgaggacta

SEQ ID NO: 9208895 - DNA, 22 bp, Homo sapiens
aaactgaggcccagagaggcag

SEQ ID NO: 9208896 - DNA, 22 bp, Homo sapiens
aaactgaggcaggggatgatta

SEQ ID NO: 9208897 - DNA, 22 bp, Homo sapiens
aaactgaggagttagactaggg

SEQ ID NO: 9208898 - DNA, 22 bp, Homo sapiens
aaactgaggagttagactaggg

SEQ ID NO: 9208899 - DNA, 22 bp, Homo sapiens
aaactgaggctcccgagggtgt

SEQ ID NO: 9208900 - DNA, 21 bp, Homo sapiens
aaactgaggcttcaagcagtg

SEQ ID NO: 9208901 - DNA, 22 bp, Homo sapiens
aaactgaggctcccgagggtgt

SEQ ID NO: 9208902 - DNA, 21 bp, Homo sapiens
aaactgaccttgcctgagaca

SEQ ID NO: 9208903 - DNA, 22 bp, Homo sapiens
aaacaatgacaacacagctgcg

SEQ ID NO: 9208904 - DNA, 17 bp, Homo sapiens
aaacaatgcagacaagc

SEQ ID NO: 9208905 - DNA, 22 bp, Homo sapiens
aaaggtcttctcaaacatccca

SEQ ID NO: 9208906 - DNA, 22 bp, Homo sapiens
aaaccctgcccttcccaagatg

SEQ ID NO: 9208907 - DNA, 22 bp, Homo sapiens
aaaccctgctcttatggaactt

SEQ ID NO: 9208908 - DNA, 22 bp, Homo sapiens
aaacctatatagtcttagaagc

SEQ ID NO: 9208909 - DNA, 22 bp, Homo sapiens
aaaccctgcccttcccaagatg

SEQ ID NO: 9208910 - DNA, 22 bp, Homo sapiens
aaaccttcacatctactctaca

SEQ ID NO: 9208911 - DNA, 22 bp, Homo sapiens
aaacctttaccagactagcaag

SEQ ID NO: 9208912 - DNA, 22 bp, Homo sapiens
aaacctttgcctggaagggagt

SEQ ID NO: 9208913 - DNA, 22 bp, Homo sapiens
aaactagatgattatgaagcat

SEQ ID NO: 9208914 - DNA, 22 bp, Homo sapiens
aaactagatgaaacgagtaaag

SEQ ID NO: 9208915 - DNA, 21 bp, Homo sapiens
aaagttcatgctttaatattc

SEQ ID NO: 9208916 - DNA, 18 bp, Homo sapiens
aaatgtactgtccatggc

SEQ ID NO: 9208917 - DNA, 22 bp, Homo sapiens
aaatgtattgcataggatattt

SEQ ID NO: 9208918 - DNA, 22 bp, Homo sapiens
aagcatgcagactacccctagg

SEQ ID NO: 9208919 - DNA, 22 bp, Homo sapiens
aagcatgcttttggaggaccat

SEQ ID NO: 9208920 - DNA, 22 bp, Homo sapiens
aagcatcttctatcagttagac

SEQ ID NO: 9208921 - DNA, 22 bp, Homo sapiens
aagcatgcaatctgtgataagg

SEQ ID NO: 9208922 - DNA, 22 bp, Homo sapiens
aagcatgcactccaaacagctt

SEQ ID NO: 9208923 - DNA, 22 bp, Homo sapiens
aaatgcaggtagtatttatttt

SEQ ID NO: 9208924 - DNA, 22 bp, Homo sapiens
aagcacagcagagccttgcttg

SEQ ID NO: 9208925 - DNA, 22 bp, Homo sapiens
aaatcctaataatgcactagtg

SEQ ID NO: 9208926 - DNA, 22 bp, Homo sapiens
aagcacagagatgggcacgcct

SEQ ID NO: 9208927 - DNA, 22 bp, Homo sapiens
aagcacagactccctctgagtg

SEQ ID NO: 9208928 - DNA, 22 bp, Homo sapiens
aagcacagactccctctgagtg

SEQ ID NO: 9208929 - DNA, 22 bp, Homo sapiens
aagcacagaccagatctccagg

SEQ ID NO: 9208930 - DNA, 23 bp, Homo sapiens
aagcacagaatggtttaggagtt

SEQ ID NO: 9208931 - DNA, 23 bp, Homo sapiens
aagcacagaatggtttaggagtt

SEQ ID NO: 9208932 - DNA, 22 bp, Homo sapiens
aagcacagaaaaggagcatgga

SEQ ID NO: 9208933 - DNA, 22 bp, Homo sapiens
aaataactttctgtgtatagtc

SEQ ID NO: 9208934 - DNA, 22 bp, Homo sapiens
aaataacttggtttcatcagag

SEQ ID NO: 9208935 - DNA, 22 bp, Homo sapiens
aaataactttctgtgtatagtc

SEQ ID NO: 9208936 - DNA, 22 bp, Homo sapiens
aaataacttggtttcatcagag

SEQ ID NO: 9208937 - DNA, 22 bp, Homo sapiens
aaataagttagcagattccagt

SEQ ID NO: 9208938 - DNA, 22 bp, Homo sapiens
aaataagttaaactagaatgat

SEQ ID NO: 9208939 - DNA, 22 bp, Homo sapiens
aaatagatttcctagcattgga

SEQ ID NO: 9208940 - DNA, 22 bp, Homo sapiens
aaatagcaatgtgaaaagagga

SEQ ID NO: 9208941 - DNA, 22 bp, Homo sapiens
aaatagcacagcagctgaggct

SEQ ID NO: 9208942 - DNA, 22 bp, Homo sapiens
aaatagcagaagcagagggggt

SEQ ID NO: 9208943 - DNA, 22 bp, Homo sapiens
aaatagatttcctagcattgga

SEQ ID NO: 9208944 - DNA, 22 bp, Homo sapiens
aaatagattgctgaggcattac

SEQ ID NO: 9208945 - DNA, 22 bp, Homo sapiens
aaatagattgctgaggcattac

SEQ ID NO: 9208946 - DNA, 22 bp, Homo sapiens
aaatccattctgttttaaaagt

SEQ ID NO: 9208947 - DNA, 22 bp, Homo sapiens
aaatagcataaaataggaagct

SEQ ID NO: 9208948 - DNA, 22 bp, Homo sapiens
aacaaacaaacattttgtcatc

SEQ ID NO: 9208949 - DNA, 22 bp, Homo sapiens
aaattttgtattctagttctag

SEQ ID NO: 9208950 - DNA, 22 bp, Homo sapiens
aaattttagactcctgggtcta

SEQ ID NO: 9208951 - DNA, 22 bp, Homo sapiens
aaagatatgtctccaaagagat

SEQ ID NO: 9208952 - DNA, 22 bp, Homo sapiens
aaagccagtttgtctctttaaa

SEQ ID NO: 9208953 - DNA, 22 bp, Homo sapiens
aaagctgctgccaatcaggctt

SEQ ID NO: 9208954 - DNA, 22 bp, Homo sapiens
aaagctgattgcaggaagagag

SEQ ID NO: 9208955 - DNA, 22 bp, Homo sapiens
aaagctttctagctatgttcta

SEQ ID NO: 9208956 - DNA, 22 bp, Homo sapiens
aacagatttgtgaagctactca

SEQ ID NO: 9208957 - DNA, 22 bp, Homo sapiens
aacagattgtaacctgatagcc

SEQ ID NO: 9208958 - DNA, 22 bp, Homo sapiens
aacagatataggcagaactttg

SEQ ID NO: 9208959 - DNA, 22 bp, Homo sapiens
aaagggcctccgcctgggcagg

SEQ ID NO: 9208960 - DNA, 22 bp, Homo sapiens
aaagcttttcagtatgttcatg

SEQ ID NO: 9208961 - DNA, 22 bp, Homo sapiens
aaagctttgtaaataaacaggt

SEQ ID NO: 9208962 - DNA, 22 bp, Homo sapiens
aactaacagtcattaaaagaac

SEQ ID NO: 9208963 - DNA, 22 bp, Homo sapiens
aactaaatctggcatttagagc

SEQ ID NO: 9208964 - DNA, 22 bp, Homo sapiens
aactaacagtcattaaaagaac

SEQ ID NO: 9208965 - DNA, 22 bp, Homo sapiens
aaagtatatatgcactttagaa

SEQ ID NO: 9208966 - DNA, 22 bp, Homo sapiens
aaagtatatatgcactttagaa

SEQ ID NO: 9208967 - DNA, 22 bp, Homo sapiens
aaagtatatttacttactgtga

SEQ ID NO: 9208968 - DNA, 22 bp, Homo sapiens
aaagtagcttagttgatatttc

SEQ ID NO: 9208969 - DNA, 22 bp, Homo sapiens
aaagtatatatgcactttagaa

SEQ ID NO: 9208970 - DNA, 22 bp, Homo sapiens
aaagtagcccttctggaattta

SEQ ID NO: 9208971 - DNA, 22 bp, Homo sapiens
aaagtagagttgtggaattact

SEQ ID NO: 9208972 - DNA, 22 bp, Homo sapiens
aaagtcaaggtttagactagag

SEQ ID NO: 9208973 - DNA, 22 bp, Homo sapiens
aaagtgtaaaagcatgttaggg

SEQ ID NO: 9208974 - DNA, 22 bp, Homo sapiens
aaagtgcagggtgctctggtat

SEQ ID NO: 9208975 - DNA, 20 bp, Homo sapiens
actccaggtggcatgaggac

SEQ ID NO: 9208976 - DNA, 22 bp, Homo sapiens
actccaggttttttcactgaag

SEQ ID NO: 9208977 - DNA, 22 bp, Homo sapiens
actcccactccagagtagaagc

SEQ ID NO: 9208978 - DNA, 18 bp, Homo sapiens
actccccacaggctctgt

SEQ ID NO: 9208979 - DNA, 22 bp, Homo sapiens
actacaaaagcactgggtatta

SEQ ID NO: 9208980 - DNA, 22 bp, Homo sapiens
actacaaaagcactgggtatta

SEQ ID NO: 9208981 - DNA, 20 bp, Homo sapiens
aagtgttttgacttctgacc

SEQ ID NO: 9208982 - DNA, 22 bp, Homo sapiens
aagttatatcatctcattgacg

SEQ ID NO: 9208983 - DNA, 22 bp, Homo sapiens
aagttagagattccatcatgct

SEQ ID NO: 9208984 - DNA, 22 bp, Homo sapiens
aagttactggcaagggctgcag

SEQ ID NO: 9208985 - DNA, 22 bp, Homo sapiens
aagtcacttgattgttgacaga

SEQ ID NO: 9208986 - DNA, 22 bp, Homo sapiens
aagtcacagctaaatagctaag

SEQ ID NO: 9208987 - DNA, 22 bp, Homo sapiens
aagtcacagagttggaagtcag

SEQ ID NO: 9208988 - DNA, 22 bp, Homo sapiens
aagtcagaaaacagagcaatta

SEQ ID NO: 9208989 - DNA, 22 bp, Homo sapiens
aagtcagaaaacagagcaatta

SEQ ID NO: 9208990 - DNA, 22 bp, Homo sapiens
aagtcagaaatatctgccatca

SEQ ID NO: 9208991 - DNA, 22 bp, Homo sapiens
aagtcagacagctgagctgcct

SEQ ID NO: 9208992 - DNA, 22 bp, Homo sapiens
aagtcagaccttgttgatagct

SEQ ID NO: 9208993 - DNA, 22 bp, Homo sapiens
aagtcagaataatgtttctttt

SEQ ID NO: 9208994 - DNA, 22 bp, Homo sapiens
aagtcagaaatcatctagtgta

SEQ ID NO: 9208995 - DNA, 22 bp, Homo sapiens
aagtcagaaattattcaggaat

SEQ ID NO: 9208996 - DNA, 22 bp, Homo sapiens
aagtcagataggtgagtccaaa

SEQ ID NO: 9208997 - DNA, 23 bp, Homo sapiens
aagtcagagccaagtcaatgaga

SEQ ID NO: 9208998 - DNA, 22 bp, Homo sapiens
aagtcagagcaactgagacatt

SEQ ID NO: 9208999 - DNA, 23 bp, Homo sapiens
aagtcagagccaagtcaatgaga

SEQ ID NO: 9209000 - DNA, 22 bp, Homo sapiens
aagtcagagcaactgagacatt

SEQ ID NO: 9209001 - DNA, 22 bp, Homo sapiens
aagtcagagatgccaaagatta

SEQ ID NO: 9209002 - DNA, 22 bp, Homo sapiens
aagtcagagatcaaggtgtcta

SEQ ID NO: 9209003 - DNA, 22 bp, Homo sapiens
aagtgcttggctaatggttatg

SEQ ID NO: 9209004 - DNA, 22 bp, Homo sapiens
aagtcaggctggggtctggcag

SEQ ID NO: 9209005 - DNA, 22 bp, Homo sapiens
actaaatttgtcaatgacactt

SEQ ID NO: 9209006 - DNA, 22 bp, Homo sapiens
actaacatgttaatcaaaagaa

SEQ ID NO: 9209007 - DNA, 22 bp, Homo sapiens
aataattagtgggacagagaac

SEQ ID NO: 9209008 - DNA, 22 bp, Homo sapiens
aataattagtgggacagagaac

SEQ ID NO: 9209009 - DNA, 22 bp, Homo sapiens
aataatgttatgtcattcttct

SEQ ID NO: 9209010 - DNA, 22 bp, Homo sapiens
aataattatttgagagcagacc

SEQ ID NO: 9209011 - DNA, 22 bp, Homo sapiens
aataatagttgcaaagtgttta

SEQ ID NO: 9209012 - DNA, 22 bp, Homo sapiens
actgccttctgctcagggttca

SEQ ID NO: 9209013 - DNA, 22 bp, Homo sapiens
actgccttccacctatggatga

SEQ ID NO: 9209014 - DNA, 22 bp, Homo sapiens
aataagattgacacaagtacct

SEQ ID NO: 9209015 - DNA, 23 bp, Homo sapiens
actgcctgtgccgatctctctca

SEQ ID NO: 9209016 - DNA, 22 bp, Homo sapiens
aagtttcaaatataaaattaca

SEQ ID NO: 9209017 - DNA, 22 bp, Homo sapiens
aataacttcagttcttacatta

SEQ ID NO: 9209018 - DNA, 22 bp, Homo sapiens
aataacttaagaaatttcccca

SEQ ID NO: 9209019 - DNA, 22 bp, Homo sapiens
aagtttctcaatggcaactggg

SEQ ID NO: 9209020 - DNA, 22 bp, Homo sapiens
aagtttaacttgaattctttct

SEQ ID NO: 9209021 - DNA, 22 bp, Homo sapiens
agaagggaactcagagatgatt

SEQ ID NO: 9209022 - DNA, 21 bp, Homo sapiens
agaagggattgtggtaaagat

SEQ ID NO: 9209023 - DNA, 22 bp, Homo sapiens
aatgagttatttaatagaaagg

SEQ ID NO: 9209024 - DNA, 20 bp, Homo sapiens
aatgagatgacttagaggaa

SEQ ID NO: 9209025 - DNA, 22 bp, Homo sapiens
agaaatactgtgagagcagcct

SEQ ID NO: 9209026 - DNA, 22 bp, Homo sapiens
aatgacctcagagcacccagaa

SEQ ID NO: 9209027 - DNA, 22 bp, Homo sapiens
aatgacatggagcatcttttca

SEQ ID NO: 9209028 - DNA, 20 bp, Homo sapiens
agaaataccacatttggcaa

SEQ ID NO: 9209029 - DNA, 22 bp, Homo sapiens
agaaatactaggaatattcata

SEQ ID NO: 9209030 - DNA, 22 bp, Homo sapiens
aatgaacacagccctctacttt

SEQ ID NO: 9209031 - DNA, 22 bp, Homo sapiens
agaaaactgcagagtagcctca

SEQ ID NO: 9209032 - DNA, 22 bp, Homo sapiens
agaaaacagaaagtcattggtg

SEQ ID NO: 9209033 - DNA, 22 bp, Homo sapiens
aatcccagctactcaggaagtt

SEQ ID NO: 9209034 - DNA, 22 bp, Homo sapiens
aatcctagaaatttatttgaag

SEQ ID NO: 9209035 - DNA, 22 bp, Homo sapiens
aatcctgacctgggcatgcttg

SEQ ID NO: 9209036 - DNA, 22 bp, Homo sapiens
aatccagggtgtggcctttcca

SEQ ID NO: 9209037 - DNA, 22 bp, Homo sapiens
aatcataattgtatacattcat

SEQ ID NO: 9209038 - DNA, 22 bp, Homo sapiens
acttgtaaacaaatctaatgta

SEQ ID NO: 9209039 - DNA, 22 bp, Homo sapiens
aatattttaggctttccaggct

SEQ ID NO: 9209040 - DNA, 22 bp, Homo sapiens
aatatttttgaggccctgttat

SEQ ID NO: 9209041 - DNA, 22 bp, Homo sapiens
aatacagagaatgttatttgga

SEQ ID NO: 9209042 - DNA, 22 bp, Homo sapiens
acttcctgctatgagcttctgt

SEQ ID NO: 9209043 - DNA, 22 bp, Homo sapiens
acttcctggattcccaagggct

SEQ ID NO: 9209044 - DNA, 21 bp, Homo sapiens
aatacagaaatgagtagttgc

SEQ ID NO: 9209045 - DNA, 21 bp, Homo sapiens
acttgaagttggagtttctgt

SEQ ID NO: 9209046 - DNA, 19 bp, Homo sapiens
aatattttagcctcttcct

SEQ ID NO: 9209047 - DNA, 22 bp, Homo sapiens
acttgacattaatttaggttgt

SEQ ID NO: 9209048 - DNA, 22 bp, Homo sapiens
acttgacacctaattagtcatc

SEQ ID NO: 9209049 - DNA, 22 bp, Homo sapiens
aatatatagaagtacccgttgt

SEQ ID NO: 9209050 - DNA, 22 bp, Homo sapiens
aaggctgggaaacatgcaggcc

SEQ ID NO: 9209051 - DNA, 22 bp, Homo sapiens
aaggctggtttccttgatgttt

SEQ ID NO: 9209052 - DNA, 22 bp, Homo sapiens
acatgtgtggacatgaatctac

SEQ ID NO: 9209053 - DNA, 22 bp, Homo sapiens
acatgtgtctaagaatgaaaga

SEQ ID NO: 9209054 - DNA, 22 bp, Homo sapiens
aaggcttggtctagtcatgcca

SEQ ID NO: 9209055 - DNA, 22 bp, Homo sapiens
aaggcttgtagatttgggcttt

SEQ ID NO: 9209056 - DNA, 16 bp, Homo sapiens
aaggctgattttccct

SEQ ID NO: 9209057 - DNA, 22 bp, Homo sapiens
aaggctgattagactgatagct

SEQ ID NO: 9209058 - DNA, 22 bp, Homo sapiens
aaggctgagtaaaacagagaac

SEQ ID NO: 9209059 - DNA, 22 bp, Homo sapiens
aaggctgaggtagggcctaaaa

SEQ ID NO: 9209060 - DNA, 22 bp, Homo sapiens
aaggctgagggctgtacctggc

SEQ ID NO: 9209061 - DNA, 22 bp, Homo sapiens
aaggctgaggcagtgaggcaga

SEQ ID NO: 9209062 - DNA, 22 bp, Homo sapiens
aaggctgaggctggagaattac

SEQ ID NO: 9209063 - DNA, 22 bp, Homo sapiens
aaggctgaggagggcctgcagg

SEQ ID NO: 9209064 - DNA, 22 bp, Homo sapiens
aaggctcttggagtgaatgcag

SEQ ID NO: 9209065 - DNA, 22 bp, Homo sapiens
aagggacatagactgtacatct

SEQ ID NO: 9209066 - DNA, 22 bp, Homo sapiens
aagggcccggctgtgggcagag

SEQ ID NO: 9209067 - DNA, 22 bp, Homo sapiens
aagggccataacttgcagtgtt

SEQ ID NO: 9209068 - DNA, 22 bp, Homo sapiens
accatgtcatttattggccaaa

SEQ ID NO: 9209069 - DNA, 23 bp, Homo sapiens
aagtaacagggataatagcagtt

SEQ ID NO: 9209070 - DNA, 22 bp, Homo sapiens
accatgggcagaatctttgcag

SEQ ID NO: 9209071 - DNA, 22 bp, Homo sapiens
accatccaaactgctttctgtg

SEQ ID NO: 9209072 - DNA, 22 bp, Homo sapiens
aaggtgggtggatcacgaggtc

SEQ ID NO: 9209073 - DNA, 22 bp, Homo sapiens
aaggtggtaatagtgcaggatt

SEQ ID NO: 9209074 - DNA, 18 bp, Homo sapiens
aaggtctgtctggtaggt

SEQ ID NO: 9209075 - DNA, 22 bp, Homo sapiens
aaggtctgtggccacctctggg

SEQ ID NO: 9209076 - DNA, 22 bp, Homo sapiens
aaggtaggctcagggttgttct

SEQ ID NO: 9209077 - DNA, 22 bp, Homo sapiens
aaggtaggttaacctgcaggag

SEQ ID NO: 9209078 - DNA, 22 bp, Homo sapiens
aagggctgaatgaagggttgaa

SEQ ID NO: 9209079 - DNA, 22 bp, Homo sapiens
accccaggaagtggaggtcatg

SEQ ID NO: 9209080 - DNA, 22 bp, Homo sapiens
accccaggaagtggaggtcatg

SEQ ID NO: 9209081 - DNA, 22 bp, Homo sapiens
accccaggagctgtgcctagtc

SEQ ID NO: 9209082 - DNA, 22 bp, Homo sapiens
accccaggagctgtgcctagtc

SEQ ID NO: 9209083 - DNA, 22 bp, Homo sapiens
accccaggagctgtgcctagtc

SEQ ID NO: 9209084 - DNA, 22 bp, Homo sapiens
aagtcacaagcatatatgcatt

SEQ ID NO: 9209085 - DNA, 23 bp, Homo sapiens
accccaggcatcgcattcctctt

SEQ ID NO: 9209086 - DNA, 23 bp, Homo sapiens
accccaggcatcgcattcctctt

SEQ ID NO: 9209087 - DNA, 22 bp, Homo sapiens
accccaggcccagggaagaggc

SEQ ID NO: 9209088 - DNA, 22 bp, Homo sapiens
accccaggcccagggaagaggc

SEQ ID NO: 9209089 - DNA, 22 bp, Homo sapiens
accccaggcccagggaagaggc

SEQ ID NO: 9209090 - DNA, 22 bp, Homo sapiens
accccagggctgccagcctcct

SEQ ID NO: 9209091 - DNA, 22 bp, Homo sapiens
accccagggctgccagcctcct

SEQ ID NO: 9209092 - DNA, 22 bp, Homo sapiens
accccagggctgccagcctcct

SEQ ID NO: 9209093 - DNA, 22 bp, Homo sapiens
accccaggtccaggttacagag

SEQ ID NO: 9209094 - DNA, 22 bp, Homo sapiens
accccaggtccaggttacagag

SEQ ID NO: 9209095 - DNA, 22 bp, Homo sapiens
accccaggtccaggttacagag

SEQ ID NO: 9209096 - DNA, 22 bp, Homo sapiens
accccaggtccaggttacagag

SEQ ID NO: 9209097 - DNA, 22 bp, Homo sapiens
accccaggtcatctgagagtcc

SEQ ID NO: 9209098 - DNA, 22 bp, Homo sapiens
accccaggtcatctgagagtcc

SEQ ID NO: 9209099 - DNA, 22 bp, Homo sapiens
accccaggtctccaggctctgg

SEQ ID NO: 9209100 - DNA, 22 bp, Homo sapiens
accccaggtctccaggctctgg

SEQ ID NO: 9209101 - DNA, 22 bp, Homo sapiens
aaggcaggatgggaaaagattt

SEQ ID NO: 9209102 - DNA, 22 bp, Homo sapiens
aaggcagcttcaccacagcatt

SEQ ID NO: 9209103 - DNA, 22 bp, Homo sapiens
aaggcagtaggatcttccacag

SEQ ID NO: 9209104 - DNA, 22 bp, Homo sapiens
aaggcaggtattgatgccacag

SEQ ID NO: 9209105 - DNA, 22 bp, Homo sapiens
aaggcagtactttatgtccata

SEQ ID NO: 9209106 - DNA, 22 bp, Homo sapiens
aaggcagtcaaagcagacttct

SEQ ID NO: 9209107 - DNA, 22 bp, Homo sapiens
acagttcttaaaacttgaatta

SEQ ID NO: 9209108 - DNA, 22 bp, Homo sapiens
aaggcagccgtgtgactgcatg

SEQ ID NO: 9209109 - DNA, 22 bp, Homo sapiens
aaggcagaaagggatgtgagtg

SEQ ID NO: 9209110 - DNA, 22 bp, Homo sapiens
aaggcagaaagggatgtgagtg

SEQ ID NO: 9209111 - DNA, 22 bp, Homo sapiens
aaggaactctagagccttgaac

SEQ ID NO: 9209112 - DNA, 22 bp, Homo sapiens
aaggaaagattctctctctaga

SEQ ID NO: 9209113 - DNA, 22 bp, Homo sapiens
aaggaaagattctctctctaga

SEQ ID NO: 9209114 - DNA, 22 bp, Homo sapiens
aaggaaaggatgagcatgcatt

SEQ ID NO: 9209115 - DNA, 22 bp, Homo sapiens
aaggaaaggatgagcatgcatt

SEQ ID NO: 9209116 - DNA, 22 bp, Homo sapiens
aaggaaagacatataaatgact

SEQ ID NO: 9209117 - DNA, 22 bp, Homo sapiens
acaggcagttgaggtttgtgtg

SEQ ID NO: 9209118 - DNA, 23 bp, Homo sapiens
acagggctggcagctgcaagacc

SEQ ID NO: 9209119 - DNA, 22 bp, Homo sapiens
acagggctctgacaccaaggta

SEQ ID NO: 9209120 - DNA, 22 bp, Homo sapiens
acaggtgtggggctgtggtact

SEQ ID NO: 9209121 - DNA, 22 bp, Homo sapiens
aagctgcagaccccctgtctca

SEQ ID NO: 9209122 - DNA, 22 bp, Homo sapiens
aagccagggtcaggggcctcct

SEQ ID NO: 9209123 - DNA, 22 bp, Homo sapiens
aagccagggtcaggggcctcct

SEQ ID NO: 9209124 - DNA, 22 bp, Homo sapiens
aagccaggctgcacttgctggg

SEQ ID NO: 9209125 - DNA, 22 bp, Homo sapiens
acagagcataatgtctagcaca

SEQ ID NO: 9209126 - DNA, 22 bp, Homo sapiens
acagagcagttctggagctggc

SEQ ID NO: 9209127 - DNA, 22 bp, Homo sapiens
agcccctctgtagctaatagta

SEQ ID NO: 9209128 - DNA, 22 bp, Homo sapiens
agcccctctgtagctaatagta

SEQ ID NO: 9209129 - DNA, 22 bp, Homo sapiens
agcccctctccgccctgagtcg

SEQ ID NO: 9209130 - DNA, 22 bp, Homo sapiens
agcccctccagtggcataaaat

SEQ ID NO: 9209131 - DNA, 22 bp, Homo sapiens
agcccctctccgccctgagtcg

SEQ ID NO: 9209132 - DNA, 17 bp, Homo sapiens
agcccctcagcgtcacc

SEQ ID NO: 9209133 - DNA, 17 bp, Homo sapiens
agcccctcagcgtcacc

SEQ ID NO: 9209134 - DNA, 23 bp, Homo sapiens
agcccctcatatctgctttctct

SEQ ID NO: 9209135 - DNA, 23 bp, Homo sapiens
agcccctcatggtgtctagacag

SEQ ID NO: 9209136 - DNA, 23 bp, Homo sapiens
agcccctcatggtgtctagacag

SEQ ID NO: 9209137 - DNA, 22 bp, Homo sapiens
agcccccaggagtctccacgcc

SEQ ID NO: 9209138 - DNA, 22 bp, Homo sapiens
agcccccagtctaaactgttgg

SEQ ID NO: 9209139 - DNA, 22 bp, Homo sapiens
agcccccaggatgcaaaatgac

SEQ ID NO: 9209140 - DNA, 22 bp, Homo sapiens
acagagcatttgggacagagag

SEQ ID NO: 9209141 - DNA, 22 bp, Homo sapiens
acagagttcccactccagaagc

SEQ ID NO: 9209142 - DNA, 22 bp, Homo sapiens
agcccctctgtggctctgcctc

SEQ ID NO: 9209143 - DNA, 22 bp, Homo sapiens
agcccctctgtggctctgcctc

SEQ ID NO: 9209144 - DNA, 22 bp, Homo sapiens
acagaggtggacctcagcaggc

SEQ ID NO: 9209145 - DNA, 22 bp, Homo sapiens
agcccagcttccttctgtctct

SEQ ID NO: 9209146 - DNA, 22 bp, Homo sapiens
acagagcactgccctgtgccgc

SEQ ID NO: 9209147 - DNA, 18 bp, Homo sapiens
agcccagcggagtgaatc

SEQ ID NO: 9209148 - DNA, 22 bp, Homo sapiens
agcccagctgcctgcctgctgt

SEQ ID NO: 9209149 - DNA, 22 bp, Homo sapiens
agccatgggctcccagtccttt

SEQ ID NO: 9209150 - DNA, 22 bp, Homo sapiens
agccatgggctcccagtccttt

SEQ ID NO: 9209151 - DNA, 22 bp, Homo sapiens
agccatgggctcccagtccttt

SEQ ID NO: 9209152 - DNA, 22 bp, Homo sapiens
agccacagtcaacctgtccata

SEQ ID NO: 9209153 - DNA, 22 bp, Homo sapiens
agccacagtcaacctgtccata

SEQ ID NO: 9209154 - DNA, 22 bp, Homo sapiens
agccacagtctgatgcctgaga

SEQ ID NO: 9209155 - DNA, 22 bp, Homo sapiens
agccacagtctgatgcctgaga

SEQ ID NO: 9209156 - DNA, 21 bp, Homo sapiens
agccatcctgaatggtgccat

SEQ ID NO: 9209157 - DNA, 22 bp, Homo sapiens
agccatcctccacagccttgat

SEQ ID NO: 9209158 - DNA, 22 bp, Homo sapiens
agccatcctcccacctcagcct

SEQ ID NO: 9209159 - DNA, 22 bp, Homo sapiens
acagcagcgtgaagtgtgttat

SEQ ID NO: 9209160 - DNA, 22 bp, Homo sapiens
agctcctgtgtgcccacctgct

SEQ ID NO: 9209161 - DNA, 22 bp, Homo sapiens
agctccttgaagggctctggga

SEQ ID NO: 9209162 - DNA, 22 bp, Homo sapiens
agctctccacacataggactag

SEQ ID NO: 9209163 - DNA, 22 bp, Homo sapiens
agctcctgttctgagagcagga

SEQ ID NO: 9209164 - DNA, 19 bp, Homo sapiens
agctcctgttcagcagctc

SEQ ID NO: 9209165 - DNA, 18 bp, Homo sapiens
agctctggggagatgggc

SEQ ID NO: 9209166 - DNA, 22 bp, Homo sapiens
agctctccatctatctgtgatg

SEQ ID NO: 9209167 - DNA, 22 bp, Homo sapiens
agctctggggcctgtcccacat

SEQ ID NO: 9209168 - DNA, 22 bp, Homo sapiens
agctatggtaatcatccaccaa

SEQ ID NO: 9209169 - DNA, 22 bp, Homo sapiens
agctagggacagataccagcca

SEQ ID NO: 9209170 - DNA, 21 bp, Homo sapiens
acagcaagccttcacatgagt

SEQ ID NO: 9209171 - DNA, 21 bp, Homo sapiens
acagcaagccttcctttcagg

SEQ ID NO: 9209172 - DNA, 23 bp, Homo sapiens
acagcaagaggaccagatgtgag

SEQ ID NO: 9209173 - DNA, 22 bp, Homo sapiens
acagcaaaggacgaacactctg

SEQ ID NO: 9209174 - DNA, 22 bp, Homo sapiens
acagcaaaggacgaacactctg

SEQ ID NO: 9209175 - DNA, 21 bp, Homo sapiens
acagattgctgagctctacct

SEQ ID NO: 9209176 - DNA, 22 bp, Homo sapiens
acagattgaagtccagaatggc

SEQ ID NO: 9209177 - DNA, 22 bp, Homo sapiens
agcctgccttgggctgcttgag

SEQ ID NO: 9209178 - DNA, 17 bp, Homo sapiens
agcctgccccatgctgc

SEQ ID NO: 9209179 - DNA, 22 bp, Homo sapiens
agcctgcctcagactcaggata

SEQ ID NO: 9209180 - DNA, 22 bp, Homo sapiens
agcctgcctcagactcaggata

SEQ ID NO: 9209181 - DNA, 22 bp, Homo sapiens
agcctgcctgtgaggctttgag

SEQ ID NO: 9209182 - DNA, 22 bp, Homo sapiens
agcctgcaggatgggcagcacc

SEQ ID NO: 9209183 - DNA, 22 bp, Homo sapiens
agcctgcacctgaccaacctgc

SEQ ID NO: 9209184 - DNA, 20 bp, Homo sapiens
agcctgccagctggcccaga

SEQ ID NO: 9209185 - DNA, 22 bp, Homo sapiens
agcctgccaggcgctgcctgga

SEQ ID NO: 9209186 - DNA, 22 bp, Homo sapiens
agcagcagtacatataagacta

SEQ ID NO: 9209187 - DNA, 21 bp, Homo sapiens
acacaggcagtgtcccgaggt

SEQ ID NO: 9209188 - DNA, 22 bp, Homo sapiens
acacaggcaatgtgagtgggag

SEQ ID NO: 9209189 - DNA, 22 bp, Homo sapiens
acacatatatttgcatatacac

SEQ ID NO: 9209190 - DNA, 22 bp, Homo sapiens
agcaccatcgggttcttgcttt

SEQ ID NO: 9209191 - DNA, 22 bp, Homo sapiens
acaattctgatggtttcccagt

SEQ ID NO: 9209192 - DNA, 21 bp, Homo sapiens
acacaggagtttcttctttct

SEQ ID NO: 9209193 - DNA, 22 bp, Homo sapiens
acacaggaagtcagcactgatg

SEQ ID NO: 9209194 - DNA, 23 bp, Homo sapiens
agcaggaaaccgagggtgatgtt

SEQ ID NO: 9209195 - DNA, 22 bp, Homo sapiens
acaccagcctcgcccgtgtgtt

SEQ ID NO: 9209196 - DNA, 22 bp, Homo sapiens
acactgtgagctgaagggctgc

SEQ ID NO: 9209197 - DNA, 18 bp, Homo sapiens
acactgcagcagtctgct

SEQ ID NO: 9209198 - DNA, 22 bp, Homo sapiens
acagaaattgctaatagctcat

SEQ ID NO: 9209199 - DNA, 19 bp, Homo sapiens
acagaaattagttattttc

SEQ ID NO: 9209200 - DNA, 22 bp, Homo sapiens
acagaaattgggcaaatggaag

SEQ ID NO: 9209201 - DNA, 22 bp, Homo sapiens
acagaacaacaaggtggaccag

SEQ ID NO: 9209202 - DNA, 22 bp, Homo sapiens
acagaacaagacctgcttattg

SEQ ID NO: 9209203 - DNA, 22 bp, Homo sapiens
agccacaggaaacagagacagc

SEQ ID NO: 9209204 - DNA, 22 bp, Homo sapiens
agccacaggaaacagagacagc

SEQ ID NO: 9209205 - DNA, 22 bp, Homo sapiens
agccacaggccatgagatacca

SEQ ID NO: 9209206 - DNA, 22 bp, Homo sapiens
agccacagggggtgagggacaa

SEQ ID NO: 9209207 - DNA, 22 bp, Homo sapiens
agccacagggggtgagggacaa

SEQ ID NO: 9209208 - DNA, 22 bp, Homo sapiens
aattatccacctttgcatgatt

SEQ ID NO: 9209209 - DNA, 22 bp, Homo sapiens
agagctgggacttggactcaat

SEQ ID NO: 9209210 - DNA, 22 bp, Homo sapiens
aatttacagttgctgatggtac

SEQ ID NO: 9209211 - DNA, 22 bp, Homo sapiens
aatttacagttgctgatggtac

SEQ ID NO: 9209212 - DNA, 22 bp, Homo sapiens
aatttacagttgctgatggtac

SEQ ID NO: 9209213 - DNA, 22 bp, Homo sapiens
aatttacaggtgcactcgccat

SEQ ID NO: 9209214 - DNA, 22 bp, Homo sapiens
aatttacaggtgcactcgccat

SEQ ID NO: 9209215 - DNA, 22 bp, Homo sapiens
aatttacacttcatttggaggg

SEQ ID NO: 9209216 - DNA, 22 bp, Homo sapiens
aatgttcagcgagggatgctag

SEQ ID NO: 9209217 - DNA, 22 bp, Homo sapiens
aatgttcagaggacaatataaa

SEQ ID NO: 9209218 - DNA, 22 bp, Homo sapiens
aatgttcaaacagatcacttag

SEQ ID NO: 9209219 - DNA, 22 bp, Homo sapiens
aatgttctgcaactgttttcat

SEQ ID NO: 9209220 - DNA, 22 bp, Homo sapiens
aatgttctgatgtagggtttag

SEQ ID NO: 9209221 - DNA, 22 bp, Homo sapiens
aatgttctgtgctggttctggg

SEQ ID NO: 9209222 - DNA, 22 bp, Homo sapiens
aatgtttcgtaaattgtctatg

SEQ ID NO: 9209223 - DNA, 22 bp, Homo sapiens
aatgtttctggatattgtgggt

SEQ ID NO: 9209224 - DNA, 22 bp, Homo sapiens
aatgtttcatttagttgtctcc

SEQ ID NO: 9209225 - DNA, 22 bp, Homo sapiens
aatgtttcaattaagtctttta

SEQ ID NO: 9209226 - DNA, 22 bp, Homo sapiens
aatgcaaggcctgtatctgatt

SEQ ID NO: 9209227 - DNA, 22 bp, Homo sapiens
aatgcaagtcaatgctataccc

SEQ ID NO: 9209228 - DNA, 22 bp, Homo sapiens
agacagagatactatgttgtca

SEQ ID NO: 9209229 - DNA, 19 bp, Homo sapiens
agacagagctcagtgggtt

SEQ ID NO: 9209230 - DNA, 21 bp, Homo sapiens
agacagagtgcagtctacata

SEQ ID NO: 9209231 - DNA, 23 bp, Homo sapiens
agacagaggctgaggctggccgc

SEQ ID NO: 9209232 - DNA, 22 bp, Homo sapiens
aatgcaaacttcttgttacttg

SEQ ID NO: 9209233 - DNA, 22 bp, Homo sapiens
aatgcaagatcaaatctaacac

SEQ ID NO: 9209234 - DNA, 22 bp, Homo sapiens
agaaggggagaagctaccagga

SEQ ID NO: 9209235 - DNA, 22 bp, Homo sapiens
agaaggggcccaaggatgtcag

SEQ ID NO: 9209236 - DNA, 22 bp, Homo sapiens
agaaggggcccaaggatgtcag

SEQ ID NO: 9209237 - DNA, 23 bp, Homo sapiens
agaagggtccttggcagcgacag

SEQ ID NO: 9209238 - DNA, 22 bp, Homo sapiens
aatgtcaattaccagaacagaa

SEQ ID NO: 9209239 - DNA, 22 bp, Homo sapiens
aatgtcaatctcagagaacaca

SEQ ID NO: 9209240 - DNA, 22 bp, Homo sapiens
agacagggtcttgatcagagct

SEQ ID NO: 9209241 - DNA, 22 bp, Homo sapiens
aatgtctgtgccttaaaacttc

SEQ ID NO: 9209242 - DNA, 22 bp, Homo sapiens
acaaatgtctacattgagaata

SEQ ID NO: 9209243 - DNA, 22 bp, Homo sapiens
acaaattatagaaaattgagct

SEQ ID NO: 9209244 - DNA, 22 bp, Homo sapiens
acaaatgttacataagtttgga

SEQ ID NO: 9209245 - DNA, 19 bp, Homo sapiens
acaagtcacttacttagta

SEQ ID NO: 9209246 - DNA, 20 bp, Homo sapiens
agcaccagtgggggcagccc

SEQ ID NO: 9209247 - DNA, 22 bp, Homo sapiens
agcaaggattatcctgggaagg

SEQ ID NO: 9209248 - DNA, 22 bp, Homo sapiens
agcaaggaaagtaggcacggaa

SEQ ID NO: 9209249 - DNA, 22 bp, Homo sapiens
agcaagctaacataggagattg

SEQ ID NO: 9209250 - DNA, 22 bp, Homo sapiens
agcaagctgttcttggagagta

SEQ ID NO: 9209251 - DNA, 22 bp, Homo sapiens
agcaagctgtcaagagagctga

SEQ ID NO: 9209252 - DNA, 22 bp, Homo sapiens
agcaaggaaactatggagagat

SEQ ID NO: 9209253 - DNA, 22 bp, Homo sapiens
agcaaggaaactatggagagat

SEQ ID NO: 9209254 - DNA, 22 bp, Homo sapiens
agcaagcagaattctgtcctct

SEQ ID NO: 9209255 - DNA, 22 bp, Homo sapiens
agcaagcagaaatgccatggca

SEQ ID NO: 9209256 - DNA, 22 bp, Homo sapiens
agatggggtttcatcatgttgg

SEQ ID NO: 9209257 - DNA, 22 bp, Homo sapiens
agatggggctcagtgtggaggc

SEQ ID NO: 9209258 - DNA, 22 bp, Homo sapiens
agatgggtaattgatggcagta

SEQ ID NO: 9209259 - DNA, 22 bp, Homo sapiens
acaatgtttttgttcaaagagt

SEQ ID NO: 9209260 - DNA, 22 bp, Homo sapiens
acaatgttttgaaacatctagg

SEQ ID NO: 9209261 - DNA, 21 bp, Homo sapiens
acaaactgaaatgagtttcct

SEQ ID NO: 9209262 - DNA, 22 bp, Homo sapiens
acaaactgaatgggttttctgt

SEQ ID NO: 9209263 - DNA, 22 bp, Homo sapiens
acaaacagagttgaaaaatagg

SEQ ID NO: 9209264 - DNA, 22 bp, Homo sapiens
acaaacagagttgaaaaatagg

SEQ ID NO: 9209265 - DNA, 22 bp, Homo sapiens
acaaacagagttgaaaaatagg

SEQ ID NO: 9209266 - DNA, 22 bp, Homo sapiens
acaaacagagttgaaaaatagg

SEQ ID NO: 9209267 - DNA, 22 bp, Homo sapiens
acaaaccagcttaagcaagatg

SEQ ID NO: 9209268 - DNA, 22 bp, Homo sapiens
acaaaccagcttaagcaagatg

SEQ ID NO: 9209269 - DNA, 22 bp, Homo sapiens
acaaaattacctagttattttc

SEQ ID NO: 9209270 - DNA, 22 bp, Homo sapiens
acaaaattacctagttattttc

SEQ ID NO: 9209271 - DNA, 22 bp, Homo sapiens
acaaaatcaaaggagtgattca

SEQ ID NO: 9209272 - DNA, 22 bp, Homo sapiens
acaaaattgtgttaaactttat

SEQ ID NO: 9209273 - DNA, 22 bp, Homo sapiens
acaaaatttttagacaaggctt

SEQ ID NO: 9209274 - DNA, 22 bp, Homo sapiens
agaggccagtggctgtgctgtc

SEQ ID NO: 9209275 - DNA, 22 bp, Homo sapiens
agaggccaggtccagagtttgt

SEQ ID NO: 9209276 - DNA, 20 bp, Homo sapiens
agaggccagttaggagtcta

SEQ ID NO: 9209277 - DNA, 20 bp, Homo sapiens
agaggccagttaggagtcta

SEQ ID NO: 9209278 - DNA, 20 bp, Homo sapiens
agaggccagttaggagtcta

SEQ ID NO: 9209279 - DNA, 22 bp, Homo sapiens
agaggccatctgctctgtgggg

SEQ ID NO: 9209280 - DNA, 20 bp, Homo sapiens
acaaaataggtactgggtag

SEQ ID NO: 9209281 - DNA, 22 bp, Homo sapiens
agaggccccaggtgagcatgcc

SEQ ID NO: 9209282 - DNA, 22 bp, Homo sapiens
agaggccatggggcatttttca

SEQ ID NO: 9209283 - DNA, 22 bp, Homo sapiens
agaggccatgctagaggcctgg

SEQ ID NO: 9209284 - DNA, 22 bp, Homo sapiens
agaggccatgctagaggcctgg

SEQ ID NO: 9209285 - DNA, 22 bp, Homo sapiens
aattttcacagtgctgtgagat

SEQ ID NO: 9209286 - DNA, 22 bp, Homo sapiens
aattttattagaaggcaagggg

SEQ ID NO: 9209287 - DNA, 22 bp, Homo sapiens
aattttattaactggatgtagc

SEQ ID NO: 9209288 - DNA, 22 bp, Homo sapiens
agagctgggtgaagtgccatca

SEQ ID NO: 9209289 - DNA, 22 bp, Homo sapiens
agagctggggccagagtcaagg

SEQ ID NO: 9209290 - DNA, 22 bp, Homo sapiens
agagctggggccagagtcaagg

SEQ ID NO: 9209291 - DNA, 22 bp, Homo sapiens
agagctgggtggacttgtagtt

SEQ ID NO: 9209292 - DNA, 22 bp, Homo sapiens
agtcaaataagactgtcataag

SEQ ID NO: 9209293 - DNA, 22 bp, Homo sapiens
agtatttgatacagtcttctag

SEQ ID NO: 9209294 - DNA, 22 bp, Homo sapiens
agtattttcgccatcacaagaa

SEQ ID NO: 9209295 - DNA, 22 bp, Homo sapiens
acgcctgtaatcccagcacttt

SEQ ID NO: 9209296 - DNA, 22 bp, Homo sapiens
aggttcttggtgtccagatttc

SEQ ID NO: 9209297 - DNA, 22 bp, Homo sapiens
aggttcttttggccaacctcat

SEQ ID NO: 9209298 - DNA, 22 bp, Homo sapiens
aggttctttgtagtgtcattgg

SEQ ID NO: 9209299 - DNA, 22 bp, Homo sapiens
agtaaaaattgaggtgcaaaat

SEQ ID NO: 9209300 - DNA, 22 bp, Homo sapiens
acgccctctcggtagaggagct

SEQ ID NO: 9209301 - DNA, 22 bp, Homo sapiens
acgcctctgcagctgccgggcc

SEQ ID NO: 9209302 - DNA, 22 bp, Homo sapiens
aggtggctcctcccatggctgg

SEQ ID NO: 9209303 - DNA, 20 bp, Homo sapiens
aggtggctcctgctgggggt

SEQ ID NO: 9209304 - DNA, 22 bp, Homo sapiens
actagacatcgagctacagagt

SEQ ID NO: 9209305 - DNA, 22 bp, Homo sapiens
agtaaaattgtattggaaaaca

SEQ ID NO: 9209306 - DNA, 22 bp, Homo sapiens
agtaaacactaaaatgactgcg

SEQ ID NO: 9209307 - DNA, 22 bp, Homo sapiens
agtaaacactaaaatgactgcg

SEQ ID NO: 9209308 - DNA, 22 bp, Homo sapiens
agtaaacactgtctttatatat

SEQ ID NO: 9209309 - DNA, 22 bp, Homo sapiens
agtaaaatcaccatctctttgt

SEQ ID NO: 9209310 - DNA, 22 bp, Homo sapiens
aggtggctatgaggatgcagtc

SEQ ID NO: 9209311 - DNA, 22 bp, Homo sapiens
aggtcctgtctatcaccctcgc

SEQ ID NO: 9209312 - DNA, 22 bp, Homo sapiens
aggtcctgtcttatctctgtaa

SEQ ID NO: 9209313 - DNA, 22 bp, Homo sapiens
aggtcctgtggtttgggtaaaa

SEQ ID NO: 9209314 - DNA, 22 bp, Homo sapiens
aggtcctgtgtccaggggcctg

SEQ ID NO: 9209315 - DNA, 20 bp, Homo sapiens
aggtcctgttccttgtctcc

SEQ ID NO: 9209316 - DNA, 22 bp, Homo sapiens
aggtcctgtttcttccctgggg

SEQ ID NO: 9209317 - DNA, 22 bp, Homo sapiens
aggtctacagcctgtgacactt

SEQ ID NO: 9209318 - DNA, 22 bp, Homo sapiens
acctgccagaatgctagtcctg

SEQ ID NO: 9209319 - DNA, 22 bp, Homo sapiens
acctgccagaatccaagccaca

SEQ ID NO: 9209320 - DNA, 19 bp, Homo sapiens
acctgccatgacagcctga

SEQ ID NO: 9209321 - DNA, 22 bp, Homo sapiens
acctgccaagcatcagtggcag

SEQ ID NO: 9209322 - DNA, 22 bp, Homo sapiens
acctgagacctaatctgactgt

SEQ ID NO: 9209323 - DNA, 22 bp, Homo sapiens
acctgagacttgggatgggaat

SEQ ID NO: 9209324 - DNA, 22 bp, Homo sapiens
acctgaggcctccccagcagac

SEQ ID NO: 9209325 - DNA, 22 bp, Homo sapiens
acctgaggctgttagtctaggt

SEQ ID NO: 9209326 - DNA, 22 bp, Homo sapiens
acctgaggctgttagtctaggt

SEQ ID NO: 9209327 - DNA, 22 bp, Homo sapiens
acctgagggcccaaacttggta

SEQ ID NO: 9209328 - DNA, 19 bp, Homo sapiens
accctctcagtgcctgagg

SEQ ID NO: 9209329 - DNA, 22 bp, Homo sapiens
accctcccatttccatgtagca

SEQ ID NO: 9209330 - DNA, 22 bp, Homo sapiens
accctccaggctgcagctcctg

SEQ ID NO: 9209331 - DNA, 22 bp, Homo sapiens
acctcttaatattgcaccttct

SEQ ID NO: 9209332 - DNA, 22 bp, Homo sapiens
acctctttgaacctcagtgtga

SEQ ID NO: 9209333 - DNA, 22 bp, Homo sapiens
acctctgtacctcctctgacag

SEQ ID NO: 9209334 - DNA, 22 bp, Homo sapiens
acctgagaatgggggcatgtgt

SEQ ID NO: 9209335 - DNA, 21 bp, Homo sapiens
agtgtaggtcattagctgttg

SEQ ID NO: 9209336 - DNA, 22 bp, Homo sapiens
agtgtttaccccaatcagttta

SEQ ID NO: 9209337 - DNA, 22 bp, Homo sapiens
agtgttcttcttcaaagctctg

SEQ ID NO: 9209338 - DNA, 21 bp, Homo sapiens
agtgtgtgataggcaggaaga

SEQ ID NO: 9209339 - DNA, 22 bp, Homo sapiens
agtgttctttgcatgaggatag

SEQ ID NO: 9209340 - DNA, 22 bp, Homo sapiens
agtgtttaatgccttttccagc

SEQ ID NO: 9209341 - DNA, 22 bp, Homo sapiens
actgcacttcagcctgggtgtc

SEQ ID NO: 9209342 - DNA, 22 bp, Homo sapiens
actgcacttcagcctgggtgtc

SEQ ID NO: 9209343 - DNA, 22 bp, Homo sapiens
actgcacttcagcctgggtgtc

SEQ ID NO: 9209344 - DNA, 19 bp, Homo sapiens
actgcactttagcctgggc

SEQ ID NO: 9209345 - DNA, 21 bp, Homo sapiens
agtggggtctctgtggaggcc

SEQ ID NO: 9209346 - DNA, 22 bp, Homo sapiens
agtggcagggctggctgctgca

SEQ ID NO: 9209347 - DNA, 22 bp, Homo sapiens
agtggcagagccagggttggga

SEQ ID NO: 9209348 - DNA, 22 bp, Homo sapiens
agtggcagtggctgggcagagc

SEQ ID NO: 9209349 - DNA, 22 bp, Homo sapiens
actgcacttcagcctgggtgac

SEQ ID NO: 9209350 - DNA, 22 bp, Homo sapiens
actgcacttcagcctgggtgac

SEQ ID NO: 9209351 - DNA, 22 bp, Homo sapiens
actgcacttcagcctgggtgac

SEQ ID NO: 9209352 - DNA, 22 bp, Homo sapiens
agtcccagcttcccccatgcag

SEQ ID NO: 9209353 - DNA, 22 bp, Homo sapiens
agtcttctttcatttactcagt

SEQ ID NO: 9209354 - DNA, 22 bp, Homo sapiens
actctgtaattctgaagcacct

SEQ ID NO: 9209355 - DNA, 22 bp, Homo sapiens
agtctttaacatttggagattg

SEQ ID NO: 9209356 - DNA, 22 bp, Homo sapiens
agtgcagtggttaggagccagg

SEQ ID NO: 9209357 - DNA, 19 bp, Homo sapiens
actctgttgtacttgaggg

SEQ ID NO: 9209358 - DNA, 22 bp, Homo sapiens
actctgtgaagatgcaggcttg

SEQ ID NO: 9209359 - DNA, 21 bp, Homo sapiens
actctgtcttgagccatctgt

SEQ ID NO: 9209360 - DNA, 22 bp, Homo sapiens
actctgtatccctctcaaattg

SEQ ID NO: 9209361 - DNA, 20 bp, Homo sapiens
actctgtaggtaatgagact

SEQ ID NO: 9209362 - DNA, 22 bp, Homo sapiens
actctgtagcctgtaagagagc

SEQ ID NO: 9209363 - DNA, 22 bp, Homo sapiens
actctgtagagtataccaatgt

SEQ ID NO: 9209364 - DNA, 20 bp, Homo sapiens
agtgcatggagggagagggc

SEQ ID NO: 9209365 - DNA, 22 bp, Homo sapiens
agtgcatgcgcttgggaggggt

SEQ ID NO: 9209366 - DNA, 22 bp, Homo sapiens
actgaggcagaagggtaagtgg

SEQ ID NO: 9209367 - DNA, 22 bp, Homo sapiens
actgaggcttacaaaggtaaag

SEQ ID NO: 9209368 - DNA, 22 bp, Homo sapiens
actgaggcttaaagagattagg

SEQ ID NO: 9209369 - DNA, 22 bp, Homo sapiens
actgaggcgcagtccggctgtc

SEQ ID NO: 9209370 - DNA, 22 bp, Homo sapiens
atatggaagagcctgggaattt

SEQ ID NO: 9209371 - DNA, 22 bp, Homo sapiens
atattcatcgtgtagaaatact

SEQ ID NO: 9209372 - DNA, 22 bp, Homo sapiens
agaaaataaattgatggtggaa

SEQ ID NO: 9209373 - DNA, 21 bp, Homo sapiens
agaaaagtatttgaatcaaga

SEQ ID NO: 9209374 - DNA, 22 bp, Homo sapiens
atcggcaagccccacaccgtcc

SEQ ID NO: 9209375 - DNA, 22 bp, Homo sapiens
agaacagaagggaggaaggcct

SEQ ID NO: 9209376 - DNA, 22 bp, Homo sapiens
agaaagggctattttgaggtag

SEQ ID NO: 9209377 - DNA, 22 bp, Homo sapiens
agaaagtacagatgagacactt

SEQ ID NO: 9209378 - DNA, 22 bp, Homo sapiens
agaaagggttctctgaggtgct

SEQ ID NO: 9209379 - DNA, 22 bp, Homo sapiens
actgtgatgttctctatcttgg

SEQ ID NO: 9209380 - DNA, 22 bp, Homo sapiens
actgtgatgatgaagcatggtt

SEQ ID NO: 9209381 - DNA, 22 bp, Homo sapiens
actgtgatgcagttgccatcca

SEQ ID NO: 9209382 - DNA, 21 bp, Homo sapiens
actgtgataatgctttttctg

SEQ ID NO: 9209383 - DNA, 22 bp, Homo sapiens
actgtgatgtttgtgatcatct

SEQ ID NO: 9209384 - DNA, 22 bp, Homo sapiens
ataaaatttgctactgttaaat

SEQ ID NO: 9209385 - DNA, 22 bp, Homo sapiens
ataaaatttgctactgttaaat

SEQ ID NO: 9209386 - DNA, 22 bp, Homo sapiens
actgtattttgggtgtattttc

SEQ ID NO: 9209387 - DNA, 22 bp, Homo sapiens
actgtattctagtcatgtttgt

SEQ ID NO: 9209388 - DNA, 22 bp, Homo sapiens
actgtcactgacagaatcaaca

SEQ ID NO: 9209389 - DNA, 22 bp, Homo sapiens
actgtcaatagtgctgagcttg

SEQ ID NO: 9209390 - DNA, 22 bp, Homo sapiens
atacatgttgtaccatatgttt

SEQ ID NO: 9209391 - DNA, 22 bp, Homo sapiens
atacatgttgagaaaatatctg

SEQ ID NO: 9209392 - DNA, 22 bp, Homo sapiens
atacattagtgaacaaaagaga

SEQ ID NO: 9209393 - DNA, 22 bp, Homo sapiens
atacattagctcatatgattaa

SEQ ID NO: 9209394 - DNA, 22 bp, Homo sapiens
acttcttgggaccctggcaccg

SEQ ID NO: 9209395 - DNA, 22 bp, Homo sapiens
atacatgttgagaaaatatctg

SEQ ID NO: 9209396 - DNA, 22 bp, Homo sapiens
atacatgttcgtgtacatgttc

SEQ ID NO: 9209397 - DNA, 22 bp, Homo sapiens
acttctggtgtcatactgcatt

SEQ ID NO: 9209398 - DNA, 22 bp, Homo sapiens
actttatttcctattgcatcca

SEQ ID NO: 9209399 - DNA, 19 bp, Homo sapiens
acttctgaggaactgcaca

SEQ ID NO: 9209400 - DNA, 22 bp, Homo sapiens
acttctgaagcagagatttggg

SEQ ID NO: 9209401 - DNA, 22 bp, Homo sapiens
acttctgactcaaccgtgagct

SEQ ID NO: 9209402 - DNA, 22 bp, Homo sapiens
acttctgataaagagcatgtgc

SEQ ID NO: 9209403 - DNA, 22 bp, Homo sapiens
acttctgattacacatgggcct

SEQ ID NO: 9209404 - DNA, 22 bp, Homo sapiens
atacagggacatccagtttttc

SEQ ID NO: 9209405 - DNA, 22 bp, Homo sapiens
acttaccagagaggatccgccc

SEQ ID NO: 9209406 - DNA, 22 bp, Homo sapiens
acttagaatatgttcaagattt

SEQ ID NO: 9209407 - DNA, 22 bp, Homo sapiens
aggagcaaatgatgagacagca

SEQ ID NO: 9209408 - DNA, 22 bp, Homo sapiens
aggagcaccattgtgctggtgt

SEQ ID NO: 9209409 - DNA, 22 bp, Homo sapiens
aggagcactaattcctgcagag

SEQ ID NO: 9209410 - DNA, 22 bp, Homo sapiens
acagtatagggcttatattgta

SEQ ID NO: 9209411 - DNA, 21 bp, Homo sapiens
acagtatattagatatttgaa

SEQ ID NO: 9209412 - DNA, 21 bp, Homo sapiens
aggacacagagacacctattg

SEQ ID NO: 9209413 - DNA, 20 bp, Homo sapiens
acagtcagggaatagaaaaa

SEQ ID NO: 9209414 - DNA, 22 bp, Homo sapiens
acagtcagggcttactcaggga

SEQ ID NO: 9209415 - DNA, 22 bp, Homo sapiens
acagtcagttgaatccaaggag

SEQ ID NO: 9209416 - DNA, 22 bp, Homo sapiens
acagtcaaatgtctatcttctt

SEQ ID NO: 9209417 - DNA, 22 bp, Homo sapiens
acagtcaatcagaacagcatgt

SEQ ID NO: 9209418 - DNA, 22 bp, Homo sapiens
acagtcaggccgagatgggcct

SEQ ID NO: 9209419 - DNA, 23 bp, Homo sapiens
acagtcgtaggtatccttttcct

SEQ ID NO: 9209420 - DNA, 22 bp, Homo sapiens
acagtcctagctgcaaagaagt

SEQ ID NO: 9209421 - DNA, 22 bp, Homo sapiens
acagtctactaaacatcatcag

SEQ ID NO: 9209422 - DNA, 23 bp, Homo sapiens
acagtgtggtggacaaggagcag

SEQ ID NO: 9209423 - DNA, 22 bp, Homo sapiens
acagtctgcttgtctccatggt

SEQ ID NO: 9209424 - DNA, 17 bp, Homo sapiens
acagtctgcctgacagt

SEQ ID NO: 9209425 - DNA, 22 bp, Homo sapiens
aggatgagattccagggtcaat

SEQ ID NO: 9209426 - DNA, 22 bp, Homo sapiens
aggatgagattgctgtgttgta

SEQ ID NO: 9209427 - DNA, 22 bp, Homo sapiens
aggatgagattgctgtgttgta

SEQ ID NO: 9209428 - DNA, 22 bp, Homo sapiens
aggatgaggctggcaggtcttg

SEQ ID NO: 9209429 - DNA, 22 bp, Homo sapiens
aggatgaggctggcaggtcttg

SEQ ID NO: 9209430 - DNA, 21 bp, Homo sapiens
acagttcatgataactccatc

SEQ ID NO: 9209431 - DNA, 22 bp, Homo sapiens
acatagcataaagaatgactct

SEQ ID NO: 9209432 - DNA, 22 bp, Homo sapiens
acatagcacgtctcaatttgga

SEQ ID NO: 9209433 - DNA, 17 bp, Homo sapiens
aggcagctcagaacatc

SEQ ID NO: 9209434 - DNA, 17 bp, Homo sapiens
aggcagctcagaacatc

SEQ ID NO: 9209435 - DNA, 22 bp, Homo sapiens
aggcagctgaggtctggcgccc

SEQ ID NO: 9209436 - DNA, 22 bp, Homo sapiens
aggcagctgccctctccttcct

SEQ ID NO: 9209437 - DNA, 21 bp, Homo sapiens
aggcagctcaggcccagagag

SEQ ID NO: 9209438 - DNA, 22 bp, Homo sapiens
aggcagctgaccacagtatgat

SEQ ID NO: 9209439 - DNA, 22 bp, Homo sapiens
aggcagctgaccacagtatgat

SEQ ID NO: 9209440 - DNA, 22 bp, Homo sapiens
acatatgttgtaaacattccaa

SEQ ID NO: 9209441 - DNA, 22 bp, Homo sapiens
agctggtgtcctcctggagctg

SEQ ID NO: 9209442 - DNA, 22 bp, Homo sapiens
agctggtgtcctcctggagctg

SEQ ID NO: 9209443 - DNA, 22 bp, Homo sapiens
acaggcacaggtgtgccccacc

SEQ ID NO: 9209444 - DNA, 19 bp, Homo sapiens
agctggcactagaatccag

SEQ ID NO: 9209445 - DNA, 22 bp, Homo sapiens
agctggcacagaccaggagatc

SEQ ID NO: 9209446 - DNA, 22 bp, Homo sapiens
acaggagggacaccttcctgct

SEQ ID NO: 9209447 - DNA, 22 bp, Homo sapiens
agctggaggggccagcaggtgt

SEQ ID NO: 9209448 - DNA, 22 bp, Homo sapiens
acagctggtgaatgttctctgt

SEQ ID NO: 9209449 - DNA, 22 bp, Homo sapiens
acagctgtatccccagagctca

SEQ ID NO: 9209450 - DNA, 22 bp, Homo sapiens
acagctgggtgctgctcagagc

SEQ ID NO: 9209451 - DNA, 22 bp, Homo sapiens
acagctgggaactcacacagca

SEQ ID NO: 9209452 - DNA, 22 bp, Homo sapiens
acagctggccgaggctcaggga

SEQ ID NO: 9209453 - DNA, 22 bp, Homo sapiens
acagctggcaggggggcatgaa

SEQ ID NO: 9209454 - DNA, 22 bp, Homo sapiens
agctctgggtcacggctgccga

SEQ ID NO: 9209455 - DNA, 22 bp, Homo sapiens
agctctggtactgctgaccgaa

SEQ ID NO: 9209456 - DNA, 22 bp, Homo sapiens
agctctggttattgaagcaggg

SEQ ID NO: 9209457 - DNA, 22 bp, Homo sapiens
agctgaaggctagaacagctgg

SEQ ID NO: 9209458 - DNA, 23 bp, Homo sapiens
aggaagagagagtgcctctttct

SEQ ID NO: 9209459 - DNA, 22 bp, Homo sapiens
acaggggcaggcaggacccttt

SEQ ID NO: 9209460 - DNA, 22 bp, Homo sapiens
acagggcttttaatcagtagtt

SEQ ID NO: 9209461 - DNA, 22 bp, Homo sapiens
aggacaattagactctttgttt

SEQ ID NO: 9209462 - DNA, 19 bp, Homo sapiens
acaggggcctttccagggt

SEQ ID NO: 9209463 - DNA, 22 bp, Homo sapiens
acagggagatgggtgaaagcgg

SEQ ID NO: 9209464 - DNA, 22 bp, Homo sapiens
acaggcaggcgggacagcccga

SEQ ID NO: 9209465 - DNA, 22 bp, Homo sapiens
acaggcagcaaaatcagcctca

SEQ ID NO: 9209466 - DNA, 22 bp, Homo sapiens
aggccaggcctttctccattcc

SEQ ID NO: 9209467 - DNA, 22 bp, Homo sapiens
aggccaggcgagacacccggct

SEQ ID NO: 9209468 - DNA, 22 bp, Homo sapiens
aggccagggcactgctctttag

SEQ ID NO: 9209469 - DNA, 22 bp, Homo sapiens
aggccaggggtgagcacttctg

SEQ ID NO: 9209470 - DNA, 22 bp, Homo sapiens
aggccagggccagattagccac

SEQ ID NO: 9209471 - DNA, 22 bp, Homo sapiens
aggccagggccagattagccac

SEQ ID NO: 9209472 - DNA, 22 bp, Homo sapiens
aggcctctgggtctcctctgac

SEQ ID NO: 9209473 - DNA, 22 bp, Homo sapiens
acatcacagagcccagataaag

SEQ ID NO: 9209474 - DNA, 22 bp, Homo sapiens
acatgctacacagagctcctcg

SEQ ID NO: 9209475 - DNA, 22 bp, Homo sapiens
acatgccagcctcagcagcagt

SEQ ID NO: 9209476 - DNA, 22 bp, Homo sapiens
acatgccatcactttcattcct

SEQ ID NO: 9209477 - DNA, 22 bp, Homo sapiens
acatgccatctttgtcaggagt

SEQ ID NO: 9209478 - DNA, 22 bp, Homo sapiens
acatgccatggttgtttgctgc

SEQ ID NO: 9209479 - DNA, 22 bp, Homo sapiens
acatgccatgaaggtatttttg

SEQ ID NO: 9209480 - DNA, 22 bp, Homo sapiens
acatgccaatttggttagttca

SEQ ID NO: 9209481 - DNA, 22 bp, Homo sapiens
acatgccagcactgcttttcag

SEQ ID NO: 9209482 - DNA, 22 bp, Homo sapiens
acatgccagcctcagcagcagt

SEQ ID NO: 9209483 - DNA, 22 bp, Homo sapiens
acatgccagcccatttaaatgg

SEQ ID NO: 9209484 - DNA, 22 bp, Homo sapiens
acatttgacatttagtatcagc

SEQ ID NO: 9209485 - DNA, 22 bp, Homo sapiens
acatttctcttagagttggact

SEQ ID NO: 9209486 - DNA, 22 bp, Homo sapiens
acatttctcagggagttttgct

SEQ ID NO: 9209487 - DNA, 22 bp, Homo sapiens
aggctgagctggtagtgagtac

SEQ ID NO: 9209488 - DNA, 22 bp, Homo sapiens
aggctgagaaagtgggaagatg

SEQ ID NO: 9209489 - DNA, 22 bp, Homo sapiens
acattgatatttcaaatacagg

SEQ ID NO: 9209490 - DNA, 22 bp, Homo sapiens
aggctctttgagactacctgga

SEQ ID NO: 9209491 - DNA, 22 bp, Homo sapiens
aggctgaaaacgagatggcaat

SEQ ID NO: 9209492 - DNA, 22 bp, Homo sapiens
aggctctgtttgctgtggtacc

SEQ ID NO: 9209493 - DNA, 22 bp, Homo sapiens
aggctctggctactacagagct

SEQ ID NO: 9209494 - DNA, 22 bp, Homo sapiens
accaggctccccttggatcctg

SEQ ID NO: 9209495 - DNA, 22 bp, Homo sapiens
accaggctctgccagtgtttac

SEQ ID NO: 9209496 - DNA, 22 bp, Homo sapiens
accaggctggagtgcagtggcg

SEQ ID NO: 9209497 - DNA, 22 bp, Homo sapiens
accaggctggagtgcagtggcg

SEQ ID NO: 9209498 - DNA, 22 bp, Homo sapiens
accaggctggagtgcagtggcg

SEQ ID NO: 9209499 - DNA, 22 bp, Homo sapiens
accaggctgtgaagtgagacta

SEQ ID NO: 9209500 - DNA, 22 bp, Homo sapiens
acccagcatgacacctgcacat

SEQ ID NO: 9209501 - DNA, 22 bp, Homo sapiens
acccaggacttggcaacctcat

SEQ ID NO: 9209502 - DNA, 22 bp, Homo sapiens
agggctgcccagtgtgagagct

SEQ ID NO: 9209503 - DNA, 22 bp, Homo sapiens
agggctgacagtgaggagtcaa

SEQ ID NO: 9209504 - DNA, 20 bp, Homo sapiens
acccagctctgtgccctggg

SEQ ID NO: 9209505 - DNA, 22 bp, Homo sapiens
acccagctaaccctaccctgga

SEQ ID NO: 9209506 - DNA, 22 bp, Homo sapiens
agggggaggctgtgctgcgtct

SEQ ID NO: 9209507 - DNA, 22 bp, Homo sapiens
accctcatgaagctggcctgga

SEQ ID NO: 9209508 - DNA, 22 bp, Homo sapiens
acccaggctggcagaggctcct

SEQ ID NO: 9209509 - DNA, 22 bp, Homo sapiens
acccaggctggagtgcagtgtc

SEQ ID NO: 9209510 - DNA, 22 bp, Homo sapiens
acccaggctggagtgcagtgtc

SEQ ID NO: 9209511 - DNA, 22 bp, Homo sapiens
acccaggctggagtgcagtgtc

SEQ ID NO: 9209512 - DNA, 22 bp, Homo sapiens
acccaggctggagtgcagtggt

SEQ ID NO: 9209513 - DNA, 22 bp, Homo sapiens
acccaggctggagtgcagtggt

SEQ ID NO: 9209514 - DNA, 22 bp, Homo sapiens
acccaggctggagtgcagtggt

SEQ ID NO: 9209515 - DNA, 22 bp, Homo sapiens
acccaggctggagtgcagtgat

SEQ ID NO: 9209516 - DNA, 22 bp, Homo sapiens
acccaggctggagtgcagtgat

SEQ ID NO: 9209517 - DNA, 22 bp, Homo sapiens
acccaggctggagtgcagtgat

SEQ ID NO: 9209518 - DNA, 22 bp, Homo sapiens
acccaggctggagtgcagtggc

SEQ ID NO: 9209519 - DNA, 22 bp, Homo sapiens
acccaggctggagtgcagtggg

SEQ ID NO: 9209520 - DNA, 22 bp, Homo sapiens
acccaggctggagtgcagtggg

SEQ ID NO: 9209521 - DNA, 22 bp, Homo sapiens
acccaggctggagtgcagtggg

SEQ ID NO: 9209522 - DNA, 22 bp, Homo sapiens
acccaggctggagtgcagtggc

SEQ ID NO: 9209523 - DNA, 22 bp, Homo sapiens
acccaggctggagtgcagtggc

SEQ ID NO: 9209524 - DNA, 22 bp, Homo sapiens
agggctgcctgactccagagcc

SEQ ID NO: 9209525 - DNA, 22 bp, Homo sapiens
acccaggctggagtgcagtgac

SEQ ID NO: 9209526 - DNA, 22 bp, Homo sapiens
acccaggctggagtgcagtgac

SEQ ID NO: 9209527 - DNA, 22 bp, Homo sapiens
acccaggctggagtgcagtgac

SEQ ID NO: 9209528 - DNA, 21 bp, Homo sapiens
agggcagattagctgtaagag

SEQ ID NO: 9209529 - DNA, 22 bp, Homo sapiens
agggcagatggaacttccccga

SEQ ID NO: 9209530 - DNA, 22 bp, Homo sapiens
agggcagcacaaggcatggact

SEQ ID NO: 9209531 - DNA, 22 bp, Homo sapiens
agggcagcacaaggcatggact

SEQ ID NO: 9209532 - DNA, 19 bp, Homo sapiens
accaggcctcagaggccct

SEQ ID NO: 9209533 - DNA, 22 bp, Homo sapiens
accagcctcctagctgctcctg

SEQ ID NO: 9209534 - DNA, 17 bp, Homo sapiens
accagcctctcctgggg

SEQ ID NO: 9209535 - DNA, 22 bp, Homo sapiens
accagcctggccaacatggcaa

SEQ ID NO: 9209536 - DNA, 22 bp, Homo sapiens
accagcctggccaacatggtga

SEQ ID NO: 9209537 - DNA, 22 bp, Homo sapiens
accagcctggccaacatggtga

SEQ ID NO: 9209538 - DNA, 22 bp, Homo sapiens
accagcctggccaacatggcaa

SEQ ID NO: 9209539 - DNA, 22 bp, Homo sapiens
accagcctgtctgagtcgtggg

SEQ ID NO: 9209540 - DNA, 18 bp, Homo sapiens
agggagagaccgcgggtc

SEQ ID NO: 9209541 - DNA, 22 bp, Homo sapiens
aggcttgtggggaatctgtgtg

SEQ ID NO: 9209542 - DNA, 22 bp, Homo sapiens
accagccccaccgggactgcag

SEQ ID NO: 9209543 - DNA, 22 bp, Homo sapiens
aggcttgggactgcttaggagc

SEQ ID NO: 9209544 - DNA, 20 bp, Homo sapiens
aggcttggcttggcaggaac

SEQ ID NO: 9209545 - DNA, 22 bp, Homo sapiens
aggcttggtgccaaggagcctg

SEQ ID NO: 9209546 - DNA, 18 bp, Homo sapiens
aggcttgggcccagcagc

SEQ ID NO: 9209547 - DNA, 18 bp, Homo sapiens
aggcttgggcccagcagc

SEQ ID NO: 9209548 - DNA, 22 bp, Homo sapiens
aggcttggttaattctgtgtga

SEQ ID NO: 9209549 - DNA, 22 bp, Homo sapiens
aggcttggttaattctgtgtga

SEQ ID NO: 9209550 - DNA, 19 bp, Homo sapiens
aggcttggttgcagcaagc

SEQ ID NO: 9209551 - DNA, 22 bp, Homo sapiens
aggcttggtttatagaagtaat

SEQ ID NO: 9209552 - DNA, 22 bp, Homo sapiens
aggcttgtctcagaagatgctg

SEQ ID NO: 9209553 - DNA, 22 bp, Homo sapiens
accagcagctgccagagtggag

SEQ ID NO: 9209554 - DNA, 22 bp, Homo sapiens
accagcagttatgaggccagga

SEQ ID NO: 9209555 - DNA, 22 bp, Homo sapiens
accagcagttatgaggccagga

SEQ ID NO: 9209556 - DNA, 22 bp, Homo sapiens
accagcagttatgaggccagga

SEQ ID NO: 9209557 - DNA, 22 bp, Homo sapiens
agagaaggaaagctgacatggg

SEQ ID NO: 9209558 - DNA, 22 bp, Homo sapiens
agagaagcattcttctcagggc

SEQ ID NO: 9209559 - DNA, 20 bp, Homo sapiens
agagaccctgtagcttgcag

SEQ ID NO: 9209560 - DNA, 22 bp, Homo sapiens
agagacccgcagcctcggagct

SEQ ID NO: 9209561 - DNA, 22 bp, Homo sapiens
agagacagggttttgtcgtgtt

SEQ ID NO: 9209562 - DNA, 22 bp, Homo sapiens
agagatgaagggcattccccag

SEQ ID NO: 9209563 - DNA, 22 bp, Homo sapiens
agagaagagcaatgataaattt

SEQ ID NO: 9209564 - DNA, 22 bp, Homo sapiens
agacccacactttgagtagcaa

SEQ ID NO: 9209565 - DNA, 22 bp, Homo sapiens
agaccatagggacctcaggttg

SEQ ID NO: 9209566 - DNA, 22 bp, Homo sapiens
agaccatgggctcctgggacat

SEQ ID NO: 9209567 - DNA, 22 bp, Homo sapiens
agaccagggtcccacagagtct

SEQ ID NO: 9209568 - DNA, 22 bp, Homo sapiens
atgtggttttggattattcatg

SEQ ID NO: 9209569 - DNA, 22 bp, Homo sapiens
atgtggggacaaaatgatggcc

SEQ ID NO: 9209570 - DNA, 22 bp, Homo sapiens
atgtgggccgtgcgggtgtcct

SEQ ID NO: 9209571 - DNA, 22 bp, Homo sapiens
agagccagcaactctagccctg

SEQ ID NO: 9209572 - DNA, 22 bp, Homo sapiens
agagcctgggcagctcctctgg

SEQ ID NO: 9209573 - DNA, 22 bp, Homo sapiens
atgtcaaacacaacaccagtgg

SEQ ID NO: 9209574 - DNA, 22 bp, Homo sapiens
atgtcaaagcagactgagagcg

SEQ ID NO: 9209575 - DNA, 22 bp, Homo sapiens
atgtcaaacacaacaccagtgg

SEQ ID NO: 9209576 - DNA, 22 bp, Homo sapiens
atgtattttaagatttgcctca

SEQ ID NO: 9209577 - DNA, 22 bp, Homo sapiens
agagatggccttaggtgggaat

SEQ ID NO: 9209578 - DNA, 22 bp, Homo sapiens
atgggggcctgaacaggcaaaa

SEQ ID NO: 9209579 - DNA, 22 bp, Homo sapiens
atggggggatgaaggagtccaa

SEQ ID NO: 9209580 - DNA, 22 bp, Homo sapiens
atgggggcggctgaagcccagg

SEQ ID NO: 9209581 - DNA, 22 bp, Homo sapiens
agagccagagacctgggttcac

SEQ ID NO: 9209582 - DNA, 22 bp, Homo sapiens
agagccaaggctgagagctatt

SEQ ID NO: 9209583 - DNA, 22 bp, Homo sapiens
atgggtaggatttactcagatg

SEQ ID NO: 9209584 - DNA, 22 bp, Homo sapiens
agacaaataactttttatgtcc

SEQ ID NO: 9209585 - DNA, 22 bp, Homo sapiens
agacaaatggagtatgagcaac

SEQ ID NO: 9209586 - DNA, 22 bp, Homo sapiens
agacaaattgggacattgtgtt

SEQ ID NO: 9209587 - DNA, 18 bp, Homo sapiens
agaattgctgcttcttct

SEQ ID NO: 9209588 - DNA, 18 bp, Homo sapiens
agacaaacttcttctgcc

SEQ ID NO: 9209589 - DNA, 22 bp, Homo sapiens
agacaaaccttgttttatgatg

SEQ ID NO: 9209590 - DNA, 20 bp, Homo sapiens
agaagtggctgcagacacta

SEQ ID NO: 9209591 - DNA, 20 bp, Homo sapiens
agaagtggctgcagacacta

SEQ ID NO: 9209592 - DNA, 22 bp, Homo sapiens
agaagtggtctgtcttccagat

SEQ ID NO: 9209593 - DNA, 22 bp, Homo sapiens
agaagttaccacatacttctct

SEQ ID NO: 9209594 - DNA, 22 bp, Homo sapiens
atgaaacatgctttgtggatga

SEQ ID NO: 9209595 - DNA, 20 bp, Homo sapiens
agaagtcagctcagaagtga

SEQ ID NO: 9209596 - DNA, 22 bp, Homo sapiens
agaagtcagccacagtgggaga

SEQ ID NO: 9209597 - DNA, 22 bp, Homo sapiens
agaagtcaatgatgagagtgct

SEQ ID NO: 9209598 - DNA, 22 bp, Homo sapiens
agaagtgagttgtgactatggg

SEQ ID NO: 9209599 - DNA, 22 bp, Homo sapiens
agaagtgaggaaatcctcttta

SEQ ID NO: 9209600 - DNA, 22 bp, Homo sapiens
agaagtgagactcagttgatga

SEQ ID NO: 9209601 - DNA, 22 bp, Homo sapiens
atctcagatctacagatctaca

SEQ ID NO: 9209602 - DNA, 21 bp, Homo sapiens
agacagcagatagtcgaaagg

SEQ ID NO: 9209603 - DNA, 22 bp, Homo sapiens
agacagcagaaactagagcact

SEQ ID NO: 9209604 - DNA, 22 bp, Homo sapiens
agacagcatgagcctgctgatg

SEQ ID NO: 9209605 - DNA, 22 bp, Homo sapiens
agacagcaggggagtctggttt

SEQ ID NO: 9209606 - DNA, 22 bp, Homo sapiens
agacagctgcctccaccacagc

SEQ ID NO: 9209607 - DNA, 22 bp, Homo sapiens
agacagctgcctccaccacagc

SEQ ID NO: 9209608 - DNA, 22 bp, Homo sapiens
agacagctctgggttccacact

SEQ ID NO: 9209609 - DNA, 22 bp, Homo sapiens
agacagcatggagctgataaca

SEQ ID NO: 9209610 - DNA, 22 bp, Homo sapiens
agacaggcagaggctgcagagg

SEQ ID NO: 9209611 - DNA, 22 bp, Homo sapiens
agacaggcagaggctgcagagg

SEQ ID NO: 9209612 - DNA, 22 bp, Homo sapiens
agacagctgggaaatggagtgt

SEQ ID NO: 9209613 - DNA, 22 bp, Homo sapiens
agacagctgctcgcagagctat

SEQ ID NO: 9209614 - DNA, 22 bp, Homo sapiens
agacagctgttccttcatgttt

SEQ ID NO: 9209615 - DNA, 21 bp, Homo sapiens
agacagctttaaagacacagg

SEQ ID NO: 9209616 - DNA, 22 bp, Homo sapiens
agacaggatgcatactcttggt

SEQ ID NO: 9209617 - DNA, 22 bp, Homo sapiens
atgcacatgaggcaagcaaaat

SEQ ID NO: 9209618 - DNA, 22 bp, Homo sapiens
agacagacatagaaattagtaa

SEQ ID NO: 9209619 - DNA, 22 bp, Homo sapiens
attgccaactgcattacagtcc

SEQ ID NO: 9209620 - DNA, 22 bp, Homo sapiens
agagtggggacagggcctgtcc

SEQ ID NO: 9209621 - DNA, 22 bp, Homo sapiens
agagttggcccacgtgtaggcg

SEQ ID NO: 9209622 - DNA, 22 bp, Homo sapiens
agagttgctatagaaggatgga

SEQ ID NO: 9209623 - DNA, 22 bp, Homo sapiens
agagttgctaccaagatgctag

SEQ ID NO: 9209624 - DNA, 22 bp, Homo sapiens
agagttgctatagaaggatgga

SEQ ID NO: 9209625 - DNA, 22 bp, Homo sapiens
agagttgttgtacaaactaaat

SEQ ID NO: 9209626 - DNA, 22 bp, Homo sapiens
agagtttacagaaataagctgt

SEQ ID NO: 9209627 - DNA, 22 bp, Homo sapiens
atttcactcttaattgcttcct

SEQ ID NO: 9209628 - DNA, 22 bp, Homo sapiens
atttcactcattcatgttactt

SEQ ID NO: 9209629 - DNA, 22 bp, Homo sapiens
agataaaatggttcaaaggcta

SEQ ID NO: 9209630 - DNA, 17 bp, Homo sapiens
agagttttaagaaattt

SEQ ID NO: 9209631 - DNA, 22 bp, Homo sapiens
atttggcaacattaattgaatc

SEQ ID NO: 9209632 - DNA, 22 bp, Homo sapiens
atttggcaatgctagagaagtt

SEQ ID NO: 9209633 - DNA, 22 bp, Homo sapiens
atttggcacactgggttctcgt

SEQ ID NO: 9209634 - DNA, 18 bp, Homo sapiens
atttggcagatgatgaac

SEQ ID NO: 9209635 - DNA, 22 bp, Homo sapiens
atttggcacagcttttcctacc

SEQ ID NO: 9209636 - DNA, 22 bp, Homo sapiens
atttggcaaaaattagcagtag

SEQ ID NO: 9209637 - DNA, 22 bp, Homo sapiens
atttggcaaaagttagaagaaa

SEQ ID NO: 9209638 - DNA, 22 bp, Homo sapiens
atttggcaaataatttgagggt

SEQ ID NO: 9209639 - DNA, 21 bp, Homo sapiens
atttggcaaaggcgatgcaca

SEQ ID NO: 9209640 - DNA, 15 bp, Homo sapiens
atttggcatggcctc

SEQ ID NO: 9209641 - DNA, 20 bp, Homo sapiens
atttggcatgaagtattgat

SEQ ID NO: 9209642 - DNA, 22 bp, Homo sapiens
atttggcataggcagaggccca

SEQ ID NO: 9209643 - DNA, 20 bp, Homo sapiens
atttggcatagtttaagcaa

SEQ ID NO: 9209644 - DNA, 22 bp, Homo sapiens
atttggcagccacagcaatctt

SEQ ID NO: 9209645 - DNA, 22 bp, Homo sapiens
atttggcagtataaattctggc

SEQ ID NO: 9209646 - DNA, 22 bp, Homo sapiens
atttggcagtgaagggatcaca

SEQ ID NO: 9209647 - DNA, 22 bp, Homo sapiens
atttggcatagagtatcattct

SEQ ID NO: 9209648 - DNA, 22 bp, Homo sapiens
atttctcattaagatcttccaa

SEQ ID NO: 9209649 - DNA, 17 bp, Homo sapiens
agagggaaaatgcggtt

SEQ ID NO: 9209650 - DNA, 22 bp, Homo sapiens
agagggagaaaagaatcagttg

SEQ ID NO: 9209651 - DNA, 22 bp, Homo sapiens
attccaggaagtgtgggaccaa

SEQ ID NO: 9209652 - DNA, 22 bp, Homo sapiens
attccaggagctaactgtggtc

SEQ ID NO: 9209653 - DNA, 22 bp, Homo sapiens
attccaggcaaagcagagaaga

SEQ ID NO: 9209654 - DNA, 22 bp, Homo sapiens
attccaggcagaccagagagat

SEQ ID NO: 9209655 - DNA, 22 bp, Homo sapiens
attccattgtgtaaggatatcg

SEQ ID NO: 9209656 - DNA, 22 bp, Homo sapiens
agaggctcactcttggaaccca

SEQ ID NO: 9209657 - DNA, 22 bp, Homo sapiens
agaggcaggaagagctgatttt

SEQ ID NO: 9209658 - DNA, 21 bp, Homo sapiens
agagctgggacttgcctgaga

SEQ ID NO: 9209659 - DNA, 21 bp, Homo sapiens
agagctgggacttgcctgaga

SEQ ID NO: 9209660 - DNA, 22 bp, Homo sapiens
agagctggtttactcaggaatt

SEQ ID NO: 9209661 - DNA, 22 bp, Homo sapiens
agagctgttcagcagccaggtt

SEQ ID NO: 9209662 - DNA, 21 bp, Homo sapiens
agagctggtaggtaggtaggt

SEQ ID NO: 9209663 - DNA, 22 bp, Homo sapiens
agagctgtgctttgcaccacgt

SEQ ID NO: 9209664 - DNA, 22 bp, Homo sapiens
agaggaagctgagatgcctctt

SEQ ID NO: 9209665 - DNA, 22 bp, Homo sapiens
attattatggttgctcttttcc

SEQ ID NO: 9209666 - DNA, 22 bp, Homo sapiens
agaggcactgttcttagcgact

SEQ ID NO: 9209667 - DNA, 22 bp, Homo sapiens
agaggaggctctgggatcgtcc

SEQ ID NO: 9209668 - DNA, 22 bp, Homo sapiens
agaggagctgggaggccctcgt

SEQ ID NO: 9209669 - DNA, 22 bp, Homo sapiens
agaggagcttttggaaaaggcc

SEQ ID NO: 9209670 - DNA, 22 bp, Homo sapiens
agaggacaggttttccatgggc

SEQ ID NO: 9209671 - DNA, 22 bp, Homo sapiens
agaggaggatttgtaaaggtct

SEQ ID NO: 9209672 - DNA, 22 bp, Homo sapiens
cacctagggtttcgcctttctt

SEQ ID NO: 9209673 - DNA, 22 bp, Homo sapiens
cacccagggctgtgcctgccca

SEQ ID NO: 9209674 - DNA, 22 bp, Homo sapiens
cacccagggctgtgcctgccca

SEQ ID NO: 9209675 - DNA, 22 bp, Homo sapiens
cacccaggctggagtgcattgg

SEQ ID NO: 9209676 - DNA, 22 bp, Homo sapiens
cacccaggctggagtgcattgg

SEQ ID NO: 9209677 - DNA, 22 bp, Homo sapiens
cacccaggctggagtgcagtgg

SEQ ID NO: 9209678 - DNA, 22 bp, Homo sapiens
cacccaggctggagtgcagtgg

SEQ ID NO: 9209679 - DNA, 22 bp, Homo sapiens
cacctctttgatttgaggcaag

SEQ ID NO: 9209680 - DNA, 22 bp, Homo sapiens
cactgctttaaggctgagtaac

SEQ ID NO: 9209681 - DNA, 22 bp, Homo sapiens
cactgcttgattgacatgcacg

SEQ ID NO: 9209682 - DNA, 22 bp, Homo sapiens
agcatacaggtctgaaacagct

SEQ ID NO: 9209683 - DNA, 20 bp, Homo sapiens
agcatacatcataagaaacc

SEQ ID NO: 9209684 - DNA, 22 bp, Homo sapiens
cactgctacctctgcctcccgg

SEQ ID NO: 9209685 - DNA, 22 bp, Homo sapiens
cactgctgatttcataggcagg

SEQ ID NO: 9209686 - DNA, 22 bp, Homo sapiens
cactgctcgctgcagcatggcc

SEQ ID NO: 9209687 - DNA, 22 bp, Homo sapiens
cactgctcgctgcagcatggcc

SEQ ID NO: 9209688 - DNA, 22 bp, Homo sapiens
cacccaggctggagagcagtgg

SEQ ID NO: 9209689 - DNA, 22 bp, Homo sapiens
cacccaggctggagtgcagggg

SEQ ID NO: 9209690 - DNA, 22 bp, Homo sapiens
cacccaggctggagtgcagggg

SEQ ID NO: 9209691 - DNA, 22 bp, Homo sapiens
cacccaggctggagtgcagtga

SEQ ID NO: 9209692 - DNA, 22 bp, Homo sapiens
cacccaggctggagtgcagtga

SEQ ID NO: 9209693 - DNA, 22 bp, Homo sapiens
agcagggtgtggtggccctgga

SEQ ID NO: 9209694 - DNA, 22 bp, Homo sapiens
agcaggggtctctgctaatgaa

SEQ ID NO: 9209695 - DNA, 22 bp, Homo sapiens
agcaggcagccatttggaaggc

SEQ ID NO: 9209696 - DNA, 22 bp, Homo sapiens
cacagtgtttgatttaggggcc

SEQ ID NO: 9209697 - DNA, 22 bp, Homo sapiens
agcaggcaggaaggcagcactg

SEQ ID NO: 9209698 - DNA, 22 bp, Homo sapiens
agcaggctgagcacccaggggg

SEQ ID NO: 9209699 - DNA, 17 bp, Homo sapiens
agcaggctgcagaggcc

SEQ ID NO: 9209700 - DNA, 22 bp, Homo sapiens
agcaggctccttccttctctgg

SEQ ID NO: 9209701 - DNA, 22 bp, Homo sapiens
agcaggctccaggctggccatc

SEQ ID NO: 9209702 - DNA, 22 bp, Homo sapiens
agcaggctccaggctggccatc

SEQ ID NO: 9209703 - DNA, 22 bp, Homo sapiens
cacacaaatattctggaggcaa

SEQ ID NO: 9209704 - DNA, 22 bp, Homo sapiens
agcagctgatggggaaggagtt

SEQ ID NO: 9209705 - DNA, 22 bp, Homo sapiens
agcagctgcagagggctccccc

SEQ ID NO: 9209706 - DNA, 22 bp, Homo sapiens
agcagctgcagggagggtctgc

SEQ ID NO: 9209707 - DNA, 22 bp, Homo sapiens
agcaggagcatttccatgattc

SEQ ID NO: 9209708 - DNA, 22 bp, Homo sapiens
agcagcaggctagggaactgct

SEQ ID NO: 9209709 - DNA, 22 bp, Homo sapiens
agcagcaggctgtgtggactga

SEQ ID NO: 9209710 - DNA, 20 bp, Homo sapiens
agcagcagatgttggaggtg

SEQ ID NO: 9209711 - DNA, 22 bp, Homo sapiens
agcagcaggagccgtggggtga

SEQ ID NO: 9209712 - DNA, 17 bp, Homo sapiens
caagagagatgactgga

SEQ ID NO: 9209713 - DNA, 22 bp, Homo sapiens
caagagacttatgtggaaacct

SEQ ID NO: 9209714 - DNA, 22 bp, Homo sapiens
caagagctagactttgtcagga

SEQ ID NO: 9209715 - DNA, 22 bp, Homo sapiens
agcagcaggcttaaggaaaagt

SEQ ID NO: 9209716 - DNA, 22 bp, Homo sapiens
agcagcagggacaaaggaacag

SEQ ID NO: 9209717 - DNA, 22 bp, Homo sapiens
agcagccacccagctgctcatt

SEQ ID NO: 9209718 - DNA, 22 bp, Homo sapiens
agcagccacccagctgctcatt

SEQ ID NO: 9209719 - DNA, 22 bp, Homo sapiens
agcagctccctcctcagccacc

SEQ ID NO: 9209720 - DNA, 22 bp, Homo sapiens
agcagctccctcctcagccacc

SEQ ID NO: 9209721 - DNA, 22 bp, Homo sapiens
agcagctccctcctcagccacc

SEQ ID NO: 9209722 - DNA, 22 bp, Homo sapiens
agcagctcccctcatgctccac

SEQ ID NO: 9209723 - DNA, 22 bp, Homo sapiens
agcaaactaattgcagttctgg

SEQ ID NO: 9209724 - DNA, 22 bp, Homo sapiens
caaaagtcttcctattctctta

SEQ ID NO: 9209725 - DNA, 21 bp, Homo sapiens
agcacagctttaagccatgtg

SEQ ID NO: 9209726 - DNA, 21 bp, Homo sapiens
agcacagctttaagccatgtg

SEQ ID NO: 9209727 - DNA, 22 bp, Homo sapiens
agcacagcttagcacctggcac

SEQ ID NO: 9209728 - DNA, 22 bp, Homo sapiens
agcacagcttcaccgagcccat

SEQ ID NO: 9209729 - DNA, 22 bp, Homo sapiens
agcaaagccgagacagccagtg

SEQ ID NO: 9209730 - DNA, 20 bp, Homo sapiens
agcaaagcctttagagtttg

SEQ ID NO: 9209731 - DNA, 22 bp, Homo sapiens
agcaaagcaccatatggcagtt

SEQ ID NO: 9209732 - DNA, 22 bp, Homo sapiens
agcaaagcaccatatggcagtt

SEQ ID NO: 9209733 - DNA, 22 bp, Homo sapiens
agcaaagatgtccggggcaagc

SEQ ID NO: 9209734 - DNA, 22 bp, Homo sapiens
agcaaagcagtggctaagctga

SEQ ID NO: 9209735 - DNA, 22 bp, Homo sapiens
agcacatgcacagtgctacact

SEQ ID NO: 9209736 - DNA, 23 bp, Homo sapiens
agcacatcaaagcagggaggaga

SEQ ID NO: 9209737 - DNA, 22 bp, Homo sapiens
agcaccaggctgttggaagccc

SEQ ID NO: 9209738 - DNA, 22 bp, Homo sapiens
caagacctcaaaatgagagggg

SEQ ID NO: 9209739 - DNA, 22 bp, Homo sapiens
agcaccagctcaaggtgcacct

SEQ ID NO: 9209740 - DNA, 22 bp, Homo sapiens
agcaccagagctatgggcctgc

SEQ ID NO: 9209741 - DNA, 22 bp, Homo sapiens
caaattaccctcaacatctaga

SEQ ID NO: 9209742 - DNA, 22 bp, Homo sapiens
caaatattccaggtacatccct

SEQ ID NO: 9209743 - DNA, 22 bp, Homo sapiens
caaatattccaggtacatccct

SEQ ID NO: 9209744 - DNA, 20 bp, Homo sapiens
caacagaggggtctggagta

SEQ ID NO: 9209745 - DNA, 22 bp, Homo sapiens
caacagagagaccagaaacagg

SEQ ID NO: 9209746 - DNA, 22 bp, Homo sapiens
cagaggtcaggttggacattat

SEQ ID NO: 9209747 - DNA, 22 bp, Homo sapiens
agcctctgcacgggcacgggtg

SEQ ID NO: 9209748 - DNA, 22 bp, Homo sapiens
agcctctgatggctcccaagga

SEQ ID NO: 9209749 - DNA, 22 bp, Homo sapiens
agcctcctggagtttctgggat

SEQ ID NO: 9209750 - DNA, 22 bp, Homo sapiens
agcctctgatggctcccaagga

SEQ ID NO: 9209751 - DNA, 22 bp, Homo sapiens
agcctctgtgactcacaggtca

SEQ ID NO: 9209752 - DNA, 22 bp, Homo sapiens
agcctctgtagaaagcagtgtg

SEQ ID NO: 9209753 - DNA, 22 bp, Homo sapiens
agcctctgggggagctgggagc

SEQ ID NO: 9209754 - DNA, 22 bp, Homo sapiens
agcctctggccctagactgctt

SEQ ID NO: 9209755 - DNA, 22 bp, Homo sapiens
agcctctggccctagactgctt

SEQ ID NO: 9209756 - DNA, 18 bp, Homo sapiens
agcctctggcagagagaa

SEQ ID NO: 9209757 - DNA, 22 bp, Homo sapiens
agcctctggtcctccctcagct

SEQ ID NO: 9209758 - DNA, 23 bp, Homo sapiens
agcctcttttctcctgccctgca

SEQ ID NO: 9209759 - DNA, 22 bp, Homo sapiens
agcctgagagccaagctgtgca

SEQ ID NO: 9209760 - DNA, 22 bp, Homo sapiens
agcctgagagccaagctgtgca

SEQ ID NO: 9209761 - DNA, 22 bp, Homo sapiens
agcctgagccccatccagctga

SEQ ID NO: 9209762 - DNA, 22 bp, Homo sapiens
cagcagctcactgaataatgac

SEQ ID NO: 9209763 - DNA, 22 bp, Homo sapiens
cagcagctcactcaggtggctc

SEQ ID NO: 9209764 - DNA, 22 bp, Homo sapiens
cagcagctcactcaggtggctc

SEQ ID NO: 9209765 - DNA, 22 bp, Homo sapiens
cagcagctcactcaggtggctc

SEQ ID NO: 9209766 - DNA, 22 bp, Homo sapiens
cagcagctcagtctctcagtag

SEQ ID NO: 9209767 - DNA, 22 bp, Homo sapiens
cagcagctccaaagaatagcca

SEQ ID NO: 9209768 - DNA, 22 bp, Homo sapiens
cagcagctccaaagaatagcca

SEQ ID NO: 9209769 - DNA, 22 bp, Homo sapiens
cagcagctcccatccgctgagc

SEQ ID NO: 9209770 - DNA, 22 bp, Homo sapiens
cagcagctgactccaagagagc

SEQ ID NO: 9209771 - DNA, 22 bp, Homo sapiens
cagcagctcctctgcggctatg

SEQ ID NO: 9209772 - DNA, 22 bp, Homo sapiens
cagcagctcctctgcggctatg

SEQ ID NO: 9209773 - DNA, 22 bp, Homo sapiens
cagcagctcaggctgcttccca

SEQ ID NO: 9209774 - DNA, 22 bp, Homo sapiens
cagcagctcaggctccttccca

SEQ ID NO: 9209775 - DNA, 22 bp, Homo sapiens
cagcagctcaggctgcttccca

SEQ ID NO: 9209776 - DNA, 22 bp, Homo sapiens
cagcagctcagtctctcagtag

SEQ ID NO: 9209777 - DNA, 22 bp, Homo sapiens
cagcagctgaggcgctggcgtg

SEQ ID NO: 9209778 - DNA, 22 bp, Homo sapiens
agcctggagttcccaggagaag

SEQ ID NO: 9209779 - DNA, 22 bp, Homo sapiens
agcctggatcctaggctcagct

SEQ ID NO: 9209780 - DNA, 22 bp, Homo sapiens
agcctggatcctaggctcagct

SEQ ID NO: 9209781 - DNA, 23 bp, Homo sapiens
agcctggcacctgcagatcggag

SEQ ID NO: 9209782 - DNA, 23 bp, Homo sapiens
agcctggcacctgcagatcggag

SEQ ID NO: 9209783 - DNA, 22 bp, Homo sapiens
cagcaggatatggtggagagag

SEQ ID NO: 9209784 - DNA, 22 bp, Homo sapiens
cagccctgagagaaccatctat

SEQ ID NO: 9209785 - DNA, 22 bp, Homo sapiens
cagccctgagagaaccatctat

SEQ ID NO: 9209786 - DNA, 22 bp, Homo sapiens
agctcagagaatagggcttgag

SEQ ID NO: 9209787 - DNA, 22 bp, Homo sapiens
cagccctgcagagggcgctcct

SEQ ID NO: 9209788 - DNA, 22 bp, Homo sapiens
cagccctgagttagcccacgga

SEQ ID NO: 9209789 - DNA, 22 bp, Homo sapiens
cagcagtgtctccagcatcaca

SEQ ID NO: 9209790 - DNA, 22 bp, Homo sapiens
cagcagtgtctccagcatcaca

SEQ ID NO: 9209791 - DNA, 22 bp, Homo sapiens
cagcataggatgtggagccagg

SEQ ID NO: 9209792 - DNA, 22 bp, Homo sapiens
cagctcagtctggagagatgca

SEQ ID NO: 9209793 - DNA, 22 bp, Homo sapiens
cagctcagtcttgaagcactgg

SEQ ID NO: 9209794 - DNA, 22 bp, Homo sapiens
cagctcagtgatgccttcacag

SEQ ID NO: 9209795 - DNA, 22 bp, Homo sapiens
agctcctgaaaagcgcttgctt

SEQ ID NO: 9209796 - DNA, 18 bp, Homo sapiens
agctcctgaactctgtgg

SEQ ID NO: 9209797 - DNA, 22 bp, Homo sapiens
cagctctgagactgaggctatg

SEQ ID NO: 9209798 - DNA, 22 bp, Homo sapiens
cagctctgagactgaggctatg

SEQ ID NO: 9209799 - DNA, 22 bp, Homo sapiens
agctcctgattctcagagatag

SEQ ID NO: 9209800 - DNA, 22 bp, Homo sapiens
agctcctgatacatgcaggaat

SEQ ID NO: 9209801 - DNA, 22 bp, Homo sapiens
agctcctgatacatgcaggaat

SEQ ID NO: 9209802 - DNA, 23 bp, Homo sapiens
agctcctgaggccagcctctcct

SEQ ID NO: 9209803 - DNA, 22 bp, Homo sapiens
agctcctgagtagctttactca

SEQ ID NO: 9209804 - DNA, 20 bp, Homo sapiens
agctcctgagggttactttc

SEQ ID NO: 9209805 - DNA, 22 bp, Homo sapiens
agctcaggcaactctgggcccc

SEQ ID NO: 9209806 - DNA, 19 bp, Homo sapiens
cagctcaggactcagcccc

SEQ ID NO: 9209807 - DNA, 22 bp, Homo sapiens
cagctcaggcactggcgcggga

SEQ ID NO: 9209808 - DNA, 22 bp, Homo sapiens
cagctcaggctctccatgctcc

SEQ ID NO: 9209809 - DNA, 22 bp, Homo sapiens
agctcagcgggcttctggtaag

SEQ ID NO: 9209810 - DNA, 22 bp, Homo sapiens
agctcagcttcctctccatgct

SEQ ID NO: 9209811 - DNA, 21 bp, Homo sapiens
agctcagccgggcacagtggc

SEQ ID NO: 9209812 - DNA, 22 bp, Homo sapiens
agctcagccctcctgtgcagct

SEQ ID NO: 9209813 - DNA, 22 bp, Homo sapiens
agctcagccctcctgtgcagct

SEQ ID NO: 9209814 - DNA, 22 bp, Homo sapiens
agctcagcccgttagtaagccc

SEQ ID NO: 9209815 - DNA, 22 bp, Homo sapiens
agctcagcactgtcagcactcc

SEQ ID NO: 9209816 - DNA, 21 bp, Homo sapiens
agctcagcaagatggaggctc

SEQ ID NO: 9209817 - DNA, 22 bp, Homo sapiens
agctcagagggaggtgaagtgg

SEQ ID NO: 9209818 - DNA, 22 bp, Homo sapiens
agctcagagataatcaagagac

SEQ ID NO: 9209819 - DNA, 22 bp, Homo sapiens
agctcagagctcgggaggatgg

SEQ ID NO: 9209820 - DNA, 22 bp, Homo sapiens
agcccagggaaccaggaagtgg

SEQ ID NO: 9209821 - DNA, 22 bp, Homo sapiens
cagagggagccctccaggagca

SEQ ID NO: 9209822 - DNA, 22 bp, Homo sapiens
cagagggacagtgtaatgcata

SEQ ID NO: 9209823 - DNA, 22 bp, Homo sapiens
agcccaggctggagtgcagtgg

SEQ ID NO: 9209824 - DNA, 20 bp, Homo sapiens
agcccaggcctgtgtgagtc

SEQ ID NO: 9209825 - DNA, 22 bp, Homo sapiens
cagaggcatactcccagtcttg

SEQ ID NO: 9209826 - DNA, 22 bp, Homo sapiens
cagaggcatataattgctgggg

SEQ ID NO: 9209827 - DNA, 22 bp, Homo sapiens
cagaggcattactgaaaaggtg

SEQ ID NO: 9209828 - DNA, 22 bp, Homo sapiens
cagaggcagtggggttgctcct

SEQ ID NO: 9209829 - DNA, 21 bp, Homo sapiens
cagaggcaggtcctgggacgg

SEQ ID NO: 9209830 - DNA, 21 bp, Homo sapiens
cagaggcaggctctgtgtgtg

SEQ ID NO: 9209831 - DNA, 22 bp, Homo sapiens
agccatcctactacctcagcat

SEQ ID NO: 9209832 - DNA, 22 bp, Homo sapiens
cagagaaagaagcccattcatt

SEQ ID NO: 9209833 - DNA, 22 bp, Homo sapiens
cagagaaagaagcccattcatt

SEQ ID NO: 9209834 - DNA, 22 bp, Homo sapiens
cagagaaagaagcccattcatt

SEQ ID NO: 9209835 - DNA, 22 bp, Homo sapiens
agcccagatggtagccctagaa

SEQ ID NO: 9209836 - DNA, 22 bp, Homo sapiens
agcccaaggcttccctgctggc

SEQ ID NO: 9209837 - DNA, 22 bp, Homo sapiens
agcccagcaaagggaggttcag

SEQ ID NO: 9209838 - DNA, 22 bp, Homo sapiens
agcccagcactgggggcccagc

SEQ ID NO: 9209839 - DNA, 22 bp, Homo sapiens
cagaatgaaatgtaagaacacc

SEQ ID NO: 9209840 - DNA, 22 bp, Homo sapiens
cagaatgagtagcatcttcacc

SEQ ID NO: 9209841 - DNA, 22 bp, Homo sapiens
cagaatccagaattgctgaggt

SEQ ID NO: 9209842 - DNA, 19 bp, Homo sapiens
agccagaactagtgtttct

SEQ ID NO: 9209843 - DNA, 22 bp, Homo sapiens
agccagaaaaacaccaagagga

SEQ ID NO: 9209844 - DNA, 22 bp, Homo sapiens
cagaatgggaaggactgcagtt

SEQ ID NO: 9209845 - DNA, 22 bp, Homo sapiens
cagacagtggacttgataaagg

SEQ ID NO: 9209846 - DNA, 22 bp, Homo sapiens
cagaaatatgtgccatgcctta

SEQ ID NO: 9209847 - DNA, 22 bp, Homo sapiens
agccacagtgcaagagagaaaa

SEQ ID NO: 9209848 - DNA, 22 bp, Homo sapiens
agccacagtctgtagccagctt

SEQ ID NO: 9209849 - DNA, 22 bp, Homo sapiens
agccacagtctgtagccagctt

SEQ ID NO: 9209850 - DNA, 22 bp, Homo sapiens
agcatagcttagctgtggaggc

SEQ ID NO: 9209851 - DNA, 22 bp, Homo sapiens
gctgtcccgctgacttccagct

SEQ ID NO: 9209852 - DNA, 22 bp, Homo sapiens
gctgtcctggggagggagaatg

SEQ ID NO: 9209853 - DNA, 22 bp, Homo sapiens
gctgtcctgggaacaggcacta

SEQ ID NO: 9209854 - DNA, 22 bp, Homo sapiens
gctgtctgtcttcacatctcgc

SEQ ID NO: 9209855 - DNA, 22 bp, Homo sapiens
gctgtgtgctcacgtagtggaa

SEQ ID NO: 9209856 - DNA, 22 bp, Homo sapiens
gctgtgtgactgagagcctggc

SEQ ID NO: 9209857 - DNA, 22 bp, Homo sapiens
gctgtaggaagacagaatgcag

SEQ ID NO: 9209858 - DNA, 22 bp, Homo sapiens
gctgtatttattttctagggtt

SEQ ID NO: 9209859 - DNA, 22 bp, Homo sapiens
gctgtatttaacaactggctca

SEQ ID NO: 9209860 - DNA, 22 bp, Homo sapiens
gctgtattcctgcactgtatag

SEQ ID NO: 9209861 - DNA, 22 bp, Homo sapiens
gctgtcagtgaggtgagacatg

SEQ ID NO: 9209862 - DNA, 22 bp, Homo sapiens
gctggccaggaagagtctcaga

SEQ ID NO: 9209863 - DNA, 22 bp, Homo sapiens
gctggccacagatccccaggga

SEQ ID NO: 9209864 - DNA, 22 bp, Homo sapiens
gctggccacactgctgatggag

SEQ ID NO: 9209865 - DNA, 22 bp, Homo sapiens
gctggccaaagtgtacctggag

SEQ ID NO: 9209866 - DNA, 19 bp, Homo sapiens
gctggccacgccccagttg

SEQ ID NO: 9209867 - DNA, 22 bp, Homo sapiens
gctttttcaaatgaaagctggt

SEQ ID NO: 9209868 - DNA, 20 bp, Homo sapiens
gctttttctaatagcagtcc

SEQ ID NO: 9209869 - DNA, 22 bp, Homo sapiens
gcttttatgcacataagggtca

SEQ ID NO: 9209870 - DNA, 22 bp, Homo sapiens
gctgtgtgttcaataatgtgat

SEQ ID NO: 9209871 - DNA, 22 bp, Homo sapiens
gcttggttactgatggaaagga

SEQ ID NO: 9209872 - DNA, 21 bp, Homo sapiens
gcttggttttggttacttgcc

SEQ ID NO: 9209873 - DNA, 22 bp, Homo sapiens
gcttggagaagatgttctcaat

SEQ ID NO: 9209874 - DNA, 22 bp, Homo sapiens
ggagctgggaattggatcatct

SEQ ID NO: 9209875 - DNA, 22 bp, Homo sapiens
ggagctgggaccctgtcatctg

SEQ ID NO: 9209876 - DNA, 22 bp, Homo sapiens
ggagctgggaccctgtcatctg

SEQ ID NO: 9209877 - DNA, 18 bp, Homo sapiens
ggagctgggcctggttcc

SEQ ID NO: 9209878 - DNA, 22 bp, Homo sapiens
ggagctggccgcctatgtgcag

SEQ ID NO: 9209879 - DNA, 22 bp, Homo sapiens
ggagctggctacagagaactcc

SEQ ID NO: 9209880 - DNA, 22 bp, Homo sapiens
ggagctgtgttatccattccca

SEQ ID NO: 9209881 - DNA, 22 bp, Homo sapiens
ggagctggtcagccttgagcat

SEQ ID NO: 9209882 - DNA, 22 bp, Homo sapiens
ggagctggggttggcatcttcc

SEQ ID NO: 9209883 - DNA, 22 bp, Homo sapiens
ggagctggggttggcatcttcc

SEQ ID NO: 9209884 - DNA, 21 bp, Homo sapiens
ggagctggggagctggcccca

SEQ ID NO: 9209885 - DNA, 21 bp, Homo sapiens
ggagctggggagctggcccca

SEQ ID NO: 9209886 - DNA, 19 bp, Homo sapiens
ggagcttggtggctgtggc

SEQ ID NO: 9209887 - DNA, 22 bp, Homo sapiens
ggagaagaggagctggaagcct

SEQ ID NO: 9209888 - DNA, 22 bp, Homo sapiens
ggagaaagggactgatctgctc

SEQ ID NO: 9209889 - DNA, 22 bp, Homo sapiens
ggagaaagtacagcaggcaaca

SEQ ID NO: 9209890 - DNA, 22 bp, Homo sapiens
ggagaaagtcagctccaagcag

SEQ ID NO: 9209891 - DNA, 22 bp, Homo sapiens
ggagaagcagcttcttgatgaa

SEQ ID NO: 9209892 - DNA, 22 bp, Homo sapiens
ggagcctggcaatgctgcgtcc

SEQ ID NO: 9209893 - DNA, 22 bp, Homo sapiens
ggagcctggcccggcccttggc

SEQ ID NO: 9209894 - DNA, 22 bp, Homo sapiens
ggagccccaattgagcagtacg

SEQ ID NO: 9209895 - DNA, 22 bp, Homo sapiens
ggagccccaattgagcagtacg

SEQ ID NO: 9209896 - DNA, 22 bp, Homo sapiens
ggagcccagtcggggtgtaggt

SEQ ID NO: 9209897 - DNA, 22 bp, Homo sapiens
ggagccagtatttagtggtctt

SEQ ID NO: 9209898 - DNA, 18 bp, Homo sapiens
ggagcccagaggtgagtt

SEQ ID NO: 9209899 - DNA, 18 bp, Homo sapiens
ggagcccagaggacagga

SEQ ID NO: 9209900 - DNA, 22 bp, Homo sapiens
ggagcccaagtctgcactcggc

SEQ ID NO: 9209901 - DNA, 18 bp, Homo sapiens
ggagcccacggcgtccca

SEQ ID NO: 9209902 - DNA, 22 bp, Homo sapiens
ggagccatgttttcagcatgat

SEQ ID NO: 9209903 - DNA, 22 bp, Homo sapiens
ggaaggctttgtagaagtgcca

SEQ ID NO: 9209904 - DNA, 22 bp, Homo sapiens
ggaagggaaaattcattcggct

SEQ ID NO: 9209905 - DNA, 22 bp, Homo sapiens
ggaagggaatccatctggttag

SEQ ID NO: 9209906 - DNA, 22 bp, Homo sapiens
ggaaggcagaggtgtcgtgggg

SEQ ID NO: 9209907 - DNA, 22 bp, Homo sapiens
ggaaggcagtgaaggggctgat

SEQ ID NO: 9209908 - DNA, 22 bp, Homo sapiens
ggaaggctaataatgcaagaaa

SEQ ID NO: 9209909 - DNA, 19 bp, Homo sapiens
ggaaggcagaggggctgtg

SEQ ID NO: 9209910 - DNA, 22 bp, Homo sapiens
ggacaggctgcatctgagcatg

SEQ ID NO: 9209911 - DNA, 22 bp, Homo sapiens
ggacaggcctggcacagtactg

SEQ ID NO: 9209912 - DNA, 22 bp, Homo sapiens
ggacaggccgcctcggtggggg

SEQ ID NO: 9209913 - DNA, 21 bp, Homo sapiens
ggacttggatggtggcagtag

SEQ ID NO: 9209914 - DNA, 21 bp, Homo sapiens
ggacttggatggtggcagtag

SEQ ID NO: 9209915 - DNA, 22 bp, Homo sapiens
ggactgggaatcagggagatgc

SEQ ID NO: 9209916 - DNA, 22 bp, Homo sapiens
ggactgggaatcagggagatgc

SEQ ID NO: 9209917 - DNA, 22 bp, Homo sapiens
ggagaaagaaatttttgattgg

SEQ ID NO: 9209918 - DNA, 22 bp, Homo sapiens
ggagaaagaagacgaacattgt

SEQ ID NO: 9209919 - DNA, 19 bp, Homo sapiens
ggacttggtttccaggctc

SEQ ID NO: 9209920 - DNA, 22 bp, Homo sapiens
ggacttggggaaggcacagtta

SEQ ID NO: 9209921 - DNA, 22 bp, Homo sapiens
ggacttggggaaggcacagtta

SEQ ID NO: 9209922 - DNA, 22 bp, Homo sapiens
ggagaaaggcatagcagaacct

SEQ ID NO: 9209923 - DNA, 22 bp, Homo sapiens
ggagaaaggcatagcagaacct

SEQ ID NO: 9209924 - DNA, 22 bp, Homo sapiens
ggagaaaggataggaatgtgct

SEQ ID NO: 9209925 - DNA, 22 bp, Homo sapiens
ggagaaagctatgtgggggagt

SEQ ID NO: 9209926 - DNA, 22 bp, Homo sapiens
ggagaaagctgtagtggaatgt

SEQ ID NO: 9209927 - DNA, 23 bp, Homo sapiens
gctcatcaggcttagagtcaagg

SEQ ID NO: 9209928 - DNA, 23 bp, Homo sapiens
gctcatcaggcttagagtcaagg

SEQ ID NO: 9209929 - DNA, 22 bp, Homo sapiens
gctcccagatttcagccttgtg

SEQ ID NO: 9209930 - DNA, 22 bp, Homo sapiens
gctagtccacagccatccaggc

SEQ ID NO: 9209931 - DNA, 22 bp, Homo sapiens
gctcagggagtttcacagtgta

SEQ ID NO: 9209932 - DNA, 22 bp, Homo sapiens
gctcagggagtttcacagtgta

SEQ ID NO: 9209933 - DNA, 20 bp, Homo sapiens
gctcagggcctgggtctgga

SEQ ID NO: 9209934 - DNA, 20 bp, Homo sapiens
gctcagggcctgggtctgga

SEQ ID NO: 9209935 - DNA, 22 bp, Homo sapiens
gctagagaccagaggccttgaa

SEQ ID NO: 9209936 - DNA, 19 bp, Homo sapiens
gctagaagatagaatgaaa

SEQ ID NO: 9209937 - DNA, 22 bp, Homo sapiens
gctaggagccgctgcactaggt

SEQ ID NO: 9209938 - DNA, 22 bp, Homo sapiens
gctagctttataatgctgggcg

SEQ ID NO: 9209939 - DNA, 22 bp, Homo sapiens
gctctctgaggtgctggcagag

SEQ ID NO: 9209940 - DNA, 22 bp, Homo sapiens
gctctccaggtctcatgcactg

SEQ ID NO: 9209941 - DNA, 22 bp, Homo sapiens
gctctcctgtgcagatgctgct

SEQ ID NO: 9209942 - DNA, 22 bp, Homo sapiens
gctccctctgctcaggcacttg

SEQ ID NO: 9209943 - DNA, 20 bp, Homo sapiens
gctccccttctctgggcctc

SEQ ID NO: 9209944 - DNA, 22 bp, Homo sapiens
gctccccattgatctgcaggct

SEQ ID NO: 9209945 - DNA, 22 bp, Homo sapiens
gctccctccatgaggcagaccg

SEQ ID NO: 9209946 - DNA, 22 bp, Homo sapiens
gctccctcccaccagcctgcag

SEQ ID NO: 9209947 - DNA, 22 bp, Homo sapiens
gctccctcccaccagcctgcag

SEQ ID NO: 9209948 - DNA, 22 bp, Homo sapiens
gctcccagcattgctgctgaat

SEQ ID NO: 9209949 - DNA, 22 bp, Homo sapiens
gctctgggtagccactgcctgg

SEQ ID NO: 9209950 - DNA, 22 bp, Homo sapiens
gctctgggtagccactgcctgg

SEQ ID NO: 9209951 - DNA, 22 bp, Homo sapiens
gctctggggttggaaagtgatc

SEQ ID NO: 9209952 - DNA, 22 bp, Homo sapiens
gctctctgccatatgaggatac

SEQ ID NO: 9209953 - DNA, 22 bp, Homo sapiens
gctgcctgaagtgtctacactg

SEQ ID NO: 9209954 - DNA, 23 bp, Homo sapiens
gctgcctctgttggtcttcagtt

SEQ ID NO: 9209955 - DNA, 22 bp, Homo sapiens
gctgctggaacaaatcacccca

SEQ ID NO: 9209956 - DNA, 22 bp, Homo sapiens
gctgctggaacaaatcacccca

SEQ ID NO: 9209957 - DNA, 19 bp, Homo sapiens
gctgctggctctggctgga

SEQ ID NO: 9209958 - DNA, 22 bp, Homo sapiens
gctgctgggaatgaacagtgtt

SEQ ID NO: 9209959 - DNA, 22 bp, Homo sapiens
gctgctgggcaccccctgagct

SEQ ID NO: 9209960 - DNA, 22 bp, Homo sapiens
gctgctggggtcacatggtaag

SEQ ID NO: 9209961 - DNA, 22 bp, Homo sapiens
gctgctgggggaacagttaaaa

SEQ ID NO: 9209962 - DNA, 22 bp, Homo sapiens
gctggagcttgagaggacaggg

SEQ ID NO: 9209963 - DNA, 22 bp, Homo sapiens
gctggagctgcagcctgggcct

SEQ ID NO: 9209964 - DNA, 22 bp, Homo sapiens
gctgctggggtggagaaacgct

SEQ ID NO: 9209965 - DNA, 22 bp, Homo sapiens
gctgctggggtggagaaacgct

SEQ ID NO: 9209966 - DNA, 22 bp, Homo sapiens
gctgctggtcctcagagctcat

SEQ ID NO: 9209967 - DNA, 22 bp, Homo sapiens
gctgctggtcctcagagctcat

SEQ ID NO: 9209968 - DNA, 22 bp, Homo sapiens
gctggagttggcaaggcatgta

SEQ ID NO: 9209969 - DNA, 22 bp, Homo sapiens
gctggaggtttcacctgagttt

SEQ ID NO: 9209970 - DNA, 22 bp, Homo sapiens
gctggaggggtaataggatggg

SEQ ID NO: 9209971 - DNA, 22 bp, Homo sapiens
gctggaggtagggaggtcctgt

SEQ ID NO: 9209972 - DNA, 22 bp, Homo sapiens
gctggaggtggtgagaaaaggt

SEQ ID NO: 9209973 - DNA, 22 bp, Homo sapiens
gctggaggtagggaggtcctgt

SEQ ID NO: 9209974 - DNA, 22 bp, Homo sapiens
gctgcagggctctcacaggggg

SEQ ID NO: 9209975 - DNA, 22 bp, Homo sapiens
gctgcagggagctggaaggctc

SEQ ID NO: 9209976 - DNA, 22 bp, Homo sapiens
gctgcaggggggtctggacttg

SEQ ID NO: 9209977 - DNA, 22 bp, Homo sapiens
gctgcaggcgcctgcggtctct

SEQ ID NO: 9209978 - DNA, 22 bp, Homo sapiens
gctgcaggctctgcaggaattg

SEQ ID NO: 9209979 - DNA, 22 bp, Homo sapiens
gctgcaggctgtggcaggggag

SEQ ID NO: 9209980 - DNA, 22 bp, Homo sapiens
gctgcagggaatgtatggattt

SEQ ID NO: 9209981 - DNA, 22 bp, Homo sapiens
gctgcaggatgaggctctgctc

SEQ ID NO: 9209982 - DNA, 18 bp, Homo sapiens
gctgcaggcgcctgcggt

SEQ ID NO: 9209983 - DNA, 22 bp, Homo sapiens
gctgcaggcattttcctgggca

SEQ ID NO: 9209984 - DNA, 22 bp, Homo sapiens
gctgagtgaggtccagagcttg

SEQ ID NO: 9209985 - DNA, 22 bp, Homo sapiens
gctgagtgtaatgatggcagag

SEQ ID NO: 9209986 - DNA, 17 bp, Homo sapiens
gctgagtgcagggagtc

SEQ ID NO: 9209987 - DNA, 22 bp, Homo sapiens
gctgaggttttctgcctgctca

SEQ ID NO: 9209988 - DNA, 18 bp, Homo sapiens
gctgaggtggtgtcagag

SEQ ID NO: 9209989 - DNA, 23 bp, Homo sapiens
gctgaggtacatttacaggaaga

SEQ ID NO: 9209990 - DNA, 22 bp, Homo sapiens
gcagcaagaggtgccatcttga

SEQ ID NO: 9209991 - DNA, 21 bp, Homo sapiens
gcagcaaatgacaacagtgag

SEQ ID NO: 9209992 - DNA, 18 bp, Homo sapiens
gcagagtgcgtctctgtg

SEQ ID NO: 9209993 - DNA, 22 bp, Homo sapiens
gcagaaggatccgcaggtgcaa

SEQ ID NO: 9209994 - DNA, 20 bp, Homo sapiens
gcacccagcttcttgttcta

SEQ ID NO: 9209995 - DNA, 22 bp, Homo sapiens
gcacccagcccagggcgtgatg

SEQ ID NO: 9209996 - DNA, 21 bp, Homo sapiens
gcacccagccggttctcccag

SEQ ID NO: 9209997 - DNA, 22 bp, Homo sapiens
gcacccagaggtcagcagtgct

SEQ ID NO: 9209998 - DNA, 22 bp, Homo sapiens
gcacccagagggcagggtctcc

SEQ ID NO: 9209999 - DNA, 22 bp, Homo sapiens
gcacccagagggcagggtctcc

SEQ ID NO: 9210000 - DNA, 22 bp, Homo sapiens
gcagacaggcccagtggaggga

SEQ ID NO: 9210001 - DNA, 22 bp, Homo sapiens
gcaaggcagcgcggagtagcta

SEQ ID NO: 9210002 - DNA, 20 bp, Homo sapiens
gcaaggcaggttgaccaaga

SEQ ID NO: 9210003 - DNA, 20 bp, Homo sapiens
gcaaggcacagtgaggaggg

SEQ ID NO: 9210004 - DNA, 22 bp, Homo sapiens
gcaaggagactgtagggccaag

SEQ ID NO: 9210005 - DNA, 22 bp, Homo sapiens
gcaaggagcctggaggtgagtg

SEQ ID NO: 9210006 - DNA, 22 bp, Homo sapiens
gcaaggaagagcaggtggtgct

SEQ ID NO: 9210007 - DNA, 22 bp, Homo sapiens
gcaaggaagcagagttgctatc

SEQ ID NO: 9210008 - DNA, 17 bp, Homo sapiens
gcaaggaagttctttgc

SEQ ID NO: 9210009 - DNA, 22 bp, Homo sapiens
gagtaggaatgttctgccatct

SEQ ID NO: 9210010 - DNA, 22 bp, Homo sapiens
gagtaggaatgttctgccatct

SEQ ID NO: 9210011 - DNA, 22 bp, Homo sapiens
gcacagagagcagtgggggaca

SEQ ID NO: 9210012 - DNA, 22 bp, Homo sapiens
gcacagcacagcaacatgtttt

SEQ ID NO: 9210013 - DNA, 22 bp, Homo sapiens
gcacagagtcactagctaagca

SEQ ID NO: 9210014 - DNA, 22 bp, Homo sapiens
gcacatgtgagagtagaggcct

SEQ ID NO: 9210015 - DNA, 22 bp, Homo sapiens
gcacatgtcttattcactgtta

SEQ ID NO: 9210016 - DNA, 22 bp, Homo sapiens
gcagccagaagactcagaacaa

SEQ ID NO: 9210017 - DNA, 21 bp, Homo sapiens
gcagccagacgggattcagtt

SEQ ID NO: 9210018 - DNA, 22 bp, Homo sapiens
gcagccagcccctctgacctct

SEQ ID NO: 9210019 - DNA, 22 bp, Homo sapiens
gcagccagcaggaagcgggaga

SEQ ID NO: 9210020 - DNA, 22 bp, Homo sapiens
gcagccaggaaagctggaccct

SEQ ID NO: 9210021 - DNA, 22 bp, Homo sapiens
gcagcagcccagggctctcaga

SEQ ID NO: 9210022 - DNA, 22 bp, Homo sapiens
gcagcaagtctagtttgtaggc

SEQ ID NO: 9210023 - DNA, 19 bp, Homo sapiens
gcagcaatagaagacaaat

SEQ ID NO: 9210024 - DNA, 22 bp, Homo sapiens
gcagcagaaggccaaggggagc

SEQ ID NO: 9210025 - DNA, 22 bp, Homo sapiens
gcagcagaaggccaaggggagc

SEQ ID NO: 9210026 - DNA, 22 bp, Homo sapiens
gcagcacacggtggtgccctgg

SEQ ID NO: 9210027 - DNA, 22 bp, Homo sapiens
gcagcagaagtagaagtacagg

SEQ ID NO: 9210028 - DNA, 22 bp, Homo sapiens
gcagctggttaatgggagaatt

SEQ ID NO: 9210029 - DNA, 23 bp, Homo sapiens
gcagctggttagaagggaaggag

SEQ ID NO: 9210030 - DNA, 22 bp, Homo sapiens
gcagctggtctggcctagagta

SEQ ID NO: 9210031 - DNA, 22 bp, Homo sapiens
gcagctggggccacacttaggc

SEQ ID NO: 9210032 - DNA, 22 bp, Homo sapiens
gcagctgggccccagcctctcc

SEQ ID NO: 9210033 - DNA, 22 bp, Homo sapiens
gcagctggggaggtcgtgggga

SEQ ID NO: 9210034 - DNA, 22 bp, Homo sapiens
gcagctggctcagagaggtggg

SEQ ID NO: 9210035 - DNA, 22 bp, Homo sapiens
gcagctggctcagagaggtggg

SEQ ID NO: 9210036 - DNA, 22 bp, Homo sapiens
gcagcccaagcctgagcatcct

SEQ ID NO: 9210037 - DNA, 22 bp, Homo sapiens
gcagcccaatggactgagacag

SEQ ID NO: 9210038 - DNA, 17 bp, Homo sapiens
gcagccagtgcagcagg

SEQ ID NO: 9210039 - DNA, 22 bp, Homo sapiens
gcagccaggaagcccaggacac

SEQ ID NO: 9210040 - DNA, 22 bp, Homo sapiens
gcagccaggtttgaggaccact

SEQ ID NO: 9210041 - DNA, 22 bp, Homo sapiens
gcaggcatggtcgctgccaggt

SEQ ID NO: 9210042 - DNA, 22 bp, Homo sapiens
gcaggccaagccctcgcagaga

SEQ ID NO: 9210043 - DNA, 22 bp, Homo sapiens
gcaggccagctgtgcagatggg

SEQ ID NO: 9210044 - DNA, 22 bp, Homo sapiens
gcaggccagctgtgcagatggg

SEQ ID NO: 9210045 - DNA, 22 bp, Homo sapiens
gcaggccaggctaggggctgtc

SEQ ID NO: 9210046 - DNA, 22 bp, Homo sapiens
gcaggccattcaggagatgtgc

SEQ ID NO: 9210047 - DNA, 22 bp, Homo sapiens
gcaggcctaagagaaggcattg

SEQ ID NO: 9210048 - DNA, 22 bp, Homo sapiens
gcagggccagggctcaggctgt

SEQ ID NO: 9210049 - DNA, 22 bp, Homo sapiens
gcagggccagtgcagagaggaa

SEQ ID NO: 9210050 - DNA, 19 bp, Homo sapiens
gcagggtggcagagctctt

SEQ ID NO: 9210051 - DNA, 22 bp, Homo sapiens
gcagggccttagcagcggctgc

SEQ ID NO: 9210052 - DNA, 22 bp, Homo sapiens
gcaggtctagaagctgcctctg

SEQ ID NO: 9210053 - DNA, 22 bp, Homo sapiens
gcaggtagtgatcgagggtgac

SEQ ID NO: 9210054 - DNA, 22 bp, Homo sapiens
gcaggtagtgctaaagacttac

SEQ ID NO: 9210055 - DNA, 22 bp, Homo sapiens
gcaggtagtgatcgagggtgac

SEQ ID NO: 9210056 - DNA, 19 bp, Homo sapiens
gcaggtagagacagcagcc

SEQ ID NO: 9210057 - DNA, 22 bp, Homo sapiens
gcaggtagcattttttgacaaa

SEQ ID NO: 9210058 - DNA, 22 bp, Homo sapiens
gcaggtctggcatagagcctgc

SEQ ID NO: 9210059 - DNA, 22 bp, Homo sapiens
gcaggtctgttgattacagtca

SEQ ID NO: 9210060 - DNA, 22 bp, Homo sapiens
gcaggtcttgaaggtgtgattt

SEQ ID NO: 9210061 - DNA, 22 bp, Homo sapiens
gcaggtctcaatctgagcaggc

SEQ ID NO: 9210062 - DNA, 22 bp, Homo sapiens
gcaggtctggagggcactgggg

SEQ ID NO: 9210063 - DNA, 22 bp, Homo sapiens
gcaggtctatcaggctgcaggt

SEQ ID NO: 9210064 - DNA, 22 bp, Homo sapiens
gccccttccatcatgtgaggac

SEQ ID NO: 9210065 - DNA, 22 bp, Homo sapiens
gcccgcgccagcctctccatct

SEQ ID NO: 9210066 - DNA, 22 bp, Homo sapiens
gccctcagagttccccacagtg

SEQ ID NO: 9210067 - DNA, 22 bp, Homo sapiens
gccctcagaggacagctgactt

SEQ ID NO: 9210068 - DNA, 22 bp, Homo sapiens
gccctgagtggtacctgtgggt

SEQ ID NO: 9210069 - DNA, 22 bp, Homo sapiens
gcccctggctggccagctcctc

SEQ ID NO: 9210070 - DNA, 22 bp, Homo sapiens
gcccctccgggcgcgtcatagc

SEQ ID NO: 9210071 - DNA, 22 bp, Homo sapiens
gcccctctccttgtgcacctgc

SEQ ID NO: 9210072 - DNA, 22 bp, Homo sapiens
gccccaggtggtaaacctaaga

SEQ ID NO: 9210073 - DNA, 22 bp, Homo sapiens
gccccaggggaggtgccctgca

SEQ ID NO: 9210074 - DNA, 22 bp, Homo sapiens
gccccaggtggtaaacctaaga

SEQ ID NO: 9210075 - DNA, 22 bp, Homo sapiens
gcccctcccagtcaggagcact

SEQ ID NO: 9210076 - DNA, 22 bp, Homo sapiens
gcccctcccagtcaggagcact

SEQ ID NO: 9210077 - DNA, 22 bp, Homo sapiens
gcccctccatccatcaccgggg

SEQ ID NO: 9210078 - DNA, 22 bp, Homo sapiens
gcccaaggtcccatggcagcac

SEQ ID NO: 9210079 - DNA, 22 bp, Homo sapiens
gccccaggggaggtgccctgca

SEQ ID NO: 9210080 - DNA, 22 bp, Homo sapiens
gcccacaggggacctggtggct

SEQ ID NO: 9210081 - DNA, 22 bp, Homo sapiens
gcccacagctcgttcctctcct

SEQ ID NO: 9210082 - DNA, 22 bp, Homo sapiens
gccctgcctgtctgctgggagg

SEQ ID NO: 9210083 - DNA, 22 bp, Homo sapiens
gccctgctccaggagaataccc

SEQ ID NO: 9210084 - DNA, 22 bp, Homo sapiens
gccctgctgctggcagaggcgc

SEQ ID NO: 9210085 - DNA, 22 bp, Homo sapiens
gccctgctgtttagagagctac

SEQ ID NO: 9210086 - DNA, 22 bp, Homo sapiens
gccctgctgtcttcagagtata

SEQ ID NO: 9210087 - DNA, 22 bp, Homo sapiens
gccctgctgtcttcagagtata

SEQ ID NO: 9210088 - DNA, 22 bp, Homo sapiens
gcctcaggtaaaacttgagttt

SEQ ID NO: 9210089 - DNA, 22 bp, Homo sapiens
gcctcagggggagaggccagct

SEQ ID NO: 9210090 - DNA, 22 bp, Homo sapiens
gcctcagggggagaggccagct

SEQ ID NO: 9210091 - DNA, 22 bp, Homo sapiens
gcctcagggggagaggccagct

SEQ ID NO: 9210092 - DNA, 22 bp, Homo sapiens
gccctggagagggatatggcat

SEQ ID NO: 9210093 - DNA, 22 bp, Homo sapiens
gccctgcttctggcatgcagaa

SEQ ID NO: 9210094 - DNA, 22 bp, Homo sapiens
gccctgcttctggcatgcagaa

SEQ ID NO: 9210095 - DNA, 22 bp, Homo sapiens
gccctggacagtgacggtgacc

SEQ ID NO: 9210096 - DNA, 22 bp, Homo sapiens
gccctggaatctctccatggga

SEQ ID NO: 9210097 - DNA, 22 bp, Homo sapiens
gccctggaatctctccatggga

SEQ ID NO: 9210098 - DNA, 22 bp, Homo sapiens
gcctcattacagccaggaagca

SEQ ID NO: 9210099 - DNA, 22 bp, Homo sapiens
gcctcatcgctgctcggcccgg

SEQ ID NO: 9210100 - DNA, 22 bp, Homo sapiens
gcctcaggtgcatctctcattc

SEQ ID NO: 9210101 - DNA, 22 bp, Homo sapiens
gcctcaggtgcatctctcattc

SEQ ID NO: 9210102 - DNA, 22 bp, Homo sapiens
gcctcagtctcccgagtagctg

SEQ ID NO: 9210103 - DNA, 19 bp, Homo sapiens
gcctgcagaaaaggcaggg

SEQ ID NO: 9210104 - DNA, 22 bp, Homo sapiens
gcctgagtgcatctgcagacat

SEQ ID NO: 9210105 - DNA, 22 bp, Homo sapiens
gcctgcacccacaggcatggcc

SEQ ID NO: 9210106 - DNA, 22 bp, Homo sapiens
gcctgcaagatggctggtcact

SEQ ID NO: 9210107 - DNA, 21 bp, Homo sapiens
gcctgcacacagtaggtgcac

SEQ ID NO: 9210108 - DNA, 22 bp, Homo sapiens
gcctgagggctcctagcaggct

SEQ ID NO: 9210109 - DNA, 18 bp, Homo sapiens
gcctccctggctacactt

SEQ ID NO: 9210110 - DNA, 22 bp, Homo sapiens
gcctccctgtagaggccagcct

SEQ ID NO: 9210111 - DNA, 18 bp, Homo sapiens
gcctccctggctacactt

SEQ ID NO: 9210112 - DNA, 22 bp, Homo sapiens
gcctccctccaccactgcaggt

SEQ ID NO: 9210113 - DNA, 22 bp, Homo sapiens
gcctcccctgcaattgtccttg

SEQ ID NO: 9210114 - DNA, 22 bp, Homo sapiens
gcctccctggcccacagcagcg

SEQ ID NO: 9210115 - DNA, 22 bp, Homo sapiens
gcctccctccaccactgcaggt

SEQ ID NO: 9210116 - DNA, 22 bp, Homo sapiens
gcctccccaggggtgtcatgag

SEQ ID NO: 9210117 - DNA, 22 bp, Homo sapiens
gcctggagaagatggaactagc

SEQ ID NO: 9210118 - DNA, 22 bp, Homo sapiens
gcctggagacaaggacaaaggg

SEQ ID NO: 9210119 - DNA, 22 bp, Homo sapiens
gccaggctaagaaaggtgtgat

SEQ ID NO: 9210120 - DNA, 22 bp, Homo sapiens
gccaggctaagaaaggtgtgat

SEQ ID NO: 9210121 - DNA, 22 bp, Homo sapiens
gccaggctcagcagtcaacctg

SEQ ID NO: 9210122 - DNA, 22 bp, Homo sapiens
gccaggctaagaaaggtgtgat

SEQ ID NO: 9210123 - DNA, 22 bp, Homo sapiens
gccaggctcagcagtcaacctg

SEQ ID NO: 9210124 - DNA, 22 bp, Homo sapiens
gccaggctcagtagcgattcct

SEQ ID NO: 9210125 - DNA, 22 bp, Homo sapiens
gccaggcgggtctcaaactcct

SEQ ID NO: 9210126 - DNA, 22 bp, Homo sapiens
gccaggcgggtctcaaactcct

SEQ ID NO: 9210127 - DNA, 19 bp, Homo sapiens
gccaggctccatagccggc

SEQ ID NO: 9210128 - DNA, 22 bp, Homo sapiens
gccaggctccaggccctcctga

SEQ ID NO: 9210129 - DNA, 22 bp, Homo sapiens
gccaggctccaggccctcctga

SEQ ID NO: 9210130 - DNA, 22 bp, Homo sapiens
gccaggctccccggatccctgg

SEQ ID NO: 9210131 - DNA, 22 bp, Homo sapiens
gccaggctccccggatccctgg

SEQ ID NO: 9210132 - DNA, 23 bp, Homo sapiens
gccaggctccggtctgtggccac

SEQ ID NO: 9210133 - DNA, 23 bp, Homo sapiens
gccaggctccggtctgtggccac

SEQ ID NO: 9210134 - DNA, 23 bp, Homo sapiens
gccaggctccggtctgtggccac

SEQ ID NO: 9210135 - DNA, 22 bp, Homo sapiens
gccaggctctcagtgactgccc

SEQ ID NO: 9210136 - DNA, 22 bp, Homo sapiens
gcccaaggtatatcagagacag

SEQ ID NO: 9210137 - DNA, 22 bp, Homo sapiens
gcccaaggtcacacacaggaag

SEQ ID NO: 9210138 - DNA, 20 bp, Homo sapiens
gcccaaggtccagaaggggg

SEQ ID NO: 9210139 - DNA, 20 bp, Homo sapiens
gcccaaggtccagaaggggg

SEQ ID NO: 9210140 - DNA, 22 bp, Homo sapiens
gcccaagccggagctgggagag

SEQ ID NO: 9210141 - DNA, 22 bp, Homo sapiens
gcccaagctccgcctcctgtcg

SEQ ID NO: 9210142 - DNA, 22 bp, Homo sapiens
gcccaagctccgcctcctgtcg

SEQ ID NO: 9210143 - DNA, 20 bp, Homo sapiens
gcccaagcgccggccgcaga

SEQ ID NO: 9210144 - DNA, 18 bp, Homo sapiens
gccaggaagcatggggac

SEQ ID NO: 9210145 - DNA, 22 bp, Homo sapiens
gccaggaaggctccctggtcac

SEQ ID NO: 9210146 - DNA, 22 bp, Homo sapiens
gccaggaaattcatgccagatc

SEQ ID NO: 9210147 - DNA, 22 bp, Homo sapiens
gccaggaaattcatgccagatc

SEQ ID NO: 9210148 - DNA, 22 bp, Homo sapiens
gccaggaacacaatgccaagct

SEQ ID NO: 9210149 - DNA, 22 bp, Homo sapiens
gccaggaacacaatgccaagct

SEQ ID NO: 9210150 - DNA, 18 bp, Homo sapiens
gccaggaagaggaatgtg

SEQ ID NO: 9210151 - DNA, 22 bp, Homo sapiens
gccaggaagcagttagatgggt

SEQ ID NO: 9210152 - DNA, 18 bp, Homo sapiens
gccaggaagcatggggac

SEQ ID NO: 9210153 - DNA, 22 bp, Homo sapiens
gccaggaaaaacgtggtgggag

SEQ ID NO: 9210154 - DNA, 22 bp, Homo sapiens
gccaggaaaaaccggccctgct

SEQ ID NO: 9210155 - DNA, 22 bp, Homo sapiens
gccaggaaagccactggcatac

SEQ ID NO: 9210156 - DNA, 22 bp, Homo sapiens
gccaggaaagccactggcatac

SEQ ID NO: 9210157 - DNA, 19 bp, Homo sapiens
gccaggaaagaatcaggcg

SEQ ID NO: 9210158 - DNA, 22 bp, Homo sapiens
gccagctgttcagacattcttt

SEQ ID NO: 9210159 - DNA, 22 bp, Homo sapiens
gccagctgtttcagagcccagt

SEQ ID NO: 9210160 - DNA, 22 bp, Homo sapiens
gccagctgtgcttttcctaaaa

SEQ ID NO: 9210161 - DNA, 22 bp, Homo sapiens
gccagctgtctaagagagtaaa

SEQ ID NO: 9210162 - DNA, 22 bp, Homo sapiens
gccagctgtaagcagtgattct

SEQ ID NO: 9210163 - DNA, 22 bp, Homo sapiens
gccagctgtatctttggccagc

SEQ ID NO: 9210164 - DNA, 22 bp, Homo sapiens
gccagctgtaggtggtgggttg

SEQ ID NO: 9210165 - DNA, 22 bp, Homo sapiens
gccagctgtaagctggggtgat

SEQ ID NO: 9210166 - DNA, 22 bp, Homo sapiens
gccagctgcaaagtatgttgaa

SEQ ID NO: 9210167 - DNA, 22 bp, Homo sapiens
gccagctggtaggcacctagcc

SEQ ID NO: 9210168 - DNA, 22 bp, Homo sapiens
gccagctggtaggcacctagcc

SEQ ID NO: 9210169 - DNA, 22 bp, Homo sapiens
gccagctggtaggcacctagcc

SEQ ID NO: 9210170 - DNA, 22 bp, Homo sapiens
gccagaagactggagtcagctg

SEQ ID NO: 9210171 - DNA, 22 bp, Homo sapiens
gccagaagactggagtcagctg

SEQ ID NO: 9210172 - DNA, 22 bp, Homo sapiens
gccagaaggggtggatccaggc

SEQ ID NO: 9210173 - DNA, 22 bp, Homo sapiens
gccagaaacatacacatcactt

SEQ ID NO: 9210174 - DNA, 22 bp, Homo sapiens
gccagctgagcaaattccagct

SEQ ID NO: 9210175 - DNA, 22 bp, Homo sapiens
gccagagacacttggaggtaga

SEQ ID NO: 9210176 - DNA, 22 bp, Homo sapiens
gcagtttagtagatgacattat

SEQ ID NO: 9210177 - DNA, 22 bp, Homo sapiens
gcagtgtttttcaatgcttcca

SEQ ID NO: 9210178 - DNA, 22 bp, Homo sapiens
gcagtgttttacagaccagcat

SEQ ID NO: 9210179 - DNA, 22 bp, Homo sapiens
gcagtgtttgtgttctcacatg

SEQ ID NO: 9210180 - DNA, 22 bp, Homo sapiens
gcagtgttggcaggatggggct

SEQ ID NO: 9210181 - DNA, 22 bp, Homo sapiens
gcagtgttggtttgctctgcag

SEQ ID NO: 9210182 - DNA, 22 bp, Homo sapiens
gcagtgttgctaggtgcggtga

SEQ ID NO: 9210183 - DNA, 22 bp, Homo sapiens
gcagtgttgtgatccaggtctt

SEQ ID NO: 9210184 - DNA, 22 bp, Homo sapiens
gcagtgttgttaaaagattaga

SEQ ID NO: 9210185 - DNA, 22 bp, Homo sapiens
gcagtgtttcaaatcaaaggca

SEQ ID NO: 9210186 - DNA, 22 bp, Homo sapiens
gcagtgtttacatattagaaac

SEQ ID NO: 9210187 - DNA, 22 bp, Homo sapiens
gcagtgtttcccagagatggaa

SEQ ID NO: 9210188 - DNA, 22 bp, Homo sapiens
gcagtgtttcagtgctttttct

SEQ ID NO: 9210189 - DNA, 22 bp, Homo sapiens
gcagtgtttggatccatagcga

SEQ ID NO: 9210190 - DNA, 23 bp, Homo sapiens
gcagtgtttgcttcatcttatcc

SEQ ID NO: 9210191 - DNA, 22 bp, Homo sapiens
gcattacaggctgtaagatgca

SEQ ID NO: 9210192 - DNA, 22 bp, Homo sapiens
gcattacaggaatttgttactg

SEQ ID NO: 9210193 - DNA, 22 bp, Homo sapiens
gcattacagcagttcaacttgg

SEQ ID NO: 9210194 - DNA, 22 bp, Homo sapiens
gcattacacatagacattcgtt

SEQ ID NO: 9210195 - DNA, 22 bp, Homo sapiens
gccactgttgctcctcaggaaa

SEQ ID NO: 9210196 - DNA, 20 bp, Homo sapiens
gccactgtgcttacactgct

SEQ ID NO: 9210197 - DNA, 22 bp, Homo sapiens
gccacccttatcccatgcttct

SEQ ID NO: 9210198 - DNA, 22 bp, Homo sapiens
gccaccctggacgcactgttcg

SEQ ID NO: 9210199 - DNA, 22 bp, Homo sapiens
gccacctcccaggacgaggctg

SEQ ID NO: 9210200 - DNA, 22 bp, Homo sapiens
gccacctccttattccacctgt

SEQ ID NO: 9210201 - DNA, 22 bp, Homo sapiens
gccacctcggctttctctgctc

SEQ ID NO: 9210202 - DNA, 22 bp, Homo sapiens
gcattggttaagagctttgggg

SEQ ID NO: 9210203 - DNA, 22 bp, Homo sapiens
gcattggttcaaggttgtgcag

SEQ ID NO: 9210204 - DNA, 22 bp, Homo sapiens
gcattggtttacacagggtgaa

SEQ ID NO: 9210205 - DNA, 22 bp, Homo sapiens
gccaccctgagctgggccaggg

SEQ ID NO: 9210206 - DNA, 18 bp, Homo sapiens
gccaccctcctcgtctcc

SEQ ID NO: 9210207 - DNA, 22 bp, Homo sapiens
gccaccctgacgccgcagaccc

SEQ ID NO: 9210208 - DNA, 22 bp, Homo sapiens
gccaccctgcaaatgcccagga

SEQ ID NO: 9210209 - DNA, 22 bp, Homo sapiens
gccaccctggaccaccctgggc

SEQ ID NO: 9210210 - DNA, 20 bp, Homo sapiens
gtgcagcacttgggggtagg

SEQ ID NO: 9210211 - DNA, 22 bp, Homo sapiens
gtgaggatacttaagagaacac

SEQ ID NO: 9210212 - DNA, 22 bp, Homo sapiens
gtgaggagtctgaagcacataa

SEQ ID NO: 9210213 - DNA, 22 bp, Homo sapiens
gtgcagcaaagtttgagatata

SEQ ID NO: 9210214 - DNA, 22 bp, Homo sapiens
gtgcagcaaagtttgagatata

SEQ ID NO: 9210215 - DNA, 22 bp, Homo sapiens
gtgcagcaaactagtgcgaggg

SEQ ID NO: 9210216 - DNA, 22 bp, Homo sapiens
gtgaggcagcaggagcctctgt

SEQ ID NO: 9210217 - DNA, 22 bp, Homo sapiens
gtgcagggtagcgacggcagga

SEQ ID NO: 9210218 - DNA, 22 bp, Homo sapiens
gtgccagaaggttcccgctgca

SEQ ID NO: 9210219 - DNA, 22 bp, Homo sapiens
gtgccagagacatgactagctg

SEQ ID NO: 9210220 - DNA, 22 bp, Homo sapiens
gtgccagagattcctaaacttt

SEQ ID NO: 9210221 - DNA, 22 bp, Homo sapiens
gtgccagagtttgaggacaatt

SEQ ID NO: 9210222 - DNA, 22 bp, Homo sapiens
gtgccagaggccccaaacaagt

SEQ ID NO: 9210223 - DNA, 22 bp, Homo sapiens
gtgcagggcagccgaatgggct

SEQ ID NO: 9210224 - DNA, 22 bp, Homo sapiens
gtgcccaggcccaaggcaccac

SEQ ID NO: 9210225 - DNA, 22 bp, Homo sapiens
gtgctggcacccctctccagtt

SEQ ID NO: 9210226 - DNA, 22 bp, Homo sapiens
gtgccagctctccccacatctg

SEQ ID NO: 9210227 - DNA, 22 bp, Homo sapiens
gtgccagctctccccacatctg

SEQ ID NO: 9210228 - DNA, 22 bp, Homo sapiens
gtgccagccgcaccccaggaga

SEQ ID NO: 9210229 - DNA, 22 bp, Homo sapiens
gtgccagccgcaccccaggaga

SEQ ID NO: 9210230 - DNA, 22 bp, Homo sapiens
gtgccagcctggtgcgcctggg

SEQ ID NO: 9210231 - DNA, 22 bp, Homo sapiens
gtgccagggggcactgaacaga

SEQ ID NO: 9210232 - DNA, 22 bp, Homo sapiens
gtgccaggtgctaagctgtgct

SEQ ID NO: 9210233 - DNA, 22 bp, Homo sapiens
gtgcccagctccacctcacaga

SEQ ID NO: 9210234 - DNA, 22 bp, Homo sapiens
gtgagcagttgtgagccccaaa

SEQ ID NO: 9210235 - DNA, 22 bp, Homo sapiens
gtgagcagttgtataaagactt

SEQ ID NO: 9210236 - DNA, 22 bp, Homo sapiens
gtgagccaataccatgctgttc

SEQ ID NO: 9210237 - DNA, 22 bp, Homo sapiens
gtgaggagctctttgactcacg

SEQ ID NO: 9210238 - DNA, 22 bp, Homo sapiens
gtgaggagctgacactggggtg

SEQ ID NO: 9210239 - DNA, 22 bp, Homo sapiens
gtgaggagggctggtcccaggc

SEQ ID NO: 9210240 - DNA, 22 bp, Homo sapiens
gtgaggactggtaaggactgca

SEQ ID NO: 9210241 - DNA, 22 bp, Homo sapiens
gtcttttttacaccttacatca

SEQ ID NO: 9210242 - DNA, 22 bp, Homo sapiens
gtctttgtggtagtcctcagcc

SEQ ID NO: 9210243 - DNA, 22 bp, Homo sapiens
gtctttgttctgcactattgtc

SEQ ID NO: 9210244 - DNA, 21 bp, Homo sapiens
gtcttttaagtgaagagaggc

SEQ ID NO: 9210245 - DNA, 22 bp, Homo sapiens
gtctccagtgttcaggtgactg

SEQ ID NO: 9210246 - DNA, 22 bp, Homo sapiens
gtctccagttacagcagccagg

SEQ ID NO: 9210247 - DNA, 22 bp, Homo sapiens
gtcttggccgtgcagatgaaga

SEQ ID NO: 9210248 - DNA, 22 bp, Homo sapiens
gtctccagggctgctggcgcct

SEQ ID NO: 9210249 - DNA, 22 bp, Homo sapiens
gtctccagggctgctggcgcct

SEQ ID NO: 9210250 - DNA, 22 bp, Homo sapiens
gtctccagtgttcaggtgactg

SEQ ID NO: 9210251 - DNA, 23 bp, Homo sapiens
gtctttatagtggggcactttgt

SEQ ID NO: 9210252 - DNA, 22 bp, Homo sapiens
gtctagaatggatgagcatttt

SEQ ID NO: 9210253 - DNA, 22 bp, Homo sapiens
gtctatgatattttgttatagc

SEQ ID NO: 9210254 - DNA, 22 bp, Homo sapiens
gtctataagtacaattgcactc

SEQ ID NO: 9210255 - DNA, 22 bp, Homo sapiens
gtctccagaattcttgggaggg

SEQ ID NO: 9210256 - DNA, 22 bp, Homo sapiens
gtctccagatatcctacacaac

SEQ ID NO: 9210257 - DNA, 22 bp, Homo sapiens
gtctccagatatcctacacaac

SEQ ID NO: 9210258 - DNA, 22 bp, Homo sapiens
gtctccagcccactctagatat

SEQ ID NO: 9210259 - DNA, 22 bp, Homo sapiens
gtcctgcttcccacagaaaccg

SEQ ID NO: 9210260 - DNA, 22 bp, Homo sapiens
gtcctgcttgttaggcctagtc

SEQ ID NO: 9210261 - DNA, 22 bp, Homo sapiens
gtcctgctggcttcaggagatt

SEQ ID NO: 9210262 - DNA, 22 bp, Homo sapiens
gtcctgctctggcccaggtttg

SEQ ID NO: 9210263 - DNA, 22 bp, Homo sapiens
gtcctctgggctttgagcagtc

SEQ ID NO: 9210264 - DNA, 22 bp, Homo sapiens
gtcctctgtccctggggcacgg

SEQ ID NO: 9210265 - DNA, 22 bp, Homo sapiens
gtcctggcttagttcgctgtaa

SEQ ID NO: 9210266 - DNA, 23 bp, Homo sapiens
gtcctctggagagaaaggcagta

SEQ ID NO: 9210267 - DNA, 22 bp, Homo sapiens
gtccaggctgacccctagagga

SEQ ID NO: 9210268 - DNA, 22 bp, Homo sapiens
gtccaggctcaaaaggttgtta

SEQ ID NO: 9210269 - DNA, 22 bp, Homo sapiens
gtcagaatttacttaatagcca

SEQ ID NO: 9210270 - DNA, 22 bp, Homo sapiens
gtcagaagcatttgtggctgaa

SEQ ID NO: 9210271 - DNA, 22 bp, Homo sapiens
gtcagacacatttctttcagtg

SEQ ID NO: 9210272 - DNA, 22 bp, Homo sapiens
gtcagacaggaatgttgcaagt

SEQ ID NO: 9210273 - DNA, 22 bp, Homo sapiens
gtcacttgagcatttcttcttt

SEQ ID NO: 9210274 - DNA, 22 bp, Homo sapiens
gtcactgtatccaggttccagc

SEQ ID NO: 9210275 - DNA, 22 bp, Homo sapiens
gtcactcttccccatagcctac

SEQ ID NO: 9210276 - DNA, 21 bp, Homo sapiens
gtcagagatgcccaactgcct

SEQ ID NO: 9210277 - DNA, 22 bp, Homo sapiens
gtccagaagctcaagttgaact

SEQ ID NO: 9210278 - DNA, 22 bp, Homo sapiens
gtccagaaggaggtcaagttgg

SEQ ID NO: 9210279 - DNA, 21 bp, Homo sapiens
gtccagagagccggctcctga

SEQ ID NO: 9210280 - DNA, 22 bp, Homo sapiens
gtccagagagatcttctgatag

SEQ ID NO: 9210281 - DNA, 22 bp, Homo sapiens
gtccagcctgaagagtgggggc

SEQ ID NO: 9210282 - DNA, 22 bp, Homo sapiens
gtccagcccgggctccgccagc

SEQ ID NO: 9210283 - DNA, 22 bp, Homo sapiens
gtccagccctctgcctccaggt

SEQ ID NO: 9210284 - DNA, 22 bp, Homo sapiens
gtccagccaggctgcagcaccc

SEQ ID NO: 9210285 - DNA, 22 bp, Homo sapiens
gtccagcccctgactcccaggc

SEQ ID NO: 9210286 - DNA, 22 bp, Homo sapiens
gtatttttcattccaagtgaga

SEQ ID NO: 9210287 - DNA, 22 bp, Homo sapiens
gtatttttcattccaagtgaga

SEQ ID NO: 9210288 - DNA, 22 bp, Homo sapiens
gtatttttagtagagtcggggt

SEQ ID NO: 9210289 - DNA, 22 bp, Homo sapiens
gtatttttaggtaaggaaagta

SEQ ID NO: 9210290 - DNA, 22 bp, Homo sapiens
gtatttttcagttaggagctta

SEQ ID NO: 9210291 - DNA, 22 bp, Homo sapiens
gtatttttagtagagtcggggt

SEQ ID NO: 9210292 - DNA, 22 bp, Homo sapiens
gtatttttcagttaggagctta

SEQ ID NO: 9210293 - DNA, 22 bp, Homo sapiens
gtatttttaggtaaggaaagta

SEQ ID NO: 9210294 - DNA, 22 bp, Homo sapiens
gtatttttaggtaaggaaagta

SEQ ID NO: 9210295 - DNA, 22 bp, Homo sapiens
gtattttgttagggtgtggtat

SEQ ID NO: 9210296 - DNA, 22 bp, Homo sapiens
gtattttcatgatttcagacca

SEQ ID NO: 9210297 - DNA, 22 bp, Homo sapiens
gtaggcaaattatggaacattg

SEQ ID NO: 9210298 - DNA, 22 bp, Homo sapiens
gtacaattatttaaatggtgaa

SEQ ID NO: 9210299 - DNA, 22 bp, Homo sapiens
gtacaattaagtgcacaaatag

SEQ ID NO: 9210300 - DNA, 22 bp, Homo sapiens
gtacaatagcagttttcccttt

SEQ ID NO: 9210301 - DNA, 22 bp, Homo sapiens
gtaggggccagaaagacttaga

SEQ ID NO: 9210302 - DNA, 22 bp, Homo sapiens
gtaggagctcatggggccagga

SEQ ID NO: 9210303 - DNA, 22 bp, Homo sapiens
gtaggcagaccagtggatgggt

SEQ ID NO: 9210304 - DNA, 22 bp, Homo sapiens
gtaggagcattgagggtatgga

SEQ ID NO: 9210305 - DNA, 22 bp, Homo sapiens
gtagggcagaagttcaatgtgg

SEQ ID NO: 9210306 - DNA, 22 bp, Homo sapiens
gtagtggagtctcctgtcctgg

SEQ ID NO: 9210307 - DNA, 22 bp, Homo sapiens
gtagtcccagctaccccggagg

SEQ ID NO: 9210308 - DNA, 22 bp, Homo sapiens
gtacaaattgatacaggttttc

SEQ ID NO: 9210309 - DNA, 22 bp, Homo sapiens
ggtgaggaattggggactgacc

SEQ ID NO: 9210310 - DNA, 22 bp, Homo sapiens
ggtgagcactgccctgggtctc

SEQ ID NO: 9210311 - DNA, 22 bp, Homo sapiens
ggtgagcagctgtctgtatgga

SEQ ID NO: 9210312 - DNA, 22 bp, Homo sapiens
ggtggaaggcctggaaggaggc

SEQ ID NO: 9210313 - DNA, 22 bp, Homo sapiens
ggtcccagctggtcactgtcag

SEQ ID NO: 9210314 - DNA, 22 bp, Homo sapiens
ggtcccagaattggttagcaca

SEQ ID NO: 9210315 - DNA, 22 bp, Homo sapiens
gggttgggactgtcatctggag

SEQ ID NO: 9210316 - DNA, 22 bp, Homo sapiens
gggttggattacttagggagaa

SEQ ID NO: 9210317 - DNA, 22 bp, Homo sapiens
gggtgtccagggcgtgtctgga

SEQ ID NO: 9210318 - DNA, 22 bp, Homo sapiens
gggtgtccagggcgtgtctgga

SEQ ID NO: 9210319 - DNA, 23 bp, Homo sapiens
ggtccctgacagcgggcaagttg

SEQ ID NO: 9210320 - DNA, 22 bp, Homo sapiens
ggtccccccatggtgagcactg

SEQ ID NO: 9210321 - DNA, 22 bp, Homo sapiens
ggtccccccatggtgagcactg

SEQ ID NO: 9210322 - DNA, 22 bp, Homo sapiens
ggtccccccatggtgagcactg

SEQ ID NO: 9210323 - DNA, 22 bp, Homo sapiens
ggtcccatgactgacacagcag

SEQ ID NO: 9210324 - DNA, 22 bp, Homo sapiens
ggtcccagttgcccaggtcagg

SEQ ID NO: 9210325 - DNA, 23 bp, Homo sapiens
ggtcccagtggagaggcctcacc

SEQ ID NO: 9210326 - DNA, 22 bp, Homo sapiens
ggttcagagtcaggatctaagt

SEQ ID NO: 9210327 - DNA, 22 bp, Homo sapiens
ggttcagagaaggctaaatagt

SEQ ID NO: 9210328 - DNA, 19 bp, Homo sapiens
ggttggagaagagcggccc

SEQ ID NO: 9210329 - DNA, 22 bp, Homo sapiens
ggttggggcgagctggaggccc

SEQ ID NO: 9210330 - DNA, 22 bp, Homo sapiens
ggttggtaactccctgtgcagt

SEQ ID NO: 9210331 - DNA, 22 bp, Homo sapiens
ggtggtggagccagctgggagt

SEQ ID NO: 9210332 - DNA, 22 bp, Homo sapiens
ggtggtggagccagctgggagt

SEQ ID NO: 9210333 - DNA, 23 bp, Homo sapiens
ggttatttgcatcctgtaattat

SEQ ID NO: 9210334 - DNA, 22 bp, Homo sapiens
ggttatctaagacagtttggca

SEQ ID NO: 9210335 - DNA, 22 bp, Homo sapiens
ggttattttggttgtctaaggc

SEQ ID NO: 9210336 - DNA, 22 bp, Homo sapiens
ggtggggagtcaggcattcttg

SEQ ID NO: 9210337 - DNA, 22 bp, Homo sapiens
ggtggggattcctgatcactgt

SEQ ID NO: 9210338 - DNA, 22 bp, Homo sapiens
ggtggggccagggctccaacct

SEQ ID NO: 9210339 - DNA, 22 bp, Homo sapiens
ggtggggcccaggcatctgatg

SEQ ID NO: 9210340 - DNA, 22 bp, Homo sapiens
ggtggggcctgctccagcggcc

SEQ ID NO: 9210341 - DNA, 22 bp, Homo sapiens
ggtggcagagacataggacata

SEQ ID NO: 9210342 - DNA, 22 bp, Homo sapiens
ggtggcagagacataggacata

SEQ ID NO: 9210343 - DNA, 22 bp, Homo sapiens
ggtggcagagacataggacata

SEQ ID NO: 9210344 - DNA, 19 bp, Homo sapiens
ggtggcagaacgtgggtcc

SEQ ID NO: 9210345 - DNA, 22 bp, Homo sapiens
ggtggcagaataattgaaggtc

SEQ ID NO: 9210346 - DNA, 22 bp, Homo sapiens
ggtggagctggaccaggagagg

SEQ ID NO: 9210347 - DNA, 22 bp, Homo sapiens
ggtggagctgtggacaggaagg

SEQ ID NO: 9210348 - DNA, 22 bp, Homo sapiens
gggcttaaggccagtgtgcttt

SEQ ID NO: 9210349 - DNA, 19 bp, Homo sapiens
gggctctggcctcagtggg

SEQ ID NO: 9210350 - DNA, 22 bp, Homo sapiens
gggctctggatggagcctgcag

SEQ ID NO: 9210351 - DNA, 22 bp, Homo sapiens
gggctctgggattcagagcaag

SEQ ID NO: 9210352 - DNA, 22 bp, Homo sapiens
gggctctgggattcagagcaag

SEQ ID NO: 9210353 - DNA, 22 bp, Homo sapiens
gggctgtgtgcccacttcccat

SEQ ID NO: 9210354 - DNA, 22 bp, Homo sapiens
gggctctggggtcagacagcct

SEQ ID NO: 9210355 - DNA, 22 bp, Homo sapiens
gggctctggggtgccctggcat

SEQ ID NO: 9210356 - DNA, 21 bp, Homo sapiens
ggggatgcgaccacaggctcc

SEQ ID NO: 9210357 - DNA, 22 bp, Homo sapiens
ggggcaggaggtgttctctttt

SEQ ID NO: 9210358 - DNA, 20 bp, Homo sapiens
ggggcaggtttttatggcta

SEQ ID NO: 9210359 - DNA, 22 bp, Homo sapiens
ggggccactggcaggaccttgg

SEQ ID NO: 9210360 - DNA, 22 bp, Homo sapiens
ggggccactggcaggaccttgg

SEQ ID NO: 9210361 - DNA, 22 bp, Homo sapiens
ggggaggaagctggaacacggg

SEQ ID NO: 9210362 - DNA, 22 bp, Homo sapiens
ggggaggaagctggaacacggg

SEQ ID NO: 9210363 - DNA, 22 bp, Homo sapiens
ggggaggagtgtacaggtttat

SEQ ID NO: 9210364 - DNA, 22 bp, Homo sapiens
ggggaggacctttccaaggctt

SEQ ID NO: 9210365 - DNA, 22 bp, Homo sapiens
ggggtgggagtgccatccttga

SEQ ID NO: 9210366 - DNA, 22 bp, Homo sapiens
ggggtgggagtgccatccttga

SEQ ID NO: 9210367 - DNA, 19 bp, Homo sapiens
ggggtggctggggctccag

SEQ ID NO: 9210368 - DNA, 22 bp, Homo sapiens
ggggtagggcgattgctgcttt

SEQ ID NO: 9210369 - DNA, 22 bp, Homo sapiens
ggggcccctgtggcttgatgcc

SEQ ID NO: 9210370 - DNA, 22 bp, Homo sapiens
gggtgagggatgagccttcttc

SEQ ID NO: 9210371 - DNA, 22 bp, Homo sapiens
ggggtgggagtgccatccttga

SEQ ID NO: 9210372 - DNA, 22 bp, Homo sapiens
gggtgcagcagagctcctctgt

SEQ ID NO: 9210373 - DNA, 22 bp, Homo sapiens
gggtggtgagatgtagctgatg

SEQ ID NO: 9210374 - DNA, 22 bp, Homo sapiens
gggtggtggccagcagtgggca

SEQ ID NO: 9210375 - DNA, 22 bp, Homo sapiens
gggtggtgtattagagctgcag

SEQ ID NO: 9210376 - DNA, 22 bp, Homo sapiens
gggtggtgtattagagctgcag

SEQ ID NO: 9210377 - DNA, 22 bp, Homo sapiens
gggtggagagaaagaaacgtga

SEQ ID NO: 9210378 - DNA, 22 bp, Homo sapiens
gggtggagccagttgactctgt

SEQ ID NO: 9210379 - DNA, 22 bp, Homo sapiens
gggtggagccagttgactctgt

SEQ ID NO: 9210380 - DNA, 22 bp, Homo sapiens
gggtggagaggctaagtccagt

SEQ ID NO: 9210381 - DNA, 21 bp, Homo sapiens
gggtggggttccagccttttc

SEQ ID NO: 9210382 - DNA, 22 bp, Homo sapiens
gggctcagaggagtggcctggg

SEQ ID NO: 9210383 - DNA, 22 bp, Homo sapiens
gggctcagaggagtggcctggg

SEQ ID NO: 9210384 - DNA, 22 bp, Homo sapiens
gggctcagttctgcttcatgct

SEQ ID NO: 9210385 - DNA, 22 bp, Homo sapiens
gggctcagctccttccttccta

SEQ ID NO: 9210386 - DNA, 21 bp, Homo sapiens
gggctcagcgctcggctcctc

SEQ ID NO: 9210387 - DNA, 22 bp, Homo sapiens
gggctcagctccttccttccta

SEQ ID NO: 9210388 - DNA, 22 bp, Homo sapiens
gggctctgagctctgggaatta

SEQ ID NO: 9210389 - DNA, 22 bp, Homo sapiens
gggctccaactacatcagcctt

SEQ ID NO: 9210390 - DNA, 22 bp, Homo sapiens
gggctctgaatcccaggtctgc

SEQ ID NO: 9210391 - DNA, 22 bp, Homo sapiens
gggctccaaaatctatgtcttc

SEQ ID NO: 9210392 - DNA, 22 bp, Homo sapiens
gggctccaacggtgagcatgga

SEQ ID NO: 9210393 - DNA, 22 bp, Homo sapiens
gggctccaaccccagtgaactc

SEQ ID NO: 9210394 - DNA, 22 bp, Homo sapiens
gggctctggacccaggcaagag

SEQ ID NO: 9210395 - DNA, 22 bp, Homo sapiens
gggctctggaaatgggagctcc

SEQ ID NO: 9210396 - DNA, 22 bp, Homo sapiens
gggctctggaaatgggagctcc

SEQ ID NO: 9210397 - DNA, 22 bp, Homo sapiens
gggctctggacccaggcaagag

SEQ ID NO: 9210398 - DNA, 22 bp, Homo sapiens
gggctctggacccaggcaagag

SEQ ID NO: 9210399 - DNA, 18 bp, Homo sapiens
gggctctggcatctgggt

SEQ ID NO: 9210400 - DNA, 22 bp, Homo sapiens
gggccccactggggctgcctgc

SEQ ID NO: 9210401 - DNA, 22 bp, Homo sapiens
gggccccagtcctcccacgtgg

SEQ ID NO: 9210402 - DNA, 22 bp, Homo sapiens
gggcccctgggaattctgtgat

SEQ ID NO: 9210403 - DNA, 22 bp, Homo sapiens
gggcccctgggaattctgtgat

SEQ ID NO: 9210404 - DNA, 22 bp, Homo sapiens
gggccccactggggctgcctgc

SEQ ID NO: 9210405 - DNA, 22 bp, Homo sapiens
gggccccactggggctgcctgc

SEQ ID NO: 9210406 - DNA, 22 bp, Homo sapiens
gggccccttgctgctctgctgg

SEQ ID NO: 9210407 - DNA, 22 bp, Homo sapiens
gggccccttgtatctctggctc

SEQ ID NO: 9210408 - DNA, 22 bp, Homo sapiens
gggccccaagaacctcctcctg

SEQ ID NO: 9210409 - DNA, 22 bp, Homo sapiens
gggcccagtaccctctgccaag

SEQ ID NO: 9210410 - DNA, 22 bp, Homo sapiens
gggcccagtaccctctgccaag

SEQ ID NO: 9210411 - DNA, 22 bp, Homo sapiens
gggccctctgcagctgcccagg

SEQ ID NO: 9210412 - DNA, 22 bp, Homo sapiens
gggccctgatctgtgagcgcag

SEQ ID NO: 9210413 - DNA, 22 bp, Homo sapiens
gggccctgcctaaggaacacac

SEQ ID NO: 9210414 - DNA, 22 bp, Homo sapiens
gggccctgccccgtggctctga

SEQ ID NO: 9210415 - DNA, 22 bp, Homo sapiens
gggccctgggattcagagcaag

SEQ ID NO: 9210416 - DNA, 22 bp, Homo sapiens
gggccctgggattcagagcaag

SEQ ID NO: 9210417 - DNA, 22 bp, Homo sapiens
gggccctggggatgtggacgcg

SEQ ID NO: 9210418 - DNA, 18 bp, Homo sapiens
gggctcacacaggtcatc

SEQ ID NO: 9210419 - DNA, 22 bp, Homo sapiens
gggctcactcatgcaactgcag

SEQ ID NO: 9210420 - DNA, 22 bp, Homo sapiens
gggctaggtctgatcagagaag

SEQ ID NO: 9210421 - DNA, 19 bp, Homo sapiens
gggcctcacccacacctcc

SEQ ID NO: 9210422 - DNA, 22 bp, Homo sapiens
gggcctcacctctccaccgcct

SEQ ID NO: 9210423 - DNA, 22 bp, Homo sapiens
gggcctcacctctccaccgcct

SEQ ID NO: 9210424 - DNA, 22 bp, Homo sapiens
gggccctggggcctgatttgca

SEQ ID NO: 9210425 - DNA, 22 bp, Homo sapiens
gggccctgtgatttcttgagga

SEQ ID NO: 9210426 - DNA, 22 bp, Homo sapiens
gggccggagctgggtcccgcgc

SEQ ID NO: 9210427 - DNA, 22 bp, Homo sapiens
gggagctccactgcctctcatt

SEQ ID NO: 9210428 - DNA, 22 bp, Homo sapiens
gggagccttgggagtgccagcc

SEQ ID NO: 9210429 - DNA, 22 bp, Homo sapiens
gggaggttgaggctgcagtgag

SEQ ID NO: 9210430 - DNA, 22 bp, Homo sapiens
gggagtggttgatggtgaaaat

SEQ ID NO: 9210431 - DNA, 21 bp, Homo sapiens
gggcaggtctctgatgtcaac

SEQ ID NO: 9210432 - DNA, 21 bp, Homo sapiens
gggcagaggggcctcctgggt

SEQ ID NO: 9210433 - DNA, 21 bp, Homo sapiens
gggcagaggggcctcctgggt

SEQ ID NO: 9210434 - DNA, 22 bp, Homo sapiens
gggcagagagctggaactcctt

SEQ ID NO: 9210435 - DNA, 22 bp, Homo sapiens
gggcagagactcagaaacagaa

SEQ ID NO: 9210436 - DNA, 22 bp, Homo sapiens
gggagccactcagctgagagtt

SEQ ID NO: 9210437 - DNA, 22 bp, Homo sapiens
gggagccccacctcggtgcccg

SEQ ID NO: 9210438 - DNA, 23 bp, Homo sapiens
gggagccaggacctcgcgcccca

SEQ ID NO: 9210439 - DNA, 22 bp, Homo sapiens
gggaaggcatacctgagggaga

SEQ ID NO: 9210440 - DNA, 22 bp, Homo sapiens
gggaagagtaactagcccatgt

SEQ ID NO: 9210441 - DNA, 22 bp, Homo sapiens
gggaagagtaactagcccatgt

SEQ ID NO: 9210442 - DNA, 22 bp, Homo sapiens
gggaagagtaactagcccatgt

SEQ ID NO: 9210443 - DNA, 22 bp, Homo sapiens
gggaagcaggtgcagctcgcct

SEQ ID NO: 9210444 - DNA, 22 bp, Homo sapiens
gggaagatagtgttgagggccc

SEQ ID NO: 9210445 - DNA, 22 bp, Homo sapiens
ggctggccagggccctcgctgg

SEQ ID NO: 9210446 - DNA, 18 bp, Homo sapiens
ggctgtgcgtggaggctg

SEQ ID NO: 9210447 - DNA, 22 bp, Homo sapiens
ggctgtggcattaggtgaggcc

SEQ ID NO: 9210448 - DNA, 21 bp, Homo sapiens
ggctgtggagccatgactcac

SEQ ID NO: 9210449 - DNA, 22 bp, Homo sapiens
ggctgtggcagctggaagtggt

SEQ ID NO: 9210450 - DNA, 22 bp, Homo sapiens
ggctgtggggccgggtacagtg

SEQ ID NO: 9210451 - DNA, 22 bp, Homo sapiens
ggctgtggggccgggtacagtg

SEQ ID NO: 9210452 - DNA, 22 bp, Homo sapiens
ggctgtggtctgggtgctcccc

SEQ ID NO: 9210453 - DNA, 22 bp, Homo sapiens
ggctgtggtctcatctagcctt

SEQ ID NO: 9210454 - DNA, 22 bp, Homo sapiens
gggaagagggagctggaatgat

SEQ ID NO: 9210455 - DNA, 22 bp, Homo sapiens
gggaagagggagctggaatgat

SEQ ID NO: 9210456 - DNA, 22 bp, Homo sapiens
ggctgcctctatttaggatcaa

SEQ ID NO: 9210457 - DNA, 20 bp, Homo sapiens
ggctgcctccttcctttcct

SEQ ID NO: 9210458 - DNA, 19 bp, Homo sapiens
ggctgcctcctgggagatt

SEQ ID NO: 9210459 - DNA, 22 bp, Homo sapiens
ggctgcctcccaggagaatctg

SEQ ID NO: 9210460 - DNA, 22 bp, Homo sapiens
ggctgcctcctgctgggctgga

SEQ ID NO: 9210461 - DNA, 22 bp, Homo sapiens
ggctgcctccactgcttgtccc

SEQ ID NO: 9210462 - DNA, 22 bp, Homo sapiens
ggctgcctcctcgagacaggat

SEQ ID NO: 9210463 - DNA, 22 bp, Homo sapiens
ggctgcctcagatttgctgact

SEQ ID NO: 9210464 - DNA, 22 bp, Homo sapiens
ggctgcagttgtgtgaaggccg

SEQ ID NO: 9210465 - DNA, 22 bp, Homo sapiens
ggctgcagtttgtcttttgctt

SEQ ID NO: 9210466 - DNA, 22 bp, Homo sapiens
ggctgcagtttgtcttttgctt

SEQ ID NO: 9210467 - DNA, 22 bp, Homo sapiens
ggctgccagcactggtgtagag

SEQ ID NO: 9210468 - DNA, 21 bp, Homo sapiens
ggctgcagggagccctggggt

SEQ ID NO: 9210469 - DNA, 22 bp, Homo sapiens
ggctgcaggcttccctccagca

SEQ ID NO: 9210470 - DNA, 22 bp, Homo sapiens
ggctgcagggcagctggtgtgg

SEQ ID NO: 9210471 - DNA, 22 bp, Homo sapiens
ggctgcaggttggttggcagct

SEQ ID NO: 9210472 - DNA, 20 bp, Homo sapiens
ggctgcagtgcacctcatct

SEQ ID NO: 9210473 - DNA, 17 bp, Homo sapiens
ggctgcagtccaggagg

SEQ ID NO: 9210474 - DNA, 17 bp, Homo sapiens
ggctggaggggacccgg

SEQ ID NO: 9210475 - DNA, 19 bp, Homo sapiens
ggctggagtggccatctgt

SEQ ID NO: 9210476 - DNA, 22 bp, Homo sapiens
ggctggagtgggctccagagtt

SEQ ID NO: 9210477 - DNA, 17 bp, Homo sapiens
ggctggagcagctcccc

SEQ ID NO: 9210478 - DNA, 22 bp, Homo sapiens
ggctggaggagaatgggtgtga

SEQ ID NO: 9210479 - DNA, 17 bp, Homo sapiens
ggctggagcagctcccc

SEQ ID NO: 9210480 - DNA, 17 bp, Homo sapiens
ggctggagcagctcccc

SEQ ID NO: 9210481 - DNA, 17 bp, Homo sapiens
ggctggagcagctcccc

SEQ ID NO: 9210482 - DNA, 22 bp, Homo sapiens
ggctggagatatgtctggaaca

SEQ ID NO: 9210483 - DNA, 22 bp, Homo sapiens
ggctggagatatgtctggaaca

SEQ ID NO: 9210484 - DNA, 22 bp, Homo sapiens
ggctgcctgctcctcctgcacg

SEQ ID NO: 9210485 - DNA, 22 bp, Homo sapiens
ggctgcctgcctccaagccggg

SEQ ID NO: 9210486 - DNA, 22 bp, Homo sapiens
ggctgcctggacctcctctttc

SEQ ID NO: 9210487 - DNA, 22 bp, Homo sapiens
ggctgcctgctcaggtgcggcg

SEQ ID NO: 9210488 - DNA, 22 bp, Homo sapiens
ggctgcctgccgcccacttggc

SEQ ID NO: 9210489 - DNA, 22 bp, Homo sapiens
ggctgcctgaggctgaggcccg

SEQ ID NO: 9210490 - DNA, 22 bp, Homo sapiens
ggctgcctctggaagctggaga

SEQ ID NO: 9210491 - DNA, 22 bp, Homo sapiens
ggctgcctctttcttagtgtct

SEQ ID NO: 9210492 - DNA, 22 bp, Homo sapiens
ggctgcctgaactttggggaaa

SEQ ID NO: 9210493 - DNA, 22 bp, Homo sapiens
ggctgcctgaggcagtgagaga

SEQ ID NO: 9210494 - DNA, 22 bp, Homo sapiens
ggctgcctctgatgtgcagacg

SEQ ID NO: 9210495 - DNA, 22 bp, Homo sapiens
ggccagcatatagagtgaagta

SEQ ID NO: 9210496 - DNA, 22 bp, Homo sapiens
ggccagcagtcacagggtcaga

SEQ ID NO: 9210497 - DNA, 19 bp, Homo sapiens
ggccagccacctcgcctgg

SEQ ID NO: 9210498 - DNA, 22 bp, Homo sapiens
ggccagcatggcaagaccaact

SEQ ID NO: 9210499 - DNA, 22 bp, Homo sapiens
ggcccaggctggagtgcggtgg

SEQ ID NO: 9210500 - DNA, 22 bp, Homo sapiens
ggcccatctcttgctctgggtt

SEQ ID NO: 9210501 - DNA, 22 bp, Homo sapiens
ggcccaggtccagcgagtacct

SEQ ID NO: 9210502 - DNA, 22 bp, Homo sapiens
ggcccaggctggagtgcagtgg

SEQ ID NO: 9210503 - DNA, 22 bp, Homo sapiens
ggccaccaaagtcctgtggctt

SEQ ID NO: 9210504 - DNA, 22 bp, Homo sapiens
ggccaccagtcctctggcaggg

SEQ ID NO: 9210505 - DNA, 22 bp, Homo sapiens
ggccaccagtcctctggcaggg

SEQ ID NO: 9210506 - DNA, 22 bp, Homo sapiens
ggccaccagtcctctggcaggg

SEQ ID NO: 9210507 - DNA, 22 bp, Homo sapiens
ggccaccaaagtcctgtggctt

SEQ ID NO: 9210508 - DNA, 22 bp, Homo sapiens
ggccaccaaagtcctgtggctt

SEQ ID NO: 9210509 - DNA, 22 bp, Homo sapiens
ggccacagtgggaaatcctggg

SEQ ID NO: 9210510 - DNA, 22 bp, Homo sapiens
ggccacagtgggaaatcctggg

SEQ ID NO: 9210511 - DNA, 22 bp, Homo sapiens
ggccacagtgggaaatcctggg

SEQ ID NO: 9210512 - DNA, 22 bp, Homo sapiens
ggccacagtgggaaatcctggg

SEQ ID NO: 9210513 - DNA, 20 bp, Homo sapiens
ggccacagggtgctggtgga

SEQ ID NO: 9210514 - DNA, 21 bp, Homo sapiens
ggccacagttagggctcagga

SEQ ID NO: 9210515 - DNA, 21 bp, Homo sapiens
ggccacagttagggctcagga

SEQ ID NO: 9210516 - DNA, 21 bp, Homo sapiens
ggccacagttagggctcagga

SEQ ID NO: 9210517 - DNA, 22 bp, Homo sapiens
ggccagagtctatatgcagaca

SEQ ID NO: 9210518 - DNA, 22 bp, Homo sapiens
ggccagcagacctcagggactc

SEQ ID NO: 9210519 - DNA, 22 bp, Homo sapiens
ggccagcagacctcagggactc

SEQ ID NO: 9210520 - DNA, 19 bp, Homo sapiens
ggccagcacagggctctgt

SEQ ID NO: 9210521 - DNA, 17 bp, Homo sapiens
ggccacagagcttgggg

SEQ ID NO: 9210522 - DNA, 17 bp, Homo sapiens
ggccacagagcttgggg

SEQ ID NO: 9210523 - DNA, 22 bp, Homo sapiens
ggcagtggctgtagtctcttgg

SEQ ID NO: 9210524 - DNA, 22 bp, Homo sapiens
ggcagtggcatgtgggtagtgg

SEQ ID NO: 9210525 - DNA, 22 bp, Homo sapiens
ggccacagcaatgctgtgatgt

SEQ ID NO: 9210526 - DNA, 22 bp, Homo sapiens
ggccacagcagatgcttcagat

SEQ ID NO: 9210527 - DNA, 20 bp, Homo sapiens
ggccacagggtgctggtgga

SEQ ID NO: 9210528 - DNA, 22 bp, Homo sapiens
ggccacagtctctggaaggatg

SEQ ID NO: 9210529 - DNA, 23 bp, Homo sapiens
ggctcagaaaaagtcctggcctc

SEQ ID NO: 9210530 - DNA, 22 bp, Homo sapiens
ggctcagaaggccatgctctgc

SEQ ID NO: 9210531 - DNA, 22 bp, Homo sapiens
ggctcagaaactaaaggcgctg

SEQ ID NO: 9210532 - DNA, 22 bp, Homo sapiens
ggctcagaaacctctggtgtct

SEQ ID NO: 9210533 - DNA, 22 bp, Homo sapiens
ggctcagactcccaggccctct

SEQ ID NO: 9210534 - DNA, 22 bp, Homo sapiens
ggctcagacctcccagctccag

SEQ ID NO: 9210535 - DNA, 22 bp, Homo sapiens
ggctcagaggagctggaacggt

SEQ ID NO: 9210536 - DNA, 22 bp, Homo sapiens
ggctcagaggccagcaggtaga

SEQ ID NO: 9210537 - DNA, 22 bp, Homo sapiens
ggctctgaaggagacagctgct

SEQ ID NO: 9210538 - DNA, 22 bp, Homo sapiens
ggctctctggaggagctcaccc

SEQ ID NO: 9210539 - DNA, 22 bp, Homo sapiens
ggctcagatggtttgttctaga

SEQ ID NO: 9210540 - DNA, 22 bp, Homo sapiens
ggctcagagttaggacccatgt

SEQ ID NO: 9210541 - DNA, 22 bp, Homo sapiens
ggctcagagacctgcgatctga

SEQ ID NO: 9210542 - DNA, 22 bp, Homo sapiens
ggctcagaggttgaggccggca

SEQ ID NO: 9210543 - DNA, 22 bp, Homo sapiens
ggctcagattccgagtggccct

SEQ ID NO: 9210544 - DNA, 22 bp, Homo sapiens
ggctctgccgtgtgctcacatg

SEQ ID NO: 9210545 - DNA, 22 bp, Homo sapiens
ggctctgcctgcccagcagcac

SEQ ID NO: 9210546 - DNA, 22 bp, Homo sapiens
ggctctgacctcccaggcagtt

SEQ ID NO: 9210547 - DNA, 22 bp, Homo sapiens
ggcctctctccttggcttgcag

SEQ ID NO: 9210548 - DNA, 22 bp, Homo sapiens
ggcctccatcttatcttactct

SEQ ID NO: 9210549 - DNA, 22 bp, Homo sapiens
ggcctccatcttatcttactct

SEQ ID NO: 9210550 - DNA, 22 bp, Homo sapiens
ggcctctcttgggacagctgtc

SEQ ID NO: 9210551 - DNA, 22 bp, Homo sapiens
ggcctctctggcatggctgccc

SEQ ID NO: 9210552 - DNA, 22 bp, Homo sapiens
ggcctctgcaactggctgtggc

SEQ ID NO: 9210553 - DNA, 22 bp, Homo sapiens
ggcagggactttgcaaatcttt

SEQ ID NO: 9210554 - DNA, 22 bp, Homo sapiens
ggcagggaagctggcatcacgg

SEQ ID NO: 9210555 - DNA, 22 bp, Homo sapiens
ggcagggaaacagctgatccca

SEQ ID NO: 9210556 - DNA, 22 bp, Homo sapiens
ggcagggccctgattcctgggg

SEQ ID NO: 9210557 - DNA, 22 bp, Homo sapiens
ggcagtgagaggtctcctggtc

SEQ ID NO: 9210558 - DNA, 22 bp, Homo sapiens
ggcagtgactggggacccccaa

SEQ ID NO: 9210559 - DNA, 17 bp, Homo sapiens
ggcagtggaggaagaga

SEQ ID NO: 9210560 - DNA, 22 bp, Homo sapiens
ggcagccctttctggccagctc

SEQ ID NO: 9210561 - DNA, 17 bp, Homo sapiens
ggcagcctcaggcgttt

SEQ ID NO: 9210562 - DNA, 22 bp, Homo sapiens
ggcagccatgtgggcagcgagt

SEQ ID NO: 9210563 - DNA, 22 bp, Homo sapiens
ggcagccatgtcccagggcttc

SEQ ID NO: 9210564 - DNA, 18 bp, Homo sapiens
ggcagcctggacatgctc

SEQ ID NO: 9210565 - DNA, 19 bp, Homo sapiens
ggcagcctgcacgggctgc

SEQ ID NO: 9210566 - DNA, 22 bp, Homo sapiens
ggcagccttctctcataggtga

SEQ ID NO: 9210567 - DNA, 22 bp, Homo sapiens
ggcagccttgactagtgactta

SEQ ID NO: 9210568 - DNA, 22 bp, Homo sapiens
ggcagcctccagggcactggtg

SEQ ID NO: 9210569 - DNA, 22 bp, Homo sapiens
ggcagcctccagggcactggtg

SEQ ID NO: 9210570 - DNA, 23 bp, Homo sapiens
ggcagcctctgactctgctttgc

SEQ ID NO: 9210571 - DNA, 21 bp, Homo sapiens
ggcagcctgacccccagagag

SEQ ID NO: 9210572 - DNA, 22 bp, Homo sapiens
ggcagctcactgattagcaatt

SEQ ID NO: 9210573 - DNA, 22 bp, Homo sapiens
ggcagctcctcctagtctgccc

SEQ ID NO: 9210574 - DNA, 22 bp, Homo sapiens
ggcagccttgagggaggcctgg

SEQ ID NO: 9210575 - DNA, 22 bp, Homo sapiens
ggcagctcacctctggtccagg

SEQ ID NO: 9210576 - DNA, 21 bp, Homo sapiens
ggcagcgtgtggacaggaagg

SEQ ID NO: 9210577 - DNA, 18 bp, Homo sapiens
ggcagggaaaagataggg

SEQ ID NO: 9210578 - DNA, 22 bp, Homo sapiens
ggcagctcctctcagcaaaaga

SEQ ID NO: 9210579 - DNA, 22 bp, Homo sapiens
ggcaggctgttcacctgctttt

SEQ ID NO: 9210580 - DNA, 22 bp, Homo sapiens
ggaggcaaagcactttgcttgg

SEQ ID NO: 9210581 - DNA, 22 bp, Homo sapiens
ggaggaggggtttacattggaa

SEQ ID NO: 9210582 - DNA, 22 bp, Homo sapiens
ggaggaggggtgactgaatgct

SEQ ID NO: 9210583 - DNA, 22 bp, Homo sapiens
ggaggaggtgggttaagttgta

SEQ ID NO: 9210584 - DNA, 22 bp, Homo sapiens
ggcaccaggctgggcataggcc

SEQ ID NO: 9210585 - DNA, 22 bp, Homo sapiens
ggcaccaggctgggcataggcc

SEQ ID NO: 9210586 - DNA, 18 bp, Homo sapiens
ggcacctctcttgcctta

SEQ ID NO: 9210587 - DNA, 22 bp, Homo sapiens
ggcaccagggcaagggtctttc

SEQ ID NO: 9210588 - DNA, 19 bp, Homo sapiens
ggcaccttggctatgcctg

SEQ ID NO: 9210589 - DNA, 19 bp, Homo sapiens
ggcaccttggtcttggact

SEQ ID NO: 9210590 - DNA, 19 bp, Homo sapiens
ggcacctttctgctgtgtc

SEQ ID NO: 9210591 - DNA, 22 bp, Homo sapiens
ggcacctggtaagtgctcagta

SEQ ID NO: 9210592 - DNA, 22 bp, Homo sapiens
ggcacctggatgtagcagtgaa

SEQ ID NO: 9210593 - DNA, 22 bp, Homo sapiens
ggcactgagcgggctctgagcg

SEQ ID NO: 9210594 - DNA, 22 bp, Homo sapiens
ggcactgaatttcttggcatct

SEQ ID NO: 9210595 - DNA, 22 bp, Homo sapiens
ggcactgaagtgggtgttgggt

SEQ ID NO: 9210596 - DNA, 22 bp, Homo sapiens
ggcagatggagaagcagcaggt

SEQ ID NO: 9210597 - DNA, 22 bp, Homo sapiens
ggcagcaactcggagagaagag

SEQ ID NO: 9210598 - DNA, 22 bp, Homo sapiens
ggcagcactgcagcttgttggg

SEQ ID NO: 9210599 - DNA, 22 bp, Homo sapiens
taccaggcagctgcacagaggc

SEQ ID NO: 9210600 - DNA, 22 bp, Homo sapiens
taccatgtcttcaataagtcta

SEQ ID NO: 9210601 - DNA, 19 bp, Homo sapiens
taccatgttgactttcctg

SEQ ID NO: 9210602 - DNA, 22 bp, Homo sapiens
taccaggcagctgcacagaggc

SEQ ID NO: 9210603 - DNA, 22 bp, Homo sapiens
taccaggagttacaggcagcag

SEQ ID NO: 9210604 - DNA, 22 bp, Homo sapiens
taccaggagttacaggcagcag

SEQ ID NO: 9210605 - DNA, 22 bp, Homo sapiens
taccagcctcagttgtgagccc

SEQ ID NO: 9210606 - DNA, 22 bp, Homo sapiens
taccagccttttaacatgggcc

SEQ ID NO: 9210607 - DNA, 22 bp, Homo sapiens
taccagcctctgttgggggtgg

SEQ ID NO: 9210608 - DNA, 22 bp, Homo sapiens
taccagcctgaccctgtctgac

SEQ ID NO: 9210609 - DNA, 22 bp, Homo sapiens
tactagtttttaggaaaagtga

SEQ ID NO: 9210610 - DNA, 22 bp, Homo sapiens
tactagaaaaacacatgctctg

SEQ ID NO: 9210611 - DNA, 22 bp, Homo sapiens
tactacaagggccctaaaaggt

SEQ ID NO: 9210612 - DNA, 22 bp, Homo sapiens
tactgttttctataatggctgt

SEQ ID NO: 9210613 - DNA, 22 bp, Homo sapiens
tactgttttttagactcatggt

SEQ ID NO: 9210614 - DNA, 22 bp, Homo sapiens
tacttaaataattgctgctatt

SEQ ID NO: 9210615 - DNA, 22 bp, Homo sapiens
tacttacagaaggaagcaattg

SEQ ID NO: 9210616 - DNA, 22 bp, Homo sapiens
tactgaaacttttcttcaactg

SEQ ID NO: 9210617 - DNA, 22 bp, Homo sapiens
tactgaaactcttgtaaatatc

SEQ ID NO: 9210618 - DNA, 22 bp, Homo sapiens
tactgaaaaagaatccagacct

SEQ ID NO: 9210619 - DNA, 22 bp, Homo sapiens
tactctaaaattagctcttggc

SEQ ID NO: 9210620 - DNA, 22 bp, Homo sapiens
tacatgcatgtcacagaatgaa

SEQ ID NO: 9210621 - DNA, 22 bp, Homo sapiens
taccaagtgtattatgctttgt

SEQ ID NO: 9210622 - DNA, 22 bp, Homo sapiens
tacagtgtctggatatcaaagg

SEQ ID NO: 9210623 - DNA, 22 bp, Homo sapiens
tacagtgtgacatttctacaaa

SEQ ID NO: 9210624 - DNA, 18 bp, Homo sapiens
tacagtattttctcgcct

SEQ ID NO: 9210625 - DNA, 22 bp, Homo sapiens
tacagtgaggtggtttccttta

SEQ ID NO: 9210626 - DNA, 22 bp, Homo sapiens
tacagtgcatagaggcatgata

SEQ ID NO: 9210627 - DNA, 22 bp, Homo sapiens
tacagtgtccctttttcagaca

SEQ ID NO: 9210628 - DNA, 22 bp, Homo sapiens
tacaagaaggaaaactagcaat

SEQ ID NO: 9210629 - DNA, 22 bp, Homo sapiens
taatttatgatgcaaagaaaag

SEQ ID NO: 9210630 - DNA, 21 bp, Homo sapiens
taatttattcagcacagtgtt

SEQ ID NO: 9210631 - DNA, 22 bp, Homo sapiens
tacaagaaatttctgcatatat

SEQ ID NO: 9210632 - DNA, 22 bp, Homo sapiens
tacagaatgttatgaagcatag

SEQ ID NO: 9210633 - DNA, 22 bp, Homo sapiens
tacagaatgttatgaagcatag

SEQ ID NO: 9210634 - DNA, 22 bp, Homo sapiens
tacagacaaagagcatgcggta

SEQ ID NO: 9210635 - DNA, 22 bp, Homo sapiens
tacacataggtctgaataaaaa

SEQ ID NO: 9210636 - DNA, 20 bp, Homo sapiens
tacagaatgcaataaaatgg

SEQ ID NO: 9210637 - DNA, 22 bp, Homo sapiens
tacagaatatagaagctggaag

SEQ ID NO: 9210638 - DNA, 22 bp, Homo sapiens
taagccaaaatcaggacacaga

SEQ ID NO: 9210639 - DNA, 22 bp, Homo sapiens
taagccagatacaccactgaaa

SEQ ID NO: 9210640 - DNA, 22 bp, Homo sapiens
taaggaaaatggacatcaaaca

SEQ ID NO: 9210641 - DNA, 22 bp, Homo sapiens
taatagttgtgactttgtaaag

SEQ ID NO: 9210642 - DNA, 22 bp, Homo sapiens
taaggattaaataagaatattt

SEQ ID NO: 9210643 - DNA, 22 bp, Homo sapiens
taaggacattggttttgagtaa

SEQ ID NO: 9210644 - DNA, 22 bp, Homo sapiens
taatatacttcccatagtttga

SEQ ID NO: 9210645 - DNA, 22 bp, Homo sapiens
taatatacttcccatagtttga

SEQ ID NO: 9210646 - DNA, 22 bp, Homo sapiens
taattcttgttcagaggtagta

SEQ ID NO: 9210647 - DNA, 22 bp, Homo sapiens
taatctctttatgagaagaagg

SEQ ID NO: 9210648 - DNA, 22 bp, Homo sapiens
taatccagggtattctagtttc

SEQ ID NO: 9210649 - DNA, 18 bp, Homo sapiens
taatccagggcaggtgat

SEQ ID NO: 9210650 - DNA, 22 bp, Homo sapiens
taacagtatagcctaacatttc

SEQ ID NO: 9210651 - DNA, 22 bp, Homo sapiens
taacatctccctgacttttgct

SEQ ID NO: 9210652 - DNA, 22 bp, Homo sapiens
taacatctaagggagagaaagt

SEQ ID NO: 9210653 - DNA, 22 bp, Homo sapiens
taacatctttagcagctcgaac

SEQ ID NO: 9210654 - DNA, 22 bp, Homo sapiens
taacagttttgagttttgcttc

SEQ ID NO: 9210655 - DNA, 22 bp, Homo sapiens
taacagttggtgtaatttcttg

SEQ ID NO: 9210656 - DNA, 22 bp, Homo sapiens
taaattaaagattggagaagga

SEQ ID NO: 9210657 - DNA, 22 bp, Homo sapiens
taaatgttactttcctttcaca

SEQ ID NO: 9210658 - DNA, 22 bp, Homo sapiens
taagagcactgaagtcttctta

SEQ ID NO: 9210659 - DNA, 22 bp, Homo sapiens
taagagatggttatcaaaagca

SEQ ID NO: 9210660 - DNA, 22 bp, Homo sapiens
taagagaaggatctgttccagg

SEQ ID NO: 9210661 - DNA, 22 bp, Homo sapiens
taagagaactggatagatagga

SEQ ID NO: 9210662 - DNA, 21 bp, Homo sapiens
taagcatatcagatagactct

SEQ ID NO: 9210663 - DNA, 18 bp, Homo sapiens
taagagcagactgtaggc

SEQ ID NO: 9210664 - DNA, 22 bp, Homo sapiens
taacatgcatagatttgtatta

SEQ ID NO: 9210665 - DNA, 22 bp, Homo sapiens
taacatgcagagtttagctttt

SEQ ID NO: 9210666 - DNA, 22 bp, Homo sapiens
taagacaattcttcagtcacaa

SEQ ID NO: 9210667 - DNA, 22 bp, Homo sapiens
taagacatttgacaaaccattt

SEQ ID NO: 9210668 - DNA, 22 bp, Homo sapiens
taagacatggttgatctagtgt

SEQ ID NO: 9210669 - DNA, 22 bp, Homo sapiens
taagacttaggtcgagtttggc

SEQ ID NO: 9210670 - DNA, 22 bp, Homo sapiens
taagacatagccaagagcatcc

SEQ ID NO: 9210671 - DNA, 21 bp, Homo sapiens
taagacagtatgaatactttc

SEQ ID NO: 9210672 - DNA, 22 bp, Homo sapiens
taagacatcctggatgttcaaa

SEQ ID NO: 9210673 - DNA, 22 bp, Homo sapiens
taagacatcattaaacagcaat

SEQ ID NO: 9210674 - DNA, 22 bp, Homo sapiens
taaaacttctcatttttatggt

SEQ ID NO: 9210675 - DNA, 22 bp, Homo sapiens
taaaactgcttggtatggtcta

SEQ ID NO: 9210676 - DNA, 22 bp, Homo sapiens
taaaagaagcttcaaggccggc

SEQ ID NO: 9210677 - DNA, 22 bp, Homo sapiens
taaaagaagcttcaaggccggc

SEQ ID NO: 9210678 - DNA, 22 bp, Homo sapiens
taaaagaccacaaggtggtaat

SEQ ID NO: 9210679 - DNA, 21 bp, Homo sapiens
taaaagatgacaagacagctc

SEQ ID NO: 9210680 - DNA, 22 bp, Homo sapiens
taaaagagaatggataacagag

SEQ ID NO: 9210681 - DNA, 22 bp, Homo sapiens
taaaagagaatggataacagag

SEQ ID NO: 9210682 - DNA, 22 bp, Homo sapiens
taaaagattttataggaacaag

SEQ ID NO: 9210683 - DNA, 22 bp, Homo sapiens
taaaagtatactttcaaaggag

SEQ ID NO: 9210684 - DNA, 22 bp, Homo sapiens
taaaagtaggaatgaaacgcat

SEQ ID NO: 9210685 - DNA, 23 bp, Homo sapiens
taaagacagccttcaggattctg

SEQ ID NO: 9210686 - DNA, 22 bp, Homo sapiens
taaatgatttatgtatgtgaaa

SEQ ID NO: 9210687 - DNA, 22 bp, Homo sapiens
taaagcagccagggtctaagcc

SEQ ID NO: 9210688 - DNA, 22 bp, Homo sapiens
taaagcacgtctatttaatgat

SEQ ID NO: 9210689 - DNA, 22 bp, Homo sapiens
taaagcacatatcttacaataa

SEQ ID NO: 9210690 - DNA, 23 bp, Homo sapiens
taaagcaaagtcaagtgcactcc

SEQ ID NO: 9210691 - DNA, 22 bp, Homo sapiens
taaagcaagacacacccatagc

SEQ ID NO: 9210692 - DNA, 22 bp, Homo sapiens
taaagcaaggaatagagtagtc

SEQ ID NO: 9210693 - DNA, 22 bp, Homo sapiens
taaagcaaggaatagagtagtc

SEQ ID NO: 9210694 - DNA, 22 bp, Homo sapiens
taaagcaaggcaaattgttggt

SEQ ID NO: 9210695 - DNA, 22 bp, Homo sapiens
taaagcaatgaaagttttgcag

SEQ ID NO: 9210696 - DNA, 22 bp, Homo sapiens
taaagcaatgaaagttttgcag

SEQ ID NO: 9210697 - DNA, 22 bp, Homo sapiens
taaagcaaggcaaattgttggt

SEQ ID NO: 9210698 - DNA, 22 bp, Homo sapiens
taaagcaattactcagtggctt

SEQ ID NO: 9210699 - DNA, 22 bp, Homo sapiens
taaagcaatttgagcaagttct

SEQ ID NO: 9210700 - DNA, 22 bp, Homo sapiens
taaagcaatttgagcaagttct

SEQ ID NO: 9210701 - DNA, 22 bp, Homo sapiens
taaagcaatttgagcaagttct

SEQ ID NO: 9210702 - DNA, 22 bp, Homo sapiens
taaagacatggtgtaggtgaac

SEQ ID NO: 9210703 - DNA, 22 bp, Homo sapiens
taaagcaaaaatgaactgccat

SEQ ID NO: 9210704 - DNA, 23 bp, Homo sapiens
taaagcaaagtcaagtgcactcc

SEQ ID NO: 9210705 - DNA, 23 bp, Homo sapiens
taaagcaaagtcaagtgcactcc

SEQ ID NO: 9210706 - DNA, 22 bp, Homo sapiens
gtttcacatgaaacttggggaa

SEQ ID NO: 9210707 - DNA, 21 bp, Homo sapiens
gttttaagggagaaaacctag

SEQ ID NO: 9210708 - DNA, 22 bp, Homo sapiens
gtttgtgtcaatgacttctgca

SEQ ID NO: 9210709 - DNA, 22 bp, Homo sapiens
gtttgtgtaacatgatgatgat

SEQ ID NO: 9210710 - DNA, 22 bp, Homo sapiens
gttgagcaaggccagagaagcc

SEQ ID NO: 9210711 - DNA, 22 bp, Homo sapiens
gttcttcatcttaaccatctgt

SEQ ID NO: 9210712 - DNA, 22 bp, Homo sapiens
gtgtttaatgcagatgtgggtg

SEQ ID NO: 9210713 - DNA, 22 bp, Homo sapiens
gttaaatgcactattgaaagct

SEQ ID NO: 9210714 - DNA, 22 bp, Homo sapiens
gttaaatgcattttccaagcac

SEQ ID NO: 9210715 - DNA, 22 bp, Homo sapiens
gttaaatgcagattctgactca

SEQ ID NO: 9210716 - DNA, 23 bp, Homo sapiens
gtgttggcagcagtgctctgggg

SEQ ID NO: 9210717 - DNA, 22 bp, Homo sapiens
gtgttctttatttagtgatgct

SEQ ID NO: 9210718 - DNA, 22 bp, Homo sapiens
gttcttcatcattaacactctg

SEQ ID NO: 9210719 - DNA, 22 bp, Homo sapiens
gttatataattcctgtggtagt

SEQ ID NO: 9210720 - DNA, 22 bp, Homo sapiens
gttatataagacaaatcagagt

SEQ ID NO: 9210721 - DNA, 22 bp, Homo sapiens
gttatatatagtatttctctga

SEQ ID NO: 9210722 - DNA, 22 bp, Homo sapiens
gttatatatagtatttctctga

SEQ ID NO: 9210723 - DNA, 22 bp, Homo sapiens
tagatctgatacaattcatctg

SEQ ID NO: 9210724 - DNA, 22 bp, Homo sapiens
tagcaaaggccttggacacgct

SEQ ID NO: 9210725 - DNA, 22 bp, Homo sapiens
tagcaaaggccttggacacgct

SEQ ID NO: 9210726 - DNA, 22 bp, Homo sapiens
tagcaaagggaaagaagggcct

SEQ ID NO: 9210727 - DNA, 23 bp, Homo sapiens
tagcaaagttgtttgggaaattt

SEQ ID NO: 9210728 - DNA, 22 bp, Homo sapiens
tagcaaataaaacagtattgaa

SEQ ID NO: 9210729 - DNA, 22 bp, Homo sapiens
tagcagctcctaaacagtggtg

SEQ ID NO: 9210730 - DNA, 22 bp, Homo sapiens
tagcaagaagctgtcacaggtg

SEQ ID NO: 9210731 - DNA, 22 bp, Homo sapiens
tagcagctctgattctgggccc

SEQ ID NO: 9210732 - DNA, 22 bp, Homo sapiens
tagcagctctttactaaccagt

SEQ ID NO: 9210733 - DNA, 22 bp, Homo sapiens
tagcagggccaggctgggaacc

SEQ ID NO: 9210734 - DNA, 19 bp, Homo sapiens
tagcagctgccaaaggaga

SEQ ID NO: 9210735 - DNA, 22 bp, Homo sapiens
tagcagctggggctattcatca

SEQ ID NO: 9210736 - DNA, 22 bp, Homo sapiens
tagcagctgcatcattttacag

SEQ ID NO: 9210737 - DNA, 19 bp, Homo sapiens
tagcagctgccaaaggaga

SEQ ID NO: 9210738 - DNA, 22 bp, Homo sapiens
tagcagcttaagtaattagaat

SEQ ID NO: 9210739 - DNA, 22 bp, Homo sapiens
tagcagctgtggaggggctgtg

SEQ ID NO: 9210740 - DNA, 22 bp, Homo sapiens
tagcagctgtcagtttcacata

SEQ ID NO: 9210741 - DNA, 22 bp, Homo sapiens
tagcagctgtgagtaaaagcca

SEQ ID NO: 9210742 - DNA, 22 bp, Homo sapiens
tagcagcttccagagagggcag

SEQ ID NO: 9210743 - DNA, 22 bp, Homo sapiens
tagctgcttctcacatgggcaa

SEQ ID NO: 9210744 - DNA, 17 bp, Homo sapiens
tagctgccccgaatgct

SEQ ID NO: 9210745 - DNA, 22 bp, Homo sapiens
tagctgcctatgtgataagaga

SEQ ID NO: 9210746 - DNA, 22 bp, Homo sapiens
tagctgcctttgggctcctgct

SEQ ID NO: 9210747 - DNA, 22 bp, Homo sapiens
tagctgccaaaagggtgggcta

SEQ ID NO: 9210748 - DNA, 22 bp, Homo sapiens
tagctgccattgctccaggaag

SEQ ID NO: 9210749 - DNA, 22 bp, Homo sapiens
tagagagccagttgtcatagtt

SEQ ID NO: 9210750 - DNA, 22 bp, Homo sapiens
tagacttttcaaaatctagacc

SEQ ID NO: 9210751 - DNA, 21 bp, Homo sapiens
tagagaaaagaagctgttcct

SEQ ID NO: 9210752 - DNA, 22 bp, Homo sapiens
tagagaaataagctttgccttg

SEQ ID NO: 9210753 - DNA, 22 bp, Homo sapiens
tagagaaaagcagggatcagga

SEQ ID NO: 9210754 - DNA, 22 bp, Homo sapiens
tagaactgtccaagtctgagct

SEQ ID NO: 9210755 - DNA, 22 bp, Homo sapiens
tagaactggcggctagaccact

SEQ ID NO: 9210756 - DNA, 19 bp, Homo sapiens
tagaactgaggacttgcat

SEQ ID NO: 9210757 - DNA, 22 bp, Homo sapiens
tagaaatggggaagtagttagg

SEQ ID NO: 9210758 - DNA, 22 bp, Homo sapiens
tagaaatgggttacatttagag

SEQ ID NO: 9210759 - DNA, 22 bp, Homo sapiens
tagttcttcatgaattcagctt

SEQ ID NO: 9210760 - DNA, 22 bp, Homo sapiens
tagtttactgttcactttgccc

SEQ ID NO: 9210761 - DNA, 22 bp, Homo sapiens
tagtttagcactaagaaaaaca

SEQ ID NO: 9210762 - DNA, 22 bp, Homo sapiens
tagttttgattagtattgtctt

SEQ ID NO: 9210763 - DNA, 22 bp, Homo sapiens
tagtttttaagtgtacaatttc

SEQ ID NO: 9210764 - DNA, 22 bp, Homo sapiens
tagtttcagattgctttcatat

SEQ ID NO: 9210765 - DNA, 22 bp, Homo sapiens
tagtttcagctccttcatcctg

SEQ ID NO: 9210766 - DNA, 22 bp, Homo sapiens
tagtttcatatgcaaaatagta

SEQ ID NO: 9210767 - DNA, 23 bp, Homo sapiens
taggggaaaaatcttctgcaatt

SEQ ID NO: 9210768 - DNA, 22 bp, Homo sapiens
taggggcagaagcggcggtcca

SEQ ID NO: 9210769 - DNA, 22 bp, Homo sapiens
tagtgccctcccctttgggata

SEQ ID NO: 9210770 - DNA, 23 bp, Homo sapiens
tagggcagctgggagggacatgc

SEQ ID NO: 9210771 - DNA, 22 bp, Homo sapiens
tagggcagagtccaggatgggc

SEQ ID NO: 9210772 - DNA, 22 bp, Homo sapiens
tagggctgtgtctccaggacca

SEQ ID NO: 9210773 - DNA, 22 bp, Homo sapiens
tagggcttcaggtgtgaggcag

SEQ ID NO: 9210774 - DNA, 20 bp, Homo sapiens
taggcagagctgtgcagcct

SEQ ID NO: 9210775 - DNA, 22 bp, Homo sapiens
taggcagaggtatggtaaggac

SEQ ID NO: 9210776 - DNA, 22 bp, Homo sapiens
taggcagcgcttggctgtgctt

SEQ ID NO: 9210777 - DNA, 22 bp, Homo sapiens
taggcagcgcttggctgtgctt

SEQ ID NO: 9210778 - DNA, 23 bp, Homo sapiens
taggccagggtgacctggggaga

SEQ ID NO: 9210779 - DNA, 22 bp, Homo sapiens
tatttgcaggacatagatatgg

SEQ ID NO: 9210780 - DNA, 22 bp, Homo sapiens
tatttgcaggcttttgtcatgg

SEQ ID NO: 9210781 - DNA, 22 bp, Homo sapiens
tatttcttgttattctcgttga

SEQ ID NO: 9210782 - DNA, 22 bp, Homo sapiens
tatttcttgttattctcgttga

SEQ ID NO: 9210783 - DNA, 22 bp, Homo sapiens
tatttggacaccaagtagaagt

SEQ ID NO: 9210784 - DNA, 22 bp, Homo sapiens
tattttgaaagtctgttttgaa

SEQ ID NO: 9210785 - DNA, 22 bp, Homo sapiens
tatttggaaatgataaagtact

SEQ ID NO: 9210786 - DNA, 22 bp, Homo sapiens
tattacaatttacattgcactt

SEQ ID NO: 9210787 - DNA, 23 bp, Homo sapiens
tattacaattggtcttattaaga

SEQ ID NO: 9210788 - DNA, 22 bp, Homo sapiens
tattgtttctggctgtggcagc

SEQ ID NO: 9210789 - DNA, 22 bp, Homo sapiens
tcaaatatgtgatagaagctaa

SEQ ID NO: 9210790 - DNA, 22 bp, Homo sapiens
tcaaatatgtgatagaagctaa

SEQ ID NO: 9210791 - DNA, 22 bp, Homo sapiens
tcaaagtaccagagtgaactga

SEQ ID NO: 9210792 - DNA, 22 bp, Homo sapiens
tcaaagtaccattatcagtgga

SEQ ID NO: 9210793 - DNA, 22 bp, Homo sapiens
tcaaagtatctcatggagagca

SEQ ID NO: 9210794 - DNA, 22 bp, Homo sapiens
tcaaagtatgctttctttggga

SEQ ID NO: 9210795 - DNA, 22 bp, Homo sapiens
tcaaaaataagatattctggac

SEQ ID NO: 9210796 - DNA, 22 bp, Homo sapiens
tcaaaaataagatattctggac

SEQ ID NO: 9210797 - DNA, 22 bp, Homo sapiens
tatttttgcctctcagataaaa

SEQ ID NO: 9210798 - DNA, 22 bp, Homo sapiens
tattttgtaattggtcatagct

SEQ ID NO: 9210799 - DNA, 22 bp, Homo sapiens
tattttgacgattttatgcaaa

SEQ ID NO: 9210800 - DNA, 22 bp, Homo sapiens
tattttgaggtatttttgagct

SEQ ID NO: 9210801 - DNA, 22 bp, Homo sapiens
tattttgagcccctgacatcta

SEQ ID NO: 9210802 - DNA, 22 bp, Homo sapiens
tattttgaggtatttttgagct

SEQ ID NO: 9210803 - DNA, 20 bp, Homo sapiens
tcaaagcaaagggagatgat

SEQ ID NO: 9210804 - DNA, 20 bp, Homo sapiens
tcaaagcaaagggagatgat

SEQ ID NO: 9210805 - DNA, 22 bp, Homo sapiens
tcaaagagctattcagttgtgg

SEQ ID NO: 9210806 - DNA, 22 bp, Homo sapiens
tcaaagagctctatcttcaaaa

SEQ ID NO: 9210807 - DNA, 22 bp, Homo sapiens
tatcattttactgtgacatttt

SEQ ID NO: 9210808 - DNA, 23 bp, Homo sapiens
tatctttttcaatgttggaaata

SEQ ID NO: 9210809 - DNA, 22 bp, Homo sapiens
tataaagagtctcaaagaagtt

SEQ ID NO: 9210810 - DNA, 22 bp, Homo sapiens
tataaactatatgttagccaga

SEQ ID NO: 9210811 - DNA, 22 bp, Homo sapiens
tatgtttggcctggcaatttca

SEQ ID NO: 9210812 - DNA, 22 bp, Homo sapiens
tattaagagatgtatgaagaga

SEQ ID NO: 9210813 - DNA, 22 bp, Homo sapiens
tattaagtatcttgatgacaaa

SEQ ID NO: 9210814 - DNA, 22 bp, Homo sapiens
tattaattcttgccaattctcc

SEQ ID NO: 9210815 - DNA, 22 bp, Homo sapiens
tatgtattctcagatttactaa

SEQ ID NO: 9210816 - DNA, 22 bp, Homo sapiens
tatgtatatgtgtgttgacaac

SEQ ID NO: 9210817 - DNA, 22 bp, Homo sapiens
tatgtataatcacagagtgtca

SEQ ID NO: 9210818 - DNA, 18 bp, Homo sapiens
tatgtataacatagttca

SEQ ID NO: 9210819 - DNA, 22 bp, Homo sapiens
tatgtaggtaaacacagacata

SEQ ID NO: 9210820 - DNA, 22 bp, Homo sapiens
tatggcttcttttgcaactact

SEQ ID NO: 9210821 - DNA, 22 bp, Homo sapiens
tatggcttctgggccaaattta

SEQ ID NO: 9210822 - DNA, 22 bp, Homo sapiens
tatgctttcattcatatgtgag

SEQ ID NO: 9210823 - DNA, 22 bp, Homo sapiens
tatgctttacttttcattgtga

SEQ ID NO: 9210824 - DNA, 22 bp, Homo sapiens
tatgctttggtagagagttgtg

SEQ ID NO: 9210825 - DNA, 22 bp, Homo sapiens
tatgcttttaacctgtaactga

SEQ ID NO: 9210826 - DNA, 20 bp, Homo sapiens
tatgctttttataagattga

SEQ ID NO: 9210827 - DNA, 22 bp, Homo sapiens
tccaggctagaagtcacaggcc

SEQ ID NO: 9210828 - DNA, 22 bp, Homo sapiens
tccaggctacttggattcctgg

SEQ ID NO: 9210829 - DNA, 22 bp, Homo sapiens
tccaggctagagtgcagtggcc

SEQ ID NO: 9210830 - DNA, 22 bp, Homo sapiens
tccaggctagcctggtagagaa

SEQ ID NO: 9210831 - DNA, 22 bp, Homo sapiens
tccaggctaggtttacaggaca

SEQ ID NO: 9210832 - DNA, 21 bp, Homo sapiens
tccaggctggaaggggcgttg

SEQ ID NO: 9210833 - DNA, 21 bp, Homo sapiens
tccaggctggaaggggcgttg

SEQ ID NO: 9210834 - DNA, 22 bp, Homo sapiens
tccaggctggacatgaggcggg

SEQ ID NO: 9210835 - DNA, 22 bp, Homo sapiens
tccaggctggagtgcagtggca

SEQ ID NO: 9210836 - DNA, 22 bp, Homo sapiens
tccaggctggacatgaggcggg

SEQ ID NO: 9210837 - DNA, 22 bp, Homo sapiens
tccaggctggacatgaggcggg

SEQ ID NO: 9210838 - DNA, 22 bp, Homo sapiens
tccaggctggctcttcaaaatt

SEQ ID NO: 9210839 - DNA, 22 bp, Homo sapiens
tccaggctggcctcgcgtgaca

SEQ ID NO: 9210840 - DNA, 22 bp, Homo sapiens
tccaggctggagtgcagtggcg

SEQ ID NO: 9210841 - DNA, 18 bp, Homo sapiens
tccaggctggattgatga

SEQ ID NO: 9210842 - DNA, 22 bp, Homo sapiens
tccaggctaattttgcattgtt

SEQ ID NO: 9210843 - DNA, 22 bp, Homo sapiens
tccaggctaattttgcattgtt

SEQ ID NO: 9210844 - DNA, 20 bp, Homo sapiens
tccaggccttgttctcagat

SEQ ID NO: 9210845 - DNA, 22 bp, Homo sapiens
tccaggccttgacaggtcagtt

SEQ ID NO: 9210846 - DNA, 22 bp, Homo sapiens
tccaggcctggctccattcagt

SEQ ID NO: 9210847 - DNA, 22 bp, Homo sapiens
tccaggcctctagccctctctt

SEQ ID NO: 9210848 - DNA, 22 bp, Homo sapiens
tccacaaggcagctcctccagg

SEQ ID NO: 9210849 - DNA, 23 bp, Homo sapiens
tccaggctgggacttcaactggc

SEQ ID NO: 9210850 - DNA, 22 bp, Homo sapiens
tccaggctttttcatgctgtct

SEQ ID NO: 9210851 - DNA, 22 bp, Homo sapiens
tccagggaaggtgtgaggctgg

SEQ ID NO: 9210852 - DNA, 22 bp, Homo sapiens
tccagggacacagagtccttct

SEQ ID NO: 9210853 - DNA, 18 bp, Homo sapiens
tccagggcttcctcctct

SEQ ID NO: 9210854 - DNA, 22 bp, Homo sapiens
tccagggctgttactttacata

SEQ ID NO: 9210855 - DNA, 22 bp, Homo sapiens
tccagtcaacttaatctcttta

SEQ ID NO: 9210856 - DNA, 21 bp, Homo sapiens
tccagtcaacttggcttggct

SEQ ID NO: 9210857 - DNA, 19 bp, Homo sapiens
tccatgcccaggcaccaag

SEQ ID NO: 9210858 - DNA, 22 bp, Homo sapiens
tccaggtcttcctattccaggt

SEQ ID NO: 9210859 - DNA, 22 bp, Homo sapiens
tccaggtctggttggacaggtt

SEQ ID NO: 9210860 - DNA, 18 bp, Homo sapiens
tccagggcttcctcctct

SEQ ID NO: 9210861 - DNA, 18 bp, Homo sapiens
tccagggcttcctcctct

SEQ ID NO: 9210862 - DNA, 21 bp, Homo sapiens
tccagggctttgattctctca

SEQ ID NO: 9210863 - DNA, 21 bp, Homo sapiens
tccagggctttgattctctca

SEQ ID NO: 9210864 - DNA, 22 bp, Homo sapiens
tccaggtctggcctgctaggca

SEQ ID NO: 9210865 - DNA, 19 bp, Homo sapiens
tccatggctcttcatcctt

SEQ ID NO: 9210866 - DNA, 22 bp, Homo sapiens
tcccaaatataatgcaagagac

SEQ ID NO: 9210867 - DNA, 22 bp, Homo sapiens
tcccagagatttcctctccttc

SEQ ID NO: 9210868 - DNA, 22 bp, Homo sapiens
tcccaggcgcctggtggggagc

SEQ ID NO: 9210869 - DNA, 16 bp, Homo sapiens
tcccaggccaggtgga

SEQ ID NO: 9210870 - DNA, 22 bp, Homo sapiens
tcccaggccacacttggggaac

SEQ ID NO: 9210871 - DNA, 22 bp, Homo sapiens
tcccaggcaggtgacaggggga

SEQ ID NO: 9210872 - DNA, 22 bp, Homo sapiens
tcccagaggctccagtctctat

SEQ ID NO: 9210873 - DNA, 22 bp, Homo sapiens
tcccagaggctccagtctctat

SEQ ID NO: 9210874 - DNA, 22 bp, Homo sapiens
tcccagcataacaaactgcccg

SEQ ID NO: 9210875 - DNA, 22 bp, Homo sapiens
tcccagcattaatgcctgtcag

SEQ ID NO: 9210876 - DNA, 22 bp, Homo sapiens
tcccagcataacaaactgcccg

SEQ ID NO: 9210877 - DNA, 22 bp, Homo sapiens
tcccagcattaatgcctgtcag

SEQ ID NO: 9210878 - DNA, 22 bp, Homo sapiens
tcctcagaagaacccctagatt

SEQ ID NO: 9210879 - DNA, 22 bp, Homo sapiens
tcctcagaatccaaactgcagt

SEQ ID NO: 9210880 - DNA, 22 bp, Homo sapiens
tcctcagaatcacctggcagct

SEQ ID NO: 9210881 - DNA, 19 bp, Homo sapiens
tcctcaggggctcacagac

SEQ ID NO: 9210882 - DNA, 22 bp, Homo sapiens
tcctcagggcggcctccgtctt

SEQ ID NO: 9210883 - DNA, 22 bp, Homo sapiens
tcctcaggtcaaagcaggagaa

SEQ ID NO: 9210884 - DNA, 22 bp, Homo sapiens
tcctcaggtcaaagcaggagaa

SEQ ID NO: 9210885 - DNA, 19 bp, Homo sapiens
tcctcaggggctcacagac

SEQ ID NO: 9210886 - DNA, 22 bp, Homo sapiens
tcctcagggcggcctccgtctt

SEQ ID NO: 9210887 - DNA, 21 bp, Homo sapiens
tcctcagggccccagagcact

SEQ ID NO: 9210888 - DNA, 22 bp, Homo sapiens
tcctcagcattagcacagacat

SEQ ID NO: 9210889 - DNA, 22 bp, Homo sapiens
tcctcagggaagatgagcctca

SEQ ID NO: 9210890 - DNA, 22 bp, Homo sapiens
tcctcagagcagccctccgcat

SEQ ID NO: 9210891 - DNA, 22 bp, Homo sapiens
tcctcagcaaacacttcactct

SEQ ID NO: 9210892 - DNA, 22 bp, Homo sapiens
tcctcagcaaacacttcactct

SEQ ID NO: 9210893 - DNA, 22 bp, Homo sapiens
tccctgggactcagacatggaa

SEQ ID NO: 9210894 - DNA, 22 bp, Homo sapiens
tcctagaatgcacctctgctgt

SEQ ID NO: 9210895 - DNA, 22 bp, Homo sapiens
tccctggagataacttctggga

SEQ ID NO: 9210896 - DNA, 22 bp, Homo sapiens
tccctggcacaagaaggctgtc

SEQ ID NO: 9210897 - DNA, 22 bp, Homo sapiens
tccctctgtgttgggcatgcct

SEQ ID NO: 9210898 - DNA, 22 bp, Homo sapiens
tccctgaaacatctctgtggat

SEQ ID NO: 9210899 - DNA, 22 bp, Homo sapiens
tccctctgggctggagcagggt

SEQ ID NO: 9210900 - DNA, 22 bp, Homo sapiens
tccctctggtctggacgccata

SEQ ID NO: 9210901 - DNA, 22 bp, Homo sapiens
tccctctgctagtgcttgagct

SEQ ID NO: 9210902 - DNA, 22 bp, Homo sapiens
tccctctggaggctctagggga

SEQ ID NO: 9210903 - DNA, 19 bp, Homo sapiens
tccctccctgtaatctcac

SEQ ID NO: 9210904 - DNA, 20 bp, Homo sapiens
tccctccctccagctctggg

SEQ ID NO: 9210905 - DNA, 22 bp, Homo sapiens
tccctccccacttctgagcttt

SEQ ID NO: 9210906 - DNA, 22 bp, Homo sapiens
tccctccccacttctgagcttt

SEQ ID NO: 9210907 - DNA, 20 bp, Homo sapiens
tccctcagtcctggctttgt

SEQ ID NO: 9210908 - DNA, 22 bp, Homo sapiens
tccctcagggtgcagttgcttt

SEQ ID NO: 9210909 - DNA, 22 bp, Homo sapiens
tccctcagcttgtctccatgca

SEQ ID NO: 9210910 - DNA, 22 bp, Homo sapiens
tccctcagcttgtctccatgca

SEQ ID NO: 9210911 - DNA, 23 bp, Homo sapiens
tccctcaggccttatctccatct

SEQ ID NO: 9210912 - DNA, 22 bp, Homo sapiens
tcccaggctaggcctctgcgtt

SEQ ID NO: 9210913 - DNA, 22 bp, Homo sapiens
tcccaggctaccagtgaggtca

SEQ ID NO: 9210914 - DNA, 22 bp, Homo sapiens
tcccaggctcttcaaggaagac

SEQ ID NO: 9210915 - DNA, 20 bp, Homo sapiens
tcccaggctccaccctagac

SEQ ID NO: 9210916 - DNA, 20 bp, Homo sapiens
tcccaggctccaccctagac

SEQ ID NO: 9210917 - DNA, 22 bp, Homo sapiens
tcccaggctggcaggcagcagt

SEQ ID NO: 9210918 - DNA, 22 bp, Homo sapiens
tcccaggctaggcctctgcgtt

SEQ ID NO: 9210919 - DNA, 22 bp, Homo sapiens
tcccaggctggggccaggtgac

SEQ ID NO: 9210920 - DNA, 23 bp, Homo sapiens
tcccagggaaggtgagcgaggct

SEQ ID NO: 9210921 - DNA, 22 bp, Homo sapiens
tcccaggctgggggcctgaagt

SEQ ID NO: 9210922 - DNA, 23 bp, Homo sapiens
tcccagggaaggtgagcgaggct

SEQ ID NO: 9210923 - DNA, 22 bp, Homo sapiens
tcccagggacaccaagctgttt

SEQ ID NO: 9210924 - DNA, 22 bp, Homo sapiens
tccctcagatgagctcctagca

SEQ ID NO: 9210925 - DNA, 21 bp, Homo sapiens
tccctcagacagggtgcctat

SEQ ID NO: 9210926 - DNA, 22 bp, Homo sapiens
tccctcagagaccgtggtgcag

SEQ ID NO: 9210927 - DNA, 20 bp, Homo sapiens
tccctcagcacttctacctc

SEQ ID NO: 9210928 - DNA, 22 bp, Homo sapiens
tcccagggacccagcctgatac

SEQ ID NO: 9210929 - DNA, 22 bp, Homo sapiens
tcccagggacccagcctgatac

SEQ ID NO: 9210930 - DNA, 22 bp, Homo sapiens
tcccagggactctctgccttcc

SEQ ID NO: 9210931 - DNA, 22 bp, Homo sapiens
tcccctttgtaagatggaaacg

SEQ ID NO: 9210932 - DNA, 19 bp, Homo sapiens
tcccgcccactgagcgtgc

SEQ ID NO: 9210933 - DNA, 22 bp, Homo sapiens
tcccgcccttgtacttgccgag

SEQ ID NO: 9210934 - DNA, 22 bp, Homo sapiens
tcccgcttcttccgaatcgcga

SEQ ID NO: 9210935 - DNA, 22 bp, Homo sapiens
tcctgaagctctcttaaggaaa

SEQ ID NO: 9210936 - DNA, 22 bp, Homo sapiens
tcctgagacatctctgctggtc

SEQ ID NO: 9210937 - DNA, 22 bp, Homo sapiens
tcctgaagaggttgtctttata

SEQ ID NO: 9210938 - DNA, 22 bp, Homo sapiens
tcctgaagatgaaaagagaggt

SEQ ID NO: 9210939 - DNA, 22 bp, Homo sapiens
tcctgaagaacgaagtcatgta

SEQ ID NO: 9210940 - DNA, 22 bp, Homo sapiens
tcctgaagaaggcagatatttg

SEQ ID NO: 9210941 - DNA, 22 bp, Homo sapiens
tcctcttctgcccatcagaggc

SEQ ID NO: 9210942 - DNA, 22 bp, Homo sapiens
tcctctggggcgtggtcctgga

SEQ ID NO: 9210943 - DNA, 22 bp, Homo sapiens
tcctctggtcttcggtgtggac

SEQ ID NO: 9210944 - DNA, 22 bp, Homo sapiens
tcctgagccctggggtcagtgt

SEQ ID NO: 9210945 - DNA, 22 bp, Homo sapiens
tcctgagcacctatgccatggc

SEQ ID NO: 9210946 - DNA, 22 bp, Homo sapiens
tcctgagtgagagctgggaggt

SEQ ID NO: 9210947 - DNA, 22 bp, Homo sapiens
tcctgagctttacagtaaggac

SEQ ID NO: 9210948 - DNA, 22 bp, Homo sapiens
tcctgagctgccgcatcagcag

SEQ ID NO: 9210949 - DNA, 22 bp, Homo sapiens
tcctgcagccattagaggtcaa

SEQ ID NO: 9210950 - DNA, 22 bp, Homo sapiens
tcctgcagccactgcaggcaga

SEQ ID NO: 9210951 - DNA, 22 bp, Homo sapiens
tcctgcagctctgagaagcatc

SEQ ID NO: 9210952 - DNA, 22 bp, Homo sapiens
tcctgcccagagctctccactc

SEQ ID NO: 9210953 - DNA, 22 bp, Homo sapiens
tcctgcctcaggctctggagta

SEQ ID NO: 9210954 - DNA, 22 bp, Homo sapiens
tcctgcctctccatgctaacta

SEQ ID NO: 9210955 - DNA, 22 bp, Homo sapiens
tcctgcctcacagttgaagttt

SEQ ID NO: 9210956 - DNA, 22 bp, Homo sapiens
tcctgcctcaggctctggagta

SEQ ID NO: 9210957 - DNA, 22 bp, Homo sapiens
tcctgcctcacagttgaagttt

SEQ ID NO: 9210958 - DNA, 22 bp, Homo sapiens
tcctgcctaccttgcggaggtg

SEQ ID NO: 9210959 - DNA, 22 bp, Homo sapiens
tcctgcctagcaggtgacctat

SEQ ID NO: 9210960 - DNA, 22 bp, Homo sapiens
tcctgcctgagcgtggaggagg

SEQ ID NO: 9210961 - DNA, 22 bp, Homo sapiens
tcctgcctgagcgtggaggagg

SEQ ID NO: 9210962 - DNA, 22 bp, Homo sapiens
tcctgcctgcaatcccagcact

SEQ ID NO: 9210963 - DNA, 22 bp, Homo sapiens
tcctgcctgcaatcccagcact

SEQ ID NO: 9210964 - DNA, 22 bp, Homo sapiens
tcctgcctgcaatcccagcact

SEQ ID NO: 9210965 - DNA, 22 bp, Homo sapiens
tcctgcctcttttcttattcca

SEQ ID NO: 9210966 - DNA, 22 bp, Homo sapiens
tcctgcctcttgccttcttcac

SEQ ID NO: 9210967 - DNA, 22 bp, Homo sapiens
tcctgcctgagcgtggaggagg

SEQ ID NO: 9210968 - DNA, 22 bp, Homo sapiens
tcaggctgttagccacctcctc

SEQ ID NO: 9210969 - DNA, 22 bp, Homo sapiens
tcaggctgtagggcccctggag

SEQ ID NO: 9210970 - DNA, 22 bp, Homo sapiens
tcaggctgtagggcccctggag

SEQ ID NO: 9210971 - DNA, 22 bp, Homo sapiens
tcaggctgttcctgtccaaaat

SEQ ID NO: 9210972 - DNA, 22 bp, Homo sapiens
tcaggctgttcctgtccaaaat

SEQ ID NO: 9210973 - DNA, 21 bp, Homo sapiens
tcagggcagctgctcttcaga

SEQ ID NO: 9210974 - DNA, 22 bp, Homo sapiens
tcagggcaggcgagcagctgct

SEQ ID NO: 9210975 - DNA, 17 bp, Homo sapiens
tcaggctgggtgcagtg

SEQ ID NO: 9210976 - DNA, 17 bp, Homo sapiens
tcaggctgggtgcagtg

SEQ ID NO: 9210977 - DNA, 17 bp, Homo sapiens
tcaggctgggtgcagtg

SEQ ID NO: 9210978 - DNA, 17 bp, Homo sapiens
tcaggctgggtgcagtg

SEQ ID NO: 9210979 - DNA, 22 bp, Homo sapiens
tcaggagacttatgtcacagtg

SEQ ID NO: 9210980 - DNA, 22 bp, Homo sapiens
tcaggagacttatgtcacagtg

SEQ ID NO: 9210981 - DNA, 20 bp, Homo sapiens
tcaggctggtgggctttccc

SEQ ID NO: 9210982 - DNA, 22 bp, Homo sapiens
tcaggctggtggtcagatggct

SEQ ID NO: 9210983 - DNA, 22 bp, Homo sapiens
tcaggctggtccccacagtgga

SEQ ID NO: 9210984 - DNA, 22 bp, Homo sapiens
tcaggctggtccccacagtgga

SEQ ID NO: 9210985 - DNA, 22 bp, Homo sapiens
tcaggctggtggtcagatggct

SEQ ID NO: 9210986 - DNA, 22 bp, Homo sapiens
tcaggctggtggtcagatggct

SEQ ID NO: 9210987 - DNA, 22 bp, Homo sapiens
tcaggctgtaaatggtgtgggt

SEQ ID NO: 9210988 - DNA, 22 bp, Homo sapiens
tcagtaaataactcagatgctc

SEQ ID NO: 9210989 - DNA, 22 bp, Homo sapiens
tcagtctcagcacctagtcaca

SEQ ID NO: 9210990 - DNA, 22 bp, Homo sapiens
tcagtgttctggatttggggca

SEQ ID NO: 9210991 - DNA, 22 bp, Homo sapiens
tcagtgttcttatttaattagg

SEQ ID NO: 9210992 - DNA, 22 bp, Homo sapiens
tcagtgttgaattttttgcaaa

SEQ ID NO: 9210993 - DNA, 22 bp, Homo sapiens
tcagtgttggcattcagaaatg

SEQ ID NO: 9210994 - DNA, 22 bp, Homo sapiens
tcagtgttggcattcagaaatg

SEQ ID NO: 9210995 - DNA, 22 bp, Homo sapiens
tcagtgttggagataattgcac

SEQ ID NO: 9210996 - DNA, 22 bp, Homo sapiens
tcagtgttggtcaagaatcagt

SEQ ID NO: 9210997 - DNA, 22 bp, Homo sapiens
tcagtgtttaccgtatgttgtt

SEQ ID NO: 9210998 - DNA, 22 bp, Homo sapiens
tcagtgtttattcaatgttatt

SEQ ID NO: 9210999 - DNA, 22 bp, Homo sapiens
tcagtgtttcagtttggaaatg

SEQ ID NO: 9211000 - DNA, 22 bp, Homo sapiens
tcagtgtttattgcggtgtgta

SEQ ID NO: 9211001 - DNA, 22 bp, Homo sapiens
tcagtgtttacatgcatccttg

SEQ ID NO: 9211002 - DNA, 22 bp, Homo sapiens
tcagtgttgtgcacatacaaaa

SEQ ID NO: 9211003 - DNA, 22 bp, Homo sapiens
tcagtgttggctacatctgcct

SEQ ID NO: 9211004 - DNA, 22 bp, Homo sapiens
tcagtgttggtcaagaatcagt

SEQ ID NO: 9211005 - DNA, 22 bp, Homo sapiens
tcataaagttatcaccaaatcc

SEQ ID NO: 9211006 - DNA, 22 bp, Homo sapiens
tcagtgtttggtttcagaattg

SEQ ID NO: 9211007 - DNA, 22 bp, Homo sapiens
tcagtgtttgaacccagggtta

SEQ ID NO: 9211008 - DNA, 22 bp, Homo sapiens
tcagtgtttcctgtggtacagc

SEQ ID NO: 9211009 - DNA, 22 bp, Homo sapiens
tcagtgtttcctagagcatata

SEQ ID NO: 9211010 - DNA, 22 bp, Homo sapiens
tcagtgtttcctagagcatata

SEQ ID NO: 9211011 - DNA, 22 bp, Homo sapiens
tcagtgtttgtggcaaatgtta

SEQ ID NO: 9211012 - DNA, 22 bp, Homo sapiens
tcagtgttttaactgtctttta

SEQ ID NO: 9211013 - DNA, 22 bp, Homo sapiens
tcagtgtttgtggcaaatgtta

SEQ ID NO: 9211014 - DNA, 22 bp, Homo sapiens
tcagtgttttccagggtctact

SEQ ID NO: 9211015 - DNA, 22 bp, Homo sapiens
tcagtgtttttaaagcaatata

SEQ ID NO: 9211016 - DNA, 22 bp, Homo sapiens
tcagtgtttttaaagcaatata

SEQ ID NO: 9211017 - DNA, 22 bp, Homo sapiens
tcatgcagaggaaggctagttt

SEQ ID NO: 9211018 - DNA, 22 bp, Homo sapiens
tcatctgtctgttcaacagcct

SEQ ID NO: 9211019 - DNA, 22 bp, Homo sapiens
tcatctgaggcaccagagcata

SEQ ID NO: 9211020 - DNA, 22 bp, Homo sapiens
tcatctgtggctgcttttgtgc

SEQ ID NO: 9211021 - DNA, 22 bp, Homo sapiens
tcatctgttatgggagtttttg

SEQ ID NO: 9211022 - DNA, 22 bp, Homo sapiens
tcatcttctattaatagggaga

SEQ ID NO: 9211023 - DNA, 22 bp, Homo sapiens
tcatacattcagcagatatttg

SEQ ID NO: 9211024 - DNA, 22 bp, Homo sapiens
tcatttacttctatgacaacat

SEQ ID NO: 9211025 - DNA, 22 bp, Homo sapiens
tcatttactgtaggcaaaaatt

SEQ ID NO: 9211026 - DNA, 22 bp, Homo sapiens
tcattgtaattatctgtggtat

SEQ ID NO: 9211027 - DNA, 21 bp, Homo sapiens
tccaaatcccattctgtagtc

SEQ ID NO: 9211028 - DNA, 22 bp, Homo sapiens
tccaaggcatagacacagtgcc

SEQ ID NO: 9211029 - DNA, 19 bp, Homo sapiens
tccaaggcatggcccagtg

SEQ ID NO: 9211030 - DNA, 22 bp, Homo sapiens
tccaaggcctggcagcacaaag

SEQ ID NO: 9211031 - DNA, 22 bp, Homo sapiens
tccaaggccgcaggctgggcct

SEQ ID NO: 9211032 - DNA, 20 bp, Homo sapiens
tccaattaaaaattgtatgc

SEQ ID NO: 9211033 - DNA, 22 bp, Homo sapiens
tccaatgttcctgctttcagct

SEQ ID NO: 9211034 - DNA, 22 bp, Homo sapiens
tcatttttttccggtaggaata

SEQ ID NO: 9211035 - DNA, 22 bp, Homo sapiens
tcattttttgcatacctgtgtc

SEQ ID NO: 9211036 - DNA, 22 bp, Homo sapiens
tcatttttctcttacacgtaga

SEQ ID NO: 9211037 - DNA, 22 bp, Homo sapiens
tcatttttcacacagggtcacc

SEQ ID NO: 9211038 - DNA, 22 bp, Homo sapiens
tcatttttgtctccggtttgtg

SEQ ID NO: 9211039 - DNA, 22 bp, Homo sapiens
tcatttttgaccatgggtagga

SEQ ID NO: 9211040 - DNA, 22 bp, Homo sapiens
tcatttttgaccatgggtagga

SEQ ID NO: 9211041 - DNA, 21 bp, Homo sapiens
tcatttttattgctaccttgc

SEQ ID NO: 9211042 - DNA, 21 bp, Homo sapiens
tcatttttattgctaccttgc

SEQ ID NO: 9211043 - DNA, 18 bp, Homo sapiens
tccaaagctgctggtttt

SEQ ID NO: 9211044 - DNA, 22 bp, Homo sapiens
tccaaagccgactgacatctga

SEQ ID NO: 9211045 - DNA, 18 bp, Homo sapiens
tccaaagccagagaagtt

SEQ ID NO: 9211046 - DNA, 18 bp, Homo sapiens
tccaaaatcatgtatttt

SEQ ID NO: 9211047 - DNA, 22 bp, Homo sapiens
tcagaatgtgcagaggaacagt

SEQ ID NO: 9211048 - DNA, 18 bp, Homo sapiens
tcagacaagttagacagg

SEQ ID NO: 9211049 - DNA, 22 bp, Homo sapiens
tcagacaactctggaggctggc

SEQ ID NO: 9211050 - DNA, 22 bp, Homo sapiens
tcagagtgggagaatgtgccaa

SEQ ID NO: 9211051 - DNA, 22 bp, Homo sapiens
tcagatttactgcagagcagat

SEQ ID NO: 9211052 - DNA, 22 bp, Homo sapiens
tcagatgggttttgaaggatgt

SEQ ID NO: 9211053 - DNA, 22 bp, Homo sapiens
tcagatggaatgatgccactgc

SEQ ID NO: 9211054 - DNA, 22 bp, Homo sapiens
tcagatttccttgcagtttgga

SEQ ID NO: 9211055 - DNA, 22 bp, Homo sapiens
tcagcaagaagctgtgggcttc

SEQ ID NO: 9211056 - DNA, 17 bp, Homo sapiens
tcagcaggggccaagct

SEQ ID NO: 9211057 - DNA, 22 bp, Homo sapiens
tcagcagggagaggagaatgca

SEQ ID NO: 9211058 - DNA, 22 bp, Homo sapiens
tcagcatatgtttggagtgtcc

SEQ ID NO: 9211059 - DNA, 22 bp, Homo sapiens
tcagccaagaagggaactggtc

SEQ ID NO: 9211060 - DNA, 22 bp, Homo sapiens
tcagccagccagctacaggctt

SEQ ID NO: 9211061 - DNA, 19 bp, Homo sapiens
tcagctctggggtcagtgg

SEQ ID NO: 9211062 - DNA, 22 bp, Homo sapiens
tcagctgccccatgtgttcact

SEQ ID NO: 9211063 - DNA, 22 bp, Homo sapiens
tcagccaggcacaatggcagct

SEQ ID NO: 9211064 - DNA, 22 bp, Homo sapiens
tcagccaggcacaatggcagct

SEQ ID NO: 9211065 - DNA, 22 bp, Homo sapiens
tcagctctgcctgtggaggcac

SEQ ID NO: 9211066 - DNA, 22 bp, Homo sapiens
tcaggaagggtggtccacaggg

SEQ ID NO: 9211067 - DNA, 22 bp, Homo sapiens
tcaggaagggctcagtctgtgc

SEQ ID NO: 9211068 - DNA, 22 bp, Homo sapiens
tcaggaagggctcagtctgtgc

SEQ ID NO: 9211069 - DNA, 22 bp, Homo sapiens
tcaggaagggtggtccacaggg

SEQ ID NO: 9211070 - DNA, 22 bp, Homo sapiens
tcagctggagatccttgttgtg

SEQ ID NO: 9211071 - DNA, 19 bp, Homo sapiens
tcagctggcaggcctcctc

SEQ ID NO: 9211072 - DNA, 22 bp, Homo sapiens
tcagctggaagatggtgcagaa

SEQ ID NO: 9211073 - DNA, 22 bp, Homo sapiens
tcaggacagaaggctgccaggg

SEQ ID NO: 9211074 - DNA, 22 bp, Homo sapiens
tcaggacagagatcagaacttc

SEQ ID NO: 9211075 - DNA, 22 bp, Homo sapiens
tcaggacagactagactagcgt

SEQ ID NO: 9211076 - DNA, 22 bp, Homo sapiens
tcaggagaacttccttctaccc

SEQ ID NO: 9211077 - DNA, 22 bp, Homo sapiens
tcaggagaatcagggctgtcct

SEQ ID NO: 9211078 - DNA, 18 bp, Homo sapiens
tcaggagacacagacgca

SEQ ID NO: 9211079 - DNA, 21 bp, Homo sapiens
tcagaatgaaaaggcaatctg

SEQ ID NO: 9211080 - DNA, 22 bp, Homo sapiens
tcagaatggcccataaatagtc

SEQ ID NO: 9211081 - DNA, 22 bp, Homo sapiens
tcagaatggacccagactatag

SEQ ID NO: 9211082 - DNA, 22 bp, Homo sapiens
tcagaatatgctaatgacattt

SEQ ID NO: 9211083 - DNA, 22 bp, Homo sapiens
tcagaagtttcaatcccagctg

SEQ ID NO: 9211084 - DNA, 22 bp, Homo sapiens
tcagaagttgataaagtagttg

SEQ ID NO: 9211085 - DNA, 22 bp, Homo sapiens
tcagaagttgataaagtagttg

SEQ ID NO: 9211086 - DNA, 22 bp, Homo sapiens
tcagaagccggaagtgctcctc

SEQ ID NO: 9211087 - DNA, 22 bp, Homo sapiens
tcagaagttaatacgaggagaa

SEQ ID NO: 9211088 - DNA, 22 bp, Homo sapiens
tcagaaaggagttagaggtctc

SEQ ID NO: 9211089 - DNA, 22 bp, Homo sapiens
tcagaaaggccacatggtgcag

SEQ ID NO: 9211090 - DNA, 22 bp, Homo sapiens
tcagaaagctatatggtgtgtc

SEQ ID NO: 9211091 - DNA, 22 bp, Homo sapiens
tcagaaagacgaaacagatggg

SEQ ID NO: 9211092 - DNA, 22 bp, Homo sapiens
tcagaaacactcttcttctgtc

SEQ ID NO: 9211093 - DNA, 22 bp, Homo sapiens
tcagaaacactcttcttctgtc

SEQ ID NO: 9211094 - DNA, 22 bp, Homo sapiens
tcagaaaccagctctctcaatt

SEQ ID NO: 9211095 - DNA, 22 bp, Homo sapiens
tcacatttgttcttgaatctaa

SEQ ID NO: 9211096 - DNA, 22 bp, Homo sapiens
tcacatttgttcctctgcactt

SEQ ID NO: 9211097 - DNA, 22 bp, Homo sapiens
tcacatttgtgttttattagag

SEQ ID NO: 9211098 - DNA, 22 bp, Homo sapiens
tcacatttgcaattgcattgtt

SEQ ID NO: 9211099 - DNA, 22 bp, Homo sapiens
tcactgcaacctccacctcccg

SEQ ID NO: 9211100 - DNA, 22 bp, Homo sapiens
tcactgcaacctccacctcccg

SEQ ID NO: 9211101 - DNA, 22 bp, Homo sapiens
tcagaaaataactgttagtttg

SEQ ID NO: 9211102 - DNA, 22 bp, Homo sapiens
tcactgctcagtctgtactaca

SEQ ID NO: 9211103 - DNA, 23 bp, Homo sapiens
tcactgctactcagcctgagatt

SEQ ID NO: 9211104 - DNA, 22 bp, Homo sapiens
tcactgcaacctccacctcccg

SEQ ID NO: 9211105 - DNA, 22 bp, Homo sapiens
tcactgcaacctccacctcccg

SEQ ID NO: 9211106 - DNA, 22 bp, Homo sapiens
tcactgcaacctccacctcccg

SEQ ID NO: 9211107 - DNA, 22 bp, Homo sapiens
tcactgcaacctccacctcctg

SEQ ID NO: 9211108 - DNA, 22 bp, Homo sapiens
tcactgcaacctccacctcctg

SEQ ID NO: 9211109 - DNA, 22 bp, Homo sapiens
tcactgcaacctccacctcctg

SEQ ID NO: 9211110 - DNA, 22 bp, Homo sapiens
tcactgcaacctccacctcctg

SEQ ID NO: 9211111 - DNA, 22 bp, Homo sapiens
tcactgctacacaagtttctgc

SEQ ID NO: 9211112 - DNA, 22 bp, Homo sapiens
tcactgcgcttcagcctgggtg

SEQ ID NO: 9211113 - DNA, 22 bp, Homo sapiens
tcaagaacttaggagcaagcca

SEQ ID NO: 9211114 - DNA, 22 bp, Homo sapiens
tcaagaactggaaattgatatg

SEQ ID NO: 9211115 - DNA, 22 bp, Homo sapiens
tcaagaactggaaattgatatg

SEQ ID NO: 9211116 - DNA, 22 bp, Homo sapiens
tcacatttctcagcactgatga

SEQ ID NO: 9211117 - DNA, 22 bp, Homo sapiens
tcacatttatttcaaagttact

SEQ ID NO: 9211118 - DNA, 22 bp, Homo sapiens
tcacagtgtcacaatgcctgga

SEQ ID NO: 9211119 - DNA, 18 bp, Homo sapiens
tcacagtgctcttgccta

SEQ ID NO: 9211120 - DNA, 22 bp, Homo sapiens
tcacagtgctctgggtggcaga

SEQ ID NO: 9211121 - DNA, 22 bp, Homo sapiens
gaatttacagggtgagcttcag

SEQ ID NO: 9211122 - DNA, 22 bp, Homo sapiens
gaatttacaagttgaataacaa

SEQ ID NO: 9211123 - DNA, 22 bp, Homo sapiens
gaatttaaggaccaagcatttt

SEQ ID NO: 9211124 - DNA, 22 bp, Homo sapiens
gacaaaagtgttttgaacaagg

SEQ ID NO: 9211125 - DNA, 22 bp, Homo sapiens
gacaaactgaagtatatttaga

SEQ ID NO: 9211126 - DNA, 18 bp, Homo sapiens
gacaaaagtacagacaga

SEQ ID NO: 9211127 - DNA, 22 bp, Homo sapiens
gacaaaactgagatcacactgt

SEQ ID NO: 9211128 - DNA, 19 bp, Homo sapiens
gaatgggaatgggaaagct

SEQ ID NO: 9211129 - DNA, 22 bp, Homo sapiens
gaatggctgaatgtcttaaatt

SEQ ID NO: 9211130 - DNA, 22 bp, Homo sapiens
gaagaagtatttttgtcctgtt

SEQ ID NO: 9211131 - DNA, 22 bp, Homo sapiens
gaagaatcctgtcctctttagg

SEQ ID NO: 9211132 - DNA, 22 bp, Homo sapiens
gaagaatccatgctaatttacc

SEQ ID NO: 9211133 - DNA, 22 bp, Homo sapiens
gaagaatcaagcagtaatttgt

SEQ ID NO: 9211134 - DNA, 22 bp, Homo sapiens
gaagaatctgaggacagtcatt

SEQ ID NO: 9211135 - DNA, 22 bp, Homo sapiens
gaatgcatgtgaagcaaagaat

SEQ ID NO: 9211136 - DNA, 22 bp, Homo sapiens
gaatgcagtgacggaggcttac

SEQ ID NO: 9211137 - DNA, 22 bp, Homo sapiens
gacagctgcatcctcagacaca

SEQ ID NO: 9211138 - DNA, 22 bp, Homo sapiens
gacagctgctcccgtttctgct

SEQ ID NO: 9211139 - DNA, 22 bp, Homo sapiens
gacatacagaatctgcagactt

SEQ ID NO: 9211140 - DNA, 22 bp, Homo sapiens
gacagctgtacactcctggtta

SEQ ID NO: 9211141 - DNA, 17 bp, Homo sapiens
gacagctggttcctggc

SEQ ID NO: 9211142 - DNA, 22 bp, Homo sapiens
gacatacagccctctccctggt

SEQ ID NO: 9211143 - DNA, 22 bp, Homo sapiens
gacatatactatggatggttct

SEQ ID NO: 9211144 - DNA, 22 bp, Homo sapiens
gaccttcttgctgtgtcctaac

SEQ ID NO: 9211145 - DNA, 22 bp, Homo sapiens
gacctggctttgggccccggca

SEQ ID NO: 9211146 - DNA, 22 bp, Homo sapiens
gacctggggtaagcttggcaac

SEQ ID NO: 9211147 - DNA, 22 bp, Homo sapiens
gacctggcctgcacagccctta

SEQ ID NO: 9211148 - DNA, 22 bp, Homo sapiens
gaccttcagtgtgtttctcaca

SEQ ID NO: 9211149 - DNA, 23 bp, Homo sapiens
gagagcccattggcaggggtacc

SEQ ID NO: 9211150 - DNA, 23 bp, Homo sapiens
gagagcccattggcaggggtacc

SEQ ID NO: 9211151 - DNA, 18 bp, Homo sapiens
gagagcccagcaggtggt

SEQ ID NO: 9211152 - DNA, 22 bp, Homo sapiens
gagagcccaaaatttagcaaga

SEQ ID NO: 9211153 - DNA, 22 bp, Homo sapiens
gagagccagctcactccagggc

SEQ ID NO: 9211154 - DNA, 17 bp, Homo sapiens
gagagccctcagatgtc

SEQ ID NO: 9211155 - DNA, 22 bp, Homo sapiens
gagagccctgcatggctgatga

SEQ ID NO: 9211156 - DNA, 22 bp, Homo sapiens
gagaggagaagcctgcgcttca

SEQ ID NO: 9211157 - DNA, 22 bp, Homo sapiens
gagaaggaagttgagccagcat

SEQ ID NO: 9211158 - DNA, 22 bp, Homo sapiens
gagagaagaaagccatggtcct

SEQ ID NO: 9211159 - DNA, 22 bp, Homo sapiens
gagaagccgagtcagctgagcc

SEQ ID NO: 9211160 - DNA, 22 bp, Homo sapiens
gagagaagggggatatgagcct

SEQ ID NO: 9211161 - DNA, 22 bp, Homo sapiens
gagagaagggggatatgagcct

SEQ ID NO: 9211162 - DNA, 22 bp, Homo sapiens
gagagaagaatgttccgaggcc

SEQ ID NO: 9211163 - DNA, 22 bp, Homo sapiens
gagaagccgagtcagctgagcc

SEQ ID NO: 9211164 - DNA, 22 bp, Homo sapiens
gagaagcaggtttagcagacaa

SEQ ID NO: 9211165 - DNA, 22 bp, Homo sapiens
gactcagagatccctggaggtc

SEQ ID NO: 9211166 - DNA, 22 bp, Homo sapiens
gagaacctctccacaagtctgg

SEQ ID NO: 9211167 - DNA, 22 bp, Homo sapiens
gagcaggaaggccagaagggtc

SEQ ID NO: 9211168 - DNA, 22 bp, Homo sapiens
gagcaggacgtgggaatgggaa

SEQ ID NO: 9211169 - DNA, 22 bp, Homo sapiens
gagcagcttgcgctgtcttcac

SEQ ID NO: 9211170 - DNA, 22 bp, Homo sapiens
gagcagagacagtacaactggc

SEQ ID NO: 9211171 - DNA, 19 bp, Homo sapiens
gagcagcttcctatctggt

SEQ ID NO: 9211172 - DNA, 22 bp, Homo sapiens
gagcagaacaggccgggtggga

SEQ ID NO: 9211173 - DNA, 22 bp, Homo sapiens
gagcacttaatcctgttattca

SEQ ID NO: 9211174 - DNA, 22 bp, Homo sapiens
gagcaccgcctccacgatgccc

SEQ ID NO: 9211175 - DNA, 22 bp, Homo sapiens
gagcactgatttatttttgtct

SEQ ID NO: 9211176 - DNA, 22 bp, Homo sapiens
gagcactgaggaaagctggtta

SEQ ID NO: 9211177 - DNA, 22 bp, Homo sapiens
gagcactgagctggaattggag

SEQ ID NO: 9211178 - DNA, 22 bp, Homo sapiens
gagcacagtccttttgttaaaa

SEQ ID NO: 9211179 - DNA, 20 bp, Homo sapiens
gagcacagtaatgactgcta

SEQ ID NO: 9211180 - DNA, 22 bp, Homo sapiens
gagcacagtgtgttgtgatttc

SEQ ID NO: 9211181 - DNA, 22 bp, Homo sapiens
gagcacccgtcggtggtaggaa

SEQ ID NO: 9211182 - DNA, 22 bp, Homo sapiens
gagcaccctttgcacatcagtc

SEQ ID NO: 9211183 - DNA, 22 bp, Homo sapiens
gagcaccgcctccacgatgccc

SEQ ID NO: 9211184 - DNA, 22 bp, Homo sapiens
gagcaaggtagctctctggggc

SEQ ID NO: 9211185 - DNA, 22 bp, Homo sapiens
gagcaatagcaccaattaactc

SEQ ID NO: 9211186 - DNA, 22 bp, Homo sapiens
gagcaatggaagatagataaca

SEQ ID NO: 9211187 - DNA, 22 bp, Homo sapiens
gagcacagatcctggagccaca

SEQ ID NO: 9211188 - DNA, 22 bp, Homo sapiens
gagcacagatcctggagccaca

SEQ ID NO: 9211189 - DNA, 22 bp, Homo sapiens
gagaggcaggaatcctgggtga

SEQ ID NO: 9211190 - DNA, 22 bp, Homo sapiens
gagcaaacatcagtgatgtctg

SEQ ID NO: 9211191 - DNA, 22 bp, Homo sapiens
gagcaacagtttatggtttttc

SEQ ID NO: 9211192 - DNA, 22 bp, Homo sapiens
gagctcagactcgggcctgggg

SEQ ID NO: 9211193 - DNA, 22 bp, Homo sapiens
gagcaggcctggggtgaggcct

SEQ ID NO: 9211194 - DNA, 22 bp, Homo sapiens
gagctcagcccaaagagcagtg

SEQ ID NO: 9211195 - DNA, 22 bp, Homo sapiens
gagctcagcctgaggcctggct

SEQ ID NO: 9211196 - DNA, 22 bp, Homo sapiens
gagctcaggagcatcagaagaa

SEQ ID NO: 9211197 - DNA, 22 bp, Homo sapiens
gagctcagattctggtgtcaga

SEQ ID NO: 9211198 - DNA, 22 bp, Homo sapiens
gagctcagcaaaggtctgtgtg

SEQ ID NO: 9211199 - DNA, 22 bp, Homo sapiens
gagctcagtgtagtcatggctt

SEQ ID NO: 9211200 - DNA, 23 bp, Homo sapiens
gagctcaggtagggctcgcccgc

SEQ ID NO: 9211201 - DNA, 22 bp, Homo sapiens
gagctcaggtggtcaaaacaat

SEQ ID NO: 9211202 - DNA, 22 bp, Homo sapiens
gagctccaccaccttcaggcag

SEQ ID NO: 9211203 - DNA, 22 bp, Homo sapiens
gagctcattcattcattgcctg

SEQ ID NO: 9211204 - DNA, 22 bp, Homo sapiens
gagctggttctgtccagggaat

SEQ ID NO: 9211205 - DNA, 22 bp, Homo sapiens
gagctggtgtgtgcccgagcac

SEQ ID NO: 9211206 - DNA, 22 bp, Homo sapiens
gagctggttctgtccagggaat

SEQ ID NO: 9211207 - DNA, 22 bp, Homo sapiens
gagctgtgcttataccaattca

SEQ ID NO: 9211208 - DNA, 20 bp, Homo sapiens
gagctgtgctctcaggagcc

SEQ ID NO: 9211209 - DNA, 20 bp, Homo sapiens
gagctgtgctctcaggagcc

SEQ ID NO: 9211210 - DNA, 22 bp, Homo sapiens
gaggacaggagactcactgttt

SEQ ID NO: 9211211 - DNA, 22 bp, Homo sapiens
gagctgtgtgcctggatggtct

SEQ ID NO: 9211212 - DNA, 22 bp, Homo sapiens
gagctgggcacacgccacttga

SEQ ID NO: 9211213 - DNA, 22 bp, Homo sapiens
gagctcccaggccccagcaagg

SEQ ID NO: 9211214 - DNA, 22 bp, Homo sapiens
gagctccagggaacagcagcta

SEQ ID NO: 9211215 - DNA, 22 bp, Homo sapiens
gagctggtcagtttcaggagag

SEQ ID NO: 9211216 - DNA, 22 bp, Homo sapiens
gagctggtcagtttcagggcca

SEQ ID NO: 9211217 - DNA, 22 bp, Homo sapiens
gagctggtgatcagctggagga

SEQ ID NO: 9211218 - DNA, 22 bp, Homo sapiens
gagctggtcgaaatgggctgac

SEQ ID NO: 9211219 - DNA, 22 bp, Homo sapiens
gagctggtcgaaatgggctgac

SEQ ID NO: 9211220 - DNA, 22 bp, Homo sapiens
gaggacagtgtgatctgccagc

SEQ ID NO: 9211221 - DNA, 22 bp, Homo sapiens
gaggacagtgtgatctgccagc

SEQ ID NO: 9211222 - DNA, 22 bp, Homo sapiens
gaggaccacagatgagcctgca

SEQ ID NO: 9211223 - DNA, 23 bp, Homo sapiens
gaggaccaaatatatacatggaa

SEQ ID NO: 9211224 - DNA, 22 bp, Homo sapiens
gaggagtgccagccgtggagtc

SEQ ID NO: 9211225 - DNA, 22 bp, Homo sapiens
gaggagtggagttgctgggttg

SEQ ID NO: 9211226 - DNA, 22 bp, Homo sapiens
gaggatggaggtgtgagctatg

SEQ ID NO: 9211227 - DNA, 22 bp, Homo sapiens
gaggcaagaaaggactttctag

SEQ ID NO: 9211228 - DNA, 22 bp, Homo sapiens
gaggcatggcctgaggctagga

SEQ ID NO: 9211229 - DNA, 22 bp, Homo sapiens
gaggcaagaaaggactttctag

SEQ ID NO: 9211230 - DNA, 22 bp, Homo sapiens
gaggccacgtgcttatgtttct

SEQ ID NO: 9211231 - DNA, 22 bp, Homo sapiens
gaggccacggttttccttgggg

SEQ ID NO: 9211232 - DNA, 22 bp, Homo sapiens
gaggccacggaagggagctgtg

SEQ ID NO: 9211233 - DNA, 22 bp, Homo sapiens
gaggccactgtccctgccttcc

SEQ ID NO: 9211234 - DNA, 21 bp, Homo sapiens
gaggccactaataggggcaga

SEQ ID NO: 9211235 - DNA, 22 bp, Homo sapiens
gaggccagagttccccgagtca

SEQ ID NO: 9211236 - DNA, 22 bp, Homo sapiens
gaggcctggaccagccacagag

SEQ ID NO: 9211237 - DNA, 22 bp, Homo sapiens
gaggccacttcctactggagga

SEQ ID NO: 9211238 - DNA, 22 bp, Homo sapiens
gaggccagaagtctgagatcag

SEQ ID NO: 9211239 - DNA, 22 bp, Homo sapiens
gaggccagaagtgcctcgggct

SEQ ID NO: 9211240 - DNA, 22 bp, Homo sapiens
gaggccagaatgagctgaatgc

SEQ ID NO: 9211241 - DNA, 22 bp, Homo sapiens
gagggacagctaaagagaaatt

SEQ ID NO: 9211242 - DNA, 22 bp, Homo sapiens
gagggagaaggactatcaggct

SEQ ID NO: 9211243 - DNA, 22 bp, Homo sapiens
gagggccagaaagttattgaga

SEQ ID NO: 9211244 - DNA, 22 bp, Homo sapiens
gagggccacttgaatgttttca

SEQ ID NO: 9211245 - DNA, 22 bp, Homo sapiens
gagggccctggcttcttgctgg

SEQ ID NO: 9211246 - DNA, 22 bp, Homo sapiens
gagggcctactggacatgtcag

SEQ ID NO: 9211247 - DNA, 22 bp, Homo sapiens
gagggccaggcagcaagaaggc

SEQ ID NO: 9211248 - DNA, 22 bp, Homo sapiens
gagggccaggcggagacaggcg

SEQ ID NO: 9211249 - DNA, 22 bp, Homo sapiens
gagggccagcagcctcagcatg

SEQ ID NO: 9211250 - DNA, 22 bp, Homo sapiens
gagggccagcagcctcagcatg

SEQ ID NO: 9211251 - DNA, 22 bp, Homo sapiens
gagggccagcagcctcagcatg

SEQ ID NO: 9211252 - DNA, 22 bp, Homo sapiens
gaggctggtcagccctaagatc

SEQ ID NO: 9211253 - DNA, 22 bp, Homo sapiens
gaggcggcggccgagcctggct

SEQ ID NO: 9211254 - DNA, 22 bp, Homo sapiens
gaggctggggtctgcctttctg

SEQ ID NO: 9211255 - DNA, 22 bp, Homo sapiens
gaggcctggtttgcatgagaat

SEQ ID NO: 9211256 - DNA, 22 bp, Homo sapiens
gaggcctggtgctgtgtccaca

SEQ ID NO: 9211257 - DNA, 19 bp, Homo sapiens
gaggcgaggcgtgcaggag

SEQ ID NO: 9211258 - DNA, 22 bp, Homo sapiens
gagggtgggctcctatctgggt

SEQ ID NO: 9211259 - DNA, 22 bp, Homo sapiens
gagggtgggccagatatgaggg

SEQ ID NO: 9211260 - DNA, 22 bp, Homo sapiens
gagggtggggaatagactgcta

SEQ ID NO: 9211261 - DNA, 22 bp, Homo sapiens
gaggtctggaccaagtcgcccc

SEQ ID NO: 9211262 - DNA, 22 bp, Homo sapiens
gaggtctgggcttgggcctggt

SEQ ID NO: 9211263 - DNA, 22 bp, Homo sapiens
gaggtctgggatggggcctgaa

SEQ ID NO: 9211264 - DNA, 22 bp, Homo sapiens
gagggtggtggcttaaggtgct

SEQ ID NO: 9211265 - DNA, 22 bp, Homo sapiens
gagggtgggtttcttgcacgtc

SEQ ID NO: 9211266 - DNA, 22 bp, Homo sapiens
gagggtggagctccagaatctg

SEQ ID NO: 9211267 - DNA, 20 bp, Homo sapiens
gagggtgggacttcctaggc

SEQ ID NO: 9211268 - DNA, 22 bp, Homo sapiens
gagggtccctgctcagggccag

SEQ ID NO: 9211269 - DNA, 22 bp, Homo sapiens
gagggtcctggctaagtctgac

SEQ ID NO: 9211270 - DNA, 22 bp, Homo sapiens
gaggtgcctggcgatgtctctg

SEQ ID NO: 9211271 - DNA, 22 bp, Homo sapiens
gaggtgcttcctttgggctctg

SEQ ID NO: 9211272 - DNA, 22 bp, Homo sapiens
gaggtgattttcaaaagaactt

SEQ ID NO: 9211273 - DNA, 22 bp, Homo sapiens
gaggtgagtggatcacgaggtc

SEQ ID NO: 9211274 - DNA, 22 bp, Homo sapiens
gaggtgagaagggggtcagatg

SEQ ID NO: 9211275 - DNA, 22 bp, Homo sapiens
gaggtggatgttgcagtgagct

SEQ ID NO: 9211276 - DNA, 22 bp, Homo sapiens
gaggtggctggctcagagccag

SEQ ID NO: 9211277 - DNA, 22 bp, Homo sapiens
gaggtgggagggcagtccctaa

SEQ ID NO: 9211278 - DNA, 22 bp, Homo sapiens
gaggtgggagggcagtccctaa

SEQ ID NO: 9211279 - DNA, 23 bp, Homo sapiens
gaggtgtgaattctgggtgctgc

SEQ ID NO: 9211280 - DNA, 18 bp, Homo sapiens
ctgggctcgagagatcct

SEQ ID NO: 9211281 - DNA, 20 bp, Homo sapiens
ctgggctcggtggccctggc

SEQ ID NO: 9211282 - DNA, 22 bp, Homo sapiens
ctgggctctaagggagcaccgt

SEQ ID NO: 9211283 - DNA, 22 bp, Homo sapiens
ctgggctcctaaccatccaggt

SEQ ID NO: 9211284 - DNA, 22 bp, Homo sapiens
ctgggctcctaaccatccaggt

SEQ ID NO: 9211285 - DNA, 22 bp, Homo sapiens
ctgggctccctcatgtgtctgc

SEQ ID NO: 9211286 - DNA, 22 bp, Homo sapiens
ctggggctgtaggaggacttat

SEQ ID NO: 9211287 - DNA, 22 bp, Homo sapiens
ctgggctctaagggagcaccgt

SEQ ID NO: 9211288 - DNA, 22 bp, Homo sapiens
ctgggggccttacggaactcca

SEQ ID NO: 9211289 - DNA, 22 bp, Homo sapiens
ctgggggcagcaagaagccatg

SEQ ID NO: 9211290 - DNA, 22 bp, Homo sapiens
ctgggggcaatggtcagagtgt

SEQ ID NO: 9211291 - DNA, 22 bp, Homo sapiens
ctgggggcagcaagaagccatg

SEQ ID NO: 9211292 - DNA, 22 bp, Homo sapiens
ctggggggctactgacagagga

SEQ ID NO: 9211293 - DNA, 22 bp, Homo sapiens
ctggggtggtgcaggcctcatg

SEQ ID NO: 9211294 - DNA, 22 bp, Homo sapiens
ctgggttccatgtagccaagag

SEQ ID NO: 9211295 - DNA, 22 bp, Homo sapiens
ctgggtggttttgatgtgaatt

SEQ ID NO: 9211296 - DNA, 22 bp, Homo sapiens
ctgggtggaaagtgctgagaat

SEQ ID NO: 9211297 - DNA, 22 bp, Homo sapiens
ctgggtggaaagtgctgagaat

SEQ ID NO: 9211298 - DNA, 22 bp, Homo sapiens
ctgggttctatttttggcttca

SEQ ID NO: 9211299 - DNA, 22 bp, Homo sapiens
ctgggttctctgcttagggcct

SEQ ID NO: 9211300 - DNA, 22 bp, Homo sapiens
ctgggttccatgtagccaagag

SEQ ID NO: 9211301 - DNA, 22 bp, Homo sapiens
ctgggttctatttttggcttca

SEQ ID NO: 9211302 - DNA, 22 bp, Homo sapiens
ctggtacagggaaataaaggaa

SEQ ID NO: 9211303 - DNA, 22 bp, Homo sapiens
ctggtacatagtaagaacacaa

SEQ ID NO: 9211304 - DNA, 22 bp, Homo sapiens
ctggtggggagtcctggtctcc

SEQ ID NO: 9211305 - DNA, 22 bp, Homo sapiens
ctggagctccagggtctcctct

SEQ ID NO: 9211306 - DNA, 22 bp, Homo sapiens
ctggagctcagcccaggttcca

SEQ ID NO: 9211307 - DNA, 22 bp, Homo sapiens
ctgggagtcagtataagaagca

SEQ ID NO: 9211308 - DNA, 22 bp, Homo sapiens
ctgggaggcggaggttgcagtg

SEQ ID NO: 9211309 - DNA, 22 bp, Homo sapiens
ctgggccagatccagcctcaca

SEQ ID NO: 9211310 - DNA, 22 bp, Homo sapiens
ctgggccagcaactgcaatgga

SEQ ID NO: 9211311 - DNA, 22 bp, Homo sapiens
ctgggccaggaccagggttgaa

SEQ ID NO: 9211312 - DNA, 22 bp, Homo sapiens
ctgggccaggaccagggttgaa

SEQ ID NO: 9211313 - DNA, 22 bp, Homo sapiens
ctgggccagcaactgcaatgga

SEQ ID NO: 9211314 - DNA, 22 bp, Homo sapiens
ctgggccagcaactgcaatgga

SEQ ID NO: 9211315 - DNA, 22 bp, Homo sapiens
ctgggcccacgagggctctggg

SEQ ID NO: 9211316 - DNA, 22 bp, Homo sapiens
ctgggcctcatccccagagttt

SEQ ID NO: 9211317 - DNA, 22 bp, Homo sapiens
ctgggcctcaccctagaccaat

SEQ ID NO: 9211318 - DNA, 22 bp, Homo sapiens
ctgggcctcacacccaccaaat

SEQ ID NO: 9211319 - DNA, 22 bp, Homo sapiens
ctgggcctagcaacagaggagt

SEQ ID NO: 9211320 - DNA, 22 bp, Homo sapiens
ctgggcccaggcggctctcgga

SEQ ID NO: 9211321 - DNA, 22 bp, Homo sapiens
ctgggccctatggaagaaaggg

SEQ ID NO: 9211322 - DNA, 22 bp, Homo sapiens
ctgggccctatggaagaaaggg

SEQ ID NO: 9211323 - DNA, 22 bp, Homo sapiens
ctgggctcagcaggccaaggcc

SEQ ID NO: 9211324 - DNA, 22 bp, Homo sapiens
ctgggctcagcccatgctgtcc

SEQ ID NO: 9211325 - DNA, 22 bp, Homo sapiens
ctgggctcaaatcctggccctg

SEQ ID NO: 9211326 - DNA, 22 bp, Homo sapiens
ctgggcctccacgggccatcac

SEQ ID NO: 9211327 - DNA, 22 bp, Homo sapiens
ctgggctcaaatcctatctcca

SEQ ID NO: 9211328 - DNA, 22 bp, Homo sapiens
ctgggctcagcccatgctgtcc

SEQ ID NO: 9211329 - DNA, 22 bp, Homo sapiens
ctgggctcagtggctcatggct

SEQ ID NO: 9211330 - DNA, 22 bp, Homo sapiens
ctgggctccactcccacagtgt

SEQ ID NO: 9211331 - DNA, 22 bp, Homo sapiens
ctgggctccactacttgctaac

SEQ ID NO: 9211332 - DNA, 22 bp, Homo sapiens
ctgggctcagtgtctcactcct

SEQ ID NO: 9211333 - DNA, 22 bp, Homo sapiens
ctgggctcagtgtctcactcct

SEQ ID NO: 9211334 - DNA, 21 bp, Homo sapiens
ctgggctcatggtgttacaga

SEQ ID NO: 9211335 - DNA, 22 bp, Homo sapiens
ctgtccagtgcagagaacagag

SEQ ID NO: 9211336 - DNA, 22 bp, Homo sapiens
ctggtttgcccacaccagccac

SEQ ID NO: 9211337 - DNA, 22 bp, Homo sapiens
ctggttttatgttatagatgga

SEQ ID NO: 9211338 - DNA, 22 bp, Homo sapiens
ctggttggtgccacatggtggc

SEQ ID NO: 9211339 - DNA, 19 bp, Homo sapiens
ctgtcccagactctgctct

SEQ ID NO: 9211340 - DNA, 22 bp, Homo sapiens
ctgtcccagatgttctcagcac

SEQ ID NO: 9211341 - DNA, 18 bp, Homo sapiens
ctgtcccatcctcaggtt

SEQ ID NO: 9211342 - DNA, 22 bp, Homo sapiens
ctgtcccaggatcctgactcca

SEQ ID NO: 9211343 - DNA, 21 bp, Homo sapiens
ctgtccccagtgagcaccccc

SEQ ID NO: 9211344 - DNA, 22 bp, Homo sapiens
ctgtcccctgtgctttcacttg

SEQ ID NO: 9211345 - DNA, 22 bp, Homo sapiens
ctgtccccgcgagtccagagct

SEQ ID NO: 9211346 - DNA, 22 bp, Homo sapiens
ctgtgaggccctgggtgctgga

SEQ ID NO: 9211347 - DNA, 22 bp, Homo sapiens
ctgtgaggcgggtggagtggag

SEQ ID NO: 9211348 - DNA, 22 bp, Homo sapiens
ctgtgactttgaataagaggga

SEQ ID NO: 9211349 - DNA, 22 bp, Homo sapiens
ctgtgacttgccaaaggtcatt

SEQ ID NO: 9211350 - DNA, 22 bp, Homo sapiens
ctgtgacttagagtgagtagag

SEQ ID NO: 9211351 - DNA, 22 bp, Homo sapiens
ctgtgacttccggatgacatga

SEQ ID NO: 9211352 - DNA, 21 bp, Homo sapiens
ctgtgactccctgggcaatcc

SEQ ID NO: 9211353 - DNA, 22 bp, Homo sapiens
ctgtgactagacctgcaggaga

SEQ ID NO: 9211354 - DNA, 19 bp, Homo sapiens
ctgtccctcccaggtatga

SEQ ID NO: 9211355 - DNA, 22 bp, Homo sapiens
ctgtccctcatcacctctgggt

SEQ ID NO: 9211356 - DNA, 22 bp, Homo sapiens
ctgtgaaactggacagcacttg

SEQ ID NO: 9211357 - DNA, 22 bp, Homo sapiens
ctgtgaaactggacagcacttg

SEQ ID NO: 9211358 - DNA, 22 bp, Homo sapiens
ctgtctgttcagattcattact

SEQ ID NO: 9211359 - DNA, 22 bp, Homo sapiens
ctgtctgttatctcaccagtcc

SEQ ID NO: 9211360 - DNA, 22 bp, Homo sapiens
ctgtgaaatgctttgcgatggt

SEQ ID NO: 9211361 - DNA, 22 bp, Homo sapiens
ctgtgaattaagtattgttatc

SEQ ID NO: 9211362 - DNA, 22 bp, Homo sapiens
ctgtgtgtttatatcatttcct

SEQ ID NO: 9211363 - DNA, 22 bp, Homo sapiens
ctgtgtgtgtctgcagcatact

SEQ ID NO: 9211364 - DNA, 22 bp, Homo sapiens
ctgtgtgtgtctgcagcatact

SEQ ID NO: 9211365 - DNA, 22 bp, Homo sapiens
ctgtgtgtgctacaggcttcca

SEQ ID NO: 9211366 - DNA, 22 bp, Homo sapiens
ctgtgtgtgctacaggcttcca

SEQ ID NO: 9211367 - DNA, 22 bp, Homo sapiens
ctgtgtgtgagaagcaggttga

SEQ ID NO: 9211368 - DNA, 23 bp, Homo sapiens
ctgtgtgtgccgagggtggccac

SEQ ID NO: 9211369 - DNA, 22 bp, Homo sapiens
ctgtggtgagcaactgactgaa

SEQ ID NO: 9211370 - DNA, 22 bp, Homo sapiens
ctgtggtcaggggttagacagg

SEQ ID NO: 9211371 - DNA, 22 bp, Homo sapiens
ctgtgtgatgggaagaatgttt

SEQ ID NO: 9211372 - DNA, 22 bp, Homo sapiens
ctgtggtggcacagcgggctgg

SEQ ID NO: 9211373 - DNA, 22 bp, Homo sapiens
ctgtgggatgggacctcagctg

SEQ ID NO: 9211374 - DNA, 22 bp, Homo sapiens
ctgtggcattgccgaggctggc

SEQ ID NO: 9211375 - DNA, 20 bp, Homo sapiens
ctgtggcatctgtcatggtg

SEQ ID NO: 9211376 - DNA, 22 bp, Homo sapiens
ctgtggcaggtgtctggggcag

SEQ ID NO: 9211377 - DNA, 22 bp, Homo sapiens
ctgtggcagggaagaggccatg

SEQ ID NO: 9211378 - DNA, 22 bp, Homo sapiens
ctgtggcacatgtggcaaggcc

SEQ ID NO: 9211379 - DNA, 22 bp, Homo sapiens
cttcacttgctcatcatgctat

SEQ ID NO: 9211380 - DNA, 22 bp, Homo sapiens
cttcactttaagccaatcatga

SEQ ID NO: 9211381 - DNA, 22 bp, Homo sapiens
cttcactgcagtcatggctctg

SEQ ID NO: 9211382 - DNA, 22 bp, Homo sapiens
cttcactgggctcctgagaggg

SEQ ID NO: 9211383 - DNA, 22 bp, Homo sapiens
cttcactgtgcttcaagcagct

SEQ ID NO: 9211384 - DNA, 22 bp, Homo sapiens
cttcactgtttggttcacagca

SEQ ID NO: 9211385 - DNA, 22 bp, Homo sapiens
cttccagggtccaggaagagcc

SEQ ID NO: 9211386 - DNA, 22 bp, Homo sapiens
cttccaggacaccagggtagta

SEQ ID NO: 9211387 - DNA, 22 bp, Homo sapiens
cttccaggacaccagggtagta

SEQ ID NO: 9211388 - DNA, 22 bp, Homo sapiens
cttccagggtccaggaagagcc

SEQ ID NO: 9211389 - DNA, 22 bp, Homo sapiens
cttccaggacaccagggtagta

SEQ ID NO: 9211390 - DNA, 22 bp, Homo sapiens
cttcacagtctttatttcctcc

SEQ ID NO: 9211391 - DNA, 22 bp, Homo sapiens
cttcacattgggcttgatatga

SEQ ID NO: 9211392 - DNA, 22 bp, Homo sapiens
cttcactgatgggacagctcaa

SEQ ID NO: 9211393 - DNA, 22 bp, Homo sapiens
cttcactgagtagtctagactc

SEQ ID NO: 9211394 - DNA, 22 bp, Homo sapiens
cttcacagcatgagctttggag

SEQ ID NO: 9211395 - DNA, 22 bp, Homo sapiens
cttcacagccaacatgggcaca

SEQ ID NO: 9211396 - DNA, 22 bp, Homo sapiens
cttcacaggcaagtctgttttt

SEQ ID NO: 9211397 - DNA, 22 bp, Homo sapiens
cttcacaggcaagtctgttttt

SEQ ID NO: 9211398 - DNA, 22 bp, Homo sapiens
cttcacagtcaccctgctgtgt

SEQ ID NO: 9211399 - DNA, 22 bp, Homo sapiens
cttcacagtataggtccctgag

SEQ ID NO: 9211400 - DNA, 22 bp, Homo sapiens
cttcacagtataggtccctgag

SEQ ID NO: 9211401 - DNA, 22 bp, Homo sapiens
cttcacagtataggtccctgag

SEQ ID NO: 9211402 - DNA, 22 bp, Homo sapiens
cttcaaatccccctgagtttga

SEQ ID NO: 9211403 - DNA, 22 bp, Homo sapiens
cttccccaggacctctgctaaa

SEQ ID NO: 9211404 - DNA, 22 bp, Homo sapiens
cttccccaaccccgactgtgtg

SEQ ID NO: 9211405 - DNA, 22 bp, Homo sapiens
cttccccaagtagagaggggag

SEQ ID NO: 9211406 - DNA, 22 bp, Homo sapiens
cttccaggtccttcttgagaag

SEQ ID NO: 9211407 - DNA, 21 bp, Homo sapiens
cttccccaggctggtctgtat

SEQ ID NO: 9211408 - DNA, 19 bp, Homo sapiens
cttcccctgttacctcact

SEQ ID NO: 9211409 - DNA, 19 bp, Homo sapiens
cttcccctgttacctcact

SEQ ID NO: 9211410 - DNA, 22 bp, Homo sapiens
cttccctgataagagcctcaga

SEQ ID NO: 9211411 - DNA, 22 bp, Homo sapiens
cttccctgagctttctcaggct

SEQ ID NO: 9211412 - DNA, 22 bp, Homo sapiens
cttccctgagctttctcaggct

SEQ ID NO: 9211413 - DNA, 22 bp, Homo sapiens
cttccctgataagagcctcaga

SEQ ID NO: 9211414 - DNA, 22 bp, Homo sapiens
cttcccttctgtgcagggcaga

SEQ ID NO: 9211415 - DNA, 20 bp, Homo sapiens
cttcttcagcctatgcttca

SEQ ID NO: 9211416 - DNA, 22 bp, Homo sapiens
cttgctttcagtctcggcctca

SEQ ID NO: 9211417 - DNA, 22 bp, Homo sapiens
cttcttctcaaggggcaggtgg

SEQ ID NO: 9211418 - DNA, 22 bp, Homo sapiens
cttgcctctgctaatggtttct

SEQ ID NO: 9211419 - DNA, 22 bp, Homo sapiens
cttgcctgaggaacagagggta

SEQ ID NO: 9211420 - DNA, 22 bp, Homo sapiens
cttgcctgaggaacagagggta

SEQ ID NO: 9211421 - DNA, 22 bp, Homo sapiens
cttgcctgccactacagctgaa

SEQ ID NO: 9211422 - DNA, 22 bp, Homo sapiens
cttcttctggtttatgtggcaa

SEQ ID NO: 9211423 - DNA, 22 bp, Homo sapiens
cttcttcttcccccttcagggg

SEQ ID NO: 9211424 - DNA, 19 bp, Homo sapiens
cttcttcttggcagccaag

SEQ ID NO: 9211425 - DNA, 22 bp, Homo sapiens
cttgcctccctcagctcacagc

SEQ ID NO: 9211426 - DNA, 22 bp, Homo sapiens
ctttcctgaggagtatggctgt

SEQ ID NO: 9211427 - DNA, 22 bp, Homo sapiens
ctttcctccactccctaggctt

SEQ ID NO: 9211428 - DNA, 22 bp, Homo sapiens
ctttctctgtgtttcacatgct

SEQ ID NO: 9211429 - DNA, 22 bp, Homo sapiens
ctttctcttcactgtcatgatc

SEQ ID NO: 9211430 - DNA, 22 bp, Homo sapiens
ctttctcttcactgtcatgatc

SEQ ID NO: 9211431 - DNA, 20 bp, Homo sapiens
ctttctctaatttataagta

SEQ ID NO: 9211432 - DNA, 22 bp, Homo sapiens
ctttctagtaggaagtagatca

SEQ ID NO: 9211433 - DNA, 22 bp, Homo sapiens
ctttctctgtgtttcacatgct

SEQ ID NO: 9211434 - DNA, 22 bp, Homo sapiens
gaaatacaggaatgccacacag

SEQ ID NO: 9211435 - DNA, 22 bp, Homo sapiens
gaaatacaggaatgccacacag

SEQ ID NO: 9211436 - DNA, 22 bp, Homo sapiens
gaaatatacattgcaggaagag

SEQ ID NO: 9211437 - DNA, 22 bp, Homo sapiens
gaaatattacagtggaggggat

SEQ ID NO: 9211438 - DNA, 22 bp, Homo sapiens
gaaatattcttgtcttgttttc

SEQ ID NO: 9211439 - DNA, 22 bp, Homo sapiens
gaaatgtctttgacaagagagg

SEQ ID NO: 9211440 - DNA, 22 bp, Homo sapiens
gaaatgtcatagtcttcaagcc

SEQ ID NO: 9211441 - DNA, 22 bp, Homo sapiens
gaaatattgtactggagatgtt

SEQ ID NO: 9211442 - DNA, 22 bp, Homo sapiens
gaaatattgggactcagagctt

SEQ ID NO: 9211443 - DNA, 22 bp, Homo sapiens
gaaatattgtactggagatgtt

SEQ ID NO: 9211444 - DNA, 22 bp, Homo sapiens
gaaatatttctcttgagcccct

SEQ ID NO: 9211445 - DNA, 22 bp, Homo sapiens
gaaattaagcaggggtctgtgg

SEQ ID NO: 9211446 - DNA, 22 bp, Homo sapiens
gaaattaaccacctttggcttt

SEQ ID NO: 9211447 - DNA, 22 bp, Homo sapiens
gaaattaagcaggggtctgtgg

SEQ ID NO: 9211448 - DNA, 22 bp, Homo sapiens
gaagaaggaagatcatgcttga

SEQ ID NO: 9211449 - DNA, 22 bp, Homo sapiens
gaagaagggagtgacaaatgca

SEQ ID NO: 9211450 - DNA, 22 bp, Homo sapiens
gaagaagagataatggggagca

SEQ ID NO: 9211451 - DNA, 19 bp, Homo sapiens
gaagaagcttgagaagtag

SEQ ID NO: 9211452 - DNA, 22 bp, Homo sapiens
gaagaagacatggaacaatagt

SEQ ID NO: 9211453 - DNA, 22 bp, Homo sapiens
ctttggcacagtgtttactagc

SEQ ID NO: 9211454 - DNA, 22 bp, Homo sapiens
ctttggcactgcgcagccattt

SEQ ID NO: 9211455 - DNA, 23 bp, Homo sapiens
ctttggcactttacaataaactc

SEQ ID NO: 9211456 - DNA, 22 bp, Homo sapiens
ctttggcacagtctcatttgat

SEQ ID NO: 9211457 - DNA, 22 bp, Homo sapiens
ctttggcaatgtcattttcaat

SEQ ID NO: 9211458 - DNA, 20 bp, Homo sapiens
ctttggcaatgagaacaggg

SEQ ID NO: 9211459 - DNA, 22 bp, Homo sapiens
cttttggcctcaaaggaaagaa

SEQ ID NO: 9211460 - DNA, 22 bp, Homo sapiens
ctttggcagacattaggggtga

SEQ ID NO: 9211461 - DNA, 22 bp, Homo sapiens
ctttttctaatcataattgtct

SEQ ID NO: 9211462 - DNA, 16 bp, Homo sapiens
ctttttctcccctctt

SEQ ID NO: 9211463 - DNA, 22 bp, Homo sapiens
ctttggcaatgaaacacaagaa

SEQ ID NO: 9211464 - DNA, 22 bp, Homo sapiens
ctttggcaagggttttaattgt

SEQ ID NO: 9211465 - DNA, 22 bp, Homo sapiens
ctttggcaacacatgtgggaca

SEQ ID NO: 9211466 - DNA, 22 bp, Homo sapiens
gaaactctcgcatcctgggaac

SEQ ID NO: 9211467 - DNA, 22 bp, Homo sapiens
gaaactgaatataagaaaggta

SEQ ID NO: 9211468 - DNA, 22 bp, Homo sapiens
gaaactgagtaggctagagcac

SEQ ID NO: 9211469 - DNA, 22 bp, Homo sapiens
gaaacctcttagcctctctttg

SEQ ID NO: 9211470 - DNA, 22 bp, Homo sapiens
gaaagaagctttagatggctat

SEQ ID NO: 9211471 - DNA, 22 bp, Homo sapiens
gaaacttttaaacctcatgagt

SEQ ID NO: 9211472 - DNA, 22 bp, Homo sapiens
cttttttcctaaggcaacatga

SEQ ID NO: 9211473 - DNA, 22 bp, Homo sapiens
cttttttcctaaggcaacatga

SEQ ID NO: 9211474 - DNA, 22 bp, Homo sapiens
gaaaaatgagctgatgtcaggg

SEQ ID NO: 9211475 - DNA, 22 bp, Homo sapiens
ctccaggagtggcctggacacc

SEQ ID NO: 9211476 - DNA, 22 bp, Homo sapiens
ctccaggatacctgttcctata

SEQ ID NO: 9211477 - DNA, 19 bp, Homo sapiens
ctccaggatggctgggcga

SEQ ID NO: 9211478 - DNA, 22 bp, Homo sapiens
ctccaggatgttagacgtccag

SEQ ID NO: 9211479 - DNA, 22 bp, Homo sapiens
ctccaggagggcttcctgtgat

SEQ ID NO: 9211480 - DNA, 22 bp, Homo sapiens
ctccaggagctgtgtctttctt

SEQ ID NO: 9211481 - DNA, 22 bp, Homo sapiens
ctccaggagggcttcctgtgat

SEQ ID NO: 9211482 - DNA, 22 bp, Homo sapiens
ctccaggagggggatggctgta

SEQ ID NO: 9211483 - DNA, 22 bp, Homo sapiens
ctccaggaggttgctgcttcct

SEQ ID NO: 9211484 - DNA, 22 bp, Homo sapiens
ctccaggaggttgctgcttcct

SEQ ID NO: 9211485 - DNA, 22 bp, Homo sapiens
ctccaggccagggaagtggaca

SEQ ID NO: 9211486 - DNA, 19 bp, Homo sapiens
ctccttccctggtttctgt

SEQ ID NO: 9211487 - DNA, 22 bp, Homo sapiens
ctccttcctgcagatctgagat

SEQ ID NO: 9211488 - DNA, 22 bp, Homo sapiens
ctccttcagctgaatccctgct

SEQ ID NO: 9211489 - DNA, 22 bp, Homo sapiens
ctccttcatgtcatgtgtccgg

SEQ ID NO: 9211490 - DNA, 22 bp, Homo sapiens
tttcattacgtgtttgacttgt

SEQ ID NO: 9211491 - DNA, 22 bp, Homo sapiens
tttccacccagagcatttgttt

SEQ ID NO: 9211492 - DNA, 22 bp, Homo sapiens
ctctctttttcgtgtgccgaag

SEQ ID NO: 9211493 - DNA, 22 bp, Homo sapiens
ctctgaaaatgtggtggggaaa

SEQ ID NO: 9211494 - DNA, 22 bp, Homo sapiens
ctctgaaactcctgcaccttct

SEQ ID NO: 9211495 - DNA, 22 bp, Homo sapiens
ctctgaaactccagccccaggt

SEQ ID NO: 9211496 - DNA, 22 bp, Homo sapiens
ctctctttctgaatgaggacta

SEQ ID NO: 9211497 - DNA, 22 bp, Homo sapiens
ctctctttgatgtataaataat

SEQ ID NO: 9211498 - DNA, 22 bp, Homo sapiens
ctctgaaagcaaaactagagaa

SEQ ID NO: 9211499 - DNA, 22 bp, Homo sapiens
ctctgaaagcaaaactagagaa

SEQ ID NO: 9211500 - DNA, 22 bp, Homo sapiens
ctctgaaattggccctcagcag

SEQ ID NO: 9211501 - DNA, 22 bp, Homo sapiens
ctctgaaagttagagaaaatag

SEQ ID NO: 9211502 - DNA, 22 bp, Homo sapiens
ctctgaaagagtttagtattat

SEQ ID NO: 9211503 - DNA, 22 bp, Homo sapiens
ctctgaaagagtttagtattat

SEQ ID NO: 9211504 - DNA, 22 bp, Homo sapiens
ctctgaaagacaagctctcatt

SEQ ID NO: 9211505 - DNA, 18 bp, Homo sapiens
ctctgaaagacacaccag

SEQ ID NO: 9211506 - DNA, 18 bp, Homo sapiens
ctctctttccactctttg

SEQ ID NO: 9211507 - DNA, 22 bp, Homo sapiens
ctctctttcattggtcgccttg

SEQ ID NO: 9211508 - DNA, 22 bp, Homo sapiens
ctctctgttatgctttcatgaa

SEQ ID NO: 9211509 - DNA, 22 bp, Homo sapiens
ctctcttcccgtgagtgttgca

SEQ ID NO: 9211510 - DNA, 22 bp, Homo sapiens
ctctctggtttcagcgaagggg

SEQ ID NO: 9211511 - DNA, 22 bp, Homo sapiens
tttctacatgtcagtaactgat

SEQ ID NO: 9211512 - DNA, 22 bp, Homo sapiens
tttctcaaggtgtcatgtattt

SEQ ID NO: 9211513 - DNA, 18 bp, Homo sapiens
ctctctggtctggatccc

SEQ ID NO: 9211514 - DNA, 19 bp, Homo sapiens
ctctctggcggtgtctgcg

SEQ ID NO: 9211515 - DNA, 19 bp, Homo sapiens
ctctctggcggtgtctgcg

SEQ ID NO: 9211516 - DNA, 22 bp, Homo sapiens
tttctcaagttcagatatttga

SEQ ID NO: 9211517 - DNA, 22 bp, Homo sapiens
ctctgggtgtgacagcacctgg

SEQ ID NO: 9211518 - DNA, 22 bp, Homo sapiens
ctctgggtctccctgaggctaa

SEQ ID NO: 9211519 - DNA, 22 bp, Homo sapiens
ctctgggtctataatgcagctg

SEQ ID NO: 9211520 - DNA, 22 bp, Homo sapiens
ctctgggtcctggggctacaag

SEQ ID NO: 9211521 - DNA, 20 bp, Homo sapiens
ctctgggtcgagacagactt

SEQ ID NO: 9211522 - DNA, 22 bp, Homo sapiens
ctctgggtctacctgtggccag

SEQ ID NO: 9211523 - DNA, 22 bp, Homo sapiens
ctctgggtgtcttaggagctca

SEQ ID NO: 9211524 - DNA, 22 bp, Homo sapiens
ctctgggtggtctcactgagtg

SEQ ID NO: 9211525 - DNA, 22 bp, Homo sapiens
ctctgggtgagacagacctggt

SEQ ID NO: 9211526 - DNA, 22 bp, Homo sapiens
ctctgggtgggcagcagatgga

SEQ ID NO: 9211527 - DNA, 20 bp, Homo sapiens
ctctgggctgcaccctcgcc

SEQ ID NO: 9211528 - DNA, 22 bp, Homo sapiens
ctctgtgattctcatgtaccac

SEQ ID NO: 9211529 - DNA, 22 bp, Homo sapiens
tttgttctaacttctgcagaca

SEQ ID NO: 9211530 - DNA, 22 bp, Homo sapiens
ctctgtgcctcagttttcttct

SEQ ID NO: 9211531 - DNA, 22 bp, Homo sapiens
ttttctcttccctctggacctg

SEQ ID NO: 9211532 - DNA, 22 bp, Homo sapiens
ttttgcctgcactgtatatata

SEQ ID NO: 9211533 - DNA, 22 bp, Homo sapiens
tttgaaagaatttatgtacttt

SEQ ID NO: 9211534 - DNA, 22 bp, Homo sapiens
tttgaaactcatgatcatcact

SEQ ID NO: 9211535 - DNA, 22 bp, Homo sapiens
tttgaaacaggtgattcagcta

SEQ ID NO: 9211536 - DNA, 22 bp, Homo sapiens
tttgaaacctagttatatgact

SEQ ID NO: 9211537 - DNA, 23 bp, Homo sapiens
ctctgcaccaggtggttttcagc

SEQ ID NO: 9211538 - DNA, 22 bp, Homo sapiens
ctctgcacccccggctcctcgt

SEQ ID NO: 9211539 - DNA, 22 bp, Homo sapiens
ctctgcacacaagtaatttcat

SEQ ID NO: 9211540 - DNA, 22 bp, Homo sapiens
ctctgcaccttgtaggaggcaa

SEQ ID NO: 9211541 - DNA, 22 bp, Homo sapiens
ctctgcacctacacaacaggaa

SEQ ID NO: 9211542 - DNA, 22 bp, Homo sapiens
ctctgcactgtccggctttctt

SEQ ID NO: 9211543 - DNA, 22 bp, Homo sapiens
ctctgcagaatttgagctgctc

SEQ ID NO: 9211544 - DNA, 22 bp, Homo sapiens
tttgcaaactttcctctggacc

SEQ ID NO: 9211545 - DNA, 22 bp, Homo sapiens
ctctggcacactccttccaggt

SEQ ID NO: 9211546 - DNA, 22 bp, Homo sapiens
ctctggccccagtggccccttg

SEQ ID NO: 9211547 - DNA, 22 bp, Homo sapiens
ctctggcctgcttcctcaggta

SEQ ID NO: 9211548 - DNA, 22 bp, Homo sapiens
ctctggcctgcttcctcaggta

SEQ ID NO: 9211549 - DNA, 22 bp, Homo sapiens
ctgcaggagtgaaagcaggcct

SEQ ID NO: 9211550 - DNA, 22 bp, Homo sapiens
ctgcaggagtgaaagcaggcct

SEQ ID NO: 9211551 - DNA, 21 bp, Homo sapiens
ctgcaggatgctgaagccagg

SEQ ID NO: 9211552 - DNA, 22 bp, Homo sapiens
ctgcaggagcaaagcctctgct

SEQ ID NO: 9211553 - DNA, 20 bp, Homo sapiens
ctgcccagccactgagggat

SEQ ID NO: 9211554 - DNA, 22 bp, Homo sapiens
ctgccatgtgtgaaaggggagg

SEQ ID NO: 9211555 - DNA, 22 bp, Homo sapiens
ctgcccaggggagtgctgtcgg

SEQ ID NO: 9211556 - DNA, 22 bp, Homo sapiens
ctgcccaggctgaaggaacatc

SEQ ID NO: 9211557 - DNA, 22 bp, Homo sapiens
ctgcccagtttgggagcctttc

SEQ ID NO: 9211558 - DNA, 22 bp, Homo sapiens
ctgcaggactgaaagatgaggt

SEQ ID NO: 9211559 - DNA, 22 bp, Homo sapiens
ctgcaggacgaccgcctcatct

SEQ ID NO: 9211560 - DNA, 22 bp, Homo sapiens
ctgcaggacagggaggagcaag

SEQ ID NO: 9211561 - DNA, 22 bp, Homo sapiens
ctgcaggaatctgtgctaggtg

SEQ ID NO: 9211562 - DNA, 22 bp, Homo sapiens
ctgcagctttggaaacctgttt

SEQ ID NO: 9211563 - DNA, 22 bp, Homo sapiens
ctgcagctgtctctactgggca

SEQ ID NO: 9211564 - DNA, 22 bp, Homo sapiens
ctgcagctgtctctactgggca

SEQ ID NO: 9211565 - DNA, 22 bp, Homo sapiens
ctgaggtgtgagccacttcccc

SEQ ID NO: 9211566 - DNA, 22 bp, Homo sapiens
ctgaggtggcatcctagctcta

SEQ ID NO: 9211567 - DNA, 22 bp, Homo sapiens
ctgaggtgctatggaggatacg

SEQ ID NO: 9211568 - DNA, 22 bp, Homo sapiens
ttttgcttgagtgcacaaaatg

SEQ ID NO: 9211569 - DNA, 22 bp, Homo sapiens
ctcttcctacagtctgctatgc

SEQ ID NO: 9211570 - DNA, 22 bp, Homo sapiens
ctcttcttatggccgtggctga

SEQ ID NO: 9211571 - DNA, 22 bp, Homo sapiens
ctcttcttatggccgtggctga

SEQ ID NO: 9211572 - DNA, 22 bp, Homo sapiens
ctcttctctgcagcctttgaag

SEQ ID NO: 9211573 - DNA, 22 bp, Homo sapiens
ctcttctctgcagcctttgaag

SEQ ID NO: 9211574 - DNA, 22 bp, Homo sapiens
ctcttcctagtgtgcagcgtgg

SEQ ID NO: 9211575 - DNA, 22 bp, Homo sapiens
ctcttcctttcccttgagggtg

SEQ ID NO: 9211576 - DNA, 19 bp, Homo sapiens
ctgagcagcggcagcactt

SEQ ID NO: 9211577 - DNA, 22 bp, Homo sapiens
ctgagcagtggttcttgagcgc

SEQ ID NO: 9211578 - DNA, 22 bp, Homo sapiens
ctgagcaggatattcacagcag

SEQ ID NO: 9211579 - DNA, 23 bp, Homo sapiens
ctgaggggaaaagggcttcaggc

SEQ ID NO: 9211580 - DNA, 22 bp, Homo sapiens
ctgaggctggagtgcagtggtg

SEQ ID NO: 9211581 - DNA, 22 bp, Homo sapiens
ctgaggcctgggggcgtggacg

SEQ ID NO: 9211582 - DNA, 22 bp, Homo sapiens
ctgaggcctggccccaccacag

SEQ ID NO: 9211583 - DNA, 22 bp, Homo sapiens
ctgaggcctgtgttggggcagt

SEQ ID NO: 9211584 - DNA, 22 bp, Homo sapiens
ctgaggcctgtgttggggcagt

SEQ ID NO: 9211585 - DNA, 22 bp, Homo sapiens
ctgaggcctggtgaggtggtga

SEQ ID NO: 9211586 - DNA, 22 bp, Homo sapiens
ctgaggccgttggtgggcctta

SEQ ID NO: 9211587 - DNA, 22 bp, Homo sapiens
ctgaggccgtctgggtctgcag

SEQ ID NO: 9211588 - DNA, 23 bp, Homo sapiens
ctgaggcctgctgcgttcaggtt

SEQ ID NO: 9211589 - DNA, 22 bp, Homo sapiens
ctgaggccgttggtgggcctta

SEQ ID NO: 9211590 - DNA, 22 bp, Homo sapiens
ctgaggccgtctgggtctgcag

SEQ ID NO: 9211591 - DNA, 22 bp, Homo sapiens
ctgaggccgtctgggtctgcag

SEQ ID NO: 9211592 - DNA, 22 bp, Homo sapiens
ctgagccaaaaagcagagcttg

SEQ ID NO: 9211593 - DNA, 22 bp, Homo sapiens
ctgagccaaaaagcagagcttg

SEQ ID NO: 9211594 - DNA, 22 bp, Homo sapiens
ctgagccaaaaagcagagcttg

SEQ ID NO: 9211595 - DNA, 22 bp, Homo sapiens
ctgctgtccaggagtgccctgt

SEQ ID NO: 9211596 - DNA, 22 bp, Homo sapiens
ctgctgtccaacctgcactcgc

SEQ ID NO: 9211597 - DNA, 22 bp, Homo sapiens
ctgctggttagtcttagtggga

SEQ ID NO: 9211598 - DNA, 22 bp, Homo sapiens
ctgctggtgcagagtggggctg

SEQ ID NO: 9211599 - DNA, 22 bp, Homo sapiens
ctgctggtgatgtctgggcatg

SEQ ID NO: 9211600 - DNA, 22 bp, Homo sapiens
ctgctgtcaaaaatcactccat

SEQ ID NO: 9211601 - DNA, 22 bp, Homo sapiens
ctgctgtcaaaaatcactccat

SEQ ID NO: 9211602 - DNA, 22 bp, Homo sapiens
ctgctgggtctatgcaagtgga

SEQ ID NO: 9211603 - DNA, 22 bp, Homo sapiens
ctgctgggtccccctgctgatt

SEQ ID NO: 9211604 - DNA, 22 bp, Homo sapiens
ctgctggtaccagtggccgtca

SEQ ID NO: 9211605 - DNA, 22 bp, Homo sapiens
ctgctgaaaacaataatgatga

SEQ ID NO: 9211606 - DNA, 22 bp, Homo sapiens
ctgccttctttcaagggtaagc

SEQ ID NO: 9211607 - DNA, 22 bp, Homo sapiens
ctgcctttgcccttgacactgt

SEQ ID NO: 9211608 - DNA, 22 bp, Homo sapiens
ctgccttgtcttgttttcaggg

SEQ ID NO: 9211609 - DNA, 21 bp, Homo sapiens
ctgctctgacagtgaggccag

SEQ ID NO: 9211610 - DNA, 22 bp, Homo sapiens
ctgcctttggggagttagaggg

SEQ ID NO: 9211611 - DNA, 22 bp, Homo sapiens
ctgcctttggaagtccagagct

SEQ ID NO: 9211612 - DNA, 22 bp, Homo sapiens
ctgcctttgtgatcagttcttt

SEQ ID NO: 9211613 - DNA, 22 bp, Homo sapiens
ctgccttttaaagccagtgtta

SEQ ID NO: 9211614 - DNA, 22 bp, Homo sapiens
ctgcctttgtgatcagttcttt

SEQ ID NO: 9211615 - DNA, 22 bp, Homo sapiens
ctgccttttcatctgagctgga

SEQ ID NO: 9211616 - DNA, 22 bp, Homo sapiens
ctgctctgtggtccatgagaca

SEQ ID NO: 9211617 - DNA, 22 bp, Homo sapiens
ctgctctgtatatgagcaggaa

SEQ ID NO: 9211618 - DNA, 22 bp, Homo sapiens
ctggaaagtgcatgtaatgagg

SEQ ID NO: 9211619 - DNA, 22 bp, Homo sapiens
ctggaaagtgcttttctgagag

SEQ ID NO: 9211620 - DNA, 22 bp, Homo sapiens
ctgctgtgagtttggaggtcta

SEQ ID NO: 9211621 - DNA, 22 bp, Homo sapiens
ctgctgtctttatttcactgct

SEQ ID NO: 9211622 - DNA, 22 bp, Homo sapiens
ctggaaggttcctcccagctcc

SEQ ID NO: 9211623 - DNA, 22 bp, Homo sapiens
ctggaaggtaacaaggccatta

SEQ ID NO: 9211624 - DNA, 22 bp, Homo sapiens
ctggaagggtctacttagcaga

SEQ ID NO: 9211625 - DNA, 22 bp, Homo sapiens
ctggaaggtggatggcgaggcc

SEQ ID NO: 9211626 - DNA, 22 bp, Homo sapiens
ctggaagggggacagccacaca

SEQ ID NO: 9211627 - DNA, 19 bp, Homo sapiens
ctggaaggagggactgttc

SEQ ID NO: 9211628 - DNA, 22 bp, Homo sapiens
ctggaaggagaaggaggctgtg

SEQ ID NO: 9211629 - DNA, 22 bp, Homo sapiens
ctggaaggagcccgggcggatc

SEQ ID NO: 9211630 - DNA, 22 bp, Homo sapiens
ctggaaggcagaggttgcagtg

SEQ ID NO: 9211631 - DNA, 22 bp, Homo sapiens
ctggagataagcagtcccaggc

SEQ ID NO: 9211632 - DNA, 22 bp, Homo sapiens
ctggagcaaaagtgactcctct

SEQ ID NO: 9211633 - DNA, 22 bp, Homo sapiens
ctggagcaggtttaggagtccc

SEQ ID NO: 9211634 - DNA, 22 bp, Homo sapiens
ctggagccccaggctgtgcaga

SEQ ID NO: 9211635 - DNA, 22 bp, Homo sapiens
cgggctggctgcagctgctgga

SEQ ID NO: 9211636 - DNA, 22 bp, Homo sapiens
cggggaggcttcggattaaagc

SEQ ID NO: 9211637 - DNA, 22 bp, Homo sapiens
cggggaagcggttctggcggta

SEQ ID NO: 9211638 - DNA, 22 bp, Homo sapiens
cggggagggcagaggctccctc

SEQ ID NO: 9211639 - DNA, 22 bp, Homo sapiens
cggggccctggggctgaaggtc

SEQ ID NO: 9211640 - DNA, 22 bp, Homo sapiens
cggggcctagctgcacaccctc

SEQ ID NO: 9211641 - DNA, 22 bp, Homo sapiens
cggggcctagtctacctcggca

SEQ ID NO: 9211642 - DNA, 22 bp, Homo sapiens
cgtgagcaaaatggacactccc

SEQ ID NO: 9211643 - DNA, 22 bp, Homo sapiens
cggagtcttgctatgttgccca

SEQ ID NO: 9211644 - DNA, 22 bp, Homo sapiens
cggagtcttgctatgttgccca

SEQ ID NO: 9211645 - DNA, 22 bp, Homo sapiens
cggcacagggtaaacgttaccc

SEQ ID NO: 9211646 - DNA, 22 bp, Homo sapiens
cggcacagtggctcacgcctgt

SEQ ID NO: 9211647 - DNA, 22 bp, Homo sapiens
cggcacaggccccatcctgact

SEQ ID NO: 9211648 - DNA, 22 bp, Homo sapiens
cggcacagccgggcaaggctgg

SEQ ID NO: 9211649 - DNA, 22 bp, Homo sapiens
cggcacagccgggcaaggctgg

SEQ ID NO: 9211650 - DNA, 22 bp, Homo sapiens
cctttttcaatatagaattgca

SEQ ID NO: 9211651 - DNA, 22 bp, Homo sapiens
cctttttccctggagggacagc

SEQ ID NO: 9211652 - DNA, 22 bp, Homo sapiens
ccttttggccaggtcagtgcag

SEQ ID NO: 9211653 - DNA, 22 bp, Homo sapiens
ccttttgctctcccatccagaa

SEQ ID NO: 9211654 - DNA, 22 bp, Homo sapiens
ccttttgctctcccatccagaa

SEQ ID NO: 9211655 - DNA, 22 bp, Homo sapiens
ttatccaacatgacttatgtcc

SEQ ID NO: 9211656 - DNA, 22 bp, Homo sapiens
cgaagacagaccatctgagtag

SEQ ID NO: 9211657 - DNA, 22 bp, Homo sapiens
ttattgcaaaggaagagcttga

SEQ ID NO: 9211658 - DNA, 22 bp, Homo sapiens
cgctccttgagcgtgtcggcct

SEQ ID NO: 9211659 - DNA, 22 bp, Homo sapiens
cgctgccttcatcccacgccta

SEQ ID NO: 9211660 - DNA, 21 bp, Homo sapiens
cgctgccttgggagtggacct

SEQ ID NO: 9211661 - DNA, 22 bp, Homo sapiens
cgctggcttcctcctggggcca

SEQ ID NO: 9211662 - DNA, 22 bp, Homo sapiens
cgctgcctccaggtgcagcagg

SEQ ID NO: 9211663 - DNA, 22 bp, Homo sapiens
cgctgcctctctggggccctgg

SEQ ID NO: 9211664 - DNA, 22 bp, Homo sapiens
ttatcaagggagaaacaggagg

SEQ ID NO: 9211665 - DNA, 22 bp, Homo sapiens
ttataaagtgagaagtgctatg

SEQ ID NO: 9211666 - DNA, 22 bp, Homo sapiens
ccttgcctcattgtgcttctcc

SEQ ID NO: 9211667 - DNA, 22 bp, Homo sapiens
ccttgccctgagcaggggtcag

SEQ ID NO: 9211668 - DNA, 22 bp, Homo sapiens
ccttgcccgctgcctctgagtt

SEQ ID NO: 9211669 - DNA, 22 bp, Homo sapiens
ccttgcagcatatagagtccct

SEQ ID NO: 9211670 - DNA, 22 bp, Homo sapiens
ttacataacggtatgaaaaatg

SEQ ID NO: 9211671 - DNA, 22 bp, Homo sapiens
ttacataactttaaaatgccgt

SEQ ID NO: 9211672 - DNA, 22 bp, Homo sapiens
ccttcaaggcaaggagggctgg

SEQ ID NO: 9211673 - DNA, 22 bp, Homo sapiens
ccttcaagttcctggtccctgg

SEQ ID NO: 9211674 - DNA, 20 bp, Homo sapiens
ccttcagaacttacatagta

SEQ ID NO: 9211675 - DNA, 22 bp, Homo sapiens
ccttcagccagttttctttgtt

SEQ ID NO: 9211676 - DNA, 22 bp, Homo sapiens
ttagcaaatatcttgaaacagg

SEQ ID NO: 9211677 - DNA, 22 bp, Homo sapiens
ttagacagagctccttgagggc

SEQ ID NO: 9211678 - DNA, 22 bp, Homo sapiens
ttagcaaatatcttgaaacagg

SEQ ID NO: 9211679 - DNA, 22 bp, Homo sapiens
tgtcagaactctattgatgtcc

SEQ ID NO: 9211680 - DNA, 22 bp, Homo sapiens
tgtcagatgtgtctccaagtgc

SEQ ID NO: 9211681 - DNA, 22 bp, Homo sapiens
tgtcagctcccagtcagagaga

SEQ ID NO: 9211682 - DNA, 22 bp, Homo sapiens
ttaaatttctacgtgatccagg

SEQ ID NO: 9211683 - DNA, 22 bp, Homo sapiens
ttaaattttagaaacagactct

SEQ ID NO: 9211684 - DNA, 22 bp, Homo sapiens
ttaagatgatgtttcttgttgt

SEQ ID NO: 9211685 - DNA, 22 bp, Homo sapiens
ttacaaagcgttgagacaagta

SEQ ID NO: 9211686 - DNA, 22 bp, Homo sapiens
ttacaaagattatattcagtta

SEQ ID NO: 9211687 - DNA, 22 bp, Homo sapiens
ttacagtttacataagaattgt

SEQ ID NO: 9211688 - DNA, 22 bp, Homo sapiens
ccttagtgtgcctgaggcagat

SEQ ID NO: 9211689 - DNA, 22 bp, Homo sapiens
ccttagtgaaacagaggcaatt

SEQ ID NO: 9211690 - DNA, 17 bp, Homo sapiens
ccttagggcagtgtggt

SEQ ID NO: 9211691 - DNA, 22 bp, Homo sapiens
ctcagagaaaaggagcaagggt

SEQ ID NO: 9211692 - DNA, 22 bp, Homo sapiens
ctcagagaaaaggagcaagggt

SEQ ID NO: 9211693 - DNA, 22 bp, Homo sapiens
ctcagagaaatgtcacaacaat

SEQ ID NO: 9211694 - DNA, 22 bp, Homo sapiens
ttctttctgtccataatgagac

SEQ ID NO: 9211695 - DNA, 22 bp, Homo sapiens
ttctttctctactagcagagct

SEQ ID NO: 9211696 - DNA, 22 bp, Homo sapiens
ctcactgcaagctcagcctccc

SEQ ID NO: 9211697 - DNA, 22 bp, Homo sapiens
ctcactgcaagctcagcctccc

SEQ ID NO: 9211698 - DNA, 22 bp, Homo sapiens
ctcagagaggttgaacaacttg

SEQ ID NO: 9211699 - DNA, 22 bp, Homo sapiens
ctcagagagtgaattcctgcct

SEQ ID NO: 9211700 - DNA, 22 bp, Homo sapiens
ctcagagagggcaccagggcca

SEQ ID NO: 9211701 - DNA, 22 bp, Homo sapiens
ctcagagcaatgaacatgcaaa

SEQ ID NO: 9211702 - DNA, 22 bp, Homo sapiens
ctcagagctcgtgggaccttgg

SEQ ID NO: 9211703 - DNA, 22 bp, Homo sapiens
ctcacaggttctgcagctcaca

SEQ ID NO: 9211704 - DNA, 22 bp, Homo sapiens
ctcacaggttagttgtgtggat

SEQ ID NO: 9211705 - DNA, 22 bp, Homo sapiens
ctatacatcccaatttcagaga

SEQ ID NO: 9211706 - DNA, 22 bp, Homo sapiens
ctcacccatatctccatgactc

SEQ ID NO: 9211707 - DNA, 22 bp, Homo sapiens
ctcactcagacatccagtgcag

SEQ ID NO: 9211708 - DNA, 22 bp, Homo sapiens
ttctggcttcatctgacaagcc

SEQ ID NO: 9211709 - DNA, 22 bp, Homo sapiens
ttctggcatgagagatgggggt

SEQ ID NO: 9211710 - DNA, 22 bp, Homo sapiens
ttctggcatctgggggaggcct

SEQ ID NO: 9211711 - DNA, 20 bp, Homo sapiens
ttctggcaaacagagttctt

SEQ ID NO: 9211712 - DNA, 22 bp, Homo sapiens
ttctggctgtatgatatttaat

SEQ ID NO: 9211713 - DNA, 22 bp, Homo sapiens
ctaaaaatccacactaggtgaa

SEQ ID NO: 9211714 - DNA, 22 bp, Homo sapiens
cgtgtgtgtacctgcgcattta

SEQ ID NO: 9211715 - DNA, 22 bp, Homo sapiens
ctagagcagattgcagagtagg

SEQ ID NO: 9211716 - DNA, 22 bp, Homo sapiens
ctagagctgttctgtgcactca

SEQ ID NO: 9211717 - DNA, 22 bp, Homo sapiens
ctagagggatgttaggatagca

SEQ ID NO: 9211718 - DNA, 18 bp, Homo sapiens
ctagatgagcttggcaag

SEQ ID NO: 9211719 - DNA, 22 bp, Homo sapiens
ctagaaagatacttaaatcaag

SEQ ID NO: 9211720 - DNA, 22 bp, Homo sapiens
ctagagaaaatgatagcaggaa

SEQ ID NO: 9211721 - DNA, 22 bp, Homo sapiens
ctagagaaacgccgtgggagga

SEQ ID NO: 9211722 - DNA, 22 bp, Homo sapiens
ctagagaaaccccatgagcttt

SEQ ID NO: 9211723 - DNA, 22 bp, Homo sapiens
ttctggaagagtaaaataagcc

SEQ ID NO: 9211724 - DNA, 23 bp, Homo sapiens
ttctggatgttctagtctgagag

SEQ ID NO: 9211725 - DNA, 22 bp, Homo sapiens
ttctattgcacacaaataatta

SEQ ID NO: 9211726 - DNA, 22 bp, Homo sapiens
ctcaggaagcacaggccctaca

SEQ ID NO: 9211727 - DNA, 22 bp, Homo sapiens
ctcaggaaccgcggcagcagcc

SEQ ID NO: 9211728 - DNA, 22 bp, Homo sapiens
ctcaggaaccgcggcagcagcc

SEQ ID NO: 9211729 - DNA, 22 bp, Homo sapiens
ctcaggacccggtccaggtggg

SEQ ID NO: 9211730 - DNA, 22 bp, Homo sapiens
ctcaggagacagtgtccacatg

SEQ ID NO: 9211731 - DNA, 22 bp, Homo sapiens
ctcaggagacagtgtccacatg

SEQ ID NO: 9211732 - DNA, 22 bp, Homo sapiens
ctcaggaaaatattgaagaagt

SEQ ID NO: 9211733 - DNA, 19 bp, Homo sapiens
ctcagctgtagctcatgtg

SEQ ID NO: 9211734 - DNA, 22 bp, Homo sapiens
ctcagctggcaattctggctcc

SEQ ID NO: 9211735 - DNA, 22 bp, Homo sapiens
ctcaggaggatgactgccttgg

SEQ ID NO: 9211736 - DNA, 22 bp, Homo sapiens
ctcaggaggccattctcaaggt

SEQ ID NO: 9211737 - DNA, 22 bp, Homo sapiens
ctcaggaggaggaagttcattg

SEQ ID NO: 9211738 - DNA, 22 bp, Homo sapiens
ctcaggagcttcctcagcccat

SEQ ID NO: 9211739 - DNA, 22 bp, Homo sapiens
ctcaggaggtttcctgtctagg

SEQ ID NO: 9211740 - DNA, 22 bp, Homo sapiens
ctcaggagtagttcagcagctg

SEQ ID NO: 9211741 - DNA, 22 bp, Homo sapiens
ctcaggagtagttcagcagctg

SEQ ID NO: 9211742 - DNA, 22 bp, Homo sapiens
ctcagggatggtgaagcaccca

SEQ ID NO: 9211743 - DNA, 22 bp, Homo sapiens
ctcagggaattatttctgtcct

SEQ ID NO: 9211744 - DNA, 22 bp, Homo sapiens
ctcagggccaaggatgctgttg

SEQ ID NO: 9211745 - DNA, 22 bp, Homo sapiens
ctcagggtgcagcacagttcct

SEQ ID NO: 9211746 - DNA, 21 bp, Homo sapiens
ctcagggcttggtgtcctcat

SEQ ID NO: 9211747 - DNA, 22 bp, Homo sapiens
ttgcatcaggtagacaactata

SEQ ID NO: 9211748 - DNA, 22 bp, Homo sapiens
ttgccctgcctccctgaggtga

SEQ ID NO: 9211749 - DNA, 22 bp, Homo sapiens
ttgccctgtctcactatgttaa

SEQ ID NO: 9211750 - DNA, 22 bp, Homo sapiens
ctccaggacagattcagggcca

SEQ ID NO: 9211751 - DNA, 22 bp, Homo sapiens
ctccaggacactaacccaggct

SEQ ID NO: 9211752 - DNA, 22 bp, Homo sapiens
ctccaggacactaacccaggct

SEQ ID NO: 9211753 - DNA, 22 bp, Homo sapiens
ctccaggaccagggctcctgga

SEQ ID NO: 9211754 - DNA, 22 bp, Homo sapiens
ctccaggaccagggctcctgga

SEQ ID NO: 9211755 - DNA, 22 bp, Homo sapiens
ctccaggacatgactttcttgc

SEQ ID NO: 9211756 - DNA, 22 bp, Homo sapiens
ctccaggactcaggcccctggg

SEQ ID NO: 9211757 - DNA, 22 bp, Homo sapiens
ctccaggactcaggcccctggg

SEQ ID NO: 9211758 - DNA, 22 bp, Homo sapiens
ctccaggactgaggacagagct

SEQ ID NO: 9211759 - DNA, 22 bp, Homo sapiens
ctccaggactgaggacagagct

SEQ ID NO: 9211760 - DNA, 22 bp, Homo sapiens
ctccaggacccagtggctccag

SEQ ID NO: 9211761 - DNA, 22 bp, Homo sapiens
ctccaggacccagtggctccag

SEQ ID NO: 9211762 - DNA, 22 bp, Homo sapiens
ctccaggacccagtggctccag

SEQ ID NO: 9211763 - DNA, 22 bp, Homo sapiens
ctccagcctcatctcctggctg

SEQ ID NO: 9211764 - DNA, 22 bp, Homo sapiens
ctccagcctcatctcctggctg

SEQ ID NO: 9211765 - DNA, 22 bp, Homo sapiens
ttggctgccttcacccctggcc

SEQ ID NO: 9211766 - DNA, 22 bp, Homo sapiens
ttggctgaccagaacctgcccc

SEQ ID NO: 9211767 - DNA, 22 bp, Homo sapiens
ctccagaggaaagcacatagtg

SEQ ID NO: 9211768 - DNA, 22 bp, Homo sapiens
ttggctctgatggggatcagga

SEQ ID NO: 9211769 - DNA, 22 bp, Homo sapiens
ttggaaggagcctaaaagagac

SEQ ID NO: 9211770 - DNA, 22 bp, Homo sapiens
ttggaaaagtgaaactagatgc

SEQ ID NO: 9211771 - DNA, 22 bp, Homo sapiens
ctcagtcttctcctccaatgga

SEQ ID NO: 9211772 - DNA, 20 bp, Homo sapiens
ttggaaggtggagaagagga

SEQ ID NO: 9211773 - DNA, 22 bp, Homo sapiens
ttggagggtcttccacagccat

SEQ ID NO: 9211774 - DNA, 22 bp, Homo sapiens
ttggagggacagatggctaggc

SEQ ID NO: 9211775 - DNA, 22 bp, Homo sapiens
ttggagtgacagatgaggaaac

SEQ ID NO: 9211776 - DNA, 22 bp, Homo sapiens
cccaggaggcagaagttgcagt

SEQ ID NO: 9211777 - DNA, 22 bp, Homo sapiens
cccaggaggaggaaaaagctcg

SEQ ID NO: 9211778 - DNA, 22 bp, Homo sapiens
cccaggaggcagaggttgcagt

SEQ ID NO: 9211779 - DNA, 22 bp, Homo sapiens
cccaggaggcagaggttggagc

SEQ ID NO: 9211780 - DNA, 22 bp, Homo sapiens
cccaggaggccaaggttgcagt

SEQ ID NO: 9211781 - DNA, 22 bp, Homo sapiens
cccaggaggcctgcctggccgg

SEQ ID NO: 9211782 - DNA, 22 bp, Homo sapiens
cccaggaggcctgcctggccgg

SEQ ID NO: 9211783 - DNA, 22 bp, Homo sapiens
tgcatatatcttatttttctgt

SEQ ID NO: 9211784 - DNA, 19 bp, Homo sapiens
tgcatatatctatgaaaga

SEQ ID NO: 9211785 - DNA, 21 bp, Homo sapiens
cccaggaggagctccggctcc

SEQ ID NO: 9211786 - DNA, 22 bp, Homo sapiens
cccaggagcttctctctgcctc

SEQ ID NO: 9211787 - DNA, 21 bp, Homo sapiens
cccaggaggctgagaagagca

SEQ ID NO: 9211788 - DNA, 22 bp, Homo sapiens
cccaggaggcggaggttgcagt

SEQ ID NO: 9211789 - DNA, 22 bp, Homo sapiens
tgccctctcaagttgagtcaga

SEQ ID NO: 9211790 - DNA, 22 bp, Homo sapiens
tgccctcttaggtctgcgcagc

SEQ ID NO: 9211791 - DNA, 22 bp, Homo sapiens
tgccctctgcctcctctgcaga

SEQ ID NO: 9211792 - DNA, 22 bp, Homo sapiens
tgccctcattataagaggctca

SEQ ID NO: 9211793 - DNA, 22 bp, Homo sapiens
tgccctctttctgtacagctcc

SEQ ID NO: 9211794 - DNA, 22 bp, Homo sapiens
cccaggaggttgaggctgcagt

SEQ ID NO: 9211795 - DNA, 22 bp, Homo sapiens
tgcctcagtctaaagtctctca

SEQ ID NO: 9211796 - DNA, 19 bp, Homo sapiens
cccaggagtctggctggtt

SEQ ID NO: 9211797 - DNA, 20 bp, Homo sapiens
cccagcccgggccgcgctcg

SEQ ID NO: 9211798 - DNA, 22 bp, Homo sapiens
tgcagcatttgctgaagcagga

SEQ ID NO: 9211799 - DNA, 22 bp, Homo sapiens
cccagcatggagtgaggactca

SEQ ID NO: 9211800 - DNA, 22 bp, Homo sapiens
cccagcatctccaggcatggcc

SEQ ID NO: 9211801 - DNA, 22 bp, Homo sapiens
tgcagtcttccagctgcacaaa

SEQ ID NO: 9211802 - DNA, 22 bp, Homo sapiens
tgcagtcttccagctgcacaaa

SEQ ID NO: 9211803 - DNA, 22 bp, Homo sapiens
tgcagtgcctcggcagtgcagc

SEQ ID NO: 9211804 - DNA, 22 bp, Homo sapiens
tgcagtggaagaggtggagatc

SEQ ID NO: 9211805 - DNA, 22 bp, Homo sapiens
cccagctcatcaggagccgccc

SEQ ID NO: 9211806 - DNA, 22 bp, Homo sapiens
cccagctcaagcagagagctaa

SEQ ID NO: 9211807 - DNA, 22 bp, Homo sapiens
cccaggactctgacacccccaa

SEQ ID NO: 9211808 - DNA, 22 bp, Homo sapiens
cccaggactctgacacccccaa

SEQ ID NO: 9211809 - DNA, 22 bp, Homo sapiens
cccaggactcttcactgcagcc

SEQ ID NO: 9211810 - DNA, 22 bp, Homo sapiens
cccaggaccgcgcggctgagcg

SEQ ID NO: 9211811 - DNA, 22 bp, Homo sapiens
cccaggactaatgagctctacg

SEQ ID NO: 9211812 - DNA, 22 bp, Homo sapiens
cccaggactcggcactctcctt

SEQ ID NO: 9211813 - DNA, 22 bp, Homo sapiens
cccaggaccatccttctgtgcc

SEQ ID NO: 9211814 - DNA, 22 bp, Homo sapiens
cccaggacccttcaatggctcc

SEQ ID NO: 9211815 - DNA, 22 bp, Homo sapiens
cccaggacccttcaatggctcc

SEQ ID NO: 9211816 - DNA, 22 bp, Homo sapiens
cccagctccagagccagaaaca

SEQ ID NO: 9211817 - DNA, 18 bp, Homo sapiens
cccagctccacttccctc

SEQ ID NO: 9211818 - DNA, 22 bp, Homo sapiens
cccaggaaatagccaggaggtg

SEQ ID NO: 9211819 - DNA, 23 bp, Homo sapiens
ccagtgtggtaggtccacaggtg

SEQ ID NO: 9211820 - DNA, 22 bp, Homo sapiens
ccagtgttacggcttgaactat

SEQ ID NO: 9211821 - DNA, 22 bp, Homo sapiens
ccagtgttagagactgatacag

SEQ ID NO: 9211822 - DNA, 22 bp, Homo sapiens
ccagtgttattttagagtgtga

SEQ ID NO: 9211823 - DNA, 22 bp, Homo sapiens
ccagtgttcaatacatatttgt

SEQ ID NO: 9211824 - DNA, 22 bp, Homo sapiens
ccagtgttcagtatgcattaag

SEQ ID NO: 9211825 - DNA, 22 bp, Homo sapiens
ccagtgttcatcaagaaaatgt

SEQ ID NO: 9211826 - DNA, 22 bp, Homo sapiens
ccagtgttcataattttacact

SEQ ID NO: 9211827 - DNA, 22 bp, Homo sapiens
tgaggcagtattttagtgactt

SEQ ID NO: 9211828 - DNA, 22 bp, Homo sapiens
tgaggcagtattttagtgactt

SEQ ID NO: 9211829 - DNA, 18 bp, Homo sapiens
tgaggcagtcagtgatgg

SEQ ID NO: 9211830 - DNA, 22 bp, Homo sapiens
ccatttttaaagagcttaagta

SEQ ID NO: 9211831 - DNA, 22 bp, Homo sapiens
ccatggccgccgctgctcagga

SEQ ID NO: 9211832 - DNA, 22 bp, Homo sapiens
ccatttttgacagaaggcctaa

SEQ ID NO: 9211833 - DNA, 22 bp, Homo sapiens
ccatttttcataaactatccaa

SEQ ID NO: 9211834 - DNA, 22 bp, Homo sapiens
ccatttttcacaagactcactt

SEQ ID NO: 9211835 - DNA, 22 bp, Homo sapiens
ccatggcagcctggcctggctt

SEQ ID NO: 9211836 - DNA, 22 bp, Homo sapiens
ccatggccaggaaagccaaggt

SEQ ID NO: 9211837 - DNA, 20 bp, Homo sapiens
ccatggccacatctgtgctg

SEQ ID NO: 9211838 - DNA, 23 bp, Homo sapiens
ccatggagcatggctcactaggc

SEQ ID NO: 9211839 - DNA, 22 bp, Homo sapiens
ccatggcaactggcgtccaggg

SEQ ID NO: 9211840 - DNA, 19 bp, Homo sapiens
ccatggcaatgatctgatg

SEQ ID NO: 9211841 - DNA, 22 bp, Homo sapiens
ccatggcaatggtcagtctatt

SEQ ID NO: 9211842 - DNA, 22 bp, Homo sapiens
cccaacaacatgaaactaccta

SEQ ID NO: 9211843 - DNA, 22 bp, Homo sapiens
cccagagaatctttcagaaagg

SEQ ID NO: 9211844 - DNA, 22 bp, Homo sapiens
cccagagaagtgaagtgacttg

SEQ ID NO: 9211845 - DNA, 22 bp, Homo sapiens
cccagagaaccttctgtgccac

SEQ ID NO: 9211846 - DNA, 22 bp, Homo sapiens
cccagagaggtaaaacagcctt

SEQ ID NO: 9211847 - DNA, 22 bp, Homo sapiens
cccagagagctttctttgtgct

SEQ ID NO: 9211848 - DNA, 22 bp, Homo sapiens
cccagagagcacaggtggtggg

SEQ ID NO: 9211849 - DNA, 22 bp, Homo sapiens
cccagagagcatttggacaaag

SEQ ID NO: 9211850 - DNA, 22 bp, Homo sapiens
cccagagaattccacatagagg

SEQ ID NO: 9211851 - DNA, 22 bp, Homo sapiens
cccagagactttgtccgacgac

SEQ ID NO: 9211852 - DNA, 19 bp, Homo sapiens
cccagagagatctcttgcc

SEQ ID NO: 9211853 - DNA, 22 bp, Homo sapiens
cccagagatctactgagcccag

SEQ ID NO: 9211854 - DNA, 22 bp, Homo sapiens
cccagagatcttgtcctttcca

SEQ ID NO: 9211855 - DNA, 22 bp, Homo sapiens
tgcagcaggttccaaagggtta

SEQ ID NO: 9211856 - DNA, 23 bp, Homo sapiens
cccagcagattgtaaagtgtcca

SEQ ID NO: 9211857 - DNA, 22 bp, Homo sapiens
cccagcagatggctatgtgcta

SEQ ID NO: 9211858 - DNA, 18 bp, Homo sapiens
cccagcactttgggagcc

SEQ ID NO: 9211859 - DNA, 18 bp, Homo sapiens
cccagcactttgggagcc

SEQ ID NO: 9211860 - DNA, 22 bp, Homo sapiens
cccacccagctgagccgctcac

SEQ ID NO: 9211861 - DNA, 21 bp, Homo sapiens
tgcagagatatctgaagcaga

SEQ ID NO: 9211862 - DNA, 22 bp, Homo sapiens
tgcagagagttagggcccgtat

SEQ ID NO: 9211863 - DNA, 22 bp, Homo sapiens
tgcagagatagaactactttct

SEQ ID NO: 9211864 - DNA, 21 bp, Homo sapiens
cccaccccataaggcagaacc

SEQ ID NO: 9211865 - DNA, 21 bp, Homo sapiens
cccaccccataaggcagaacc

SEQ ID NO: 9211866 - DNA, 22 bp, Homo sapiens
cccacccagcctggctgagggg

SEQ ID NO: 9211867 - DNA, 23 bp, Homo sapiens
cccacatgtctgagtcagtgcca

SEQ ID NO: 9211868 - DNA, 22 bp, Homo sapiens
cccacccactctgaccagaagc

SEQ ID NO: 9211869 - DNA, 22 bp, Homo sapiens
cccacagggctgctgatggcag

SEQ ID NO: 9211870 - DNA, 22 bp, Homo sapiens
cccacaggccctgctgccttga

SEQ ID NO: 9211871 - DNA, 22 bp, Homo sapiens
cccacaggtggaagcctcggaa

SEQ ID NO: 9211872 - DNA, 22 bp, Homo sapiens
cccacaggtggaagcctcggaa

SEQ ID NO: 9211873 - DNA, 22 bp, Homo sapiens
cccacaggtccccatgaactcg

SEQ ID NO: 9211874 - DNA, 22 bp, Homo sapiens
cccacaggtggaagcctcggaa

SEQ ID NO: 9211875 - DNA, 22 bp, Homo sapiens
cccacaggtggaagcctcggaa

SEQ ID NO: 9211876 - DNA, 22 bp, Homo sapiens
cccacaggcaggtgcatgggct

SEQ ID NO: 9211877 - DNA, 22 bp, Homo sapiens
cccacaggcaggtgcatgggct

SEQ ID NO: 9211878 - DNA, 22 bp, Homo sapiens
cccacaggcaggggcagagaca

SEQ ID NO: 9211879 - DNA, 22 bp, Homo sapiens
cccacaggcaggggcagagaca

SEQ ID NO: 9211880 - DNA, 22 bp, Homo sapiens
cccacaggcaggggcagagaca

SEQ ID NO: 9211881 - DNA, 22 bp, Homo sapiens
cccacagaatgccaatgagacc

SEQ ID NO: 9211882 - DNA, 22 bp, Homo sapiens
cccaagggtgcccagcagagga

SEQ ID NO: 9211883 - DNA, 22 bp, Homo sapiens
ccaggctgagcatgattggagc

SEQ ID NO: 9211884 - DNA, 22 bp, Homo sapiens
ccaggctgagcatgattggagc

SEQ ID NO: 9211885 - DNA, 22 bp, Homo sapiens
ccaggctgagcatgattggagc

SEQ ID NO: 9211886 - DNA, 22 bp, Homo sapiens
ccaggctgccgaggaaagaaag

SEQ ID NO: 9211887 - DNA, 22 bp, Homo sapiens
ccaggctgccgaggaaagaaag

SEQ ID NO: 9211888 - DNA, 22 bp, Homo sapiens
ccaggctgcagtcaaggggcat

SEQ ID NO: 9211889 - DNA, 22 bp, Homo sapiens
ccaggctgcagtcaaggggcat

SEQ ID NO: 9211890 - DNA, 22 bp, Homo sapiens
ccaggctgctcacaagctgccc

SEQ ID NO: 9211891 - DNA, 22 bp, Homo sapiens
ccaggctgctcacaagctgccc

SEQ ID NO: 9211892 - DNA, 22 bp, Homo sapiens
ccaggctgctcacaagctgccc

SEQ ID NO: 9211893 - DNA, 22 bp, Homo sapiens
tgaaagcaggcgggctacttta

SEQ ID NO: 9211894 - DNA, 22 bp, Homo sapiens
tgaaagcagtgatttctccttc

SEQ ID NO: 9211895 - DNA, 22 bp, Homo sapiens
tgaaagcagtgccatgattatg

SEQ ID NO: 9211896 - DNA, 22 bp, Homo sapiens
tgaaagcatatgctaaagacca

SEQ ID NO: 9211897 - DNA, 20 bp, Homo sapiens
tgaaagcatgtggtatttgg

SEQ ID NO: 9211898 - DNA, 22 bp, Homo sapiens
tgaaagcatgcttgccaagctt

SEQ ID NO: 9211899 - DNA, 22 bp, Homo sapiens
tgaaagctgtccactaggctgt

SEQ ID NO: 9211900 - DNA, 22 bp, Homo sapiens
ccaggctcctcatgatcttgtt

SEQ ID NO: 9211901 - DNA, 22 bp, Homo sapiens
ccaggctccccaggaggccctt

SEQ ID NO: 9211902 - DNA, 22 bp, Homo sapiens
ccaggctccccaggaggccctt

SEQ ID NO: 9211903 - DNA, 22 bp, Homo sapiens
ccaggctccgcatagaccccac

SEQ ID NO: 9211904 - DNA, 22 bp, Homo sapiens
tgaaagcagcaccaataccatt

SEQ ID NO: 9211905 - DNA, 22 bp, Homo sapiens
tgaaagcagatagctctgttgt

SEQ ID NO: 9211906 - DNA, 22 bp, Homo sapiens
tgaagagatagaagtacatgct

SEQ ID NO: 9211907 - DNA, 22 bp, Homo sapiens
tgaacactgtatattcttcttg

SEQ ID NO: 9211908 - DNA, 22 bp, Homo sapiens
ccaggctatctggccttgagct

SEQ ID NO: 9211909 - DNA, 22 bp, Homo sapiens
ccaggctagagtgcagtggcgt

SEQ ID NO: 9211910 - DNA, 22 bp, Homo sapiens
ccaggctagagtgcagtggcat

SEQ ID NO: 9211911 - DNA, 22 bp, Homo sapiens
ccaggctagagagcagtggcat

SEQ ID NO: 9211912 - DNA, 22 bp, Homo sapiens
ccaggctagagagcagtggcac

SEQ ID NO: 9211913 - DNA, 22 bp, Homo sapiens
ccaggctcacctggagcccctg

SEQ ID NO: 9211914 - DNA, 17 bp, Homo sapiens
ccaggctccatcactgt

SEQ ID NO: 9211915 - DNA, 22 bp, Homo sapiens
ccaggctcaggtgcgagagaca

SEQ ID NO: 9211916 - DNA, 22 bp, Homo sapiens
ccaggctcagcgcgcacgtctg

SEQ ID NO: 9211917 - DNA, 22 bp, Homo sapiens
ccaggctcaggcctgctcgttg

SEQ ID NO: 9211918 - DNA, 22 bp, Homo sapiens
ccaggctagaaactgaggcaca

SEQ ID NO: 9211919 - DNA, 19 bp, Homo sapiens
ccaggcctggcgtctccgc

SEQ ID NO: 9211920 - DNA, 22 bp, Homo sapiens
ccaggcgtggcttcagcagccc

SEQ ID NO: 9211921 - DNA, 22 bp, Homo sapiens
ccaggcgtggcttcagcagccc

SEQ ID NO: 9211922 - DNA, 22 bp, Homo sapiens
ccagcccttgctgaagggtggc

SEQ ID NO: 9211923 - DNA, 22 bp, Homo sapiens
ccagccctttgtggttcactga

SEQ ID NO: 9211924 - DNA, 22 bp, Homo sapiens
ccagcccttgaggtctgtccat

SEQ ID NO: 9211925 - DNA, 22 bp, Homo sapiens
tctgcagacaggaagctgaggc

SEQ ID NO: 9211926 - DNA, 21 bp, Homo sapiens
ccagcctcagatcagggagct

SEQ ID NO: 9211927 - DNA, 21 bp, Homo sapiens
ccagcctcagatcagggagct

SEQ ID NO: 9211928 - DNA, 21 bp, Homo sapiens
ccagcctcagatcagggagct

SEQ ID NO: 9211929 - DNA, 22 bp, Homo sapiens
tcttgtcctaagagctggattc

SEQ ID NO: 9211930 - DNA, 22 bp, Homo sapiens
tctttaaagttggagcttgcaa

SEQ ID NO: 9211931 - DNA, 22 bp, Homo sapiens
tgaccaggatactgcagggatg

SEQ ID NO: 9211932 - DNA, 22 bp, Homo sapiens
tgaccacagacccaatgactac

SEQ ID NO: 9211933 - DNA, 22 bp, Homo sapiens
tgaccaatactgtggatgccag

SEQ ID NO: 9211934 - DNA, 22 bp, Homo sapiens
ccagggccagtaagattggcat

SEQ ID NO: 9211935 - DNA, 22 bp, Homo sapiens
ccagggccaagagacctcgagg

SEQ ID NO: 9211936 - DNA, 22 bp, Homo sapiens
ccagggcccacggccagaatag

SEQ ID NO: 9211937 - DNA, 22 bp, Homo sapiens
tgagaaaacagtttgtaataat

SEQ ID NO: 9211938 - DNA, 22 bp, Homo sapiens
ccagggtctctgctgcctgaga

SEQ ID NO: 9211939 - DNA, 22 bp, Homo sapiens
tgaccccactgtgctcagaggt

SEQ ID NO: 9211940 - DNA, 22 bp, Homo sapiens
tgaccccactgtgctcagaggt

SEQ ID NO: 9211941 - DNA, 19 bp, Homo sapiens
tgaccccacgctccagagc

SEQ ID NO: 9211942 - DNA, 22 bp, Homo sapiens
ccaggcttggtgtgtggtcagg

SEQ ID NO: 9211943 - DNA, 19 bp, Homo sapiens
ccaggctttatgcaaatac

SEQ ID NO: 9211944 - DNA, 22 bp, Homo sapiens
ccaggctttaagaggtggaaac

SEQ ID NO: 9211945 - DNA, 22 bp, Homo sapiens
ccaggctttgtaccaggctttc

SEQ ID NO: 9211946 - DNA, 22 bp, Homo sapiens
ccaggctttgtaccaggctttc

SEQ ID NO: 9211947 - DNA, 22 bp, Homo sapiens
ccaggcttttagctgcatggca

SEQ ID NO: 9211948 - DNA, 22 bp, Homo sapiens
ccagggaagaaagatgaagtgc

SEQ ID NO: 9211949 - DNA, 22 bp, Homo sapiens
tgacagaggagctggaatgatt

SEQ ID NO: 9211950 - DNA, 22 bp, Homo sapiens
ccagggccaagagacctcgagg

SEQ ID NO: 9211951 - DNA, 22 bp, Homo sapiens
tgagcagactctgcagagccac

SEQ ID NO: 9211952 - DNA, 22 bp, Homo sapiens
tgagcagaatgttcagataaat

SEQ ID NO: 9211953 - DNA, 22 bp, Homo sapiens
tgagcagaagttataaataaga

SEQ ID NO: 9211954 - DNA, 22 bp, Homo sapiens
tgagcagacttgatgaggcagc

SEQ ID NO: 9211955 - DNA, 22 bp, Homo sapiens
tgagcccaggagttggagaccg

SEQ ID NO: 9211956 - DNA, 22 bp, Homo sapiens
tgagcagaaaagaatgctgagc

SEQ ID NO: 9211957 - DNA, 22 bp, Homo sapiens
tgagcagaagccctcctggact

SEQ ID NO: 9211958 - DNA, 22 bp, Homo sapiens
tgagcagaagccctcctggact

SEQ ID NO: 9211959 - DNA, 22 bp, Homo sapiens
tgagcagaacacgggatccatg

SEQ ID NO: 9211960 - DNA, 22 bp, Homo sapiens
tgagcagaagattggaacttac

SEQ ID NO: 9211961 - DNA, 22 bp, Homo sapiens
tgagctggcaggggctcaggga

SEQ ID NO: 9211962 - DNA, 19 bp, Homo sapiens
tgagctggctgagcctctc

SEQ ID NO: 9211963 - DNA, 19 bp, Homo sapiens
tgagctggctgagcctctc

SEQ ID NO: 9211964 - DNA, 22 bp, Homo sapiens
tgagctggcaggggctcaggga

SEQ ID NO: 9211965 - DNA, 22 bp, Homo sapiens
tgagctgggaagagcagccaga

SEQ ID NO: 9211966 - DNA, 22 bp, Homo sapiens
tgagctggcttgtcaaccaggg

SEQ ID NO: 9211967 - DNA, 19 bp, Homo sapiens
tgagctggctgagcctctc

SEQ ID NO: 9211968 - DNA, 22 bp, Homo sapiens
tgagctgggaagagcagccaga

SEQ ID NO: 9211969 - DNA, 22 bp, Homo sapiens
tgaggacatgagtgggacagag

SEQ ID NO: 9211970 - DNA, 22 bp, Homo sapiens
tgaggacatgagtgggacagag

SEQ ID NO: 9211971 - DNA, 23 bp, Homo sapiens
tgagctgggcctgcaggggtctc

SEQ ID NO: 9211972 - DNA, 22 bp, Homo sapiens
tgagctgggctgggctgagctg

SEQ ID NO: 9211973 - DNA, 22 bp, Homo sapiens
tgagctgggctgggctgagctg

SEQ ID NO: 9211974 - DNA, 22 bp, Homo sapiens
tgaggaatttctttatgaatga

SEQ ID NO: 9211975 - DNA, 22 bp, Homo sapiens
tgaggacaatccctaactcaga

SEQ ID NO: 9211976 - DNA, 23 bp, Homo sapiens
tgagctggtattgtccatctcca

SEQ ID NO: 9211977 - DNA, 23 bp, Homo sapiens
tgagctggtattgtccatctcca

SEQ ID NO: 9211978 - DNA, 22 bp, Homo sapiens
ccaggtctatcaagttgggctc

SEQ ID NO: 9211979 - DNA, 19 bp, Homo sapiens
tgagactgggtgcagtact

SEQ ID NO: 9211980 - DNA, 22 bp, Homo sapiens
ccagggtggggtccaggaacca

SEQ ID NO: 9211981 - DNA, 22 bp, Homo sapiens
ccagggtggggtccaggaacca

SEQ ID NO: 9211982 - DNA, 22 bp, Homo sapiens
ccagggtgtgggcgtcggcacg

SEQ ID NO: 9211983 - DNA, 22 bp, Homo sapiens
ccagggtgtgagaaggaagtag

SEQ ID NO: 9211984 - DNA, 22 bp, Homo sapiens
ccagggtgtagggattccagat

SEQ ID NO: 9211985 - DNA, 22 bp, Homo sapiens
ccagggtggcgtagatgctggg

SEQ ID NO: 9211986 - DNA, 22 bp, Homo sapiens
ccagggtgggaggctgaaggcg

SEQ ID NO: 9211987 - DNA, 22 bp, Homo sapiens
ccagggtgggaggctgaaggcg

SEQ ID NO: 9211988 - DNA, 22 bp, Homo sapiens
ccagggtgtgggcgtcggcacg

SEQ ID NO: 9211989 - DNA, 22 bp, Homo sapiens
ccaggtaggagagtcaacatgt

SEQ ID NO: 9211990 - DNA, 22 bp, Homo sapiens
ccaggtaggagagagggatcct

SEQ ID NO: 9211991 - DNA, 22 bp, Homo sapiens
ccaggtagccaaggggtctggg

SEQ ID NO: 9211992 - DNA, 22 bp, Homo sapiens
tggaaagacatgtccttcatta

SEQ ID NO: 9211993 - DNA, 20 bp, Homo sapiens
tggaagacactgaagggcca

SEQ ID NO: 9211994 - DNA, 21 bp, Homo sapiens
tggaaggctgctctgccaggg

SEQ ID NO: 9211995 - DNA, 22 bp, Homo sapiens
tggaaggctgagagtcctgggg

SEQ ID NO: 9211996 - DNA, 22 bp, Homo sapiens
tggaagggaaagtttggggtcc

SEQ ID NO: 9211997 - DNA, 19 bp, Homo sapiens
tgcctgctcctggcttcca

SEQ ID NO: 9211998 - DNA, 22 bp, Homo sapiens
tgcctgctagatatccaggtga

SEQ ID NO: 9211999 - DNA, 23 bp, Homo sapiens
tgcctccaccgagggccaggcat

SEQ ID NO: 9212000 - DNA, 17 bp, Homo sapiens
tgcctccagcagggtga

SEQ ID NO: 9212001 - DNA, 22 bp, Homo sapiens
tgcctccaacagcccatcctag

SEQ ID NO: 9212002 - DNA, 22 bp, Homo sapiens
tgcctcagtttcatctgcagaa

SEQ ID NO: 9212003 - DNA, 22 bp, Homo sapiens
tgcctgccttgctgctggacag

SEQ ID NO: 9212004 - DNA, 22 bp, Homo sapiens
tgcctgcctctggcagccctgc

SEQ ID NO: 9212005 - DNA, 22 bp, Homo sapiens
tgcctgcctaggaagctgtgaa

SEQ ID NO: 9212006 - DNA, 22 bp, Homo sapiens
tgcctgcctcaggccgagtgct

SEQ ID NO: 9212007 - DNA, 22 bp, Homo sapiens
tgcctgcctaggaagctgtgaa

SEQ ID NO: 9212008 - DNA, 20 bp, Homo sapiens
tgcctgcccctgctttttcc

SEQ ID NO: 9212009 - DNA, 22 bp, Homo sapiens
tgcctgccctgaaaactgccca

SEQ ID NO: 9212010 - DNA, 22 bp, Homo sapiens
ccctgccttggggtccacaccg

SEQ ID NO: 9212011 - DNA, 22 bp, Homo sapiens
ccctgccttcttggcctttaaa

SEQ ID NO: 9212012 - DNA, 22 bp, Homo sapiens
ccctgccttgttggagcctatg

SEQ ID NO: 9212013 - DNA, 22 bp, Homo sapiens
ccctgccttgtctgggctaggt

SEQ ID NO: 9212014 - DNA, 22 bp, Homo sapiens
ccctgccttgtctgggctaggt

SEQ ID NO: 9212015 - DNA, 22 bp, Homo sapiens
ccctgctcttctgactcaagct

SEQ ID NO: 9212016 - DNA, 22 bp, Homo sapiens
ccctgctcttagtgcctgtgtg

SEQ ID NO: 9212017 - DNA, 22 bp, Homo sapiens
ccctgctcttagtgcctgtgtg

SEQ ID NO: 9212018 - DNA, 22 bp, Homo sapiens
tggaggtacataatgagagggt

SEQ ID NO: 9212019 - DNA, 23 bp, Homo sapiens
ccctggagctagtctgagcagag

SEQ ID NO: 9212020 - DNA, 19 bp, Homo sapiens
ccctgccctggtgactggg

SEQ ID NO: 9212021 - DNA, 22 bp, Homo sapiens
ccctgcagtcctttcttggctc

SEQ ID NO: 9212022 - DNA, 22 bp, Homo sapiens
ccctgcctacagggttttcttt

SEQ ID NO: 9212023 - DNA, 22 bp, Homo sapiens
ccctgcctctgaagctgctcag

SEQ ID NO: 9212024 - DNA, 22 bp, Homo sapiens
ccctgcctgtgggcatcaacat

SEQ ID NO: 9212025 - DNA, 22 bp, Homo sapiens
tggacaggttgagtaggaggag

SEQ ID NO: 9212026 - DNA, 20 bp, Homo sapiens
ccctgcagccatgggagtgg

SEQ ID NO: 9212027 - DNA, 22 bp, Homo sapiens
ccctgcagccggccagctcatt

SEQ ID NO: 9212028 - DNA, 22 bp, Homo sapiens
ccctgcagagggatgggggcag

SEQ ID NO: 9212029 - DNA, 22 bp, Homo sapiens
ccctgcagatcagtgagaactt

SEQ ID NO: 9212030 - DNA, 17 bp, Homo sapiens
ccctgcaccctactctc

SEQ ID NO: 9212031 - DNA, 23 bp, Homo sapiens
ccctgcactaagaggagaaggtg

SEQ ID NO: 9212032 - DNA, 22 bp, Homo sapiens
ccctgcagaaccacagacaaac

SEQ ID NO: 9212033 - DNA, 22 bp, Homo sapiens
ccctgtcctggatgggagcact

SEQ ID NO: 9212034 - DNA, 22 bp, Homo sapiens
ccctgtccttggctgtgaggct

SEQ ID NO: 9212035 - DNA, 22 bp, Homo sapiens
ccctgtctcattgatcacttgt

SEQ ID NO: 9212036 - DNA, 22 bp, Homo sapiens
ccctggtggtacggcactggca

SEQ ID NO: 9212037 - DNA, 22 bp, Homo sapiens
ccctggtgccctgggtcagcct

SEQ ID NO: 9212038 - DNA, 22 bp, Homo sapiens
ccctggtggggccagacttgct

SEQ ID NO: 9212039 - DNA, 22 bp, Homo sapiens
ccctggagctgcttgcatgttg

SEQ ID NO: 9212040 - DNA, 22 bp, Homo sapiens
ccctggagctgcttgcatgttg

SEQ ID NO: 9212041 - DNA, 20 bp, Homo sapiens
ccctgtgattggcaagtgtc

SEQ ID NO: 9212042 - DNA, 22 bp, Homo sapiens
ccctgtccttggctgtgaggct

SEQ ID NO: 9212043 - DNA, 22 bp, Homo sapiens
ccctgtggcaggaggaggagca

SEQ ID NO: 9212044 - DNA, 22 bp, Homo sapiens
ccggctactcgggaggctgacg

SEQ ID NO: 9212045 - DNA, 22 bp, Homo sapiens
ccgggagcaggcgccaccgcca

SEQ ID NO: 9212046 - DNA, 22 bp, Homo sapiens
ccgggcctcgggacaccgggta

SEQ ID NO: 9212047 - DNA, 22 bp, Homo sapiens
ccgtggtcacctgagctccttg

SEQ ID NO: 9212048 - DNA, 22 bp, Homo sapiens
ccgtctgcagcctccaggagtt

SEQ ID NO: 9212049 - DNA, 22 bp, Homo sapiens
ccgtgctcgggaaaggccagtg

SEQ ID NO: 9212050 - DNA, 22 bp, Homo sapiens
cctcacccactacactcaaggg

SEQ ID NO: 9212051 - DNA, 22 bp, Homo sapiens
cctcacagaggggcagccatct

SEQ ID NO: 9212052 - DNA, 22 bp, Homo sapiens
cctcccctcagacagagactgg

SEQ ID NO: 9212053 - DNA, 22 bp, Homo sapiens
cctcccctcagacagagactgg

SEQ ID NO: 9212054 - DNA, 22 bp, Homo sapiens
tggctcagcggtggcagcagac

SEQ ID NO: 9212055 - DNA, 22 bp, Homo sapiens
tggctcagcgcggcctggtctt

SEQ ID NO: 9212056 - DNA, 22 bp, Homo sapiens
cctccctccctgcagaagccac

SEQ ID NO: 9212057 - DNA, 22 bp, Homo sapiens
cctccctctgttagagctgtct

SEQ ID NO: 9212058 - DNA, 19 bp, Homo sapiens
cctccccttggaccagcaa

SEQ ID NO: 9212059 - DNA, 19 bp, Homo sapiens
cctccccttggaccagcaa

SEQ ID NO: 9212060 - DNA, 22 bp, Homo sapiens
tggctacatttatactctcatt

SEQ ID NO: 9212061 - DNA, 22 bp, Homo sapiens
tggctacatttatactctcatt

SEQ ID NO: 9212062 - DNA, 22 bp, Homo sapiens
tggctactgtacttgagctatt

SEQ ID NO: 9212063 - DNA, 22 bp, Homo sapiens
tggctacagaatgaatgctgcc

SEQ ID NO: 9212064 - DNA, 22 bp, Homo sapiens
tggctcagcgcggcctggtctt

SEQ ID NO: 9212065 - DNA, 22 bp, Homo sapiens
tggctcagccattcgtgttgcc

SEQ ID NO: 9212066 - DNA, 20 bp, Homo sapiens
tggctagcattaaaatgact

SEQ ID NO: 9212067 - DNA, 22 bp, Homo sapiens
cctcaccttttctctgattgct

SEQ ID NO: 9212068 - DNA, 22 bp, Homo sapiens
cctcacctcagtctgggcctca

SEQ ID NO: 9212069 - DNA, 19 bp, Homo sapiens
cctcaccctgcagaggagg

SEQ ID NO: 9212070 - DNA, 22 bp, Homo sapiens
cctcactcttgtcctggcaggt

SEQ ID NO: 9212071 - DNA, 21 bp, Homo sapiens
tggcctcccacacttccatgg

SEQ ID NO: 9212072 - DNA, 22 bp, Homo sapiens
tggccctgcttatgtctctctt

SEQ ID NO: 9212073 - DNA, 22 bp, Homo sapiens
tggctaacaaggtgaaaccccg

SEQ ID NO: 9212074 - DNA, 22 bp, Homo sapiens
cctcagctgcttccctggagcc

SEQ ID NO: 9212075 - DNA, 23 bp, Homo sapiens
tggcctctccccacctggcagaa

SEQ ID NO: 9212076 - DNA, 22 bp, Homo sapiens
tggcctcggcatccagcaagag

SEQ ID NO: 9212077 - DNA, 22 bp, Homo sapiens
tggcctcggcatccagcaagag

SEQ ID NO: 9212078 - DNA, 22 bp, Homo sapiens
tggcctcggcatccagcaagag

SEQ ID NO: 9212079 - DNA, 23 bp, Homo sapiens
cctcagcatggcaggagcccagc

SEQ ID NO: 9212080 - DNA, 18 bp, Homo sapiens
cctgaagcctgtgtcttt

SEQ ID NO: 9212081 - DNA, 22 bp, Homo sapiens
cctcttctgagtgagactccct

SEQ ID NO: 9212082 - DNA, 22 bp, Homo sapiens
tgggccagaagtatgcatgttt

SEQ ID NO: 9212083 - DNA, 22 bp, Homo sapiens
tgggccacttgaaagtggatgt

SEQ ID NO: 9212084 - DNA, 22 bp, Homo sapiens
tgggccagaggcatggagctat

SEQ ID NO: 9212085 - DNA, 21 bp, Homo sapiens
tgggccagatctgagtttcta

SEQ ID NO: 9212086 - DNA, 22 bp, Homo sapiens
cctctggccatcccccattaag

SEQ ID NO: 9212087 - DNA, 22 bp, Homo sapiens
cctctggccagagaaaggccag

SEQ ID NO: 9212088 - DNA, 22 bp, Homo sapiens
cctctggccacatgggacatag

SEQ ID NO: 9212089 - DNA, 22 bp, Homo sapiens
cctctggccattctttgatgga

SEQ ID NO: 9212090 - DNA, 22 bp, Homo sapiens
cctctggccattctttgatgga

SEQ ID NO: 9212091 - DNA, 22 bp, Homo sapiens
cctctggcctaggccgggagag

SEQ ID NO: 9212092 - DNA, 22 bp, Homo sapiens
tgggccactgctccaagtagct

SEQ ID NO: 9212093 - DNA, 22 bp, Homo sapiens
tgggccactgctgcggaaggcg

SEQ ID NO: 9212094 - DNA, 22 bp, Homo sapiens
tgggccactgctgcggaaggcg

SEQ ID NO: 9212095 - DNA, 23 bp, Homo sapiens
tgggccactatagaaatctctca

SEQ ID NO: 9212096 - DNA, 22 bp, Homo sapiens
cctctggcctaggccgggagag

SEQ ID NO: 9212097 - DNA, 22 bp, Homo sapiens
tgggagcagttcaggtgtggct

SEQ ID NO: 9212098 - DNA, 22 bp, Homo sapiens
tgggagcaggtgtgctagggaa

SEQ ID NO: 9212099 - DNA, 22 bp, Homo sapiens
tgggagcctggcaggccagagg

SEQ ID NO: 9212100 - DNA, 22 bp, Homo sapiens
cctctggcaagtgatttatcat

SEQ ID NO: 9212101 - DNA, 16 bp, Homo sapiens
cctctggcaattagat

SEQ ID NO: 9212102 - DNA, 22 bp, Homo sapiens
cctctggcatagcaagtggcct

SEQ ID NO: 9212103 - DNA, 22 bp, Homo sapiens
cctctggcatagcaagtggcct

SEQ ID NO: 9212104 - DNA, 22 bp, Homo sapiens
cctctggcagccagccagttgt

SEQ ID NO: 9212105 - DNA, 23 bp, Homo sapiens
tgggagctcaagggaggctgccc

SEQ ID NO: 9212106 - DNA, 22 bp, Homo sapiens
tgggagctcacaggcctggctc

SEQ ID NO: 9212107 - DNA, 22 bp, Homo sapiens
cctctggcaacttcacagccca

SEQ ID NO: 9212108 - DNA, 22 bp, Homo sapiens
cctctggatctttctccacact

SEQ ID NO: 9212109 - DNA, 21 bp, Homo sapiens
tggctctgaaagagtgctgca

SEQ ID NO: 9212110 - DNA, 22 bp, Homo sapiens
tgggagcaggaagcaggaagta

SEQ ID NO: 9212111 - DNA, 21 bp, Homo sapiens
tgggagagcgttgctgtcctc

SEQ ID NO: 9212112 - DNA, 22 bp, Homo sapiens
tggctctcagctcccagcagcc

SEQ ID NO: 9212113 - DNA, 22 bp, Homo sapiens
tggctctcagctcccagcagcc

SEQ ID NO: 9212114 - DNA, 22 bp, Homo sapiens
cctccctgcgctcctgcggcgg

SEQ ID NO: 9212115 - DNA, 22 bp, Homo sapiens
tggctctcagctcccagcagcc

SEQ ID NO: 9212116 - DNA, 22 bp, Homo sapiens
cctgcacttctcacagctgctg

SEQ ID NO: 9212117 - DNA, 22 bp, Homo sapiens
cctgccaggagctggtgctgca

SEQ ID NO: 9212118 - DNA, 22 bp, Homo sapiens
cctgccaggccagtgagcttcc

SEQ ID NO: 9212119 - DNA, 22 bp, Homo sapiens
cctgcactacctggggctgctg

SEQ ID NO: 9212120 - DNA, 22 bp, Homo sapiens
cctgccagagcagcttgtcctc

SEQ ID NO: 9212121 - DNA, 22 bp, Homo sapiens
tggggtcctctcacttggaggg

SEQ ID NO: 9212122 - DNA, 20 bp, Homo sapiens
tggggtcctggaggggatcc

SEQ ID NO: 9212123 - DNA, 22 bp, Homo sapiens
cctgcaagacctgagacacacc

SEQ ID NO: 9212124 - DNA, 22 bp, Homo sapiens
cctgcaagactatttagttcca

SEQ ID NO: 9212125 - DNA, 22 bp, Homo sapiens
cctgcacagccttggctgacac

SEQ ID NO: 9212126 - DNA, 22 bp, Homo sapiens
cctgcaagagcggagaagccag

SEQ ID NO: 9212127 - DNA, 22 bp, Homo sapiens
tgggggtgtcctggtgcacaca

SEQ ID NO: 9212128 - DNA, 17 bp, Homo sapiens
tggggtccccgatggtg

SEQ ID NO: 9212129 - DNA, 22 bp, Homo sapiens
tggggtagggaaaagaagtcga

SEQ ID NO: 9212130 - DNA, 22 bp, Homo sapiens
tggggtaggagtcagcgagaga

SEQ ID NO: 9212131 - DNA, 21 bp, Homo sapiens
cctgagggtggttgtgaagat

SEQ ID NO: 9212132 - DNA, 22 bp, Homo sapiens
cctgaccagagtgagggcttag

SEQ ID NO: 9212133 - DNA, 22 bp, Homo sapiens
cctgaccacccttggacaaggt

SEQ ID NO: 9212134 - DNA, 19 bp, Homo sapiens
cctgaccacacaggccttg

SEQ ID NO: 9212135 - DNA, 22 bp, Homo sapiens
cctgaccatttgccacatgggt

SEQ ID NO: 9212136 - DNA, 21 bp, Homo sapiens
cctgacctaatttgccatcag

SEQ ID NO: 9212137 - DNA, 22 bp, Homo sapiens
cctgacagcgtgtccctggccc

SEQ ID NO: 9212138 - DNA, 22 bp, Homo sapiens
cctgacaggagaagcgcagcat

SEQ ID NO: 9212139 - DNA, 22 bp, Homo sapiens
cctgacaggcggaggctgcagt

SEQ ID NO: 9212140 - DNA, 22 bp, Homo sapiens
cctgacagtggtagccttggca

SEQ ID NO: 9212141 - DNA, 22 bp, Homo sapiens
cctgacaggcggaggctgcagt

SEQ ID NO: 9212142 - DNA, 22 bp, Homo sapiens
cctgagaatgtttaacagagaa

SEQ ID NO: 9212143 - DNA, 22 bp, Homo sapiens
cctgagacatgaaccaggctcc

SEQ ID NO: 9212144 - DNA, 22 bp, Homo sapiens
cctgaggccctggctgtgctga

SEQ ID NO: 9212145 - DNA, 22 bp, Homo sapiens
cctgaggctccacctccagaga

SEQ ID NO: 9212146 - DNA, 22 bp, Homo sapiens
cctgaggctctcctgaataatg

SEQ ID NO: 9212147 - DNA, 22 bp, Homo sapiens
cctgaggcttaatctgtcccaa

SEQ ID NO: 9212148 - DNA, 22 bp, Homo sapiens
cctgagggcgccgagctcccag

SEQ ID NO: 9212149 - DNA, 22 bp, Homo sapiens
tgtcaacaaaacggttcaaatg

SEQ ID NO: 9212150 - DNA, 22 bp, Homo sapiens
tgtcaacaacagcattttctat

SEQ ID NO: 9212151 - DNA, 22 bp, Homo sapiens
tgtcaacacacctatctcaatt

SEQ ID NO: 9212152 - DNA, 22 bp, Homo sapiens
tgtcaagagtagtttgaatagt

SEQ ID NO: 9212153 - DNA, 22 bp, Homo sapiens
tgtcaagagctgttgaggctga

SEQ ID NO: 9212154 - DNA, 22 bp, Homo sapiens
cctggaggcggaggttgcagtg

SEQ ID NO: 9212155 - DNA, 22 bp, Homo sapiens
cctggaggcggaggttgcagtg

SEQ ID NO: 9212156 - DNA, 18 bp, Homo sapiens
cctggagctccacagcaa

SEQ ID NO: 9212157 - DNA, 18 bp, Homo sapiens
cctggagctccacagcaa

SEQ ID NO: 9212158 - DNA, 22 bp, Homo sapiens
cctggagcttttccatcctgga

SEQ ID NO: 9212159 - DNA, 22 bp, Homo sapiens
cctggagcttttccatcctgga

SEQ ID NO: 9212160 - DNA, 22 bp, Homo sapiens
cctggagcactctccctggctg

SEQ ID NO: 9212161 - DNA, 22 bp, Homo sapiens
tgtacatacatagatatacaca

SEQ ID NO: 9212162 - DNA, 22 bp, Homo sapiens
tgtacatacatagatatacaca

SEQ ID NO: 9212163 - DNA, 22 bp, Homo sapiens
tgtaattatttctgtgcagtca

SEQ ID NO: 9212164 - DNA, 22 bp, Homo sapiens
tgtaatattgtagtgacagtac

SEQ ID NO: 9212165 - DNA, 22 bp, Homo sapiens
tgtaatatatataactgtgtgc

SEQ ID NO: 9212166 - DNA, 22 bp, Homo sapiens
tgtaatatatataactgtgtgc

SEQ ID NO: 9212167 - DNA, 21 bp, Homo sapiens
tgtaagtttcatctgaattgg

SEQ ID NO: 9212168 - DNA, 22 bp, Homo sapiens
tgtaatataagcattaatagtt

SEQ ID NO: 9212169 - DNA, 22 bp, Homo sapiens
tgtaaagagaagaaacgtgagc

SEQ ID NO: 9212170 - DNA, 22 bp, Homo sapiens
cctgcttcagggatgatggcac

SEQ ID NO: 9212171 - DNA, 22 bp, Homo sapiens
cctgctgtagggcccctggggc

SEQ ID NO: 9212172 - DNA, 22 bp, Homo sapiens
tggtctcttcttccaagatggc

SEQ ID NO: 9212173 - DNA, 22 bp, Homo sapiens
tggtctcttcttccaagatggc

SEQ ID NO: 9212174 - DNA, 22 bp, Homo sapiens
cctgctggacctcaacacattt

SEQ ID NO: 9212175 - DNA, 22 bp, Homo sapiens
cctgctgctatgaaggtgacag

SEQ ID NO: 9212176 - DNA, 22 bp, Homo sapiens
tggtctggggaccgagggttac

SEQ ID NO: 9212177 - DNA, 22 bp, Homo sapiens
tggtctgggcaaatccttctga

SEQ ID NO: 9212178 - DNA, 20 bp, Homo sapiens
tggtctggagccagtgagga

SEQ ID NO: 9212179 - DNA, 17 bp, Homo sapiens
tggtctggaagaactga

SEQ ID NO: 9212180 - DNA, 22 bp, Homo sapiens
cctgccaggcgagtctaggcca

SEQ ID NO: 9212181 - DNA, 22 bp, Homo sapiens
cctgccaggctttgggcttctg

SEQ ID NO: 9212182 - DNA, 18 bp, Homo sapiens
cctgccagtctggagcag

SEQ ID NO: 9212183 - DNA, 22 bp, Homo sapiens
cctgccagtcactatgtcacct

SEQ ID NO: 9212184 - DNA, 22 bp, Homo sapiens
cctgccagggccagaggccagc

SEQ ID NO: 9212185 - DNA, 22 bp, Homo sapiens
cctgcctgtccctcagtccaca

SEQ ID NO: 9212186 - DNA, 20 bp, Homo sapiens
cctgcctgtgtttgtgatga

SEQ ID NO: 9212187 - DNA, 22 bp, Homo sapiens
cctgcctgtaagatgggtacaa

SEQ ID NO: 9212188 - DNA, 22 bp, Homo sapiens
cctgcctgggctcacttgccag

SEQ ID NO: 9212189 - DNA, 22 bp, Homo sapiens
cctgcctggggacaaaggaggg

SEQ ID NO: 9212190 - DNA, 22 bp, Homo sapiens
tgggtcagattgagcccctggt

SEQ ID NO: 9212191 - DNA, 23 bp, Homo sapiens
tgggtcagctgcctccaggacaa

SEQ ID NO: 9212192 - DNA, 20 bp, Homo sapiens
tcacaggagggaaggcaggt

SEQ ID NO: 9212193 - DNA, 22 bp, Homo sapiens
tcacaggaggactgaaagatat

SEQ ID NO: 9212194 - DNA, 22 bp, Homo sapiens
tcacaggagtcaaggaatagta

SEQ ID NO: 9212195 - DNA, 23 bp, Homo sapiens
tcacagttacttttgcatcaacc

SEQ ID NO: 9212196 - DNA, 22 bp, Homo sapiens
tcacagagaaaagctatcacaa

SEQ ID NO: 9212197 - DNA, 22 bp, Homo sapiens
tcacagagaaaagctatcacaa

SEQ ID NO: 9212198 - DNA, 22 bp, Homo sapiens
tcacagagaaatgtggcacaaa

SEQ ID NO: 9212199 - DNA, 22 bp, Homo sapiens
tcacagagaaatgtggcacaaa

SEQ ID NO: 9212200 - DNA, 22 bp, Homo sapiens
tcacaggacagccttccacccg

SEQ ID NO: 9212201 - DNA, 22 bp, Homo sapiens
tcacaggaaccatcagagaaat

SEQ ID NO: 9212202 - DNA, 22 bp, Homo sapiens
tcacaggagcccaggggagctg

SEQ ID NO: 9212203 - DNA, 22 bp, Homo sapiens
tcacaggagaatgtacttacca

SEQ ID NO: 9212204 - DNA, 22 bp, Homo sapiens
tcacaggaccctgagggtggcg

SEQ ID NO: 9212205 - DNA, 22 bp, Homo sapiens
cagtgaggaagctgtctggacc

SEQ ID NO: 9212206 - DNA, 22 bp, Homo sapiens
caggttggggacttaggatgac

SEQ ID NO: 9212207 - DNA, 22 bp, Homo sapiens
caggttgggctgcgaggaggag

SEQ ID NO: 9212208 - DNA, 22 bp, Homo sapiens
caggttcttaacttgttcttcc

SEQ ID NO: 9212209 - DNA, 22 bp, Homo sapiens
caggttctggagatgcagagat

SEQ ID NO: 9212210 - DNA, 22 bp, Homo sapiens
caggttctggggctccactgtg

SEQ ID NO: 9212211 - DNA, 22 bp, Homo sapiens
caggttctgggtcctgggtcct

SEQ ID NO: 9212212 - DNA, 22 bp, Homo sapiens
caggttctatactgaataattt

SEQ ID NO: 9212213 - DNA, 22 bp, Homo sapiens
caggttctcagaaggcagtcac

SEQ ID NO: 9212214 - DNA, 22 bp, Homo sapiens
caggttctcagaaggcagtcac

SEQ ID NO: 9212215 - DNA, 22 bp, Homo sapiens
caggttctgaggatggtgcctg

SEQ ID NO: 9212216 - DNA, 22 bp, Homo sapiens
caggttctggagatgcagagat

SEQ ID NO: 9212217 - DNA, 22 bp, Homo sapiens
caggttctggagatgcagagat

SEQ ID NO: 9212218 - DNA, 22 bp, Homo sapiens
cagggtggggaaatagcgccct

SEQ ID NO: 9212219 - DNA, 22 bp, Homo sapiens
cagggtgggcacccagcctcca

SEQ ID NO: 9212220 - DNA, 22 bp, Homo sapiens
cagggtgggcacccagcctcca

SEQ ID NO: 9212221 - DNA, 22 bp, Homo sapiens
cagggtgggcacccagcctcca

SEQ ID NO: 9212222 - DNA, 22 bp, Homo sapiens
cagggtggccctgtggtctcat

SEQ ID NO: 9212223 - DNA, 22 bp, Homo sapiens
cagggtggccctgtggtctcat

SEQ ID NO: 9212224 - DNA, 22 bp, Homo sapiens
caggttcccaggtccagggctt

SEQ ID NO: 9212225 - DNA, 22 bp, Homo sapiens
tatttccaagctgaatccaatg

SEQ ID NO: 9212226 - DNA, 22 bp, Homo sapiens
cagtagtggtctatcactggag

SEQ ID NO: 9212227 - DNA, 21 bp, Homo sapiens
tatttctttgactctctccct

SEQ ID NO: 9212228 - DNA, 22 bp, Homo sapiens
tatttctttcaggtatgtgttg

SEQ ID NO: 9212229 - DNA, 20 bp, Homo sapiens
cagtcccaatccagggccag

SEQ ID NO: 9212230 - DNA, 22 bp, Homo sapiens
cagtgggatatgggggcagcat

SEQ ID NO: 9212231 - DNA, 22 bp, Homo sapiens
cagtggctgtttctggaaggca

SEQ ID NO: 9212232 - DNA, 22 bp, Homo sapiens
cagtggcttacaatgaactaga

SEQ ID NO: 9212233 - DNA, 22 bp, Homo sapiens
cagtggcttcttcctagagcca

SEQ ID NO: 9212234 - DNA, 22 bp, Homo sapiens
cagtggcttctcatgtcattca

SEQ ID NO: 9212235 - DNA, 22 bp, Homo sapiens
cagtggctggttagggacagga

SEQ ID NO: 9212236 - DNA, 22 bp, Homo sapiens
cagtggctggttagggacagga

SEQ ID NO: 9212237 - DNA, 22 bp, Homo sapiens
cagtggctgtgaccagggacct

SEQ ID NO: 9212238 - DNA, 22 bp, Homo sapiens
cagtggctgagagtggacactg

SEQ ID NO: 9212239 - DNA, 22 bp, Homo sapiens
cagtgccatgtctgagccccta

SEQ ID NO: 9212240 - DNA, 22 bp, Homo sapiens
cagtgccacttaatgaggctgc

SEQ ID NO: 9212241 - DNA, 22 bp, Homo sapiens
cagtgtttgtggaattcaggtg

SEQ ID NO: 9212242 - DNA, 22 bp, Homo sapiens
cagtgtttgcttaagttatatg

SEQ ID NO: 9212243 - DNA, 22 bp, Homo sapiens
cagttaaacgggccatgtgagt

SEQ ID NO: 9212244 - DNA, 22 bp, Homo sapiens
cagttaaacagattgagtgtta

SEQ ID NO: 9212245 - DNA, 22 bp, Homo sapiens
cagtgtctttcagactcagaaa

SEQ ID NO: 9212246 - DNA, 22 bp, Homo sapiens
tcagagaaatgctgagctcatg

SEQ ID NO: 9212247 - DNA, 22 bp, Homo sapiens
cagtgtctccagatgctccaat

SEQ ID NO: 9212248 - DNA, 22 bp, Homo sapiens
cagtgtctcagtttcacttgaa

SEQ ID NO: 9212249 - DNA, 21 bp, Homo sapiens
tcagagaacccggcaggcaag

SEQ ID NO: 9212250 - DNA, 22 bp, Homo sapiens
tcagagaaataattgctgagtt

SEQ ID NO: 9212251 - DNA, 22 bp, Homo sapiens
tcagagaaaggccaaaatatca

SEQ ID NO: 9212252 - DNA, 22 bp, Homo sapiens
tcagactgacggccgaggcaag

SEQ ID NO: 9212253 - DNA, 23 bp, Homo sapiens
tcagaagtgggatacaaagctga

SEQ ID NO: 9212254 - DNA, 20 bp, Homo sapiens
tcagaagtgcagctgcccct

SEQ ID NO: 9212255 - DNA, 21 bp, Homo sapiens
tcagaagtgcagcccaggaat

SEQ ID NO: 9212256 - DNA, 21 bp, Homo sapiens
tcagaagtgcagcccaggaat

SEQ ID NO: 9212257 - DNA, 22 bp, Homo sapiens
cagttaaagctgcatgtgtcag

SEQ ID NO: 9212258 - DNA, 22 bp, Homo sapiens
cagttaaagtgcttatcacaga

SEQ ID NO: 9212259 - DNA, 22 bp, Homo sapiens
cagttaaaggcccaatatctgg

SEQ ID NO: 9212260 - DNA, 22 bp, Homo sapiens
cagttaccatcttcagtgatga

SEQ ID NO: 9212261 - DNA, 22 bp, Homo sapiens
cagttgttcccagcaatgaaag

SEQ ID NO: 9212262 - DNA, 22 bp, Homo sapiens
tcaggaaagagtaatgtataca

SEQ ID NO: 9212263 - DNA, 22 bp, Homo sapiens
tcaggaaagaagatgctcagtg

SEQ ID NO: 9212264 - DNA, 21 bp, Homo sapiens
tcaggaaacacctcttaagga

SEQ ID NO: 9212265 - DNA, 22 bp, Homo sapiens
tcaggaaactacagttgaacta

SEQ ID NO: 9212266 - DNA, 22 bp, Homo sapiens
tcagcttttgtcagaaattgta

SEQ ID NO: 9212267 - DNA, 22 bp, Homo sapiens
tactcaaaaagttatgaatcat

SEQ ID NO: 9212268 - DNA, 22 bp, Homo sapiens
tactcaaactcactaagacaga

SEQ ID NO: 9212269 - DNA, 22 bp, Homo sapiens
tactcaaactcactaagacaga

SEQ ID NO: 9212270 - DNA, 22 bp, Homo sapiens
gtgaggggtggctgagcagttt

SEQ ID NO: 9212271 - DNA, 22 bp, Homo sapiens
gtgaggggtggctgagcagttt

SEQ ID NO: 9212272 - DNA, 22 bp, Homo sapiens
gtgaggggtggctgagcagttt

SEQ ID NO: 9212273 - DNA, 20 bp, Homo sapiens
cagccctgtgacctggccct

SEQ ID NO: 9212274 - DNA, 22 bp, Homo sapiens
gtgaggggccaagagtagggca

SEQ ID NO: 9212275 - DNA, 22 bp, Homo sapiens
caggctggagtgcagtggggcg

SEQ ID NO: 9212276 - DNA, 22 bp, Homo sapiens
caggctggagtgcagtggggcg

SEQ ID NO: 9212277 - DNA, 22 bp, Homo sapiens
caggctggagtgcagtggggcg

SEQ ID NO: 9212278 - DNA, 22 bp, Homo sapiens
caggctggagtgcagtggcgct

SEQ ID NO: 9212279 - DNA, 22 bp, Homo sapiens
caggctggagtgcagtggcgct

SEQ ID NO: 9212280 - DNA, 22 bp, Homo sapiens
caggctggagtgcagtggcgcc

SEQ ID NO: 9212281 - DNA, 22 bp, Homo sapiens
caggctggagtgcagtggcgcc

SEQ ID NO: 9212282 - DNA, 22 bp, Homo sapiens
caggctggagtgcaatgacgcc

SEQ ID NO: 9212283 - DNA, 22 bp, Homo sapiens
caggctggagtgagtgtagtgg

SEQ ID NO: 9212284 - DNA, 22 bp, Homo sapiens
caggctggagtgagtgtagtgg

SEQ ID NO: 9212285 - DNA, 22 bp, Homo sapiens
caggctggagtgcaatggcaca

SEQ ID NO: 9212286 - DNA, 22 bp, Homo sapiens
caggctggagtgcaatggcaca

SEQ ID NO: 9212287 - DNA, 22 bp, Homo sapiens
caggctggagtgcaatggtgct

SEQ ID NO: 9212288 - DNA, 22 bp, Homo sapiens
caggctggagtgcaatggtgct

SEQ ID NO: 9212289 - DNA, 22 bp, Homo sapiens
tactgtgaatacaaaataaatt

SEQ ID NO: 9212290 - DNA, 22 bp, Homo sapiens
tactgtgacagagtacttaaac

SEQ ID NO: 9212291 - DNA, 22 bp, Homo sapiens
caggctgcctggaagaggactg

SEQ ID NO: 9212292 - DNA, 22 bp, Homo sapiens
caggctggagtacaattgtgtg

SEQ ID NO: 9212293 - DNA, 22 bp, Homo sapiens
caggctggagtgagtgtagtgg

SEQ ID NO: 9212294 - DNA, 22 bp, Homo sapiens
tagaggaaatttccaaggtgag

SEQ ID NO: 9212295 - DNA, 22 bp, Homo sapiens
tagagctggaatttgcagcaag

SEQ ID NO: 9212296 - DNA, 22 bp, Homo sapiens
tagagtgtaatacaaactaaac

SEQ ID NO: 9212297 - DNA, 19 bp, Homo sapiens
tagaggagaagggaagtgg

SEQ ID NO: 9212298 - DNA, 22 bp, Homo sapiens
tagaggaaccaggcaggctgag

SEQ ID NO: 9212299 - DNA, 22 bp, Homo sapiens
caggctgggcagcctccccggc

SEQ ID NO: 9212300 - DNA, 22 bp, Homo sapiens
caggctgggcagcctccccggc

SEQ ID NO: 9212301 - DNA, 22 bp, Homo sapiens
caggctgggcagcctccccggc

SEQ ID NO: 9212302 - DNA, 22 bp, Homo sapiens
caggctgggctggtgttagagt

SEQ ID NO: 9212303 - DNA, 22 bp, Homo sapiens
caggctgggctggtgttagagt

SEQ ID NO: 9212304 - DNA, 22 bp, Homo sapiens
caggctgggctccggagataaa

SEQ ID NO: 9212305 - DNA, 22 bp, Homo sapiens
caggctgggctccggagataaa

SEQ ID NO: 9212306 - DNA, 22 bp, Homo sapiens
caggctgggctccggagataaa

SEQ ID NO: 9212307 - DNA, 22 bp, Homo sapiens
caggctggtcccagagcattgc

SEQ ID NO: 9212308 - DNA, 22 bp, Homo sapiens
caggctggtcccagagcattgc

SEQ ID NO: 9212309 - DNA, 22 bp, Homo sapiens
tagacattttaagacatatacc

SEQ ID NO: 9212310 - DNA, 22 bp, Homo sapiens
tagcaaggacaacatatgagag

SEQ ID NO: 9212311 - DNA, 22 bp, Homo sapiens
tagcaagatgtcactccaagtt

SEQ ID NO: 9212312 - DNA, 22 bp, Homo sapiens
cagggcagaacatatagatagt

SEQ ID NO: 9212313 - DNA, 22 bp, Homo sapiens
tatcattctaattctcctcgta

SEQ ID NO: 9212314 - DNA, 22 bp, Homo sapiens
tatcatttaacagaatcattgc

SEQ ID NO: 9212315 - DNA, 22 bp, Homo sapiens
cagggtggcactcagcgcatct

SEQ ID NO: 9212316 - DNA, 22 bp, Homo sapiens
cagggtggcaggcaccatggcc

SEQ ID NO: 9212317 - DNA, 22 bp, Homo sapiens
cagggtggccaggtagataata

SEQ ID NO: 9212318 - DNA, 22 bp, Homo sapiens
tagggtccaagccttataatta

SEQ ID NO: 9212319 - DNA, 22 bp, Homo sapiens
tagggtcctcatctgtaaatga

SEQ ID NO: 9212320 - DNA, 22 bp, Homo sapiens
tagggtcctgcctacagagaca

SEQ ID NO: 9212321 - DNA, 22 bp, Homo sapiens
tagggtcccagataggagccag

SEQ ID NO: 9212322 - DNA, 22 bp, Homo sapiens
tagggtccatatggatgaatgg

SEQ ID NO: 9212323 - DNA, 22 bp, Homo sapiens
tagggccagataggcttcttga

SEQ ID NO: 9212324 - DNA, 22 bp, Homo sapiens
tagggacaaagagctgaggcct

SEQ ID NO: 9212325 - DNA, 22 bp, Homo sapiens
caggggaaggagccttgaaact

SEQ ID NO: 9212326 - DNA, 22 bp, Homo sapiens
caggggaaggagccttgaaact

SEQ ID NO: 9212327 - DNA, 22 bp, Homo sapiens
caggggacactcctgcttgggc

SEQ ID NO: 9212328 - DNA, 22 bp, Homo sapiens
cagggcttggttggaaccaccc

SEQ ID NO: 9212329 - DNA, 19 bp, Homo sapiens
taggtaggtaggtaggtat

SEQ ID NO: 9212330 - DNA, 22 bp, Homo sapiens
cagggcttggatctgtggtcag

SEQ ID NO: 9212331 - DNA, 22 bp, Homo sapiens
cagggctttgtgtgcctgggga

SEQ ID NO: 9212332 - DNA, 22 bp, Homo sapiens
cagggctttttattagctgcct

SEQ ID NO: 9212333 - DNA, 22 bp, Homo sapiens
cagggctttcctgagaagtgat

SEQ ID NO: 9212334 - DNA, 22 bp, Homo sapiens
taggtagggaccaccttgggga

SEQ ID NO: 9212335 - DNA, 22 bp, Homo sapiens
taggtagggaaatggttcctgt

SEQ ID NO: 9212336 - DNA, 22 bp, Homo sapiens
taggtaggtaaacaggactaat

SEQ ID NO: 9212337 - DNA, 22 bp, Homo sapiens
taggtacacagtaagtgctcaa

SEQ ID NO: 9212338 - DNA, 22 bp, Homo sapiens
tagctaccattattgagcacct

SEQ ID NO: 9212339 - DNA, 22 bp, Homo sapiens
tagctcctggctgcagggcctc

SEQ ID NO: 9212340 - DNA, 22 bp, Homo sapiens
tagctcctggctgcagggcctc

SEQ ID NO: 9212341 - DNA, 22 bp, Homo sapiens
tagctcctccccatccaggttc

SEQ ID NO: 9212342 - DNA, 22 bp, Homo sapiens
tagctcagcaggtgggacaggt

SEQ ID NO: 9212343 - DNA, 22 bp, Homo sapiens
cagggcagccaggccccgtggg

SEQ ID NO: 9212344 - DNA, 22 bp, Homo sapiens
taggaacatatgcagtgctttt

SEQ ID NO: 9212345 - DNA, 22 bp, Homo sapiens
taggaacaagtttccttgctgt

SEQ ID NO: 9212346 - DNA, 22 bp, Homo sapiens
cagggcaggaatttgacattgc

SEQ ID NO: 9212347 - DNA, 22 bp, Homo sapiens
cagggccttgttcaggagtgaa

SEQ ID NO: 9212348 - DNA, 22 bp, Homo sapiens
cagggcctgcttccttcttgtt

SEQ ID NO: 9212349 - DNA, 22 bp, Homo sapiens
taggagcctgctctgcagggac

SEQ ID NO: 9212350 - DNA, 22 bp, Homo sapiens
taggagcctgctctgcagggac

SEQ ID NO: 9212351 - DNA, 22 bp, Homo sapiens
taggagacattgatcccaagaa

SEQ ID NO: 9212352 - DNA, 22 bp, Homo sapiens
taggagaggtgaatggcacact

SEQ ID NO: 9212353 - DNA, 19 bp, Homo sapiens
taggaccctggtggccccc

SEQ ID NO: 9212354 - DNA, 22 bp, Homo sapiens
taggaccaggggctgccaggaa

SEQ ID NO: 9212355 - DNA, 19 bp, Homo sapiens
taggaccctggtggccccc

SEQ ID NO: 9212356 - DNA, 22 bp, Homo sapiens
taggactttgagaattgttatt

SEQ ID NO: 9212357 - DNA, 22 bp, Homo sapiens
taggacctggagcccagcaccg

SEQ ID NO: 9212358 - DNA, 22 bp, Homo sapiens
tccaggctccctcaggatgcac

SEQ ID NO: 9212359 - DNA, 22 bp, Homo sapiens
tccaggctcccctgcgtgctcc

SEQ ID NO: 9212360 - DNA, 22 bp, Homo sapiens
tccaggctcccctgcgtgctcc

SEQ ID NO: 9212361 - DNA, 19 bp, Homo sapiens
tccaggctccattggcaga

SEQ ID NO: 9212362 - DNA, 22 bp, Homo sapiens
tccaggctcagtcaagcacttc

SEQ ID NO: 9212363 - DNA, 18 bp, Homo sapiens
tccaggctccaggctaac

SEQ ID NO: 9212364 - DNA, 22 bp, Homo sapiens
catgtgtggttacctacttgac

SEQ ID NO: 9212365 - DNA, 22 bp, Homo sapiens
catgtgttttgtcatttcaata

SEQ ID NO: 9212366 - DNA, 22 bp, Homo sapiens
catgtgttaatctttctgcaaa

SEQ ID NO: 9212367 - DNA, 22 bp, Homo sapiens
tccaggcccgagatgggctgga

SEQ ID NO: 9212368 - DNA, 22 bp, Homo sapiens
tccaggcccctgcctgggcctg

SEQ ID NO: 9212369 - DNA, 22 bp, Homo sapiens
tccagctggcttcggaagtgga

SEQ ID NO: 9212370 - DNA, 22 bp, Homo sapiens
tccagctggcctaacttcaggg

SEQ ID NO: 9212371 - DNA, 22 bp, Homo sapiens
tccagctggcccggccatgaat

SEQ ID NO: 9212372 - DNA, 22 bp, Homo sapiens
tccagctggcccggccatgaat

SEQ ID NO: 9212373 - DNA, 17 bp, Homo sapiens
tccagcctcctctgctg

SEQ ID NO: 9212374 - DNA, 17 bp, Homo sapiens
tccagcctcctctgctg

SEQ ID NO: 9212375 - DNA, 22 bp, Homo sapiens
tccagcctcctatttaccctaa

SEQ ID NO: 9212376 - DNA, 22 bp, Homo sapiens
tccagcctcatttctcctgctt

SEQ ID NO: 9212377 - DNA, 22 bp, Homo sapiens
tccagcctcatttctcctgctt

SEQ ID NO: 9212378 - DNA, 22 bp, Homo sapiens
tccagcctcatttctcctgctt

SEQ ID NO: 9212379 - DNA, 22 bp, Homo sapiens
tccagcctaggggaacagctgc

SEQ ID NO: 9212380 - DNA, 22 bp, Homo sapiens
tccagcctaatgttcttcccac

SEQ ID NO: 9212381 - DNA, 22 bp, Homo sapiens
tccagctgaggtggcctctgtg

SEQ ID NO: 9212382 - DNA, 21 bp, Homo sapiens
tccagctgcacaagcatgggg

SEQ ID NO: 9212383 - DNA, 22 bp, Homo sapiens
tccagctgcaaggggcacagct

SEQ ID NO: 9212384 - DNA, 22 bp, Homo sapiens
tccagctgcaaggggcacagct

SEQ ID NO: 9212385 - DNA, 22 bp, Homo sapiens
tccagctgctagctagatgcaa

SEQ ID NO: 9212386 - DNA, 22 bp, Homo sapiens
tccagctgctgccagccaagct

SEQ ID NO: 9212387 - DNA, 19 bp, Homo sapiens
tccagactgtccaggctat

SEQ ID NO: 9212388 - DNA, 22 bp, Homo sapiens
tccagactgccctgcacatgtg

SEQ ID NO: 9212389 - DNA, 22 bp, Homo sapiens
tccagagagaaaaacaagcttt

SEQ ID NO: 9212390 - DNA, 22 bp, Homo sapiens
tccagccctgtgtctgggagag

SEQ ID NO: 9212391 - DNA, 22 bp, Homo sapiens
tcatgcactacataacgatgtt

SEQ ID NO: 9212392 - DNA, 22 bp, Homo sapiens
catgaaaaatttactgttaaca

SEQ ID NO: 9212393 - DNA, 22 bp, Homo sapiens
tcatgatacccaagtacctaga

SEQ ID NO: 9212394 - DNA, 22 bp, Homo sapiens
tcatgacagccagagctctgac

SEQ ID NO: 9212395 - DNA, 22 bp, Homo sapiens
tccacaggtatgaggccccacc

SEQ ID NO: 9212396 - DNA, 22 bp, Homo sapiens
tccacaggtatgaggccccacc

SEQ ID NO: 9212397 - DNA, 22 bp, Homo sapiens
tccacaggtatttctccttgct

SEQ ID NO: 9212398 - DNA, 22 bp, Homo sapiens
tccagacccatgaccctgggga

SEQ ID NO: 9212399 - DNA, 22 bp, Homo sapiens
cattcacatcttgttccatcac

SEQ ID NO: 9212400 - DNA, 22 bp, Homo sapiens
cattcacagagggggaagcatc

SEQ ID NO: 9212401 - DNA, 22 bp, Homo sapiens
cattcacagcaggtcagctgaa

SEQ ID NO: 9212402 - DNA, 22 bp, Homo sapiens
cattcaaatgtgccactgtcct

SEQ ID NO: 9212403 - DNA, 22 bp, Homo sapiens
cattcaaattaagattttgtta

SEQ ID NO: 9212404 - DNA, 22 bp, Homo sapiens
catgttggcactgtctctgcct

SEQ ID NO: 9212405 - DNA, 22 bp, Homo sapiens
catgttatttatccattaaaca

SEQ ID NO: 9212406 - DNA, 22 bp, Homo sapiens
catgttgtatcattctgttcct

SEQ ID NO: 9212407 - DNA, 22 bp, Homo sapiens
catgttggtgtgctgcacccgt

SEQ ID NO: 9212408 - DNA, 22 bp, Homo sapiens
catgttggtgtgctgcacccat

SEQ ID NO: 9212409 - DNA, 22 bp, Homo sapiens
tcccagccaggctctaccactt

SEQ ID NO: 9212410 - DNA, 22 bp, Homo sapiens
tcccaggaatccgtcctctaga

SEQ ID NO: 9212411 - DNA, 22 bp, Homo sapiens
tcccaggaattgaagccagtgt

SEQ ID NO: 9212412 - DNA, 22 bp, Homo sapiens
tcccaggacaggccacatggaa

SEQ ID NO: 9212413 - DNA, 22 bp, Homo sapiens
tcccagagctgataagccttta

SEQ ID NO: 9212414 - DNA, 22 bp, Homo sapiens
tccccagatggccagctacatg

SEQ ID NO: 9212415 - DNA, 22 bp, Homo sapiens
tccccagacagcgggaggcctg

SEQ ID NO: 9212416 - DNA, 22 bp, Homo sapiens
tcccgttgatgacggtgcatcc

SEQ ID NO: 9212417 - DNA, 22 bp, Homo sapiens
tcccagggtcctcttctggaat

SEQ ID NO: 9212418 - DNA, 22 bp, Homo sapiens
tcccagggtcagtggtgaggcc

SEQ ID NO: 9212419 - DNA, 22 bp, Homo sapiens
cattgcaacttcaaactcctgg

SEQ ID NO: 9212420 - DNA, 22 bp, Homo sapiens
cattgaaatatggaaactgatg

SEQ ID NO: 9212421 - DNA, 22 bp, Homo sapiens
tccctcactggttctgcatccc

SEQ ID NO: 9212422 - DNA, 22 bp, Homo sapiens
tccctaggtcctagtcacagta

SEQ ID NO: 9212423 - DNA, 22 bp, Homo sapiens
tccctagtcgcatctgtggaga

SEQ ID NO: 9212424 - DNA, 22 bp, Homo sapiens
tccctaggtcctagtcacagta

SEQ ID NO: 9212425 - DNA, 20 bp, Homo sapiens
tccctaggcaggagggcact

SEQ ID NO: 9212426 - DNA, 22 bp, Homo sapiens
tccctcagaaattctctctgaa

SEQ ID NO: 9212427 - DNA, 22 bp, Homo sapiens
tccctcagaaattctctctgaa

SEQ ID NO: 9212428 - DNA, 22 bp, Homo sapiens
tcctcagctttggtttactcat

SEQ ID NO: 9212429 - DNA, 22 bp, Homo sapiens
tcctcagcttttatttcacttg

SEQ ID NO: 9212430 - DNA, 22 bp, Homo sapiens
tcctcagcttttatttcacttg

SEQ ID NO: 9212431 - DNA, 22 bp, Homo sapiens
tcctcaggatctaggagtgctt

SEQ ID NO: 9212432 - DNA, 22 bp, Homo sapiens
tcctcaggatctaggagtgctt

SEQ ID NO: 9212433 - DNA, 22 bp, Homo sapiens
tcctcaggagagctcctatgcc

SEQ ID NO: 9212434 - DNA, 22 bp, Homo sapiens
tcctcaggatgtggagtagaat

SEQ ID NO: 9212435 - DNA, 22 bp, Homo sapiens
tcctcaggatgtggggtagaat

SEQ ID NO: 9212436 - DNA, 22 bp, Homo sapiens
tcctcaggatgtggagtagaat

SEQ ID NO: 9212437 - DNA, 17 bp, Homo sapiens
tcctccccgcagttgca

SEQ ID NO: 9212438 - DNA, 22 bp, Homo sapiens
tcctcccctcagggcaacggat

SEQ ID NO: 9212439 - DNA, 22 bp, Homo sapiens
catttgtagtatctgtttatat

SEQ ID NO: 9212440 - DNA, 22 bp, Homo sapiens
catttgtagttaaaaatgtctc

SEQ ID NO: 9212441 - DNA, 22 bp, Homo sapiens
tcctcaggctgcctggaagact

SEQ ID NO: 9212442 - DNA, 22 bp, Homo sapiens
catttggaaagagactagagaa

SEQ ID NO: 9212443 - DNA, 22 bp, Homo sapiens
tcctcagggaagatgagcctca

SEQ ID NO: 9212444 - DNA, 22 bp, Homo sapiens
tcctcagggaagatgagcctca

SEQ ID NO: 9212445 - DNA, 22 bp, Homo sapiens
catttggattttgaagagagta

SEQ ID NO: 9212446 - DNA, 22 bp, Homo sapiens
ccagcatctatgtgctgttgat

SEQ ID NO: 9212447 - DNA, 22 bp, Homo sapiens
ccagcatctaacgctcctggga

SEQ ID NO: 9212448 - DNA, 22 bp, Homo sapiens
ccagcatccatgctccctcggg

SEQ ID NO: 9212449 - DNA, 22 bp, Homo sapiens
ccagcatccatgctccctcggg

SEQ ID NO: 9212450 - DNA, 22 bp, Homo sapiens
ccagcatccatgctccctcggg

SEQ ID NO: 9212451 - DNA, 22 bp, Homo sapiens
ccagcaggtgtagggctcatgg

SEQ ID NO: 9212452 - DNA, 22 bp, Homo sapiens
ccagcaggtgtagggctcatgg

SEQ ID NO: 9212453 - DNA, 22 bp, Homo sapiens
ccagcagggttggtttcttctg

SEQ ID NO: 9212454 - DNA, 22 bp, Homo sapiens
ccagcaggggaatatttttagg

SEQ ID NO: 9212455 - DNA, 19 bp, Homo sapiens
ccagcaggttcatttcagg

SEQ ID NO: 9212456 - DNA, 22 bp, Homo sapiens
ccagcatcagcacccaaggagc

SEQ ID NO: 9212457 - DNA, 22 bp, Homo sapiens
ccagcccttcccaactggccag

SEQ ID NO: 9212458 - DNA, 22 bp, Homo sapiens
tctgcagaattcgaggaagaaa

SEQ ID NO: 9212459 - DNA, 22 bp, Homo sapiens
ccagccctcactgaggcctctc

SEQ ID NO: 9212460 - DNA, 22 bp, Homo sapiens
ccagccacagcttccagctcct

SEQ ID NO: 9212461 - DNA, 22 bp, Homo sapiens
ccagccctcactgaggcctctc

SEQ ID NO: 9212462 - DNA, 22 bp, Homo sapiens
ccagcatggcacctgagatgag

SEQ ID NO: 9212463 - DNA, 20 bp, Homo sapiens
ccagcatgtacacatgtgga

SEQ ID NO: 9212464 - DNA, 19 bp, Homo sapiens
ccagccctgtcacttcttg

SEQ ID NO: 9212465 - DNA, 19 bp, Homo sapiens
ccagccctgtcacttcttg

SEQ ID NO: 9212466 - DNA, 22 bp, Homo sapiens
ccagccctgtttatgtgtcact

SEQ ID NO: 9212467 - DNA, 22 bp, Homo sapiens
ccagccctgcctctcagggccc

SEQ ID NO: 9212468 - DNA, 22 bp, Homo sapiens
ccagccctgtcaccaactggag

SEQ ID NO: 9212469 - DNA, 22 bp, Homo sapiens
ccagccctgtcaccaactggag

SEQ ID NO: 9212470 - DNA, 22 bp, Homo sapiens
ccagcagctgcaaagcctgggt

SEQ ID NO: 9212471 - DNA, 22 bp, Homo sapiens
ccagcagggaaaaacccaccaa

SEQ ID NO: 9212472 - DNA, 22 bp, Homo sapiens
ccagcagggaaaaacccaccaa

SEQ ID NO: 9212473 - DNA, 22 bp, Homo sapiens
ccagcagggcagtgccctggac

SEQ ID NO: 9212474 - DNA, 22 bp, Homo sapiens
ccagcagcccacaggcgtccct

SEQ ID NO: 9212475 - DNA, 22 bp, Homo sapiens
ccagcagccagagaaggacctc

SEQ ID NO: 9212476 - DNA, 22 bp, Homo sapiens
ccagcagcatcctgcagcactt

SEQ ID NO: 9212477 - DNA, 22 bp, Homo sapiens
ccagcagcaggccaggccctcc

SEQ ID NO: 9212478 - DNA, 22 bp, Homo sapiens
ccagcagagtctaggaaggagg

SEQ ID NO: 9212479 - DNA, 22 bp, Homo sapiens
ccagcagcagcgtccaaggaga

SEQ ID NO: 9212480 - DNA, 22 bp, Homo sapiens
ccagcagagggtcttggccatt

SEQ ID NO: 9212481 - DNA, 22 bp, Homo sapiens
ccagcagaggggcggagtgcag

SEQ ID NO: 9212482 - DNA, 22 bp, Homo sapiens
tctctgggaaatggagaatttt

SEQ ID NO: 9212483 - DNA, 22 bp, Homo sapiens
tctctgggaatgggcctgggta

SEQ ID NO: 9212484 - DNA, 22 bp, Homo sapiens
tctctgggaatgggcctgggta

SEQ ID NO: 9212485 - DNA, 22 bp, Homo sapiens
tctctgggaattcacaagccct

SEQ ID NO: 9212486 - DNA, 22 bp, Homo sapiens
tctctgcccaagtttctcaagt

SEQ ID NO: 9212487 - DNA, 22 bp, Homo sapiens
tctctgccaccatgagatgggc

SEQ ID NO: 9212488 - DNA, 22 bp, Homo sapiens
tctctgccacagcttctgcctt

SEQ ID NO: 9212489 - DNA, 22 bp, Homo sapiens
tctctgggagccaggatgacac

SEQ ID NO: 9212490 - DNA, 22 bp, Homo sapiens
tctctgggagcaattgtttgct

SEQ ID NO: 9212491 - DNA, 22 bp, Homo sapiens
tctctgggacactgggtcagtt

SEQ ID NO: 9212492 - DNA, 22 bp, Homo sapiens
tctctgggacactgggtcagtt

SEQ ID NO: 9212493 - DNA, 22 bp, Homo sapiens
tctctgggaattttttggacat

SEQ ID NO: 9212494 - DNA, 22 bp, Homo sapiens
tctctgggaattttttggacat

SEQ ID NO: 9212495 - DNA, 22 bp, Homo sapiens
tctctgggagttgagcagcagc

SEQ ID NO: 9212496 - DNA, 21 bp, Homo sapiens
tctctgggaggacttgtgaga

SEQ ID NO: 9212497 - DNA, 21 bp, Homo sapiens
tctctgggaggacttgtgaga

SEQ ID NO: 9212498 - DNA, 22 bp, Homo sapiens
tctctgggagccaggatgacac

SEQ ID NO: 9212499 - DNA, 23 bp, Homo sapiens
tctcctggctgcactgtggccac

SEQ ID NO: 9212500 - DNA, 22 bp, Homo sapiens
tctctgagttttaaggatgatg

SEQ ID NO: 9212501 - DNA, 23 bp, Homo sapiens
tctctgcatgtcctgagcacatc

SEQ ID NO: 9212502 - DNA, 22 bp, Homo sapiens
tctctgcatccccagggctctc

SEQ ID NO: 9212503 - DNA, 19 bp, Homo sapiens
tctctgcagcgcgcccggc

SEQ ID NO: 9212504 - DNA, 22 bp, Homo sapiens
tctctgcagctaagaaattaat

SEQ ID NO: 9212505 - DNA, 22 bp, Homo sapiens
ccaccctggacaggcctctgag

SEQ ID NO: 9212506 - DNA, 19 bp, Homo sapiens
ccaccctgggagctcactc

SEQ ID NO: 9212507 - DNA, 22 bp, Homo sapiens
ccaccctggactcgaggcccga

SEQ ID NO: 9212508 - DNA, 22 bp, Homo sapiens
ccaccctgtgcaggcgtgggta

SEQ ID NO: 9212509 - DNA, 22 bp, Homo sapiens
ccaccgccatggcgttgtacag

SEQ ID NO: 9212510 - DNA, 22 bp, Homo sapiens
ccacccttgggttcggaggccg

SEQ ID NO: 9212511 - DNA, 22 bp, Homo sapiens
tcgggccataggctaggtccct

SEQ ID NO: 9212512 - DNA, 22 bp, Homo sapiens
tcgccccgaggcagccctatgc

SEQ ID NO: 9212513 - DNA, 22 bp, Homo sapiens
ccaccagctttgccaccctgct

SEQ ID NO: 9212514 - DNA, 22 bp, Homo sapiens
ccaccacttctggcttctggtg

SEQ ID NO: 9212515 - DNA, 22 bp, Homo sapiens
ccaccagcttcagcagccgcgg

SEQ ID NO: 9212516 - DNA, 22 bp, Homo sapiens
ccaccagcttcagcagccgcgg

SEQ ID NO: 9212517 - DNA, 22 bp, Homo sapiens
tcctctctgcactggccctgcc

SEQ ID NO: 9212518 - DNA, 22 bp, Homo sapiens
tcctgaagtcacaggctctgag

SEQ ID NO: 9212519 - DNA, 21 bp, Homo sapiens
tcctctgcagtgaggtggcct

SEQ ID NO: 9212520 - DNA, 21 bp, Homo sapiens
tcctctgcagtgaggtggcct

SEQ ID NO: 9212521 - DNA, 22 bp, Homo sapiens
tcctctgagacatcaggttgag

SEQ ID NO: 9212522 - DNA, 22 bp, Homo sapiens
ccacatttactgatgtatgtat

SEQ ID NO: 9212523 - DNA, 21 bp, Homo sapiens
ccacatggtgaaaccctatct

SEQ ID NO: 9212524 - DNA, 23 bp, Homo sapiens
ccacatggcaagatgatgcattc

SEQ ID NO: 9212525 - DNA, 22 bp, Homo sapiens
ccacagtgatccctgcctgcga

SEQ ID NO: 9212526 - DNA, 22 bp, Homo sapiens
ccacagtgatccctgcctgcga

SEQ ID NO: 9212527 - DNA, 22 bp, Homo sapiens
ccacatgatgaggaagctgaac

SEQ ID NO: 9212528 - DNA, 22 bp, Homo sapiens
ccacagtgattcacttttgaag

SEQ ID NO: 9212529 - DNA, 22 bp, Homo sapiens
tctcccacagtctcccatggct

SEQ ID NO: 9212530 - DNA, 22 bp, Homo sapiens
tctcccacggtacaggataaac

SEQ ID NO: 9212531 - DNA, 22 bp, Homo sapiens
tctccctctttgtctgctttgg

SEQ ID NO: 9212532 - DNA, 22 bp, Homo sapiens
tctccctggagccctgaagcat

SEQ ID NO: 9212533 - DNA, 22 bp, Homo sapiens
tctccaggaaccatcatggtaa

SEQ ID NO: 9212534 - DNA, 22 bp, Homo sapiens
ccagagagctacaaggcataaa

SEQ ID NO: 9212535 - DNA, 19 bp, Homo sapiens
ccagagagctaggtacaga

SEQ ID NO: 9212536 - DNA, 21 bp, Homo sapiens
ccagagagagggaagtgggtt

SEQ ID NO: 9212537 - DNA, 22 bp, Homo sapiens
ccacttgaaatatctttgttct

SEQ ID NO: 9212538 - DNA, 22 bp, Homo sapiens
ccacttgaatcaaattcttagg

SEQ ID NO: 9212539 - DNA, 22 bp, Homo sapiens
tctcaagagggaggcaatcatg

SEQ ID NO: 9212540 - DNA, 22 bp, Homo sapiens
tctcaagcttgttggtatgttt

SEQ ID NO: 9212541 - DNA, 23 bp, Homo sapiens
tctcaagcttcactgtgtgttgt

SEQ ID NO: 9212542 - DNA, 22 bp, Homo sapiens
tctcaagagggaggcaatcatg

SEQ ID NO: 9212543 - DNA, 22 bp, Homo sapiens
ccacctgagataagagagctca

SEQ ID NO: 9212544 - DNA, 22 bp, Homo sapiens
ttggccagtggaaagaggagga

SEQ ID NO: 9212545 - DNA, 22 bp, Homo sapiens
ttggccagtgaaccaggcctgg

SEQ ID NO: 9212546 - DNA, 22 bp, Homo sapiens
ttggccagcgacgaccttctta

SEQ ID NO: 9212547 - DNA, 22 bp, Homo sapiens
ttggccaggtccatttctccat

SEQ ID NO: 9212548 - DNA, 22 bp, Homo sapiens
ttgggacagcaacggttctgtt

SEQ ID NO: 9212549 - DNA, 20 bp, Homo sapiens
ttgggccacactgattcagc

SEQ ID NO: 9212550 - DNA, 22 bp, Homo sapiens
ttgggccactttagtttcctta

SEQ ID NO: 9212551 - DNA, 22 bp, Homo sapiens
ttgggcccatggggctaagcta

SEQ ID NO: 9212552 - DNA, 22 bp, Homo sapiens
ttgggccaaagatgtccttgtt

SEQ ID NO: 9212553 - DNA, 22 bp, Homo sapiens
ttgggccaaatagctatttact

SEQ ID NO: 9212554 - DNA, 22 bp, Homo sapiens
ttgggccaaggcagatctccaa

SEQ ID NO: 9212555 - DNA, 22 bp, Homo sapiens
ttgggccaaggcagatctccaa

SEQ ID NO: 9212556 - DNA, 22 bp, Homo sapiens
ttgggcaggtgtggctctcctt

SEQ ID NO: 9212557 - DNA, 22 bp, Homo sapiens
ttggcagcattccagccaagca

SEQ ID NO: 9212558 - DNA, 22 bp, Homo sapiens
ttggagctaccaggaagggctg

SEQ ID NO: 9212559 - DNA, 22 bp, Homo sapiens
ttggagccatgcccagctctct

SEQ ID NO: 9212560 - DNA, 22 bp, Homo sapiens
ttggagccctgaggatctggat

SEQ ID NO: 9212561 - DNA, 22 bp, Homo sapiens
ttggagaatgttttcctgcagt

SEQ ID NO: 9212562 - DNA, 18 bp, Homo sapiens
ttggacctgtgtcagggc

SEQ ID NO: 9212563 - DNA, 22 bp, Homo sapiens
ttgtcctgtgatttcagggcct

SEQ ID NO: 9212564 - DNA, 22 bp, Homo sapiens
ttgtccagagccaggctgtcgg

SEQ ID NO: 9212565 - DNA, 22 bp, Homo sapiens
ttgtccaaggtcccacagttag

SEQ ID NO: 9212566 - DNA, 22 bp, Homo sapiens
ttgtcattggggttatttgtta

SEQ ID NO: 9212567 - DNA, 22 bp, Homo sapiens
ttgtcaaatccttgtcatctgc

SEQ ID NO: 9212568 - DNA, 22 bp, Homo sapiens
ttgtcacccctagaggaattct

SEQ ID NO: 9212569 - DNA, 22 bp, Homo sapiens
ttgtcaccatatttcattttga

SEQ ID NO: 9212570 - DNA, 22 bp, Homo sapiens
ttgtcacctatactgagcttaa

SEQ ID NO: 9212571 - DNA, 22 bp, Homo sapiens
ttgtaagaatatgaatacaaat

SEQ ID NO: 9212572 - DNA, 22 bp, Homo sapiens
ttgtaacatcaccatcaaaatc

SEQ ID NO: 9212573 - DNA, 22 bp, Homo sapiens
ttgtaacaggtactaaataact

SEQ ID NO: 9212574 - DNA, 22 bp, Homo sapiens
ttgtaacaggtactaaataact

SEQ ID NO: 9212575 - DNA, 22 bp, Homo sapiens
ttgtaacagctgcttaatagag

SEQ ID NO: 9212576 - DNA, 22 bp, Homo sapiens
ttgtaacacttttctattaata

SEQ ID NO: 9212577 - DNA, 22 bp, Homo sapiens
ttgtaacaggcactctgtgcca

SEQ ID NO: 9212578 - DNA, 22 bp, Homo sapiens
ttgtaacagctgtttatatagt

SEQ ID NO: 9212579 - DNA, 22 bp, Homo sapiens
ttgtaacactcccactcttctt

SEQ ID NO: 9212580 - DNA, 22 bp, Homo sapiens
ttgtaacaatctgtcataaatg

SEQ ID NO: 9212581 - DNA, 23 bp, Homo sapiens
ttgtatttttagtagagacaggg

SEQ ID NO: 9212582 - DNA, 22 bp, Homo sapiens
ttgtatttcgatgcacgtgtag

SEQ ID NO: 9212583 - DNA, 22 bp, Homo sapiens
ttgtacacacaggaacaaacgt

SEQ ID NO: 9212584 - DNA, 22 bp, Homo sapiens
ttgtacacaattcttaacatac

SEQ ID NO: 9212585 - DNA, 22 bp, Homo sapiens
ttgtaagagagaattgcaaatt

SEQ ID NO: 9212586 - DNA, 22 bp, Homo sapiens
ttgcagaacttaaagacagagt

SEQ ID NO: 9212587 - DNA, 22 bp, Homo sapiens
ttgcagagatcagcaggtttga

SEQ ID NO: 9212588 - DNA, 22 bp, Homo sapiens
ttgcagatatttccgatgctat

SEQ ID NO: 9212589 - DNA, 22 bp, Homo sapiens
ttgacagatgtgaaagtgagca

SEQ ID NO: 9212590 - DNA, 22 bp, Homo sapiens
ttgacaaaacaacacagatttc

SEQ ID NO: 9212591 - DNA, 22 bp, Homo sapiens
ttgacaaagtttagtaataatc

SEQ ID NO: 9212592 - DNA, 22 bp, Homo sapiens
ttgcagcttcttgcatcagaaa

SEQ ID NO: 9212593 - DNA, 22 bp, Homo sapiens
ttgcagcttctaccactgtttc

SEQ ID NO: 9212594 - DNA, 22 bp, Homo sapiens
ttgcagcttctaccactgtttc

SEQ ID NO: 9212595 - DNA, 22 bp, Homo sapiens
ttgcagctgaggaaattgaagc

SEQ ID NO: 9212596 - DNA, 22 bp, Homo sapiens
ttgcagctgtgagctttacacg

SEQ ID NO: 9212597 - DNA, 22 bp, Homo sapiens
ttgcagctgcagtaaatgttca

SEQ ID NO: 9212598 - DNA, 22 bp, Homo sapiens
ttgcagcttagtgatgttatct

SEQ ID NO: 9212599 - DNA, 22 bp, Homo sapiens
ttgcagctgttgcaaagtctct

SEQ ID NO: 9212600 - DNA, 22 bp, Homo sapiens
ttgcagcttcaagcaggttgac

SEQ ID NO: 9212601 - DNA, 23 bp, Homo sapiens
ttggaaatggggagaacagattc

SEQ ID NO: 9212602 - DNA, 22 bp, Homo sapiens
ttggaaatgcaaatatattgaa

SEQ ID NO: 9212603 - DNA, 22 bp, Homo sapiens
ttggaaaatgaggcacagagag

SEQ ID NO: 9212604 - DNA, 22 bp, Homo sapiens
ttgctttccgtcatgtgctaat

SEQ ID NO: 9212605 - DNA, 22 bp, Homo sapiens
ttgctgaaagtggcaagaagta

SEQ ID NO: 9212606 - DNA, 22 bp, Homo sapiens
ttgctgaagttgctcagctcca

SEQ ID NO: 9212607 - DNA, 18 bp, Homo sapiens
ttgctcttctatgtcaat

SEQ ID NO: 9212608 - DNA, 22 bp, Homo sapiens
ttgcattgtaggatgttagaag

SEQ ID NO: 9212609 - DNA, 22 bp, Homo sapiens
tttagattgtgacctcccccca

SEQ ID NO: 9212610 - DNA, 22 bp, Homo sapiens
tttaccaaatgagactattgtt

SEQ ID NO: 9212611 - DNA, 22 bp, Homo sapiens
tttaccaagctttaattacata

SEQ ID NO: 9212612 - DNA, 22 bp, Homo sapiens
tttaccaaggcatagtaatctc

SEQ ID NO: 9212613 - DNA, 22 bp, Homo sapiens
tttaccaaatagattatgtcag

SEQ ID NO: 9212614 - DNA, 22 bp, Homo sapiens
tttatatagagatttgtgcatg

SEQ ID NO: 9212615 - DNA, 22 bp, Homo sapiens
tttatataacagagactgctat

SEQ ID NO: 9212616 - DNA, 22 bp, Homo sapiens
tttatattgtaaaaatggttct

SEQ ID NO: 9212617 - DNA, 22 bp, Homo sapiens
tttatatagagatttgtgcatg

SEQ ID NO: 9212618 - DNA, 22 bp, Homo sapiens
tttatccattcaccagttgaac

SEQ ID NO: 9212619 - DNA, 22 bp, Homo sapiens
tttatccatatcattaaaatct

SEQ ID NO: 9212620 - DNA, 22 bp, Homo sapiens
tttatcacagaataagaagtca

SEQ ID NO: 9212621 - DNA, 22 bp, Homo sapiens
tttatcacagaataagaagtca

SEQ ID NO: 9212622 - DNA, 22 bp, Homo sapiens
tttatccagaatcaggattttt

SEQ ID NO: 9212623 - DNA, 22 bp, Homo sapiens
tttaaagaaattcctcatcttt

SEQ ID NO: 9212624 - DNA, 22 bp, Homo sapiens
tttaaacatcttgttgccttaa

SEQ ID NO: 9212625 - DNA, 22 bp, Homo sapiens
ttgtgtgtagactcagccattg

SEQ ID NO: 9212626 - DNA, 17 bp, Homo sapiens
ttgtgtgtagttctgat

SEQ ID NO: 9212627 - DNA, 22 bp, Homo sapiens
ttgtgtgtagactcagccattg

SEQ ID NO: 9212628 - DNA, 22 bp, Homo sapiens
ttgtgtgtactggttatgggca

SEQ ID NO: 9212629 - DNA, 22 bp, Homo sapiens
tttaaatgcagacgttgattca

SEQ ID NO: 9212630 - DNA, 22 bp, Homo sapiens
tttaaatgctttaagcaagggt

SEQ ID NO: 9212631 - DNA, 22 bp, Homo sapiens
tttaaataggactcctgggggt

SEQ ID NO: 9212632 - DNA, 22 bp, Homo sapiens
tttaaatgtttaaaactcgtga

SEQ ID NO: 9212633 - DNA, 22 bp, Homo sapiens
tttaaatgttcatgatactgaa

SEQ ID NO: 9212634 - DNA, 22 bp, Homo sapiens
tttaaatgtgttcttagtagct

SEQ ID NO: 9212635 - DNA, 22 bp, Homo sapiens
tttaaatggcattttcccagat

SEQ ID NO: 9212636 - DNA, 22 bp, Homo sapiens
tttaagcagagaaatgatgtat

SEQ ID NO: 9212637 - DNA, 22 bp, Homo sapiens
tttacagcttctatactatgtg

SEQ ID NO: 9212638 - DNA, 22 bp, Homo sapiens
tttacagtaaggtggatggtac

SEQ ID NO: 9212639 - DNA, 22 bp, Homo sapiens
tttcatgtgttgaatgtgtaca

SEQ ID NO: 9212640 - DNA, 22 bp, Homo sapiens
tttcatgcacaaatgagcaagg

SEQ ID NO: 9212641 - DNA, 22 bp, Homo sapiens
tttcaccatcttggccaggctg

SEQ ID NO: 9212642 - DNA, 20 bp, Homo sapiens
tttcaccatcttggccaggc

SEQ ID NO: 9212643 - DNA, 20 bp, Homo sapiens
tttcactgtggtgctggaga

SEQ ID NO: 9212644 - DNA, 22 bp, Homo sapiens
tttcactggaattttaacattt

SEQ ID NO: 9212645 - DNA, 18 bp, Homo sapiens
tttcacagattcatgact

SEQ ID NO: 9212646 - DNA, 22 bp, Homo sapiens
tttcacagctgggtggcagagt

SEQ ID NO: 9212647 - DNA, 22 bp, Homo sapiens
tttcagagaggcttcaaatctt

SEQ ID NO: 9212648 - DNA, 22 bp, Homo sapiens
tttcagaaatcaaaaccagggt

SEQ ID NO: 9212649 - DNA, 23 bp, Homo sapiens
tttattctcagatacataggtct

SEQ ID NO: 9212650 - DNA, 22 bp, Homo sapiens
tttattctctagttggtcagat

SEQ ID NO: 9212651 - DNA, 22 bp, Homo sapiens
tttattctgtgctacatgaaga

SEQ ID NO: 9212652 - DNA, 22 bp, Homo sapiens
tttattcttgagagtgagaaga

SEQ ID NO: 9212653 - DNA, 22 bp, Homo sapiens
tttattcttgagagtgagaaga

SEQ ID NO: 9212654 - DNA, 22 bp, Homo sapiens
tttattctataggcattaagca

SEQ ID NO: 9212655 - DNA, 22 bp, Homo sapiens
tttattctagctcagaatagtt

SEQ ID NO: 9212656 - DNA, 22 bp, Homo sapiens
tttcaacagaatatgatcagag

SEQ ID NO: 9212657 - DNA, 22 bp, Homo sapiens
ttattatagattatgcaagatt

SEQ ID NO: 9212658 - DNA, 22 bp, Homo sapiens
ttatatatatgtagaggtcacg

SEQ ID NO: 9212659 - DNA, 22 bp, Homo sapiens
ttatatatcttgatttgttcca

SEQ ID NO: 9212660 - DNA, 22 bp, Homo sapiens
ttatatatcttgatttgttcca

SEQ ID NO: 9212661 - DNA, 22 bp, Homo sapiens
ttatatgagtatcatatcactt

SEQ ID NO: 9212662 - DNA, 22 bp, Homo sapiens
ttatatgattgaagtgcataag

SEQ ID NO: 9212663 - DNA, 22 bp, Homo sapiens
ttattgtagcactttggcagtg

SEQ ID NO: 9212664 - DNA, 22 bp, Homo sapiens
ttattgaaatggaagctataac

SEQ ID NO: 9212665 - DNA, 18 bp, Homo sapiens
tcctgcctgcgggctccc

SEQ ID NO: 9212666 - DNA, 19 bp, Homo sapiens
tcctgcctggggccgcctg

SEQ ID NO: 9212667 - DNA, 18 bp, Homo sapiens
tcctgcctgcgggctccc

SEQ ID NO: 9212668 - DNA, 22 bp, Homo sapiens
tcctgcctgtttacctgtactt

SEQ ID NO: 9212669 - DNA, 18 bp, Homo sapiens
tcctgcctgtgccccagg

SEQ ID NO: 9212670 - DNA, 22 bp, Homo sapiens
ttagccagtgaaatggagaaat

SEQ ID NO: 9212671 - DNA, 22 bp, Homo sapiens
tcctgctggactctgagtacaa

SEQ ID NO: 9212672 - DNA, 22 bp, Homo sapiens
ttagccaggggagcagcttgtc

SEQ ID NO: 9212673 - DNA, 22 bp, Homo sapiens
ttagccaaacaggtgaaattga

SEQ ID NO: 9212674 - DNA, 22 bp, Homo sapiens
ttagctaaactgtaactagaat

SEQ ID NO: 9212675 - DNA, 22 bp, Homo sapiens
ttagctgctgattaaatatgtt

SEQ ID NO: 9212676 - DNA, 22 bp, Homo sapiens
ttatagcagcatgatttacaat

SEQ ID NO: 9212677 - DNA, 22 bp, Homo sapiens
ttatacatgtgttttgagatga

SEQ ID NO: 9212678 - DNA, 22 bp, Homo sapiens
ttaggaaacatcatttttgctg

SEQ ID NO: 9212679 - DNA, 22 bp, Homo sapiens
ttcagagcatctctaaagccag

SEQ ID NO: 9212680 - DNA, 22 bp, Homo sapiens
ttcagagccacttcaagtctaa

SEQ ID NO: 9212681 - DNA, 22 bp, Homo sapiens
ttcagcaattttttaagctaat

SEQ ID NO: 9212682 - DNA, 22 bp, Homo sapiens
ttcagcaagaccaccatgtacc

SEQ ID NO: 9212683 - DNA, 22 bp, Homo sapiens
ttcagcaaggcatgtgcaggag

SEQ ID NO: 9212684 - DNA, 22 bp, Homo sapiens
ttcagcaagtgtctctactgtc

SEQ ID NO: 9212685 - DNA, 22 bp, Homo sapiens
ttcagcaactcaaacctattag

SEQ ID NO: 9212686 - DNA, 22 bp, Homo sapiens
ttcacagatgtattggaactcc

SEQ ID NO: 9212687 - DNA, 22 bp, Homo sapiens
ttcacagatttccctgcacatg

SEQ ID NO: 9212688 - DNA, 22 bp, Homo sapiens
ttcacagactttccatagattg

SEQ ID NO: 9212689 - DNA, 22 bp, Homo sapiens
ttccaggaacactctgtgtccc

SEQ ID NO: 9212690 - DNA, 22 bp, Homo sapiens
ttccaggaacactctgtgtccc

SEQ ID NO: 9212691 - DNA, 22 bp, Homo sapiens
ttccaggaagacatctcaggaa

SEQ ID NO: 9212692 - DNA, 22 bp, Homo sapiens
ttccaggaagacatctcaggaa

SEQ ID NO: 9212693 - DNA, 22 bp, Homo sapiens
ttccaggaagattcaacaaaag

SEQ ID NO: 9212694 - DNA, 22 bp, Homo sapiens
ttccaggaagcagttagcagcc

SEQ ID NO: 9212695 - DNA, 22 bp, Homo sapiens
ttccaggaacagatgaaggttg

SEQ ID NO: 9212696 - DNA, 22 bp, Homo sapiens
ttccaggaagcagttagcagcc

SEQ ID NO: 9212697 - DNA, 22 bp, Homo sapiens
ttccaggaagtgactatgtcat

SEQ ID NO: 9212698 - DNA, 22 bp, Homo sapiens
ttccaggaagctctcggcctct

SEQ ID NO: 9212699 - DNA, 22 bp, Homo sapiens
ttccaggaagctctcggcctct

SEQ ID NO: 9212700 - DNA, 22 bp, Homo sapiens
ttccagtctagtacctggatgc

SEQ ID NO: 9212701 - DNA, 22 bp, Homo sapiens
ttccagtcaagtaagaatatct

SEQ ID NO: 9212702 - DNA, 22 bp, Homo sapiens
ttccagtgatatattagtgcaa

SEQ ID NO: 9212703 - DNA, 19 bp, Homo sapiens
ttccagttctaatctcttc

SEQ ID NO: 9212704 - DNA, 22 bp, Homo sapiens
ttccaggctgatgggccacagg

SEQ ID NO: 9212705 - DNA, 22 bp, Homo sapiens
ttccaggcgcacgtcggcctta

SEQ ID NO: 9212706 - DNA, 19 bp, Homo sapiens
ttccaggtgctgtggggag

SEQ ID NO: 9212707 - DNA, 21 bp, Homo sapiens
ttcataaaccattctcatgca

SEQ ID NO: 9212708 - DNA, 22 bp, Homo sapiens
ttcagtttgtttgactgttaga

SEQ ID NO: 9212709 - DNA, 22 bp, Homo sapiens
ttcatacaatgggatattatga

SEQ ID NO: 9212710 - DNA, 22 bp, Homo sapiens
ttcttagtggtagtcatctttg

SEQ ID NO: 9212711 - DNA, 22 bp, Homo sapiens
ttcttagagatggttaaaaata

SEQ ID NO: 9212712 - DNA, 22 bp, Homo sapiens
ttctgtgattcctccagccagc

SEQ ID NO: 9212713 - DNA, 22 bp, Homo sapiens
ttctgtgactcctcagagattt

SEQ ID NO: 9212714 - DNA, 22 bp, Homo sapiens
ttctgtgaggacttctcaagga

SEQ ID NO: 9212715 - DNA, 22 bp, Homo sapiens
ttctgtgaatcttttttcccac

SEQ ID NO: 9212716 - DNA, 22 bp, Homo sapiens
ttctgtcttcccactgaggagc

SEQ ID NO: 9212717 - DNA, 22 bp, Homo sapiens
ttctgtcttctcggttgtttac

SEQ ID NO: 9212718 - DNA, 22 bp, Homo sapiens
ttctgtaagggatttattctga

SEQ ID NO: 9212719 - DNA, 22 bp, Homo sapiens
ttctctgggatctggcaaaagg

SEQ ID NO: 9212720 - DNA, 22 bp, Homo sapiens
ttctctggggactgtctctatt

SEQ ID NO: 9212721 - DNA, 22 bp, Homo sapiens
ttctctgggcttttcggatccg

SEQ ID NO: 9212722 - DNA, 22 bp, Homo sapiens
ttctctggacagtgaagagagg

SEQ ID NO: 9212723 - DNA, 22 bp, Homo sapiens
ttctctgggacaggaacagttt

SEQ ID NO: 9212724 - DNA, 22 bp, Homo sapiens
ttctctgggaacataaatgaag

SEQ ID NO: 9212725 - DNA, 16 bp, Homo sapiens
ttctctggggttgtgc

SEQ ID NO: 9212726 - DNA, 22 bp, Homo sapiens
ttctctgggttaggggaactat

SEQ ID NO: 9212727 - DNA, 22 bp, Homo sapiens
ttctctggtaaacacatgcgta

SEQ ID NO: 9212728 - DNA, 22 bp, Homo sapiens
ttctctggggttcagtatctct

SEQ ID NO: 9212729 - DNA, 22 bp, Homo sapiens
ttctctggggacttggttggag

SEQ ID NO: 9212730 - DNA, 21 bp, Homo sapiens
ttctctggtcaagcacacata

SEQ ID NO: 9212731 - DNA, 22 bp, Homo sapiens
ttctggaaatgcacaactaatt

SEQ ID NO: 9212732 - DNA, 22 bp, Homo sapiens
ttctggaagttggaaatagcag

SEQ ID NO: 9212733 - DNA, 22 bp, Homo sapiens
ttgaaatgtagtcctgccttca

SEQ ID NO: 9212734 - DNA, 22 bp, Homo sapiens
ttgaaatggcagcagctgacct

SEQ ID NO: 9212735 - DNA, 22 bp, Homo sapiens
ttcttttgggaattacgtatgc

SEQ ID NO: 9212736 - DNA, 22 bp, Homo sapiens
ttgaaaggcacaggcacctggg

SEQ ID NO: 9212737 - DNA, 20 bp, Homo sapiens
ttcttttgataagcttgaca

SEQ ID NO: 9212738 - DNA, 22 bp, Homo sapiens
ttcttcaattattggaaagaaa

SEQ ID NO: 9212739 - DNA, 22 bp, Homo sapiens
ttcttcaattattggaaagaaa

SEQ ID NO: 9212740 - DNA, 22 bp, Homo sapiens
ttcttcaagggtaaaggcaacg

SEQ ID NO: 9212741 - DNA, 22 bp, Homo sapiens
ttcttcaagtctggtccagctt

SEQ ID NO: 9212742 - DNA, 22 bp, Homo sapiens
ttcttcaacaaggacactgtta

SEQ ID NO: 9212743 - DNA, 22 bp, Homo sapiens
ttcttcaaagtccttattcctt

SEQ ID NO: 9212744 - DNA, 22 bp, Homo sapiens
ttcttcaaatgctgaaagtcta

SEQ ID NO: 9212745 - DNA, 22 bp, Homo sapiens
ttcttcaaccatctacataaac

SEQ ID NO: 9212746 - DNA, 22 bp, Homo sapiens
ttcttcaaaacaacactggcct

SEQ ID NO: 9212747 - DNA, 22 bp, Homo sapiens
ttcttcaaaatccagcatgatt

SEQ ID NO: 9212748 - DNA, 22 bp, Homo sapiens
ttcttcaaaatccagcatgatt

SEQ ID NO: 9212749 - DNA, 22 bp, Homo sapiens
ttcttcaaagatgtctgttgga

SEQ ID NO: 9212750 - DNA, 22 bp, Homo sapiens
ttcttcaaagtaatagagacta

SEQ ID NO: 9212751 - DNA, 22 bp, Homo sapiens
ttcttcaaagatgtctgttgga

SEQ ID NO: 9212752 - DNA, 22 bp, Homo sapiens
ttcttcaaacaaaagtggcatg

SEQ ID NO: 9212753 - DNA, 21 bp, Homo sapiens
ttcttcaaagaagaaggcaca

SEQ ID NO: 9212754 - DNA, 22 bp, Homo sapiens
ttcctgctccatttgctgagct

SEQ ID NO: 9212755 - DNA, 22 bp, Homo sapiens
ttcctgcctacatgccttatgc

SEQ ID NO: 9212756 - DNA, 22 bp, Homo sapiens
ttcctggcattatgggaggctg

SEQ ID NO: 9212757 - DNA, 22 bp, Homo sapiens
ttcctgagaaatttgtacctgg

SEQ ID NO: 9212758 - DNA, 22 bp, Homo sapiens
ttccagttgtcataaagctagg

SEQ ID NO: 9212759 - DNA, 22 bp, Homo sapiens
ttccagttctggctttgccact

SEQ ID NO: 9212760 - DNA, 22 bp, Homo sapiens
ttccttgaccactgcataatga

SEQ ID NO: 9212761 - DNA, 22 bp, Homo sapiens
ttccttgaatgagtcatggaaa

SEQ ID NO: 9212762 - DNA, 22 bp, Homo sapiens
ttccttgaaagtttgaactgac

SEQ ID NO: 9212763 - DNA, 22 bp, Homo sapiens
ttccttgcctcggggtaccttg

SEQ ID NO: 9212764 - DNA, 22 bp, Homo sapiens
ttccttgccctctgggatcttg

SEQ ID NO: 9212765 - DNA, 22 bp, Homo sapiens
ttcctggtaaattatgtccagg

SEQ ID NO: 9212766 - DNA, 22 bp, Homo sapiens
ttcctggtaacaatctcaaagt

SEQ ID NO: 9212767 - DNA, 22 bp, Homo sapiens
ttcctggtaaattatgtccagg

SEQ ID NO: 9212768 - DNA, 22 bp, Homo sapiens
ttcctggtctatttagaattgc

SEQ ID NO: 9212769 - DNA, 22 bp, Homo sapiens
ttcctggtctgtgccattcaga

SEQ ID NO: 9212770 - DNA, 22 bp, Homo sapiens
ttcctggtcctattatatacac

SEQ ID NO: 9212771 - DNA, 22 bp, Homo sapiens
ttcctggtcccgttcttcactg

SEQ ID NO: 9212772 - DNA, 22 bp, Homo sapiens
ttcctggtttatggaaagcatg

SEQ ID NO: 9212773 - DNA, 22 bp, Homo sapiens
ttcctggtttgcctggaatcca

SEQ ID NO: 9212774 - DNA, 22 bp, Homo sapiens
ttcctggtttatacctgtatca

SEQ ID NO: 9212775 - DNA, 22 bp, Homo sapiens
ttcctggttggattctgattaa

SEQ ID NO: 9212776 - DNA, 22 bp, Homo sapiens
ttcctggttggattctgattaa

SEQ ID NO: 9212777 - DNA, 22 bp, Homo sapiens
ttcctggtttatacctgtatca

SEQ ID NO: 9212778 - DNA, 22 bp, Homo sapiens
ttcctggtggtggtgacagcac

SEQ ID NO: 9212779 - DNA, 22 bp, Homo sapiens
ttcctggtggctttgccaactg

SEQ ID NO: 9212780 - DNA, 22 bp, Homo sapiens
ttcctggtgacctcactggtag

SEQ ID NO: 9212781 - DNA, 22 bp, Homo sapiens
ttcctggtgacctcactggtag

SEQ ID NO: 9212782 - DNA, 22 bp, Homo sapiens
ttcctggtgagatttcgttctg

SEQ ID NO: 9212783 - DNA, 22 bp, Homo sapiens
ttctcagctttccttgcagtta

SEQ ID NO: 9212784 - DNA, 22 bp, Homo sapiens
ttctcaggaactcagtgtcagc

SEQ ID NO: 9212785 - DNA, 22 bp, Homo sapiens
ttctcaggcccctgcctggact

SEQ ID NO: 9212786 - DNA, 22 bp, Homo sapiens
ttctcagggtctggatggcctg

SEQ ID NO: 9212787 - DNA, 22 bp, Homo sapiens
ttctcagggtctggatggcctg

SEQ ID NO: 9212788 - DNA, 22 bp, Homo sapiens
ttctcaggcctttgggatggga

SEQ ID NO: 9212789 - DNA, 22 bp, Homo sapiens
ttctcaggcccctgcctggact

SEQ ID NO: 9212790 - DNA, 22 bp, Homo sapiens
ttctcaggctgtggagccgtct

SEQ ID NO: 9212791 - DNA, 21 bp, Homo sapiens
ttctcagatcgagtagtgaga

SEQ ID NO: 9212792 - DNA, 22 bp, Homo sapiens
ttctccagagggctctgcagga

SEQ ID NO: 9212793 - DNA, 22 bp, Homo sapiens
ttctccagaccactgcctctgt

SEQ ID NO: 9212794 - DNA, 22 bp, Homo sapiens
ttctcctctgttggccttccct

SEQ ID NO: 9212795 - DNA, 22 bp, Homo sapiens
ttctcctgagttcccaggtcta

SEQ ID NO: 9212796 - DNA, 23 bp, Homo sapiens
ttctcctgaggaagcagggactg

SEQ ID NO: 9212797 - DNA, 23 bp, Homo sapiens
ttctcctgaggaagcagggactg

SEQ ID NO: 9212798 - DNA, 22 bp, Homo sapiens
ttctcaggtagtgctgatgctg

SEQ ID NO: 9212799 - DNA, 22 bp, Homo sapiens
ttctcaggtcaccagggtgcca

SEQ ID NO: 9212800 - DNA, 22 bp, Homo sapiens
ttctcaggtcaccagggtgcca

SEQ ID NO: 9212801 - DNA, 23 bp, Homo sapiens
ttctctagatgaggtgaagatgg

SEQ ID NO: 9212802 - DNA, 22 bp, Homo sapiens
ttctctaggttttagatgaaga

SEQ ID NO: 9212803 - DNA, 22 bp, Homo sapiens
ttctctaatggtgatgattaga

SEQ ID NO: 9212804 - DNA, 22 bp, Homo sapiens
ttctctgcagcttaggcccagt

SEQ ID NO: 9212805 - DNA, 22 bp, Homo sapiens
ttctctggaactgaaacaagat

SEQ ID NO: 9212806 - DNA, 22 bp, Homo sapiens
ttctctggaaggctctacggga

SEQ ID NO: 9212807 - DNA, 22 bp, Homo sapiens
ttttcttactgtctgtgatcct

SEQ ID NO: 9212808 - DNA, 22 bp, Homo sapiens
ttttcttatggtgaagcacaaa

SEQ ID NO: 9212809 - DNA, 20 bp, Homo sapiens
ttttctgtgccaagaaaact

SEQ ID NO: 9212810 - DNA, 22 bp, Homo sapiens
ttttctcttgttaatgtactga

SEQ ID NO: 9212811 - DNA, 22 bp, Homo sapiens
ttttcatttttgtagatgcaag

SEQ ID NO: 9212812 - DNA, 22 bp, Homo sapiens
ttttcatttacattagggaaga

SEQ ID NO: 9212813 - DNA, 22 bp, Homo sapiens
ttttcatttacattagggaaga

SEQ ID NO: 9212814 - DNA, 22 bp, Homo sapiens
ttttccaaattagaagtagaga

SEQ ID NO: 9212815 - DNA, 22 bp, Homo sapiens
ttttcattgtaaatcaggaaac

SEQ ID NO: 9212816 - DNA, 22 bp, Homo sapiens
ttttcatgtcatgtccttgagg

SEQ ID NO: 9212817 - DNA, 22 bp, Homo sapiens
ttttcatctctgctttgtacct

SEQ ID NO: 9212818 - DNA, 22 bp, Homo sapiens
ttttcacacaaggtgataagtt

SEQ ID NO: 9212819 - DNA, 22 bp, Homo sapiens
ttttattggagtgataccaagc

SEQ ID NO: 9212820 - DNA, 22 bp, Homo sapiens
tttgtaaaggcctgaatttcag

SEQ ID NO: 9212821 - DNA, 22 bp, Homo sapiens
tttgtaaaaggaggaagcatgg

SEQ ID NO: 9212822 - DNA, 22 bp, Homo sapiens
tttgtaaaaggaggaagcatgg

SEQ ID NO: 9212823 - DNA, 22 bp, Homo sapiens
tttgtgtggtggatactgggta

SEQ ID NO: 9212824 - DNA, 22 bp, Homo sapiens
tttgtgtgtatatgtatataga

SEQ ID NO: 9212825 - DNA, 22 bp, Homo sapiens
tttgttataacaataaaaagtc

SEQ ID NO: 9212826 - DNA, 22 bp, Homo sapiens
tttgttaaggagtattgcttct

SEQ ID NO: 9212827 - DNA, 22 bp, Homo sapiens
tttgtgttttagctggtgaggc

SEQ ID NO: 9212828 - DNA, 22 bp, Homo sapiens
tttgtgttgttttaagccacta

SEQ ID NO: 9212829 - DNA, 22 bp, Homo sapiens
ttttaaatctccagttgacccc

SEQ ID NO: 9212830 - DNA, 22 bp, Homo sapiens
ttttaaactgcagaatttagaa

SEQ ID NO: 9212831 - DNA, 22 bp, Homo sapiens
ttttaaactgcagaatttagaa

SEQ ID NO: 9212832 - DNA, 22 bp, Homo sapiens
ttttaattcaaagtgaatagtg

SEQ ID NO: 9212833 - DNA, 22 bp, Homo sapiens
ttttatgtcataaggacactca

SEQ ID NO: 9212834 - DNA, 22 bp, Homo sapiens
tttgaagagccacagtgaaatt

SEQ ID NO: 9212835 - DNA, 22 bp, Homo sapiens
tttgaatatcacaaactttcaa

SEQ ID NO: 9212836 - DNA, 22 bp, Homo sapiens
tttgacaagagggcatcttcag

SEQ ID NO: 9212837 - DNA, 22 bp, Homo sapiens
tttgacaaccaggcaggtaaga

SEQ ID NO: 9212838 - DNA, 22 bp, Homo sapiens
tttgacaacgttgttgtgagga

SEQ ID NO: 9212839 - DNA, 19 bp, Homo sapiens
tttgacagagtttgagcat

SEQ ID NO: 9212840 - DNA, 22 bp, Homo sapiens
tttgacaattcatgacatttat

SEQ ID NO: 9212841 - DNA, 22 bp, Homo sapiens
tttgacaaatgtatctgcatta

SEQ ID NO: 9212842 - DNA, 22 bp, Homo sapiens
tttgacaaatatttattggcac

SEQ ID NO: 9212843 - DNA, 22 bp, Homo sapiens
tttcctctgagtgagctgggag

SEQ ID NO: 9212844 - DNA, 22 bp, Homo sapiens
tttcctctgactgctcccctgc

SEQ ID NO: 9212845 - DNA, 22 bp, Homo sapiens
tttcctctccggggcctccagg

SEQ ID NO: 9212846 - DNA, 22 bp, Homo sapiens
tttcctctgactgctcccctgc

SEQ ID NO: 9212847 - DNA, 22 bp, Homo sapiens
tttcctctccggggcctccagg

SEQ ID NO: 9212848 - DNA, 22 bp, Homo sapiens
tttcctctccggggcctccagg

SEQ ID NO: 9212849 - DNA, 22 bp, Homo sapiens
tttcctcatttatctgctggga

SEQ ID NO: 9212850 - DNA, 22 bp, Homo sapiens
tttcctcagaagtgtctactat

SEQ ID NO: 9212851 - DNA, 22 bp, Homo sapiens
tttcctctaaacgcatttgctt

SEQ ID NO: 9212852 - DNA, 22 bp, Homo sapiens
tttccctctgtgccagcttctc

SEQ ID NO: 9212853 - DNA, 21 bp, Homo sapiens
tttccctcattgtgttggcac

SEQ ID NO: 9212854 - DNA, 21 bp, Homo sapiens
tttctttctggctctcacagt

SEQ ID NO: 9212855 - DNA, 22 bp, Homo sapiens
tttgataattaaaaattgtagt

SEQ ID NO: 9212856 - DNA, 22 bp, Homo sapiens
tttgagtgcccatgtttcccag

SEQ ID NO: 9212857 - DNA, 22 bp, Homo sapiens
tttgcttgttcaagatttctgt

SEQ ID NO: 9212858 - DNA, 22 bp, Homo sapiens
tttggtaagtacccacctgggt

SEQ ID NO: 9212859 - DNA, 22 bp, Homo sapiens
tttggaaaatattgaactggtt

SEQ ID NO: 9212860 - DNA, 22 bp, Homo sapiens
tttggaaatttcatcaatagcc

SEQ ID NO: 9212861 - DNA, 22 bp, Homo sapiens
tttggaaatgagaagccacctt

SEQ ID NO: 9212862 - DNA, 22 bp, Homo sapiens
tttggaaagttgtcactttaga

SEQ ID NO: 9212863 - DNA, 22 bp, Homo sapiens
tttttatactttgctcaagatt

SEQ ID NO: 9212864 - DNA, 22 bp, Homo sapiens
ttttgttggcttaagaaataca

SEQ ID NO: 9212865 - DNA, 22 bp, Homo sapiens
ttttcttcctggattttggcat

SEQ ID NO: 9212866 - DNA, 22 bp, Homo sapiens
tttttataactcttttgtgaca

SEQ ID NO: 9212867 - DNA, 22 bp, Homo sapiens
ggcaggaataaattatggactt

SEQ ID NO: 9212868 - DNA, 22 bp, Homo sapiens
ggcaggaagtagcagtctgagc

SEQ ID NO: 9212869 - DNA, 22 bp, Homo sapiens
ggcaggaagctcatgtggactg

SEQ ID NO: 9212870 - DNA, 22 bp, Homo sapiens
ggcaggaagcattaaaacgatt

SEQ ID NO: 9212871 - DNA, 22 bp, Homo sapiens
ggcagctgcaaatctgctctgt

SEQ ID NO: 9212872 - DNA, 22 bp, Homo sapiens
ggcaggaaaacaatgagccagg

SEQ ID NO: 9212873 - DNA, 22 bp, Homo sapiens
ggcagctgcaaatctgctctgt

SEQ ID NO: 9212874 - DNA, 22 bp, Homo sapiens
ggcagctgcaaatctgctctgt

SEQ ID NO: 9212875 - DNA, 22 bp, Homo sapiens
ggagtgaagcaaataatgctgg

SEQ ID NO: 9212876 - DNA, 22 bp, Homo sapiens
ggagtgactctcggggccacta

SEQ ID NO: 9212877 - DNA, 22 bp, Homo sapiens
ggagtctgattttttatgggtg

SEQ ID NO: 9212878 - DNA, 22 bp, Homo sapiens
ggagtctgcggcagacactgta

SEQ ID NO: 9212879 - DNA, 22 bp, Homo sapiens
ggagtctgctcccagacatgat

SEQ ID NO: 9212880 - DNA, 22 bp, Homo sapiens
ggagtctggagtggggcccaag

SEQ ID NO: 9212881 - DNA, 22 bp, Homo sapiens
ggagtctgtcacctgtttctct

SEQ ID NO: 9212882 - DNA, 21 bp, Homo sapiens
ggagtctgtggatgctgtttc

SEQ ID NO: 9212883 - DNA, 22 bp, Homo sapiens
ggagtctgttttacatgcagga

SEQ ID NO: 9212884 - DNA, 22 bp, Homo sapiens
ggcagtagccagggactggcag

SEQ ID NO: 9212885 - DNA, 22 bp, Homo sapiens
cacatttctctacctcacacaa

SEQ ID NO: 9212886 - DNA, 22 bp, Homo sapiens
ggcaggagaaaggtctcttctt

SEQ ID NO: 9212887 - DNA, 22 bp, Homo sapiens
cacatgcagttttccagcagtc

SEQ ID NO: 9212888 - DNA, 23 bp, Homo sapiens
ggccactttgtgtcagtatgtgc

SEQ ID NO: 9212889 - DNA, 22 bp, Homo sapiens
ggccagcccagtggtcctctct

SEQ ID NO: 9212890 - DNA, 22 bp, Homo sapiens
ggccagcctggggctcccagac

SEQ ID NO: 9212891 - DNA, 22 bp, Homo sapiens
ggccagcctggggctcccagac

SEQ ID NO: 9212892 - DNA, 22 bp, Homo sapiens
caccactgaattgttcactttc

SEQ ID NO: 9212893 - DNA, 22 bp, Homo sapiens
caccacagcatccactagaagg

SEQ ID NO: 9212894 - DNA, 19 bp, Homo sapiens
cacattttgagtctgagat

SEQ ID NO: 9212895 - DNA, 22 bp, Homo sapiens
cacatttttactgccaacttaa

SEQ ID NO: 9212896 - DNA, 22 bp, Homo sapiens
cacccaggaggttgggaagggc

SEQ ID NO: 9212897 - DNA, 22 bp, Homo sapiens
cacccaggacaggccagatgtg

SEQ ID NO: 9212898 - DNA, 22 bp, Homo sapiens
cacccaggcaaggattctgcaa

SEQ ID NO: 9212899 - DNA, 22 bp, Homo sapiens
cacccaggcaggtggctgagaa

SEQ ID NO: 9212900 - DNA, 22 bp, Homo sapiens
cacccaggcaggtggctgagaa

SEQ ID NO: 9212901 - DNA, 22 bp, Homo sapiens
cacccaggacaaaatatggaat

SEQ ID NO: 9212902 - DNA, 22 bp, Homo sapiens
ggcccagagctccctggcacct

SEQ ID NO: 9212903 - DNA, 22 bp, Homo sapiens
ggcccagagtctgcaatggagt

SEQ ID NO: 9212904 - DNA, 21 bp, Homo sapiens
ggccccagcccatgggttctc

SEQ ID NO: 9212905 - DNA, 22 bp, Homo sapiens
ggccccagcagaccctcctctg

SEQ ID NO: 9212906 - DNA, 22 bp, Homo sapiens
ggccccagggattaggccaacc

SEQ ID NO: 9212907 - DNA, 22 bp, Homo sapiens
ggccccaggcctttggtctggc

SEQ ID NO: 9212908 - DNA, 22 bp, Homo sapiens
ggccccagcctcagtcccctga

SEQ ID NO: 9212909 - DNA, 22 bp, Homo sapiens
ggccccaggcctttggtctggc

SEQ ID NO: 9212910 - DNA, 22 bp, Homo sapiens
ggctcctgtcctcctggagctc

SEQ ID NO: 9212911 - DNA, 19 bp, Homo sapiens
ggctcctggggctcagccc

SEQ ID NO: 9212912 - DNA, 21 bp, Homo sapiens
cactgaggtcaggggtagggt

SEQ ID NO: 9212913 - DNA, 20 bp, Homo sapiens
cactgaggtgcagctcatgc

SEQ ID NO: 9212914 - DNA, 22 bp, Homo sapiens
cactgagttagtacgcaaacat

SEQ ID NO: 9212915 - DNA, 22 bp, Homo sapiens
cactgagttccctgacatttca

SEQ ID NO: 9212916 - DNA, 22 bp, Homo sapiens
cactgaggcttccttaggcaat

SEQ ID NO: 9212917 - DNA, 22 bp, Homo sapiens
cactgagggagggtttcttctg

SEQ ID NO: 9212918 - DNA, 22 bp, Homo sapiens
cactgagggcggagcccaggga

SEQ ID NO: 9212919 - DNA, 22 bp, Homo sapiens
cactgagggggtggtttcagga

SEQ ID NO: 9212920 - DNA, 22 bp, Homo sapiens
ggcgctcagtgttgccccagag

SEQ ID NO: 9212921 - DNA, 22 bp, Homo sapiens
cactgaggctgggggagaaggt

SEQ ID NO: 9212922 - DNA, 22 bp, Homo sapiens
ggcgccgcactcggtgcagccg

SEQ ID NO: 9212923 - DNA, 19 bp, Homo sapiens
ggctgcctttccttaccag

SEQ ID NO: 9212924 - DNA, 22 bp, Homo sapiens
ggctgcctttagaacggatgct

SEQ ID NO: 9212925 - DNA, 22 bp, Homo sapiens
ggctgccttgggggttgtcatt

SEQ ID NO: 9212926 - DNA, 22 bp, Homo sapiens
ggctgcggccgcgggtctgtgc

SEQ ID NO: 9212927 - DNA, 22 bp, Homo sapiens
cactgtcttgattactatgggt

SEQ ID NO: 9212928 - DNA, 22 bp, Homo sapiens
cactgtcttttgtgaagacaat

SEQ ID NO: 9212929 - DNA, 22 bp, Homo sapiens
ggctgccttgaccctggctccg

SEQ ID NO: 9212930 - DNA, 22 bp, Homo sapiens
ggctgcctcagatttgctgact

SEQ ID NO: 9212931 - DNA, 22 bp, Homo sapiens
ggctgcctcaattaatcttaca

SEQ ID NO: 9212932 - DNA, 22 bp, Homo sapiens
cactgtcttttgtgaagacaat

SEQ ID NO: 9212933 - DNA, 22 bp, Homo sapiens
cactgtgctcctaactagctgt

SEQ ID NO: 9212934 - DNA, 22 bp, Homo sapiens
cactgtgaaaaatggagtggtc

SEQ ID NO: 9212935 - DNA, 22 bp, Homo sapiens
ggctgcctcaaagctcaagctc

SEQ ID NO: 9212936 - DNA, 22 bp, Homo sapiens
ggctgcagcagagggactcacg

SEQ ID NO: 9212937 - DNA, 22 bp, Homo sapiens
ggctgcagattgtagtctgtta

SEQ ID NO: 9212938 - DNA, 22 bp, Homo sapiens
ggctgcagccctcgcctagcca

SEQ ID NO: 9212939 - DNA, 22 bp, Homo sapiens
cactgtccctgtttcctggaaa

SEQ ID NO: 9212940 - DNA, 19 bp, Homo sapiens
cactgtcctagtcgaggcc

SEQ ID NO: 9212941 - DNA, 22 bp, Homo sapiens
cactgtcctagtcttcctggag

SEQ ID NO: 9212942 - DNA, 22 bp, Homo sapiens
ggctgcagcggattggggattg

SEQ ID NO: 9212943 - DNA, 22 bp, Homo sapiens
cactgtccaatagatacataat

SEQ ID NO: 9212944 - DNA, 22 bp, Homo sapiens
cactgtccatgcttgctaaccc

SEQ ID NO: 9212945 - DNA, 22 bp, Homo sapiens
ggctgcagattgtagtctgtta

SEQ ID NO: 9212946 - DNA, 22 bp, Homo sapiens
ggctgcagaggcgatctgaggt

SEQ ID NO: 9212947 - DNA, 22 bp, Homo sapiens
ggctgcagatagccagccacca

SEQ ID NO: 9212948 - DNA, 22 bp, Homo sapiens
ggcttggaaattgcaggacaca

SEQ ID NO: 9212949 - DNA, 20 bp, Homo sapiens
ggcttctttacatctgtgtt

SEQ ID NO: 9212950 - DNA, 23 bp, Homo sapiens
ggcttcttgcctgtcttggtgct

SEQ ID NO: 9212951 - DNA, 22 bp, Homo sapiens
ggcttcttgtgtgtcaggctct

SEQ ID NO: 9212952 - DNA, 20 bp, Homo sapiens
cagaacatgagcatcgagcc

SEQ ID NO: 9212953 - DNA, 22 bp, Homo sapiens
cagaagagatgaaatagtatta

SEQ ID NO: 9212954 - DNA, 22 bp, Homo sapiens
cagaaatgtttatatgtggtgt

SEQ ID NO: 9212955 - DNA, 22 bp, Homo sapiens
cagaaatgttctaatgattcag

SEQ ID NO: 9212956 - DNA, 22 bp, Homo sapiens
ggctgggagccccacagagtca

SEQ ID NO: 9212957 - DNA, 23 bp, Homo sapiens
ggctgggagctccgggtgcacgt

SEQ ID NO: 9212958 - DNA, 22 bp, Homo sapiens
ggctggctttctctccgcacct

SEQ ID NO: 9212959 - DNA, 22 bp, Homo sapiens
ggctgggacgatgaggattagt

SEQ ID NO: 9212960 - DNA, 22 bp, Homo sapiens
cagaaatggagcccaggaatct

SEQ ID NO: 9212961 - DNA, 22 bp, Homo sapiens
cagaaatggaagttctggttta

SEQ ID NO: 9212962 - DNA, 22 bp, Homo sapiens
cagaaatggaattttccatcac

SEQ ID NO: 9212963 - DNA, 22 bp, Homo sapiens
cagaaatgtactgacatgcagt

SEQ ID NO: 9212964 - DNA, 22 bp, Homo sapiens
cagaaatgtactgacatgcagt

SEQ ID NO: 9212965 - DNA, 22 bp, Homo sapiens
cagaaatggtctgttcagctta

SEQ ID NO: 9212966 - DNA, 22 bp, Homo sapiens
cagaaatgcctgcttctctctc

SEQ ID NO: 9212967 - DNA, 23 bp, Homo sapiens
cagaaatgacagtaagcaccctg

SEQ ID NO: 9212968 - DNA, 22 bp, Homo sapiens
ggaagagcctggggtgtcaggc

SEQ ID NO: 9212969 - DNA, 22 bp, Homo sapiens
ggaagactgcatggcatagtga

SEQ ID NO: 9212970 - DNA, 22 bp, Homo sapiens
ggaacactgtggttccatagca

SEQ ID NO: 9212971 - DNA, 22 bp, Homo sapiens
ggaaggggtcacctcctgatga

SEQ ID NO: 9212972 - DNA, 22 bp, Homo sapiens
ggacaagcctgtgagtgggttt

SEQ ID NO: 9212973 - DNA, 22 bp, Homo sapiens
ggacaagcctgtgagtgggttt

SEQ ID NO: 9212974 - DNA, 22 bp, Homo sapiens
ggacaagcctgtgagtgggttt

SEQ ID NO: 9212975 - DNA, 19 bp, Homo sapiens
ggacacagaaagctgcatt

SEQ ID NO: 9212976 - DNA, 19 bp, Homo sapiens
ggacacagaaagctgcatt

SEQ ID NO: 9212977 - DNA, 23 bp, Homo sapiens
ggacacagagataagtgagacaa

SEQ ID NO: 9212978 - DNA, 22 bp, Homo sapiens
ggacacagataatcacacagat

SEQ ID NO: 9212979 - DNA, 22 bp, Homo sapiens
ggacagcccatacacatgtctg

SEQ ID NO: 9212980 - DNA, 22 bp, Homo sapiens
ggacagctcctgcacttgagta

SEQ ID NO: 9212981 - DNA, 22 bp, Homo sapiens
ggacagctgctttcaggccaca

SEQ ID NO: 9212982 - DNA, 22 bp, Homo sapiens
ggacagctgctttcaggccaca

SEQ ID NO: 9212983 - DNA, 21 bp, Homo sapiens
ggacagctgcgcgcagggctc

SEQ ID NO: 9212984 - DNA, 22 bp, Homo sapiens
ggacagctctgccaggagctca

SEQ ID NO: 9212985 - DNA, 22 bp, Homo sapiens
ggacagctctgccaggagctca

SEQ ID NO: 9212986 - DNA, 22 bp, Homo sapiens
cacagcagggatgaatggagtg

SEQ ID NO: 9212987 - DNA, 22 bp, Homo sapiens
cacagcagggcatggctgttgt

SEQ ID NO: 9212988 - DNA, 21 bp, Homo sapiens
cacagcagggttcctgggctc

SEQ ID NO: 9212989 - DNA, 21 bp, Homo sapiens
cacagcagggttcctgggctc

SEQ ID NO: 9212990 - DNA, 22 bp, Homo sapiens
cacagcagtctttcactaaata

SEQ ID NO: 9212991 - DNA, 22 bp, Homo sapiens
ggaggagcacttgacggggtct

SEQ ID NO: 9212992 - DNA, 22 bp, Homo sapiens
ggaggagcacttctgagctcag

SEQ ID NO: 9212993 - DNA, 22 bp, Homo sapiens
ggaggagcacttctgagctcag

SEQ ID NO: 9212994 - DNA, 22 bp, Homo sapiens
ggagcagcttgcatgctcaggg

SEQ ID NO: 9212995 - DNA, 20 bp, Homo sapiens
ggagctggcatccagcctct

SEQ ID NO: 9212996 - DNA, 22 bp, Homo sapiens
ggaggggatttagtagatgcta

SEQ ID NO: 9212997 - DNA, 22 bp, Homo sapiens
ggaggggatggtttgaccctgg

SEQ ID NO: 9212998 - DNA, 22 bp, Homo sapiens
cacagctgaagtagccatgtgg

SEQ ID NO: 9212999 - DNA, 22 bp, Homo sapiens
cacagcctttagggtacacaca

SEQ ID NO: 9213000 - DNA, 22 bp, Homo sapiens
cacagccttactgagatccact

SEQ ID NO: 9213001 - DNA, 22 bp, Homo sapiens
cacagcctcctctggctcacgg

SEQ ID NO: 9213002 - DNA, 22 bp, Homo sapiens
cacaggagaaaggggaagctcg

SEQ ID NO: 9213003 - DNA, 18 bp, Homo sapiens
cacaggagatgacctgac

SEQ ID NO: 9213004 - DNA, 22 bp, Homo sapiens
cacaggagaacccacagattct

SEQ ID NO: 9213005 - DNA, 22 bp, Homo sapiens
cacaggagagctgggaggtgcc

SEQ ID NO: 9213006 - DNA, 22 bp, Homo sapiens
cacaggagagctgggaggtgcc

SEQ ID NO: 9213007 - DNA, 22 bp, Homo sapiens
caatggtggtgtcagaagagat

SEQ ID NO: 9213008 - DNA, 22 bp, Homo sapiens
caatggcctcccaagcaggggg

SEQ ID NO: 9213009 - DNA, 22 bp, Homo sapiens
gcttccagacgatcatgtaaga

SEQ ID NO: 9213010 - DNA, 22 bp, Homo sapiens
gcttccagagactgagctcttc

SEQ ID NO: 9213011 - DNA, 22 bp, Homo sapiens
gcttccagatcccatgctctta

SEQ ID NO: 9213012 - DNA, 20 bp, Homo sapiens
gcttccagaggaggccccgt

SEQ ID NO: 9213013 - DNA, 22 bp, Homo sapiens
gcttccagaatgactaggatgt

SEQ ID NO: 9213014 - DNA, 22 bp, Homo sapiens
gcttccacctactaaatgccac

SEQ ID NO: 9213015 - DNA, 20 bp, Homo sapiens
gcttccaggagggctgatat

SEQ ID NO: 9213016 - DNA, 19 bp, Homo sapiens
gcttccagcactgcaggag

SEQ ID NO: 9213017 - DNA, 22 bp, Homo sapiens
gcttccagcaccagcagagggg

SEQ ID NO: 9213018 - DNA, 22 bp, Homo sapiens
gcttccagcaccagcagagggg

SEQ ID NO: 9213019 - DNA, 19 bp, Homo sapiens
ggaaatgtggaaacatcct

SEQ ID NO: 9213020 - DNA, 22 bp, Homo sapiens
ggaaatgtcatagaaatataag

SEQ ID NO: 9213021 - DNA, 22 bp, Homo sapiens
ggaaatgtatgtattaagcacc

SEQ ID NO: 9213022 - DNA, 22 bp, Homo sapiens
ggaaatgtatgattctcatcag

SEQ ID NO: 9213023 - DNA, 22 bp, Homo sapiens
caatcccatcaccatctgctct

SEQ ID NO: 9213024 - DNA, 21 bp, Homo sapiens
caagtgtggatgtggaaggta

SEQ ID NO: 9213025 - DNA, 22 bp, Homo sapiens
caagttgtgaatgacagacttc

SEQ ID NO: 9213026 - DNA, 22 bp, Homo sapiens
caagttgtgaatgacagacttc

SEQ ID NO: 9213027 - DNA, 22 bp, Homo sapiens
caagttgtttaggaggtgttgt

SEQ ID NO: 9213028 - DNA, 22 bp, Homo sapiens
caagttgctctgcctctgtagg

SEQ ID NO: 9213029 - DNA, 22 bp, Homo sapiens
gctgggagcaaagccatgcata

SEQ ID NO: 9213030 - DNA, 19 bp, Homo sapiens
gctgggagcagaccctccc

SEQ ID NO: 9213031 - DNA, 22 bp, Homo sapiens
gctgggagccccgagccagcgc

SEQ ID NO: 9213032 - DNA, 22 bp, Homo sapiens
gctgggagccctggtctgctcc

SEQ ID NO: 9213033 - DNA, 22 bp, Homo sapiens
gctggccagtgtggtgaccacc

SEQ ID NO: 9213034 - DNA, 22 bp, Homo sapiens
gctggccagtgtggtgaccacc

SEQ ID NO: 9213035 - DNA, 22 bp, Homo sapiens
gctggccatagaagccaaagag

SEQ ID NO: 9213036 - DNA, 22 bp, Homo sapiens
gctggccatatattttgctgtt

SEQ ID NO: 9213037 - DNA, 22 bp, Homo sapiens
gctggccatggcctgcgccatc

SEQ ID NO: 9213038 - DNA, 22 bp, Homo sapiens
gctggccatggggagtgaggag

SEQ ID NO: 9213039 - DNA, 22 bp, Homo sapiens
gctggccatggggagtgaggag

SEQ ID NO: 9213040 - DNA, 22 bp, Homo sapiens
gctgggagccctggtctgctcc

SEQ ID NO: 9213041 - DNA, 22 bp, Homo sapiens
gctgggccagagcagcagcact

SEQ ID NO: 9213042 - DNA, 22 bp, Homo sapiens
gctgggccagagcagcagcact

SEQ ID NO: 9213043 - DNA, 22 bp, Homo sapiens
gctgggcccagatcccaggatc

SEQ ID NO: 9213044 - DNA, 22 bp, Homo sapiens
gctgggcccagatcccaggatc

SEQ ID NO: 9213045 - DNA, 20 bp, Homo sapiens
gctgggctaccactggccct

SEQ ID NO: 9213046 - DNA, 20 bp, Homo sapiens
gctgggctaccactggccct

SEQ ID NO: 9213047 - DNA, 22 bp, Homo sapiens
gctgggccgacctgggctgcag

SEQ ID NO: 9213048 - DNA, 22 bp, Homo sapiens
gctgggccttccgattctcaag

SEQ ID NO: 9213049 - DNA, 22 bp, Homo sapiens
gctgggccctgggtgccctagc

SEQ ID NO: 9213050 - DNA, 18 bp, Homo sapiens
caaattcagtgctggaag

SEQ ID NO: 9213051 - DNA, 22 bp, Homo sapiens
caaatttaagttagaaagcaat

SEQ ID NO: 9213052 - DNA, 22 bp, Homo sapiens
caaatttaagtgaggtctttgt

SEQ ID NO: 9213053 - DNA, 22 bp, Homo sapiens
gctgaggtaggaggttgcagtg

SEQ ID NO: 9213054 - DNA, 22 bp, Homo sapiens
caaatttaggtaacagtctgta

SEQ ID NO: 9213055 - DNA, 19 bp, Homo sapiens
gctggcagatgtggccgtg

SEQ ID NO: 9213056 - DNA, 22 bp, Homo sapiens
gctggcagagctctgggctggg

SEQ ID NO: 9213057 - DNA, 22 bp, Homo sapiens
gctggaggctggagtgcagtgg

SEQ ID NO: 9213058 - DNA, 22 bp, Homo sapiens
cagagagcacataggatacttt

SEQ ID NO: 9213059 - DNA, 22 bp, Homo sapiens
cagagagagtggggtgtggatt

SEQ ID NO: 9213060 - DNA, 22 bp, Homo sapiens
cagagagagtggggtgtggatt

SEQ ID NO: 9213061 - DNA, 22 bp, Homo sapiens
cagagagcttagtgtgctgcat

SEQ ID NO: 9213062 - DNA, 22 bp, Homo sapiens
gggccagctctgtgatgtaggg

SEQ ID NO: 9213063 - DNA, 22 bp, Homo sapiens
gggccctgcgactcgcggcgga

SEQ ID NO: 9213064 - DNA, 22 bp, Homo sapiens
gggccctgcgtccggaagtctg

SEQ ID NO: 9213065 - DNA, 22 bp, Homo sapiens
gggccctggccgaatccctctg

SEQ ID NO: 9213066 - DNA, 22 bp, Homo sapiens
gggccctggatttaagcatgga

SEQ ID NO: 9213067 - DNA, 22 bp, Homo sapiens
gggccctggacgtggcggcaga

SEQ ID NO: 9213068 - DNA, 22 bp, Homo sapiens
gggccctggacgtggcggcaga

SEQ ID NO: 9213069 - DNA, 18 bp, Homo sapiens
cagagcagaggtggagcg

SEQ ID NO: 9213070 - DNA, 22 bp, Homo sapiens
cagagcagagtgattgttctgg

SEQ ID NO: 9213071 - DNA, 22 bp, Homo sapiens
gggccctggctttcctgttctt

SEQ ID NO: 9213072 - DNA, 18 bp, Homo sapiens
gggccctggcgtccgccc

SEQ ID NO: 9213073 - DNA, 22 bp, Homo sapiens
cagagcaggaatagggtgttga

SEQ ID NO: 9213074 - DNA, 22 bp, Homo sapiens
cagagcagcagagcttccatgg

SEQ ID NO: 9213075 - DNA, 22 bp, Homo sapiens
cagagcagcctccagggggagc

SEQ ID NO: 9213076 - DNA, 22 bp, Homo sapiens
cagagcagcctccagggggagc

SEQ ID NO: 9213077 - DNA, 23 bp, Homo sapiens
cagaagcacctgttgactgctgc

SEQ ID NO: 9213078 - DNA, 23 bp, Homo sapiens
cagaagcacctgttgactgctgc

SEQ ID NO: 9213079 - DNA, 22 bp, Homo sapiens
cagaagcagattctaaagcaag

SEQ ID NO: 9213080 - DNA, 22 bp, Homo sapiens
cagaagcagattctaaagcaag

SEQ ID NO: 9213081 - DNA, 22 bp, Homo sapiens
cagaagcactaggaggaaacgt

SEQ ID NO: 9213082 - DNA, 22 bp, Homo sapiens
cagaagagtagctgaacaagtt

SEQ ID NO: 9213083 - DNA, 22 bp, Homo sapiens
cagaagatgctttgtaaaatga

SEQ ID NO: 9213084 - DNA, 22 bp, Homo sapiens
cagaagcaaatgccttgctgag

SEQ ID NO: 9213085 - DNA, 22 bp, Homo sapiens
cagaagcaagggccaaagtctt

SEQ ID NO: 9213086 - DNA, 22 bp, Homo sapiens
cagaagcaagggccaaagtctt

SEQ ID NO: 9213087 - DNA, 22 bp, Homo sapiens
cagaagcaagtagtgattcttt

SEQ ID NO: 9213088 - DNA, 22 bp, Homo sapiens
cagaagcaagagccggagctag

SEQ ID NO: 9213089 - DNA, 22 bp, Homo sapiens
cagagagagtcaaatctttgct

SEQ ID NO: 9213090 - DNA, 22 bp, Homo sapiens
cagagagagtcaaatctttgct

SEQ ID NO: 9213091 - DNA, 22 bp, Homo sapiens
cagagagaggggctgcctggcc

SEQ ID NO: 9213092 - DNA, 22 bp, Homo sapiens
cagagagaatcttggcagctga

SEQ ID NO: 9213093 - DNA, 22 bp, Homo sapiens
gggggaggtgaatgcaataagg

SEQ ID NO: 9213094 - DNA, 22 bp, Homo sapiens
cagaggaagttccttgatgaga

SEQ ID NO: 9213095 - DNA, 22 bp, Homo sapiens
cagaggaaggctctgggaatgt

SEQ ID NO: 9213096 - DNA, 22 bp, Homo sapiens
cagaggaagctgggtgtggagt

SEQ ID NO: 9213097 - DNA, 22 bp, Homo sapiens
gggggcaggtctggaactttga

SEQ ID NO: 9213098 - DNA, 22 bp, Homo sapiens
gggggatgctcaggaggctgct

SEQ ID NO: 9213099 - DNA, 22 bp, Homo sapiens
gggggcagtaacctcaaagtgt

SEQ ID NO: 9213100 - DNA, 22 bp, Homo sapiens
cagaggcaggaagatgggcagt

SEQ ID NO: 9213101 - DNA, 22 bp, Homo sapiens
cagagctttgtgtcagggctgt

SEQ ID NO: 9213102 - DNA, 22 bp, Homo sapiens
cagaggaaatgggaaggagata

SEQ ID NO: 9213103 - DNA, 22 bp, Homo sapiens
cagaggaagagatacaagccct

SEQ ID NO: 9213104 - DNA, 20 bp, Homo sapiens
gggctctgcatccatcagcc

SEQ ID NO: 9213105 - DNA, 20 bp, Homo sapiens
gggctctgcatccatcagcc

SEQ ID NO: 9213106 - DNA, 21 bp, Homo sapiens
gggctctgccctcctggagct

SEQ ID NO: 9213107 - DNA, 22 bp, Homo sapiens
gggctctgcctggctgggagta

SEQ ID NO: 9213108 - DNA, 22 bp, Homo sapiens
gggctctgcgctcagctccagc

SEQ ID NO: 9213109 - DNA, 22 bp, Homo sapiens
cagagctgtcatttgccagtga

SEQ ID NO: 9213110 - DNA, 22 bp, Homo sapiens
cagagcttctgacagctgctgc

SEQ ID NO: 9213111 - DNA, 22 bp, Homo sapiens
cagagcttcctgctgggcttct

SEQ ID NO: 9213112 - DNA, 22 bp, Homo sapiens
gggctcaggcctggcctctcac

SEQ ID NO: 9213113 - DNA, 22 bp, Homo sapiens
cagcagaagtccgactccagtc

SEQ ID NO: 9213114 - DNA, 21 bp, Homo sapiens
cagcagaagcatctatggaag

SEQ ID NO: 9213115 - DNA, 22 bp, Homo sapiens
ggtgtctgcttccctccagctg

SEQ ID NO: 9213116 - DNA, 22 bp, Homo sapiens
gtaaacatcagccactctattt

SEQ ID NO: 9213117 - DNA, 22 bp, Homo sapiens
gtaactaggggcatggacacat

SEQ ID NO: 9213118 - DNA, 22 bp, Homo sapiens
gtaacattctagaaacttaaca

SEQ ID NO: 9213119 - DNA, 22 bp, Homo sapiens
gtaacatttacagttcctagag

SEQ ID NO: 9213120 - DNA, 22 bp, Homo sapiens
gtaactttggatttagggtacc

SEQ ID NO: 9213121 - DNA, 22 bp, Homo sapiens
ggtggcagtcttaagagatctt

SEQ ID NO: 9213122 - DNA, 22 bp, Homo sapiens
ggtggcagtcttaagagatctt

SEQ ID NO: 9213123 - DNA, 22 bp, Homo sapiens
ggtggcagggagtgtccctggg

SEQ ID NO: 9213124 - DNA, 22 bp, Homo sapiens
ggtggcagggagtgtccctggg

SEQ ID NO: 9213125 - DNA, 22 bp, Homo sapiens
cagatggattttgtaggctgat

SEQ ID NO: 9213126 - DNA, 22 bp, Homo sapiens
ggtggctgcttcctcaagagga

SEQ ID NO: 9213127 - DNA, 22 bp, Homo sapiens
ggtgggaaggggccagtgtgcg

SEQ ID NO: 9213128 - DNA, 22 bp, Homo sapiens
ggtgggaaggccactgaaggtt

SEQ ID NO: 9213129 - DNA, 22 bp, Homo sapiens
cagcagaagcaacattcaggct

SEQ ID NO: 9213130 - DNA, 22 bp, Homo sapiens
cagaggctgatgtgggatgggc

SEQ ID NO: 9213131 - DNA, 21 bp, Homo sapiens
cagaggctgagagggcaatct

SEQ ID NO: 9213132 - DNA, 22 bp, Homo sapiens
ggggtagggtgattgtgaagta

SEQ ID NO: 9213133 - DNA, 22 bp, Homo sapiens
cagaggctgctctgggtggcat

SEQ ID NO: 9213134 - DNA, 22 bp, Homo sapiens
cagagtggtgcaagggcagtgt

SEQ ID NO: 9213135 - DNA, 22 bp, Homo sapiens
ggggtcctggaggccagctgga

SEQ ID NO: 9213136 - DNA, 22 bp, Homo sapiens
ggggtcctcggagcctgggtct

SEQ ID NO: 9213137 - DNA, 22 bp, Homo sapiens
ggggtcctcggagcctgggtct

SEQ ID NO: 9213138 - DNA, 22 bp, Homo sapiens
ggggtcctggaggccagctgga

SEQ ID NO: 9213139 - DNA, 22 bp, Homo sapiens
ggtgcagaaggaagggagctgg

SEQ ID NO: 9213140 - DNA, 22 bp, Homo sapiens
ggtgcagctggacagagaagcc

SEQ ID NO: 9213141 - DNA, 22 bp, Homo sapiens
ggtgcagcctccccagtgacag

SEQ ID NO: 9213142 - DNA, 20 bp, Homo sapiens
cagatgctggatcttggtcc

SEQ ID NO: 9213143 - DNA, 22 bp, Homo sapiens
cagataaaattaatattaccaa

SEQ ID NO: 9213144 - DNA, 22 bp, Homo sapiens
cagataggaaagggcatcccag

SEQ ID NO: 9213145 - DNA, 22 bp, Homo sapiens
cagatagcaaatgggtaagcta

SEQ ID NO: 9213146 - DNA, 22 bp, Homo sapiens
cagatagcaatttgggcagggg

SEQ ID NO: 9213147 - DNA, 22 bp, Homo sapiens
cagatagcgtttgagagcataa

SEQ ID NO: 9213148 - DNA, 22 bp, Homo sapiens
gtgcatggggagggaagcgctc

SEQ ID NO: 9213149 - DNA, 22 bp, Homo sapiens
gtgcatggtaagatgcttcaca

SEQ ID NO: 9213150 - DNA, 22 bp, Homo sapiens
gtgcctgggggtaatgtaggat

SEQ ID NO: 9213151 - DNA, 22 bp, Homo sapiens
gtgcctgggacttgctccggat

SEQ ID NO: 9213152 - DNA, 19 bp, Homo sapiens
cagcctcaatccctcgggc

SEQ ID NO: 9213153 - DNA, 22 bp, Homo sapiens
cagccctttccttctcagcttt

SEQ ID NO: 9213154 - DNA, 22 bp, Homo sapiens
cagcccttaagagtcatccctc

SEQ ID NO: 9213155 - DNA, 22 bp, Homo sapiens
cagccctgtgctaagcaccctc

SEQ ID NO: 9213156 - DNA, 22 bp, Homo sapiens
cagcccttgcgacaccctggct

SEQ ID NO: 9213157 - DNA, 22 bp, Homo sapiens
gtgcctggggttgagctatgaa

SEQ ID NO: 9213158 - DNA, 22 bp, Homo sapiens
gtgcctgtaagggcaggtttct

SEQ ID NO: 9213159 - DNA, 22 bp, Homo sapiens
cagctcccagaactgaccatgt

SEQ ID NO: 9213160 - DNA, 22 bp, Homo sapiens
cagctccagctctgggcgcctc

SEQ ID NO: 9213161 - DNA, 22 bp, Homo sapiens
cagctcagcttcctgggtgtgt

SEQ ID NO: 9213162 - DNA, 22 bp, Homo sapiens
cagctccagcccaggcagctcc

SEQ ID NO: 9213163 - DNA, 22 bp, Homo sapiens
cagctccagcccaggcagctcc

SEQ ID NO: 9213164 - DNA, 22 bp, Homo sapiens
cagctccacttgagtggggcct

SEQ ID NO: 9213165 - DNA, 21 bp, Homo sapiens
cagctccactaaagcagctgt

SEQ ID NO: 9213166 - DNA, 22 bp, Homo sapiens
cagctctgaggaacactccttt

SEQ ID NO: 9213167 - DNA, 22 bp, Homo sapiens
cagctcctcacgagtcttgaaa

SEQ ID NO: 9213168 - DNA, 22 bp, Homo sapiens
cagctcctctgttagccctggg

SEQ ID NO: 9213169 - DNA, 22 bp, Homo sapiens
cagctcctatgagtatgattcc

SEQ ID NO: 9213170 - DNA, 22 bp, Homo sapiens
gtgcagcagggggaagacagtg

SEQ ID NO: 9213171 - DNA, 22 bp, Homo sapiens
gtgcaggagcaggagccatgtc

SEQ ID NO: 9213172 - DNA, 22 bp, Homo sapiens
gtgaatggggcaggaaggatgg

SEQ ID NO: 9213173 - DNA, 22 bp, Homo sapiens
gtctttggagaggtgccatttc

SEQ ID NO: 9213174 - DNA, 22 bp, Homo sapiens
gtgaagtggagtggtatggttt

SEQ ID NO: 9213175 - DNA, 22 bp, Homo sapiens
gtctctgggttaagcagtgcat

SEQ ID NO: 9213176 - DNA, 22 bp, Homo sapiens
gtctctggctttatgctggttt

SEQ ID NO: 9213177 - DNA, 22 bp, Homo sapiens
gtctctgggtgtgtgatgccaa

SEQ ID NO: 9213178 - DNA, 22 bp, Homo sapiens
gtctccagaagcctagacagcc

SEQ ID NO: 9213179 - DNA, 22 bp, Homo sapiens
gtctccacagcccagctgccac

SEQ ID NO: 9213180 - DNA, 22 bp, Homo sapiens
cagcatgacagtctgcagcaga

SEQ ID NO: 9213181 - DNA, 22 bp, Homo sapiens
cagcatgcaagtccagatgtgg

SEQ ID NO: 9213182 - DNA, 22 bp, Homo sapiens
cagcatgcagcccctggcagct

SEQ ID NO: 9213183 - DNA, 22 bp, Homo sapiens
cagcatgcattttctctctttg

SEQ ID NO: 9213184 - DNA, 22 bp, Homo sapiens
cagcatgcaggggcctgagcac

SEQ ID NO: 9213185 - DNA, 22 bp, Homo sapiens
gtctcaaactcctaggctaaag

SEQ ID NO: 9213186 - DNA, 20 bp, Homo sapiens
gtctcaagtatctcacagtc

SEQ ID NO: 9213187 - DNA, 22 bp, Homo sapiens
gtcctctgtgtaggctgcagac

SEQ ID NO: 9213188 - DNA, 22 bp, Homo sapiens
gtcctaccatgaattcactcca

SEQ ID NO: 9213189 - DNA, 22 bp, Homo sapiens
gtcctaatctcttcttataagg

SEQ ID NO: 9213190 - DNA, 22 bp, Homo sapiens
gtcctgaatgcctttaggcaga

SEQ ID NO: 9213191 - DNA, 22 bp, Homo sapiens
gtcctgagatgtcacaaggttt

SEQ ID NO: 9213192 - DNA, 22 bp, Homo sapiens
gtcctgaggcaggatgggtttc

SEQ ID NO: 9213193 - DNA, 22 bp, Homo sapiens
cagcagtcacacaaactctgga

SEQ ID NO: 9213194 - DNA, 22 bp, Homo sapiens
cagcagtgacaagactaagaag

SEQ ID NO: 9213195 - DNA, 22 bp, Homo sapiens
cagcagtggaactacccaggga

SEQ ID NO: 9213196 - DNA, 20 bp, Homo sapiens
cagcagagacccatggggag

SEQ ID NO: 9213197 - DNA, 22 bp, Homo sapiens
cagcagagcatttggtaggagg

SEQ ID NO: 9213198 - DNA, 22 bp, Homo sapiens
gaggaagcagggcttggctgag

SEQ ID NO: 9213199 - DNA, 22 bp, Homo sapiens
gaggaagccccattgaagccag

SEQ ID NO: 9213200 - DNA, 22 bp, Homo sapiens
gaggaagctgcgtggcatttca

SEQ ID NO: 9213201 - DNA, 22 bp, Homo sapiens
gaggaagcagggcttggctgag

SEQ ID NO: 9213202 - DNA, 22 bp, Homo sapiens
gaggaagccccattgaagccag

SEQ ID NO: 9213203 - DNA, 22 bp, Homo sapiens
gagctttgcattattcagaagc

SEQ ID NO: 9213204 - DNA, 22 bp, Homo sapiens
gagctttgctggaagcctgggg

SEQ ID NO: 9213205 - DNA, 22 bp, Homo sapiens
gagctttgcctaaaactagaat

SEQ ID NO: 9213206 - DNA, 22 bp, Homo sapiens
gagctttgctggaagcctgggg

SEQ ID NO: 9213207 - DNA, 22 bp, Homo sapiens
gagctttggggaagaatacaga

SEQ ID NO: 9213208 - DNA, 22 bp, Homo sapiens
gagctttgtcccttgggggctc

SEQ ID NO: 9213209 - DNA, 22 bp, Homo sapiens
gagctttgtagcaggaaggaag

SEQ ID NO: 9213210 - DNA, 22 bp, Homo sapiens
gagctttggtgccaagtatttg

SEQ ID NO: 9213211 - DNA, 22 bp, Homo sapiens
gagctttgtaaaaaacttgcac

SEQ ID NO: 9213212 - DNA, 22 bp, Homo sapiens
gagctttgttccgtggtggcac

SEQ ID NO: 9213213 - DNA, 22 bp, Homo sapiens
gagctttgtgctggtaggtggt

SEQ ID NO: 9213214 - DNA, 22 bp, Homo sapiens
gagctttgtctcctggagaccc

SEQ ID NO: 9213215 - DNA, 22 bp, Homo sapiens
gagcttggtgctgcctgttgtc

SEQ ID NO: 9213216 - DNA, 22 bp, Homo sapiens
gagcttggtgttatttctgtgg

SEQ ID NO: 9213217 - DNA, 22 bp, Homo sapiens
gagctttgatcgctaagcctca

SEQ ID NO: 9213218 - DNA, 22 bp, Homo sapiens
gagcttggtgctgcctgttgtc

SEQ ID NO: 9213219 - DNA, 22 bp, Homo sapiens
gagctttgagattcttatggta

SEQ ID NO: 9213220 - DNA, 22 bp, Homo sapiens
gagcttggggcatatggtgcta

SEQ ID NO: 9213221 - DNA, 22 bp, Homo sapiens
gagcttgggtgccatgctgagc

SEQ ID NO: 9213222 - DNA, 22 bp, Homo sapiens
gagcttggtgatgcctcctggt

SEQ ID NO: 9213223 - DNA, 22 bp, Homo sapiens
gagcttggtgcacagtggttaa

SEQ ID NO: 9213224 - DNA, 22 bp, Homo sapiens
gagcttggtgcacagtggttaa

SEQ ID NO: 9213225 - DNA, 22 bp, Homo sapiens
gagcttggtgatgcctcctggt

SEQ ID NO: 9213226 - DNA, 22 bp, Homo sapiens
gagctctgctactcaaagtatg

SEQ ID NO: 9213227 - DNA, 22 bp, Homo sapiens
gagctctggacgaggggagtgg

SEQ ID NO: 9213228 - DNA, 22 bp, Homo sapiens
gagctctggcagggcaggtctg

SEQ ID NO: 9213229 - DNA, 22 bp, Homo sapiens
gagctctgtacacagagggtgt

SEQ ID NO: 9213230 - DNA, 22 bp, Homo sapiens
gagctctgggtggcaggtgtct

SEQ ID NO: 9213231 - DNA, 22 bp, Homo sapiens
atgtaacaaatggtatacatgt

SEQ ID NO: 9213232 - DNA, 22 bp, Homo sapiens
atgtaacattgaattatatagt

SEQ ID NO: 9213233 - DNA, 22 bp, Homo sapiens
atgtaacacccacttttatagc

SEQ ID NO: 9213234 - DNA, 22 bp, Homo sapiens
atgtaatttatgttatccataa

SEQ ID NO: 9213235 - DNA, 22 bp, Homo sapiens
atgtaatttatgttatccataa

SEQ ID NO: 9213236 - DNA, 21 bp, Homo sapiens
atgtcaaatgctttattttat

SEQ ID NO: 9213237 - DNA, 22 bp, Homo sapiens
atgtacaatctatcacaagaag

SEQ ID NO: 9213238 - DNA, 22 bp, Homo sapiens
atgtacaatctatcacaagaag

SEQ ID NO: 9213239 - DNA, 22 bp, Homo sapiens
atgtacaaaatgttttgaaatg

SEQ ID NO: 9213240 - DNA, 22 bp, Homo sapiens
gagcagctagataaagcccttc

SEQ ID NO: 9213241 - DNA, 22 bp, Homo sapiens
gagcagctaaaattctcatgca

SEQ ID NO: 9213242 - DNA, 22 bp, Homo sapiens
gagcacagggaatagacagata

SEQ ID NO: 9213243 - DNA, 22 bp, Homo sapiens
gagcagctcagaggactagtgt

SEQ ID NO: 9213244 - DNA, 22 bp, Homo sapiens
gagcagctcaggcacttagcca

SEQ ID NO: 9213245 - DNA, 22 bp, Homo sapiens
gagcagctccagccgcatgact

SEQ ID NO: 9213246 - DNA, 22 bp, Homo sapiens
gagcagctccagccgcatgact

SEQ ID NO: 9213247 - DNA, 22 bp, Homo sapiens
gagcagctcgagaaggaagcag

SEQ ID NO: 9213248 - DNA, 22 bp, Homo sapiens
gagaggtggaggttgcagtgag

SEQ ID NO: 9213249 - DNA, 22 bp, Homo sapiens
gagaggaagccttctgtacttg

SEQ ID NO: 9213250 - DNA, 22 bp, Homo sapiens
gagaggctggcagtgccaggtt

SEQ ID NO: 9213251 - DNA, 22 bp, Homo sapiens
gagaggctgaaatcacaggagc

SEQ ID NO: 9213252 - DNA, 22 bp, Homo sapiens
gagccttcatcgcagccttgtt

SEQ ID NO: 9213253 - DNA, 23 bp, Homo sapiens
gagctctgcactaggccctggga

SEQ ID NO: 9213254 - DNA, 22 bp, Homo sapiens
gagcctggcctcctgcctcagc

SEQ ID NO: 9213255 - DNA, 22 bp, Homo sapiens
gagcctgggtccttccctggga

SEQ ID NO: 9213256 - DNA, 22 bp, Homo sapiens
gagcctgggtccttccctggga

SEQ ID NO: 9213257 - DNA, 22 bp, Homo sapiens
gagcctggggaccctcctgagt

SEQ ID NO: 9213258 - DNA, 22 bp, Homo sapiens
gagcctgggactgggggtcatg

SEQ ID NO: 9213259 - DNA, 22 bp, Homo sapiens
gagcagggagacaactctggtg

SEQ ID NO: 9213260 - DNA, 19 bp, Homo sapiens
gagcagctgcacccattga

SEQ ID NO: 9213261 - DNA, 22 bp, Homo sapiens
gagcagctgagctggaatgaga

SEQ ID NO: 9213262 - DNA, 22 bp, Homo sapiens
gagcagctctgggtgacccagt

SEQ ID NO: 9213263 - DNA, 22 bp, Homo sapiens
gagcagctctgtgcctggagac

SEQ ID NO: 9213264 - DNA, 22 bp, Homo sapiens
gagcagctctgtgcctggagac

SEQ ID NO: 9213265 - DNA, 22 bp, Homo sapiens
gagcagggcttgtcctcctcat

SEQ ID NO: 9213266 - DNA, 22 bp, Homo sapiens
gagcagtaggagaaccctgagc

SEQ ID NO: 9213267 - DNA, 22 bp, Homo sapiens
gagcctggattgtcaccgactt

SEQ ID NO: 9213268 - DNA, 22 bp, Homo sapiens
gatcgagttgtttgttctgggg

SEQ ID NO: 9213269 - DNA, 22 bp, Homo sapiens
atgtttcatccactggcctttc

SEQ ID NO: 9213270 - DNA, 22 bp, Homo sapiens
atgtttcaatgcactttagcct

SEQ ID NO: 9213271 - DNA, 21 bp, Homo sapiens
gagtgcaggtctgatgccatc

SEQ ID NO: 9213272 - DNA, 21 bp, Homo sapiens
gagtgcaggtctgatgccatc

SEQ ID NO: 9213273 - DNA, 22 bp, Homo sapiens
gagtgcagatgaacagaagatt

SEQ ID NO: 9213274 - DNA, 23 bp, Homo sapiens
gagtgcagaatagacatgcagtg

SEQ ID NO: 9213275 - DNA, 22 bp, Homo sapiens
gagtccaggctggtcaaatagc

SEQ ID NO: 9213276 - DNA, 22 bp, Homo sapiens
gaggccacagtcctgaggcatc

SEQ ID NO: 9213277 - DNA, 22 bp, Homo sapiens
gaggctgtgtgtccctctggac

SEQ ID NO: 9213278 - DNA, 22 bp, Homo sapiens
gaggccacattacttggtgggt

SEQ ID NO: 9213279 - DNA, 22 bp, Homo sapiens
gaggccacagtcctgaggcatc

SEQ ID NO: 9213280 - DNA, 22 bp, Homo sapiens
gaggccacagtgtctgggggcc

SEQ ID NO: 9213281 - DNA, 22 bp, Homo sapiens
gaggccacagtcagtgttcatc

SEQ ID NO: 9213282 - DNA, 22 bp, Homo sapiens
gaggccaaggtgggcagatcac

SEQ ID NO: 9213283 - DNA, 22 bp, Homo sapiens
gaggccaactttggagaacagg

SEQ ID NO: 9213284 - DNA, 22 bp, Homo sapiens
gaggccacagctatcagggaca

SEQ ID NO: 9213285 - DNA, 22 bp, Homo sapiens
gaggccaagttggagaccaggt

SEQ ID NO: 9213286 - DNA, 22 bp, Homo sapiens
gaggccaaggtgggcagatcac

SEQ ID NO: 9213287 - DNA, 22 bp, Homo sapiens
gaggcttctgtaaccctgtcct

SEQ ID NO: 9213288 - DNA, 22 bp, Homo sapiens
gaggcttcccgcccatgctgga

SEQ ID NO: 9213289 - DNA, 22 bp, Homo sapiens
gagggatggtagttgacactga

SEQ ID NO: 9213290 - DNA, 22 bp, Homo sapiens
gagggcaagagttggaaacggt

SEQ ID NO: 9213291 - DNA, 22 bp, Homo sapiens
gagggcaaaacagagaagatgt

SEQ ID NO: 9213292 - DNA, 22 bp, Homo sapiens
gaggtaggctgtgaaagggggt

SEQ ID NO: 9213293 - DNA, 22 bp, Homo sapiens
gaggttggggctgcagtgagct

SEQ ID NO: 9213294 - DNA, 22 bp, Homo sapiens
gaggttggggctgcagtgagct

SEQ ID NO: 9213295 - DNA, 22 bp, Homo sapiens
gaggtaggcagggtgacttggc

SEQ ID NO: 9213296 - DNA, 22 bp, Homo sapiens
gaggtagggaagacaaatatgc

SEQ ID NO: 9213297 - DNA, 22 bp, Homo sapiens
gaggttggtgaggggacacggt

SEQ ID NO: 9213298 - DNA, 17 bp, Homo sapiens
gaggtaggaagtgagtc

SEQ ID NO: 9213299 - DNA, 22 bp, Homo sapiens
gagggggctctgccaacctgtc

SEQ ID NO: 9213300 - DNA, 22 bp, Homo sapiens
gagggcactgggtttcaatgtc

SEQ ID NO: 9213301 - DNA, 22 bp, Homo sapiens
atgccacttcattccagcctcg

SEQ ID NO: 9213302 - DNA, 22 bp, Homo sapiens
atgccccaggaggtgccatcca

SEQ ID NO: 9213303 - DNA, 22 bp, Homo sapiens
atgccccaggaggtgccatcca

SEQ ID NO: 9213304 - DNA, 22 bp, Homo sapiens
atgccccagtgtgtgcttcctt

SEQ ID NO: 9213305 - DNA, 22 bp, Homo sapiens
atgcctgccatttagaagtctt

SEQ ID NO: 9213306 - DNA, 22 bp, Homo sapiens
atgcctgcttactccaggtgct

SEQ ID NO: 9213307 - DNA, 22 bp, Homo sapiens
atgcctgcttactccaggtgct

SEQ ID NO: 9213308 - DNA, 22 bp, Homo sapiens
atgcctggactgacatgcactg

SEQ ID NO: 9213309 - DNA, 22 bp, Homo sapiens
gaagcactgcatttcaagatca

SEQ ID NO: 9213310 - DNA, 22 bp, Homo sapiens
gaagcagagcctaaggcagaca

SEQ ID NO: 9213311 - DNA, 22 bp, Homo sapiens
gaagcaatgtgttttcaacatt

SEQ ID NO: 9213312 - DNA, 22 bp, Homo sapiens
gacagggaggaaagagactgct

SEQ ID NO: 9213313 - DNA, 22 bp, Homo sapiens
atgctttagtgtcaagtttggg

SEQ ID NO: 9213314 - DNA, 22 bp, Homo sapiens
gacataaaattcaataatttgt

SEQ ID NO: 9213315 - DNA, 21 bp, Homo sapiens
gactttcttaccagatttttg

SEQ ID NO: 9213316 - DNA, 22 bp, Homo sapiens
gactttgaacagtgtatcagta

SEQ ID NO: 9213317 - DNA, 20 bp, Homo sapiens
atgctttcttgtgtgctgct

SEQ ID NO: 9213318 - DNA, 22 bp, Homo sapiens
atgctttcttctttcctgtaag

SEQ ID NO: 9213319 - DNA, 22 bp, Homo sapiens
gaccctctagatggaagcactg

SEQ ID NO: 9213320 - DNA, 22 bp, Homo sapiens
gactttccaggtcctgggctat

SEQ ID NO: 9213321 - DNA, 22 bp, Homo sapiens
gaccccaggcagatcagggggt

SEQ ID NO: 9213322 - DNA, 22 bp, Homo sapiens
gaccctccactcactgctgtgt

SEQ ID NO: 9213323 - DNA, 22 bp, Homo sapiens
gaccctccactcactgctgtgt

SEQ ID NO: 9213324 - DNA, 22 bp, Homo sapiens
gaaatctttgccttagctgtgt

SEQ ID NO: 9213325 - DNA, 22 bp, Homo sapiens
atgaggcatgtgaggagaaggg

SEQ ID NO: 9213326 - DNA, 22 bp, Homo sapiens
atgaggcatagcagggatcgga

SEQ ID NO: 9213327 - DNA, 22 bp, Homo sapiens
atgcacaagaggctagaaaaga

SEQ ID NO: 9213328 - DNA, 18 bp, Homo sapiens
atgcaagctatggatttg

SEQ ID NO: 9213329 - DNA, 22 bp, Homo sapiens
gaagaaactgaaaggggttggt

SEQ ID NO: 9213330 - DNA, 22 bp, Homo sapiens
gaagaaacaggggcttggggag

SEQ ID NO: 9213331 - DNA, 22 bp, Homo sapiens
gaagaaagattggcatgcttca

SEQ ID NO: 9213332 - DNA, 22 bp, Homo sapiens
gaactttaggattttcacaggt

SEQ ID NO: 9213333 - DNA, 22 bp, Homo sapiens
gaactttatcaaaagttgttta

SEQ ID NO: 9213334 - DNA, 22 bp, Homo sapiens
gaacatttccagaaaggaacta

SEQ ID NO: 9213335 - DNA, 22 bp, Homo sapiens
gaacatttgatgatgacattgg

SEQ ID NO: 9213336 - DNA, 22 bp, Homo sapiens
gaacatttatgatgcaatacct

SEQ ID NO: 9213337 - DNA, 22 bp, Homo sapiens
gaacattactgcttgggagagg

SEQ ID NO: 9213338 - DNA, 22 bp, Homo sapiens
gaacattattgtacaaatgtct

SEQ ID NO: 9213339 - DNA, 22 bp, Homo sapiens
ctttttccagcttcagggtggg

SEQ ID NO: 9213340 - DNA, 19 bp, Homo sapiens
gaaaacatgggtgagggtc

SEQ ID NO: 9213341 - DNA, 22 bp, Homo sapiens
gaaaactattggcctagaacaa

SEQ ID NO: 9213342 - DNA, 22 bp, Homo sapiens
gaaaactaacggaaaagttagg

SEQ ID NO: 9213343 - DNA, 22 bp, Homo sapiens
gaaaagaactgcatgggattaa

SEQ ID NO: 9213344 - DNA, 22 bp, Homo sapiens
gaaaacttggatctctagaatg

SEQ ID NO: 9213345 - DNA, 22 bp, Homo sapiens
atgaagcagcgttgtagagtga

SEQ ID NO: 9213346 - DNA, 22 bp, Homo sapiens
atcttcaattgaaaactagcct

SEQ ID NO: 9213347 - DNA, 22 bp, Homo sapiens
atcttcaaggaaaaaatacagt

SEQ ID NO: 9213348 - DNA, 22 bp, Homo sapiens
atcttcaagggaagaaagagta

SEQ ID NO: 9213349 - DNA, 22 bp, Homo sapiens
atcttcaactcagagagtgctg

SEQ ID NO: 9213350 - DNA, 22 bp, Homo sapiens
atcttcaaagggatgtccatgg

SEQ ID NO: 9213351 - DNA, 22 bp, Homo sapiens
gcaggctgtgaggctcagatgg

SEQ ID NO: 9213352 - DNA, 22 bp, Homo sapiens
gcaggctgtgaggctcagatgg

SEQ ID NO: 9213353 - DNA, 22 bp, Homo sapiens
gcaggctgtctaaagttagagt

SEQ ID NO: 9213354 - DNA, 22 bp, Homo sapiens
gcaggctgtgaggctcagatgg

SEQ ID NO: 9213355 - DNA, 22 bp, Homo sapiens
gcaggctgtctaaagttagagt

SEQ ID NO: 9213356 - DNA, 22 bp, Homo sapiens
gcaggctgtctaaagttagagt

SEQ ID NO: 9213357 - DNA, 22 bp, Homo sapiens
gcaggctgtagacaccaaacta

SEQ ID NO: 9213358 - DNA, 22 bp, Homo sapiens
gcaggctgtctaaagttagagt

SEQ ID NO: 9213359 - DNA, 22 bp, Homo sapiens
gcaggctgtagacaccaaacta

SEQ ID NO: 9213360 - DNA, 22 bp, Homo sapiens
gcaggctggtctgaccatccct

SEQ ID NO: 9213361 - DNA, 22 bp, Homo sapiens
gcaggctgtggtatgttgggca

SEQ ID NO: 9213362 - DNA, 22 bp, Homo sapiens
gcaggctgtggtatgttgggca

SEQ ID NO: 9213363 - DNA, 22 bp, Homo sapiens
gcaggctgtggtatgttgggca

SEQ ID NO: 9213364 - DNA, 22 bp, Homo sapiens
gcagggactttggcaacaggtg

SEQ ID NO: 9213365 - DNA, 22 bp, Homo sapiens
gcagggaggaagagatgcttcc

SEQ ID NO: 9213366 - DNA, 22 bp, Homo sapiens
gcagggagggcctttcatgaca

SEQ ID NO: 9213367 - DNA, 22 bp, Homo sapiens
gcaggatgagtgagtacattta

SEQ ID NO: 9213368 - DNA, 22 bp, Homo sapiens
gcaggatggtggaaggcctgct

SEQ ID NO: 9213369 - DNA, 22 bp, Homo sapiens
gcaggatgggtgtagcccagca

SEQ ID NO: 9213370 - DNA, 22 bp, Homo sapiens
gcaggagcagtcaggggcagct

SEQ ID NO: 9213371 - DNA, 22 bp, Homo sapiens
gcaggagcaaactgcagtgtgg

SEQ ID NO: 9213372 - DNA, 22 bp, Homo sapiens
gcaggagcaatggcctatcaga

SEQ ID NO: 9213373 - DNA, 22 bp, Homo sapiens
attggtggtgaggacatgccag

SEQ ID NO: 9213374 - DNA, 22 bp, Homo sapiens
attgtaaaagtattctaagatt

SEQ ID NO: 9213375 - DNA, 22 bp, Homo sapiens
attgtaaaagtattctaagatt

SEQ ID NO: 9213376 - DNA, 22 bp, Homo sapiens
attgtaaagtactgtgtacaat

SEQ ID NO: 9213377 - DNA, 22 bp, Homo sapiens
gcaggggttttctgacttgagt

SEQ ID NO: 9213378 - DNA, 22 bp, Homo sapiens
gcaggggtagtgtcttcctgag

SEQ ID NO: 9213379 - DNA, 22 bp, Homo sapiens
gcagggctgggatttgagccca

SEQ ID NO: 9213380 - DNA, 22 bp, Homo sapiens
gcagggaggtttgctgacctgg

SEQ ID NO: 9213381 - DNA, 22 bp, Homo sapiens
attgttatgaaaataagatgtt

SEQ ID NO: 9213382 - DNA, 22 bp, Homo sapiens
gcagtgcattactcacatgttt

SEQ ID NO: 9213383 - DNA, 22 bp, Homo sapiens
gcagtgcagtgggacagggcgc

SEQ ID NO: 9213384 - DNA, 22 bp, Homo sapiens
gcagtgcaggacaaatcagtgc

SEQ ID NO: 9213385 - DNA, 18 bp, Homo sapiens
gcagtgcaggaagaagag

SEQ ID NO: 9213386 - DNA, 22 bp, Homo sapiens
gcagtgcaggaacatagcttct

SEQ ID NO: 9213387 - DNA, 22 bp, Homo sapiens
gcagtgcatgtcggaactcatt

SEQ ID NO: 9213388 - DNA, 22 bp, Homo sapiens
gcagtgcagtgggacagggcgc

SEQ ID NO: 9213389 - DNA, 22 bp, Homo sapiens
gcagtgcattactcacatgttt

SEQ ID NO: 9213390 - DNA, 21 bp, Homo sapiens
gcagtgcagcttggagggtag

SEQ ID NO: 9213391 - DNA, 22 bp, Homo sapiens
attgtaagtagaaatgttatgg

SEQ ID NO: 9213392 - DNA, 22 bp, Homo sapiens
attgtacaatgcctggaacatt

SEQ ID NO: 9213393 - DNA, 19 bp, Homo sapiens
gccactcctgatgctgccc

SEQ ID NO: 9213394 - DNA, 22 bp, Homo sapiens
gccactgattattcagcagaca

SEQ ID NO: 9213395 - DNA, 22 bp, Homo sapiens
gccactgaacattagagctagt

SEQ ID NO: 9213396 - DNA, 22 bp, Homo sapiens
gccacagtcaggacggggagag

SEQ ID NO: 9213397 - DNA, 20 bp, Homo sapiens
gccacagttttctcactgca

SEQ ID NO: 9213398 - DNA, 22 bp, Homo sapiens
gcattcctgagaatgcagagtg

SEQ ID NO: 9213399 - DNA, 16 bp, Homo sapiens
attgttttcaattaga

SEQ ID NO: 9213400 - DNA, 22 bp, Homo sapiens
attgttttccaaagatgctgct

SEQ ID NO: 9213401 - DNA, 22 bp, Homo sapiens
attgttttgtagaatgaccctt

SEQ ID NO: 9213402 - DNA, 22 bp, Homo sapiens
attgttttgtttcccagtgact

SEQ ID NO: 9213403 - DNA, 23 bp, Homo sapiens
attgtttttggctctcagggaat

SEQ ID NO: 9213404 - DNA, 22 bp, Homo sapiens
atttaaatgcttaagagggttt

SEQ ID NO: 9213405 - DNA, 20 bp, Homo sapiens
gccactgggcaccagcaggg

SEQ ID NO: 9213406 - DNA, 22 bp, Homo sapiens
gccactggcgctgtgcagagtg

SEQ ID NO: 9213407 - DNA, 22 bp, Homo sapiens
gccactgtcataccctggcaat

SEQ ID NO: 9213408 - DNA, 22 bp, Homo sapiens
gccactgtcctgtgcctgtgct

SEQ ID NO: 9213409 - DNA, 22 bp, Homo sapiens
attgttttattaaatgagccct

SEQ ID NO: 9213410 - DNA, 22 bp, Homo sapiens
attgttttaattccattgtgaa

SEQ ID NO: 9213411 - DNA, 22 bp, Homo sapiens
gcagaagggaataaggagcttt

SEQ ID NO: 9213412 - DNA, 22 bp, Homo sapiens
gcactgtgacccagagcaggtg

SEQ ID NO: 9213413 - DNA, 22 bp, Homo sapiens
gcagaagtcagaccatctgaat

SEQ ID NO: 9213414 - DNA, 22 bp, Homo sapiens
gcagaagtggattctacaattt

SEQ ID NO: 9213415 - DNA, 22 bp, Homo sapiens
gcagaagtggattctacaattt

SEQ ID NO: 9213416 - DNA, 22 bp, Homo sapiens
gcagaagtacctcgttctagtt

SEQ ID NO: 9213417 - DNA, 22 bp, Homo sapiens
gcagaggcctaggtggaaggcc

SEQ ID NO: 9213418 - DNA, 22 bp, Homo sapiens
gcagaagttaatcgaaggccat

SEQ ID NO: 9213419 - DNA, 22 bp, Homo sapiens
gcagaatacattttgttttcct

SEQ ID NO: 9213420 - DNA, 22 bp, Homo sapiens
gcagaggggaagctgaggaatt

SEQ ID NO: 9213421 - DNA, 19 bp, Homo sapiens
gcagatgatgaggctggtc

SEQ ID NO: 9213422 - DNA, 22 bp, Homo sapiens
gcagatagggtattaggagtaa

SEQ ID NO: 9213423 - DNA, 22 bp, Homo sapiens
gcagaggcctgaaggtggcggg

SEQ ID NO: 9213424 - DNA, 22 bp, Homo sapiens
gcagaggctgggtgtcccagtc

SEQ ID NO: 9213425 - DNA, 22 bp, Homo sapiens
gcagccaggtttgaggaccact

SEQ ID NO: 9213426 - DNA, 17 bp, Homo sapiens
gcagcctcttggtagtg

SEQ ID NO: 9213427 - DNA, 22 bp, Homo sapiens
gcagcctgaggccctttctggc

SEQ ID NO: 9213428 - DNA, 22 bp, Homo sapiens
gcagcctgatgatctgggttgt

SEQ ID NO: 9213429 - DNA, 22 bp, Homo sapiens
gcagcctgttgtaccagcctgt

SEQ ID NO: 9213430 - DNA, 22 bp, Homo sapiens
gcagcctgttgtaccagcctgt

SEQ ID NO: 9213431 - DNA, 22 bp, Homo sapiens
gcagcctgggcaacagagtgag

SEQ ID NO: 9213432 - DNA, 22 bp, Homo sapiens
gcagcctgggcaacagagtgag

SEQ ID NO: 9213433 - DNA, 22 bp, Homo sapiens
gcagccttccgtggacctggac

SEQ ID NO: 9213434 - DNA, 22 bp, Homo sapiens
gcaggagagtctgtgccaggtt

SEQ ID NO: 9213435 - DNA, 19 bp, Homo sapiens
gcagccaggtgctctacct

SEQ ID NO: 9213436 - DNA, 22 bp, Homo sapiens
gcagccagggctaagctgggga

SEQ ID NO: 9213437 - DNA, 22 bp, Homo sapiens
gcagccaggctacagcgggctt

SEQ ID NO: 9213438 - DNA, 21 bp, Homo sapiens
gcagccaggactttgggctgg

SEQ ID NO: 9213439 - DNA, 22 bp, Homo sapiens
atgtttctcactgtttctctat

SEQ ID NO: 9213440 - DNA, 22 bp, Homo sapiens
gcaaacaagctgcctgaagatt

SEQ ID NO: 9213441 - DNA, 22 bp, Homo sapiens
gcaaatgttctatatttgctgt

SEQ ID NO: 9213442 - DNA, 22 bp, Homo sapiens
gcacacaggggagttctcagaa

SEQ ID NO: 9213443 - DNA, 22 bp, Homo sapiens
gcacacagggatttttgaatgg

SEQ ID NO: 9213444 - DNA, 21 bp, Homo sapiens
gcaaccagaccacagggcagt

SEQ ID NO: 9213445 - DNA, 23 bp, Homo sapiens
gcactgggctctcagcaaggtgt

SEQ ID NO: 9213446 - DNA, 22 bp, Homo sapiens
gcactcagtaccaggtcactgc

SEQ ID NO: 9213447 - DNA, 22 bp, Homo sapiens
gcacagggccctgtgcgtaggt

SEQ ID NO: 9213448 - DNA, 22 bp, Homo sapiens
gcacagggaggctggcctggcc

SEQ ID NO: 9213449 - DNA, 22 bp, Homo sapiens
gcacagggcaacaggtctgtta

SEQ ID NO: 9213450 - DNA, 22 bp, Homo sapiens
gcactgtgaatatactagcaaa

SEQ ID NO: 9213451 - DNA, 22 bp, Homo sapiens
gcactgggtgtgaggcagcgtc

SEQ ID NO: 9213452 - DNA, 22 bp, Homo sapiens
gcactgggtgggagatctgaat

SEQ ID NO: 9213453 - DNA, 22 bp, Homo sapiens
gcactgggtgggagatctgaat

SEQ ID NO: 9213454 - DNA, 22 bp, Homo sapiens
gcactgggggcagcagtgaggg

SEQ ID NO: 9213455 - DNA, 22 bp, Homo sapiens
gcactggggtcatagcctccag

SEQ ID NO: 9213456 - DNA, 22 bp, Homo sapiens
gcactggggtcatagcctccag

SEQ ID NO: 9213457 - DNA, 22 bp, Homo sapiens
gcacagaggatgaggcagctct

SEQ ID NO: 9213458 - DNA, 21 bp, Homo sapiens
gcacagggacagatcatcaca

SEQ ID NO: 9213459 - DNA, 22 bp, Homo sapiens
gcacagggagacagccgtggcc

SEQ ID NO: 9213460 - DNA, 20 bp, Homo sapiens
gcacagagatgagcaaagta

SEQ ID NO: 9213461 - DNA, 18 bp, Homo sapiens
gcacagagcccaggctct

SEQ ID NO: 9213462 - DNA, 19 bp, Homo sapiens
gctcagtctcctgattgct

SEQ ID NO: 9213463 - DNA, 22 bp, Homo sapiens
gctcagtctaaagacatgctcc

SEQ ID NO: 9213464 - DNA, 22 bp, Homo sapiens
gctccaggccacggcttcttgg

SEQ ID NO: 9213465 - DNA, 22 bp, Homo sapiens
gctccaggccccagcgttccgc

SEQ ID NO: 9213466 - DNA, 22 bp, Homo sapiens
gctccaggcgagctggaccaga

SEQ ID NO: 9213467 - DNA, 17 bp, Homo sapiens
gctccaggcgtgagtga

SEQ ID NO: 9213468 - DNA, 22 bp, Homo sapiens
gctcaggggaatgggctgccgt

SEQ ID NO: 9213469 - DNA, 22 bp, Homo sapiens
gctcagggtcccttggtgctgg

SEQ ID NO: 9213470 - DNA, 22 bp, Homo sapiens
gctcggccccgacggccggcgg

SEQ ID NO: 9213471 - DNA, 22 bp, Homo sapiens
gctcctggatgttcaagtcggc

SEQ ID NO: 9213472 - DNA, 22 bp, Homo sapiens
gctcctggatgttcaagtcggc

SEQ ID NO: 9213473 - DNA, 22 bp, Homo sapiens
gctccaggctgctctgtcccat

SEQ ID NO: 9213474 - DNA, 22 bp, Homo sapiens
gctccaggctgctctgtcccat

SEQ ID NO: 9213475 - DNA, 22 bp, Homo sapiens
gctctagaaagaaggatgtggg

SEQ ID NO: 9213476 - DNA, 21 bp, Homo sapiens
gcctggctctcactggcctgg

SEQ ID NO: 9213477 - DNA, 22 bp, Homo sapiens
gcctggctcctaaggactggct

SEQ ID NO: 9213478 - DNA, 22 bp, Homo sapiens
gcctggctcctaagagcacaac

SEQ ID NO: 9213479 - DNA, 23 bp, Homo sapiens
gctaaattgaagtctcaggggaa

SEQ ID NO: 9213480 - DNA, 22 bp, Homo sapiens
gctaaatttaagcctttctcct

SEQ ID NO: 9213481 - DNA, 22 bp, Homo sapiens
gctatgttcccttttgctataa

SEQ ID NO: 9213482 - DNA, 22 bp, Homo sapiens
gctacagactgagcatggctct

SEQ ID NO: 9213483 - DNA, 22 bp, Homo sapiens
gctcaaagaatattcagaatga

SEQ ID NO: 9213484 - DNA, 22 bp, Homo sapiens
gctcaaagcactttgcaaatat

SEQ ID NO: 9213485 - DNA, 22 bp, Homo sapiens
gctcaaaggccaggtagcagca

SEQ ID NO: 9213486 - DNA, 22 bp, Homo sapiens
gctcaaaggttgatagctgtgc

SEQ ID NO: 9213487 - DNA, 21 bp, Homo sapiens
gctcaaagggcttgccatgct

SEQ ID NO: 9213488 - DNA, 22 bp, Homo sapiens
caaatcaccacttaatgggtta

SEQ ID NO: 9213489 - DNA, 22 bp, Homo sapiens
gctctgactgagcttcctgcct

SEQ ID NO: 9213490 - DNA, 22 bp, Homo sapiens
gctctgacctggccgccctgct

SEQ ID NO: 9213491 - DNA, 22 bp, Homo sapiens
gctctgggtgaacttggagcaa

SEQ ID NO: 9213492 - DNA, 22 bp, Homo sapiens
gctctgggtgaacttggagcaa

SEQ ID NO: 9213493 - DNA, 15 bp, Homo sapiens
gctctgggtatttga

SEQ ID NO: 9213494 - DNA, 22 bp, Homo sapiens
gctctgggtgaatggcagattg

SEQ ID NO: 9213495 - DNA, 22 bp, Homo sapiens
gctctgggtgaatggcagattg

SEQ ID NO: 9213496 - DNA, 20 bp, Homo sapiens
gctctgggtggtaaatgact

SEQ ID NO: 9213497 - DNA, 22 bp, Homo sapiens
gctctgggtgaagggtaccatt

SEQ ID NO: 9213498 - DNA, 17 bp, Homo sapiens
caaatcctaggatgtct

SEQ ID NO: 9213499 - DNA, 22 bp, Homo sapiens
caaattaccctcaacatctaga

SEQ ID NO: 9213500 - DNA, 22 bp, Homo sapiens
gctctgggttctgatttatgag

SEQ ID NO: 9213501 - DNA, 22 bp, Homo sapiens
gctgagctgggacagtcctggg

SEQ ID NO: 9213502 - DNA, 22 bp, Homo sapiens
gcctggctcacagagcagcctt

SEQ ID NO: 9213503 - DNA, 18 bp, Homo sapiens
attttgaacaatgctgta

SEQ ID NO: 9213504 - DNA, 22 bp, Homo sapiens
attttcttctctccctggctgc

SEQ ID NO: 9213505 - DNA, 22 bp, Homo sapiens
attttacataaggaaggtttaa

SEQ ID NO: 9213506 - DNA, 22 bp, Homo sapiens
gcctgcctagaattgcagcttt

SEQ ID NO: 9213507 - DNA, 22 bp, Homo sapiens
gcctgcctagaattgcagcttt

SEQ ID NO: 9213508 - DNA, 22 bp, Homo sapiens
gcctgccccttcctgggcaggg

SEQ ID NO: 9213509 - DNA, 22 bp, Homo sapiens
atttgattagctgtgtaatttt

SEQ ID NO: 9213510 - DNA, 22 bp, Homo sapiens
atttcttccttctcctagaaga

SEQ ID NO: 9213511 - DNA, 23 bp, Homo sapiens
atttgacagagcatagcatttct

SEQ ID NO: 9213512 - DNA, 22 bp, Homo sapiens
atttgacaacttctggtggcat

SEQ ID NO: 9213513 - DNA, 22 bp, Homo sapiens
atttgacagtgagttgtggatg

SEQ ID NO: 9213514 - DNA, 22 bp, Homo sapiens
atttgacattgacacacctatg

SEQ ID NO: 9213515 - DNA, 22 bp, Homo sapiens
atttgcaattttactttgcagt

SEQ ID NO: 9213516 - DNA, 22 bp, Homo sapiens
attttaaggcttatttaaaggc

SEQ ID NO: 9213517 - DNA, 22 bp, Homo sapiens
atttacatttatttgagaaggt

SEQ ID NO: 9213518 - DNA, 22 bp, Homo sapiens
atttactaatgtcatatcgcgt

SEQ ID NO: 9213519 - DNA, 18 bp, Homo sapiens
gccagagggaagcaggtg

SEQ ID NO: 9213520 - DNA, 18 bp, Homo sapiens
gccagagggaagcaggtg

SEQ ID NO: 9213521 - DNA, 22 bp, Homo sapiens
atttacataatagactttaggt

SEQ ID NO: 9213522 - DNA, 22 bp, Homo sapiens
atttacagtttagcatttcaag

SEQ ID NO: 9213523 - DNA, 22 bp, Homo sapiens
gccagaggggctcgaaggcgcg

SEQ ID NO: 9213524 - DNA, 22 bp, Homo sapiens
gccagaggggctcgaaggcgcg

SEQ ID NO: 9213525 - DNA, 18 bp, Homo sapiens
gccagaggtactactgat

SEQ ID NO: 9213526 - DNA, 18 bp, Homo sapiens
gccagaggtactactgat

SEQ ID NO: 9213527 - DNA, 22 bp, Homo sapiens
gcccagcaggacagagtggttt

SEQ ID NO: 9213528 - DNA, 22 bp, Homo sapiens
gcccagcaggacagagtggttt

SEQ ID NO: 9213529 - DNA, 22 bp, Homo sapiens
gcccagcaggggatggcagctc

SEQ ID NO: 9213530 - DNA, 22 bp, Homo sapiens
gcccagcaggggatggcagctc

SEQ ID NO: 9213531 - DNA, 23 bp, Homo sapiens
gccctgcccttagcacactcaca

SEQ ID NO: 9213532 - DNA, 22 bp, Homo sapiens
gccctcccctctgggtggtgag

SEQ ID NO: 9213533 - DNA, 22 bp, Homo sapiens
gccctcctggcaggcagtgatg

SEQ ID NO: 9213534 - DNA, 23 bp, Homo sapiens
gccctccctcccaggtgggtgtt

SEQ ID NO: 9213535 - DNA, 18 bp, Homo sapiens
agtaggcactgtggggtt

SEQ ID NO: 9213536 - DNA, 22 bp, Homo sapiens
agtagcataaatagtggtagta

SEQ ID NO: 9213537 - DNA, 22 bp, Homo sapiens
agtagcatgtgcacagtaattt

SEQ ID NO: 9213538 - DNA, 22 bp, Homo sapiens
agtagcagtgacagctgaggta

SEQ ID NO: 9213539 - DNA, 20 bp, Homo sapiens
agtagcagtaatatggaaga

SEQ ID NO: 9213540 - DNA, 20 bp, Homo sapiens
agtagcagtgtgacattgac

SEQ ID NO: 9213541 - DNA, 22 bp, Homo sapiens
agtagcagtttggctgaattta

SEQ ID NO: 9213542 - DNA, 22 bp, Homo sapiens
agtagcagtgacagctgaggta

SEQ ID NO: 9213543 - DNA, 22 bp, Homo sapiens
agtagcagaaggtcttgaaggg

SEQ ID NO: 9213544 - DNA, 22 bp, Homo sapiens
agtagcagaaggtcttgaaggg

SEQ ID NO: 9213545 - DNA, 19 bp, Homo sapiens
agtagcagaaagtgcagtg

SEQ ID NO: 9213546 - DNA, 22 bp, Homo sapiens
agtagcagaaggtcttgaaggg

SEQ ID NO: 9213547 - DNA, 22 bp, Homo sapiens
agtagcagagttggactatgca

SEQ ID NO: 9213548 - DNA, 22 bp, Homo sapiens
agtagcagagttggactatgca

SEQ ID NO: 9213549 - DNA, 20 bp, Homo sapiens
agtagcagtaatatggaaga

SEQ ID NO: 9213550 - DNA, 20 bp, Homo sapiens
agtagcagtaatatggaaga

SEQ ID NO: 9213551 - DNA, 23 bp, Homo sapiens
agtcaagatgcatctgtgaggaa

SEQ ID NO: 9213552 - DNA, 22 bp, Homo sapiens
agtcaagattctggcactagca

SEQ ID NO: 9213553 - DNA, 22 bp, Homo sapiens
agtagggagaccggaggccgcc

SEQ ID NO: 9213554 - DNA, 23 bp, Homo sapiens
agtagcacatacagtacttgttc

SEQ ID NO: 9213555 - DNA, 19 bp, Homo sapiens
agtagcagaaagtgcagtg

SEQ ID NO: 9213556 - DNA, 19 bp, Homo sapiens
agtagcagaaagtgcagtg

SEQ ID NO: 9213557 - DNA, 20 bp, Homo sapiens
agtagacaactgcaggtgtg

SEQ ID NO: 9213558 - DNA, 22 bp, Homo sapiens
agtagacatgagcaatgataat

SEQ ID NO: 9213559 - DNA, 22 bp, Homo sapiens
agtagacagacccatggcttta

SEQ ID NO: 9213560 - DNA, 22 bp, Homo sapiens
agtagacagccttgctcctgag

SEQ ID NO: 9213561 - DNA, 22 bp, Homo sapiens
agtagaaagttgcaggaggaat

SEQ ID NO: 9213562 - DNA, 22 bp, Homo sapiens
agtagaaatgtaagaaggatta

SEQ ID NO: 9213563 - DNA, 22 bp, Homo sapiens
agtaaacagtaggaactgagaa

SEQ ID NO: 9213564 - DNA, 20 bp, Homo sapiens
ccttctccagcttgttcttg

SEQ ID NO: 9213565 - DNA, 22 bp, Homo sapiens
ccttctcccctctgcagggtgt

SEQ ID NO: 9213566 - DNA, 21 bp, Homo sapiens
ccttctccattacagtaagct

SEQ ID NO: 9213567 - DNA, 22 bp, Homo sapiens
ccttccagggtttttgccaatc

SEQ ID NO: 9213568 - DNA, 22 bp, Homo sapiens
ccttccaggtgcaggcaagcct

SEQ ID NO: 9213569 - DNA, 22 bp, Homo sapiens
ccttccaggttttggctccatt

SEQ ID NO: 9213570 - DNA, 22 bp, Homo sapiens
agtaaacataatttacctgtag

SEQ ID NO: 9213571 - DNA, 22 bp, Homo sapiens
agtaaacataatttacctgtag

SEQ ID NO: 9213572 - DNA, 22 bp, Homo sapiens
agtaaacatttcagatttattt

SEQ ID NO: 9213573 - DNA, 22 bp, Homo sapiens
agtaaataacagagaaaatggg

SEQ ID NO: 9213574 - DNA, 22 bp, Homo sapiens
agtaaataacagagaaaatggg

SEQ ID NO: 9213575 - DNA, 22 bp, Homo sapiens
agtaaatttctgcatgtgtact

SEQ ID NO: 9213576 - DNA, 22 bp, Homo sapiens
ctatatatatcatcttccagtt

SEQ ID NO: 9213577 - DNA, 22 bp, Homo sapiens
ctagtctctggaggtcagggct

SEQ ID NO: 9213578 - DNA, 22 bp, Homo sapiens
agtcaggaagctggagctgggg

SEQ ID NO: 9213579 - DNA, 22 bp, Homo sapiens
agtcagcagcctggccaggaga

SEQ ID NO: 9213580 - DNA, 22 bp, Homo sapiens
agtcagcagtgaaagcacagcc

SEQ ID NO: 9213581 - DNA, 22 bp, Homo sapiens
agtcagcagtgaaagcacagcc

SEQ ID NO: 9213582 - DNA, 22 bp, Homo sapiens
agtcagcatctgcactgtgctg

SEQ ID NO: 9213583 - DNA, 22 bp, Homo sapiens
ctatgaccccagcatgaataag

SEQ ID NO: 9213584 - DNA, 22 bp, Homo sapiens
ctatgaccccagcatgaataag

SEQ ID NO: 9213585 - DNA, 22 bp, Homo sapiens
ctatctgtaaatttgaggttct

SEQ ID NO: 9213586 - DNA, 22 bp, Homo sapiens
ctattgtttctatgctctgagg

SEQ ID NO: 9213587 - DNA, 22 bp, Homo sapiens
agtcctgggtctggagaatgga

SEQ ID NO: 9213588 - DNA, 22 bp, Homo sapiens
ctattgcatttgcatcttcatc

SEQ ID NO: 9213589 - DNA, 22 bp, Homo sapiens
ctagcttcaagtcctggctgtg

SEQ ID NO: 9213590 - DNA, 22 bp, Homo sapiens
ctaggcaagagtttattatggt

SEQ ID NO: 9213591 - DNA, 22 bp, Homo sapiens
ctaggactgtcagcctgagttg

SEQ ID NO: 9213592 - DNA, 22 bp, Homo sapiens
agtcacagttagactacccaag

SEQ ID NO: 9213593 - DNA, 22 bp, Homo sapiens
agtcacatcgattataaaattt

SEQ ID NO: 9213594 - DNA, 20 bp, Homo sapiens
agtcacatgcatacacaagt

SEQ ID NO: 9213595 - DNA, 22 bp, Homo sapiens
agtcacaggcaagagggctcca

SEQ ID NO: 9213596 - DNA, 20 bp, Homo sapiens
agggttcccttgttcagcag

SEQ ID NO: 9213597 - DNA, 22 bp, Homo sapiens
agggttctgccagtgtcttgag

SEQ ID NO: 9213598 - DNA, 22 bp, Homo sapiens
cctgagtagctggaattaaagg

SEQ ID NO: 9213599 - DNA, 22 bp, Homo sapiens
aggtcacagctttctcgtgagg

SEQ ID NO: 9213600 - DNA, 22 bp, Homo sapiens
aggtcacacaactgtcagaggc

SEQ ID NO: 9213601 - DNA, 22 bp, Homo sapiens
aggtaagaatagaggattgggg

SEQ ID NO: 9213602 - DNA, 22 bp, Homo sapiens
cctgggaggctgtttccagcct

SEQ ID NO: 9213603 - DNA, 22 bp, Homo sapiens
cctgggaggctgtgggtctgct

SEQ ID NO: 9213604 - DNA, 22 bp, Homo sapiens
cctgggaggctgtgggtctgct

SEQ ID NO: 9213605 - DNA, 22 bp, Homo sapiens
cctgggagggcaagtgctgatg

SEQ ID NO: 9213606 - DNA, 22 bp, Homo sapiens
cctgggaggctgaggctgcagt

SEQ ID NO: 9213607 - DNA, 19 bp, Homo sapiens
aggtcagtggctcaggcat

SEQ ID NO: 9213608 - DNA, 22 bp, Homo sapiens
aggtcaccatggcatgctccac

SEQ ID NO: 9213609 - DNA, 22 bp, Homo sapiens
aggtcagaaaaggagagcattg

SEQ ID NO: 9213610 - DNA, 22 bp, Homo sapiens
aggtcagcatgagtagaaggta

SEQ ID NO: 9213611 - DNA, 22 bp, Homo sapiens
aggtcagcaggccaggggcgaa

SEQ ID NO: 9213612 - DNA, 22 bp, Homo sapiens
aggtcagatgggagatgggatg

SEQ ID NO: 9213613 - DNA, 22 bp, Homo sapiens
aggtcaggaggcctctgccatt

SEQ ID NO: 9213614 - DNA, 22 bp, Homo sapiens
aggtcagctgcactggtgtaat

SEQ ID NO: 9213615 - DNA, 22 bp, Homo sapiens
cctggggctctgcacagagcag

SEQ ID NO: 9213616 - DNA, 22 bp, Homo sapiens
cctggggctctgcacagagcag

SEQ ID NO: 9213617 - DNA, 22 bp, Homo sapiens
cctggggctttctttgtatcat

SEQ ID NO: 9213618 - DNA, 22 bp, Homo sapiens
cctggggctccagagcagcgga

SEQ ID NO: 9213619 - DNA, 22 bp, Homo sapiens
cctggggctccagagcagcgga

SEQ ID NO: 9213620 - DNA, 22 bp, Homo sapiens
cctgggctttgagggcaggatg

SEQ ID NO: 9213621 - DNA, 22 bp, Homo sapiens
cctgggctttgagggcaggatg

SEQ ID NO: 9213622 - DNA, 20 bp, Homo sapiens
aggtcctggttctctgggat

SEQ ID NO: 9213623 - DNA, 22 bp, Homo sapiens
aggtcctggtgaccatggagtt

SEQ ID NO: 9213624 - DNA, 20 bp, Homo sapiens
aggtcctgggactggcagag

SEQ ID NO: 9213625 - DNA, 22 bp, Homo sapiens
aggtcctgggagttctagtgtg

SEQ ID NO: 9213626 - DNA, 22 bp, Homo sapiens
aggtcctggtcttgagtcttaa

SEQ ID NO: 9213627 - DNA, 22 bp, Homo sapiens
aggtcctggactgctcttgtta

SEQ ID NO: 9213628 - DNA, 22 bp, Homo sapiens
aggtcctgatgatctctgagag

SEQ ID NO: 9213629 - DNA, 23 bp, Homo sapiens
aggtcctggacatatgtgcatca

SEQ ID NO: 9213630 - DNA, 19 bp, Homo sapiens
aggtcctgatcagcaagga

SEQ ID NO: 9213631 - DNA, 22 bp, Homo sapiens
cctgggtcaccaggcccaggca

SEQ ID NO: 9213632 - DNA, 22 bp, Homo sapiens
cctgggtcactcaggcaggcgg

SEQ ID NO: 9213633 - DNA, 22 bp, Homo sapiens
cctgggtccaattctggcttgt

SEQ ID NO: 9213634 - DNA, 22 bp, Homo sapiens
aggtgcagctgacaccatgtgg

SEQ ID NO: 9213635 - DNA, 22 bp, Homo sapiens
cctgtgggagcccaggcagata

SEQ ID NO: 9213636 - DNA, 22 bp, Homo sapiens
cctgtgccagctgggccctgcc

SEQ ID NO: 9213637 - DNA, 22 bp, Homo sapiens
cctgtttggtacaatctgccaa

SEQ ID NO: 9213638 - DNA, 22 bp, Homo sapiens
ccttccagagttcagtctgccc

SEQ ID NO: 9213639 - DNA, 22 bp, Homo sapiens
cctgtgggccctggacagagac

SEQ ID NO: 9213640 - DNA, 22 bp, Homo sapiens
ctgagctgctttgcttttgggg

SEQ ID NO: 9213641 - DNA, 22 bp, Homo sapiens
ctgagctgcggcaggcacctgg

SEQ ID NO: 9213642 - DNA, 22 bp, Homo sapiens
agttcccaaattacaggccaca

SEQ ID NO: 9213643 - DNA, 22 bp, Homo sapiens
agttcccaggtgatgctgatgt

SEQ ID NO: 9213644 - DNA, 22 bp, Homo sapiens
agttccagctgtgaccagaaaa

SEQ ID NO: 9213645 - DNA, 22 bp, Homo sapiens
ctgagcagccccaccagccatt

SEQ ID NO: 9213646 - DNA, 22 bp, Homo sapiens
ctgagccagagggagtcgggtc

SEQ ID NO: 9213647 - DNA, 22 bp, Homo sapiens
ctgagccaaggggacagtgaca

SEQ ID NO: 9213648 - DNA, 22 bp, Homo sapiens
ctgagccagctggcatgtgcta

SEQ ID NO: 9213649 - DNA, 22 bp, Homo sapiens
ctgagctcaagtgatctgccca

SEQ ID NO: 9213650 - DNA, 22 bp, Homo sapiens
ctgagctcagtcccagctctac

SEQ ID NO: 9213651 - DNA, 22 bp, Homo sapiens
ctgagctctaatgtcagccttg

SEQ ID NO: 9213652 - DNA, 22 bp, Homo sapiens
ctgagccagggccacacatgga

SEQ ID NO: 9213653 - DNA, 22 bp, Homo sapiens
ctgagccagggccacacatgga

SEQ ID NO: 9213654 - DNA, 22 bp, Homo sapiens
agtgtgcatttgcagaagaccc

SEQ ID NO: 9213655 - DNA, 20 bp, Homo sapiens
agtgtgcatttagagtctgc

SEQ ID NO: 9213656 - DNA, 22 bp, Homo sapiens
agtgtgggcccccaggttagcc

SEQ ID NO: 9213657 - DNA, 17 bp, Homo sapiens
agtgtttccttatcatt

SEQ ID NO: 9213658 - DNA, 20 bp, Homo sapiens
agtgtttgctcacagtctcc

SEQ ID NO: 9213659 - DNA, 22 bp, Homo sapiens
agttaaatcattactgacagag

SEQ ID NO: 9213660 - DNA, 22 bp, Homo sapiens
agtgttttattagaacacagcc

SEQ ID NO: 9213661 - DNA, 22 bp, Homo sapiens
agtgtctttgacacattcaaag

SEQ ID NO: 9213662 - DNA, 22 bp, Homo sapiens
agtgtctttgtctctcaagcac

SEQ ID NO: 9213663 - DNA, 22 bp, Homo sapiens
agtggctcccatgtcttgcact

SEQ ID NO: 9213664 - DNA, 22 bp, Homo sapiens
agtggctcttgggtcactgggc

SEQ ID NO: 9213665 - DNA, 22 bp, Homo sapiens
agtggcctggagccccgcctgg

SEQ ID NO: 9213666 - DNA, 22 bp, Homo sapiens
agtggctatgcatgactggaat

SEQ ID NO: 9213667 - DNA, 22 bp, Homo sapiens
agtggcctggagccccgcctgg

SEQ ID NO: 9213668 - DNA, 22 bp, Homo sapiens
agtggccagtgctgctctgggg

SEQ ID NO: 9213669 - DNA, 22 bp, Homo sapiens
agtgggtggcgcagaggaggaa

SEQ ID NO: 9213670 - DNA, 22 bp, Homo sapiens
agtgggtggcgcagaggaggaa

SEQ ID NO: 9213671 - DNA, 22 bp, Homo sapiens
ctctggagtgggtggccgggag

SEQ ID NO: 9213672 - DNA, 22 bp, Homo sapiens
ctctggagtgtctggccagggt

SEQ ID NO: 9213673 - DNA, 22 bp, Homo sapiens
ctctggagttctcatgaggaac

SEQ ID NO: 9213674 - DNA, 22 bp, Homo sapiens
agtgaggggcagctgagtgggc

SEQ ID NO: 9213675 - DNA, 22 bp, Homo sapiens
agtgaggtcatactggagaggg

SEQ ID NO: 9213676 - DNA, 22 bp, Homo sapiens
agtgagtggagagctctaggtt

SEQ ID NO: 9213677 - DNA, 22 bp, Homo sapiens
agtgaaaacactagttcttgcc

SEQ ID NO: 9213678 - DNA, 22 bp, Homo sapiens
agtgaaaacctaatcatgcagt

SEQ ID NO: 9213679 - DNA, 22 bp, Homo sapiens
agtgaaaggttgagaatattct

SEQ ID NO: 9213680 - DNA, 22 bp, Homo sapiens
agtgaggctaataggcaatggt

SEQ ID NO: 9213681 - DNA, 22 bp, Homo sapiens
agtctttatacagaaatatatg

SEQ ID NO: 9213682 - DNA, 19 bp, Homo sapiens
agtctcacccaagcagtct

SEQ ID NO: 9213683 - DNA, 22 bp, Homo sapiens
agtctcaaagtcagtgtcatgg

SEQ ID NO: 9213684 - DNA, 22 bp, Homo sapiens
agtctacatttctaacaagctc

SEQ ID NO: 9213685 - DNA, 22 bp, Homo sapiens
agtctacaagaactccagtgca

SEQ ID NO: 9213686 - DNA, 20 bp, Homo sapiens
agtggagcagcccaagcagc

SEQ ID NO: 9213687 - DNA, 22 bp, Homo sapiens
agtggagcttttcctatcagag

SEQ ID NO: 9213688 - DNA, 22 bp, Homo sapiens
agtggcatcaaatcaaggtttg

SEQ ID NO: 9213689 - DNA, 22 bp, Homo sapiens
agtggcatcaactttatctgta

SEQ ID NO: 9213690 - DNA, 22 bp, Homo sapiens
agtggcagtggggcagggccct

SEQ ID NO: 9213691 - DNA, 20 bp, Homo sapiens
agtggccactgcagagatgc

SEQ ID NO: 9213692 - DNA, 20 bp, Homo sapiens
agtggcagggaaatggaaag

SEQ ID NO: 9213693 - DNA, 22 bp, Homo sapiens
agtggcaatgggagtggagaca

SEQ ID NO: 9213694 - DNA, 22 bp, Homo sapiens
agtgctgggtactgttcccatt

SEQ ID NO: 9213695 - DNA, 22 bp, Homo sapiens
agtgcctggaccccatgacata

SEQ ID NO: 9213696 - DNA, 18 bp, Homo sapiens
agtgccagctctgctttc

SEQ ID NO: 9213697 - DNA, 22 bp, Homo sapiens
ctggtccctgcagtgtgctggg

SEQ ID NO: 9213698 - DNA, 22 bp, Homo sapiens
ctggtcctaaagccctactcca

SEQ ID NO: 9213699 - DNA, 22 bp, Homo sapiens
ctggtcccagcagagctctgag

SEQ ID NO: 9213700 - DNA, 22 bp, Homo sapiens
ctgggtggcgtctggggccagt

SEQ ID NO: 9213701 - DNA, 22 bp, Homo sapiens
ctgggtggcgtctggggccagt

SEQ ID NO: 9213702 - DNA, 22 bp, Homo sapiens
ctggtcaggctgaactgccaca

SEQ ID NO: 9213703 - DNA, 18 bp, Homo sapiens
ctggtcagggcaatgggc

SEQ ID NO: 9213704 - DNA, 18 bp, Homo sapiens
ctggtcagggcaatgggc

SEQ ID NO: 9213705 - DNA, 22 bp, Homo sapiens
atattcactgagcataaagcca

SEQ ID NO: 9213706 - DNA, 18 bp, Homo sapiens
ctgggtctccaggctgcc

SEQ ID NO: 9213707 - DNA, 18 bp, Homo sapiens
atattcaagaagacagag

SEQ ID NO: 9213708 - DNA, 22 bp, Homo sapiens
ctgggtggagcctggtcatctg

SEQ ID NO: 9213709 - DNA, 22 bp, Homo sapiens
ctgggtggatcgcagccccagg

SEQ ID NO: 9213710 - DNA, 20 bp, Homo sapiens
ctgggtggcaagcaaggggg

SEQ ID NO: 9213711 - DNA, 22 bp, Homo sapiens
ctgggtggcagagcctgcagtg

SEQ ID NO: 9213712 - DNA, 22 bp, Homo sapiens
ctgggtggcagagcctgcagtg

SEQ ID NO: 9213713 - DNA, 22 bp, Homo sapiens
ctgggaggcggaggttgtagtg

SEQ ID NO: 9213714 - DNA, 22 bp, Homo sapiens
ctgggaggggtagccaatccta

SEQ ID NO: 9213715 - DNA, 20 bp, Homo sapiens
ctgggaggtcttccaaatca

SEQ ID NO: 9213716 - DNA, 20 bp, Homo sapiens
ctgggaggtcttccaaatca

SEQ ID NO: 9213717 - DNA, 22 bp, Homo sapiens
ctgggaggtgaacagaaaaact

SEQ ID NO: 9213718 - DNA, 22 bp, Homo sapiens
ctgggaggtgcagcaaaaatca

SEQ ID NO: 9213719 - DNA, 22 bp, Homo sapiens
ctgggaggtggaggttgcattg

SEQ ID NO: 9213720 - DNA, 22 bp, Homo sapiens
ctgggaggatacacaagatcag

SEQ ID NO: 9213721 - DNA, 22 bp, Homo sapiens
ctgggaggatacacaagatcag

SEQ ID NO: 9213722 - DNA, 22 bp, Homo sapiens
ctgggaggacaacttggagctc

SEQ ID NO: 9213723 - DNA, 22 bp, Homo sapiens
ctgggagcttgttaggaatgca

SEQ ID NO: 9213724 - DNA, 22 bp, Homo sapiens
ctggggctgtgggagacaaggc

SEQ ID NO: 9213725 - DNA, 22 bp, Homo sapiens
ctggggcttcaatgcttcggtg

SEQ ID NO: 9213726 - DNA, 23 bp, Homo sapiens
ctggggctttcaaatctgggcag

SEQ ID NO: 9213727 - DNA, 22 bp, Homo sapiens
ctggggctgtaggaggacttat

SEQ ID NO: 9213728 - DNA, 22 bp, Homo sapiens
ctggggcatctgacagataaat

SEQ ID NO: 9213729 - DNA, 22 bp, Homo sapiens
ctgggggcaatggtcagagtgt

SEQ ID NO: 9213730 - DNA, 22 bp, Homo sapiens
atattattctagctcttgtgtg

SEQ ID NO: 9213731 - DNA, 22 bp, Homo sapiens
atattattctagtaacagtgat

SEQ ID NO: 9213732 - DNA, 19 bp, Homo sapiens
ctggggctttggtactgcc

SEQ ID NO: 9213733 - DNA, 22 bp, Homo sapiens
ctgggggcaagcagacagctgt

SEQ ID NO: 9213734 - DNA, 22 bp, Homo sapiens
atcaggaaagaaaagcttggcg

SEQ ID NO: 9213735 - DNA, 22 bp, Homo sapiens
ctgtctcctccactgcatggga

SEQ ID NO: 9213736 - DNA, 22 bp, Homo sapiens
ctgtaatcccagctacctggga

SEQ ID NO: 9213737 - DNA, 22 bp, Homo sapiens
ctgtaatcccagctacctggga

SEQ ID NO: 9213738 - DNA, 22 bp, Homo sapiens
atcagccaattacagaacatga

SEQ ID NO: 9213739 - DNA, 22 bp, Homo sapiens
atcagctgaaaaacaggcagca

SEQ ID NO: 9213740 - DNA, 22 bp, Homo sapiens
atcagctgaaaaacaggcagca

SEQ ID NO: 9213741 - DNA, 22 bp, Homo sapiens
atcagctcttgatgcctttctt

SEQ ID NO: 9213742 - DNA, 22 bp, Homo sapiens
atcagcagtgagtggctttcat

SEQ ID NO: 9213743 - DNA, 19 bp, Homo sapiens
atcacagacgtgcctcatc

SEQ ID NO: 9213744 - DNA, 22 bp, Homo sapiens
atcacagagctcccttccactg

SEQ ID NO: 9213745 - DNA, 22 bp, Homo sapiens
atcacagctagtaagtggagga

SEQ ID NO: 9213746 - DNA, 22 bp, Homo sapiens
atctgtgatcaagacagacagt

SEQ ID NO: 9213747 - DNA, 22 bp, Homo sapiens
atctgtaattttgaatgcaaat

SEQ ID NO: 9213748 - DNA, 22 bp, Homo sapiens
atctggtatgaggttttgcttt

SEQ ID NO: 9213749 - DNA, 22 bp, Homo sapiens
atctggttcttcttaggcatca

SEQ ID NO: 9213750 - DNA, 20 bp, Homo sapiens
atctcctgctaccacccatt

SEQ ID NO: 9213751 - DNA, 22 bp, Homo sapiens
atctccttggatcacgtttagt

SEQ ID NO: 9213752 - DNA, 23 bp, Homo sapiens
atctcctgagaacccacagtggt

SEQ ID NO: 9213753 - DNA, 22 bp, Homo sapiens
cttccttggcttctggggtgtg

SEQ ID NO: 9213754 - DNA, 22 bp, Homo sapiens
cttccttgtggtccttctcatt

SEQ ID NO: 9213755 - DNA, 23 bp, Homo sapiens
atctctctttattcttggggata

SEQ ID NO: 9213756 - DNA, 22 bp, Homo sapiens
atctctctatgcactgaggact

SEQ ID NO: 9213757 - DNA, 22 bp, Homo sapiens
cttctgtggtaaactttgttgt

SEQ ID NO: 9213758 - DNA, 22 bp, Homo sapiens
cttctgtggatatgttctctct

SEQ ID NO: 9213759 - DNA, 22 bp, Homo sapiens
cttctgtgctaaatgcaaaacc

SEQ ID NO: 9213760 - DNA, 22 bp, Homo sapiens
cttctgcaggccctgtctgacc

SEQ ID NO: 9213761 - DNA, 22 bp, Homo sapiens
cttctgagatgttgttttacag

SEQ ID NO: 9213762 - DNA, 22 bp, Homo sapiens
cttctgagggcctttgcttcca

SEQ ID NO: 9213763 - DNA, 22 bp, Homo sapiens
cttcaagttgtctgagggtggg

SEQ ID NO: 9213764 - DNA, 22 bp, Homo sapiens
cttcaagttgggcggcgggcag

SEQ ID NO: 9213765 - DNA, 22 bp, Homo sapiens
cttcaagtccagctcatgctct

SEQ ID NO: 9213766 - DNA, 22 bp, Homo sapiens
cttccttgcggcccctgcctag

SEQ ID NO: 9213767 - DNA, 22 bp, Homo sapiens
cttccttgctgtctgctccagg

SEQ ID NO: 9213768 - DNA, 19 bp, Homo sapiens
cttccttgctccccatgtg

SEQ ID NO: 9213769 - DNA, 22 bp, Homo sapiens
cttccttctgaagcatagaagc

SEQ ID NO: 9213770 - DNA, 22 bp, Homo sapiens
cttcctctcttgcccataagag

SEQ ID NO: 9213771 - DNA, 22 bp, Homo sapiens
cttcctctatgttcaggtagaa

SEQ ID NO: 9213772 - DNA, 22 bp, Homo sapiens
cttcctctcaataagatgagaa

SEQ ID NO: 9213773 - DNA, 22 bp, Homo sapiens
cttatgtataatgttccacata

SEQ ID NO: 9213774 - DNA, 22 bp, Homo sapiens
cttatgtacacacatatattgt

SEQ ID NO: 9213775 - DNA, 21 bp, Homo sapiens
atccatccatcttggcctaac

SEQ ID NO: 9213776 - DNA, 22 bp, Homo sapiens
cttagatgaagtcacagaaccc

SEQ ID NO: 9213777 - DNA, 22 bp, Homo sapiens
atccatttgacataatttcagc

SEQ ID NO: 9213778 - DNA, 22 bp, Homo sapiens
atccatttcctccactataaag

SEQ ID NO: 9213779 - DNA, 18 bp, Homo sapiens
atccatttaatgcctgga

SEQ ID NO: 9213780 - DNA, 22 bp, Homo sapiens
cttaacaagcccaactttcatt

SEQ ID NO: 9213781 - DNA, 22 bp, Homo sapiens
atcatacagcctttgttagtgt

SEQ ID NO: 9213782 - DNA, 22 bp, Homo sapiens
cttaagcaaaatattctttcac

SEQ ID NO: 9213783 - DNA, 21 bp, Homo sapiens
cttaagatggcatagtacgaa

SEQ ID NO: 9213784 - DNA, 22 bp, Homo sapiens
ctggcctaaaaatacagaacaa

SEQ ID NO: 9213785 - DNA, 22 bp, Homo sapiens
ctggcctcacagaggctaagcc

SEQ ID NO: 9213786 - DNA, 22 bp, Homo sapiens
ctggcctcagagggtcatggtg

SEQ ID NO: 9213787 - DNA, 22 bp, Homo sapiens
ctggcctcatagccaagctgtg

SEQ ID NO: 9213788 - DNA, 22 bp, Homo sapiens
ctggcctcatagccaagctgtg

SEQ ID NO: 9213789 - DNA, 20 bp, Homo sapiens
ctggccagaacgcctacaca

SEQ ID NO: 9213790 - DNA, 20 bp, Homo sapiens
ctggccagaacgcctacaca

SEQ ID NO: 9213791 - DNA, 22 bp, Homo sapiens
ctggccagaagcacctttggcg

SEQ ID NO: 9213792 - DNA, 22 bp, Homo sapiens
ctggccagaagcacctttggcg

SEQ ID NO: 9213793 - DNA, 22 bp, Homo sapiens
ctggccagactacacatgtgtg

SEQ ID NO: 9213794 - DNA, 22 bp, Homo sapiens
ctggccctatgagcctcctgat

SEQ ID NO: 9213795 - DNA, 22 bp, Homo sapiens
ctggcccttctcttgcttcctg

SEQ ID NO: 9213796 - DNA, 22 bp, Homo sapiens
ctggccactggtggtcataggc

SEQ ID NO: 9213797 - DNA, 22 bp, Homo sapiens
ctggccactgcgggcctctgcc

SEQ ID NO: 9213798 - DNA, 22 bp, Homo sapiens
ctggccactgcgggcctctgcc

SEQ ID NO: 9213799 - DNA, 22 bp, Homo sapiens
ctggcaggttatagagctgccc

SEQ ID NO: 9213800 - DNA, 22 bp, Homo sapiens
ctggcaggttatagagctgccc

SEQ ID NO: 9213801 - DNA, 22 bp, Homo sapiens
ctggcaggtttggtgtctggtg

SEQ ID NO: 9213802 - DNA, 22 bp, Homo sapiens
ctggcaggttatagagctgccc

SEQ ID NO: 9213803 - DNA, 22 bp, Homo sapiens
ctggcaggttatagagctgccc

SEQ ID NO: 9213804 - DNA, 22 bp, Homo sapiens
ctggcaggtggaggttgcagtg

SEQ ID NO: 9213805 - DNA, 22 bp, Homo sapiens
ctggcaggtccagctggactca

SEQ ID NO: 9213806 - DNA, 22 bp, Homo sapiens
ctggcaggtccagctggactca

SEQ ID NO: 9213807 - DNA, 22 bp, Homo sapiens
ctggcaggtctcgctgacgtgt

SEQ ID NO: 9213808 - DNA, 22 bp, Homo sapiens
atacacattactttctgtctga

SEQ ID NO: 9213809 - DNA, 20 bp, Homo sapiens
atacacattcatagaaaaat

SEQ ID NO: 9213810 - DNA, 22 bp, Homo sapiens
ctggcacaactccacctcagcg

SEQ ID NO: 9213811 - DNA, 22 bp, Homo sapiens
ctggcacaatgtcacttttgct

SEQ ID NO: 9213812 - DNA, 22 bp, Homo sapiens
ctggcacacaagtatttccttt

SEQ ID NO: 9213813 - DNA, 22 bp, Homo sapiens
ctggcacacagaggccctcggg

SEQ ID NO: 9213814 - DNA, 22 bp, Homo sapiens
ctggcacacagaggccctcggg

SEQ ID NO: 9213815 - DNA, 22 bp, Homo sapiens
ctggcacaaatggaaaccaagc

SEQ ID NO: 9213816 - DNA, 22 bp, Homo sapiens
ctggcacaaaagaaaactgcca

SEQ ID NO: 9213817 - DNA, 22 bp, Homo sapiens
ctggcacagagacagaaggatt

SEQ ID NO: 9213818 - DNA, 22 bp, Homo sapiens
ctggcacagagtgagcattcaa

SEQ ID NO: 9213819 - DNA, 22 bp, Homo sapiens
ctggcacacagtaggcaccaat

SEQ ID NO: 9213820 - DNA, 22 bp, Homo sapiens
ctggcacacagcaggctctcag

SEQ ID NO: 9213821 - DNA, 22 bp, Homo sapiens
ctggcacacagcaggctctcag

SEQ ID NO: 9213822 - DNA, 22 bp, Homo sapiens
ctggcagcttattagaaatgca

SEQ ID NO: 9213823 - DNA, 22 bp, Homo sapiens
ctggcagcttagcactctggtt

SEQ ID NO: 9213824 - DNA, 22 bp, Homo sapiens
atacatgtgggtctaaacatat

SEQ ID NO: 9213825 - DNA, 22 bp, Homo sapiens
atacatgtaactgcattgtaat

SEQ ID NO: 9213826 - DNA, 19 bp, Homo sapiens
atacatgcatttacatgct

SEQ ID NO: 9213827 - DNA, 22 bp, Homo sapiens
ctggcacacgtggcagggtagg

SEQ ID NO: 9213828 - DNA, 22 bp, Homo sapiens
ctggcacagccactgcaggcag

SEQ ID NO: 9213829 - DNA, 22 bp, Homo sapiens
ctggcacaggatccgagacctt

SEQ ID NO: 9213830 - DNA, 22 bp, Homo sapiens
ctggcacagcttgggccccatc

SEQ ID NO: 9213831 - DNA, 22 bp, Homo sapiens
ctggcacagccactgcaggcag

SEQ ID NO: 9213832 - DNA, 20 bp, Homo sapiens
ctggcacagggtccgtcctt

SEQ ID NO: 9213833 - DNA, 22 bp, Homo sapiens
ctggcacataattagtgatcct

SEQ ID NO: 9213834 - DNA, 22 bp, Homo sapiens
ctggcacagttaacatatgcta

SEQ ID NO: 9213835 - DNA, 22 bp, Homo sapiens
ctggcacatagcaaatctcaac

SEQ ID NO: 9213836 - DNA, 22 bp, Homo sapiens
ctggcacagttaacatatgcta

SEQ ID NO: 9213837 - DNA, 22 bp, Homo sapiens
ctgggagaggaacctcgagggt

SEQ ID NO: 9213838 - DNA, 20 bp, Homo sapiens
atataccatcccacaacagg

SEQ ID NO: 9213839 - DNA, 19 bp, Homo sapiens
atatacatactgtgtgcat

SEQ ID NO: 9213840 - DNA, 22 bp, Homo sapiens
atatacttggagactatcattg

SEQ ID NO: 9213841 - DNA, 22 bp, Homo sapiens
atatactgtaggccactataag

SEQ ID NO: 9213842 - DNA, 22 bp, Homo sapiens
atatacacatgtgtatacattt

SEQ ID NO: 9213843 - DNA, 22 bp, Homo sapiens
ctggccttcagactcggactga

SEQ ID NO: 9213844 - DNA, 22 bp, Homo sapiens
ctggccttgttcctccccaagt

SEQ ID NO: 9213845 - DNA, 22 bp, Homo sapiens
ctggcctttagccccagtgtct

SEQ ID NO: 9213846 - DNA, 22 bp, Homo sapiens
ctggcctttcgtgagagctggg

SEQ ID NO: 9213847 - DNA, 23 bp, Homo sapiens
atataaacaccagatagattgta

SEQ ID NO: 9213848 - DNA, 22 bp, Homo sapiens
ctggctctttcctagctaggct

SEQ ID NO: 9213849 - DNA, 22 bp, Homo sapiens
ctgctgggggacacaggtccgg

SEQ ID NO: 9213850 - DNA, 22 bp, Homo sapiens
ctgctggggtcagagcactggg

SEQ ID NO: 9213851 - DNA, 22 bp, Homo sapiens
ctgctgtgtcagagtccagggg

SEQ ID NO: 9213852 - DNA, 21 bp, Homo sapiens
atacacatacacataaatgtg

SEQ ID NO: 9213853 - DNA, 22 bp, Homo sapiens
atacacatctatttaagagaca

SEQ ID NO: 9213854 - DNA, 22 bp, Homo sapiens
ctgcctggtgcggtgcccaccc

SEQ ID NO: 9213855 - DNA, 22 bp, Homo sapiens
ctgcctgtaactttctgaagca

SEQ ID NO: 9213856 - DNA, 22 bp, Homo sapiens
ctgcctgggttcaagtcctgtt

SEQ ID NO: 9213857 - DNA, 22 bp, Homo sapiens
ctgcctgggttcaagtcctgtt

SEQ ID NO: 9213858 - DNA, 22 bp, Homo sapiens
ctgcctgggttcaagtcctgtt

SEQ ID NO: 9213859 - DNA, 22 bp, Homo sapiens
ctgcctggggcatcagtcaagg

SEQ ID NO: 9213860 - DNA, 22 bp, Homo sapiens
ctgcctggtactttaggcactt

SEQ ID NO: 9213861 - DNA, 22 bp, Homo sapiens
ctgcctggggcatcagtcaagg

SEQ ID NO: 9213862 - DNA, 22 bp, Homo sapiens
ctgcctggaaggagcaagggga

SEQ ID NO: 9213863 - DNA, 22 bp, Homo sapiens
ctgctggggaggcgcctcgacg

SEQ ID NO: 9213864 - DNA, 22 bp, Homo sapiens
ctgctgggggacacaggtccgg

SEQ ID NO: 9213865 - DNA, 22 bp, Homo sapiens
ctgctgggctcctcatgtgact

SEQ ID NO: 9213866 - DNA, 22 bp, Homo sapiens
ctgctgggcctggtctctgagg

SEQ ID NO: 9213867 - DNA, 22 bp, Homo sapiens
ctgctgggcctggtctctgagg

SEQ ID NO: 9213868 - DNA, 19 bp, Homo sapiens
ctgctcaggtcagtctgtc

SEQ ID NO: 9213869 - DNA, 22 bp, Homo sapiens
ctgctagcccaggatgcaggga

SEQ ID NO: 9213870 - DNA, 22 bp, Homo sapiens
ctgctagggttcagcagtgcct

SEQ ID NO: 9213871 - DNA, 22 bp, Homo sapiens
ctgctagcccgccggccagcga

SEQ ID NO: 9213872 - DNA, 22 bp, Homo sapiens
ctgctcaacatttgtaggataa

SEQ ID NO: 9213873 - DNA, 22 bp, Homo sapiens
ctgcagggaccacaagcaggtt

SEQ ID NO: 9213874 - DNA, 22 bp, Homo sapiens
ataaactcatgccaagaaatga

SEQ ID NO: 9213875 - DNA, 22 bp, Homo sapiens
ataaactctgcctcagaagagc

SEQ ID NO: 9213876 - DNA, 22 bp, Homo sapiens
ataaagatttctttttctctac

SEQ ID NO: 9213877 - DNA, 22 bp, Homo sapiens
ataaagcatttcccctgtgtgg

SEQ ID NO: 9213878 - DNA, 22 bp, Homo sapiens
agttctgtggctgtgccctgta

SEQ ID NO: 9213879 - DNA, 22 bp, Homo sapiens
agttctcataaacgtccttgga

SEQ ID NO: 9213880 - DNA, 22 bp, Homo sapiens
agttccttgatgttctatggac

SEQ ID NO: 9213881 - DNA, 22 bp, Homo sapiens
agttctagaagacttttccatt

SEQ ID NO: 9213882 - DNA, 22 bp, Homo sapiens
ataaaaaggacagatgtggtct

SEQ ID NO: 9213883 - DNA, 22 bp, Homo sapiens
ataaaaatgagggcggtagcta

SEQ ID NO: 9213884 - DNA, 22 bp, Homo sapiens
ataaaacttattagaattgtgt

SEQ ID NO: 9213885 - DNA, 22 bp, Homo sapiens
ataaaacttgggtatgatccct

SEQ ID NO: 9213886 - DNA, 22 bp, Homo sapiens
ataaaagaagttttggtacttg

SEQ ID NO: 9213887 - DNA, 22 bp, Homo sapiens
aggggaggcagcgataaacctg

SEQ ID NO: 9213888 - DNA, 22 bp, Homo sapiens
aggggaggagcttttcttgcct

SEQ ID NO: 9213889 - DNA, 22 bp, Homo sapiens
aggggaggtgtccccaaatctc

SEQ ID NO: 9213890 - DNA, 19 bp, Homo sapiens
aggggcactgtctctagag

SEQ ID NO: 9213891 - DNA, 22 bp, Homo sapiens
cctcttccactgggccccatcc

SEQ ID NO: 9213892 - DNA, 22 bp, Homo sapiens
aggggcagcctcacaatcctct

SEQ ID NO: 9213893 - DNA, 22 bp, Homo sapiens
aggggcacggatgacctgttag

SEQ ID NO: 9213894 - DNA, 22 bp, Homo sapiens
aggggatggagctggaaggcag

SEQ ID NO: 9213895 - DNA, 22 bp, Homo sapiens
cctgaagaaaattccacgagaa

SEQ ID NO: 9213896 - DNA, 22 bp, Homo sapiens
cctgaacatttctgctccagcc

SEQ ID NO: 9213897 - DNA, 22 bp, Homo sapiens
cctgaagagtgaatgtggcagt

SEQ ID NO: 9213898 - DNA, 22 bp, Homo sapiens
cctgaagatgctgtggcctggt

SEQ ID NO: 9213899 - DNA, 22 bp, Homo sapiens
cctgaagagcactctagagttg

SEQ ID NO: 9213900 - DNA, 22 bp, Homo sapiens
cctgaagagcactctagagttg

SEQ ID NO: 9213901 - DNA, 22 bp, Homo sapiens
cctgagagccctagccaggcgc

SEQ ID NO: 9213902 - DNA, 22 bp, Homo sapiens
cctgagagggggccctagaaat

SEQ ID NO: 9213903 - DNA, 22 bp, Homo sapiens
cctgagaggccctctcactgtc

SEQ ID NO: 9213904 - DNA, 22 bp, Homo sapiens
cctgagagccagtgcctgccca

SEQ ID NO: 9213905 - DNA, 22 bp, Homo sapiens
cctgagagcattccacactgaa

SEQ ID NO: 9213906 - DNA, 22 bp, Homo sapiens
cctgagagagtgagccctgaca

SEQ ID NO: 9213907 - DNA, 22 bp, Homo sapiens
cctgagagagaagcgacctggt

SEQ ID NO: 9213908 - DNA, 22 bp, Homo sapiens
cctgaagatgctgtggcctggt

SEQ ID NO: 9213909 - DNA, 22 bp, Homo sapiens
cctgagagtgagtgccacctta

SEQ ID NO: 9213910 - DNA, 22 bp, Homo sapiens
cctgagagtgagggcctcctta

SEQ ID NO: 9213911 - DNA, 22 bp, Homo sapiens
agggtagggcccggagacagac

SEQ ID NO: 9213912 - DNA, 22 bp, Homo sapiens
agggtagggcccggagacagac

SEQ ID NO: 9213913 - DNA, 22 bp, Homo sapiens
agggtaggaactgagtggaagg

SEQ ID NO: 9213914 - DNA, 22 bp, Homo sapiens
agggtaggaactgagtggaagg

SEQ ID NO: 9213915 - DNA, 22 bp, Homo sapiens
agggtagggtaaatgatgcatc

SEQ ID NO: 9213916 - DNA, 22 bp, Homo sapiens
agggtagggccgtagggccatg

SEQ ID NO: 9213917 - DNA, 22 bp, Homo sapiens
agggtagggccgtagggccatg

SEQ ID NO: 9213918 - DNA, 22 bp, Homo sapiens
cctcagcttgatttctgcagag

SEQ ID NO: 9213919 - DNA, 22 bp, Homo sapiens
cctcaggaaatgaataaatggc

SEQ ID NO: 9213920 - DNA, 22 bp, Homo sapiens
cctcaggaaccacattgctgct

SEQ ID NO: 9213921 - DNA, 20 bp, Homo sapiens
cctcagagcgcaggccccct

SEQ ID NO: 9213922 - DNA, 20 bp, Homo sapiens
agggcctgctctgtggtgtc

SEQ ID NO: 9213923 - DNA, 22 bp, Homo sapiens
agggcctggaactgtgggcagg

SEQ ID NO: 9213924 - DNA, 22 bp, Homo sapiens
agggcctccagggcagcagtgg

SEQ ID NO: 9213925 - DNA, 23 bp, Homo sapiens
agggcctgatggctcccgctggc

SEQ ID NO: 9213926 - DNA, 22 bp, Homo sapiens
agggcctgaggctgacggggag

SEQ ID NO: 9213927 - DNA, 22 bp, Homo sapiens
agggcctgcatcaggagcttgg

SEQ ID NO: 9213928 - DNA, 22 bp, Homo sapiens
agggcctgcatcaggagcttgg

SEQ ID NO: 9213929 - DNA, 22 bp, Homo sapiens
agggctaccaccaagctgcaca

SEQ ID NO: 9213930 - DNA, 22 bp, Homo sapiens
agggctggagccacagctggga

SEQ ID NO: 9213931 - DNA, 22 bp, Homo sapiens
cctcaggatacaggagccacag

SEQ ID NO: 9213932 - DNA, 22 bp, Homo sapiens
cctcaggccagggggcggccag

SEQ ID NO: 9213933 - DNA, 22 bp, Homo sapiens
cctcaggcaggaaactgtcccg

SEQ ID NO: 9213934 - DNA, 22 bp, Homo sapiens
cctcaggatacaggagccacag

SEQ ID NO: 9213935 - DNA, 22 bp, Homo sapiens
cctcaggatacaggagccacag

SEQ ID NO: 9213936 - DNA, 22 bp, Homo sapiens
cctcaggatacaggagccacag

SEQ ID NO: 9213937 - DNA, 22 bp, Homo sapiens
cctcaggatccgcaggtgcagt

SEQ ID NO: 9213938 - DNA, 22 bp, Homo sapiens
agggcgacaatggagagcgttt

SEQ ID NO: 9213939 - DNA, 22 bp, Homo sapiens
cccaggctggtcctgaactcct

SEQ ID NO: 9213940 - DNA, 22 bp, Homo sapiens
cccaggctgcgtatccacaata

SEQ ID NO: 9213941 - DNA, 22 bp, Homo sapiens
cccaggctgtctgtcctttgct

SEQ ID NO: 9213942 - DNA, 18 bp, Homo sapiens
cccaggctttgtgggtct

SEQ ID NO: 9213943 - DNA, 18 bp, Homo sapiens
cccaggctttgtgggtct

SEQ ID NO: 9213944 - DNA, 18 bp, Homo sapiens
cccaggctttgtgggtct

SEQ ID NO: 9213945 - DNA, 22 bp, Homo sapiens
cccaggcttcccaatcagaagg

SEQ ID NO: 9213946 - DNA, 22 bp, Homo sapiens
cccaggctgtgcaaacttcaaa

SEQ ID NO: 9213947 - DNA, 22 bp, Homo sapiens
cccaggctgtgcaaacttcaaa

SEQ ID NO: 9213948 - DNA, 22 bp, Homo sapiens
cccaggcttttaagttagacag

SEQ ID NO: 9213949 - DNA, 22 bp, Homo sapiens
cccaggcttttaagttagacag

SEQ ID NO: 9213950 - DNA, 22 bp, Homo sapiens
cccaggcttttaagttagacag

SEQ ID NO: 9213951 - DNA, 22 bp, Homo sapiens
cccaggcttttctcttgcccca

SEQ ID NO: 9213952 - DNA, 22 bp, Homo sapiens
cccaggcttttctcttgcccca

SEQ ID NO: 9213953 - DNA, 22 bp, Homo sapiens
cccagtcatcctgcaggtgaaa

SEQ ID NO: 9213954 - DNA, 22 bp, Homo sapiens
cccaggctgatgggatgggcca

SEQ ID NO: 9213955 - DNA, 22 bp, Homo sapiens
cccaggctgatgttcagcgggt

SEQ ID NO: 9213956 - DNA, 22 bp, Homo sapiens
cccaggctgcatgagtccatgg

SEQ ID NO: 9213957 - DNA, 22 bp, Homo sapiens
cccaggctgccacgattactgc

SEQ ID NO: 9213958 - DNA, 22 bp, Homo sapiens
cccaggctgatgttcagcgggt

SEQ ID NO: 9213959 - DNA, 22 bp, Homo sapiens
cccaggctgcatgagtccatgg

SEQ ID NO: 9213960 - DNA, 22 bp, Homo sapiens
cccaggaggtcaaggctgcagt

SEQ ID NO: 9213961 - DNA, 22 bp, Homo sapiens
cccaggcctggtctgggccagt

SEQ ID NO: 9213962 - DNA, 23 bp, Homo sapiens
cccaggctacaaattatgctctg

SEQ ID NO: 9213963 - DNA, 22 bp, Homo sapiens
cccaggctgagttagaggtgtc

SEQ ID NO: 9213964 - DNA, 22 bp, Homo sapiens
cccaggaggtcgaagctgcagt

SEQ ID NO: 9213965 - DNA, 22 bp, Homo sapiens
cccaggaggtcgaagctgcagt

SEQ ID NO: 9213966 - DNA, 22 bp, Homo sapiens
aggctggtagtatttagtcaca

SEQ ID NO: 9213967 - DNA, 22 bp, Homo sapiens
aggctggtgcctgcagtgaatc

SEQ ID NO: 9213968 - DNA, 22 bp, Homo sapiens
aggctgtctgaccccagagccc

SEQ ID NO: 9213969 - DNA, 22 bp, Homo sapiens
aggctgtgaaatgtggcaagga

SEQ ID NO: 9213970 - DNA, 20 bp, Homo sapiens
cccaggagctgtgccccatc

SEQ ID NO: 9213971 - DNA, 20 bp, Homo sapiens
cccaggagctgtgccccatc

SEQ ID NO: 9213972 - DNA, 23 bp, Homo sapiens
cccaggagcctgagtcctctctg

SEQ ID NO: 9213973 - DNA, 23 bp, Homo sapiens
cccaggagcctgagtcctctctg

SEQ ID NO: 9213974 - DNA, 22 bp, Homo sapiens
cccaggagcttctctctgcctc

SEQ ID NO: 9213975 - DNA, 22 bp, Homo sapiens
cccaggagggtggcctctgccc

SEQ ID NO: 9213976 - DNA, 22 bp, Homo sapiens
cccaggaggtagaggttgcagt

SEQ ID NO: 9213977 - DNA, 22 bp, Homo sapiens
cccaggagatgcactccattgg

SEQ ID NO: 9213978 - DNA, 22 bp, Homo sapiens
cccaggagatgcactccattgg

SEQ ID NO: 9213979 - DNA, 22 bp, Homo sapiens
cccaggagatggaggttgcagt

SEQ ID NO: 9213980 - DNA, 22 bp, Homo sapiens
ccccagataggttcatgcccta

SEQ ID NO: 9213981 - DNA, 22 bp, Homo sapiens
ccccagcacaggctcctcagat

SEQ ID NO: 9213982 - DNA, 22 bp, Homo sapiens
ccccagcacaggctcctcagat

SEQ ID NO: 9213983 - DNA, 22 bp, Homo sapiens
ccccagcactctgactcttacc

SEQ ID NO: 9213984 - DNA, 22 bp, Homo sapiens
ccctaggggcaatgatggtgct

SEQ ID NO: 9213985 - DNA, 22 bp, Homo sapiens
ccctagggtttggccagagccc

SEQ ID NO: 9213986 - DNA, 22 bp, Homo sapiens
ccctcaccaggctccaggcatg

SEQ ID NO: 9213987 - DNA, 22 bp, Homo sapiens
ccctcaccaggctccaggcatg

SEQ ID NO: 9213988 - DNA, 22 bp, Homo sapiens
ccctcactgtccttgggccctt

SEQ ID NO: 9213989 - DNA, 22 bp, Homo sapiens
ccctcactctgcctcctggggt

SEQ ID NO: 9213990 - DNA, 17 bp, Homo sapiens
ccctcactcctgccggg

SEQ ID NO: 9213991 - DNA, 22 bp, Homo sapiens
ccctcacttcacgctctgcaga

SEQ ID NO: 9213992 - DNA, 22 bp, Homo sapiens
cccatggcttaggagggagtgt

SEQ ID NO: 9213993 - DNA, 22 bp, Homo sapiens
cccatggcaataaggtcacagg

SEQ ID NO: 9213994 - DNA, 22 bp, Homo sapiens
cccatgggttttcctccctgcc

SEQ ID NO: 9213995 - DNA, 22 bp, Homo sapiens
cccatggagtgcctgagggcca

SEQ ID NO: 9213996 - DNA, 22 bp, Homo sapiens
cccatgccttctgactcacagg

SEQ ID NO: 9213997 - DNA, 22 bp, Homo sapiens
cccatgagtgctgctcagaggc

SEQ ID NO: 9213998 - DNA, 22 bp, Homo sapiens
cccatgcaccctctaagaagga

SEQ ID NO: 9213999 - DNA, 22 bp, Homo sapiens
ccccactctcggccagataggc

SEQ ID NO: 9214000 - DNA, 22 bp, Homo sapiens
ccctccatgagtgtgctgctgg

SEQ ID NO: 9214001 - DNA, 20 bp, Homo sapiens
ccctcccagatgcttcccaa

SEQ ID NO: 9214002 - DNA, 20 bp, Homo sapiens
ccctcccagatgcttcccaa

SEQ ID NO: 9214003 - DNA, 22 bp, Homo sapiens
ccctcccaagcactctgacata

SEQ ID NO: 9214004 - DNA, 22 bp, Homo sapiens
ccctcccaagcactctgacata

SEQ ID NO: 9214005 - DNA, 18 bp, Homo sapiens
ccctgccagctcccagca

SEQ ID NO: 9214006 - DNA, 17 bp, Homo sapiens
ccctgccaccaggaagc

SEQ ID NO: 9214007 - DNA, 22 bp, Homo sapiens
ccctgccaatcccgtctctctg

SEQ ID NO: 9214008 - DNA, 22 bp, Homo sapiens
ccctcccagatgggcttgaggt

SEQ ID NO: 9214009 - DNA, 22 bp, Homo sapiens
ccctcccagatgggcttgaggt

SEQ ID NO: 9214010 - DNA, 22 bp, Homo sapiens
ccctcccaggagtggccagaga

SEQ ID NO: 9214011 - DNA, 22 bp, Homo sapiens
ccctcccagatgggcttgaggt

SEQ ID NO: 9214012 - DNA, 22 bp, Homo sapiens
ccctgctgtcaggtgctgggag

SEQ ID NO: 9214013 - DNA, 22 bp, Homo sapiens
ccctgccagggtcctgacagac

SEQ ID NO: 9214014 - DNA, 23 bp, Homo sapiens
ccctgcccattgagcaggacgtc

SEQ ID NO: 9214015 - DNA, 22 bp, Homo sapiens
ccagagctaaacacacaggctg

SEQ ID NO: 9214016 - DNA, 22 bp, Homo sapiens
ccagagctccagggctacagaa

SEQ ID NO: 9214017 - DNA, 22 bp, Homo sapiens
aggccacatagcttgcatgtag

SEQ ID NO: 9214018 - DNA, 22 bp, Homo sapiens
aggccacagttgaggccagcaa

SEQ ID NO: 9214019 - DNA, 22 bp, Homo sapiens
aggccacagttgaggccagcaa

SEQ ID NO: 9214020 - DNA, 22 bp, Homo sapiens
aggccacatagcttgcatgtag

SEQ ID NO: 9214021 - DNA, 22 bp, Homo sapiens
aggccaccaccctatctcctgg

SEQ ID NO: 9214022 - DNA, 22 bp, Homo sapiens
aggccaccaccctatctcctgg

SEQ ID NO: 9214023 - DNA, 21 bp, Homo sapiens
ccagagcctgctgagccccct

SEQ ID NO: 9214024 - DNA, 22 bp, Homo sapiens
aggccagaaatgtcagggagtg

SEQ ID NO: 9214025 - DNA, 22 bp, Homo sapiens
aggccagtgtggctggagcaca

SEQ ID NO: 9214026 - DNA, 22 bp, Homo sapiens
aggccagtgcctttccagggct

SEQ ID NO: 9214027 - DNA, 22 bp, Homo sapiens
aggccaggtggtcatgcttgct

SEQ ID NO: 9214028 - DNA, 22 bp, Homo sapiens
aggccaggtggtcatgcttgct

SEQ ID NO: 9214029 - DNA, 22 bp, Homo sapiens
aggccaggttcctcaatcttga

SEQ ID NO: 9214030 - DNA, 22 bp, Homo sapiens
aggcccaaaagaaaccactggg

SEQ ID NO: 9214031 - DNA, 23 bp, Homo sapiens
aggcccaactctgtgagggctgc

SEQ ID NO: 9214032 - DNA, 22 bp, Homo sapiens
ccagcaggactttggaaatatg

SEQ ID NO: 9214033 - DNA, 22 bp, Homo sapiens
ccagcaggaaagtgacgtttga

SEQ ID NO: 9214034 - DNA, 22 bp, Homo sapiens
ccagaaaatatggctaaggtga

SEQ ID NO: 9214035 - DNA, 22 bp, Homo sapiens
ccagaaaatgcagaacatagaa

SEQ ID NO: 9214036 - DNA, 22 bp, Homo sapiens
ccactgggggctgctcccaggt

SEQ ID NO: 9214037 - DNA, 22 bp, Homo sapiens
ccagactgagggtccctgagct

SEQ ID NO: 9214038 - DNA, 22 bp, Homo sapiens
ccagaagaccggggagtcaggg

SEQ ID NO: 9214039 - DNA, 22 bp, Homo sapiens
ccagactgcttgcttcccagcc

SEQ ID NO: 9214040 - DNA, 22 bp, Homo sapiens
ccagactgtcagcaacttcaag

SEQ ID NO: 9214041 - DNA, 22 bp, Homo sapiens
ccagagaaaagaggccaaggat

SEQ ID NO: 9214042 - DNA, 22 bp, Homo sapiens
aggccacagtactttgcagacc

SEQ ID NO: 9214043 - DNA, 22 bp, Homo sapiens
aggccacagtcagtgggtgctg

SEQ ID NO: 9214044 - DNA, 22 bp, Homo sapiens
ccagctctggcttcttgctggg

SEQ ID NO: 9214045 - DNA, 22 bp, Homo sapiens
ccagctctgcttgcccagtcag

SEQ ID NO: 9214046 - DNA, 22 bp, Homo sapiens
ccagctctgcttgcccagtcag

SEQ ID NO: 9214047 - DNA, 22 bp, Homo sapiens
ccagctctgtaagctgtgaaat

SEQ ID NO: 9214048 - DNA, 22 bp, Homo sapiens
ccagctctgtaagctgtgaaat

SEQ ID NO: 9214049 - DNA, 22 bp, Homo sapiens
ccagctcttttggctgagtgag

SEQ ID NO: 9214050 - DNA, 22 bp, Homo sapiens
ccagcaggagatgcctgtgtct

SEQ ID NO: 9214051 - DNA, 22 bp, Homo sapiens
ccagcaggagatgcctgtgtct

SEQ ID NO: 9214052 - DNA, 22 bp, Homo sapiens
ccagcaggcagtcatatccttt

SEQ ID NO: 9214053 - DNA, 22 bp, Homo sapiens
ccagctccggtgtgcttatttc

SEQ ID NO: 9214054 - DNA, 22 bp, Homo sapiens
ccagcaggagactagcaacata

SEQ ID NO: 9214055 - DNA, 22 bp, Homo sapiens
ccagcaggagagaacatttccc

SEQ ID NO: 9214056 - DNA, 22 bp, Homo sapiens
ccagctgacgatgcctggtctc

SEQ ID NO: 9214057 - DNA, 22 bp, Homo sapiens
ccagctgagaagtgtaaagtga

SEQ ID NO: 9214058 - DNA, 22 bp, Homo sapiens
ccagctggaagagtgcagaact

SEQ ID NO: 9214059 - DNA, 22 bp, Homo sapiens
ccagctggagctcgcagatagg

SEQ ID NO: 9214060 - DNA, 22 bp, Homo sapiens
ccagctggagccaaggtggact

SEQ ID NO: 9214061 - DNA, 22 bp, Homo sapiens
ccagctggcactgtggctgccc

SEQ ID NO: 9214062 - DNA, 22 bp, Homo sapiens
ccagctggcaggagagtcaggg

SEQ ID NO: 9214063 - DNA, 22 bp, Homo sapiens
aggcctgcctggatcacacaga

SEQ ID NO: 9214064 - DNA, 22 bp, Homo sapiens
ccaggaaggtatgggaagaaaa

SEQ ID NO: 9214065 - DNA, 22 bp, Homo sapiens
ccaggaaggtgtttaactagag

SEQ ID NO: 9214066 - DNA, 22 bp, Homo sapiens
ccaggaagtatgacccaacaga

SEQ ID NO: 9214067 - DNA, 22 bp, Homo sapiens
ccaggacaagccagagggacag

SEQ ID NO: 9214068 - DNA, 22 bp, Homo sapiens
ccaggacaagccagagggacag

SEQ ID NO: 9214069 - DNA, 22 bp, Homo sapiens
aggcctggtgtgccggatgcag

SEQ ID NO: 9214070 - DNA, 22 bp, Homo sapiens
aggcctgtcccagctgaggacg

SEQ ID NO: 9214071 - DNA, 22 bp, Homo sapiens
aggcgggttcagggctgccatg

SEQ ID NO: 9214072 - DNA, 22 bp, Homo sapiens
aggcgggtttaggacaatgctt

SEQ ID NO: 9214073 - DNA, 22 bp, Homo sapiens
ccaggaaggcaggcctccccgc

SEQ ID NO: 9214074 - DNA, 22 bp, Homo sapiens
ccaggaaggcaggcctccccgc

SEQ ID NO: 9214075 - DNA, 22 bp, Homo sapiens
aggcctggccccagttgctagg

SEQ ID NO: 9214076 - DNA, 22 bp, Homo sapiens
aggcctggccccagttgctagg

SEQ ID NO: 9214077 - DNA, 22 bp, Homo sapiens
aggcctggctttggtttgctga

SEQ ID NO: 9214078 - DNA, 22 bp, Homo sapiens
aggcctggcctttatgttcaag

SEQ ID NO: 9214079 - DNA, 22 bp, Homo sapiens
aggctggagtgctggagtgctg

SEQ ID NO: 9214080 - DNA, 22 bp, Homo sapiens
aggctggagtgcagtggcgtga

SEQ ID NO: 9214081 - DNA, 22 bp, Homo sapiens
aggctggagtacagtggctatt

SEQ ID NO: 9214082 - DNA, 22 bp, Homo sapiens
aggctggccagtgctgcagtgg

SEQ ID NO: 9214083 - DNA, 22 bp, Homo sapiens
aggctggcccacctcttgtctt

SEQ ID NO: 9214084 - DNA, 22 bp, Homo sapiens
aggctggccagtgctgcagtgg

SEQ ID NO: 9214085 - DNA, 22 bp, Homo sapiens
aggctggagtgtagcagtgcag

SEQ ID NO: 9214086 - DNA, 22 bp, Homo sapiens
aggctggaggtttgttgcggct

SEQ ID NO: 9214087 - DNA, 22 bp, Homo sapiens
aggctggagagtgcagtggcgt

SEQ ID NO: 9214088 - DNA, 22 bp, Homo sapiens
aggctggagagtgcagtggcgt

SEQ ID NO: 9214089 - DNA, 22 bp, Homo sapiens
aggctggagacccgccaagaaa

SEQ ID NO: 9214090 - DNA, 19 bp, Homo sapiens
aggctggagacaccaggcc

SEQ ID NO: 9214091 - DNA, 22 bp, Homo sapiens
ccaggtcttcactttactgaag

SEQ ID NO: 9214092 - DNA, 22 bp, Homo sapiens
ccaggtctgtcttcttagctca

SEQ ID NO: 9214093 - DNA, 19 bp, Homo sapiens
ccaggtctggggccagatt

SEQ ID NO: 9214094 - DNA, 19 bp, Homo sapiens
ccaggtctggggccagatt

SEQ ID NO: 9214095 - DNA, 22 bp, Homo sapiens
ccaggtctggcactggccagtc

SEQ ID NO: 9214096 - DNA, 22 bp, Homo sapiens
ccaggtctttggccttggcact

SEQ ID NO: 9214097 - DNA, 22 bp, Homo sapiens
ccaggtcttgtttgacatcaat

SEQ ID NO: 9214098 - DNA, 22 bp, Homo sapiens
ccaggtcttggcccccggacct

SEQ ID NO: 9214099 - DNA, 21 bp, Homo sapiens
ccaggtcttggtccttggact

SEQ ID NO: 9214100 - DNA, 21 bp, Homo sapiens
ccaggtcttggtccttggact

SEQ ID NO: 9214101 - DNA, 22 bp, Homo sapiens
ccaggtctttgactaatatgct

SEQ ID NO: 9214102 - DNA, 22 bp, Homo sapiens
ccaggtcttgtttgacatcaat

SEQ ID NO: 9214103 - DNA, 22 bp, Homo sapiens
aggctggaaagggaccagagtg

SEQ ID NO: 9214104 - DNA, 22 bp, Homo sapiens
ccatttgtggtttatttgctct

SEQ ID NO: 9214105 - DNA, 22 bp, Homo sapiens
aggctggctggggatgcgtctt

SEQ ID NO: 9214106 - DNA, 22 bp, Homo sapiens
aggctggcggtgactgctctga

SEQ ID NO: 9214107 - DNA, 22 bp, Homo sapiens
aggctggcggtgactgctctga

SEQ ID NO: 9214108 - DNA, 22 bp, Homo sapiens
ccatttagtaaggaagaacagc

SEQ ID NO: 9214109 - DNA, 22 bp, Homo sapiens
ccatttggcaagaaagagtcat

SEQ ID NO: 9214110 - DNA, 22 bp, Homo sapiens
ccatttggaggtcattaggaca

SEQ ID NO: 9214111 - DNA, 17 bp, Homo sapiens
aggctggccttcacagt

SEQ ID NO: 9214112 - DNA, 22 bp, Homo sapiens
aggctggccctactggctgcct

SEQ ID NO: 9214113 - DNA, 22 bp, Homo sapiens
aggctggccctactggctgcct

SEQ ID NO: 9214114 - DNA, 22 bp, Homo sapiens
ccaggctgctgttggtgtccgc

SEQ ID NO: 9214115 - DNA, 22 bp, Homo sapiens
ccaggctgctgttggtgtccgc

SEQ ID NO: 9214116 - DNA, 22 bp, Homo sapiens
ccaggctctgcgctggacatgg

SEQ ID NO: 9214117 - DNA, 22 bp, Homo sapiens
ccaggctgctgttggtgtccgc

SEQ ID NO: 9214118 - DNA, 22 bp, Homo sapiens
ccaggctctgcgctggacatgg

SEQ ID NO: 9214119 - DNA, 22 bp, Homo sapiens
aggctaaggtgggaggatcgct

SEQ ID NO: 9214120 - DNA, 22 bp, Homo sapiens
aggctaagtgggtgtcagggcc

SEQ ID NO: 9214121 - DNA, 21 bp, Homo sapiens
ccaggctgggagggcagttcc

SEQ ID NO: 9214122 - DNA, 21 bp, Homo sapiens
ccaggctgggagggcagttcc

SEQ ID NO: 9214123 - DNA, 22 bp, Homo sapiens
ccaggctgggcggggaacctgg

SEQ ID NO: 9214124 - DNA, 22 bp, Homo sapiens
ccaggctgggcggggaacctgg

SEQ ID NO: 9214125 - DNA, 22 bp, Homo sapiens
ccaggctgggctacaagttgag

SEQ ID NO: 9214126 - DNA, 15 bp, Homo sapiens
ccaggctgggtgagc

SEQ ID NO: 9214127 - DNA, 22 bp, Homo sapiens
ccaggctggtctgaatttctag

SEQ ID NO: 9214128 - DNA, 22 bp, Homo sapiens
ccaggctgggctacaagttgag

SEQ ID NO: 9214129 - DNA, 22 bp, Homo sapiens
ccaggctgggctacaagttgag

SEQ ID NO: 9214130 - DNA, 22 bp, Homo sapiens
ccaggctgcttagccttatctt

SEQ ID NO: 9214131 - DNA, 22 bp, Homo sapiens
ccaggctgcttagccttatctt

SEQ ID NO: 9214132 - DNA, 22 bp, Homo sapiens
ccaggctgcttagccttatctt

SEQ ID NO: 9214133 - DNA, 22 bp, Homo sapiens
ccaggctggaatcaatattctg

SEQ ID NO: 9214134 - DNA, 22 bp, Homo sapiens
ccaggctggaatcaatattctg

SEQ ID NO: 9214135 - DNA, 22 bp, Homo sapiens
ccaggctgctttattactctgt

SEQ ID NO: 9214136 - DNA, 22 bp, Homo sapiens
ccaggctgctttattactctgt

SEQ ID NO: 9214137 - DNA, 22 bp, Homo sapiens
ccaggctggagtatagtggcgc

SEQ ID NO: 9214138 - DNA, 22 bp, Homo sapiens
ccaggctggagtatagtggcgc

SEQ ID NO: 9214139 - DNA, 22 bp, Homo sapiens
ccaggctggtctgaatttctag

SEQ ID NO: 9214140 - DNA, 22 bp, Homo sapiens
ccagggcctcgtgttctgagtg

SEQ ID NO: 9214141 - DNA, 22 bp, Homo sapiens
ccagggcctgagggcgacgccc

SEQ ID NO: 9214142 - DNA, 22 bp, Homo sapiens
ccagggcctgccacttagcaag

SEQ ID NO: 9214143 - DNA, 23 bp, Homo sapiens
ccagggctacgggcaccgtcctg

SEQ ID NO: 9214144 - DNA, 20 bp, Homo sapiens
ccagggctggctcctgggat

SEQ ID NO: 9214145 - DNA, 22 bp, Homo sapiens
ccagggctcaggctcccagtgg

SEQ ID NO: 9214146 - DNA, 22 bp, Homo sapiens
aggctgaggatccctgtgttct

SEQ ID NO: 9214147 - DNA, 22 bp, Homo sapiens
ccagggctggtgggagatgctg

SEQ ID NO: 9214148 - DNA, 22 bp, Homo sapiens
aggctgagctgacctggtttgg

SEQ ID NO: 9214149 - DNA, 22 bp, Homo sapiens
ccagggctggtgggagatgctg

SEQ ID NO: 9214150 - DNA, 22 bp, Homo sapiens
ccagggctggtggctgcagagg

SEQ ID NO: 9214151 - DNA, 22 bp, Homo sapiens
aggctgaggcaagaggatcact

SEQ ID NO: 9214152 - DNA, 22 bp, Homo sapiens
ccaggtctggaaccaccagggc

SEQ ID NO: 9214153 - DNA, 22 bp, Homo sapiens
ccaggtctgcgggcggcaggca

SEQ ID NO: 9214154 - DNA, 22 bp, Homo sapiens
ccaggtctgcgggcggcaggca

SEQ ID NO: 9214155 - DNA, 22 bp, Homo sapiens
ccaggtctcgggtctgctcgtg

SEQ ID NO: 9214156 - DNA, 22 bp, Homo sapiens
aggaatgaactcgagtgatctg

SEQ ID NO: 9214157 - DNA, 22 bp, Homo sapiens
caggtcctgccttggttaccct

SEQ ID NO: 9214158 - DNA, 22 bp, Homo sapiens
cagggttgcatgcatctgtggg

SEQ ID NO: 9214159 - DNA, 22 bp, Homo sapiens
aggaagaggtagctgtcaaggg

SEQ ID NO: 9214160 - DNA, 22 bp, Homo sapiens
aggaagagggtggcagataatc

SEQ ID NO: 9214161 - DNA, 22 bp, Homo sapiens
aggaagcaccggaatgatgact

SEQ ID NO: 9214162 - DNA, 22 bp, Homo sapiens
aggaagcactggaaggggttgg

SEQ ID NO: 9214163 - DNA, 22 bp, Homo sapiens
aggaagagtgttacctatgggt

SEQ ID NO: 9214164 - DNA, 22 bp, Homo sapiens
aggaaacatgaatctgccttga

SEQ ID NO: 9214165 - DNA, 22 bp, Homo sapiens
aggaaacattgatattgggaaa

SEQ ID NO: 9214166 - DNA, 17 bp, Homo sapiens
aggaaacattttctttc

SEQ ID NO: 9214167 - DNA, 22 bp, Homo sapiens
cagggtggtaccagcatctagt

SEQ ID NO: 9214168 - DNA, 22 bp, Homo sapiens
cagggtggtaccagcatctagt

SEQ ID NO: 9214169 - DNA, 22 bp, Homo sapiens
cagggtggtgaatagctatagt

SEQ ID NO: 9214170 - DNA, 22 bp, Homo sapiens
cagggtggtgaatagctatagt

SEQ ID NO: 9214171 - DNA, 22 bp, Homo sapiens
cagggtggggctggctatcaaa

SEQ ID NO: 9214172 - DNA, 22 bp, Homo sapiens
cagggtggggctggctatcaaa

SEQ ID NO: 9214173 - DNA, 22 bp, Homo sapiens
cagggtggggctggctatcaaa

SEQ ID NO: 9214174 - DNA, 22 bp, Homo sapiens
aggaaaatcgagtctggaggca

SEQ ID NO: 9214175 - DNA, 22 bp, Homo sapiens
aggaaaatgatattctgctgtt

SEQ ID NO: 9214176 - DNA, 22 bp, Homo sapiens
aggaaaatggaccagagttgtt

SEQ ID NO: 9214177 - DNA, 22 bp, Homo sapiens
aggaaaacacagtattgatgga

SEQ ID NO: 9214178 - DNA, 22 bp, Homo sapiens
aggaaaacagaccaaggagctc

SEQ ID NO: 9214179 - DNA, 22 bp, Homo sapiens
agctttgggggtaggtatagag

SEQ ID NO: 9214180 - DNA, 22 bp, Homo sapiens
agctttgggccactggctggat

SEQ ID NO: 9214181 - DNA, 22 bp, Homo sapiens
cagggacccgcacaggtagcat

SEQ ID NO: 9214182 - DNA, 22 bp, Homo sapiens
cagggacatttccaagagaatt

SEQ ID NO: 9214183 - DNA, 22 bp, Homo sapiens
cagggacattggtggccaggtt

SEQ ID NO: 9214184 - DNA, 22 bp, Homo sapiens
cagggacatgactggtctctgt

SEQ ID NO: 9214185 - DNA, 22 bp, Homo sapiens
cagggacagggatcatttgctt

SEQ ID NO: 9214186 - DNA, 22 bp, Homo sapiens
cagggacaggggagaaaagatg

SEQ ID NO: 9214187 - DNA, 22 bp, Homo sapiens
cagggacataagaggaacatgg

SEQ ID NO: 9214188 - DNA, 22 bp, Homo sapiens
cagggacataagaggaacatgg

SEQ ID NO: 9214189 - DNA, 20 bp, Homo sapiens
cagggacagtggcagattca

SEQ ID NO: 9214190 - DNA, 20 bp, Homo sapiens
agctttctccttggagctcc

SEQ ID NO: 9214191 - DNA, 22 bp, Homo sapiens
agctttctatatatgagttgct

SEQ ID NO: 9214192 - DNA, 22 bp, Homo sapiens
caggctggagttacctttaggg

SEQ ID NO: 9214193 - DNA, 22 bp, Homo sapiens
caggctggagttacctttaggg

SEQ ID NO: 9214194 - DNA, 22 bp, Homo sapiens
caggctgtgggagtcaggaccc

SEQ ID NO: 9214195 - DNA, 22 bp, Homo sapiens
caggcttaggagtcagcctgct

SEQ ID NO: 9214196 - DNA, 22 bp, Homo sapiens
caggctgtgttcctggaacccc

SEQ ID NO: 9214197 - DNA, 22 bp, Homo sapiens
caggctgtggatcaggagcctt

SEQ ID NO: 9214198 - DNA, 22 bp, Homo sapiens
agcttctccatctgcccagaga

SEQ ID NO: 9214199 - DNA, 22 bp, Homo sapiens
agcttctcaggagtctgaggca

SEQ ID NO: 9214200 - DNA, 22 bp, Homo sapiens
caggcttgctgctagagcactt

SEQ ID NO: 9214201 - DNA, 22 bp, Homo sapiens
agcttctcaggagtctgaggca

SEQ ID NO: 9214202 - DNA, 22 bp, Homo sapiens
agcttctcaggagtctgaggca

SEQ ID NO: 9214203 - DNA, 22 bp, Homo sapiens
caggcttgctagaggagccaaa

SEQ ID NO: 9214204 - DNA, 22 bp, Homo sapiens
caggcttgagggcaggcccagt

SEQ ID NO: 9214205 - DNA, 22 bp, Homo sapiens
agctttctagactctgtggtca

SEQ ID NO: 9214206 - DNA, 23 bp, Homo sapiens
agcttctggttcaggtcaagcag

SEQ ID NO: 9214207 - DNA, 22 bp, Homo sapiens
agcttctggaaggcaaggcttg

SEQ ID NO: 9214208 - DNA, 22 bp, Homo sapiens
agcttctgcatcttttcttccc

SEQ ID NO: 9214209 - DNA, 22 bp, Homo sapiens
agcttctgcccgtgtttgctct

SEQ ID NO: 9214210 - DNA, 22 bp, Homo sapiens
agcttctctcagggtatctttc

SEQ ID NO: 9214211 - DNA, 22 bp, Homo sapiens
agcttctcggctgggagtattt

SEQ ID NO: 9214212 - DNA, 22 bp, Homo sapiens
agcttctccctttcctattggt

SEQ ID NO: 9214213 - DNA, 22 bp, Homo sapiens
agcttctctctttgcactcaca

SEQ ID NO: 9214214 - DNA, 22 bp, Homo sapiens
caggaagaaagaggtgaggtgt

SEQ ID NO: 9214215 - DNA, 22 bp, Homo sapiens
caggaagaccagggctgtggct

SEQ ID NO: 9214216 - DNA, 22 bp, Homo sapiens
caggaagaagggtggtgagtcc

SEQ ID NO: 9214217 - DNA, 22 bp, Homo sapiens
caggaaaaggagactttagcac

SEQ ID NO: 9214218 - DNA, 17 bp, Homo sapiens
agctgcctctcccacca

SEQ ID NO: 9214219 - DNA, 22 bp, Homo sapiens
agctgcctcctggtgccccatc

SEQ ID NO: 9214220 - DNA, 21 bp, Homo sapiens
agctgcctccacttctgaggc

SEQ ID NO: 9214221 - DNA, 22 bp, Homo sapiens
agctgcctccatggtcaaagat

SEQ ID NO: 9214222 - DNA, 22 bp, Homo sapiens
agctgcctccctgtgcttgtcc

SEQ ID NO: 9214223 - DNA, 22 bp, Homo sapiens
agctgcctgccatgccgctggt

SEQ ID NO: 9214224 - DNA, 21 bp, Homo sapiens
agctgcctgctctggacctgg

SEQ ID NO: 9214225 - DNA, 22 bp, Homo sapiens
agctgcctgctgcactcggtgc

SEQ ID NO: 9214226 - DNA, 22 bp, Homo sapiens
agctgcctgcatttatatcctg

SEQ ID NO: 9214227 - DNA, 22 bp, Homo sapiens
agctgcctctgaactttaattc

SEQ ID NO: 9214228 - DNA, 22 bp, Homo sapiens
agctgcctctgctggtttagaa

SEQ ID NO: 9214229 - DNA, 22 bp, Homo sapiens
agctgcctctcttgaggttacg

SEQ ID NO: 9214230 - DNA, 22 bp, Homo sapiens
agctgcctgcttatgagctcca

SEQ ID NO: 9214231 - DNA, 22 bp, Homo sapiens
agctgcctggagccagagttga

SEQ ID NO: 9214232 - DNA, 22 bp, Homo sapiens
agctgctttgccaatgcgttcc

SEQ ID NO: 9214233 - DNA, 21 bp, Homo sapiens
agctgctttcagctcctagag

SEQ ID NO: 9214234 - DNA, 22 bp, Homo sapiens
agctggaacgtcacaggagcag

SEQ ID NO: 9214235 - DNA, 18 bp, Homo sapiens
agctgcttttggcttaaa

SEQ ID NO: 9214236 - DNA, 22 bp, Homo sapiens
caggaagaccagggctgtggct

SEQ ID NO: 9214237 - DNA, 22 bp, Homo sapiens
agctgcctagtagattgattgg

SEQ ID NO: 9214238 - DNA, 21 bp, Homo sapiens
agctgcctccacttctgaggc

SEQ ID NO: 9214239 - DNA, 22 bp, Homo sapiens
agctgcctcagtcactcatggc

SEQ ID NO: 9214240 - DNA, 22 bp, Homo sapiens
agctgcctcagcaacacagacc

SEQ ID NO: 9214241 - DNA, 22 bp, Homo sapiens
caggcagagtgagaagcccttg

SEQ ID NO: 9214242 - DNA, 19 bp, Homo sapiens
agctggggcggtgtgtgtt

SEQ ID NO: 9214243 - DNA, 22 bp, Homo sapiens
agctgggtgcggtggctcatgc

SEQ ID NO: 9214244 - DNA, 22 bp, Homo sapiens
caggcagaggaggccttctcct

SEQ ID NO: 9214245 - DNA, 20 bp, Homo sapiens
caggcagaggatgctgacca

SEQ ID NO: 9214246 - DNA, 22 bp, Homo sapiens
caggcagaggaagtctgggtct

SEQ ID NO: 9214247 - DNA, 22 bp, Homo sapiens
caggcagaggaagtctgggtct

SEQ ID NO: 9214248 - DNA, 22 bp, Homo sapiens
caggcagagtcagattagactt

SEQ ID NO: 9214249 - DNA, 22 bp, Homo sapiens
agctggtatgaacaggatagga

SEQ ID NO: 9214250 - DNA, 22 bp, Homo sapiens
agctggtatttgttagggagtt

SEQ ID NO: 9214251 - DNA, 22 bp, Homo sapiens
agctgggtgttcttgggcctaa

SEQ ID NO: 9214252 - DNA, 22 bp, Homo sapiens
agctgggtgtgtatcagataaa

SEQ ID NO: 9214253 - DNA, 22 bp, Homo sapiens
agctgggttcagaggcacatgg

SEQ ID NO: 9214254 - DNA, 22 bp, Homo sapiens
agctgggcctgagctggaagct

SEQ ID NO: 9214255 - DNA, 22 bp, Homo sapiens
agctggaggagtttctcctagc

SEQ ID NO: 9214256 - DNA, 22 bp, Homo sapiens
agctgggactcaactgtctggg

SEQ ID NO: 9214257 - DNA, 22 bp, Homo sapiens
agctgggactcaactgtctggg

SEQ ID NO: 9214258 - DNA, 22 bp, Homo sapiens
agctggagatgcccagcaccgg

SEQ ID NO: 9214259 - DNA, 22 bp, Homo sapiens
agctggagattctggggacagt

SEQ ID NO: 9214260 - DNA, 19 bp, Homo sapiens
agctggagattggagggca

SEQ ID NO: 9214261 - DNA, 22 bp, Homo sapiens
agctggagccagtgtgaggctt

SEQ ID NO: 9214262 - DNA, 22 bp, Homo sapiens
agctggagccagtgtgaggctt

SEQ ID NO: 9214263 - DNA, 22 bp, Homo sapiens
agctggagcttcaagcaggtaa

SEQ ID NO: 9214264 - DNA, 20 bp, Homo sapiens
agctggagaagggcccttcc

SEQ ID NO: 9214265 - DNA, 22 bp, Homo sapiens
agctggagaaacctgggagggt

SEQ ID NO: 9214266 - DNA, 22 bp, Homo sapiens
agctggagaaacctgggagggt

SEQ ID NO: 9214267 - DNA, 22 bp, Homo sapiens
agctggaattacaggagcccat

SEQ ID NO: 9214268 - DNA, 22 bp, Homo sapiens
agctggagatgagtgacgtgcc

SEQ ID NO: 9214269 - DNA, 22 bp, Homo sapiens
agctggagatgcccagcaccgg

SEQ ID NO: 9214270 - DNA, 22 bp, Homo sapiens
agctggagatcatgctgatact

SEQ ID NO: 9214271 - DNA, 22 bp, Homo sapiens
agctggagaatgtggatgatcc

SEQ ID NO: 9214272 - DNA, 22 bp, Homo sapiens
agctggagagtttccaggaagg

SEQ ID NO: 9214273 - DNA, 22 bp, Homo sapiens
agctggagatcatgctgatact

SEQ ID NO: 9214274 - DNA, 22 bp, Homo sapiens
aggaggctggttcaggccatat

SEQ ID NO: 9214275 - DNA, 22 bp, Homo sapiens
aggaggggcaatgatagtctgg

SEQ ID NO: 9214276 - DNA, 22 bp, Homo sapiens
aggaggtgagcggtcatgtggt

SEQ ID NO: 9214277 - DNA, 22 bp, Homo sapiens
aggagggttctctggacagagg

SEQ ID NO: 9214278 - DNA, 22 bp, Homo sapiens
aggagggtttcaatgggatgag

SEQ ID NO: 9214279 - DNA, 22 bp, Homo sapiens
aggagggttgaggaggatactt

SEQ ID NO: 9214280 - DNA, 22 bp, Homo sapiens
catcagaatctgagtctctgcc

SEQ ID NO: 9214281 - DNA, 22 bp, Homo sapiens
catcagaatagctctgtggata

SEQ ID NO: 9214282 - DNA, 22 bp, Homo sapiens
catcagaagatggctctggaaa

SEQ ID NO: 9214283 - DNA, 22 bp, Homo sapiens
aggaggctgcaaccctgaggcc

SEQ ID NO: 9214284 - DNA, 22 bp, Homo sapiens
aggaggctgggcacagtggcct

SEQ ID NO: 9214285 - DNA, 22 bp, Homo sapiens
catattttagttgctgaacagc

SEQ ID NO: 9214286 - DNA, 19 bp, Homo sapiens
catatttttgggctggcat

SEQ ID NO: 9214287 - DNA, 22 bp, Homo sapiens
cagttctctgtgcctcgctggg

SEQ ID NO: 9214288 - DNA, 22 bp, Homo sapiens
cagttctcttgatcgtctcttg

SEQ ID NO: 9214289 - DNA, 22 bp, Homo sapiens
cagttataggagccattgtata

SEQ ID NO: 9214290 - DNA, 22 bp, Homo sapiens
cagtctcttttcagctccatcc

SEQ ID NO: 9214291 - DNA, 22 bp, Homo sapiens
aggacaagacaaggaccagaga

SEQ ID NO: 9214292 - DNA, 22 bp, Homo sapiens
aggacaagacaaggaccagaga

SEQ ID NO: 9214293 - DNA, 22 bp, Homo sapiens
aggaattttgtatggatactgt

SEQ ID NO: 9214294 - DNA, 19 bp, Homo sapiens
aggaatttctcagggaggc

SEQ ID NO: 9214295 - DNA, 22 bp, Homo sapiens
aggaatttaagggctcagagag

SEQ ID NO: 9214296 - DNA, 22 bp, Homo sapiens
aggaatttagacagggcataaa

SEQ ID NO: 9214297 - DNA, 22 bp, Homo sapiens
aggaatttgctggaacacagat

SEQ ID NO: 9214298 - DNA, 22 bp, Homo sapiens
aggaatttggggttacatgatg

SEQ ID NO: 9214299 - DNA, 22 bp, Homo sapiens
aggaattttacatctcagagag

SEQ ID NO: 9214300 - DNA, 21 bp, Homo sapiens
cagtgaggccctcctgttccc

SEQ ID NO: 9214301 - DNA, 17 bp, Homo sapiens
cagtgaggcctttcctc

SEQ ID NO: 9214302 - DNA, 22 bp, Homo sapiens
cagtgaggctctgctgagcggt

SEQ ID NO: 9214303 - DNA, 22 bp, Homo sapiens
cagtgagggaagatctcagcac

SEQ ID NO: 9214304 - DNA, 22 bp, Homo sapiens
cagtgagggcattcagtgctgg

SEQ ID NO: 9214305 - DNA, 22 bp, Homo sapiens
cagtgagggcattcagtgctgg

SEQ ID NO: 9214306 - DNA, 22 bp, Homo sapiens
cagtgagggcattcagtgctgg

SEQ ID NO: 9214307 - DNA, 22 bp, Homo sapiens
cagtgcagccaaggacaggcac

SEQ ID NO: 9214308 - DNA, 22 bp, Homo sapiens
cagtgcagctgccccgctggta

SEQ ID NO: 9214309 - DNA, 22 bp, Homo sapiens
cagtgcaggcttgtggccgcag

SEQ ID NO: 9214310 - DNA, 22 bp, Homo sapiens
aggagatcagcttagggaaggt

SEQ ID NO: 9214311 - DNA, 22 bp, Homo sapiens
aggagcagattggtaagatcat

SEQ ID NO: 9214312 - DNA, 22 bp, Homo sapiens
aggagatggagctcagtgggca

SEQ ID NO: 9214313 - DNA, 22 bp, Homo sapiens
aggagcagcccactcctgtcct

SEQ ID NO: 9214314 - DNA, 22 bp, Homo sapiens
aggagcagcttctgaaccatgt

SEQ ID NO: 9214315 - DNA, 22 bp, Homo sapiens
aggagctgatagtctatggaga

SEQ ID NO: 9214316 - DNA, 22 bp, Homo sapiens
aggagctggcctagaaaggaga

SEQ ID NO: 9214317 - DNA, 22 bp, Homo sapiens
aggagctggcctagaaaggaga

SEQ ID NO: 9214318 - DNA, 22 bp, Homo sapiens
aggagctgggctgctgctggga

SEQ ID NO: 9214319 - DNA, 22 bp, Homo sapiens
aggagctgggagaaggactaaa

SEQ ID NO: 9214320 - DNA, 22 bp, Homo sapiens
aggatataaaaagactatttgg

SEQ ID NO: 9214321 - DNA, 22 bp, Homo sapiens
aggataagtttgattcttgcca

SEQ ID NO: 9214322 - DNA, 22 bp, Homo sapiens
catgtctgagtagagtgtgatt

SEQ ID NO: 9214323 - DNA, 22 bp, Homo sapiens
aggcacagggatgcggagccag

SEQ ID NO: 9214324 - DNA, 22 bp, Homo sapiens
aggcacagggatgcggagccag

SEQ ID NO: 9214325 - DNA, 22 bp, Homo sapiens
aggcacagggatgcggagccag

SEQ ID NO: 9214326 - DNA, 22 bp, Homo sapiens
aggcacaggtggacttcacagt

SEQ ID NO: 9214327 - DNA, 22 bp, Homo sapiens
aggcacaggtggacttcacagt

SEQ ID NO: 9214328 - DNA, 22 bp, Homo sapiens
aggcagagagcagtggccgtct

SEQ ID NO: 9214329 - DNA, 22 bp, Homo sapiens
aggcagagagcagtggccgtct

SEQ ID NO: 9214330 - DNA, 22 bp, Homo sapiens
aggcactgacagattctgtgtc

SEQ ID NO: 9214331 - DNA, 22 bp, Homo sapiens
aggcactgaaaggtggccagag

SEQ ID NO: 9214332 - DNA, 22 bp, Homo sapiens
aggcactgaagaactctttttg

SEQ ID NO: 9214333 - DNA, 22 bp, Homo sapiens
aggcacagtttcatccccgggc

SEQ ID NO: 9214334 - DNA, 20 bp, Homo sapiens
aggcacagttcctagttggg

SEQ ID NO: 9214335 - DNA, 20 bp, Homo sapiens
aggcacagttcctagttggg

SEQ ID NO: 9214336 - DNA, 19 bp, Homo sapiens
aggcacaggttgtctggac

SEQ ID NO: 9214337 - DNA, 19 bp, Homo sapiens
aggcacaggttgtctggac

SEQ ID NO: 9214338 - DNA, 22 bp, Homo sapiens
aggcacagtgcctggaatcaaa

SEQ ID NO: 9214339 - DNA, 22 bp, Homo sapiens
aggcacagtgcctggaatcaaa

SEQ ID NO: 9214340 - DNA, 22 bp, Homo sapiens
aggcacagtggccctgtttggg

SEQ ID NO: 9214341 - DNA, 22 bp, Homo sapiens
aggcacagtggctcacacctgt

SEQ ID NO: 9214342 - DNA, 22 bp, Homo sapiens
ccaaagaaacccaagctcaggg

SEQ ID NO: 9214343 - DNA, 22 bp, Homo sapiens
ccaaaccatccatctccaggct

SEQ ID NO: 9214344 - DNA, 22 bp, Homo sapiens
ccaaaattattacatttgtagg

SEQ ID NO: 9214345 - DNA, 22 bp, Homo sapiens
ccaaaattaagcctcttatgtt

SEQ ID NO: 9214346 - DNA, 22 bp, Homo sapiens
aggcaggcccctgagaatagac

SEQ ID NO: 9214347 - DNA, 22 bp, Homo sapiens
ccaaagcaagtcacatgatcaa

SEQ ID NO: 9214348 - DNA, 22 bp, Homo sapiens
ccaaagcaagtcacatgatcaa

SEQ ID NO: 9214349 - DNA, 18 bp, Homo sapiens
aggcaggatcctggcctc

SEQ ID NO: 9214350 - DNA, 18 bp, Homo sapiens
aggcaggatcctggcctc

SEQ ID NO: 9214351 - DNA, 22 bp, Homo sapiens
aggcaggccgtgtccctcctca

SEQ ID NO: 9214352 - DNA, 22 bp, Homo sapiens
aggcaggccctgggccatcccg

SEQ ID NO: 9214353 - DNA, 20 bp, Homo sapiens
aggcagagcgcacttttaga

SEQ ID NO: 9214354 - DNA, 22 bp, Homo sapiens
aggcagagctaggaagaattgt

SEQ ID NO: 9214355 - DNA, 22 bp, Homo sapiens
aggcagagctgatgttctgtga

SEQ ID NO: 9214356 - DNA, 22 bp, Homo sapiens
aggcagagctgatgttctgtga

SEQ ID NO: 9214357 - DNA, 22 bp, Homo sapiens
aggcagagctgggttttgaaat

SEQ ID NO: 9214358 - DNA, 22 bp, Homo sapiens
aggcagaggagaatgatcttcc

SEQ ID NO: 9214359 - DNA, 22 bp, Homo sapiens
aggcagaggagaatgatcttcc

SEQ ID NO: 9214360 - DNA, 22 bp, Homo sapiens
aggcagctggcagcacccaggg

SEQ ID NO: 9214361 - DNA, 22 bp, Homo sapiens
aggcagctggcagcacccaggg

SEQ ID NO: 9214362 - DNA, 21 bp, Homo sapiens
aggcagcgtgagggccactca

SEQ ID NO: 9214363 - DNA, 22 bp, Homo sapiens
aggcagctggcaaattctagag

SEQ ID NO: 9214364 - DNA, 22 bp, Homo sapiens
aggcagcgtagcaaggctagta

SEQ ID NO: 9214365 - DNA, 20 bp, Homo sapiens
aggcagctgggaaatgaggg

SEQ ID NO: 9214366 - DNA, 22 bp, Homo sapiens
aggcagctgtgaggactggatt

SEQ ID NO: 9214367 - DNA, 20 bp, Homo sapiens
aggcagctggccaggcaggt

SEQ ID NO: 9214368 - DNA, 20 bp, Homo sapiens
aggcagctggccaggcaggt

SEQ ID NO: 9214369 - DNA, 22 bp, Homo sapiens
aggcagctggcagcacccaggg

SEQ ID NO: 9214370 - DNA, 22 bp, Homo sapiens
aggcagcttctgattagcagcg

SEQ ID NO: 9214371 - DNA, 22 bp, Homo sapiens
aggcagcttaagccctggccca

SEQ ID NO: 9214372 - DNA, 22 bp, Homo sapiens
aggcagcttctgattagcagcg

SEQ ID NO: 9214373 - DNA, 22 bp, Homo sapiens
aggcagctttaactggtagtag

SEQ ID NO: 9214374 - DNA, 22 bp, Homo sapiens
aggcagctttctggtgcaccat

SEQ ID NO: 9214375 - DNA, 22 bp, Homo sapiens
aggcagctttctgtaggggtgt

SEQ ID NO: 9214376 - DNA, 22 bp, Homo sapiens
aggagacataactatgatgaga

SEQ ID NO: 9214377 - DNA, 22 bp, Homo sapiens
aggagaccttttgagtgtgaga

SEQ ID NO: 9214378 - DNA, 22 bp, Homo sapiens
aggagaccttcaccacttccac

SEQ ID NO: 9214379 - DNA, 20 bp, Homo sapiens
aggagaccaagccaagtgga

SEQ ID NO: 9214380 - DNA, 22 bp, Homo sapiens
aggagacccaatgccagaaaga

SEQ ID NO: 9214381 - DNA, 17 bp, Homo sapiens
aggaagcgagctggcct

SEQ ID NO: 9214382 - DNA, 23 bp, Homo sapiens
aggaaggaggtcctaacagtatc

SEQ ID NO: 9214383 - DNA, 22 bp, Homo sapiens
aggagcagaccgtagtcctgca

SEQ ID NO: 9214384 - DNA, 22 bp, Homo sapiens
aggagccatggaggtgaggcgg

SEQ ID NO: 9214385 - DNA, 22 bp, Homo sapiens
aggagccattttccaagggcga

SEQ ID NO: 9214386 - DNA, 22 bp, Homo sapiens
acaggggctccgaaggtgaggg

SEQ ID NO: 9214387 - DNA, 22 bp, Homo sapiens
acaggggctccgaaggtgaggg

SEQ ID NO: 9214388 - DNA, 22 bp, Homo sapiens
acagggtgaatgtgacattatc

SEQ ID NO: 9214389 - DNA, 22 bp, Homo sapiens
acagggtgactttgtgacagat

SEQ ID NO: 9214390 - DNA, 22 bp, Homo sapiens
aggagccctgcgggaggcagag

SEQ ID NO: 9214391 - DNA, 22 bp, Homo sapiens
aggagccctccgttgcttcatc

SEQ ID NO: 9214392 - DNA, 22 bp, Homo sapiens
aggagcccctcttcagtcctgg

SEQ ID NO: 9214393 - DNA, 23 bp, Homo sapiens
aggagcccaaggagaggtaactt

SEQ ID NO: 9214394 - DNA, 22 bp, Homo sapiens
aggagcccagcctgggctcgga

SEQ ID NO: 9214395 - DNA, 23 bp, Homo sapiens
aggagcccctaattctgggcagc

SEQ ID NO: 9214396 - DNA, 22 bp, Homo sapiens
aggagctgcatggatacctggt

SEQ ID NO: 9214397 - DNA, 23 bp, Homo sapiens
acatacataagcaccacattttg

SEQ ID NO: 9214398 - DNA, 22 bp, Homo sapiens
aggcacagatttggggaaagca

SEQ ID NO: 9214399 - DNA, 22 bp, Homo sapiens
aggcacagatttggggaaagca

SEQ ID NO: 9214400 - DNA, 18 bp, Homo sapiens
aggcacagagcatacata

SEQ ID NO: 9214401 - DNA, 22 bp, Homo sapiens
aggcacagaatggcattcagtg

SEQ ID NO: 9214402 - DNA, 22 bp, Homo sapiens
aggcacagagaagtaaagtatc

SEQ ID NO: 9214403 - DNA, 22 bp, Homo sapiens
aggcacagagaatgccctccat

SEQ ID NO: 9214404 - DNA, 22 bp, Homo sapiens
aggcacagagaggttaaatgca

SEQ ID NO: 9214405 - DNA, 22 bp, Homo sapiens
aggcacagaatggcattcagtg

SEQ ID NO: 9214406 - DNA, 22 bp, Homo sapiens
aggcaacatgggccaggcagaa

SEQ ID NO: 9214407 - DNA, 22 bp, Homo sapiens
aggcaacaagggtagtcagtga

SEQ ID NO: 9214408 - DNA, 22 bp, Homo sapiens
aggcaacaagggtagtcagtga

SEQ ID NO: 9214409 - DNA, 22 bp, Homo sapiens
aggcaaagagccagcaaatctg

SEQ ID NO: 9214410 - DNA, 22 bp, Homo sapiens
aggagggtcatgttgaagtgta

SEQ ID NO: 9214411 - DNA, 22 bp, Homo sapiens
aggagggagatgcccatcctgg

SEQ ID NO: 9214412 - DNA, 22 bp, Homo sapiens
aggagggagatgcccatcctgg

SEQ ID NO: 9214413 - DNA, 20 bp, Homo sapiens
aggagggacctggattggcg

SEQ ID NO: 9214414 - DNA, 22 bp, Homo sapiens
aggaggccgctgatgggctccc

SEQ ID NO: 9214415 - DNA, 17 bp, Homo sapiens
aggagggaaatagcttg

SEQ ID NO: 9214416 - DNA, 18 bp, Homo sapiens
aggaaagaaaggcaggtg

SEQ ID NO: 9214417 - DNA, 22 bp, Homo sapiens
aggaagagcattcacatggtag

SEQ ID NO: 9214418 - DNA, 18 bp, Homo sapiens
aggaagcaggaggaaggc

SEQ ID NO: 9214419 - DNA, 22 bp, Homo sapiens
aggaagccactgaatgaaagtt

SEQ ID NO: 9214420 - DNA, 22 bp, Homo sapiens
aggaagccacgagtggcacggg

SEQ ID NO: 9214421 - DNA, 22 bp, Homo sapiens
aggaaagaaaggaggtgcattt

SEQ ID NO: 9214422 - DNA, 23 bp, Homo sapiens
aggaaactgaaggggccctctat

SEQ ID NO: 9214423 - DNA, 22 bp, Homo sapiens
agctttggtgctgtcacacaaa

SEQ ID NO: 9214424 - DNA, 22 bp, Homo sapiens
agctttggttgaggggagtgtg

SEQ ID NO: 9214425 - DNA, 22 bp, Homo sapiens
agctgggagctgaaggctgatt

SEQ ID NO: 9214426 - DNA, 19 bp, Homo sapiens
agctggctcttctttgtct

SEQ ID NO: 9214427 - DNA, 22 bp, Homo sapiens
agctgggaggctcctctgtgac

SEQ ID NO: 9214428 - DNA, 22 bp, Homo sapiens
agctgggcaaaatgtgaggttg

SEQ ID NO: 9214429 - DNA, 22 bp, Homo sapiens
agctgtgggcctgggagagctg

SEQ ID NO: 9214430 - DNA, 22 bp, Homo sapiens
agctgtgggatttgggtgtgcc

SEQ ID NO: 9214431 - DNA, 22 bp, Homo sapiens
agctgtgggatttgggtgtgcc

SEQ ID NO: 9214432 - DNA, 22 bp, Homo sapiens
agctgtggggaggaggctagca

SEQ ID NO: 9214433 - DNA, 22 bp, Homo sapiens
agctgcttcctctttgatgtca

SEQ ID NO: 9214434 - DNA, 22 bp, Homo sapiens
agctgcttataagatttgggag

SEQ ID NO: 9214435 - DNA, 22 bp, Homo sapiens
agctgctgtcctaggcactgta

SEQ ID NO: 9214436 - DNA, 22 bp, Homo sapiens
agctgctggggagggcagacac

SEQ ID NO: 9214437 - DNA, 22 bp, Homo sapiens
agctgctgtttcttgcacgtat

SEQ ID NO: 9214438 - DNA, 22 bp, Homo sapiens
agctgcttagagtcctcaggat

SEQ ID NO: 9214439 - DNA, 22 bp, Homo sapiens
acagcctgcagccccaggtcgc

SEQ ID NO: 9214440 - DNA, 22 bp, Homo sapiens
acagcctgcagccccaggtcgc

SEQ ID NO: 9214441 - DNA, 20 bp, Homo sapiens
agctggcctgtcctaggcct

SEQ ID NO: 9214442 - DNA, 22 bp, Homo sapiens
acagcctgatttatggagcagt

SEQ ID NO: 9214443 - DNA, 22 bp, Homo sapiens
acagcctgagagtggagctggc

SEQ ID NO: 9214444 - DNA, 22 bp, Homo sapiens
acagcctgacttttgttgtcac

SEQ ID NO: 9214445 - DNA, 22 bp, Homo sapiens
acagcctgacttttgttgtcac

SEQ ID NO: 9214446 - DNA, 21 bp, Homo sapiens
agctggctctctctggagaga

SEQ ID NO: 9214447 - DNA, 21 bp, Homo sapiens
agctggctctctctggagaga

SEQ ID NO: 9214448 - DNA, 21 bp, Homo sapiens
agctggctctctctggagaga

SEQ ID NO: 9214449 - DNA, 22 bp, Homo sapiens
agctggctcagccgggtggtct

SEQ ID NO: 9214450 - DNA, 22 bp, Homo sapiens
agctggctatgccctgtgaacc

SEQ ID NO: 9214451 - DNA, 22 bp, Homo sapiens
agctggctatgccctgtgaacc

SEQ ID NO: 9214452 - DNA, 22 bp, Homo sapiens
agctggctatgccctgtgaacc

SEQ ID NO: 9214453 - DNA, 22 bp, Homo sapiens
agctggccttcggtgtcactgg

SEQ ID NO: 9214454 - DNA, 22 bp, Homo sapiens
agctggctatacttgaaaagtc

SEQ ID NO: 9214455 - DNA, 22 bp, Homo sapiens
agctggctatacttgaaaagtc

SEQ ID NO: 9214456 - DNA, 21 bp, Homo sapiens
agctggctatagttagtgatg

SEQ ID NO: 9214457 - DNA, 22 bp, Homo sapiens
agctggccttagtgagcacctg

SEQ ID NO: 9214458 - DNA, 22 bp, Homo sapiens
agctccaggtgcaagtcatggt

SEQ ID NO: 9214459 - DNA, 22 bp, Homo sapiens
agctccaggtgcaagtcatggt

SEQ ID NO: 9214460 - DNA, 22 bp, Homo sapiens
acagccagaggtggtcctgggt

SEQ ID NO: 9214461 - DNA, 22 bp, Homo sapiens
agctgcagctacagtgttggtt

SEQ ID NO: 9214462 - DNA, 22 bp, Homo sapiens
agctgcaggaagtagaagcgga

SEQ ID NO: 9214463 - DNA, 22 bp, Homo sapiens
agctgcagcttcctagtccagc

SEQ ID NO: 9214464 - DNA, 22 bp, Homo sapiens
agctgcaggagtcgcctaggat

SEQ ID NO: 9214465 - DNA, 22 bp, Homo sapiens
agctgctgggatacagtagtga

SEQ ID NO: 9214466 - DNA, 22 bp, Homo sapiens
agctgcaggcccatgctcagtc

SEQ ID NO: 9214467 - DNA, 22 bp, Homo sapiens
agctgcagccctcctgcatggc

SEQ ID NO: 9214468 - DNA, 22 bp, Homo sapiens
aggctccagggctgtgtgggag

SEQ ID NO: 9214469 - DNA, 22 bp, Homo sapiens
aggctccaggcctccctgcatg

SEQ ID NO: 9214470 - DNA, 22 bp, Homo sapiens
aggctccacggtcactggctct

SEQ ID NO: 9214471 - DNA, 22 bp, Homo sapiens
aggctccacggtcactggctct

SEQ ID NO: 9214472 - DNA, 22 bp, Homo sapiens
acattgatatttcaaatacagg

SEQ ID NO: 9214473 - DNA, 22 bp, Homo sapiens
acattgaacagtacaaatgatc

SEQ ID NO: 9214474 - DNA, 22 bp, Homo sapiens
acattgaattcaaaattactga

SEQ ID NO: 9214475 - DNA, 22 bp, Homo sapiens
acattacactgtggtcctgttc

SEQ ID NO: 9214476 - DNA, 23 bp, Homo sapiens
acattacacgcagtaattgcccc

SEQ ID NO: 9214477 - DNA, 22 bp, Homo sapiens
aggccctgcaggaagcaggatg

SEQ ID NO: 9214478 - DNA, 22 bp, Homo sapiens
acattctacagttaaccattag

SEQ ID NO: 9214479 - DNA, 22 bp, Homo sapiens
acattctatgaagataatttta

SEQ ID NO: 9214480 - DNA, 22 bp, Homo sapiens
acattcttggactccactctag

SEQ ID NO: 9214481 - DNA, 22 bp, Homo sapiens
acattgaaagcatattatctcc

SEQ ID NO: 9214482 - DNA, 22 bp, Homo sapiens
acatgaaaagactatctgatta

SEQ ID NO: 9214483 - DNA, 22 bp, Homo sapiens
acatctttttggaaacggctga

SEQ ID NO: 9214484 - DNA, 22 bp, Homo sapiens
aggccagcattctctctccagg

SEQ ID NO: 9214485 - DNA, 22 bp, Homo sapiens
aggccagcagcatgacggcatc

SEQ ID NO: 9214486 - DNA, 22 bp, Homo sapiens
aggcccagggctgctctctgaa

SEQ ID NO: 9214487 - DNA, 22 bp, Homo sapiens
aggcccagggctgctctctgaa

SEQ ID NO: 9214488 - DNA, 21 bp, Homo sapiens
aggcccagctttcctcttgct

SEQ ID NO: 9214489 - DNA, 22 bp, Homo sapiens
aggccctgagaaaatccctgca

SEQ ID NO: 9214490 - DNA, 22 bp, Homo sapiens
aggccagggtcccacactcgca

SEQ ID NO: 9214491 - DNA, 22 bp, Homo sapiens
aggcccagctgggccaggaaca

SEQ ID NO: 9214492 - DNA, 22 bp, Homo sapiens
aggccacagcctgggaggtgac

SEQ ID NO: 9214493 - DNA, 22 bp, Homo sapiens
aggccacaggattgcacagcat

SEQ ID NO: 9214494 - DNA, 22 bp, Homo sapiens
aggccacaggtggaagccagag

SEQ ID NO: 9214495 - DNA, 22 bp, Homo sapiens
aggccacaggcaccctgtgttc

SEQ ID NO: 9214496 - DNA, 22 bp, Homo sapiens
aggccagcacgacagccgcagg

SEQ ID NO: 9214497 - DNA, 22 bp, Homo sapiens
aggccacagagagtgcatgtgc

SEQ ID NO: 9214498 - DNA, 22 bp, Homo sapiens
aggccacagatactgtgaagta

SEQ ID NO: 9214499 - DNA, 22 bp, Homo sapiens
aggccacagagagtgcatgtgc

SEQ ID NO: 9214500 - DNA, 18 bp, Homo sapiens
aggccacactccagaaca

SEQ ID NO: 9214501 - DNA, 22 bp, Homo sapiens
aggccacacaactcttagagat

SEQ ID NO: 9214502 - DNA, 22 bp, Homo sapiens
acatacatgggattaaaaaatt

SEQ ID NO: 9214503 - DNA, 22 bp, Homo sapiens
acatacatgggattaaaaaatt

SEQ ID NO: 9214504 - DNA, 20 bp, Homo sapiens
aggcatgggatgcccagatt

SEQ ID NO: 9214505 - DNA, 20 bp, Homo sapiens
aggcatgggatgcccagatt

SEQ ID NO: 9214506 - DNA, 22 bp, Homo sapiens
accagggcggcttgaggaggca

SEQ ID NO: 9214507 - DNA, 22 bp, Homo sapiens
accaggctgtgaagtgagacta

SEQ ID NO: 9214508 - DNA, 22 bp, Homo sapiens
accaggagtctagcctagtcaa

SEQ ID NO: 9214509 - DNA, 22 bp, Homo sapiens
accaggagggaccctggtggcc

SEQ ID NO: 9214510 - DNA, 22 bp, Homo sapiens
accagtaagatcctgtacatac

SEQ ID NO: 9214511 - DNA, 22 bp, Homo sapiens
accagtgagtatttgtaacaga

SEQ ID NO: 9214512 - DNA, 23 bp, Homo sapiens
agggcccaagcctggacagcagg

SEQ ID NO: 9214513 - DNA, 22 bp, Homo sapiens
accagctgaactgcagcccagg

SEQ ID NO: 9214514 - DNA, 23 bp, Homo sapiens
aggcttcctatcttagagctggg

SEQ ID NO: 9214515 - DNA, 23 bp, Homo sapiens
accaacaagcctctggagagtgg

SEQ ID NO: 9214516 - DNA, 22 bp, Homo sapiens
accaggagccacaggaggagcc

SEQ ID NO: 9214517 - DNA, 20 bp, Homo sapiens
accaggagatggaggcaggg

SEQ ID NO: 9214518 - DNA, 22 bp, Homo sapiens
accaggaggcctggagcacaaa

SEQ ID NO: 9214519 - DNA, 22 bp, Homo sapiens
accaggaggctacactgtccca

SEQ ID NO: 9214520 - DNA, 20 bp, Homo sapiens
accaggaatcttttctgagc

SEQ ID NO: 9214521 - DNA, 22 bp, Homo sapiens
accaggagaggcacttgcaatg

SEQ ID NO: 9214522 - DNA, 22 bp, Homo sapiens
accaggagaggcacttgcaatg

SEQ ID NO: 9214523 - DNA, 19 bp, Homo sapiens
accaggagacagtgagctt

SEQ ID NO: 9214524 - DNA, 19 bp, Homo sapiens
accaggagacagtgagctt

SEQ ID NO: 9214525 - DNA, 22 bp, Homo sapiens
accaggagacatgaccaatgag

SEQ ID NO: 9214526 - DNA, 22 bp, Homo sapiens
accaggaacaagccatggagga

SEQ ID NO: 9214527 - DNA, 22 bp, Homo sapiens
accaggaacaagccatggagga

SEQ ID NO: 9214528 - DNA, 22 bp, Homo sapiens
accaggaactcacccgcagagg

SEQ ID NO: 9214529 - DNA, 19 bp, Homo sapiens
accaggaacttccctaggc

SEQ ID NO: 9214530 - DNA, 22 bp, Homo sapiens
accaggaactcacccgcagagg

SEQ ID NO: 9214531 - DNA, 22 bp, Homo sapiens
accaggaagaacaggcaaggca

SEQ ID NO: 9214532 - DNA, 22 bp, Homo sapiens
accaggaagagattccaattta

SEQ ID NO: 9214533 - DNA, 22 bp, Homo sapiens
accaggaagaacaggcaaggca

SEQ ID NO: 9214534 - DNA, 22 bp, Homo sapiens
accaggaatattttgctcattt

SEQ ID NO: 9214535 - DNA, 22 bp, Homo sapiens
accaggaatattttgctcattt

SEQ ID NO: 9214536 - DNA, 18 bp, Homo sapiens
accaggaagcttcttgtc

SEQ ID NO: 9214537 - DNA, 22 bp, Homo sapiens
accaggaagtgtgggccaacgt

SEQ ID NO: 9214538 - DNA, 22 bp, Homo sapiens
accaggaagtgtgggccaacgt

SEQ ID NO: 9214539 - DNA, 18 bp, Homo sapiens
accaggaagcttcttgtc

SEQ ID NO: 9214540 - DNA, 22 bp, Homo sapiens
accaggaagctgtgagaccttt

SEQ ID NO: 9214541 - DNA, 22 bp, Homo sapiens
accaggaagctgtgagaccttt

SEQ ID NO: 9214542 - DNA, 22 bp, Homo sapiens
accaggaagcatccctttgtaa

SEQ ID NO: 9214543 - DNA, 22 bp, Homo sapiens
accaggaagagattccaattta

SEQ ID NO: 9214544 - DNA, 19 bp, Homo sapiens
acccagggttgatgtccag

SEQ ID NO: 9214545 - DNA, 22 bp, Homo sapiens
acccagggtcaccccgtagggt

SEQ ID NO: 9214546 - DNA, 22 bp, Homo sapiens
acccagggtcaccccgtagggt

SEQ ID NO: 9214547 - DNA, 22 bp, Homo sapiens
acccagggttcctgggtcccag

SEQ ID NO: 9214548 - DNA, 22 bp, Homo sapiens
acccagggtttgagctctgcag

SEQ ID NO: 9214549 - DNA, 22 bp, Homo sapiens
acccaggtggctctgacggggg

SEQ ID NO: 9214550 - DNA, 22 bp, Homo sapiens
acccagggtagagtgcagtggc

SEQ ID NO: 9214551 - DNA, 22 bp, Homo sapiens
acccagggtagagtgcagtggc

SEQ ID NO: 9214552 - DNA, 22 bp, Homo sapiens
acccagggtagaacctcagagc

SEQ ID NO: 9214553 - DNA, 22 bp, Homo sapiens
acccagggaccccgctgacgcc

SEQ ID NO: 9214554 - DNA, 22 bp, Homo sapiens
acccaggctggcgtgcagtggc

SEQ ID NO: 9214555 - DNA, 22 bp, Homo sapiens
acccaggctggcgtgcagtggc

SEQ ID NO: 9214556 - DNA, 22 bp, Homo sapiens
acccaggctggcgtgcagtggc

SEQ ID NO: 9214557 - DNA, 21 bp, Homo sapiens
agggcctctcatttgtgccag

SEQ ID NO: 9214558 - DNA, 22 bp, Homo sapiens
agggcctctctgggcctttcct

SEQ ID NO: 9214559 - DNA, 22 bp, Homo sapiens
agggcctctgagccagttctgg

SEQ ID NO: 9214560 - DNA, 23 bp, Homo sapiens
agggcctctgtcccccagcactc

SEQ ID NO: 9214561 - DNA, 22 bp, Homo sapiens
agggcctgagaccgtggcttga

SEQ ID NO: 9214562 - DNA, 22 bp, Homo sapiens
acccaccctactagcagtgtcc

SEQ ID NO: 9214563 - DNA, 22 bp, Homo sapiens
acccacgaagatgagcggcatg

SEQ ID NO: 9214564 - DNA, 22 bp, Homo sapiens
acccacagccgctgtgcgtccc

SEQ ID NO: 9214565 - DNA, 22 bp, Homo sapiens
accctgggtgagaggcaaacag

SEQ ID NO: 9214566 - DNA, 22 bp, Homo sapiens
accctgggttcccgcagcacca

SEQ ID NO: 9214567 - DNA, 22 bp, Homo sapiens
accctgggcttggcctgctcag

SEQ ID NO: 9214568 - DNA, 22 bp, Homo sapiens
accctgggacctggaggtggat

SEQ ID NO: 9214569 - DNA, 22 bp, Homo sapiens
accctggagcttttctggccct

SEQ ID NO: 9214570 - DNA, 22 bp, Homo sapiens
accctggagcaataatccctgg

SEQ ID NO: 9214571 - DNA, 22 bp, Homo sapiens
accccaagacagtagaagagaa

SEQ ID NO: 9214572 - DNA, 22 bp, Homo sapiens
accccaagacagtagaagagaa

SEQ ID NO: 9214573 - DNA, 22 bp, Homo sapiens
accccacagcatacaaaggcac

SEQ ID NO: 9214574 - DNA, 22 bp, Homo sapiens
accccagcgcatatggtctgcg

SEQ ID NO: 9214575 - DNA, 22 bp, Homo sapiens
actcctgggtgctgaccagcgt

SEQ ID NO: 9214576 - DNA, 22 bp, Homo sapiens
actcctgggtgctgaccagcgt

SEQ ID NO: 9214577 - DNA, 22 bp, Homo sapiens
actccctccaaatctgcacagt

SEQ ID NO: 9214578 - DNA, 22 bp, Homo sapiens
actccagggtgactctgtctga

SEQ ID NO: 9214579 - DNA, 22 bp, Homo sapiens
actcctcagttgcttcttagtt

SEQ ID NO: 9214580 - DNA, 22 bp, Homo sapiens
agtcactgtcaaagccacacac

SEQ ID NO: 9214581 - DNA, 22 bp, Homo sapiens
agtcactgtcttgcaaaggtca

SEQ ID NO: 9214582 - DNA, 22 bp, Homo sapiens
agtcactgctttgtccctgtgt

SEQ ID NO: 9214583 - DNA, 22 bp, Homo sapiens
agtcactgagatggtgaggcta

SEQ ID NO: 9214584 - DNA, 22 bp, Homo sapiens
agtcactgaataccttaatgtt

SEQ ID NO: 9214585 - DNA, 22 bp, Homo sapiens
agtcacttccagacacctgcct

SEQ ID NO: 9214586 - DNA, 22 bp, Homo sapiens
agtagtggggccagggtttgaa

SEQ ID NO: 9214587 - DNA, 22 bp, Homo sapiens
agtagtggcttcctggagtgct

SEQ ID NO: 9214588 - DNA, 22 bp, Homo sapiens
aggtggggaaaccagcgatccc

SEQ ID NO: 9214589 - DNA, 23 bp, Homo sapiens
agtacatttgacccaaataagct

SEQ ID NO: 9214590 - DNA, 22 bp, Homo sapiens
agtaccatctctgcctctgcct

SEQ ID NO: 9214591 - DNA, 23 bp, Homo sapiens
agtaccatgtgttccttctcgtt

SEQ ID NO: 9214592 - DNA, 22 bp, Homo sapiens
agtacatttagtttatgaacat

SEQ ID NO: 9214593 - DNA, 23 bp, Homo sapiens
agtacattcgaaaaattctgtga

SEQ ID NO: 9214594 - DNA, 22 bp, Homo sapiens
acccttggttttgcagagctgt

SEQ ID NO: 9214595 - DNA, 22 bp, Homo sapiens
acccttcatagaggagaagctg

SEQ ID NO: 9214596 - DNA, 22 bp, Homo sapiens
aggtatttcctttaaagaaact

SEQ ID NO: 9214597 - DNA, 22 bp, Homo sapiens
aggtatttatgagagcacatat

SEQ ID NO: 9214598 - DNA, 22 bp, Homo sapiens
aggtatttcatggagcaagcag

SEQ ID NO: 9214599 - DNA, 22 bp, Homo sapiens
aggtaggaaagtctccttgtat

SEQ ID NO: 9214600 - DNA, 22 bp, Homo sapiens
aggtcaagggcaagagtgaggt

SEQ ID NO: 9214601 - DNA, 22 bp, Homo sapiens
aggtcaagggagctgagggcca

SEQ ID NO: 9214602 - DNA, 22 bp, Homo sapiens
aggtcaaggctgcagtgagctg

SEQ ID NO: 9214603 - DNA, 22 bp, Homo sapiens
acctttttgttctgttctcagc

SEQ ID NO: 9214604 - DNA, 22 bp, Homo sapiens
accttttttcagaactctaaag

SEQ ID NO: 9214605 - DNA, 22 bp, Homo sapiens
aggtgacatcccggcagcagag

SEQ ID NO: 9214606 - DNA, 22 bp, Homo sapiens
actacttgagctgaggctagca

SEQ ID NO: 9214607 - DNA, 22 bp, Homo sapiens
actacttgtgagagattatctc

SEQ ID NO: 9214608 - DNA, 22 bp, Homo sapiens
agtgctctctccccagtgctac

SEQ ID NO: 9214609 - DNA, 22 bp, Homo sapiens
agtgctctcatgctgactatta

SEQ ID NO: 9214610 - DNA, 22 bp, Homo sapiens
actgcacttcaccctgggtgac

SEQ ID NO: 9214611 - DNA, 22 bp, Homo sapiens
actgcacttcaccctgggtgac

SEQ ID NO: 9214612 - DNA, 22 bp, Homo sapiens
actgcacttcaccctgggtgac

SEQ ID NO: 9214613 - DNA, 22 bp, Homo sapiens
agtgctcacctgtcaggtcaag

SEQ ID NO: 9214614 - DNA, 22 bp, Homo sapiens
agtgctatcgagttctaatgct

SEQ ID NO: 9214615 - DNA, 22 bp, Homo sapiens
agtgctcactctccacagtgcc

SEQ ID NO: 9214616 - DNA, 22 bp, Homo sapiens
agtgctcataaaaatgtgaaac

SEQ ID NO: 9214617 - DNA, 22 bp, Homo sapiens
actgcactccagcctgggtgac

SEQ ID NO: 9214618 - DNA, 22 bp, Homo sapiens
actgcacttacatagaggaggc

SEQ ID NO: 9214619 - DNA, 22 bp, Homo sapiens
actgcactcctgcctgggtaac

SEQ ID NO: 9214620 - DNA, 22 bp, Homo sapiens
actgcactcctgcctgggtaac

SEQ ID NO: 9214621 - DNA, 22 bp, Homo sapiens
actgcactccagcctgggtgat

SEQ ID NO: 9214622 - DNA, 22 bp, Homo sapiens
actgcactccagcctgggtgat

SEQ ID NO: 9214623 - DNA, 22 bp, Homo sapiens
actgcactccagcctgggtgat

SEQ ID NO: 9214624 - DNA, 22 bp, Homo sapiens
actgcactccagcctgggtgat

SEQ ID NO: 9214625 - DNA, 22 bp, Homo sapiens
actctgaattaattgctctcaa

SEQ ID NO: 9214626 - DNA, 22 bp, Homo sapiens
actctgaagaagacttccagac

SEQ ID NO: 9214627 - DNA, 22 bp, Homo sapiens
actctgaatgtgcatgtaaatc

SEQ ID NO: 9214628 - DNA, 22 bp, Homo sapiens
actctgaactccaggaggctca

SEQ ID NO: 9214629 - DNA, 22 bp, Homo sapiens
actctgaaccaattcgcaatga

SEQ ID NO: 9214630 - DNA, 22 bp, Homo sapiens
actctgaaccagagatcatacc

SEQ ID NO: 9214631 - DNA, 21 bp, Homo sapiens
actctgaaaattaatagttat

SEQ ID NO: 9214632 - DNA, 22 bp, Homo sapiens
actctgaaacttgcaacacatt

SEQ ID NO: 9214633 - DNA, 21 bp, Homo sapiens
actctgaaaattaatagttat

SEQ ID NO: 9214634 - DNA, 22 bp, Homo sapiens
actctgaaatagaggctggtgg

SEQ ID NO: 9214635 - DNA, 22 bp, Homo sapiens
actctgccatcccaggtgctgt

SEQ ID NO: 9214636 - DNA, 22 bp, Homo sapiens
actctgccccgagttctgggaa

SEQ ID NO: 9214637 - DNA, 22 bp, Homo sapiens
actctgcctttcagcagatgaa

SEQ ID NO: 9214638 - DNA, 22 bp, Homo sapiens
agtgaactgtggcccgtgaact

SEQ ID NO: 9214639 - DNA, 21 bp, Homo sapiens
actgagagatgttggatcata

SEQ ID NO: 9214640 - DNA, 22 bp, Homo sapiens
actgcccttgtcctggcacacc

SEQ ID NO: 9214641 - DNA, 22 bp, Homo sapiens
actgccctccagcctgggtgac

SEQ ID NO: 9214642 - DNA, 20 bp, Homo sapiens
actgccagccttgtctactg

SEQ ID NO: 9214643 - DNA, 23 bp, Homo sapiens
actgccagagcaggctttgcctg

SEQ ID NO: 9214644 - DNA, 22 bp, Homo sapiens
actgccaggatggcactagagg

SEQ ID NO: 9214645 - DNA, 22 bp, Homo sapiens
actgccaggtgctccatctgaa

SEQ ID NO: 9214646 - DNA, 22 bp, Homo sapiens
actgccagtcattccacaattt

SEQ ID NO: 9214647 - DNA, 22 bp, Homo sapiens
actgccagttgttttgtccagt

SEQ ID NO: 9214648 - DNA, 23 bp, Homo sapiens
actgccagttttaccacagacgg

SEQ ID NO: 9214649 - DNA, 22 bp, Homo sapiens
actgcctggcagaggtttgcaa

SEQ ID NO: 9214650 - DNA, 19 bp, Homo sapiens
actgcctgcaggtgttggg

SEQ ID NO: 9214651 - DNA, 22 bp, Homo sapiens
actgcctgcatccttagggtag

SEQ ID NO: 9214652 - DNA, 22 bp, Homo sapiens
actgcctgcctctgattctgca

SEQ ID NO: 9214653 - DNA, 22 bp, Homo sapiens
actggcatcccactggtacagg

SEQ ID NO: 9214654 - DNA, 21 bp, Homo sapiens
actggccaccactggcagggg

SEQ ID NO: 9214655 - DNA, 22 bp, Homo sapiens
actgggcatcccatggcagagc

SEQ ID NO: 9214656 - DNA, 22 bp, Homo sapiens
actgggccagacactgattccc

SEQ ID NO: 9214657 - DNA, 22 bp, Homo sapiens
actgggccagatcagagcaact

SEQ ID NO: 9214658 - DNA, 22 bp, Homo sapiens
actgggcctgtacagagaaaac

SEQ ID NO: 9214659 - DNA, 22 bp, Homo sapiens
actgggcctggattggcgtgtc

SEQ ID NO: 9214660 - DNA, 22 bp, Homo sapiens
agaaagcacagcgggtccattt

SEQ ID NO: 9214661 - DNA, 22 bp, Homo sapiens
agaaagcaccctgcactttctg

SEQ ID NO: 9214662 - DNA, 22 bp, Homo sapiens
agaaagcaccctgcactttctg

SEQ ID NO: 9214663 - DNA, 22 bp, Homo sapiens
agaaagcacgggccccaggctc

SEQ ID NO: 9214664 - DNA, 22 bp, Homo sapiens
agaaagcacgggccccaggctc

SEQ ID NO: 9214665 - DNA, 22 bp, Homo sapiens
agaaagcactctgtcttttacc

SEQ ID NO: 9214666 - DNA, 22 bp, Homo sapiens
agaaagcctcaatcttcaggcc

SEQ ID NO: 9214667 - DNA, 22 bp, Homo sapiens
agaaagcactctgtcttttacc

SEQ ID NO: 9214668 - DNA, 22 bp, Homo sapiens
agaaagcactctgtcttttacc

SEQ ID NO: 9214669 - DNA, 22 bp, Homo sapiens
agaaagcagcatttatgatctc

SEQ ID NO: 9214670 - DNA, 22 bp, Homo sapiens
agaaagcagtcccttccgaccg

SEQ ID NO: 9214671 - DNA, 22 bp, Homo sapiens
agaaagcatctccattgtaggt

SEQ ID NO: 9214672 - DNA, 21 bp, Homo sapiens
atatttttgtttggactgtca

SEQ ID NO: 9214673 - DNA, 22 bp, Homo sapiens
atatttttccatgtgggactct

SEQ ID NO: 9214674 - DNA, 22 bp, Homo sapiens
atattttggtagctctcaatga

SEQ ID NO: 9214675 - DNA, 22 bp, Homo sapiens
atattttgtaacttggaatagg

SEQ ID NO: 9214676 - DNA, 21 bp, Homo sapiens
agaaaaaccagcatgttttca

SEQ ID NO: 9214677 - DNA, 22 bp, Homo sapiens
atatttctccaaatgttttcaa

SEQ ID NO: 9214678 - DNA, 22 bp, Homo sapiens
acttttttataaggaagaagat

SEQ ID NO: 9214679 - DNA, 22 bp, Homo sapiens
acttttgaagaattatgcaaaa

SEQ ID NO: 9214680 - DNA, 22 bp, Homo sapiens
acttttcccttggtagagttgc

SEQ ID NO: 9214681 - DNA, 22 bp, Homo sapiens
agaaggagtgtacaggtcatgc

SEQ ID NO: 9214682 - DNA, 21 bp, Homo sapiens
agaaggcaaaagcagacatct

SEQ ID NO: 9214683 - DNA, 22 bp, Homo sapiens
agaaggcagatgggacggagca

SEQ ID NO: 9214684 - DNA, 22 bp, Homo sapiens
agaaggcagatgggacggagca

SEQ ID NO: 9214685 - DNA, 22 bp, Homo sapiens
agaaggcagaaagtccaggtat

SEQ ID NO: 9214686 - DNA, 20 bp, Homo sapiens
agaaggcaggagacaaaagg

SEQ ID NO: 9214687 - DNA, 22 bp, Homo sapiens
agaaggcaggttttaaaatgtc

SEQ ID NO: 9214688 - DNA, 22 bp, Homo sapiens
agaagccaagaacagacagtgc

SEQ ID NO: 9214689 - DNA, 22 bp, Homo sapiens
agaagccaacagggcaggagag

SEQ ID NO: 9214690 - DNA, 22 bp, Homo sapiens
agaagccaagaacagacagtgc

SEQ ID NO: 9214691 - DNA, 22 bp, Homo sapiens
agaagccaattctgtgtgagtc

SEQ ID NO: 9214692 - DNA, 22 bp, Homo sapiens
agaagccacaggaaagcagctt

SEQ ID NO: 9214693 - DNA, 22 bp, Homo sapiens
agaagccacaggaaagcagctt

SEQ ID NO: 9214694 - DNA, 22 bp, Homo sapiens
atctctttgatggctcctgtga

SEQ ID NO: 9214695 - DNA, 22 bp, Homo sapiens
atctctggccttccttttccaa

SEQ ID NO: 9214696 - DNA, 22 bp, Homo sapiens
atctctgggctttgagtttgtt

SEQ ID NO: 9214697 - DNA, 22 bp, Homo sapiens
atctctggcccctggggtccga

SEQ ID NO: 9214698 - DNA, 22 bp, Homo sapiens
atctctgggtccatagaagaga

SEQ ID NO: 9214699 - DNA, 22 bp, Homo sapiens
atctctggttgttttgctccca

SEQ ID NO: 9214700 - DNA, 22 bp, Homo sapiens
atctctggtccaaatgttacct

SEQ ID NO: 9214701 - DNA, 22 bp, Homo sapiens
agaacatggattgtcaaaggta

SEQ ID NO: 9214702 - DNA, 22 bp, Homo sapiens
atctctggcaatgcagcatcgt

SEQ ID NO: 9214703 - DNA, 22 bp, Homo sapiens
atctcagggctggagccctgga

SEQ ID NO: 9214704 - DNA, 22 bp, Homo sapiens
agaaccttcagattaggaggtg

SEQ ID NO: 9214705 - DNA, 22 bp, Homo sapiens
atccccagaaaataggtgccta

SEQ ID NO: 9214706 - DNA, 22 bp, Homo sapiens
agaacatatctgttttctaact

SEQ ID NO: 9214707 - DNA, 22 bp, Homo sapiens
agaacatctaaatatctgagac

SEQ ID NO: 9214708 - DNA, 22 bp, Homo sapiens
atccaggagtcgtggcgctcag

SEQ ID NO: 9214709 - DNA, 22 bp, Homo sapiens
atccaggagggctgactcctta

SEQ ID NO: 9214710 - DNA, 20 bp, Homo sapiens
atccaggatgttgatttgaa

SEQ ID NO: 9214711 - DNA, 22 bp, Homo sapiens
atccaggaaggatggcattgag

SEQ ID NO: 9214712 - DNA, 22 bp, Homo sapiens
atccagctttgtctggtcttcg

SEQ ID NO: 9214713 - DNA, 22 bp, Homo sapiens
atccatttttgcaaagttgttc

SEQ ID NO: 9214714 - DNA, 22 bp, Homo sapiens
atcccaggggttgtatcttccc

SEQ ID NO: 9214715 - DNA, 22 bp, Homo sapiens
atcccaggaggctgcgcagtta

SEQ ID NO: 9214716 - DNA, 22 bp, Homo sapiens
atcccagatagtgaccctcagg

SEQ ID NO: 9214717 - DNA, 21 bp, Homo sapiens
atcccagcacccaggagtgca

SEQ ID NO: 9214718 - DNA, 22 bp, Homo sapiens
actttggacaatttattactgt

SEQ ID NO: 9214719 - DNA, 22 bp, Homo sapiens
actttggaataagctatataac

SEQ ID NO: 9214720 - DNA, 22 bp, Homo sapiens
actttaaagcagaatggctatg

SEQ ID NO: 9214721 - DNA, 22 bp, Homo sapiens
actttacaagcttatagcctag

SEQ ID NO: 9214722 - DNA, 22 bp, Homo sapiens
actttacaagcttatagcctag

SEQ ID NO: 9214723 - DNA, 22 bp, Homo sapiens
actttacaatatcctgtgactt

SEQ ID NO: 9214724 - DNA, 22 bp, Homo sapiens
actttacacatcttttctcatt

SEQ ID NO: 9214725 - DNA, 22 bp, Homo sapiens
atacatatccacaggagataaa

SEQ ID NO: 9214726 - DNA, 21 bp, Homo sapiens
actttacaatttacatagtga

SEQ ID NO: 9214727 - DNA, 22 bp, Homo sapiens
acttctcttcataggtggcaat

SEQ ID NO: 9214728 - DNA, 22 bp, Homo sapiens
atacaaaatatatactggagac

SEQ ID NO: 9214729 - DNA, 22 bp, Homo sapiens
actttaaaactgatcatcagag

SEQ ID NO: 9214730 - DNA, 22 bp, Homo sapiens
actttaaaactgatcatcagag

SEQ ID NO: 9214731 - DNA, 22 bp, Homo sapiens
actgggctccagatgtgatacg

SEQ ID NO: 9214732 - DNA, 22 bp, Homo sapiens
agttttatgcagtgttctgata

SEQ ID NO: 9214733 - DNA, 22 bp, Homo sapiens
actgggccttgtgtgtctcatc

SEQ ID NO: 9214734 - DNA, 22 bp, Homo sapiens
actgggctaccccaccattacc

SEQ ID NO: 9214735 - DNA, 22 bp, Homo sapiens
actgggctagagtggaagctgg

SEQ ID NO: 9214736 - DNA, 22 bp, Homo sapiens
actgggctcaagtgattgtcct

SEQ ID NO: 9214737 - DNA, 22 bp, Homo sapiens
actgggctagagtggaagctgg

SEQ ID NO: 9214738 - DNA, 21 bp, Homo sapiens
actgggctagcctgacttctg

SEQ ID NO: 9214739 - DNA, 21 bp, Homo sapiens
actgggctagcctgacttctg

SEQ ID NO: 9214740 - DNA, 22 bp, Homo sapiens
actgggctcataatgtcataga

SEQ ID NO: 9214741 - DNA, 22 bp, Homo sapiens
actgggctcaagtgattgtcct

SEQ ID NO: 9214742 - DNA, 22 bp, Homo sapiens
actgggctccaaggacctggag

SEQ ID NO: 9214743 - DNA, 22 bp, Homo sapiens
actgggctccagatgtgatacg

SEQ ID NO: 9214744 - DNA, 22 bp, Homo sapiens
actgggctccaaggacctggag

SEQ ID NO: 9214745 - DNA, 22 bp, Homo sapiens
actgggctcccaggcttgtcat

SEQ ID NO: 9214746 - DNA, 22 bp, Homo sapiens
acttaaaaacagatccagcagg

SEQ ID NO: 9214747 - DNA, 22 bp, Homo sapiens
actgttttctgtaaagggccag

SEQ ID NO: 9214748 - DNA, 22 bp, Homo sapiens
acttaaaaccagacagcgtcat

SEQ ID NO: 9214749 - DNA, 22 bp, Homo sapiens
acttccttgtcaggtgcatcat

SEQ ID NO: 9214750 - DNA, 22 bp, Homo sapiens
acttccttttcaaccatacagc

SEQ ID NO: 9214751 - DNA, 22 bp, Homo sapiens
acttccttttgggaaactgttt

SEQ ID NO: 9214752 - DNA, 22 bp, Homo sapiens
acttcctgggcatgcagagtcc

SEQ ID NO: 9214753 - DNA, 22 bp, Homo sapiens
acttcctgtgttggtcttgctg

SEQ ID NO: 9214754 - DNA, 19 bp, Homo sapiens
ataaataaaaagtgggaga

SEQ ID NO: 9214755 - DNA, 22 bp, Homo sapiens
acttccagcacctcaagcggaa

SEQ ID NO: 9214756 - DNA, 22 bp, Homo sapiens
agagcagatttcaaatattggc

SEQ ID NO: 9214757 - DNA, 22 bp, Homo sapiens
agagcagatggccagggggcct

SEQ ID NO: 9214758 - DNA, 22 bp, Homo sapiens
agagcagcacgttgtccccaca

SEQ ID NO: 9214759 - DNA, 22 bp, Homo sapiens
agagcagatggagctggaagag

SEQ ID NO: 9214760 - DNA, 22 bp, Homo sapiens
agagcagagtggctgtagcttg

SEQ ID NO: 9214761 - DNA, 22 bp, Homo sapiens
agagcagatggagctggaagag

SEQ ID NO: 9214762 - DNA, 22 bp, Homo sapiens
agagcccagtgacatcagcaca

SEQ ID NO: 9214763 - DNA, 22 bp, Homo sapiens
agagcccaggtcctggagaggg

SEQ ID NO: 9214764 - DNA, 22 bp, Homo sapiens
agagcccctggtggagtgagaa

SEQ ID NO: 9214765 - DNA, 22 bp, Homo sapiens
agagcccctggtggagtgagaa

SEQ ID NO: 9214766 - DNA, 22 bp, Homo sapiens
agagcccctcggtggaggggtc

SEQ ID NO: 9214767 - DNA, 22 bp, Homo sapiens
agagcccatcagtggcagtgga

SEQ ID NO: 9214768 - DNA, 22 bp, Homo sapiens
agagcccctgggtcacacagcc

SEQ ID NO: 9214769 - DNA, 22 bp, Homo sapiens
agagcccaggcaggcatccagg

SEQ ID NO: 9214770 - DNA, 22 bp, Homo sapiens
agagattgtgctactcacccaa

SEQ ID NO: 9214771 - DNA, 22 bp, Homo sapiens
agagcagacatccttgtcttgt

SEQ ID NO: 9214772 - DNA, 22 bp, Homo sapiens
agagcagagggctctgggacaa

SEQ ID NO: 9214773 - DNA, 22 bp, Homo sapiens
agagcagaggcatggccgtggg

SEQ ID NO: 9214774 - DNA, 22 bp, Homo sapiens
agagcagagtggctgtagcttg

SEQ ID NO: 9214775 - DNA, 22 bp, Homo sapiens
agagctggccagggatcactct

SEQ ID NO: 9214776 - DNA, 21 bp, Homo sapiens
agagctggcctgccaggccct

SEQ ID NO: 9214777 - DNA, 22 bp, Homo sapiens
agagctggatggtcaagatggc

SEQ ID NO: 9214778 - DNA, 22 bp, Homo sapiens
agagctggatggtcaagatggc

SEQ ID NO: 9214779 - DNA, 22 bp, Homo sapiens
agagctggcagcagcttctcct

SEQ ID NO: 9214780 - DNA, 22 bp, Homo sapiens
agagctggagcagccccactgg

SEQ ID NO: 9214781 - DNA, 22 bp, Homo sapiens
agagctggacgtctgagcccta

SEQ ID NO: 9214782 - DNA, 22 bp, Homo sapiens
agagcctgagcctgaaagccct

SEQ ID NO: 9214783 - DNA, 22 bp, Homo sapiens
agagcctgaggatgtcccagct

SEQ ID NO: 9214784 - DNA, 22 bp, Homo sapiens
agagccctttctccaggcacct

SEQ ID NO: 9214785 - DNA, 22 bp, Homo sapiens
agagcccttgccctcagtcacc

SEQ ID NO: 9214786 - DNA, 22 bp, Homo sapiens
agagcctctgtcatggagagaa

SEQ ID NO: 9214787 - DNA, 22 bp, Homo sapiens
agagccctgcagttcttcagga

SEQ ID NO: 9214788 - DNA, 22 bp, Homo sapiens
agagccctgtggttctggtaag

SEQ ID NO: 9214789 - DNA, 22 bp, Homo sapiens
agagccctgccaatggatgagg

SEQ ID NO: 9214790 - DNA, 22 bp, Homo sapiens
agagccctgaagcagagctaaa

SEQ ID NO: 9214791 - DNA, 21 bp, Homo sapiens
agagacagagaaagtaacatt

SEQ ID NO: 9214792 - DNA, 21 bp, Homo sapiens
agagagaaggccatatggtcc

SEQ ID NO: 9214793 - DNA, 22 bp, Homo sapiens
agagagcatggcacagaggggt

SEQ ID NO: 9214794 - DNA, 22 bp, Homo sapiens
agagaattaattaggagcactg

SEQ ID NO: 9214795 - DNA, 19 bp, Homo sapiens
agagaggctgtgtgaggga

SEQ ID NO: 9214796 - DNA, 22 bp, Homo sapiens
agagagcctgagtggcagctat

SEQ ID NO: 9214797 - DNA, 22 bp, Homo sapiens
agagagcccgggccagggcaca

SEQ ID NO: 9214798 - DNA, 22 bp, Homo sapiens
agagagctctggctgggtgacc

SEQ ID NO: 9214799 - DNA, 22 bp, Homo sapiens
agagagctgtcctgggacaccc

SEQ ID NO: 9214800 - DNA, 22 bp, Homo sapiens
agagaatacagggtaacaggaa

SEQ ID NO: 9214801 - DNA, 22 bp, Homo sapiens
agagaaaagagttcaggctttg

SEQ ID NO: 9214802 - DNA, 22 bp, Homo sapiens
agagaaaagagttcaggctttg

SEQ ID NO: 9214803 - DNA, 22 bp, Homo sapiens
agagaaaactcattgaggtgtc

SEQ ID NO: 9214804 - DNA, 19 bp, Homo sapiens
agacttttgtaagttgaga

SEQ ID NO: 9214805 - DNA, 22 bp, Homo sapiens
agacttgggacctaggaatgga

SEQ ID NO: 9214806 - DNA, 22 bp, Homo sapiens
agactttagggccatggtaggt

SEQ ID NO: 9214807 - DNA, 22 bp, Homo sapiens
agactttataaatcttaatttc

SEQ ID NO: 9214808 - DNA, 22 bp, Homo sapiens
atgcatcaggcactaggaatag

SEQ ID NO: 9214809 - DNA, 22 bp, Homo sapiens
atgcatttttgagtatgaatga

SEQ ID NO: 9214810 - DNA, 20 bp, Homo sapiens
agacagaatcagagataaag

SEQ ID NO: 9214811 - DNA, 22 bp, Homo sapiens
agacagaatttgtcagataaat

SEQ ID NO: 9214812 - DNA, 22 bp, Homo sapiens
agactggggttctggcaaggag

SEQ ID NO: 9214813 - DNA, 22 bp, Homo sapiens
atgcctgtggagatatttaagg

SEQ ID NO: 9214814 - DNA, 22 bp, Homo sapiens
atgcctgtgctatattctcaca

SEQ ID NO: 9214815 - DNA, 22 bp, Homo sapiens
atgcctgtaatcccagtgcttt

SEQ ID NO: 9214816 - DNA, 22 bp, Homo sapiens
atgcctgtctcagggtctgttt

SEQ ID NO: 9214817 - DNA, 22 bp, Homo sapiens
atgcctgtaattccagcatttt

SEQ ID NO: 9214818 - DNA, 22 bp, Homo sapiens
atgcctgtttgaaattggacct

SEQ ID NO: 9214819 - DNA, 22 bp, Homo sapiens
atgcctgtgggaaaaacttgtt

SEQ ID NO: 9214820 - DNA, 19 bp, Homo sapiens
atgcctgttgattagttac

SEQ ID NO: 9214821 - DNA, 22 bp, Homo sapiens
atgcctgtaatcccagcacttt

SEQ ID NO: 9214822 - DNA, 22 bp, Homo sapiens
atgcctgtaaaacagcacccag

SEQ ID NO: 9214823 - DNA, 22 bp, Homo sapiens
agaccccatacctcagcaggta

SEQ ID NO: 9214824 - DNA, 22 bp, Homo sapiens
agacctggaagttcaagagaaa

SEQ ID NO: 9214825 - DNA, 22 bp, Homo sapiens
atgccaagtacaggcactgctc

SEQ ID NO: 9214826 - DNA, 22 bp, Homo sapiens
agacctggagtggggcctcagg

SEQ ID NO: 9214827 - DNA, 22 bp, Homo sapiens
agacctggatgtgagggaagta

SEQ ID NO: 9214828 - DNA, 22 bp, Homo sapiens
agacctgggttcgagtcctaac

SEQ ID NO: 9214829 - DNA, 22 bp, Homo sapiens
agacctgggtgccctgtgcttt

SEQ ID NO: 9214830 - DNA, 22 bp, Homo sapiens
agacctgggtgccctgtgcttt

SEQ ID NO: 9214831 - DNA, 22 bp, Homo sapiens
agacctgggtgccctgtgcttt

SEQ ID NO: 9214832 - DNA, 22 bp, Homo sapiens
agacctgtgatcacatggaatg

SEQ ID NO: 9214833 - DNA, 22 bp, Homo sapiens
agacctgttgggttcattggct

SEQ ID NO: 9214834 - DNA, 22 bp, Homo sapiens
agacctggtgatagctgtccta

SEQ ID NO: 9214835 - DNA, 22 bp, Homo sapiens
agacctggtttatcaccagcat

SEQ ID NO: 9214836 - DNA, 22 bp, Homo sapiens
agacctggtttatcaccagcat

SEQ ID NO: 9214837 - DNA, 22 bp, Homo sapiens
atgaggccagaccactctgcat

SEQ ID NO: 9214838 - DNA, 20 bp, Homo sapiens
atgaggccagcagggctcag

SEQ ID NO: 9214839 - DNA, 22 bp, Homo sapiens
atgaggccagggtgccatgaaa

SEQ ID NO: 9214840 - DNA, 22 bp, Homo sapiens
atgaggctctcaggggagctgt

SEQ ID NO: 9214841 - DNA, 22 bp, Homo sapiens
atgaggcctttcttcacccttt

SEQ ID NO: 9214842 - DNA, 22 bp, Homo sapiens
atgaggcctatcttggcagagg

SEQ ID NO: 9214843 - DNA, 22 bp, Homo sapiens
atgaggcccaaacattacaaat

SEQ ID NO: 9214844 - DNA, 22 bp, Homo sapiens
atgaggccatggctgtcactaa

SEQ ID NO: 9214845 - DNA, 22 bp, Homo sapiens
atgaggcccaggaatctgtatt

SEQ ID NO: 9214846 - DNA, 22 bp, Homo sapiens
agacaaatttcctgcaatgaag

SEQ ID NO: 9214847 - DNA, 19 bp, Homo sapiens
atgaagccccagggcccgt

SEQ ID NO: 9214848 - DNA, 22 bp, Homo sapiens
atgaagcattacaggatgacag

SEQ ID NO: 9214849 - DNA, 22 bp, Homo sapiens
atctgcttcctgggctccatga

SEQ ID NO: 9214850 - DNA, 22 bp, Homo sapiens
atctgcttgaaacttcttatac

SEQ ID NO: 9214851 - DNA, 22 bp, Homo sapiens
atctgcctggctccaggtgagc

SEQ ID NO: 9214852 - DNA, 22 bp, Homo sapiens
atctgcctgcagtggaggtggg

SEQ ID NO: 9214853 - DNA, 22 bp, Homo sapiens
agaatatagttaccaaattctg

SEQ ID NO: 9214854 - DNA, 22 bp, Homo sapiens
agaatatgattcagaccattag

SEQ ID NO: 9214855 - DNA, 20 bp, Homo sapiens
agcaagagtaaggacagcga

SEQ ID NO: 9214856 - DNA, 23 bp, Homo sapiens
caaagatgattggaacatggctt

SEQ ID NO: 9214857 - DNA, 22 bp, Homo sapiens
caaagcaaggctcagtttgaac

SEQ ID NO: 9214858 - DNA, 22 bp, Homo sapiens
caaagcaagggctgaagactcc

SEQ ID NO: 9214859 - DNA, 22 bp, Homo sapiens
caaagcaagggctgaagactcc

SEQ ID NO: 9214860 - DNA, 22 bp, Homo sapiens
caaagcaagggctgaagactcc

SEQ ID NO: 9214861 - DNA, 22 bp, Homo sapiens
caaaggcaggtgctgaatattc

SEQ ID NO: 9214862 - DNA, 22 bp, Homo sapiens
caaaggcaggtcatggccactt

SEQ ID NO: 9214863 - DNA, 22 bp, Homo sapiens
agcaagaaaatctctgtccaat

SEQ ID NO: 9214864 - DNA, 22 bp, Homo sapiens
agcaacttttctagacatggtc

SEQ ID NO: 9214865 - DNA, 22 bp, Homo sapiens
agcaagaagggcaaggaagttt

SEQ ID NO: 9214866 - DNA, 18 bp, Homo sapiens
agcaagacagtggtgtga

SEQ ID NO: 9214867 - DNA, 22 bp, Homo sapiens
agcaacagggtggtcttcagaa

SEQ ID NO: 9214868 - DNA, 22 bp, Homo sapiens
agatgtgggtgtcaggcagtga

SEQ ID NO: 9214869 - DNA, 22 bp, Homo sapiens
agatgtgggcaatggaatggag

SEQ ID NO: 9214870 - DNA, 22 bp, Homo sapiens
agatgtgtttctagttcctgca

SEQ ID NO: 9214871 - DNA, 22 bp, Homo sapiens
agcaacagcaacgacatttctc

SEQ ID NO: 9214872 - DNA, 22 bp, Homo sapiens
attttatctgcttactttcagg

SEQ ID NO: 9214873 - DNA, 22 bp, Homo sapiens
agatgtggatcctagggtagaa

SEQ ID NO: 9214874 - DNA, 22 bp, Homo sapiens
agatgtggccggctagggagag

SEQ ID NO: 9214875 - DNA, 22 bp, Homo sapiens
agatgtggctgcacccaccgct

SEQ ID NO: 9214876 - DNA, 22 bp, Homo sapiens
agatgtggcctttgggagatta

SEQ ID NO: 9214877 - DNA, 22 bp, Homo sapiens
attttcagaacattcattcact

SEQ ID NO: 9214878 - DNA, 22 bp, Homo sapiens
attttcagaacattcattcact

SEQ ID NO: 9214879 - DNA, 22 bp, Homo sapiens
attggccatttgcatgtattat

SEQ ID NO: 9214880 - DNA, 22 bp, Homo sapiens
attggccatttgcatgtattat

SEQ ID NO: 9214881 - DNA, 22 bp, Homo sapiens
attggctttcttttgtgaaaat

SEQ ID NO: 9214882 - DNA, 22 bp, Homo sapiens
attggctttgatatctaaaggg

SEQ ID NO: 9214883 - DNA, 21 bp, Homo sapiens
agagtggcaaagtgtccaaga

SEQ ID NO: 9214884 - DNA, 22 bp, Homo sapiens
agagtggcagcaagtcaggtag

SEQ ID NO: 9214885 - DNA, 22 bp, Homo sapiens
attggtctggggaaatgaagag

SEQ ID NO: 9214886 - DNA, 22 bp, Homo sapiens
attgggatgccggctgataaga

SEQ ID NO: 9214887 - DNA, 22 bp, Homo sapiens
agatataataatttacaagtgt

SEQ ID NO: 9214888 - DNA, 22 bp, Homo sapiens
agatcacagtggcaactccctt

SEQ ID NO: 9214889 - DNA, 22 bp, Homo sapiens
agatgctggggcccctcggatg

SEQ ID NO: 9214890 - DNA, 22 bp, Homo sapiens
agatcagaaatgtaatggcagt

SEQ ID NO: 9214891 - DNA, 17 bp, Homo sapiens
agatggcctctaagatt

SEQ ID NO: 9214892 - DNA, 22 bp, Homo sapiens
agatggcaggccctgtgggggt

SEQ ID NO: 9214893 - DNA, 17 bp, Homo sapiens
agatggcaggaggcaga

SEQ ID NO: 9214894 - DNA, 22 bp, Homo sapiens
agatggcagcagaacaaacagg

SEQ ID NO: 9214895 - DNA, 22 bp, Homo sapiens
agatggagttgtagcagtgact

SEQ ID NO: 9214896 - DNA, 22 bp, Homo sapiens
agatggagtggagatgagtaaa

SEQ ID NO: 9214897 - DNA, 22 bp, Homo sapiens
agatggagaccttggatgaact

SEQ ID NO: 9214898 - DNA, 22 bp, Homo sapiens
agagggcttccctaggagtgag

SEQ ID NO: 9214899 - DNA, 22 bp, Homo sapiens
agagggctggacgcaggttgga

SEQ ID NO: 9214900 - DNA, 22 bp, Homo sapiens
agaggctgggcaggacccacag

SEQ ID NO: 9214901 - DNA, 22 bp, Homo sapiens
agagtcagcttatgacacagtc

SEQ ID NO: 9214902 - DNA, 22 bp, Homo sapiens
agagtcagaaagcagacagggg

SEQ ID NO: 9214903 - DNA, 22 bp, Homo sapiens
agagtcagaaccaagatgaggc

SEQ ID NO: 9214904 - DNA, 22 bp, Homo sapiens
agagtcaagtagggcatgggct

SEQ ID NO: 9214905 - DNA, 22 bp, Homo sapiens
agagtatgcatctattgtacct

SEQ ID NO: 9214906 - DNA, 19 bp, Homo sapiens
agagtattgaatttgccct

SEQ ID NO: 9214907 - DNA, 22 bp, Homo sapiens
agagtctgatatttgtaccaga

SEQ ID NO: 9214908 - DNA, 22 bp, Homo sapiens
agagtccctcttcccaggaggc

SEQ ID NO: 9214909 - DNA, 22 bp, Homo sapiens
agagtctgaatgctcagagttg

SEQ ID NO: 9214910 - DNA, 22 bp, Homo sapiens
agagtctgaggaggaccaacag

SEQ ID NO: 9214911 - DNA, 22 bp, Homo sapiens
agagtgctcagatgcatgtctt

SEQ ID NO: 9214912 - DNA, 23 bp, Homo sapiens
agagtgcagagatatgcttgtgt

SEQ ID NO: 9214913 - DNA, 23 bp, Homo sapiens
agaggcaggagtggcttgcccgg

SEQ ID NO: 9214914 - DNA, 22 bp, Homo sapiens
agaggccaccactgtcagggac

SEQ ID NO: 9214915 - DNA, 22 bp, Homo sapiens
agaggccaccactgtcagggac

SEQ ID NO: 9214916 - DNA, 16 bp, Homo sapiens
agaggccacagacaga

SEQ ID NO: 9214917 - DNA, 22 bp, Homo sapiens
agaggccaccagaggtggtgcc

SEQ ID NO: 9214918 - DNA, 22 bp, Homo sapiens
agaggccaccagaggtggtgcc

SEQ ID NO: 9214919 - DNA, 22 bp, Homo sapiens
agaggccaccttctcttgagaa

SEQ ID NO: 9214920 - DNA, 22 bp, Homo sapiens
agaggccactttgcctgtgatg

SEQ ID NO: 9214921 - DNA, 22 bp, Homo sapiens
agaggccactttgcctgtgatg

SEQ ID NO: 9214922 - DNA, 22 bp, Homo sapiens
agaggccagaaggcgcaccccg

SEQ ID NO: 9214923 - DNA, 22 bp, Homo sapiens
agaggccagaaggcgcaccccg

SEQ ID NO: 9214924 - DNA, 22 bp, Homo sapiens
agaggccagaaagtatgccacc

SEQ ID NO: 9214925 - DNA, 22 bp, Homo sapiens
agaggccagcaaccacagtaaa

SEQ ID NO: 9214926 - DNA, 22 bp, Homo sapiens
agaggccagcaaccacagtaaa

SEQ ID NO: 9214927 - DNA, 22 bp, Homo sapiens
agaggccagatcatcatagatg

SEQ ID NO: 9214928 - DNA, 22 bp, Homo sapiens
agaggccagatcatcatagatg

SEQ ID NO: 9214929 - DNA, 22 bp, Homo sapiens
agaggccagcactgcagggaag

SEQ ID NO: 9214930 - DNA, 22 bp, Homo sapiens
agaggccagcactgcagggaag

SEQ ID NO: 9214931 - DNA, 22 bp, Homo sapiens
agaggccagcactgcagggaag

SEQ ID NO: 9214932 - DNA, 22 bp, Homo sapiens
agaggccagcccaggccaccga

SEQ ID NO: 9214933 - DNA, 22 bp, Homo sapiens
agaggccagcagtgcctatctg

SEQ ID NO: 9214934 - DNA, 22 bp, Homo sapiens
agaggccagcagtgcctatctg

SEQ ID NO: 9214935 - DNA, 23 bp, Homo sapiens
agaggccagcctttggagacacc

SEQ ID NO: 9214936 - DNA, 23 bp, Homo sapiens
agaggccagcctttggagacacc

SEQ ID NO: 9214937 - DNA, 22 bp, Homo sapiens
agaggccaggctgcagagggat

SEQ ID NO: 9214938 - DNA, 22 bp, Homo sapiens
agaggccaggctgcagagggat

SEQ ID NO: 9214939 - DNA, 22 bp, Homo sapiens
agaggccaggctgcagagggat

SEQ ID NO: 9214940 - DNA, 22 bp, Homo sapiens
agaggccagctagcgggccatc

SEQ ID NO: 9214941 - DNA, 22 bp, Homo sapiens
agaggccaggcagcccaaggtg

SEQ ID NO: 9214942 - DNA, 22 bp, Homo sapiens
agaggccaggcagcccaaggtg

SEQ ID NO: 9214943 - DNA, 22 bp, Homo sapiens
agaggcaggaggttgacttgag

SEQ ID NO: 9214944 - DNA, 20 bp, Homo sapiens
agagctgggaagctccctat

SEQ ID NO: 9214945 - DNA, 22 bp, Homo sapiens
agagctgggaccgtctggaagt

SEQ ID NO: 9214946 - DNA, 22 bp, Homo sapiens
agagctgggaccgtctggaagt

SEQ ID NO: 9214947 - DNA, 22 bp, Homo sapiens
agaggcaagattatcagggcat

SEQ ID NO: 9214948 - DNA, 22 bp, Homo sapiens
agaggaggctgggtccagataa

SEQ ID NO: 9214949 - DNA, 22 bp, Homo sapiens
agaggcaaggcaggattcttct

SEQ ID NO: 9214950 - DNA, 19 bp, Homo sapiens
agaggcaagggctcatgac

SEQ ID NO: 9214951 - DNA, 19 bp, Homo sapiens
agaggcaagggtggaagta

SEQ ID NO: 9214952 - DNA, 19 bp, Homo sapiens
agaggcaagggtggaagta

SEQ ID NO: 9214953 - DNA, 22 bp, Homo sapiens
agaggcaagttcagagctagga

SEQ ID NO: 9214954 - DNA, 22 bp, Homo sapiens
agaggcaatgaaagcagtctct

SEQ ID NO: 9214955 - DNA, 21 bp, Homo sapiens
agcagctgggcaacatggagg

SEQ ID NO: 9214956 - DNA, 22 bp, Homo sapiens
agcaggaacgagttcatgggga

SEQ ID NO: 9214957 - DNA, 22 bp, Homo sapiens
agcaggaaggtctgtgtgagtc

SEQ ID NO: 9214958 - DNA, 22 bp, Homo sapiens
agcaggaaggtctgtgtgagtc

SEQ ID NO: 9214959 - DNA, 22 bp, Homo sapiens
agcaggaagtagtctgtaagca

SEQ ID NO: 9214960 - DNA, 22 bp, Homo sapiens
agcaggaaggggatgatgggca

SEQ ID NO: 9214961 - DNA, 22 bp, Homo sapiens
agcaggaaggggatgatgggca

SEQ ID NO: 9214962 - DNA, 20 bp, Homo sapiens
agcaggaatgatgctttcat

SEQ ID NO: 9214963 - DNA, 22 bp, Homo sapiens
cacagcaagagctaaatgacca

SEQ ID NO: 9214964 - DNA, 22 bp, Homo sapiens
cacagcaatagctaactgatac

SEQ ID NO: 9214965 - DNA, 22 bp, Homo sapiens
agcaggctgggcaatatgggca

SEQ ID NO: 9214966 - DNA, 22 bp, Homo sapiens
cacagcagagggagccattgaa

SEQ ID NO: 9214967 - DNA, 22 bp, Homo sapiens
cacagcagagggagccattgaa

SEQ ID NO: 9214968 - DNA, 22 bp, Homo sapiens
cacagcagacagggaggcggct

SEQ ID NO: 9214969 - DNA, 22 bp, Homo sapiens
cacagcagaaagtgtaggagga

SEQ ID NO: 9214970 - DNA, 22 bp, Homo sapiens
cacagcagaacttaatttcaaa

SEQ ID NO: 9214971 - DNA, 22 bp, Homo sapiens
agcagggaggcggtgtgctggc

SEQ ID NO: 9214972 - DNA, 22 bp, Homo sapiens
agcagggagaccatctcttcct

SEQ ID NO: 9214973 - DNA, 22 bp, Homo sapiens
agcagggaggcccagggcactg

SEQ ID NO: 9214974 - DNA, 22 bp, Homo sapiens
agcagggcagtgatcagaaagg

SEQ ID NO: 9214975 - DNA, 22 bp, Homo sapiens
cacatttaatcctttataagta

SEQ ID NO: 9214976 - DNA, 22 bp, Homo sapiens
caccagctacagactactgtgt

SEQ ID NO: 9214977 - DNA, 20 bp, Homo sapiens
caccagcagcagctgccacc

SEQ ID NO: 9214978 - DNA, 22 bp, Homo sapiens
caccagccccctcacgctgtca

SEQ ID NO: 9214979 - DNA, 20 bp, Homo sapiens
caccagcagcagctgccacc

SEQ ID NO: 9214980 - DNA, 20 bp, Homo sapiens
caccagcagcagctgccacc

SEQ ID NO: 9214981 - DNA, 22 bp, Homo sapiens
caccagcaccagctctgtgcct

SEQ ID NO: 9214982 - DNA, 22 bp, Homo sapiens
caccagcagaagactgagggtg

SEQ ID NO: 9214983 - DNA, 22 bp, Homo sapiens
caccagcagaagactgagggtg

SEQ ID NO: 9214984 - DNA, 23 bp, Homo sapiens
caccactttctccttctccttgg

SEQ ID NO: 9214985 - DNA, 22 bp, Homo sapiens
agcatgctggttacgtgtagca

SEQ ID NO: 9214986 - DNA, 23 bp, Homo sapiens
agcatggaataggaaagaggcag

SEQ ID NO: 9214987 - DNA, 22 bp, Homo sapiens
agcatggacagtggcagcagtg

SEQ ID NO: 9214988 - DNA, 22 bp, Homo sapiens
agcatggcattattggaaggac

SEQ ID NO: 9214989 - DNA, 22 bp, Homo sapiens
agcatgctatattgattgtagt

SEQ ID NO: 9214990 - DNA, 22 bp, Homo sapiens
agcatgtggctatctttggggg

SEQ ID NO: 9214991 - DNA, 22 bp, Homo sapiens
agcatgttcatcttctgttggt

SEQ ID NO: 9214992 - DNA, 23 bp, Homo sapiens
agcatgttgtgatgttaccactg

SEQ ID NO: 9214993 - DNA, 22 bp, Homo sapiens
cactgttctttttgtagtccaa

SEQ ID NO: 9214994 - DNA, 22 bp, Homo sapiens
cactgttcatcaaaactgctct

SEQ ID NO: 9214995 - DNA, 22 bp, Homo sapiens
cactttactatctataaaataa

SEQ ID NO: 9214996 - DNA, 22 bp, Homo sapiens
cactgttttattccaacatagg

SEQ ID NO: 9214997 - DNA, 22 bp, Homo sapiens
cactgtggggtttggctggaac

SEQ ID NO: 9214998 - DNA, 19 bp, Homo sapiens
cactgtggtccttcactgc

SEQ ID NO: 9214999 - DNA, 22 bp, Homo sapiens
agcatgaaagcataggacagtc

SEQ ID NO: 9215000 - DNA, 22 bp, Homo sapiens
agcatgaagacttcagagctag

SEQ ID NO: 9215001 - DNA, 22 bp, Homo sapiens
agcatgaaaggcgtgccaactt

SEQ ID NO: 9215002 - DNA, 22 bp, Homo sapiens
agcagtggagcgagatgtttaa

SEQ ID NO: 9215003 - DNA, 22 bp, Homo sapiens
agcagtccttctttagagagcc

SEQ ID NO: 9215004 - DNA, 22 bp, Homo sapiens
agcagtgccgcatcttgtgacc

SEQ ID NO: 9215005 - DNA, 22 bp, Homo sapiens
agcagtgcccattctgccccct

SEQ ID NO: 9215006 - DNA, 22 bp, Homo sapiens
agcagtgccgcatcttgtgacc

SEQ ID NO: 9215007 - DNA, 21 bp, Homo sapiens
agcagtgctcctgggatgagg

SEQ ID NO: 9215008 - DNA, 22 bp, Homo sapiens
agcagtggacctcagtgctatt

SEQ ID NO: 9215009 - DNA, 22 bp, Homo sapiens
agcagtgcttgccttagtgtga

SEQ ID NO: 9215010 - DNA, 22 bp, Homo sapiens
agcagtccttctttagagagcc

SEQ ID NO: 9215011 - DNA, 20 bp, Homo sapiens
agcagtccaaaagggcagac

SEQ ID NO: 9215012 - DNA, 22 bp, Homo sapiens
agcagtaagtgaagactagttt

SEQ ID NO: 9215013 - DNA, 23 bp, Homo sapiens
agcagtaacttcagaaacatcag

SEQ ID NO: 9215014 - DNA, 22 bp, Homo sapiens
agcaggtttaaactctaatgca

SEQ ID NO: 9215015 - DNA, 23 bp, Homo sapiens
agcagtaacttcagaaacatcag

SEQ ID NO: 9215016 - DNA, 22 bp, Homo sapiens
caatacatcaggtcaaaatgtg

SEQ ID NO: 9215017 - DNA, 16 bp, Homo sapiens
caatacatggcatttc

SEQ ID NO: 9215018 - DNA, 22 bp, Homo sapiens
agcagcagatcaaacaggcttg

SEQ ID NO: 9215019 - DNA, 22 bp, Homo sapiens
agcagcagaggtcagaaaggta

SEQ ID NO: 9215020 - DNA, 23 bp, Homo sapiens
agcagccctgggacctggcctgc

SEQ ID NO: 9215021 - DNA, 22 bp, Homo sapiens
agcagcctattcttctcttgga

SEQ ID NO: 9215022 - DNA, 22 bp, Homo sapiens
agcagcctattcttctcttgga

SEQ ID NO: 9215023 - DNA, 22 bp, Homo sapiens
agcagcctcccagggagcagcc

SEQ ID NO: 9215024 - DNA, 22 bp, Homo sapiens
agcagcctctgtagaggtctcc

SEQ ID NO: 9215025 - DNA, 22 bp, Homo sapiens
agcagcctggacttggatgtgg

SEQ ID NO: 9215026 - DNA, 21 bp, Homo sapiens
agcagcagatctggtgagggc

SEQ ID NO: 9215027 - DNA, 22 bp, Homo sapiens
agcagcccgaggatcatgtgtc

SEQ ID NO: 9215028 - DNA, 22 bp, Homo sapiens
cacagaacatttttagatgcag

SEQ ID NO: 9215029 - DNA, 22 bp, Homo sapiens
agcagctcccctcatgctccac

SEQ ID NO: 9215030 - DNA, 22 bp, Homo sapiens
cacagagatcggaacagaagta

SEQ ID NO: 9215031 - DNA, 22 bp, Homo sapiens
agcagctcagaggcaccagggc

SEQ ID NO: 9215032 - DNA, 22 bp, Homo sapiens
agcagctcagaggcaccagggc

SEQ ID NO: 9215033 - DNA, 22 bp, Homo sapiens
agcagctcaacagtgtctctat

SEQ ID NO: 9215034 - DNA, 22 bp, Homo sapiens
agcagctcaaagcctgcaagga

SEQ ID NO: 9215035 - DNA, 22 bp, Homo sapiens
agcagctcaacagtgtctctat

SEQ ID NO: 9215036 - DNA, 22 bp, Homo sapiens
agcagctagacttcagaatctg

SEQ ID NO: 9215037 - DNA, 22 bp, Homo sapiens
agcagctcaaagcctgcaagga

SEQ ID NO: 9215038 - DNA, 22 bp, Homo sapiens
agcagcctttgatcatctggga

SEQ ID NO: 9215039 - DNA, 21 bp, Homo sapiens
agcagccttgtgtgccaggca

SEQ ID NO: 9215040 - DNA, 21 bp, Homo sapiens
agcagctgggcaacatggagg

SEQ ID NO: 9215041 - DNA, 17 bp, Homo sapiens
agcagctggcacaggag

SEQ ID NO: 9215042 - DNA, 22 bp, Homo sapiens
agcagctggaacatatgaagaa

SEQ ID NO: 9215043 - DNA, 22 bp, Homo sapiens
cacagagcaggggtctgtgtca

SEQ ID NO: 9215044 - DNA, 22 bp, Homo sapiens
cacagagctcaagtcttagaaa

SEQ ID NO: 9215045 - DNA, 22 bp, Homo sapiens
caataatatcctgtgctgtttg

SEQ ID NO: 9215046 - DNA, 22 bp, Homo sapiens
caataatatcctgtgctgtttg

SEQ ID NO: 9215047 - DNA, 22 bp, Homo sapiens
agcagaggtttgttggaaacct

SEQ ID NO: 9215048 - DNA, 22 bp, Homo sapiens
agcagagtcttcaagggcaggc

SEQ ID NO: 9215049 - DNA, 22 bp, Homo sapiens
agcagagcggggcctccggaag

SEQ ID NO: 9215050 - DNA, 22 bp, Homo sapiens
agcagagctttttggactcaga

SEQ ID NO: 9215051 - DNA, 21 bp, Homo sapiens
agcagaggctgcctggtgact

SEQ ID NO: 9215052 - DNA, 22 bp, Homo sapiens
agcagagctgggatcctgggtc

SEQ ID NO: 9215053 - DNA, 22 bp, Homo sapiens
agcacctggagggctgggacct

SEQ ID NO: 9215054 - DNA, 22 bp, Homo sapiens
agcacctgcttgtgactaggga

SEQ ID NO: 9215055 - DNA, 22 bp, Homo sapiens
caaaggcctgagaactgagggg

SEQ ID NO: 9215056 - DNA, 17 bp, Homo sapiens
caaagggagcccaccaa

SEQ ID NO: 9215057 - DNA, 22 bp, Homo sapiens
caaaggctttgctatgatgcat

SEQ ID NO: 9215058 - DNA, 22 bp, Homo sapiens
caaagggaaaagccatgtgggc

SEQ ID NO: 9215059 - DNA, 20 bp, Homo sapiens
agcacctgtgtagaagcatc

SEQ ID NO: 9215060 - DNA, 23 bp, Homo sapiens
agcacgggtacagcctggccagg

SEQ ID NO: 9215061 - DNA, 22 bp, Homo sapiens
agcactgcctctgagctccagc

SEQ ID NO: 9215062 - DNA, 22 bp, Homo sapiens
agcactgtagttatagctaaca

SEQ ID NO: 9215063 - DNA, 22 bp, Homo sapiens
agcactggagtttagtgggatt

SEQ ID NO: 9215064 - DNA, 22 bp, Homo sapiens
agccaggcagggctctcgctct

SEQ ID NO: 9215065 - DNA, 22 bp, Homo sapiens
cagagacccttctcagtggcca

SEQ ID NO: 9215066 - DNA, 22 bp, Homo sapiens
agccaggccagactcacaccct

SEQ ID NO: 9215067 - DNA, 22 bp, Homo sapiens
cagagaccccgctgcccttctg

SEQ ID NO: 9215068 - DNA, 20 bp, Homo sapiens
cagagacccaggcttcagct

SEQ ID NO: 9215069 - DNA, 22 bp, Homo sapiens
cagagacatgtggcctgcacgt

SEQ ID NO: 9215070 - DNA, 22 bp, Homo sapiens
cagagacattctccccattgga

SEQ ID NO: 9215071 - DNA, 22 bp, Homo sapiens
agccaggccagactcacaccct

SEQ ID NO: 9215072 - DNA, 22 bp, Homo sapiens
agccaggccagctgtcttgagt

SEQ ID NO: 9215073 - DNA, 22 bp, Homo sapiens
agccaggccttagggagaggca

SEQ ID NO: 9215074 - DNA, 22 bp, Homo sapiens
cagagccttagttctcctagaa

SEQ ID NO: 9215075 - DNA, 22 bp, Homo sapiens
cactttctgtgtatcttccatt

SEQ ID NO: 9215076 - DNA, 19 bp, Homo sapiens
agccagagtggcccagggg

SEQ ID NO: 9215077 - DNA, 22 bp, Homo sapiens
agccagagagtgttggagatgt

SEQ ID NO: 9215078 - DNA, 22 bp, Homo sapiens
agccagagagtgttggagatgt

SEQ ID NO: 9215079 - DNA, 22 bp, Homo sapiens
agccagcacggcgccatggagt

SEQ ID NO: 9215080 - DNA, 22 bp, Homo sapiens
agccagatgctattgctggaaa

SEQ ID NO: 9215081 - DNA, 22 bp, Homo sapiens
agccagcagggcttagaggaca

SEQ ID NO: 9215082 - DNA, 22 bp, Homo sapiens
agccagcaggtgagtgcagcct

SEQ ID NO: 9215083 - DNA, 22 bp, Homo sapiens
agccagcaggtgcagaattcca

SEQ ID NO: 9215084 - DNA, 22 bp, Homo sapiens
agccagcaggtgagtgcagcct

SEQ ID NO: 9215085 - DNA, 22 bp, Homo sapiens
agccagctaagggaagcatgat

SEQ ID NO: 9215086 - DNA, 22 bp, Homo sapiens
agccagctaccggggctcctgg

SEQ ID NO: 9215087 - DNA, 22 bp, Homo sapiens
agccagctaccggggctcctgg

SEQ ID NO: 9215088 - DNA, 22 bp, Homo sapiens
agccagccgggggaccacagtg

SEQ ID NO: 9215089 - DNA, 22 bp, Homo sapiens
agccctgggcagccaaggaagc

SEQ ID NO: 9215090 - DNA, 22 bp, Homo sapiens
agccctggcccggctgtgcttt

SEQ ID NO: 9215091 - DNA, 22 bp, Homo sapiens
agccctggctcccagcagcgct

SEQ ID NO: 9215092 - DNA, 22 bp, Homo sapiens
agccctggctcccagcagcgct

SEQ ID NO: 9215093 - DNA, 22 bp, Homo sapiens
agccctgggcacctgtgagggg

SEQ ID NO: 9215094 - DNA, 22 bp, Homo sapiens
agccctgggcacctgtgagggg

SEQ ID NO: 9215095 - DNA, 22 bp, Homo sapiens
agccctgggaggccagcttgta

SEQ ID NO: 9215096 - DNA, 22 bp, Homo sapiens
agccctggcagagccaggtagt

SEQ ID NO: 9215097 - DNA, 22 bp, Homo sapiens
agccctggcagagccaggtagt

SEQ ID NO: 9215098 - DNA, 22 bp, Homo sapiens
agccctggattctgaggtccaa

SEQ ID NO: 9215099 - DNA, 22 bp, Homo sapiens
agccctggagcaaaggtgtctt

SEQ ID NO: 9215100 - DNA, 22 bp, Homo sapiens
agcccccaaaagtgcttatgat

SEQ ID NO: 9215101 - DNA, 22 bp, Homo sapiens
agcccccaaaagtgcttatgat

SEQ ID NO: 9215102 - DNA, 22 bp, Homo sapiens
agcccccacgtttcctgggtcc

SEQ ID NO: 9215103 - DNA, 22 bp, Homo sapiens
agccccagttccctggaagtct

SEQ ID NO: 9215104 - DNA, 22 bp, Homo sapiens
agccccagtccgctgcgggcgg

SEQ ID NO: 9215105 - DNA, 22 bp, Homo sapiens
agcccagggacagggcggatgt

SEQ ID NO: 9215106 - DNA, 22 bp, Homo sapiens
agcccaggttgaggctgcagtg

SEQ ID NO: 9215107 - DNA, 22 bp, Homo sapiens
agccagttggctatgaggagga

SEQ ID NO: 9215108 - DNA, 22 bp, Homo sapiens
agccagtttaagcaggaggggt

SEQ ID NO: 9215109 - DNA, 22 bp, Homo sapiens
agccccaggatgggccgcagga

SEQ ID NO: 9215110 - DNA, 22 bp, Homo sapiens
agccccaggcccggacgcctct

SEQ ID NO: 9215111 - DNA, 22 bp, Homo sapiens
agccccaggatgggccgcagga

SEQ ID NO: 9215112 - DNA, 20 bp, Homo sapiens
agccccacccttgtcctggc

SEQ ID NO: 9215113 - DNA, 22 bp, Homo sapiens
agccccagcccctctctcacaa

SEQ ID NO: 9215114 - DNA, 22 bp, Homo sapiens
agccccagcccctctctcacaa

SEQ ID NO: 9215115 - DNA, 22 bp, Homo sapiens
agcccaggttgaggctgcagtg

SEQ ID NO: 9215116 - DNA, 22 bp, Homo sapiens
agcccaggttgaggctgcagtg

SEQ ID NO: 9215117 - DNA, 22 bp, Homo sapiens
agcccaggttgaggctgcagtg

SEQ ID NO: 9215118 - DNA, 22 bp, Homo sapiens
agcccagtgggccgaggcgggg

SEQ ID NO: 9215119 - DNA, 20 bp, Homo sapiens
agctaagaggaaaagtgaga

SEQ ID NO: 9215120 - DNA, 22 bp, Homo sapiens
agctagagctgagaagcacttg

SEQ ID NO: 9215121 - DNA, 22 bp, Homo sapiens
agctacagtcggaaggacagac

SEQ ID NO: 9215122 - DNA, 22 bp, Homo sapiens
agctaagacttagtgacttagt

SEQ ID NO: 9215123 - DNA, 18 bp, Homo sapiens
agcctgggctctgcctgg

SEQ ID NO: 9215124 - DNA, 22 bp, Homo sapiens
agcctgggttagggttcttccc

SEQ ID NO: 9215125 - DNA, 18 bp, Homo sapiens
agcctgggctctgcctgg

SEQ ID NO: 9215126 - DNA, 22 bp, Homo sapiens
agcctgggcctggcttcccgcc

SEQ ID NO: 9215127 - DNA, 22 bp, Homo sapiens
agcctgggcatgggacgggagg

SEQ ID NO: 9215128 - DNA, 20 bp, Homo sapiens
agcctggggaattccacccc

SEQ ID NO: 9215129 - DNA, 22 bp, Homo sapiens
agcctggggcacttctccaaac

SEQ ID NO: 9215130 - DNA, 22 bp, Homo sapiens
agcctggggtttcagtttgcac

SEQ ID NO: 9215131 - DNA, 22 bp, Homo sapiens
agcctgggagacactaagttgt

SEQ ID NO: 9215132 - DNA, 17 bp, Homo sapiens
agcctgggaaggagtga

SEQ ID NO: 9215133 - DNA, 22 bp, Homo sapiens
agcctgggcaacaacacagcga

SEQ ID NO: 9215134 - DNA, 22 bp, Homo sapiens
agcctgggcaactccattcact

SEQ ID NO: 9215135 - DNA, 20 bp, Homo sapiens
cagatgggacgtggaggagt

SEQ ID NO: 9215136 - DNA, 22 bp, Homo sapiens
cagatgtgattcttccctcagc

SEQ ID NO: 9215137 - DNA, 22 bp, Homo sapiens
cagcaactctcctgtgctcaaa

SEQ ID NO: 9215138 - DNA, 22 bp, Homo sapiens
cagcaacatgtggtagtgtagg

SEQ ID NO: 9215139 - DNA, 22 bp, Homo sapiens
agctcctggaggtgcgcactcg

SEQ ID NO: 9215140 - DNA, 20 bp, Homo sapiens
agctcctggactagagagtg

SEQ ID NO: 9215141 - DNA, 22 bp, Homo sapiens
agctcctgattctcagagatag

SEQ ID NO: 9215142 - DNA, 22 bp, Homo sapiens
agctccagcctcttctggaggt

SEQ ID NO: 9215143 - DNA, 23 bp, Homo sapiens
agctccagctgacgtgggcagcc

SEQ ID NO: 9215144 - DNA, 22 bp, Homo sapiens
agctccaggataagacaggtgc

SEQ ID NO: 9215145 - DNA, 22 bp, Homo sapiens
agctccagattaattgtaggag

SEQ ID NO: 9215146 - DNA, 22 bp, Homo sapiens
agctccagccgctgatgggttt

SEQ ID NO: 9215147 - DNA, 22 bp, Homo sapiens
agctccagccctagtacagctg

SEQ ID NO: 9215148 - DNA, 23 bp, Homo sapiens
agctccagaacatagcacaggaa

SEQ ID NO: 9215149 - DNA, 22 bp, Homo sapiens
agctaggacaggtagagatggg

SEQ ID NO: 9215150 - DNA, 19 bp, Homo sapiens
agctcaggcccatcgtccc

SEQ ID NO: 9215151 - DNA, 22 bp, Homo sapiens
agctaggaaattgaggctgaga

SEQ ID NO: 9215152 - DNA, 22 bp, Homo sapiens
agctaggaaattgaggctgaga

SEQ ID NO: 9215153 - DNA, 22 bp, Homo sapiens
agctcctggcaaggtcatggtg

SEQ ID NO: 9215154 - DNA, 22 bp, Homo sapiens
agctcctggcaaggtcatggtg

SEQ ID NO: 9215155 - DNA, 22 bp, Homo sapiens
agctcctgggcacctctttcac

SEQ ID NO: 9215156 - DNA, 22 bp, Homo sapiens
agctcctgggccaagcccatgc

SEQ ID NO: 9215157 - DNA, 19 bp, Homo sapiens
agctcctgggctctgggcc

SEQ ID NO: 9215158 - DNA, 22 bp, Homo sapiens
agctcctgtagtacatattatt

SEQ ID NO: 9215159 - DNA, 22 bp, Homo sapiens
agctcctgtctcaagggagcct

SEQ ID NO: 9215160 - DNA, 22 bp, Homo sapiens
agctcctggtctttgtccagag

SEQ ID NO: 9215161 - DNA, 22 bp, Homo sapiens
agctcctgggggttccaagcag

SEQ ID NO: 9215162 - DNA, 18 bp, Homo sapiens
agctcctggtctcaggga

SEQ ID NO: 9215163 - DNA, 20 bp, Homo sapiens
agctcctggtataggtgcct

SEQ ID NO: 9215164 - DNA, 22 bp, Homo sapiens
agctcctgtggcagctcttctg

SEQ ID NO: 9215165 - DNA, 22 bp, Homo sapiens
agctcctgtggctgaaagagga

SEQ ID NO: 9215166 - DNA, 22 bp, Homo sapiens
aaggccactttaccttaaatcc

SEQ ID NO: 9215167 - DNA, 22 bp, Homo sapiens
aaggccacacttgctggccagc

SEQ ID NO: 9215168 - DNA, 22 bp, Homo sapiens
aaggccacacttgctggccagc

SEQ ID NO: 9215169 - DNA, 22 bp, Homo sapiens
aaggccacagagcctcagagag

SEQ ID NO: 9215170 - DNA, 22 bp, Homo sapiens
aaggccaccaccagcgaggggg

SEQ ID NO: 9215171 - DNA, 22 bp, Homo sapiens
aaggccactgaagaaatcacaa

SEQ ID NO: 9215172 - DNA, 22 bp, Homo sapiens
aaggccacgtctccttccagag

SEQ ID NO: 9215173 - DNA, 22 bp, Homo sapiens
aaggccaactaggatgagctag

SEQ ID NO: 9215174 - DNA, 22 bp, Homo sapiens
aaggccaaagttttcaggctaa

SEQ ID NO: 9215175 - DNA, 22 bp, Homo sapiens
aaggccaaagacacctacacag

SEQ ID NO: 9215176 - DNA, 22 bp, Homo sapiens
aaggcattgctgatcctcaggt

SEQ ID NO: 9215177 - DNA, 22 bp, Homo sapiens
aacaataactagacatgccatg

SEQ ID NO: 9215178 - DNA, 22 bp, Homo sapiens
aagggagacagttgtgtgagga

SEQ ID NO: 9215179 - DNA, 22 bp, Homo sapiens
aacaagttactcttaaagtata

SEQ ID NO: 9215180 - DNA, 22 bp, Homo sapiens
aacaagttagggtcttttactt

SEQ ID NO: 9215181 - DNA, 19 bp, Homo sapiens
aacaagtaggaatggaaga

SEQ ID NO: 9215182 - DNA, 22 bp, Homo sapiens
aacaagcagatgcaatgcactt

SEQ ID NO: 9215183 - DNA, 22 bp, Homo sapiens
aagtacagaaatagcaggtgca

SEQ ID NO: 9215184 - DNA, 22 bp, Homo sapiens
aagtacagaaatagcaggtgca

SEQ ID NO: 9215185 - DNA, 22 bp, Homo sapiens
aaggggcctcacagatgggctt

SEQ ID NO: 9215186 - DNA, 22 bp, Homo sapiens
aaggggcctcacagatgggctt

SEQ ID NO: 9215187 - DNA, 22 bp, Homo sapiens
aaggggaagtagcaccagaggt

SEQ ID NO: 9215188 - DNA, 22 bp, Homo sapiens
aaggggaatagagtgggttgtg

SEQ ID NO: 9215189 - DNA, 22 bp, Homo sapiens
aagggaggaggatttattgtac

SEQ ID NO: 9215190 - DNA, 22 bp, Homo sapiens
aagggagcttaggagatcaggc

SEQ ID NO: 9215191 - DNA, 22 bp, Homo sapiens
aagggagccaagaaagcagggc

SEQ ID NO: 9215192 - DNA, 22 bp, Homo sapiens
aaattattatgcccctctataa

SEQ ID NO: 9215193 - DNA, 17 bp, Homo sapiens
aaggaccaacaggaaat

SEQ ID NO: 9215194 - DNA, 22 bp, Homo sapiens
aaattaactatcacttttgtga

SEQ ID NO: 9215195 - DNA, 22 bp, Homo sapiens
aaattagtacattgcaaagtcc

SEQ ID NO: 9215196 - DNA, 22 bp, Homo sapiens
aaattataggtgccaccttgga

SEQ ID NO: 9215197 - DNA, 22 bp, Homo sapiens
aaattagtcatgttgtattact

SEQ ID NO: 9215198 - DNA, 22 bp, Homo sapiens
aaattagtcggtttaggaattt

SEQ ID NO: 9215199 - DNA, 22 bp, Homo sapiens
aaatttaaggaggtgctcactt

SEQ ID NO: 9215200 - DNA, 22 bp, Homo sapiens
aaatttaagaagtgtgtgcgtg

SEQ ID NO: 9215201 - DNA, 22 bp, Homo sapiens
aaatttaaaaagcagcattgca

SEQ ID NO: 9215202 - DNA, 22 bp, Homo sapiens
aaatttaaaaagcagcattgca

SEQ ID NO: 9215203 - DNA, 22 bp, Homo sapiens
aaatttaaaaagcagcattgca

SEQ ID NO: 9215204 - DNA, 22 bp, Homo sapiens
aaggagaaatggtagatgtgca

SEQ ID NO: 9215205 - DNA, 22 bp, Homo sapiens
aaggacctgattttgagcatct

SEQ ID NO: 9215206 - DNA, 22 bp, Homo sapiens
aagccagtaagtttttgtcatt

SEQ ID NO: 9215207 - DNA, 22 bp, Homo sapiens
aagccatggtagaaaactcagt

SEQ ID NO: 9215208 - DNA, 22 bp, Homo sapiens
aagctggcaattatcaaaactg

SEQ ID NO: 9215209 - DNA, 22 bp, Homo sapiens
aagcccagatgagatccctgga

SEQ ID NO: 9215210 - DNA, 22 bp, Homo sapiens
aagctttgactactgcctcttg

SEQ ID NO: 9215211 - DNA, 22 bp, Homo sapiens
aagctttgcaatgcttcattat

SEQ ID NO: 9215212 - DNA, 22 bp, Homo sapiens
aagctttgataattggattact

SEQ ID NO: 9215213 - DNA, 22 bp, Homo sapiens
aagctttggaagggcagggttg

SEQ ID NO: 9215214 - DNA, 22 bp, Homo sapiens
aagctttgcaccggtggctgga

SEQ ID NO: 9215215 - DNA, 22 bp, Homo sapiens
aagctttggagaggcgggcagg

SEQ ID NO: 9215216 - DNA, 22 bp, Homo sapiens
aagctttgttcttcacagagtg

SEQ ID NO: 9215217 - DNA, 22 bp, Homo sapiens
aagctttgtccaaggccatgca

SEQ ID NO: 9215218 - DNA, 22 bp, Homo sapiens
aagctttgggcagaagaggatt

SEQ ID NO: 9215219 - DNA, 22 bp, Homo sapiens
aactccaggcagggaggccact

SEQ ID NO: 9215220 - DNA, 22 bp, Homo sapiens
aactcatctgggtgagtttgtc

SEQ ID NO: 9215221 - DNA, 22 bp, Homo sapiens
aactcatcttcgagtgaggctg

SEQ ID NO: 9215222 - DNA, 22 bp, Homo sapiens
aaccagagtgacactctacaga

SEQ ID NO: 9215223 - DNA, 23 bp, Homo sapiens
aatcacttccctccaaatggatt

SEQ ID NO: 9215224 - DNA, 22 bp, Homo sapiens
aatcacattagtgaaacactga

SEQ ID NO: 9215225 - DNA, 22 bp, Homo sapiens
aacatttcagcaaataagaaca

SEQ ID NO: 9215226 - DNA, 21 bp, Homo sapiens
aacatttcaggatccaaattg

SEQ ID NO: 9215227 - DNA, 22 bp, Homo sapiens
aacatttaggaaggacctcctc

SEQ ID NO: 9215228 - DNA, 22 bp, Homo sapiens
aacatttatggtagtcattgca

SEQ ID NO: 9215229 - DNA, 22 bp, Homo sapiens
aacatttatggtagtcattgca

SEQ ID NO: 9215230 - DNA, 22 bp, Homo sapiens
aacatttattgagcacctactg

SEQ ID NO: 9215231 - DNA, 22 bp, Homo sapiens
aacattgaaatatttgcaatag

SEQ ID NO: 9215232 - DNA, 22 bp, Homo sapiens
aacattcttcaaatatcactct

SEQ ID NO: 9215233 - DNA, 22 bp, Homo sapiens
aacattcttaagatttgtgtct

SEQ ID NO: 9215234 - DNA, 22 bp, Homo sapiens
aacattaagatggcggaacagt

SEQ ID NO: 9215235 - DNA, 22 bp, Homo sapiens
aacattaagatggcggaacagt

SEQ ID NO: 9215236 - DNA, 22 bp, Homo sapiens
aacattctgtcaattgatgacc

SEQ ID NO: 9215237 - DNA, 22 bp, Homo sapiens
aacattctggttctaaaaacct

SEQ ID NO: 9215238 - DNA, 22 bp, Homo sapiens
aagttgctaatgatgtgtttgc

SEQ ID NO: 9215239 - DNA, 22 bp, Homo sapiens
aataaaatggtcagttttctca

SEQ ID NO: 9215240 - DNA, 22 bp, Homo sapiens
aataaacaaaggacaaggaggt

SEQ ID NO: 9215241 - DNA, 22 bp, Homo sapiens
aataaacaaatccttccttccc

SEQ ID NO: 9215242 - DNA, 22 bp, Homo sapiens
aataaacaaatctttcctgtgg

SEQ ID NO: 9215243 - DNA, 22 bp, Homo sapiens
aagtcaagataaaggtgctggc

SEQ ID NO: 9215244 - DNA, 22 bp, Homo sapiens
aacactgctccaaaaaaggctt

SEQ ID NO: 9215245 - DNA, 22 bp, Homo sapiens
aagttcttagacaagcttgtgg

SEQ ID NO: 9215246 - DNA, 23 bp, Homo sapiens
aagttcttttagatgtcttcgtg

SEQ ID NO: 9215247 - DNA, 22 bp, Homo sapiens
aagaggaggattgatgtgggag

SEQ ID NO: 9215248 - DNA, 22 bp, Homo sapiens
aagacattttgaaattggaagc

SEQ ID NO: 9215249 - DNA, 22 bp, Homo sapiens
aagacatttatttgaatcaatt

SEQ ID NO: 9215250 - DNA, 22 bp, Homo sapiens
aagaggcagaaatatcgctgaa

SEQ ID NO: 9215251 - DNA, 22 bp, Homo sapiens
aagaggcataaaatttatatgg

SEQ ID NO: 9215252 - DNA, 23 bp, Homo sapiens
aagaggaggccctgctcccgtcc

SEQ ID NO: 9215253 - DNA, 22 bp, Homo sapiens
aagaggagtagatgtggttggt

SEQ ID NO: 9215254 - DNA, 22 bp, Homo sapiens
aagaggagggcagattcaaggc

SEQ ID NO: 9215255 - DNA, 22 bp, Homo sapiens
aagaggagtagatgtggttggt

SEQ ID NO: 9215256 - DNA, 19 bp, Homo sapiens
aagaggcaaccctcgagcc

SEQ ID NO: 9215257 - DNA, 19 bp, Homo sapiens
aagaggcaaccctcgagcc

SEQ ID NO: 9215258 - DNA, 22 bp, Homo sapiens
acacacaggtaaaggagcctgg

SEQ ID NO: 9215259 - DNA, 19 bp, Homo sapiens
aagagggaaagtgctatgc

SEQ ID NO: 9215260 - DNA, 22 bp, Homo sapiens
acacacagcgcctaccatgtgc

SEQ ID NO: 9215261 - DNA, 22 bp, Homo sapiens
acacacagagtttatacaggca

SEQ ID NO: 9215262 - DNA, 22 bp, Homo sapiens
acactacaacagcagaggtgag

SEQ ID NO: 9215263 - DNA, 22 bp, Homo sapiens
acactacaatctcagaactata

SEQ ID NO: 9215264 - DNA, 22 bp, Homo sapiens
acactacagggagaagactcac

SEQ ID NO: 9215265 - DNA, 23 bp, Homo sapiens
acactaaatgtgaaggagcaaag

SEQ ID NO: 9215266 - DNA, 22 bp, Homo sapiens
acacggcactttaggaaggggc

SEQ ID NO: 9215267 - DNA, 22 bp, Homo sapiens
acacggcactttaggaaggggc

SEQ ID NO: 9215268 - DNA, 23 bp, Homo sapiens
acacctgtgctgtagtcactaca

SEQ ID NO: 9215269 - DNA, 22 bp, Homo sapiens
aagagtcatagagacattgatt

SEQ ID NO: 9215270 - DNA, 22 bp, Homo sapiens
aagaggttgtctgtgatgagtt

SEQ ID NO: 9215271 - DNA, 22 bp, Homo sapiens
aagaggttgtacctaaagtgtt

SEQ ID NO: 9215272 - DNA, 22 bp, Homo sapiens
aagagtttaattttgtctagac

SEQ ID NO: 9215273 - DNA, 22 bp, Homo sapiens
aagagtctattggaactagaca

SEQ ID NO: 9215274 - DNA, 22 bp, Homo sapiens
aagagtggagctggaaagtggg

SEQ ID NO: 9215275 - DNA, 22 bp, Homo sapiens
aagagtggagctggaaagtggg

SEQ ID NO: 9215276 - DNA, 22 bp, Homo sapiens
aagagtggagctggaaagtggg

SEQ ID NO: 9215277 - DNA, 19 bp, Homo sapiens
acagaaatgtaagtgagac

SEQ ID NO: 9215278 - DNA, 19 bp, Homo sapiens
acagaaatgtaagtgagac

SEQ ID NO: 9215279 - DNA, 22 bp, Homo sapiens
aagatagatgtcatcagcatat

SEQ ID NO: 9215280 - DNA, 22 bp, Homo sapiens
aagatttgtggatttaaggata

SEQ ID NO: 9215281 - DNA, 22 bp, Homo sapiens
aagatttttttccacagactca

SEQ ID NO: 9215282 - DNA, 22 bp, Homo sapiens
aagcaaaaggttacacttctgg

SEQ ID NO: 9215283 - DNA, 22 bp, Homo sapiens
aagcaaacaggagaagagctgt

SEQ ID NO: 9215284 - DNA, 22 bp, Homo sapiens
acagagctgtacatgtgccatg

SEQ ID NO: 9215285 - DNA, 22 bp, Homo sapiens
acagagcttcccagcctgagca

SEQ ID NO: 9215286 - DNA, 22 bp, Homo sapiens
acagaggaaggctgagctgccc

SEQ ID NO: 9215287 - DNA, 22 bp, Homo sapiens
acagatctacattgtctgaccc

SEQ ID NO: 9215288 - DNA, 22 bp, Homo sapiens
acagatgaattttaattgtgtt

SEQ ID NO: 9215289 - DNA, 22 bp, Homo sapiens
aactctatttaccctactaaac

SEQ ID NO: 9215290 - DNA, 22 bp, Homo sapiens
aactcctctctggtggttcgtc

SEQ ID NO: 9215291 - DNA, 20 bp, Homo sapiens
aactcctagcctcaagtgat

SEQ ID NO: 9215292 - DNA, 20 bp, Homo sapiens
aactcctagcctcaagtgat

SEQ ID NO: 9215293 - DNA, 22 bp, Homo sapiens
aatgtacaataagacaaagagg

SEQ ID NO: 9215294 - DNA, 22 bp, Homo sapiens
aatgtcaagggaagcaggaaat

SEQ ID NO: 9215295 - DNA, 22 bp, Homo sapiens
aatgtcaacacttggtatgtca

SEQ ID NO: 9215296 - DNA, 22 bp, Homo sapiens
aatgtcaataactttatccctc

SEQ ID NO: 9215297 - DNA, 22 bp, Homo sapiens
aatgtcaagtagccaatgcttc

SEQ ID NO: 9215298 - DNA, 22 bp, Homo sapiens
aatgtcaaaggctatacattca

SEQ ID NO: 9215299 - DNA, 22 bp, Homo sapiens
aatgtcaaacagagcagagcta

SEQ ID NO: 9215300 - DNA, 22 bp, Homo sapiens
aatgtcaaaatggaatgagact

SEQ ID NO: 9215301 - DNA, 22 bp, Homo sapiens
aatgtcaaagtgctttgcaaac

SEQ ID NO: 9215302 - DNA, 22 bp, Homo sapiens
aatgtcaaaggctatacattca

SEQ ID NO: 9215303 - DNA, 22 bp, Homo sapiens
aatgtcaacacaagagaaatgc

SEQ ID NO: 9215304 - DNA, 22 bp, Homo sapiens
aatgtcaaatgagaggggagaa

SEQ ID NO: 9215305 - DNA, 22 bp, Homo sapiens
aatgtattttgggagtttcttt

SEQ ID NO: 9215306 - DNA, 22 bp, Homo sapiens
aatgtcaaaataattgatttgt

SEQ ID NO: 9215307 - DNA, 22 bp, Homo sapiens
aattactgggtctgagattaat

SEQ ID NO: 9215308 - DNA, 22 bp, Homo sapiens
aatgttaatttactgtcttcat

SEQ ID NO: 9215309 - DNA, 22 bp, Homo sapiens
aatgttaattcacagccaaata

SEQ ID NO: 9215310 - DNA, 22 bp, Homo sapiens
aatgttaattcacagccaaata

SEQ ID NO: 9215311 - DNA, 22 bp, Homo sapiens
aatgttaatgtgtttgcttatg

SEQ ID NO: 9215312 - DNA, 22 bp, Homo sapiens
aatgttacgatcaacaacacat

SEQ ID NO: 9215313 - DNA, 22 bp, Homo sapiens
aatgtcttttaacctctggact

SEQ ID NO: 9215314 - DNA, 22 bp, Homo sapiens
aagacaatgtttctgatagata

SEQ ID NO: 9215315 - DNA, 22 bp, Homo sapiens
aagacaattttgagtatgcaca

SEQ ID NO: 9215316 - DNA, 22 bp, Homo sapiens
acaacaaaatgaggaagtggtc

SEQ ID NO: 9215317 - DNA, 22 bp, Homo sapiens
acaacaaaatgaggaagtggtc

SEQ ID NO: 9215318 - DNA, 22 bp, Homo sapiens
aagacattgtcattttataatt

SEQ ID NO: 9215319 - DNA, 22 bp, Homo sapiens
aagacattgctgcttttaattg

SEQ ID NO: 9215320 - DNA, 22 bp, Homo sapiens
aagacattggacaatccagagg

SEQ ID NO: 9215321 - DNA, 22 bp, Homo sapiens
aagacattggcattgactgtaa

SEQ ID NO: 9215322 - DNA, 22 bp, Homo sapiens
aagacattgcatgataatgctg

SEQ ID NO: 9215323 - DNA, 22 bp, Homo sapiens
aagacattagaatcagcctgtt

SEQ ID NO: 9215324 - DNA, 22 bp, Homo sapiens
aagacattcacaaatgttcact

SEQ ID NO: 9215325 - DNA, 22 bp, Homo sapiens
acaagaataaggataagagatt

SEQ ID NO: 9215326 - DNA, 22 bp, Homo sapiens
acaagaataaggataagagatt

SEQ ID NO: 9215327 - DNA, 23 bp, Homo sapiens
acaactttacagatacattttgt

SEQ ID NO: 9215328 - DNA, 22 bp, Homo sapiens
acaagaaccaaagaaggatatt

SEQ ID NO: 9215329 - DNA, 22 bp, Homo sapiens
aagaatctttccagttttgatg

SEQ ID NO: 9215330 - DNA, 22 bp, Homo sapiens
aagaatctgttgattccccact

SEQ ID NO: 9215331 - DNA, 22 bp, Homo sapiens
aagaatcttaatccagaaacct

SEQ ID NO: 9215332 - DNA, 22 bp, Homo sapiens
aagaatctgacataatttcctg

SEQ ID NO: 9215333 - DNA, 22 bp, Homo sapiens
aattcacaaaaccagattgctt

SEQ ID NO: 9215334 - DNA, 22 bp, Homo sapiens
aagaattggtttcctctgtcat

SEQ ID NO: 9215335 - DNA, 22 bp, Homo sapiens
aagacaatcctggacagtcagc

SEQ ID NO: 9215336 - DNA, 17 bp, Homo sapiens
aagacaagacaaatgca

SEQ ID NO: 9215337 - DNA, 22 bp, Homo sapiens
aagacaagcatcaaatcaggca

SEQ ID NO: 9215338 - DNA, 22 bp, Homo sapiens
aagacaacagagatgacagact

SEQ ID NO: 9215339 - DNA, 22 bp, Homo sapiens
aattagaagctgttagcaaaat

SEQ ID NO: 9215340 - DNA, 22 bp, Homo sapiens
aattattgagcatctactgtgt

SEQ ID NO: 9215341 - DNA, 20 bp, Homo sapiens
aattagatgtttaatcaata

SEQ ID NO: 9215342 - DNA, 23 bp, Homo sapiens
aattcaaattcagtgtgactagg

SEQ ID NO: 9215343 - DNA, 22 bp, Homo sapiens
aagcagaaagaacaactgagtg

SEQ ID NO: 9215344 - DNA, 22 bp, Homo sapiens
aagcagatattgtgggagtggg

SEQ ID NO: 9215345 - DNA, 22 bp, Homo sapiens
aagcagagttagcttgtcacct

SEQ ID NO: 9215346 - DNA, 22 bp, Homo sapiens
aagcagaaaaactgagctccaa

SEQ ID NO: 9215347 - DNA, 22 bp, Homo sapiens
aagcactggggccacagacacg

SEQ ID NO: 9215348 - DNA, 22 bp, Homo sapiens
aagcagcagccatcccccaagg

SEQ ID NO: 9215349 - DNA, 22 bp, Homo sapiens
aagcatggtggatgatacagtg

SEQ ID NO: 9215350 - DNA, 22 bp, Homo sapiens
aagcagcacgctttgccaacaa

SEQ ID NO: 9215351 - DNA, 22 bp, Homo sapiens
aagcaacagaaacattctaata

SEQ ID NO: 9215352 - DNA, 22 bp, Homo sapiens
aagcaaaggcaggagcttgtga

SEQ ID NO: 9215353 - DNA, 22 bp, Homo sapiens
aagcaaagagtttagtgggtga

SEQ ID NO: 9215354 - DNA, 22 bp, Homo sapiens
aagcaaagagtttagtgggtga

SEQ ID NO: 9215355 - DNA, 18 bp, Homo sapiens
aagaggaggagcaggttg

SEQ ID NO: 9215356 - DNA, 18 bp, Homo sapiens
aagaggaggagcaggttg

SEQ ID NO: 9215357 - DNA, 22 bp, Homo sapiens
aagaggagacttcagcaacttg

SEQ ID NO: 9215358 - DNA, 22 bp, Homo sapiens
aagaggagacttcagcaacttg

SEQ ID NO: 9215359 - DNA, 22 bp, Homo sapiens
aaatatcatttataacttttaa

SEQ ID NO: 9215360 - DNA, 22 bp, Homo sapiens
aaatatcatttataacttttaa

SEQ ID NO: 9215361 - DNA, 22 bp, Homo sapiens
aagcaactgttgaattggacta

SEQ ID NO: 9215362 - DNA, 22 bp, Homo sapiens
aaatatgaatgataagagttat

SEQ ID NO: 9215363 - DNA, 22 bp, Homo sapiens
aaatatgaatgataagagttat

SEQ ID NO: 9215364 - DNA, 22 bp, Homo sapiens
aagcacagctggaacagcagga

SEQ ID NO: 9215365 - DNA, 22 bp, Homo sapiens
aagcacagctggaacagcagga

SEQ ID NO: 9215366 - DNA, 22 bp, Homo sapiens
aagcacctgcagttgacaaaaa

SEQ ID NO: 9215367 - DNA, 22 bp, Homo sapiens
aagaggaagtctccatggagag

SEQ ID NO: 9215368 - DNA, 22 bp, Homo sapiens
aagaggaatgggtgtgtttatg

SEQ ID NO: 9215369 - DNA, 22 bp, Homo sapiens
aagaggacttgtgaagatgtac

SEQ ID NO: 9215370 - DNA, 22 bp, Homo sapiens
aagaggagaaaggctggctttg

SEQ ID NO: 9215371 - DNA, 22 bp, Homo sapiens
aagagcccttttcagtctagtt

SEQ ID NO: 9215372 - DNA, 22 bp, Homo sapiens
aagagcctggctgctaggctca

SEQ ID NO: 9215373 - DNA, 22 bp, Homo sapiens
aagagcctggctgctaggctca

SEQ ID NO: 9215374 - DNA, 20 bp, Homo sapiens
aagagcccgcagggcagtgc

SEQ ID NO: 9215375 - DNA, 22 bp, Homo sapiens
aagagcatttccactggcactg

SEQ ID NO: 9215376 - DNA, 22 bp, Homo sapiens
aagacagagactctgcaacagg

SEQ ID NO: 9215377 - DNA, 22 bp, Homo sapiens
aagacagagactctgcaacagg

SEQ ID NO: 9215378 - DNA, 22 bp, Homo sapiens
aagacagaagtgatttgatgtg

SEQ ID NO: 9215379 - DNA, 22 bp, Homo sapiens
aagaatgttcttgtagtcatga

SEQ ID NO: 9215380 - DNA, 22 bp, Homo sapiens
aagaatgttagtttctgataca

SEQ ID NO: 9215381 - DNA, 22 bp, Homo sapiens
aagaatgttcaacgcttttttg

SEQ ID NO: 9215382 - DNA, 22 bp, Homo sapiens
aagaatgagctcaaagatctta

SEQ ID NO: 9215383 - DNA, 22 bp, Homo sapiens
aagaatgtcaagcagaaggtct

SEQ ID NO: 9215384 - DNA, 22 bp, Homo sapiens
aagaatgtcaagcagaaggtct

SEQ ID NO: 9215385 - DNA, 22 bp, Homo sapiens
aagaatgtggcatttatttata

SEQ ID NO: 9215386 - DNA, 22 bp, Homo sapiens
aagaaagtgctttgtaaattat

SEQ ID NO: 9215387 - DNA, 22 bp, Homo sapiens
aagaaaggtctctgcccgctat

SEQ ID NO: 9215388 - DNA, 22 bp, Homo sapiens
aacagctttgtatacagtaact

SEQ ID NO: 9215389 - DNA, 22 bp, Homo sapiens
aacagctttgcttctggagaca

SEQ ID NO: 9215390 - DNA, 22 bp, Homo sapiens
aacagcagcatgacagctgggt

SEQ ID NO: 9215391 - DNA, 22 bp, Homo sapiens
aacagcagctgaggagctgggc

SEQ ID NO: 9215392 - DNA, 22 bp, Homo sapiens
aacagcttgctgcaccttaata

SEQ ID NO: 9215393 - DNA, 22 bp, Homo sapiens
aacaatgttcttttagcttgaa

SEQ ID NO: 9215394 - DNA, 22 bp, Homo sapiens
aacaagaacacctacagttcta

SEQ ID NO: 9215395 - DNA, 22 bp, Homo sapiens
aacaagaagggaaggcatgatt

SEQ ID NO: 9215396 - DNA, 22 bp, Homo sapiens
aacacataggcagagcatgaca

SEQ ID NO: 9215397 - DNA, 22 bp, Homo sapiens
aacacaaagaagctgcaggatc

SEQ ID NO: 9215398 - DNA, 22 bp, Homo sapiens
aaagcaagtctctacaaagtac

SEQ ID NO: 9215399 - DNA, 22 bp, Homo sapiens
aaagcaagtctctacaaagtac

SEQ ID NO: 9215400 - DNA, 22 bp, Homo sapiens
aaagcaatggcacatgatggta

SEQ ID NO: 9215401 - DNA, 22 bp, Homo sapiens
aaagcaattacaaaagggataa

SEQ ID NO: 9215402 - DNA, 22 bp, Homo sapiens
aaagcaatgtctctgcctggtt

SEQ ID NO: 9215403 - DNA, 22 bp, Homo sapiens
aacaacaacggagaaagggttg

SEQ ID NO: 9215404 - DNA, 22 bp, Homo sapiens
aaagcacattacaagctcagtc

SEQ ID NO: 9215405 - DNA, 23 bp, Homo sapiens
aacatttgtaaggtgattttgtt

SEQ ID NO: 9215406 - DNA, 21 bp, Homo sapiens
aacatttggctggcttttgtg

SEQ ID NO: 9215407 - DNA, 22 bp, Homo sapiens
aacatttcttctgaaactgagt

SEQ ID NO: 9215408 - DNA, 20 bp, Homo sapiens
aactcagagatgaaaaagac

SEQ ID NO: 9215409 - DNA, 22 bp, Homo sapiens
aacaggaaaacagcacaatagc

SEQ ID NO: 9215410 - DNA, 22 bp, Homo sapiens
aacagtgagaaggtggacagga

SEQ ID NO: 9215411 - DNA, 22 bp, Homo sapiens
aacagtatctacgggaactatt

SEQ ID NO: 9215412 - DNA, 22 bp, Homo sapiens
aacagtattggttgaactcaag

SEQ ID NO: 9215413 - DNA, 22 bp, Homo sapiens
aacattctactgtactgcattg

SEQ ID NO: 9215414 - DNA, 22 bp, Homo sapiens
aacattctcattgggatatgtg

SEQ ID NO: 9215415 - DNA, 22 bp, Homo sapiens
aacattctatgtgcattcagaa

SEQ ID NO: 9215416 - DNA, 22 bp, Homo sapiens
aacatttcattggaagctatgt

SEQ ID NO: 9215417 - DNA, 21 bp, Homo sapiens
aacatttctgggagaactcac

SEQ ID NO: 9215418 - DNA, 22 bp, Homo sapiens
aacattaattacagtcaaacat

SEQ ID NO: 9215419 - DNA, 22 bp, Homo sapiens
aacattcaattgaggaagttaa

SEQ ID NO: 9215420 - DNA, 23 bp, Homo sapiens
aaacttgctatggctgaaatcat

SEQ ID NO: 9215421 - DNA, 20 bp, Homo sapiens
aaacttgatggcatagaata

SEQ ID NO: 9215422 - DNA, 22 bp, Homo sapiens
aaactttaagacagtcctcaag

SEQ ID NO: 9215423 - DNA, 22 bp, Homo sapiens
aaacttgtgagctaaataaatg

SEQ ID NO: 9215424 - DNA, 22 bp, Homo sapiens
aaagaagagcaaatttgttgta

SEQ ID NO: 9215425 - DNA, 22 bp, Homo sapiens
aaagaagacagacatttctttc

SEQ ID NO: 9215426 - DNA, 22 bp, Homo sapiens
aaagaagagctggaaggagtct

SEQ ID NO: 9215427 - DNA, 22 bp, Homo sapiens
aaagaagatggagacctgacta

SEQ ID NO: 9215428 - DNA, 22 bp, Homo sapiens
aaagagctttagaaatctcaga

SEQ ID NO: 9215429 - DNA, 22 bp, Homo sapiens
aaagatgtcacaagatgtgatg

SEQ ID NO: 9215430 - DNA, 19 bp, Homo sapiens
aaacacagatttcttacca

SEQ ID NO: 9215431 - DNA, 22 bp, Homo sapiens
aaacatgaatagatattaaaca

SEQ ID NO: 9215432 - DNA, 22 bp, Homo sapiens
aaacatcttgctctgattggta

SEQ ID NO: 9215433 - DNA, 22 bp, Homo sapiens
aaacatgagttaaaagtaactg

SEQ ID NO: 9215434 - DNA, 22 bp, Homo sapiens
aaacatgagttaaaagtaactg

SEQ ID NO: 9215435 - DNA, 22 bp, Homo sapiens
aaaatagcatattgctttcttt

SEQ ID NO: 9215436 - DNA, 22 bp, Homo sapiens
aaaatagctatggaatgtcact

SEQ ID NO: 9215437 - DNA, 22 bp, Homo sapiens
aaaatagattctaggatgtctt

SEQ ID NO: 9215438 - DNA, 22 bp, Homo sapiens
aaacaacttctgcactatgggt

SEQ ID NO: 9215439 - DNA, 22 bp, Homo sapiens
aaacaaacataggtttgaaagt

SEQ ID NO: 9215440 - DNA, 22 bp, Homo sapiens
aaacaaatttcaagctgtgaca

SEQ ID NO: 9215441 - DNA, 22 bp, Homo sapiens
aaaaatgcttggacttaataaa

SEQ ID NO: 9215442 - DNA, 19 bp, Homo sapiens
aaaaacttagtccagaaag

SEQ ID NO: 9215443 - DNA, 20 bp, Homo sapiens
aaaaagacaaaacgagttgg

SEQ ID NO: 9215444 - DNA, 20 bp, Homo sapiens
aaaaagacaaaacgagttgg

SEQ ID NO: 9215445 - DNA, 22 bp, Homo sapiens
aaaaagatgtcctgaagtttag

SEQ ID NO: 9215446 - DNA, 22 bp, Homo sapiens
aaatccaggaagcagtggtgta

SEQ ID NO: 9215447 - DNA, 22 bp, Homo sapiens
aaatccaggtagtttggtttga

SEQ ID NO: 9215448 - DNA, 22 bp, Homo sapiens
aaatccaggtccatgtggggta

SEQ ID NO: 9215449 - DNA, 22 bp, Homo sapiens
aaatccagatgagggtaccaga

SEQ ID NO: 9215450 - DNA, 22 bp, Homo sapiens
aaatatgttttccagttgtcat

SEQ ID NO: 9215451 - DNA, 22 bp, Homo sapiens
aaatatgtgatcagtgaataaa

SEQ ID NO: 9215452 - DNA, 22 bp, Homo sapiens
aaatattagggagaacagggac

SEQ ID NO: 9215453 - DNA, 22 bp, Homo sapiens
aaatattattgcttaaggggag

SEQ ID NO: 9215454 - DNA, 22 bp, Homo sapiens
aaatataatttctgcctcaata

SEQ ID NO: 9215455 - DNA, 22 bp, Homo sapiens
aaatataatttctgcctcaata

SEQ ID NO: 9215456 - DNA, 19 bp, Homo sapiens
aaactaaggggaaatgttt

SEQ ID NO: 9215457 - DNA, 22 bp, Homo sapiens
aaactaaggtgctgtggactga

SEQ ID NO: 9215458 - DNA, 22 bp, Homo sapiens
aaatatgtgatcagtgaataaa

SEQ ID NO: 9215459 - DNA, 23 bp, Homo sapiens
aaatatgtctgagggcaaagaat

SEQ ID NO: 9215460 - DNA, 22 bp, Homo sapiens
aaatagaaaccaacaaggtcag

SEQ ID NO: 9215461 - DNA, 22 bp, Homo sapiens
aaatagaattaactagctactg

SEQ ID NO: 9215462 - DNA, 22 bp, Homo sapiens
aaatagaattggaagcagagtt

SEQ ID NO: 9215463 - DNA, 22 bp, Homo sapiens
aaactaaacctggcttagtaag

SEQ ID NO: 9215464 - DNA, 22 bp, Homo sapiens
aaacactgcagggtttacttga

SEQ ID NO: 9215465 - DNA, 22 bp, Homo sapiens
aaagtgcagtccatgaaattaa

SEQ ID NO: 9215466 - DNA, 23 bp, Homo sapiens
aaagtgcagttgaggaatcatag

SEQ ID NO: 9215467 - DNA, 22 bp, Homo sapiens
aaagtgctgggattataggcat

SEQ ID NO: 9215468 - DNA, 22 bp, Homo sapiens
aaacatcataggcatgcatgat

SEQ ID NO: 9215469 - DNA, 22 bp, Homo sapiens
aaacatctactgtaggctggag

SEQ ID NO: 9215470 - DNA, 22 bp, Homo sapiens
aaacatctattatgtgctgagc

SEQ ID NO: 9215471 - DNA, 22 bp, Homo sapiens
aaaggcctctgtcctagtgcct

SEQ ID NO: 9215472 - DNA, 22 bp, Homo sapiens
aaaggcctctgtcctagtgcct

SEQ ID NO: 9215473 - DNA, 22 bp, Homo sapiens
aaaggcccacagtcagtctacc

SEQ ID NO: 9215474 - DNA, 22 bp, Homo sapiens
aaagcaatgcttgtggaatgta

SEQ ID NO: 9215475 - DNA, 22 bp, Homo sapiens
aaagcaatgcttgtggaatgta

SEQ ID NO: 9215476 - DNA, 22 bp, Homo sapiens
aaagcaatcagattcagatgtc

SEQ ID NO: 9215477 - DNA, 22 bp, Homo sapiens
aaagcaatagtaatggtaatag

SEQ ID NO: 9215478 - DNA, 22 bp, Homo sapiens
aaagcaatgcccgttcattatc

SEQ ID NO: 9215479 - DNA, 22 bp, Homo sapiens
aaagatgtcagtttgaaataac

SEQ ID NO: 9215480 - DNA, 22 bp, Homo sapiens
aaagatgtcagtttgaaataac

SEQ ID NO: 9215481 - DNA, 22 bp, Homo sapiens
aaagatgtcagtcagataggat

SEQ ID NO: 9215482 - DNA, 22 bp, Homo sapiens
aaagatgtcatacacattaaga

SEQ ID NO: 9215483 - DNA, 22 bp, Homo sapiens
aaagatgtccaagtaaagttaa

SEQ ID NO: 9215484 - DNA, 22 bp, Homo sapiens
aaagcaataggttaggtcaaga

SEQ ID NO: 9215485 - DNA, 22 bp, Homo sapiens
aaagatgtgtaagaaataaaca

SEQ ID NO: 9215486 - DNA, 22 bp, Homo sapiens
aaagatgtgcctgtttcatagt

SEQ ID NO: 9215487 - DNA, 22 bp, Homo sapiens
agagggccataggtgcatagtt

SEQ ID NO: 9215488 - DNA, 22 bp, Homo sapiens
agagggcataaaatagagcacg

SEQ ID NO: 9215489 - DNA, 22 bp, Homo sapiens
aattttgttcttggaaatcagg

SEQ ID NO: 9215490 - DNA, 22 bp, Homo sapiens
aatttcaagtggcatctttgat

SEQ ID NO: 9215491 - DNA, 22 bp, Homo sapiens
aatttcaaagctcactggcata

SEQ ID NO: 9215492 - DNA, 22 bp, Homo sapiens
agaggccacaccagcctcccgt

SEQ ID NO: 9215493 - DNA, 22 bp, Homo sapiens
agaggccaatagtaggtggcat

SEQ ID NO: 9215494 - DNA, 22 bp, Homo sapiens
agaggccaatagtaggtggcat

SEQ ID NO: 9215495 - DNA, 21 bp, Homo sapiens
agaggccaagtcatcatttcc

SEQ ID NO: 9215496 - DNA, 22 bp, Homo sapiens
agaggcaacatggggaacagat

SEQ ID NO: 9215497 - DNA, 22 bp, Homo sapiens
agagcagctggggcagagacca

SEQ ID NO: 9215498 - DNA, 22 bp, Homo sapiens
agagcagctggctgcatctaga

SEQ ID NO: 9215499 - DNA, 22 bp, Homo sapiens
agagcagctgtgacatggacag

SEQ ID NO: 9215500 - DNA, 22 bp, Homo sapiens
agagcagcttttcggaaccact

SEQ ID NO: 9215501 - DNA, 21 bp, Homo sapiens
agaggcaggcattaagtacac

SEQ ID NO: 9215502 - DNA, 22 bp, Homo sapiens
agaggccaaagaatctacaaga

SEQ ID NO: 9215503 - DNA, 23 bp, Homo sapiens
agaggccaacttcttgcccctcc

SEQ ID NO: 9215504 - DNA, 23 bp, Homo sapiens
agaggccaacttcttgcccctcc

SEQ ID NO: 9215505 - DNA, 22 bp, Homo sapiens
agaggccaagccagactgtgca

SEQ ID NO: 9215506 - DNA, 22 bp, Homo sapiens
agaggccaagccagactgtgca

SEQ ID NO: 9215507 - DNA, 22 bp, Homo sapiens
agagcagcgtttgtggaacact

SEQ ID NO: 9215508 - DNA, 18 bp, Homo sapiens
agagcagcggcatcacac

SEQ ID NO: 9215509 - DNA, 22 bp, Homo sapiens
agagcagctgcattcagcacct

SEQ ID NO: 9215510 - DNA, 22 bp, Homo sapiens
agagcagctgcattcagcacct

SEQ ID NO: 9215511 - DNA, 22 bp, Homo sapiens
aattcacagttctgcaccttac

SEQ ID NO: 9215512 - DNA, 22 bp, Homo sapiens
agatgttttgtgtatttcatca

SEQ ID NO: 9215513 - DNA, 22 bp, Homo sapiens
agatctggttggagtcctgaca

SEQ ID NO: 9215514 - DNA, 22 bp, Homo sapiens
agatctggaaaatcacaggtgc

SEQ ID NO: 9215515 - DNA, 22 bp, Homo sapiens
agatgggtctcccttagcacct

SEQ ID NO: 9215516 - DNA, 21 bp, Homo sapiens
agattacaggtgtgatccacc

SEQ ID NO: 9215517 - DNA, 22 bp, Homo sapiens
agattaggtatggtttaagtag

SEQ ID NO: 9215518 - DNA, 20 bp, Homo sapiens
agattaggggctttcttctt

SEQ ID NO: 9215519 - DNA, 21 bp, Homo sapiens
agatccctgaggagagcatcc

SEQ ID NO: 9215520 - DNA, 21 bp, Homo sapiens
agatccctgaggagagcatcc

SEQ ID NO: 9215521 - DNA, 22 bp, Homo sapiens
agatcctgccaatggaagcagg

SEQ ID NO: 9215522 - DNA, 22 bp, Homo sapiens
agatccatccagcactcttgcc

SEQ ID NO: 9215523 - DNA, 22 bp, Homo sapiens
aattttgtttaagtgatctgct

SEQ ID NO: 9215524 - DNA, 22 bp, Homo sapiens
acaaaaaccgtggattcagcat

SEQ ID NO: 9215525 - DNA, 22 bp, Homo sapiens
agaggtggagctcttggcatca

SEQ ID NO: 9215526 - DNA, 20 bp, Homo sapiens
agaggttcagtctggagaag

SEQ ID NO: 9215527 - DNA, 22 bp, Homo sapiens
agaggttcagagaaggcgatct

SEQ ID NO: 9215528 - DNA, 21 bp, Homo sapiens
agagtctgcatttctgacaag

SEQ ID NO: 9215529 - DNA, 22 bp, Homo sapiens
agagtacactgtacacacaatt

SEQ ID NO: 9215530 - DNA, 22 bp, Homo sapiens
agataatgtcaaattctgtctg

SEQ ID NO: 9215531 - DNA, 22 bp, Homo sapiens
agagtctgttacttgtccccta

SEQ ID NO: 9215532 - DNA, 22 bp, Homo sapiens
agagaaagtaaagattctacct

SEQ ID NO: 9215533 - DNA, 22 bp, Homo sapiens
agagaaagtaaagattctacct

SEQ ID NO: 9215534 - DNA, 20 bp, Homo sapiens
agagagcacaggcaggaaag

SEQ ID NO: 9215535 - DNA, 22 bp, Homo sapiens
aattatgtagccatatgaaaca

SEQ ID NO: 9215536 - DNA, 22 bp, Homo sapiens
agagatattatttaccaagtta

SEQ ID NO: 9215537 - DNA, 22 bp, Homo sapiens
agacactgatgttcagctcaat

SEQ ID NO: 9215538 - DNA, 22 bp, Homo sapiens
agacactgccacttctgttccc

SEQ ID NO: 9215539 - DNA, 22 bp, Homo sapiens
agagaaactgatgtcctttgaa

SEQ ID NO: 9215540 - DNA, 18 bp, Homo sapiens
agagaaagaccaaagcat

SEQ ID NO: 9215541 - DNA, 22 bp, Homo sapiens
agactgggccatttccccagct

SEQ ID NO: 9215542 - DNA, 22 bp, Homo sapiens
agactgggattctccctgatca

SEQ ID NO: 9215543 - DNA, 22 bp, Homo sapiens
aatggagacaagaacccaggac

SEQ ID NO: 9215544 - DNA, 22 bp, Homo sapiens
aatgctttttgcgaaatgtgca

SEQ ID NO: 9215545 - DNA, 22 bp, Homo sapiens
aatgcttttacgacatgtacct

SEQ ID NO: 9215546 - DNA, 22 bp, Homo sapiens
aatgctttgactatatctataa

SEQ ID NO: 9215547 - DNA, 22 bp, Homo sapiens
agaataatcactgaagttcaaa

SEQ ID NO: 9215548 - DNA, 22 bp, Homo sapiens
agaataatcactgaagttcaaa

SEQ ID NO: 9215549 - DNA, 22 bp, Homo sapiens
aatggagaccctaaggaagagg

SEQ ID NO: 9215550 - DNA, 22 bp, Homo sapiens
agaagtttgttatgtaaacaaa

SEQ ID NO: 9215551 - DNA, 22 bp, Homo sapiens
agaataaaatagtctgaagatg

SEQ ID NO: 9215552 - DNA, 23 bp, Homo sapiens
agaattgttgttagggaaaagta

SEQ ID NO: 9215553 - DNA, 22 bp, Homo sapiens
agaatcttcagtctaattccta

SEQ ID NO: 9215554 - DNA, 22 bp, Homo sapiens
agaatcttggaactcagatcac

SEQ ID NO: 9215555 - DNA, 22 bp, Homo sapiens
agaatcttcagatgatttgtca

SEQ ID NO: 9215556 - DNA, 22 bp, Homo sapiens
agaatcttcggtaactggaaga

SEQ ID NO: 9215557 - DNA, 22 bp, Homo sapiens
agaatttaggatgcatgtgaat

SEQ ID NO: 9215558 - DNA, 22 bp, Homo sapiens
agaatttagctccttggtcata

SEQ ID NO: 9215559 - DNA, 22 bp, Homo sapiens
agaatttatgacaacgatagcc

SEQ ID NO: 9215560 - DNA, 22 bp, Homo sapiens
aatgtacaggctggctatgggg

SEQ ID NO: 9215561 - DNA, 22 bp, Homo sapiens
aatgtagaatgatccttaggat

SEQ ID NO: 9215562 - DNA, 22 bp, Homo sapiens
agaatttttgattatctactcg

SEQ ID NO: 9215563 - DNA, 22 bp, Homo sapiens
agcaggagctgtgggaagatgg

SEQ ID NO: 9215564 - DNA, 22 bp, Homo sapiens
agcaggagcccttatcaccagg

SEQ ID NO: 9215565 - DNA, 22 bp, Homo sapiens
agcagctgagatggtaagattc

SEQ ID NO: 9215566 - DNA, 22 bp, Homo sapiens
agcaggagggttttgtagagtc

SEQ ID NO: 9215567 - DNA, 22 bp, Homo sapiens
agcaggagggttttgtagagtc

SEQ ID NO: 9215568 - DNA, 21 bp, Homo sapiens
agcaggaggcagtcacagctc

SEQ ID NO: 9215569 - DNA, 22 bp, Homo sapiens
agcaggaggagagcctggcggt

SEQ ID NO: 9215570 - DNA, 21 bp, Homo sapiens
agcaggaggcagtcacagctc

SEQ ID NO: 9215571 - DNA, 22 bp, Homo sapiens
agcagctcttaacaaagcatgg

SEQ ID NO: 9215572 - DNA, 22 bp, Homo sapiens
agcagctctgtttacctggagg

SEQ ID NO: 9215573 - DNA, 22 bp, Homo sapiens
agcagctctggcactgtagcat

SEQ ID NO: 9215574 - DNA, 22 bp, Homo sapiens
agcagctctgagaggccagcac

SEQ ID NO: 9215575 - DNA, 22 bp, Homo sapiens
agcagctctgagaggccagcac

SEQ ID NO: 9215576 - DNA, 22 bp, Homo sapiens
agcagctcgggctacagagggg

SEQ ID NO: 9215577 - DNA, 22 bp, Homo sapiens
agcagctcggccagtcaccagg

SEQ ID NO: 9215578 - DNA, 22 bp, Homo sapiens
agcagctcggccagtcaccagg

SEQ ID NO: 9215579 - DNA, 17 bp, Homo sapiens
agcagctgaagcagcca

SEQ ID NO: 9215580 - DNA, 22 bp, Homo sapiens
agcagctgaccagtgagtcctg

SEQ ID NO: 9215581 - DNA, 19 bp, Homo sapiens
agcagccatcgaccatgga

SEQ ID NO: 9215582 - DNA, 22 bp, Homo sapiens
agcagctcctctaggaacggat

SEQ ID NO: 9215583 - DNA, 19 bp, Homo sapiens
agcagttatatgcatggga

SEQ ID NO: 9215584 - DNA, 23 bp, Homo sapiens
agatttggaaagctgagtggcgt

SEQ ID NO: 9215585 - DNA, 22 bp, Homo sapiens
agatttggtgtctggttgatat

SEQ ID NO: 9215586 - DNA, 22 bp, Homo sapiens
agatttctgtcaccttctatgc

SEQ ID NO: 9215587 - DNA, 22 bp, Homo sapiens
agcagccagagtctgaacatta

SEQ ID NO: 9215588 - DNA, 22 bp, Homo sapiens
agcagcatacacatcatgttga

SEQ ID NO: 9215589 - DNA, 22 bp, Homo sapiens
acacacttgcagagaggaggga

SEQ ID NO: 9215590 - DNA, 22 bp, Homo sapiens
agcagcagattcagcaggaatg

SEQ ID NO: 9215591 - DNA, 22 bp, Homo sapiens
agcagcagattcagcaggaatg

SEQ ID NO: 9215592 - DNA, 22 bp, Homo sapiens
agcagcagattatggtctacat

SEQ ID NO: 9215593 - DNA, 22 bp, Homo sapiens
agcagaaatagaagtcaatgat

SEQ ID NO: 9215594 - DNA, 19 bp, Homo sapiens
agcagcagcaccagggatt

SEQ ID NO: 9215595 - DNA, 19 bp, Homo sapiens
agcagcagcaccagggatt

SEQ ID NO: 9215596 - DNA, 22 bp, Homo sapiens
agctccaaggttgaggagtgag

SEQ ID NO: 9215597 - DNA, 22 bp, Homo sapiens
agctccaaggttgaggagtgag

SEQ ID NO: 9215598 - DNA, 22 bp, Homo sapiens
agctccactaaacagaatactc

SEQ ID NO: 9215599 - DNA, 23 bp, Homo sapiens
agctccagggaacaggcagtagg

SEQ ID NO: 9215600 - DNA, 22 bp, Homo sapiens
agctcaggtctcaggaggtgtc

SEQ ID NO: 9215601 - DNA, 22 bp, Homo sapiens
agctcagggctccaggaccgct

SEQ ID NO: 9215602 - DNA, 22 bp, Homo sapiens
agctcaggtagactcagcatct

SEQ ID NO: 9215603 - DNA, 22 bp, Homo sapiens
agctcagggccatcggcccttt

SEQ ID NO: 9215604 - DNA, 22 bp, Homo sapiens
agctcaggctctgcagggacta

SEQ ID NO: 9215605 - DNA, 22 bp, Homo sapiens
agcctggctgtaacctcatggt

SEQ ID NO: 9215606 - DNA, 22 bp, Homo sapiens
agcctgtctgtctccaaagctg

SEQ ID NO: 9215607 - DNA, 22 bp, Homo sapiens
agcctgtggatccctgcactgg

SEQ ID NO: 9215608 - DNA, 22 bp, Homo sapiens
agcctgcttcctcagggaacaa

SEQ ID NO: 9215609 - DNA, 22 bp, Homo sapiens
agcctggcctgggcaggcacat

SEQ ID NO: 9215610 - DNA, 22 bp, Homo sapiens
agcctggcctgggcaggcacat

SEQ ID NO: 9215611 - DNA, 22 bp, Homo sapiens
agcctggcggtcgtcggtcagg

SEQ ID NO: 9215612 - DNA, 20 bp, Homo sapiens
agccctgtaaatcccctgga

SEQ ID NO: 9215613 - DNA, 22 bp, Homo sapiens
agccctgggttagggtgggagc

SEQ ID NO: 9215614 - DNA, 22 bp, Homo sapiens
agccctggtagcctgctgccat

SEQ ID NO: 9215615 - DNA, 22 bp, Homo sapiens
agccctggggctggtcttggaa

SEQ ID NO: 9215616 - DNA, 22 bp, Homo sapiens
agccctgcatagaagggaacac

SEQ ID NO: 9215617 - DNA, 22 bp, Homo sapiens
agccctgcgtgccaggggactg

SEQ ID NO: 9215618 - DNA, 22 bp, Homo sapiens
agccctgccctgccatgtggca

SEQ ID NO: 9215619 - DNA, 22 bp, Homo sapiens
agccctgcacagttcgggagga

SEQ ID NO: 9215620 - DNA, 22 bp, Homo sapiens
agccctgcaggatgagggaggt

SEQ ID NO: 9215621 - DNA, 22 bp, Homo sapiens
agccaggaatgcatgctctgct

SEQ ID NO: 9215622 - DNA, 22 bp, Homo sapiens
agccaggcgggtctttgctcct

SEQ ID NO: 9215623 - DNA, 20 bp, Homo sapiens
agccaggctcaagctccccc

SEQ ID NO: 9215624 - DNA, 20 bp, Homo sapiens
agccaggctcaagctccccc

SEQ ID NO: 9215625 - DNA, 22 bp, Homo sapiens
agcatgaaaacatgaaacagca

SEQ ID NO: 9215626 - DNA, 22 bp, Homo sapiens
agcatctttaggaagagaaaga

SEQ ID NO: 9215627 - DNA, 22 bp, Homo sapiens
agcatcttgaaatataaagtca

SEQ ID NO: 9215628 - DNA, 22 bp, Homo sapiens
agcattccacactgaagtctgc

SEQ ID NO: 9215629 - DNA, 22 bp, Homo sapiens
agcattccacactgaagtctgc

SEQ ID NO: 9215630 - DNA, 22 bp, Homo sapiens
agcattccacactgaagtctgc

SEQ ID NO: 9215631 - DNA, 22 bp, Homo sapiens
agcatctgcttaatggcttaac

SEQ ID NO: 9215632 - DNA, 18 bp, Homo sapiens
acagaactgagatttgag

SEQ ID NO: 9215633 - DNA, 22 bp, Homo sapiens
acagaacatattgcttctctca

SEQ ID NO: 9215634 - DNA, 22 bp, Homo sapiens
acagaacatattgcttctctca

SEQ ID NO: 9215635 - DNA, 22 bp, Homo sapiens
agcccaggtctggcccagcctg

SEQ ID NO: 9215636 - DNA, 22 bp, Homo sapiens
agcccaggtctggcccagcctg

SEQ ID NO: 9215637 - DNA, 22 bp, Homo sapiens
agcccaggtgactcatacaccc

SEQ ID NO: 9215638 - DNA, 22 bp, Homo sapiens
agcccaggtgaggggttcgaaa

SEQ ID NO: 9215639 - DNA, 22 bp, Homo sapiens
agcccaggtggagtgtgtgggg

SEQ ID NO: 9215640 - DNA, 22 bp, Homo sapiens
aagtggagtccctacaaccagc

SEQ ID NO: 9215641 - DNA, 22 bp, Homo sapiens
actcagagatatggtggttgat

SEQ ID NO: 9215642 - DNA, 23 bp, Homo sapiens
actcagagaccccgggaagtgac

SEQ ID NO: 9215643 - DNA, 22 bp, Homo sapiens
aagtggcagttcaggaagcaga

SEQ ID NO: 9215644 - DNA, 22 bp, Homo sapiens
aagtggcagaatagtggcagga

SEQ ID NO: 9215645 - DNA, 22 bp, Homo sapiens
aagtggcagttcaggaagcaga

SEQ ID NO: 9215646 - DNA, 22 bp, Homo sapiens
aagtttgtcgaaattatcagca

SEQ ID NO: 9215647 - DNA, 22 bp, Homo sapiens
aagttttactgaggacacatgt

SEQ ID NO: 9215648 - DNA, 22 bp, Homo sapiens
actgaccagatatgtcatacct

SEQ ID NO: 9215649 - DNA, 22 bp, Homo sapiens
actgagactgaatctgaatgat

SEQ ID NO: 9215650 - DNA, 18 bp, Homo sapiens
acctgcctgttcttctct

SEQ ID NO: 9215651 - DNA, 22 bp, Homo sapiens
aagtaacacggaacttgaagca

SEQ ID NO: 9215652 - DNA, 22 bp, Homo sapiens
aagtaaaccacagagaagccac

SEQ ID NO: 9215653 - DNA, 23 bp, Homo sapiens
accttggacttcccagcttccag

SEQ ID NO: 9215654 - DNA, 20 bp, Homo sapiens
acctggggttgcctgtgctc

SEQ ID NO: 9215655 - DNA, 22 bp, Homo sapiens
accttgaacccagcttgctgca

SEQ ID NO: 9215656 - DNA, 23 bp, Homo sapiens
aagtgaacaggagctagatggtc

SEQ ID NO: 9215657 - DNA, 22 bp, Homo sapiens
accttgtcttttatagaacaag

SEQ ID NO: 9215658 - DNA, 19 bp, Homo sapiens
acttcctgcccgctccttt

SEQ ID NO: 9215659 - DNA, 22 bp, Homo sapiens
aatatgacatagaattgagatg

SEQ ID NO: 9215660 - DNA, 23 bp, Homo sapiens
acttccagttataggaactcttc

SEQ ID NO: 9215661 - DNA, 22 bp, Homo sapiens
acttccctgtgggcaggtagtg

SEQ ID NO: 9215662 - DNA, 22 bp, Homo sapiens
acttcctgacttctgggttgga

SEQ ID NO: 9215663 - DNA, 22 bp, Homo sapiens
acttcctgaatggggctaatta

SEQ ID NO: 9215664 - DNA, 22 bp, Homo sapiens
acttccagctgccctgtgtgct

SEQ ID NO: 9215665 - DNA, 16 bp, Homo sapiens
acttccaggggagccc

SEQ ID NO: 9215666 - DNA, 22 bp, Homo sapiens
acttccagggtagaggggaaga

SEQ ID NO: 9215667 - DNA, 20 bp, Homo sapiens
acttagtgtagggttcctag

SEQ ID NO: 9215668 - DNA, 22 bp, Homo sapiens
acttagtggctatgtgacctta

SEQ ID NO: 9215669 - DNA, 22 bp, Homo sapiens
acttatagccagaattaattat

SEQ ID NO: 9215670 - DNA, 22 bp, Homo sapiens
acttagtgccctggcccttaca

SEQ ID NO: 9215671 - DNA, 22 bp, Homo sapiens
acttagcattatgtaattacta

SEQ ID NO: 9215672 - DNA, 22 bp, Homo sapiens
acttagcaatttgattaaaaga

SEQ ID NO: 9215673 - DNA, 22 bp, Homo sapiens
acttagaattagtgtagaatga

SEQ ID NO: 9215674 - DNA, 22 bp, Homo sapiens
acttagcagagtgagttgacta

SEQ ID NO: 9215675 - DNA, 22 bp, Homo sapiens
acttagcacgaacatttacttt

SEQ ID NO: 9215676 - DNA, 22 bp, Homo sapiens
actgtggcgtcaggaagaaatt

SEQ ID NO: 9215677 - DNA, 22 bp, Homo sapiens
actgtggatcaaagacttgggg

SEQ ID NO: 9215678 - DNA, 22 bp, Homo sapiens
aatactgtctttcacagatatt

SEQ ID NO: 9215679 - DNA, 22 bp, Homo sapiens
aatactgtaaatggagcagcca

SEQ ID NO: 9215680 - DNA, 22 bp, Homo sapiens
aatagaaaggaggggctcttgt

SEQ ID NO: 9215681 - DNA, 22 bp, Homo sapiens
aatatgatgccaaattgctaca

SEQ ID NO: 9215682 - DNA, 22 bp, Homo sapiens
aatatgtttataagatatcttc

SEQ ID NO: 9215683 - DNA, 22 bp, Homo sapiens
aatatgttcaaaatagatcact

SEQ ID NO: 9215684 - DNA, 22 bp, Homo sapiens
aatatgttcaaaatagatcact

SEQ ID NO: 9215685 - DNA, 22 bp, Homo sapiens
aatatgttcaaaatagatcact

SEQ ID NO: 9215686 - DNA, 22 bp, Homo sapiens
aatatgttccacttaaagctgg

SEQ ID NO: 9215687 - DNA, 22 bp, Homo sapiens
agaaaatgtgaacttgtgaatt

SEQ ID NO: 9215688 - DNA, 20 bp, Homo sapiens
agaaaatgttttcagctgga

SEQ ID NO: 9215689 - DNA, 20 bp, Homo sapiens
agaaaatgttttcagctgga

SEQ ID NO: 9215690 - DNA, 22 bp, Homo sapiens
agaaaataatttcttggctggt

SEQ ID NO: 9215691 - DNA, 22 bp, Homo sapiens
agaaaatattcattgagaggct

SEQ ID NO: 9215692 - DNA, 22 bp, Homo sapiens
agaaaactgggaggagagcttc

SEQ ID NO: 9215693 - DNA, 22 bp, Homo sapiens
agaaaataatttcttggctggt

SEQ ID NO: 9215694 - DNA, 22 bp, Homo sapiens
agaaaactggagcctggggttg

SEQ ID NO: 9215695 - DNA, 22 bp, Homo sapiens
agaaaactggagcctggggttg

SEQ ID NO: 9215696 - DNA, 22 bp, Homo sapiens
agaaactacttggaggaaagat

SEQ ID NO: 9215697 - DNA, 22 bp, Homo sapiens
agaaactatcctgagtagcaaa

SEQ ID NO: 9215698 - DNA, 22 bp, Homo sapiens
agaaactaagtcataactcttt

SEQ ID NO: 9215699 - DNA, 22 bp, Homo sapiens
agaaactattatggtaaacaaa

SEQ ID NO: 9215700 - DNA, 22 bp, Homo sapiens
agaaactattatggtaaacaaa

SEQ ID NO: 9215701 - DNA, 17 bp, Homo sapiens
aatctgtttacagtcag

SEQ ID NO: 9215702 - DNA, 22 bp, Homo sapiens
aatcttcactcattcagagttg

SEQ ID NO: 9215703 - DNA, 22 bp, Homo sapiens
aatcttaagctgaattctctcc

SEQ ID NO: 9215704 - DNA, 22 bp, Homo sapiens
aatcttcattttgacaagattc

SEQ ID NO: 9215705 - DNA, 22 bp, Homo sapiens
aagccctggctcagctcaccag

SEQ ID NO: 9215706 - DNA, 22 bp, Homo sapiens
aagccctggcgggtggagggcc

SEQ ID NO: 9215707 - DNA, 22 bp, Homo sapiens
aagccctggaactttcctagcc

SEQ ID NO: 9215708 - DNA, 22 bp, Homo sapiens
aagccctgacctgagagtccgt

SEQ ID NO: 9215709 - DNA, 22 bp, Homo sapiens
aagccctgagcactgcagagaa

SEQ ID NO: 9215710 - DNA, 22 bp, Homo sapiens
aagccctgagcactgcagagaa

SEQ ID NO: 9215711 - DNA, 22 bp, Homo sapiens
aagccctgactatgaagacata

SEQ ID NO: 9215712 - DNA, 22 bp, Homo sapiens
acaggcactttgacatgccatc

SEQ ID NO: 9215713 - DNA, 22 bp, Homo sapiens
acaggcactgtcaagtcatgaa

SEQ ID NO: 9215714 - DNA, 22 bp, Homo sapiens
acaggcacctgccaccacatct

SEQ ID NO: 9215715 - DNA, 20 bp, Homo sapiens
acaggagatctgaggaaagg

SEQ ID NO: 9215716 - DNA, 20 bp, Homo sapiens
acaggagatctgaggaaagg

SEQ ID NO: 9215717 - DNA, 22 bp, Homo sapiens
acaggagcaacagactaagaca

SEQ ID NO: 9215718 - DNA, 22 bp, Homo sapiens
acaggagccaaacacatgccag

SEQ ID NO: 9215719 - DNA, 22 bp, Homo sapiens
acaggaggagcagctgtgtgcc

SEQ ID NO: 9215720 - DNA, 22 bp, Homo sapiens
acaggagctctagggacagcac

SEQ ID NO: 9215721 - DNA, 22 bp, Homo sapiens
acaggaaattggcatatcagtt

SEQ ID NO: 9215722 - DNA, 22 bp, Homo sapiens
acaggaaatgaaatggtatcta

SEQ ID NO: 9215723 - DNA, 22 bp, Homo sapiens
acaggaaagagctaggcatagg

SEQ ID NO: 9215724 - DNA, 22 bp, Homo sapiens
acagctttttactaatagattg

SEQ ID NO: 9215725 - DNA, 22 bp, Homo sapiens
acagctttatctcagggatcag

SEQ ID NO: 9215726 - DNA, 22 bp, Homo sapiens
acagatgaggaaacagggtcag

SEQ ID NO: 9215727 - DNA, 22 bp, Homo sapiens
acagatgagagacaatgtgcta

SEQ ID NO: 9215728 - DNA, 22 bp, Homo sapiens
acagatttaggactgtagcgat

SEQ ID NO: 9215729 - DNA, 22 bp, Homo sapiens
acagatttgactggtacctggc

SEQ ID NO: 9215730 - DNA, 22 bp, Homo sapiens
acagctggagtgttggtgaggt

SEQ ID NO: 9215731 - DNA, 22 bp, Homo sapiens
acagattttaaatttgtagttg

SEQ ID NO: 9215732 - DNA, 22 bp, Homo sapiens
acagatttttcagctcctgtgt

SEQ ID NO: 9215733 - DNA, 22 bp, Homo sapiens
acagattttggtatttgcaatg

SEQ ID NO: 9215734 - DNA, 22 bp, Homo sapiens
acaggctctggggcaggatggc

SEQ ID NO: 9215735 - DNA, 22 bp, Homo sapiens
acaggctgaaagttaagttctg

SEQ ID NO: 9215736 - DNA, 22 bp, Homo sapiens
acaggctgacttcctgccatgt

SEQ ID NO: 9215737 - DNA, 22 bp, Homo sapiens
acaggctgaggatgattgcatc

SEQ ID NO: 9215738 - DNA, 22 bp, Homo sapiens
acaggctgacttcctgccatgt

SEQ ID NO: 9215739 - DNA, 22 bp, Homo sapiens
acaggctgagcgtccatcttca

SEQ ID NO: 9215740 - DNA, 22 bp, Homo sapiens
acaggctgttggggtccagggt

SEQ ID NO: 9215741 - DNA, 22 bp, Homo sapiens
acaggcttacaggctgcaagta

SEQ ID NO: 9215742 - DNA, 22 bp, Homo sapiens
acaggctgccacttgcatccaa

SEQ ID NO: 9215743 - DNA, 22 bp, Homo sapiens
acaggctgatagaccataaata

SEQ ID NO: 9215744 - DNA, 22 bp, Homo sapiens
acaggcttctcacagaaaaggg

SEQ ID NO: 9215745 - DNA, 22 bp, Homo sapiens
acaggcttttttagaatgacat

SEQ ID NO: 9215746 - DNA, 21 bp, Homo sapiens
acaggctttagaaaatgactc

SEQ ID NO: 9215747 - DNA, 22 bp, Homo sapiens
acaggtagatacatacttctaa

SEQ ID NO: 9215748 - DNA, 22 bp, Homo sapiens
acaggtagaaattcatctatat

SEQ ID NO: 9215749 - DNA, 15 bp, Homo sapiens
acaggtagacaattg

SEQ ID NO: 9215750 - DNA, 22 bp, Homo sapiens
acaggtaggttaaaatgtgtca

SEQ ID NO: 9215751 - DNA, 22 bp, Homo sapiens
acaggtagcatttttcctcttt

SEQ ID NO: 9215752 - DNA, 22 bp, Homo sapiens
acaggtagtctgaacactgggt

SEQ ID NO: 9215753 - DNA, 22 bp, Homo sapiens
acaggtagtgggctagatctgg

SEQ ID NO: 9215754 - DNA, 22 bp, Homo sapiens
acaggtctccagagtgagagga

SEQ ID NO: 9215755 - DNA, 22 bp, Homo sapiens
acaggtctgcagtaactgggaa

SEQ ID NO: 9215756 - DNA, 22 bp, Homo sapiens
acaggtctactggcaagcagtg

SEQ ID NO: 9215757 - DNA, 22 bp, Homo sapiens
acaggtctggtctgggtgggac

SEQ ID NO: 9215758 - DNA, 22 bp, Homo sapiens
acaggtctgtgtgcacagtgct

SEQ ID NO: 9215759 - DNA, 22 bp, Homo sapiens
acagtgcataaaaacaactttt

SEQ ID NO: 9215760 - DNA, 22 bp, Homo sapiens
acagtgcagtgtgatgagtatt

SEQ ID NO: 9215761 - DNA, 22 bp, Homo sapiens
acagtgcaggtctcaacaatta

SEQ ID NO: 9215762 - DNA, 22 bp, Homo sapiens
acagtgcgggctgcggtgggtc

SEQ ID NO: 9215763 - DNA, 22 bp, Homo sapiens
acagtgcattattgctgaatgc

SEQ ID NO: 9215764 - DNA, 20 bp, Homo sapiens
acagtgcatggggggacagc

SEQ ID NO: 9215765 - DNA, 19 bp, Homo sapiens
acagtgcatgggacctggt

SEQ ID NO: 9215766 - DNA, 22 bp, Homo sapiens
acaggtgtgagaacatgccttg

SEQ ID NO: 9215767 - DNA, 22 bp, Homo sapiens
acagtgtagcatggtagcaatg

SEQ ID NO: 9215768 - DNA, 22 bp, Homo sapiens
acagtgtatgatatttcacagt

SEQ ID NO: 9215769 - DNA, 22 bp, Homo sapiens
acataacaatcataggacatag

SEQ ID NO: 9215770 - DNA, 20 bp, Homo sapiens
acagtgggtggggagcactg

SEQ ID NO: 9215771 - DNA, 20 bp, Homo sapiens
acagtgggtggggagcactg

SEQ ID NO: 9215772 - DNA, 22 bp, Homo sapiens
acagtgctgatctagactgacc

SEQ ID NO: 9215773 - DNA, 22 bp, Homo sapiens
acattagaacattaatattggg

SEQ ID NO: 9215774 - DNA, 22 bp, Homo sapiens
acattagataactcagaaagga

SEQ ID NO: 9215775 - DNA, 22 bp, Homo sapiens
aaggccagcttgtagggctggt

SEQ ID NO: 9215776 - DNA, 22 bp, Homo sapiens
acatgtaaaagataaattaaca

SEQ ID NO: 9215777 - DNA, 22 bp, Homo sapiens
aaggccaggcagggagctgtga

SEQ ID NO: 9215778 - DNA, 22 bp, Homo sapiens
acattacataagattgtaacct

SEQ ID NO: 9215779 - DNA, 21 bp, Homo sapiens
acattacagggtgatgtgtct

SEQ ID NO: 9215780 - DNA, 21 bp, Homo sapiens
acattacagggtgatgtgtct

SEQ ID NO: 9215781 - DNA, 22 bp, Homo sapiens
acattacagcaagtttacgtta

SEQ ID NO: 9215782 - DNA, 18 bp, Homo sapiens
acatacattctgtctgca

SEQ ID NO: 9215783 - DNA, 22 bp, Homo sapiens
acataacactcttctctagtga

SEQ ID NO: 9215784 - DNA, 19 bp, Homo sapiens
acatggctctccagtctgg

SEQ ID NO: 9215785 - DNA, 22 bp, Homo sapiens
acatggctggcaccttaaattt

SEQ ID NO: 9215786 - DNA, 22 bp, Homo sapiens
acatgccaagatcctcgtcttt

SEQ ID NO: 9215787 - DNA, 22 bp, Homo sapiens
acattcttataagagtgaggca

SEQ ID NO: 9215788 - DNA, 22 bp, Homo sapiens
acattcttaacagttaaaaact

SEQ ID NO: 9215789 - DNA, 22 bp, Homo sapiens
accacaggaggatggctgctgg

SEQ ID NO: 9215790 - DNA, 22 bp, Homo sapiens
accacaggacccatgagtcagt

SEQ ID NO: 9215791 - DNA, 22 bp, Homo sapiens
accacaggacccatgagtcagt

SEQ ID NO: 9215792 - DNA, 22 bp, Homo sapiens
accacaggggaggaatgatgcc

SEQ ID NO: 9215793 - DNA, 22 bp, Homo sapiens
accacccccttgggtgtggaag

SEQ ID NO: 9215794 - DNA, 22 bp, Homo sapiens
accacccccttgggtgtggaag

SEQ ID NO: 9215795 - DNA, 22 bp, Homo sapiens
accacccacctcacagcatagt

SEQ ID NO: 9215796 - DNA, 22 bp, Homo sapiens
accacccagccagcttctccct

SEQ ID NO: 9215797 - DNA, 22 bp, Homo sapiens
accacccattcagaaacactga

SEQ ID NO: 9215798 - DNA, 22 bp, Homo sapiens
accagctgctgattgctaaatg

SEQ ID NO: 9215799 - DNA, 22 bp, Homo sapiens
accagctgccttttcttagtag

SEQ ID NO: 9215800 - DNA, 22 bp, Homo sapiens
accagctgcctggtctatctgc

SEQ ID NO: 9215801 - DNA, 22 bp, Homo sapiens
accagctgccttttcttagtag

SEQ ID NO: 9215802 - DNA, 23 bp, Homo sapiens
accagctgccctgaactttgtgc

SEQ ID NO: 9215803 - DNA, 23 bp, Homo sapiens
accagctgccctgaactttgtgc

SEQ ID NO: 9215804 - DNA, 22 bp, Homo sapiens
accagctgccaagggctacact

SEQ ID NO: 9215805 - DNA, 22 bp, Homo sapiens
accagctgagttctcggatggt

SEQ ID NO: 9215806 - DNA, 22 bp, Homo sapiens
accagcacggattagaatgctt

SEQ ID NO: 9215807 - DNA, 17 bp, Homo sapiens
accacctctcaccagca

SEQ ID NO: 9215808 - DNA, 22 bp, Homo sapiens
aagggcagagggaatcccacat

SEQ ID NO: 9215809 - DNA, 22 bp, Homo sapiens
aagggcagcctgactcacggtc

SEQ ID NO: 9215810 - DNA, 22 bp, Homo sapiens
aaggttgcagcagtgttgatga

SEQ ID NO: 9215811 - DNA, 22 bp, Homo sapiens
aaggttgctgttttgcttcaaa

SEQ ID NO: 9215812 - DNA, 22 bp, Homo sapiens
accaggccaaaatcatatttac

SEQ ID NO: 9215813 - DNA, 22 bp, Homo sapiens
accaggcatgatgtggagcaca

SEQ ID NO: 9215814 - DNA, 22 bp, Homo sapiens
accaggcagagctgggccttaa

SEQ ID NO: 9215815 - DNA, 22 bp, Homo sapiens
accaggcactcttgtggcagtg

SEQ ID NO: 9215816 - DNA, 22 bp, Homo sapiens
accaggcaactgtgaatgggct

SEQ ID NO: 9215817 - DNA, 22 bp, Homo sapiens
accaggcaaaaccacaggagca

SEQ ID NO: 9215818 - DNA, 22 bp, Homo sapiens
accagctgttaggcttggtgct

SEQ ID NO: 9215819 - DNA, 22 bp, Homo sapiens
accagctgtgtcctggctgcag

SEQ ID NO: 9215820 - DNA, 22 bp, Homo sapiens
accagctgttaggcttggtgct

SEQ ID NO: 9215821 - DNA, 22 bp, Homo sapiens
accagctgttatctgtagtatc

SEQ ID NO: 9215822 - DNA, 22 bp, Homo sapiens
accagctgtgtgacttttaatg

SEQ ID NO: 9215823 - DNA, 22 bp, Homo sapiens
accaggaaatttggcaacaaag

SEQ ID NO: 9215824 - DNA, 22 bp, Homo sapiens
accaggaaatttggcaacaaag

SEQ ID NO: 9215825 - DNA, 22 bp, Homo sapiens
accaggaaactgtgcccacgac

SEQ ID NO: 9215826 - DNA, 22 bp, Homo sapiens
accaggaaactctcgtctagtt

SEQ ID NO: 9215827 - DNA, 22 bp, Homo sapiens
accaggaaaaacactgtgttgg

SEQ ID NO: 9215828 - DNA, 22 bp, Homo sapiens
accaggaaactgtgcccacgac

SEQ ID NO: 9215829 - DNA, 22 bp, Homo sapiens
gggcatgcctgagcctgccact

SEQ ID NO: 9215830 - DNA, 22 bp, Homo sapiens
gggcctccgtgtgctggtgctc

SEQ ID NO: 9215831 - DNA, 22 bp, Homo sapiens
gggcctccgtgtgctggtgctc

SEQ ID NO: 9215832 - DNA, 22 bp, Homo sapiens
gggcctccgtgtgctggtgctc

SEQ ID NO: 9215833 - DNA, 22 bp, Homo sapiens
gggcctcagctctgctctgcaa

SEQ ID NO: 9215834 - DNA, 22 bp, Homo sapiens
gggcctcagctctgctctgcaa

SEQ ID NO: 9215835 - DNA, 22 bp, Homo sapiens
gggcctcagctggagtctgcct

SEQ ID NO: 9215836 - DNA, 22 bp, Homo sapiens
gggcctcaggccttgctctgtg

SEQ ID NO: 9215837 - DNA, 22 bp, Homo sapiens
gggcctgaggcccagacactgg

SEQ ID NO: 9215838 - DNA, 22 bp, Homo sapiens
gggcctgccattgctgccccag

SEQ ID NO: 9215839 - DNA, 22 bp, Homo sapiens
gggcctggggacaccaccatga

SEQ ID NO: 9215840 - DNA, 22 bp, Homo sapiens
gggcctgggaacttgcatttag

SEQ ID NO: 9215841 - DNA, 22 bp, Homo sapiens
gggcctgggaacttgcatttag

SEQ ID NO: 9215842 - DNA, 21 bp, Homo sapiens
gggcctggctgcgcaggacgg

SEQ ID NO: 9215843 - DNA, 21 bp, Homo sapiens
gggcctggctgcgcaggacgg

SEQ ID NO: 9215844 - DNA, 22 bp, Homo sapiens
gggctccagcagaggcagccgg

SEQ ID NO: 9215845 - DNA, 22 bp, Homo sapiens
gggctccagcccgggaccaggt

SEQ ID NO: 9215846 - DNA, 22 bp, Homo sapiens
gggctccagattgcagcgatca

SEQ ID NO: 9215847 - DNA, 22 bp, Homo sapiens
gggctccagagtccatgttctt

SEQ ID NO: 9215848 - DNA, 22 bp, Homo sapiens
gggctccacctagggacactgg

SEQ ID NO: 9215849 - DNA, 22 bp, Homo sapiens
gggctccatcacaggctccatc

SEQ ID NO: 9215850 - DNA, 22 bp, Homo sapiens
gggctccagtttggccaggaag

SEQ ID NO: 9215851 - DNA, 22 bp, Homo sapiens
gggctccagtttggccaggaag

SEQ ID NO: 9215852 - DNA, 22 bp, Homo sapiens
gggctccaggcaggcaggaaat

SEQ ID NO: 9215853 - DNA, 22 bp, Homo sapiens
gggctccagctgtttgccatga

SEQ ID NO: 9215854 - DNA, 22 bp, Homo sapiens
gggctggctaagacttttctgt

SEQ ID NO: 9215855 - DNA, 22 bp, Homo sapiens
ggggatggtagaccggtgacgt

SEQ ID NO: 9215856 - DNA, 22 bp, Homo sapiens
ggggatggattccgggtccctg

SEQ ID NO: 9215857 - DNA, 22 bp, Homo sapiens
ggggatggattccgggtccctg

SEQ ID NO: 9215858 - DNA, 22 bp, Homo sapiens
ggggatggaatgtagtagtgat

SEQ ID NO: 9215859 - DNA, 22 bp, Homo sapiens
ggggatggaggcgtgtggtcct

SEQ ID NO: 9215860 - DNA, 22 bp, Homo sapiens
gggctgggattgcttgctgtga

SEQ ID NO: 9215861 - DNA, 22 bp, Homo sapiens
gggctgggcatggtgttccctc

SEQ ID NO: 9215862 - DNA, 22 bp, Homo sapiens
gggctggctgattttcctctct

SEQ ID NO: 9215863 - DNA, 22 bp, Homo sapiens
gggctgggaatggctaagtatg

SEQ ID NO: 9215864 - DNA, 21 bp, Homo sapiens
gggggaagaggagttgctagt

SEQ ID NO: 9215865 - DNA, 22 bp, Homo sapiens
gggggaagaggcatgaagtcct

SEQ ID NO: 9215866 - DNA, 22 bp, Homo sapiens
gggggaagtaattataaaccaa

SEQ ID NO: 9215867 - DNA, 22 bp, Homo sapiens
gggggactaactggatcctgga

SEQ ID NO: 9215868 - DNA, 22 bp, Homo sapiens
gggggaagaaagaacatggcat

SEQ ID NO: 9215869 - DNA, 22 bp, Homo sapiens
gggggaagactgggctagtgat

SEQ ID NO: 9215870 - DNA, 22 bp, Homo sapiens
ggggcaggagcccttcttcagc

SEQ ID NO: 9215871 - DNA, 22 bp, Homo sapiens
ggggcagctcccgagggcagga

SEQ ID NO: 9215872 - DNA, 22 bp, Homo sapiens
ggggctgttgaagttagttgag

SEQ ID NO: 9215873 - DNA, 22 bp, Homo sapiens
gggggccttgttagtggatgga

SEQ ID NO: 9215874 - DNA, 23 bp, Homo sapiens
gggggccgtcctggggattatag

SEQ ID NO: 9215875 - DNA, 22 bp, Homo sapiens
gggtcagcgatttcaggggcag

SEQ ID NO: 9215876 - DNA, 16 bp, Homo sapiens
ggtgggaggtgaggtg

SEQ ID NO: 9215877 - DNA, 22 bp, Homo sapiens
ggtgggagggctgcgttcctct

SEQ ID NO: 9215878 - DNA, 22 bp, Homo sapiens
ggtgggaggcaggctgctccca

SEQ ID NO: 9215879 - DNA, 22 bp, Homo sapiens
ggtgggagagctctgtctccag

SEQ ID NO: 9215880 - DNA, 22 bp, Homo sapiens
ggtgcctgtatttggggcacag

SEQ ID NO: 9215881 - DNA, 20 bp, Homo sapiens
ggtgcgaggccagagcagac

SEQ ID NO: 9215882 - DNA, 22 bp, Homo sapiens
ggtgccagcctagtgcagtggt

SEQ ID NO: 9215883 - DNA, 22 bp, Homo sapiens
ggtgccagagtggcccaggggc

SEQ ID NO: 9215884 - DNA, 22 bp, Homo sapiens
ggtgccaggctgtagtcagggt

SEQ ID NO: 9215885 - DNA, 22 bp, Homo sapiens
ggtgccagtgggtctcaggata

SEQ ID NO: 9215886 - DNA, 21 bp, Homo sapiens
ggtcttccaaataaggagaaa

SEQ ID NO: 9215887 - DNA, 22 bp, Homo sapiens
ggtcccaagcaatgcccttggc

SEQ ID NO: 9215888 - DNA, 22 bp, Homo sapiens
ggtcccaagtgcttttcctgca

SEQ ID NO: 9215889 - DNA, 22 bp, Homo sapiens
ggtcccaatctaatcacatgag

SEQ ID NO: 9215890 - DNA, 22 bp, Homo sapiens
ggtctggcctcgggcaccccca

SEQ ID NO: 9215891 - DNA, 22 bp, Homo sapiens
ggtctggcctggcattctatgg

SEQ ID NO: 9215892 - DNA, 17 bp, Homo sapiens
ggtctggggccattggc

SEQ ID NO: 9215893 - DNA, 22 bp, Homo sapiens
ggtgcagtggtgtggcaaaggg

SEQ ID NO: 9215894 - DNA, 22 bp, Homo sapiens
ggtcagggggatctgtgaggta

SEQ ID NO: 9215895 - DNA, 18 bp, Homo sapiens
ggtaggagccaggaatgt

SEQ ID NO: 9215896 - DNA, 20 bp, Homo sapiens
ggtagcagctgctgtcatcc

SEQ ID NO: 9215897 - DNA, 22 bp, Homo sapiens
ggtagcagggctgtgagtcaga

SEQ ID NO: 9215898 - DNA, 22 bp, Homo sapiens
ggtagggaaggtctcccacatt

SEQ ID NO: 9215899 - DNA, 22 bp, Homo sapiens
ggtagggatgggatttggaagt

SEQ ID NO: 9215900 - DNA, 22 bp, Homo sapiens
ggtcagcccctgctcaaggccg

SEQ ID NO: 9215901 - DNA, 22 bp, Homo sapiens
ggtcaggaaaagactccccaga

SEQ ID NO: 9215902 - DNA, 22 bp, Homo sapiens
ggtcaggatccaagtctgtgct

SEQ ID NO: 9215903 - DNA, 22 bp, Homo sapiens
ggtcagccttggatttggtagc

SEQ ID NO: 9215904 - DNA, 23 bp, Homo sapiens
gggtccagagacaggcatgggtg

SEQ ID NO: 9215905 - DNA, 22 bp, Homo sapiens
gggtccagagttgaagaggtta

SEQ ID NO: 9215906 - DNA, 22 bp, Homo sapiens
gggtccagagcctcagcccaga

SEQ ID NO: 9215907 - DNA, 22 bp, Homo sapiens
gggtccagagttgaagaggtta

SEQ ID NO: 9215908 - DNA, 22 bp, Homo sapiens
gggtccagacactccagaggaa

SEQ ID NO: 9215909 - DNA, 22 bp, Homo sapiens
gggtccagcgacagcaggctca

SEQ ID NO: 9215910 - DNA, 22 bp, Homo sapiens
ggtaacagttacagtaacagta

SEQ ID NO: 9215911 - DNA, 22 bp, Homo sapiens
ggtaacagtatgtagagtaaga

SEQ ID NO: 9215912 - DNA, 22 bp, Homo sapiens
ggtagacaatggaatgtggcct

SEQ ID NO: 9215913 - DNA, 22 bp, Homo sapiens
ggtagacaactttgtaatagcc

SEQ ID NO: 9215914 - DNA, 22 bp, Homo sapiens
ggtaccaccaattcagctgcca

SEQ ID NO: 9215915 - DNA, 22 bp, Homo sapiens
ggtaccaccaattcagctgcca

SEQ ID NO: 9215916 - DNA, 22 bp, Homo sapiens
ggtacatttttctgtcactttg

SEQ ID NO: 9215917 - DNA, 22 bp, Homo sapiens
gtctccttgtggatctcaagga

SEQ ID NO: 9215918 - DNA, 22 bp, Homo sapiens
gtctggggtccttttggcttta

SEQ ID NO: 9215919 - DNA, 22 bp, Homo sapiens
gtctggggtactttcatctgat

SEQ ID NO: 9215920 - DNA, 22 bp, Homo sapiens
gtctcctgaggcatccattgaa

SEQ ID NO: 9215921 - DNA, 22 bp, Homo sapiens
gtctcctggaaatatgcccata

SEQ ID NO: 9215922 - DNA, 22 bp, Homo sapiens
gtctcctggctgcagctaagac

SEQ ID NO: 9215923 - DNA, 22 bp, Homo sapiens
gtctcctgctagcaagcaccac

SEQ ID NO: 9215924 - DNA, 22 bp, Homo sapiens
gtcttccacatttcaagaggct

SEQ ID NO: 9215925 - DNA, 22 bp, Homo sapiens
gtcttctgcaactgcacctgcc

SEQ ID NO: 9215926 - DNA, 22 bp, Homo sapiens
gtcttcaacaataactaccact

SEQ ID NO: 9215927 - DNA, 22 bp, Homo sapiens
gtcttcaatagagcctcaattt

SEQ ID NO: 9215928 - DNA, 22 bp, Homo sapiens
gtcttcaactggactccaggga

SEQ ID NO: 9215929 - DNA, 22 bp, Homo sapiens
gtcttattaggttaaccctgct

SEQ ID NO: 9215930 - DNA, 22 bp, Homo sapiens
gtcttcttgtgttgcctgtctt

SEQ ID NO: 9215931 - DNA, 22 bp, Homo sapiens
gtcttcttttcagtctgcttgt

SEQ ID NO: 9215932 - DNA, 22 bp, Homo sapiens
gtcttctggaagagagccagct

SEQ ID NO: 9215933 - DNA, 22 bp, Homo sapiens
gtcttctgtctgtctggcatgt

SEQ ID NO: 9215934 - DNA, 22 bp, Homo sapiens
gtcttctgttctgtgaggcttc

SEQ ID NO: 9215935 - DNA, 22 bp, Homo sapiens
gtgaggccgcacgccccggagt

SEQ ID NO: 9215936 - DNA, 22 bp, Homo sapiens
gtgagtcttaagcaccaccttt

SEQ ID NO: 9215937 - DNA, 22 bp, Homo sapiens
gtgaggtggtacaatattaact

SEQ ID NO: 9215938 - DNA, 20 bp, Homo sapiens
gtgcaatggcaccatctcag

SEQ ID NO: 9215939 - DNA, 20 bp, Homo sapiens
gtgcaatggcgcaatctcgg

SEQ ID NO: 9215940 - DNA, 22 bp, Homo sapiens
gtgccctgagtgggtaggagag

SEQ ID NO: 9215941 - DNA, 22 bp, Homo sapiens
gtgcctctgagctctgctacag

SEQ ID NO: 9215942 - DNA, 22 bp, Homo sapiens
gtgcctctcattggctgagccc

SEQ ID NO: 9215943 - DNA, 21 bp, Homo sapiens
gtgccctgttcccacatgccc

SEQ ID NO: 9215944 - DNA, 23 bp, Homo sapiens
gtgccgacgctccagcaccatcc

SEQ ID NO: 9215945 - DNA, 22 bp, Homo sapiens
gtgctggggagataggaagaga

SEQ ID NO: 9215946 - DNA, 22 bp, Homo sapiens
gtgctggggagataggaagaga

SEQ ID NO: 9215947 - DNA, 22 bp, Homo sapiens
gtcagtgcttgaagggcagaga

SEQ ID NO: 9215948 - DNA, 22 bp, Homo sapiens
gtcagtaggaacctagggtcaa

SEQ ID NO: 9215949 - DNA, 22 bp, Homo sapiens
gtcacaggtgtggaggtgctgg

SEQ ID NO: 9215950 - DNA, 22 bp, Homo sapiens
gtcacagtgcctgaagctctga

SEQ ID NO: 9215951 - DNA, 22 bp, Homo sapiens
gtcaattagctaaaatttggta

SEQ ID NO: 9215952 - DNA, 22 bp, Homo sapiens
gtcaattagtggcaatttcata

SEQ ID NO: 9215953 - DNA, 22 bp, Homo sapiens
gtctcctaaaccatcctggtac

SEQ ID NO: 9215954 - DNA, 22 bp, Homo sapiens
gtctcctccatggagatggtat

SEQ ID NO: 9215955 - DNA, 22 bp, Homo sapiens
gtcctctgcccaggtcaaggtt

SEQ ID NO: 9215956 - DNA, 22 bp, Homo sapiens
gtcctccatggtcttgaagtaa

SEQ ID NO: 9215957 - DNA, 22 bp, Homo sapiens
gtccctggagctgagcagtgct

SEQ ID NO: 9215958 - DNA, 22 bp, Homo sapiens
gtccctggagctgagcagtgct

SEQ ID NO: 9215959 - DNA, 22 bp, Homo sapiens
gtaaatcatggtcagaataaat

SEQ ID NO: 9215960 - DNA, 22 bp, Homo sapiens
ggtgggcagctcttggcaggca

SEQ ID NO: 9215961 - DNA, 22 bp, Homo sapiens
gtaacattattcatgagataca

SEQ ID NO: 9215962 - DNA, 19 bp, Homo sapiens
gtaacagtggacattttag

SEQ ID NO: 9215963 - DNA, 22 bp, Homo sapiens
gtaacagtttgggttccaattg

SEQ ID NO: 9215964 - DNA, 22 bp, Homo sapiens
gtaacacttggctgcaacctgg

SEQ ID NO: 9215965 - DNA, 22 bp, Homo sapiens
gtaacactagctctgtcacttt

SEQ ID NO: 9215966 - DNA, 22 bp, Homo sapiens
gtaataatactagtcagccttg

SEQ ID NO: 9215967 - DNA, 22 bp, Homo sapiens
gtaataatggtccccaaacact

SEQ ID NO: 9215968 - DNA, 22 bp, Homo sapiens
gtaataatttgctacctggtgg

SEQ ID NO: 9215969 - DNA, 22 bp, Homo sapiens
gtaatagtctcaaactcctgga

SEQ ID NO: 9215970 - DNA, 22 bp, Homo sapiens
gtaatagtctcaaactcctgga

SEQ ID NO: 9215971 - DNA, 17 bp, Homo sapiens
gtaatataataagcctt

SEQ ID NO: 9215972 - DNA, 22 bp, Homo sapiens
gtaggaagctctgaggctagtt

SEQ ID NO: 9215973 - DNA, 22 bp, Homo sapiens
gtagctgatcctgaggacaggg

SEQ ID NO: 9215974 - DNA, 22 bp, Homo sapiens
gtagctctgtttaaagttcttt

SEQ ID NO: 9215975 - DNA, 22 bp, Homo sapiens
gtcaacagtattaggacatttg

SEQ ID NO: 9215976 - DNA, 22 bp, Homo sapiens
gtagcagctctccagggttcac

SEQ ID NO: 9215977 - DNA, 22 bp, Homo sapiens
gtagcagctctgagcatgctgc

SEQ ID NO: 9215978 - DNA, 22 bp, Homo sapiens
gtagcagcagagcaggtcctcc

SEQ ID NO: 9215979 - DNA, 22 bp, Homo sapiens
gtagcagagggcccaggtaact

SEQ ID NO: 9215980 - DNA, 22 bp, Homo sapiens
gtagcagcttcagcccaaatta

SEQ ID NO: 9215981 - DNA, 22 bp, Homo sapiens
gtagcccacctggggagggcga

SEQ ID NO: 9215982 - DNA, 22 bp, Homo sapiens
gtaatgatgtctgagaagtatg

SEQ ID NO: 9215983 - DNA, 22 bp, Homo sapiens
gtagacaggttataaatcagtg

SEQ ID NO: 9215984 - DNA, 22 bp, Homo sapiens
gtagacagtttgggccgaaatt

SEQ ID NO: 9215985 - DNA, 22 bp, Homo sapiens
gtagaggacatttgacatgatg

SEQ ID NO: 9215986 - DNA, 22 bp, Homo sapiens
gtagagcaggacttgagatgtt

SEQ ID NO: 9215987 - DNA, 22 bp, Homo sapiens
ggcagaaggcctcccagctcct

SEQ ID NO: 9215988 - DNA, 19 bp, Homo sapiens
ggcagaaggtgtaggggga

SEQ ID NO: 9215989 - DNA, 22 bp, Homo sapiens
ggcagaaggcaattagagactg

SEQ ID NO: 9215990 - DNA, 22 bp, Homo sapiens
ggcagaaggcaattagagactg

SEQ ID NO: 9215991 - DNA, 22 bp, Homo sapiens
ggcagaagataggacagggaat

SEQ ID NO: 9215992 - DNA, 22 bp, Homo sapiens
ggcagaagataggacagggaat

SEQ ID NO: 9215993 - DNA, 22 bp, Homo sapiens
ggcagcaggagccatctggtag

SEQ ID NO: 9215994 - DNA, 21 bp, Homo sapiens
ggcagaagtagcatggacggg

SEQ ID NO: 9215995 - DNA, 22 bp, Homo sapiens
ggcacttggatcttagttgggg

SEQ ID NO: 9215996 - DNA, 20 bp, Homo sapiens
ggcacttgatcccctggttc

SEQ ID NO: 9215997 - DNA, 18 bp, Homo sapiens
ggcactggtgatgcagag

SEQ ID NO: 9215998 - DNA, 18 bp, Homo sapiens
ggcactggtgatgcagag

SEQ ID NO: 9215999 - DNA, 22 bp, Homo sapiens
ggcactgggttgtaggaattaa

SEQ ID NO: 9216000 - DNA, 19 bp, Homo sapiens
ggcactggggccaggacca

SEQ ID NO: 9216001 - DNA, 22 bp, Homo sapiens
ggcactgggcaccggctgaggg

SEQ ID NO: 9216002 - DNA, 22 bp, Homo sapiens
ggatttcttccttcctcagaag

SEQ ID NO: 9216003 - DNA, 22 bp, Homo sapiens
ggcagctgttggctctctagga

SEQ ID NO: 9216004 - DNA, 22 bp, Homo sapiens
ggcagctgttggctctctagga

SEQ ID NO: 9216005 - DNA, 22 bp, Homo sapiens
ggcagctgttggctctctagga

SEQ ID NO: 9216006 - DNA, 22 bp, Homo sapiens
ggcagctgtttgtcctcctgtt

SEQ ID NO: 9216007 - DNA, 17 bp, Homo sapiens
ggcagctgtgtgcatgc

SEQ ID NO: 9216008 - DNA, 22 bp, Homo sapiens
ggcagcttcctgagccagcagc

SEQ ID NO: 9216009 - DNA, 22 bp, Homo sapiens
ggcagcagggtctagattgatg

SEQ ID NO: 9216010 - DNA, 22 bp, Homo sapiens
ggcagcagggctgtctccctac

SEQ ID NO: 9216011 - DNA, 22 bp, Homo sapiens
ggcagccagcacgcagttgatg

SEQ ID NO: 9216012 - DNA, 22 bp, Homo sapiens
ggcagccagtagggccagcctg

SEQ ID NO: 9216013 - DNA, 22 bp, Homo sapiens
ggagatttatagcacacttcag

SEQ ID NO: 9216014 - DNA, 22 bp, Homo sapiens
ggagcaccccagatcagagaac

SEQ ID NO: 9216015 - DNA, 22 bp, Homo sapiens
ggagcacagccttgccagtacc

SEQ ID NO: 9216016 - DNA, 22 bp, Homo sapiens
ggatgaggaagattactgagaa

SEQ ID NO: 9216017 - DNA, 22 bp, Homo sapiens
ggatctggggtagagcagtggg

SEQ ID NO: 9216018 - DNA, 22 bp, Homo sapiens
ggatctgttttgcctctgaggg

SEQ ID NO: 9216019 - DNA, 22 bp, Homo sapiens
ggatctggggctctgctgctca

SEQ ID NO: 9216020 - DNA, 17 bp, Homo sapiens
ggagcagatccaccatt

SEQ ID NO: 9216021 - DNA, 22 bp, Homo sapiens
ggagcagagctgggcttggctg

SEQ ID NO: 9216022 - DNA, 22 bp, Homo sapiens
ggagcagacataaccttacaga

SEQ ID NO: 9216023 - DNA, 22 bp, Homo sapiens
ggagcagagcatttcacagcct

SEQ ID NO: 9216024 - DNA, 22 bp, Homo sapiens
ggagcagagctcttcatctgca

SEQ ID NO: 9216025 - DNA, 22 bp, Homo sapiens
ggatgaggtagatgaacaaggg

SEQ ID NO: 9216026 - DNA, 19 bp, Homo sapiens
ggatgagggtcaggcatag

SEQ ID NO: 9216027 - DNA, 22 bp, Homo sapiens
ggatgcacgaaggcgcctcgga

SEQ ID NO: 9216028 - DNA, 22 bp, Homo sapiens
ggatgcccactatctgctggct

SEQ ID NO: 9216029 - DNA, 22 bp, Homo sapiens
ggatgcaggggcagcagagcct

SEQ ID NO: 9216030 - DNA, 22 bp, Homo sapiens
ggatgcaggacggcatggatgt

SEQ ID NO: 9216031 - DNA, 22 bp, Homo sapiens
ggatgcaggagttgaagaagga

SEQ ID NO: 9216032 - DNA, 22 bp, Homo sapiens
ggatgcaggggcagcagagcct

SEQ ID NO: 9216033 - DNA, 22 bp, Homo sapiens
ggatgttgattgaatggccatt

SEQ ID NO: 9216034 - DNA, 22 bp, Homo sapiens
ggatggcaggacaaggacccag

SEQ ID NO: 9216035 - DNA, 22 bp, Homo sapiens
ggatggagatgaccatggtgac

SEQ ID NO: 9216036 - DNA, 22 bp, Homo sapiens
ggatggagatgaccatggtgac

SEQ ID NO: 9216037 - DNA, 22 bp, Homo sapiens
ggccaggagctgcacagggctc

SEQ ID NO: 9216038 - DNA, 22 bp, Homo sapiens
ggccaggaagggaagatcagca

SEQ ID NO: 9216039 - DNA, 22 bp, Homo sapiens
ggccaggcactgtgtgagatat

SEQ ID NO: 9216040 - DNA, 22 bp, Homo sapiens
ggccaggccaagagggttggaa

SEQ ID NO: 9216041 - DNA, 22 bp, Homo sapiens
ggccaggatctgtttgtccacc

SEQ ID NO: 9216042 - DNA, 22 bp, Homo sapiens
ggccctgctcaggctgcgatga

SEQ ID NO: 9216043 - DNA, 22 bp, Homo sapiens
ggccctgggccctctagcttgt

SEQ ID NO: 9216044 - DNA, 22 bp, Homo sapiens
ggccctgggacacaacaccgaa

SEQ ID NO: 9216045 - DNA, 21 bp, Homo sapiens
ggcctaggggcagatggtgct

SEQ ID NO: 9216046 - DNA, 22 bp, Homo sapiens
ggcggtctcagcaccctcttgg

SEQ ID NO: 9216047 - DNA, 22 bp, Homo sapiens
ggcgggtgtaagtaggacagcg

SEQ ID NO: 9216048 - DNA, 22 bp, Homo sapiens
ggcctgcctcacagtcagcacc

SEQ ID NO: 9216049 - DNA, 22 bp, Homo sapiens
ggcctgctggctccagcgcccg

SEQ ID NO: 9216050 - DNA, 22 bp, Homo sapiens
ggccaggaacttttgggatggg

SEQ ID NO: 9216051 - DNA, 22 bp, Homo sapiens
ggcatcttgttgctcaaatcta

SEQ ID NO: 9216052 - DNA, 22 bp, Homo sapiens
ggcatcttgttgctcaaatcta

SEQ ID NO: 9216053 - DNA, 23 bp, Homo sapiens
ggcatcttgtctagagaaatctg

SEQ ID NO: 9216054 - DNA, 22 bp, Homo sapiens
ggcagggtttctccattctgcc

SEQ ID NO: 9216055 - DNA, 22 bp, Homo sapiens
ggcagggtttacaatagcaata

SEQ ID NO: 9216056 - DNA, 21 bp, Homo sapiens
gggagggatggaaatgatgtt

SEQ ID NO: 9216057 - DNA, 22 bp, Homo sapiens
gggagggattagttctgcctgg

SEQ ID NO: 9216058 - DNA, 22 bp, Homo sapiens
gggagggattagttctgcctgg

SEQ ID NO: 9216059 - DNA, 22 bp, Homo sapiens
gggaggtgatggcaagcagcgg

SEQ ID NO: 9216060 - DNA, 22 bp, Homo sapiens
gggaggtgattaggaccatgta

SEQ ID NO: 9216061 - DNA, 22 bp, Homo sapiens
gggaggtgattaggaccatgta

SEQ ID NO: 9216062 - DNA, 22 bp, Homo sapiens
gggcacaggagaaggatctggc

SEQ ID NO: 9216063 - DNA, 22 bp, Homo sapiens
gggcacaggagaaggatctggc

SEQ ID NO: 9216064 - DNA, 22 bp, Homo sapiens
gggagggacacaaagagttccc

SEQ ID NO: 9216065 - DNA, 22 bp, Homo sapiens
gggagggagaggacagttctat

SEQ ID NO: 9216066 - DNA, 22 bp, Homo sapiens
gggagctggagctggaagactc

SEQ ID NO: 9216067 - DNA, 22 bp, Homo sapiens
gggagggaggtgatgcttggct

SEQ ID NO: 9216068 - DNA, 22 bp, Homo sapiens
gggagggaggtgatgcttggct

SEQ ID NO: 9216069 - DNA, 22 bp, Homo sapiens
gggagggaggtgatgcttggct

SEQ ID NO: 9216070 - DNA, 22 bp, Homo sapiens
gggagggagaggacagttctat

SEQ ID NO: 9216071 - DNA, 22 bp, Homo sapiens
gggagggaggtgctggttcacg

SEQ ID NO: 9216072 - DNA, 22 bp, Homo sapiens
gggagggaggtgctggttcacg

SEQ ID NO: 9216073 - DNA, 22 bp, Homo sapiens
gggagggatctgctaggcaatg

SEQ ID NO: 9216074 - DNA, 22 bp, Homo sapiens
gggagggatctgctaggcaatg

SEQ ID NO: 9216075 - DNA, 19 bp, Homo sapiens
gggcagtggcactagggag

SEQ ID NO: 9216076 - DNA, 22 bp, Homo sapiens
gggcagtcacagtgctggagca

SEQ ID NO: 9216077 - DNA, 22 bp, Homo sapiens
gggcacagtactccaatcaact

SEQ ID NO: 9216078 - DNA, 22 bp, Homo sapiens
gggcacagtctaaagttgggcc

SEQ ID NO: 9216079 - DNA, 22 bp, Homo sapiens
gggcacagtctgcagcccccca

SEQ ID NO: 9216080 - DNA, 22 bp, Homo sapiens
gggcactgctggaggctccctg

SEQ ID NO: 9216081 - DNA, 22 bp, Homo sapiens
ggctgtgcctctggcagcacat

SEQ ID NO: 9216082 - DNA, 22 bp, Homo sapiens
ggctttctgagtcaaacactga

SEQ ID NO: 9216083 - DNA, 22 bp, Homo sapiens
ggctttgacatgctgaattaaa

SEQ ID NO: 9216084 - DNA, 22 bp, Homo sapiens
gggaagggagggacctcagtct

SEQ ID NO: 9216085 - DNA, 22 bp, Homo sapiens
gggagctgagctggaagagaat

SEQ ID NO: 9216086 - DNA, 22 bp, Homo sapiens
gggagctgagctctgagccacg

SEQ ID NO: 9216087 - DNA, 17 bp, Homo sapiens
gggaagtggagaaagct

SEQ ID NO: 9216088 - DNA, 22 bp, Homo sapiens
gggaagtgatggagccaggatt

SEQ ID NO: 9216089 - DNA, 23 bp, Homo sapiens
gggaagtggggatttgaagtcat

SEQ ID NO: 9216090 - DNA, 22 bp, Homo sapiens
ggctggaatgtgtggatgtgat

SEQ ID NO: 9216091 - DNA, 22 bp, Homo sapiens
ggctggaatgcaactgtgtgtt

SEQ ID NO: 9216092 - DNA, 22 bp, Homo sapiens
ggctgctttatcggctgctgaa

SEQ ID NO: 9216093 - DNA, 22 bp, Homo sapiens
ggctggaaggtagaagatgagg

SEQ ID NO: 9216094 - DNA, 22 bp, Homo sapiens
ggctgcttgctgtttcttggat

SEQ ID NO: 9216095 - DNA, 18 bp, Homo sapiens
ggctgaggttgactagaa

SEQ ID NO: 9216096 - DNA, 18 bp, Homo sapiens
ggctgaggttgactagaa

SEQ ID NO: 9216097 - DNA, 22 bp, Homo sapiens
ggctgagggttaagatcagaca

SEQ ID NO: 9216098 - DNA, 22 bp, Homo sapiens
ggctgagggttaagatcagaca

SEQ ID NO: 9216099 - DNA, 22 bp, Homo sapiens
ggctgagggccagggctagtct

SEQ ID NO: 9216100 - DNA, 22 bp, Homo sapiens
ggctgagggccagggctagtct

SEQ ID NO: 9216101 - DNA, 22 bp, Homo sapiens
ggctgaggggcccagaggaaca

SEQ ID NO: 9216102 - DNA, 22 bp, Homo sapiens
ggctgaggggcccagaggaaca

SEQ ID NO: 9216103 - DNA, 22 bp, Homo sapiens
ggctgagggtatagctgtccca

SEQ ID NO: 9216104 - DNA, 22 bp, Homo sapiens
ggctgagggtatagctgtccca

SEQ ID NO: 9216105 - DNA, 19 bp, Homo sapiens
ggctggagaaaggaatcag

SEQ ID NO: 9216106 - DNA, 21 bp, Homo sapiens
ggctggtcgcgtgcatgtctc

SEQ ID NO: 9216107 - DNA, 22 bp, Homo sapiens
ggctcctgaggaccaggcacag

SEQ ID NO: 9216108 - DNA, 22 bp, Homo sapiens
ggctccctgggtgctcctgctc

SEQ ID NO: 9216109 - DNA, 22 bp, Homo sapiens
ggctccctgggtgctcctgctc

SEQ ID NO: 9216110 - DNA, 22 bp, Homo sapiens
ggctccctgttctattccctgg

SEQ ID NO: 9216111 - DNA, 22 bp, Homo sapiens
ggctcctgagaatgggccatca

SEQ ID NO: 9216112 - DNA, 22 bp, Homo sapiens
ggctctggggggaagtctgttg

SEQ ID NO: 9216113 - DNA, 22 bp, Homo sapiens
ggctctgggtctgtggggagcg

SEQ ID NO: 9216114 - DNA, 22 bp, Homo sapiens
ggctctggggttggcccatctc

SEQ ID NO: 9216115 - DNA, 22 bp, Homo sapiens
ggctctggggaagctctcttca

SEQ ID NO: 9216116 - DNA, 22 bp, Homo sapiens
ggctctggggcctcctcccttg

SEQ ID NO: 9216117 - DNA, 22 bp, Homo sapiens
ggctctgtggctggccatgatg

SEQ ID NO: 9216118 - DNA, 22 bp, Homo sapiens
ggctctggttgaccatgatggc

SEQ ID NO: 9216119 - DNA, 22 bp, Homo sapiens
ggctctggtgtgaagcagcctc

SEQ ID NO: 9216120 - DNA, 17 bp, Homo sapiens
ggctctgggtgtcacat

SEQ ID NO: 9216121 - DNA, 22 bp, Homo sapiens
ggctctgggtgtgaccttgggt

SEQ ID NO: 9216122 - DNA, 22 bp, Homo sapiens
ggctctgggtgtgaccttgggt

SEQ ID NO: 9216123 - DNA, 17 bp, Homo sapiens
ggctctgggtgtcacat

SEQ ID NO: 9216124 - DNA, 22 bp, Homo sapiens
ggctctgggtctgtggggagcg

SEQ ID NO: 9216125 - DNA, 22 bp, Homo sapiens
ggctaggcaggctcagagccta

SEQ ID NO: 9216126 - DNA, 22 bp, Homo sapiens
ggctaccagataaattacagag

SEQ ID NO: 9216127 - DNA, 22 bp, Homo sapiens
ggctacagggtacaccacatct

SEQ ID NO: 9216128 - DNA, 22 bp, Homo sapiens
ggctacagaggccgtgagcctg

SEQ ID NO: 9216129 - DNA, 22 bp, Homo sapiens
ggcgtgggcgaggtgctctatc

SEQ ID NO: 9216130 - DNA, 22 bp, Homo sapiens
ggctcccaggagggcctggagg

SEQ ID NO: 9216131 - DNA, 22 bp, Homo sapiens
ggctccctagggagagtgggag

SEQ ID NO: 9216132 - DNA, 22 bp, Homo sapiens
ggctccctcaccaccatcacat

SEQ ID NO: 9216133 - DNA, 22 bp, Homo sapiens
ggctccctgcaacctccgcctc

SEQ ID NO: 9216134 - DNA, 22 bp, Homo sapiens
ggctccctgcaacctccgcctc

SEQ ID NO: 9216135 - DNA, 17 bp, Homo sapiens
ggctccctgactatgga

SEQ ID NO: 9216136 - DNA, 22 bp, Homo sapiens
ggctccctgcctgtcctcagtc

SEQ ID NO: 9216137 - DNA, 22 bp, Homo sapiens
ggctccctgcctgtcctcagtc

SEQ ID NO: 9216138 - DNA, 22 bp, Homo sapiens
ggagaggagctattgggggctc

SEQ ID NO: 9216139 - DNA, 22 bp, Homo sapiens
ggagaggatgttttagtaactt

SEQ ID NO: 9216140 - DNA, 22 bp, Homo sapiens
ggagaggacatggctcccacag

SEQ ID NO: 9216141 - DNA, 22 bp, Homo sapiens
ggagaggacatggctcccacag

SEQ ID NO: 9216142 - DNA, 22 bp, Homo sapiens
ggagaggagattgtggcatttt

SEQ ID NO: 9216143 - DNA, 22 bp, Homo sapiens
ggagaggaaatgccagcacttc

SEQ ID NO: 9216144 - DNA, 22 bp, Homo sapiens
ggaccttcctggctcctggggt

SEQ ID NO: 9216145 - DNA, 22 bp, Homo sapiens
ggacctggcaatttgcatctct

SEQ ID NO: 9216146 - DNA, 22 bp, Homo sapiens
ggagagagatgccgccttgctc

SEQ ID NO: 9216147 - DNA, 22 bp, Homo sapiens
ggacagagcagacgagcagcgg

SEQ ID NO: 9216148 - DNA, 22 bp, Homo sapiens
ggacagagccctggtggcctaa

SEQ ID NO: 9216149 - DNA, 22 bp, Homo sapiens
ggacctgaacataaaacgaggc

SEQ ID NO: 9216150 - DNA, 22 bp, Homo sapiens
ggacctgaaggaaagccactta

SEQ ID NO: 9216151 - DNA, 22 bp, Homo sapiens
ggacctgatgtttagtcttgtt

SEQ ID NO: 9216152 - DNA, 22 bp, Homo sapiens
ggaccctgggcttgctcctggg

SEQ ID NO: 9216153 - DNA, 22 bp, Homo sapiens
ggaccctggagacccactggga

SEQ ID NO: 9216154 - DNA, 22 bp, Homo sapiens
ggaccctgcgtgtatccacact

SEQ ID NO: 9216155 - DNA, 22 bp, Homo sapiens
ggacccagctctgagaccctgc

SEQ ID NO: 9216156 - DNA, 22 bp, Homo sapiens
ggacccagaggggagtctggca

SEQ ID NO: 9216157 - DNA, 18 bp, Homo sapiens
ggacccagggcctcaccc

SEQ ID NO: 9216158 - DNA, 22 bp, Homo sapiens
ggacccaggtagggaggaagat

SEQ ID NO: 9216159 - DNA, 22 bp, Homo sapiens
ggacagagggcaggagcccaga

SEQ ID NO: 9216160 - DNA, 22 bp, Homo sapiens
gcttcctgatattcatactgtt

SEQ ID NO: 9216161 - DNA, 22 bp, Homo sapiens
gcttcctgagtacaccctcatc

SEQ ID NO: 9216162 - DNA, 22 bp, Homo sapiens
gcttcctggaacaactgttgct

SEQ ID NO: 9216163 - DNA, 22 bp, Homo sapiens
gcttcctggaacaactgttgct

SEQ ID NO: 9216164 - DNA, 22 bp, Homo sapiens
ggaaatacaaagatacaccact

SEQ ID NO: 9216165 - DNA, 22 bp, Homo sapiens
ggaaatatcttgtactatgtga

SEQ ID NO: 9216166 - DNA, 22 bp, Homo sapiens
gcttcctgagacaacattgagt

SEQ ID NO: 9216167 - DNA, 22 bp, Homo sapiens
gcttcctgagaaacaatctgat

SEQ ID NO: 9216168 - DNA, 18 bp, Homo sapiens
gcttcctgaaagctgccc

SEQ ID NO: 9216169 - DNA, 22 bp, Homo sapiens
gcttcctacatgtgtctgcgag

SEQ ID NO: 9216170 - DNA, 22 bp, Homo sapiens
gcttcctagatctgtggtactc

SEQ ID NO: 9216171 - DNA, 22 bp, Homo sapiens
gcttcctagcattagccattgc

SEQ ID NO: 9216172 - DNA, 22 bp, Homo sapiens
gcttcccctccaagcactgcct

SEQ ID NO: 9216173 - DNA, 22 bp, Homo sapiens
gcttcccattatggaaactctt

SEQ ID NO: 9216174 - DNA, 22 bp, Homo sapiens
gcttcccatagtggaattcggg

SEQ ID NO: 9216175 - DNA, 22 bp, Homo sapiens
gcttccggagccaaaaggcccc

SEQ ID NO: 9216176 - DNA, 20 bp, Homo sapiens
gcttcccaattcttgatctg

SEQ ID NO: 9216177 - DNA, 20 bp, Homo sapiens
gcttcccaattcttgatctg

SEQ ID NO: 9216178 - DNA, 19 bp, Homo sapiens
gcttcccaccagccagccc

SEQ ID NO: 9216179 - DNA, 22 bp, Homo sapiens
gcttcccagcagaggaaagact

SEQ ID NO: 9216180 - DNA, 23 bp, Homo sapiens
gcttcccagacaatactgcttcc

SEQ ID NO: 9216181 - DNA, 22 bp, Homo sapiens
gcttcccaggcgcctgaccttt

SEQ ID NO: 9216182 - DNA, 22 bp, Homo sapiens
ggaagccccagacccagagtct

SEQ ID NO: 9216183 - DNA, 22 bp, Homo sapiens
ggaagccccagctgtgggatcc

SEQ ID NO: 9216184 - DNA, 19 bp, Homo sapiens
ggaagccctgggtcagagc

SEQ ID NO: 9216185 - DNA, 22 bp, Homo sapiens
ggaagcccagctgtctcctgtc

SEQ ID NO: 9216186 - DNA, 22 bp, Homo sapiens
ggaagccaggcccagagatgct

SEQ ID NO: 9216187 - DNA, 22 bp, Homo sapiens
ggaaccttgataataagttgtt

SEQ ID NO: 9216188 - DNA, 21 bp, Homo sapiens
ggaagcagtggcggcaactcc

SEQ ID NO: 9216189 - DNA, 22 bp, Homo sapiens
ggaaccagtaactggtcattgc

SEQ ID NO: 9216190 - DNA, 22 bp, Homo sapiens
ggaaccttacctaccagtggag

SEQ ID NO: 9216191 - DNA, 22 bp, Homo sapiens
ggaaccttagtgttcttttacc

SEQ ID NO: 9216192 - DNA, 19 bp, Homo sapiens
ggaaccttagagcttcagc

SEQ ID NO: 9216193 - DNA, 22 bp, Homo sapiens
ggaaccttcatactgtttacca

SEQ ID NO: 9216194 - DNA, 23 bp, Homo sapiens
ggaaccttcttagcccctgagca

SEQ ID NO: 9216195 - DNA, 22 bp, Homo sapiens
ggaaccttattcacgccattta

SEQ ID NO: 9216196 - DNA, 22 bp, Homo sapiens
ggaacagggatttggcctggtt

SEQ ID NO: 9216197 - DNA, 21 bp, Homo sapiens
gctggctctctgacgtgcttt

SEQ ID NO: 9216198 - DNA, 22 bp, Homo sapiens
gctggctctacatttgaggtca

SEQ ID NO: 9216199 - DNA, 22 bp, Homo sapiens
gctggctcgggaagcaggggat

SEQ ID NO: 9216200 - DNA, 22 bp, Homo sapiens
gctggctcggatttgaacagga

SEQ ID NO: 9216201 - DNA, 22 bp, Homo sapiens
gctggctctgccccacctgttc

SEQ ID NO: 9216202 - DNA, 22 bp, Homo sapiens
gctggctctgatgggctccagg

SEQ ID NO: 9216203 - DNA, 22 bp, Homo sapiens
gctggctctgcacccaggcctc

SEQ ID NO: 9216204 - DNA, 22 bp, Homo sapiens
gctggctctgatgggctccagg

SEQ ID NO: 9216205 - DNA, 22 bp, Homo sapiens
gctggctgccttactttgtgga

SEQ ID NO: 9216206 - DNA, 22 bp, Homo sapiens
gctggctgcagattttagaggt

SEQ ID NO: 9216207 - DNA, 22 bp, Homo sapiens
gctggctgccaatttcagagct

SEQ ID NO: 9216208 - DNA, 22 bp, Homo sapiens
gctggctgccaatttcagagct

SEQ ID NO: 9216209 - DNA, 22 bp, Homo sapiens
gctggctgcacaggggctcact

SEQ ID NO: 9216210 - DNA, 18 bp, Homo sapiens
gctggctgcacttctgct

SEQ ID NO: 9216211 - DNA, 22 bp, Homo sapiens
gctgggaggatctctccctgtc

SEQ ID NO: 9216212 - DNA, 22 bp, Homo sapiens
gctgggagaggccctgaagtga

SEQ ID NO: 9216213 - DNA, 21 bp, Homo sapiens
gctgcccaaccctgcatctcc

SEQ ID NO: 9216214 - DNA, 22 bp, Homo sapiens
gctgccatggctgggggccgtg

SEQ ID NO: 9216215 - DNA, 22 bp, Homo sapiens
gctgccatgccacagcactcac

SEQ ID NO: 9216216 - DNA, 22 bp, Homo sapiens
gctgccatggtccaggctccag

SEQ ID NO: 9216217 - DNA, 22 bp, Homo sapiens
gctgccatgttgtgaggacact

SEQ ID NO: 9216218 - DNA, 22 bp, Homo sapiens
gctgccattatgggaacgagaa

SEQ ID NO: 9216219 - DNA, 22 bp, Homo sapiens
gctggcagactgggggcagaac

SEQ ID NO: 9216220 - DNA, 22 bp, Homo sapiens
gctggctccaaaagcaggggct

SEQ ID NO: 9216221 - DNA, 22 bp, Homo sapiens
gctggctcccagaggccccagc

SEQ ID NO: 9216222 - DNA, 22 bp, Homo sapiens
gctggcagggacagctgcgtgt

SEQ ID NO: 9216223 - DNA, 22 bp, Homo sapiens
gctggcagagacaagaagacta

SEQ ID NO: 9216224 - DNA, 22 bp, Homo sapiens
gctgggagtcgcgtctgtggcc

SEQ ID NO: 9216225 - DNA, 22 bp, Homo sapiens
gctgggtcccaagcctggggag

SEQ ID NO: 9216226 - DNA, 22 bp, Homo sapiens
gctgggtccatggtcctcgggt

SEQ ID NO: 9216227 - DNA, 22 bp, Homo sapiens
gctgggtcagaatctccctgtg

SEQ ID NO: 9216228 - DNA, 21 bp, Homo sapiens
gctgggtcagcaggtcctctg

SEQ ID NO: 9216229 - DNA, 19 bp, Homo sapiens
gctgggtggggtccacagc

SEQ ID NO: 9216230 - DNA, 22 bp, Homo sapiens
gctgggtctggctgtgagccgg

SEQ ID NO: 9216231 - DNA, 19 bp, Homo sapiens
gctgggtgaggtcgttgga

SEQ ID NO: 9216232 - DNA, 22 bp, Homo sapiens
gctgggtctctccctggtcctg

SEQ ID NO: 9216233 - DNA, 22 bp, Homo sapiens
gctgggtcctatgctggtagag

SEQ ID NO: 9216234 - DNA, 22 bp, Homo sapiens
gctgggtttccagcaggcagga

SEQ ID NO: 9216235 - DNA, 22 bp, Homo sapiens
gctgggttttcttccgggccta

SEQ ID NO: 9216236 - DNA, 22 bp, Homo sapiens
gctgggttttcttccgggccta

SEQ ID NO: 9216237 - DNA, 22 bp, Homo sapiens
gctgggttttcttccgggccta

SEQ ID NO: 9216238 - DNA, 22 bp, Homo sapiens
gcttccaagcggtagatagcat

SEQ ID NO: 9216239 - DNA, 22 bp, Homo sapiens
gcttccaaacaaaattttgatg

SEQ ID NO: 9216240 - DNA, 22 bp, Homo sapiens
gcttccagtaactcttgaaagg

SEQ ID NO: 9216241 - DNA, 22 bp, Homo sapiens
gcttccaagtcaatcaatgctg

SEQ ID NO: 9216242 - DNA, 22 bp, Homo sapiens
gcttcccaaacttgtggataga

SEQ ID NO: 9216243 - DNA, 23 bp, Homo sapiens
gcttccattctagtttgctgtgc

SEQ ID NO: 9216244 - DNA, 22 bp, Homo sapiens
gcttccatgttgctgctggtca

SEQ ID NO: 9216245 - DNA, 22 bp, Homo sapiens
gcttccagtcctcagaggctgg

SEQ ID NO: 9216246 - DNA, 22 bp, Homo sapiens
gctgtgagggcttctgaggcat

SEQ ID NO: 9216247 - DNA, 22 bp, Homo sapiens
gctccttcaggtggtagctgtt

SEQ ID NO: 9216248 - DNA, 18 bp, Homo sapiens
gctcctggttggaaagaa

SEQ ID NO: 9216249 - DNA, 21 bp, Homo sapiens
gctcctggtgctgcgtggcgc

SEQ ID NO: 9216250 - DNA, 22 bp, Homo sapiens
gctcctggtgctgtagagattt

SEQ ID NO: 9216251 - DNA, 22 bp, Homo sapiens
gctcctggtgctgtagagattt

SEQ ID NO: 9216252 - DNA, 22 bp, Homo sapiens
gctcctggtgctgtagagattt

SEQ ID NO: 9216253 - DNA, 22 bp, Homo sapiens
gctcctggtctggagcttcaag

SEQ ID NO: 9216254 - DNA, 22 bp, Homo sapiens
gctcctggtctggagcttcaag

SEQ ID NO: 9216255 - DNA, 22 bp, Homo sapiens
gctcagggaactttttgcaggc

SEQ ID NO: 9216256 - DNA, 22 bp, Homo sapiens
gctcaggcctccagaggggcaa

SEQ ID NO: 9216257 - DNA, 22 bp, Homo sapiens
gctcaggcctccagaggggcaa

SEQ ID NO: 9216258 - DNA, 22 bp, Homo sapiens
gctctggctactgtggctaccg

SEQ ID NO: 9216259 - DNA, 22 bp, Homo sapiens
gctctggcccaaaccctttcta

SEQ ID NO: 9216260 - DNA, 21 bp, Homo sapiens
gctctggcctactgttccctc

SEQ ID NO: 9216261 - DNA, 22 bp, Homo sapiens
gctctggccagaccctcagtgg

SEQ ID NO: 9216262 - DNA, 22 bp, Homo sapiens
gctctggctactccaccctgtt

SEQ ID NO: 9216263 - DNA, 22 bp, Homo sapiens
gctctgctgaagccccttgcat

SEQ ID NO: 9216264 - DNA, 22 bp, Homo sapiens
gctctgctcttgacttaccagg

SEQ ID NO: 9216265 - DNA, 22 bp, Homo sapiens
gctctgctgcttactagatggt

SEQ ID NO: 9216266 - DNA, 23 bp, Homo sapiens
gctctggcagcttgtgtcagcac

SEQ ID NO: 9216267 - DNA, 23 bp, Homo sapiens
gctctggcagcttgtgtcagcac

SEQ ID NO: 9216268 - DNA, 22 bp, Homo sapiens
gctctggcactggcgcgggatg

SEQ ID NO: 9216269 - DNA, 22 bp, Homo sapiens
gctctggcagctgatattagga

SEQ ID NO: 9216270 - DNA, 17 bp, Homo sapiens
gctctggcacaggattg

SEQ ID NO: 9216271 - DNA, 22 bp, Homo sapiens
gctctgctggaagttctctgga

SEQ ID NO: 9216272 - DNA, 22 bp, Homo sapiens
gctctgctccctcaaatgacat

SEQ ID NO: 9216273 - DNA, 22 bp, Homo sapiens
gctctgctccctcaaatgacat

SEQ ID NO: 9216274 - DNA, 22 bp, Homo sapiens
gctctgctctaacattcctgac

SEQ ID NO: 9216275 - DNA, 22 bp, Homo sapiens
gctctcagggtgatggcatact

SEQ ID NO: 9216276 - DNA, 17 bp, Homo sapiens
gctctgccccagcctct

SEQ ID NO: 9216277 - DNA, 18 bp, Homo sapiens
gctctgcccaggctgccc

SEQ ID NO: 9216278 - DNA, 22 bp, Homo sapiens
gctgaagggagtgctgagtctg

SEQ ID NO: 9216279 - DNA, 21 bp, Homo sapiens
gctgcaaattctaacaattat

SEQ ID NO: 9216280 - DNA, 22 bp, Homo sapiens
gctgcacatggcagaggccttt

SEQ ID NO: 9216281 - DNA, 22 bp, Homo sapiens
gctgcaggttgggcaacagagt

SEQ ID NO: 9216282 - DNA, 22 bp, Homo sapiens
gctgcagggggtgggcgtctcc

SEQ ID NO: 9216283 - DNA, 22 bp, Homo sapiens
gctgcagggggtgggcgtctcc

SEQ ID NO: 9216284 - DNA, 22 bp, Homo sapiens
gctgcaggatgaggctctgctc

SEQ ID NO: 9216285 - DNA, 22 bp, Homo sapiens
gctgcaggagctggagctgtgg

SEQ ID NO: 9216286 - DNA, 22 bp, Homo sapiens
gctgccagagattttagaacta

SEQ ID NO: 9216287 - DNA, 22 bp, Homo sapiens
gctgccagaatgggaaatctga

SEQ ID NO: 9216288 - DNA, 22 bp, Homo sapiens
gctgccagaagaggaggggtta

SEQ ID NO: 9216289 - DNA, 22 bp, Homo sapiens
gctgcacttgagcctgggagaa

SEQ ID NO: 9216290 - DNA, 23 bp, Homo sapiens
gctgcagctgtggatgttctcag

SEQ ID NO: 9216291 - DNA, 22 bp, Homo sapiens
gctgccaggacggagaggagcg

SEQ ID NO: 9216292 - DNA, 21 bp, Homo sapiens
gctgccaggattttgcaggaa

SEQ ID NO: 9216293 - DNA, 22 bp, Homo sapiens
gctgccagggaggtggtggagg

SEQ ID NO: 9216294 - DNA, 22 bp, Homo sapiens
gctgccagctttccttggctga

SEQ ID NO: 9216295 - DNA, 22 bp, Homo sapiens
gctgccagcccagcaaggtgtg

SEQ ID NO: 9216296 - DNA, 22 bp, Homo sapiens
gctgccagccagggtgggatcc

SEQ ID NO: 9216297 - DNA, 22 bp, Homo sapiens
gctgccagctgcggcccacgcg

SEQ ID NO: 9216298 - DNA, 22 bp, Homo sapiens
gctgccagcgtcagacctgggg

SEQ ID NO: 9216299 - DNA, 22 bp, Homo sapiens
gctgccagctcactctcctgag

SEQ ID NO: 9216300 - DNA, 22 bp, Homo sapiens
gctgccaggggcagctgtctca

SEQ ID NO: 9216301 - DNA, 22 bp, Homo sapiens
gctgccaggccctggggctatg

SEQ ID NO: 9216302 - DNA, 20 bp, Homo sapiens
gctgccagggcggagacatc

SEQ ID NO: 9216303 - DNA, 22 bp, Homo sapiens
gctgccagtctaatgggaaaca

SEQ ID NO: 9216304 - DNA, 22 bp, Homo sapiens
gctgccagtagttggagctcca

SEQ ID NO: 9216305 - DNA, 20 bp, Homo sapiens
gctgccagtgcctgatgctt

SEQ ID NO: 9216306 - DNA, 22 bp, Homo sapiens
gctgccagtgtggcatgatgca

SEQ ID NO: 9216307 - DNA, 22 bp, Homo sapiens
gctgccatcccctgctgggctg

SEQ ID NO: 9216308 - DNA, 22 bp, Homo sapiens
gctgccatctcctgaggacagg

SEQ ID NO: 9216309 - DNA, 22 bp, Homo sapiens
gctgccatcagagttcaggaat

SEQ ID NO: 9216310 - DNA, 22 bp, Homo sapiens
gctgccagttccttcttactcc

SEQ ID NO: 9216311 - DNA, 22 bp, Homo sapiens
gcctggggaacttgatcctgtc

SEQ ID NO: 9216312 - DNA, 22 bp, Homo sapiens
gcctggggaacttgatcctgtc

SEQ ID NO: 9216313 - DNA, 21 bp, Homo sapiens
gcctggcttcacaggcactga

SEQ ID NO: 9216314 - DNA, 22 bp, Homo sapiens
gcctggctgtcaaacccagaag

SEQ ID NO: 9216315 - DNA, 22 bp, Homo sapiens
gcctggctgtctggcaaggttc

SEQ ID NO: 9216316 - DNA, 22 bp, Homo sapiens
gcctggctgggcaccaggggag

SEQ ID NO: 9216317 - DNA, 22 bp, Homo sapiens
gcctggctgctggttctgagga

SEQ ID NO: 9216318 - DNA, 22 bp, Homo sapiens
gcctggctgctagccagaggca

SEQ ID NO: 9216319 - DNA, 22 bp, Homo sapiens
gcctggctgctagccagaggca

SEQ ID NO: 9216320 - DNA, 21 bp, Homo sapiens
gcctggctagaagctcctagc

SEQ ID NO: 9216321 - DNA, 22 bp, Homo sapiens
gcctcagggataggatgagcat

SEQ ID NO: 9216322 - DNA, 22 bp, Homo sapiens
gcctcagggataggatgagcat

SEQ ID NO: 9216323 - DNA, 22 bp, Homo sapiens
gcctcagggataggatgagcat

SEQ ID NO: 9216324 - DNA, 22 bp, Homo sapiens
gcctcaggcctatagctgctgt

SEQ ID NO: 9216325 - DNA, 22 bp, Homo sapiens
gcctcaggcctatagctgctgt

SEQ ID NO: 9216326 - DNA, 22 bp, Homo sapiens
gcctcaggcctatagctgctgt

SEQ ID NO: 9216327 - DNA, 22 bp, Homo sapiens
gcctggggcatgcagctgatac

SEQ ID NO: 9216328 - DNA, 22 bp, Homo sapiens
gcctggggcatgcagctgatac

SEQ ID NO: 9216329 - DNA, 22 bp, Homo sapiens
gcctggggccagcttgggctga

SEQ ID NO: 9216330 - DNA, 22 bp, Homo sapiens
gcctggggtctctgactcacag

SEQ ID NO: 9216331 - DNA, 22 bp, Homo sapiens
gcctggggtctctgactcacag

SEQ ID NO: 9216332 - DNA, 22 bp, Homo sapiens
gcctggggggcatgtcataata

SEQ ID NO: 9216333 - DNA, 22 bp, Homo sapiens
gcctggggtcccttgttggcac

SEQ ID NO: 9216334 - DNA, 22 bp, Homo sapiens
gcctggtgataagcagtgacct

SEQ ID NO: 9216335 - DNA, 22 bp, Homo sapiens
gcctggtgaaaggcagagagcg

SEQ ID NO: 9216336 - DNA, 22 bp, Homo sapiens
gcctggtggacactgggcatca

SEQ ID NO: 9216337 - DNA, 22 bp, Homo sapiens
gcctggtgctatgagggccagc

SEQ ID NO: 9216338 - DNA, 22 bp, Homo sapiens
gctcaagccttctgcccacctc

SEQ ID NO: 9216339 - DNA, 22 bp, Homo sapiens
gctcaaatttcagactcatgaa

SEQ ID NO: 9216340 - DNA, 22 bp, Homo sapiens
gctcaagagagatgcagttctt

SEQ ID NO: 9216341 - DNA, 22 bp, Homo sapiens
gctcaagccatcttagtagccc

SEQ ID NO: 9216342 - DNA, 22 bp, Homo sapiens
gctcacagtacagtgctggctc

SEQ ID NO: 9216343 - DNA, 22 bp, Homo sapiens
gctcacagtctgctgagtgcag

SEQ ID NO: 9216344 - DNA, 22 bp, Homo sapiens
gctcagctgcacctggagagcc

SEQ ID NO: 9216345 - DNA, 22 bp, Homo sapiens
gctcagctgcacctggagagcc

SEQ ID NO: 9216346 - DNA, 22 bp, Homo sapiens
gctcagctggagagggacgggt

SEQ ID NO: 9216347 - DNA, 22 bp, Homo sapiens
gctcagctggagagggacgggt

SEQ ID NO: 9216348 - DNA, 22 bp, Homo sapiens
gctcaggcccagcggctggtgt

SEQ ID NO: 9216349 - DNA, 17 bp, Homo sapiens
gccttctctgccctcac

SEQ ID NO: 9216350 - DNA, 22 bp, Homo sapiens
gccttttttgttgctctgtcac

SEQ ID NO: 9216351 - DNA, 22 bp, Homo sapiens
gccttttttgttgctctgtcac

SEQ ID NO: 9216352 - DNA, 22 bp, Homo sapiens
gccttgccaaggggcagcagag

SEQ ID NO: 9216353 - DNA, 22 bp, Homo sapiens
gccttgccaaggggcagcagag

SEQ ID NO: 9216354 - DNA, 22 bp, Homo sapiens
gccttgccaagagaggattttg

SEQ ID NO: 9216355 - DNA, 22 bp, Homo sapiens
gcgagaaactaagtgccctttg

SEQ ID NO: 9216356 - DNA, 22 bp, Homo sapiens
gcgggccaccttggagagcgct

SEQ ID NO: 9216357 - DNA, 22 bp, Homo sapiens
gcgctcaggtgccaggcctgcg

SEQ ID NO: 9216358 - DNA, 22 bp, Homo sapiens
gcaaggaacaaatgctctgctt

SEQ ID NO: 9216359 - DNA, 22 bp, Homo sapiens
gcaagcagttgtggcttctgag

SEQ ID NO: 9216360 - DNA, 22 bp, Homo sapiens
gcaagctgatgtgatagtgaaa

SEQ ID NO: 9216361 - DNA, 22 bp, Homo sapiens
gcaagcagacattcaggtaggt

SEQ ID NO: 9216362 - DNA, 22 bp, Homo sapiens
gcaagcagttgtggcttctgag

SEQ ID NO: 9216363 - DNA, 22 bp, Homo sapiens
gcaagcagttacccaggattcg

SEQ ID NO: 9216364 - DNA, 22 bp, Homo sapiens
gcacaggcaatagatacagcta

SEQ ID NO: 9216365 - DNA, 19 bp, Homo sapiens
gcacaggacatctgatgga

SEQ ID NO: 9216366 - DNA, 22 bp, Homo sapiens
gcacagctggactctgcctggc

SEQ ID NO: 9216367 - DNA, 22 bp, Homo sapiens
gcacaggaaatgactcatgtta

SEQ ID NO: 9216368 - DNA, 22 bp, Homo sapiens
gcacagctggggtatgatgcca

SEQ ID NO: 9216369 - DNA, 20 bp, Homo sapiens
gcacagctgagttcagggtc

SEQ ID NO: 9216370 - DNA, 22 bp, Homo sapiens
gcacagctctccccaagacgaa

SEQ ID NO: 9216371 - DNA, 22 bp, Homo sapiens
gcacagctctccccaagacgaa

SEQ ID NO: 9216372 - DNA, 22 bp, Homo sapiens
gcacagctcgagctcaggaggg

SEQ ID NO: 9216373 - DNA, 22 bp, Homo sapiens
gcacagctcgagctcaggaggg

SEQ ID NO: 9216374 - DNA, 22 bp, Homo sapiens
gcacagctcctggtaagctggg

SEQ ID NO: 9216375 - DNA, 18 bp, Homo sapiens
gcacagctaggagggtcc

SEQ ID NO: 9216376 - DNA, 22 bp, Homo sapiens
gcacagctcctggtaagctggg

SEQ ID NO: 9216377 - DNA, 22 bp, Homo sapiens
gcacagctagacggtagccaaa

SEQ ID NO: 9216378 - DNA, 22 bp, Homo sapiens
gcacagctatgagctgaattgt

SEQ ID NO: 9216379 - DNA, 22 bp, Homo sapiens
gcacagctcagcatgggaggac

SEQ ID NO: 9216380 - DNA, 22 bp, Homo sapiens
gaggggctggggttgactccaa

SEQ ID NO: 9216381 - DNA, 22 bp, Homo sapiens
gcaagattccgctctagagcct

SEQ ID NO: 9216382 - DNA, 22 bp, Homo sapiens
gcaagcaagcaggtagagctga

SEQ ID NO: 9216383 - DNA, 22 bp, Homo sapiens
gcaagacctatctagttgctgt

SEQ ID NO: 9216384 - DNA, 22 bp, Homo sapiens
gcaagacctatctagttgctgt

SEQ ID NO: 9216385 - DNA, 22 bp, Homo sapiens
gcaagagacttttatgtctgcc

SEQ ID NO: 9216386 - DNA, 22 bp, Homo sapiens
gcaagagacttttatgtctgcc

SEQ ID NO: 9216387 - DNA, 22 bp, Homo sapiens
gcaagatgttaacatagggaga

SEQ ID NO: 9216388 - DNA, 22 bp, Homo sapiens
gcaagatgttaacatagggaga

SEQ ID NO: 9216389 - DNA, 22 bp, Homo sapiens
gcaaatgagttgtaacataaaa

SEQ ID NO: 9216390 - DNA, 22 bp, Homo sapiens
gagggtcccgagccctgtcaga

SEQ ID NO: 9216391 - DNA, 22 bp, Homo sapiens
gagggtccccatgcagagctca

SEQ ID NO: 9216392 - DNA, 22 bp, Homo sapiens
gagggtccctgctcagggccag

SEQ ID NO: 9216393 - DNA, 22 bp, Homo sapiens
gcagaggacacaggagggcaag

SEQ ID NO: 9216394 - DNA, 22 bp, Homo sapiens
gcacttgattacattagtgcct

SEQ ID NO: 9216395 - DNA, 22 bp, Homo sapiens
gcagagctccccaagacaccaa

SEQ ID NO: 9216396 - DNA, 22 bp, Homo sapiens
gcagaggagcaagctggacacc

SEQ ID NO: 9216397 - DNA, 22 bp, Homo sapiens
gcacttagggtatgtactgggc

SEQ ID NO: 9216398 - DNA, 22 bp, Homo sapiens
gcactgtttatctaagtcttga

SEQ ID NO: 9216399 - DNA, 22 bp, Homo sapiens
gcacttgataaatgttaactga

SEQ ID NO: 9216400 - DNA, 22 bp, Homo sapiens
gcacttgagccaatgctagtag

SEQ ID NO: 9216401 - DNA, 22 bp, Homo sapiens
gcacttgaggacgactcagctg

SEQ ID NO: 9216402 - DNA, 22 bp, Homo sapiens
gcacttgacccccagagctggt

SEQ ID NO: 9216403 - DNA, 22 bp, Homo sapiens
gcacttgaaaagatcaggtgca

SEQ ID NO: 9216404 - DNA, 22 bp, Homo sapiens
gcactgggaatgctgatgggct

SEQ ID NO: 9216405 - DNA, 22 bp, Homo sapiens
gcactgggaatgagggcagctt

SEQ ID NO: 9216406 - DNA, 22 bp, Homo sapiens
gcactgggagctgcctgccggt

SEQ ID NO: 9216407 - DNA, 22 bp, Homo sapiens
gcactgggaatgtgagcagctg

SEQ ID NO: 9216408 - DNA, 22 bp, Homo sapiens
gcactgggctccaggaaggagg

SEQ ID NO: 9216409 - DNA, 22 bp, Homo sapiens
gcactgggctccaggaaggagg

SEQ ID NO: 9216410 - DNA, 16 bp, Homo sapiens
gcactgggatgtcttc

SEQ ID NO: 9216411 - DNA, 22 bp, Homo sapiens
gcactgggagtctgtgggggtt

SEQ ID NO: 9216412 - DNA, 22 bp, Homo sapiens
gcactgcatctactggcaagta

SEQ ID NO: 9216413 - DNA, 22 bp, Homo sapiens
gcactgcaggtgggtggagagg

SEQ ID NO: 9216414 - DNA, 22 bp, Homo sapiens
gcactgcatctactggcaagta

SEQ ID NO: 9216415 - DNA, 22 bp, Homo sapiens
gcactgggaagaatgagcctgt

SEQ ID NO: 9216416 - DNA, 22 bp, Homo sapiens
gcactgggaagaatgagcctgt

SEQ ID NO: 9216417 - DNA, 22 bp, Homo sapiens
gcactggaaatacctagatgaa

SEQ ID NO: 9216418 - DNA, 22 bp, Homo sapiens
gcacaggcacagagggccactg

SEQ ID NO: 9216419 - DNA, 22 bp, Homo sapiens
gcacaggcacagagggccactg

SEQ ID NO: 9216420 - DNA, 22 bp, Homo sapiens
gcacaggcacagagggccactg

SEQ ID NO: 9216421 - DNA, 22 bp, Homo sapiens
gcactgagcaccagccacagat

SEQ ID NO: 9216422 - DNA, 18 bp, Homo sapiens
gcactgaggaaaacctct

SEQ ID NO: 9216423 - DNA, 22 bp, Homo sapiens
gcaggctgagttgggaaaccaa

SEQ ID NO: 9216424 - DNA, 22 bp, Homo sapiens
gcaggctgagttgggaaaccaa

SEQ ID NO: 9216425 - DNA, 22 bp, Homo sapiens
gcaggctgagtattaccctagt

SEQ ID NO: 9216426 - DNA, 22 bp, Homo sapiens
gcaggctgagtattaccctagt

SEQ ID NO: 9216427 - DNA, 22 bp, Homo sapiens
gcaggctgagtattaccctagt

SEQ ID NO: 9216428 - DNA, 22 bp, Homo sapiens
gcaggctgagagtccaagaagg

SEQ ID NO: 9216429 - DNA, 22 bp, Homo sapiens
gcaggctgaaactcggggtcta

SEQ ID NO: 9216430 - DNA, 22 bp, Homo sapiens
gcaggctgagagtccaagaagg

SEQ ID NO: 9216431 - DNA, 22 bp, Homo sapiens
gcaggctcccttgcagagcagg

SEQ ID NO: 9216432 - DNA, 22 bp, Homo sapiens
gcaggctccaaggcctgggaga

SEQ ID NO: 9216433 - DNA, 22 bp, Homo sapiens
gcaggctgccaccttctgagtt

SEQ ID NO: 9216434 - DNA, 22 bp, Homo sapiens
gcagggccttagcagcggctgc

SEQ ID NO: 9216435 - DNA, 22 bp, Homo sapiens
gcagggccttagcagcggctgc

SEQ ID NO: 9216436 - DNA, 22 bp, Homo sapiens
gcaggctgatagaggattccat

SEQ ID NO: 9216437 - DNA, 22 bp, Homo sapiens
gcaggctgatagaggattccat

SEQ ID NO: 9216438 - DNA, 22 bp, Homo sapiens
gcaggctgatgactggagttgg

SEQ ID NO: 9216439 - DNA, 22 bp, Homo sapiens
gcaggctgatgactggagttgg

SEQ ID NO: 9216440 - DNA, 22 bp, Homo sapiens
gcagggctagatatttgcaagt

SEQ ID NO: 9216441 - DNA, 22 bp, Homo sapiens
gcagggctattggaaggagatg

SEQ ID NO: 9216442 - DNA, 22 bp, Homo sapiens
gcagggctaggtcttctagggc

SEQ ID NO: 9216443 - DNA, 22 bp, Homo sapiens
gcagggctaatggggcaagtag

SEQ ID NO: 9216444 - DNA, 22 bp, Homo sapiens
gcagctggagccagccagacac

SEQ ID NO: 9216445 - DNA, 22 bp, Homo sapiens
gcagctggacccacacggctta

SEQ ID NO: 9216446 - DNA, 22 bp, Homo sapiens
gcagctggcccctttccttgtt

SEQ ID NO: 9216447 - DNA, 22 bp, Homo sapiens
gcagctggccctgacacgcaga

SEQ ID NO: 9216448 - DNA, 22 bp, Homo sapiens
gcaggaggagcattaactgagc

SEQ ID NO: 9216449 - DNA, 22 bp, Homo sapiens
gcaggagctggaaagtgatgtt

SEQ ID NO: 9216450 - DNA, 22 bp, Homo sapiens
gcaggagctggaaagtgatgtt

SEQ ID NO: 9216451 - DNA, 22 bp, Homo sapiens
gcaggaggatcacttgagccca

SEQ ID NO: 9216452 - DNA, 22 bp, Homo sapiens
gcaggaggccaggtatgcttta

SEQ ID NO: 9216453 - DNA, 22 bp, Homo sapiens
gcagcaggagagtaatagcggt

SEQ ID NO: 9216454 - DNA, 22 bp, Homo sapiens
gcagaggagcaagttgctacag

SEQ ID NO: 9216455 - DNA, 23 bp, Homo sapiens
gcagaggagcaagctggacacca

SEQ ID NO: 9216456 - DNA, 22 bp, Homo sapiens
gcagcagctctgaatgggcccc

SEQ ID NO: 9216457 - DNA, 22 bp, Homo sapiens
gcagcagctcagccgggcactg

SEQ ID NO: 9216458 - DNA, 22 bp, Homo sapiens
gcagcagctcagccgggcactg

SEQ ID NO: 9216459 - DNA, 22 bp, Homo sapiens
gcagctgcaagcacttctggca

SEQ ID NO: 9216460 - DNA, 22 bp, Homo sapiens
gcagctgcacttctacctaatt

SEQ ID NO: 9216461 - DNA, 22 bp, Homo sapiens
gcagctgcagaccctcagtgct

SEQ ID NO: 9216462 - DNA, 22 bp, Homo sapiens
gcagctgatggaagtcctattg

SEQ ID NO: 9216463 - DNA, 22 bp, Homo sapiens
gcagcatttgtggaatgggccc

SEQ ID NO: 9216464 - DNA, 22 bp, Homo sapiens
gcagcattgtgaggtcctgccc

SEQ ID NO: 9216465 - DNA, 22 bp, Homo sapiens
gcagcatttctcaaagggtggt

SEQ ID NO: 9216466 - DNA, 22 bp, Homo sapiens
gcagcattgcacttttgttctt

SEQ ID NO: 9216467 - DNA, 22 bp, Homo sapiens
gcagctgccccgactgtgagtc

SEQ ID NO: 9216468 - DNA, 20 bp, Homo sapiens
gcagctgcccccagtccctg

SEQ ID NO: 9216469 - DNA, 22 bp, Homo sapiens
gcagctgccgtgagctcacgcc

SEQ ID NO: 9216470 - DNA, 22 bp, Homo sapiens
gcagctgccgtgagctcacgcc

SEQ ID NO: 9216471 - DNA, 22 bp, Homo sapiens
gcagctgcaggcaggcttgctg

SEQ ID NO: 9216472 - DNA, 22 bp, Homo sapiens
gcagctgcagagaccgggtggg

SEQ ID NO: 9216473 - DNA, 22 bp, Homo sapiens
gcagctgcaggtggtcccatgc

SEQ ID NO: 9216474 - DNA, 18 bp, Homo sapiens
gcagctgcagttgtagct

SEQ ID NO: 9216475 - DNA, 22 bp, Homo sapiens
gcagctgccagtccccttccag

SEQ ID NO: 9216476 - DNA, 22 bp, Homo sapiens
gcagcattaccaagacatggca

SEQ ID NO: 9216477 - DNA, 21 bp, Homo sapiens
gcagcatgagaaagccccaaa

SEQ ID NO: 9216478 - DNA, 22 bp, Homo sapiens
gcagcatctgtacatagacgct

SEQ ID NO: 9216479 - DNA, 22 bp, Homo sapiens
gcagcatctagggcactggcct

SEQ ID NO: 9216480 - DNA, 22 bp, Homo sapiens
gcagcatccttggcctccaccc

SEQ ID NO: 9216481 - DNA, 22 bp, Homo sapiens
gcagcatcctgggccacagtcc

SEQ ID NO: 9216482 - DNA, 22 bp, Homo sapiens
gcagcatccccaggcagcaggg

SEQ ID NO: 9216483 - DNA, 22 bp, Homo sapiens
gcagcatccccaggcagcaggg

SEQ ID NO: 9216484 - DNA, 22 bp, Homo sapiens
gcagcatcaggttcactgcgtg

SEQ ID NO: 9216485 - DNA, 22 bp, Homo sapiens
gcagcatcaatccatgcttctc

SEQ ID NO: 9216486 - DNA, 22 bp, Homo sapiens
gcccaggctggagtgcagtggt

SEQ ID NO: 9216487 - DNA, 22 bp, Homo sapiens
gcccagcaaggaccaagggccg

SEQ ID NO: 9216488 - DNA, 22 bp, Homo sapiens
gcccagagtggccacttggctc

SEQ ID NO: 9216489 - DNA, 22 bp, Homo sapiens
gcccagagttcaaggctgcagt

SEQ ID NO: 9216490 - DNA, 22 bp, Homo sapiens
gcccagggcagggcaagagtga

SEQ ID NO: 9216491 - DNA, 23 bp, Homo sapiens
gcccagggactgggaatcagtgg

SEQ ID NO: 9216492 - DNA, 22 bp, Homo sapiens
gcccaggctggagtgcagtggt

SEQ ID NO: 9216493 - DNA, 22 bp, Homo sapiens
gcccagggcgatggtcggggcc

SEQ ID NO: 9216494 - DNA, 22 bp, Homo sapiens
gcccagggctgcaagtggacgc

SEQ ID NO: 9216495 - DNA, 22 bp, Homo sapiens
gcccagggcgatggtcggggcc

SEQ ID NO: 9216496 - DNA, 22 bp, Homo sapiens
gcccatggaaaacctgtcctct

SEQ ID NO: 9216497 - DNA, 22 bp, Homo sapiens
gccctctggggcacacagagga

SEQ ID NO: 9216498 - DNA, 22 bp, Homo sapiens
gcccaggggcagcgcatagtgg

SEQ ID NO: 9216499 - DNA, 22 bp, Homo sapiens
gcccaggggagtagtcaattta

SEQ ID NO: 9216500 - DNA, 22 bp, Homo sapiens
gcccagggcttcaaagagagaa

SEQ ID NO: 9216501 - DNA, 22 bp, Homo sapiens
gcccagtggtaaaagcaggcct

SEQ ID NO: 9216502 - DNA, 22 bp, Homo sapiens
gcccatccatggggtcatggcc

SEQ ID NO: 9216503 - DNA, 22 bp, Homo sapiens
gcctagagaaaaagcctctgca

SEQ ID NO: 9216504 - DNA, 22 bp, Homo sapiens
gcctcagacactgcctgggtgt

SEQ ID NO: 9216505 - DNA, 23 bp, Homo sapiens
gcctcagagaaacagctgcacac

SEQ ID NO: 9216506 - DNA, 22 bp, Homo sapiens
gcctcagctgttgcaggggccc

SEQ ID NO: 9216507 - DNA, 22 bp, Homo sapiens
gcctcaggactggcatactcat

SEQ ID NO: 9216508 - DNA, 22 bp, Homo sapiens
gccctgagactgagcatgggtt

SEQ ID NO: 9216509 - DNA, 22 bp, Homo sapiens
gccctctgttattgcatcctta

SEQ ID NO: 9216510 - DNA, 22 bp, Homo sapiens
gccctgagcctatgagcctctc

SEQ ID NO: 9216511 - DNA, 22 bp, Homo sapiens
gccctgagcactgctgctgggg

SEQ ID NO: 9216512 - DNA, 22 bp, Homo sapiens
gccaggtcccctcatggctcct

SEQ ID NO: 9216513 - DNA, 22 bp, Homo sapiens
gccaggtggtctggctccagag

SEQ ID NO: 9216514 - DNA, 22 bp, Homo sapiens
gccaggtgggagacagacagca

SEQ ID NO: 9216515 - DNA, 22 bp, Homo sapiens
gccaggttctggggaggtacaa

SEQ ID NO: 9216516 - DNA, 22 bp, Homo sapiens
gccaggagaatgctagcagagg

SEQ ID NO: 9216517 - DNA, 22 bp, Homo sapiens
gccaggagagctccttcaggtt

SEQ ID NO: 9216518 - DNA, 22 bp, Homo sapiens
gccaggagccctgggcaagttc

SEQ ID NO: 9216519 - DNA, 22 bp, Homo sapiens
gccaggaccctggagggcatct

SEQ ID NO: 9216520 - DNA, 22 bp, Homo sapiens
gccaggaatttcaagagccact

SEQ ID NO: 9216521 - DNA, 22 bp, Homo sapiens
gccaggacctcccagagctttc

SEQ ID NO: 9216522 - DNA, 22 bp, Homo sapiens
gccaggactcttcctagaaggt

SEQ ID NO: 9216523 - DNA, 22 bp, Homo sapiens
gccaggactagagggaggtgag

SEQ ID NO: 9216524 - DNA, 22 bp, Homo sapiens
gcccacaggtcctacctctttc

SEQ ID NO: 9216525 - DNA, 22 bp, Homo sapiens
gcccacagtacgaggctcaggc

SEQ ID NO: 9216526 - DNA, 20 bp, Homo sapiens
gcccactctaatccactgtc

SEQ ID NO: 9216527 - DNA, 18 bp, Homo sapiens
gccagtgccctggctcac

SEQ ID NO: 9216528 - DNA, 22 bp, Homo sapiens
gccagtaagtggtagagttgag

SEQ ID NO: 9216529 - DNA, 22 bp, Homo sapiens
gccagtaaaacaaaggccatgt

SEQ ID NO: 9216530 - DNA, 22 bp, Homo sapiens
gcatgaggggggttaggaagtt

SEQ ID NO: 9216531 - DNA, 22 bp, Homo sapiens
gcatctgatccaatagatatat

SEQ ID NO: 9216532 - DNA, 22 bp, Homo sapiens
gcatcttcacacaaagccagtg

SEQ ID NO: 9216533 - DNA, 19 bp, Homo sapiens
gcatttctctttacagcca

SEQ ID NO: 9216534 - DNA, 22 bp, Homo sapiens
gcatcctggctctaggtgtcat

SEQ ID NO: 9216535 - DNA, 22 bp, Homo sapiens
gcagtccccgtcgtggcaggga

SEQ ID NO: 9216536 - DNA, 22 bp, Homo sapiens
gcagtcctctcattggcctcct

SEQ ID NO: 9216537 - DNA, 22 bp, Homo sapiens
gcagtcctcctgcctcagcctc

SEQ ID NO: 9216538 - DNA, 22 bp, Homo sapiens
gcagggctcaacaggacacccc

SEQ ID NO: 9216539 - DNA, 22 bp, Homo sapiens
gcagggctcattgccaggcatt

SEQ ID NO: 9216540 - DNA, 22 bp, Homo sapiens
gcagggctccactgtggccaag

SEQ ID NO: 9216541 - DNA, 22 bp, Homo sapiens
gccagccataggccagcactgg

SEQ ID NO: 9216542 - DNA, 22 bp, Homo sapiens
gccagccataggccagcactgg

SEQ ID NO: 9216543 - DNA, 22 bp, Homo sapiens
gccagccccagacatcctatcg

SEQ ID NO: 9216544 - DNA, 22 bp, Homo sapiens
gccagccccttagggctctccc

SEQ ID NO: 9216545 - DNA, 22 bp, Homo sapiens
gccagcatcctggtggtggttg

SEQ ID NO: 9216546 - DNA, 22 bp, Homo sapiens
gccagcagtggccaccaccagg

SEQ ID NO: 9216547 - DNA, 23 bp, Homo sapiens
gccagcatagatcattctgagta

SEQ ID NO: 9216548 - DNA, 22 bp, Homo sapiens
gccagcatagtaagcagtcatc

SEQ ID NO: 9216549 - DNA, 22 bp, Homo sapiens
gccagcagtcctgctgtgtgcc

SEQ ID NO: 9216550 - DNA, 22 bp, Homo sapiens
gccagcagtccagtccttagtg

SEQ ID NO: 9216551 - DNA, 22 bp, Homo sapiens
gccagcagtatgtcctggcagt

SEQ ID NO: 9216552 - DNA, 22 bp, Homo sapiens
gccagagctgagtgaggttctt

SEQ ID NO: 9216553 - DNA, 23 bp, Homo sapiens
gccagaggaacgcagagctttct

SEQ ID NO: 9216554 - DNA, 22 bp, Homo sapiens
gccagcaggttgtcaaggagct

SEQ ID NO: 9216555 - DNA, 22 bp, Homo sapiens
gccagcagggcggagccatcta

SEQ ID NO: 9216556 - DNA, 22 bp, Homo sapiens
gcatttttgatcccactaggat

SEQ ID NO: 9216557 - DNA, 22 bp, Homo sapiens
gccaagctcaccttctgatgga

SEQ ID NO: 9216558 - DNA, 22 bp, Homo sapiens
gccaagctctttaaaggccaaa

SEQ ID NO: 9216559 - DNA, 22 bp, Homo sapiens
gccaagctgtttttcagagacg

SEQ ID NO: 9216560 - DNA, 22 bp, Homo sapiens
gccaaggcctctgcaggatgag

SEQ ID NO: 9216561 - DNA, 22 bp, Homo sapiens
gccaaggcctctgcaggatgag

SEQ ID NO: 9216562 - DNA, 22 bp, Homo sapiens
gcattttaataagattcatagg

SEQ ID NO: 9216563 - DNA, 22 bp, Homo sapiens
gcatttgtgtggcggaaggatt

SEQ ID NO: 9216564 - DNA, 22 bp, Homo sapiens
gcatttttctctcctataggag

SEQ ID NO: 9216565 - DNA, 22 bp, Homo sapiens
gcatttttcatccctcttgggt

SEQ ID NO: 9216566 - DNA, 22 bp, Homo sapiens
gcatttttctaatcattggcat

SEQ ID NO: 9216567 - DNA, 22 bp, Homo sapiens
gccagagcatgcactgcctgca

SEQ ID NO: 9216568 - DNA, 22 bp, Homo sapiens
gccagagcagaatagagtggcc

SEQ ID NO: 9216569 - DNA, 22 bp, Homo sapiens
gccaagggggcagtgcatgggt

SEQ ID NO: 9216570 - DNA, 22 bp, Homo sapiens
tcaggctgaaggaggcctatct

SEQ ID NO: 9216571 - DNA, 22 bp, Homo sapiens
tcaggctgaaaggactccagtt

SEQ ID NO: 9216572 - DNA, 22 bp, Homo sapiens
tcaggctgaatcatcctagctt

SEQ ID NO: 9216573 - DNA, 22 bp, Homo sapiens
tcaggctgaaaggactccagtt

SEQ ID NO: 9216574 - DNA, 22 bp, Homo sapiens
tcaggctgaccaggttttgctc

SEQ ID NO: 9216575 - DNA, 22 bp, Homo sapiens
tcaggctgagaaaatctggacc

SEQ ID NO: 9216576 - DNA, 22 bp, Homo sapiens
tcaggctgagaaaatctggacc

SEQ ID NO: 9216577 - DNA, 22 bp, Homo sapiens
tcaggctgaggtcatctgcatc

SEQ ID NO: 9216578 - DNA, 22 bp, Homo sapiens
tcagggagagcctgtctgacgt

SEQ ID NO: 9216579 - DNA, 22 bp, Homo sapiens
tcagggcacattctgcagtggc

SEQ ID NO: 9216580 - DNA, 22 bp, Homo sapiens
tcaggggcttgaggtgcatgtc

SEQ ID NO: 9216581 - DNA, 22 bp, Homo sapiens
tcaggggcccttccctcagcag

SEQ ID NO: 9216582 - DNA, 22 bp, Homo sapiens
tcaggggcagccggggaagcca

SEQ ID NO: 9216583 - DNA, 22 bp, Homo sapiens
tcaggggaaatctctcagcgaa

SEQ ID NO: 9216584 - DNA, 22 bp, Homo sapiens
tcaggggacttaggagagaagt

SEQ ID NO: 9216585 - DNA, 21 bp, Homo sapiens
tcaggtagttgctttgttgaa

SEQ ID NO: 9216586 - DNA, 20 bp, Homo sapiens
tcaggtagatctttgaggtc

SEQ ID NO: 9216587 - DNA, 22 bp, Homo sapiens
tcaggtagtggttaagttctgt

SEQ ID NO: 9216588 - DNA, 22 bp, Homo sapiens
tcaggtagttgacagaacttag

SEQ ID NO: 9216589 - DNA, 22 bp, Homo sapiens
tcaggtcttttgtctcctagaa

SEQ ID NO: 9216590 - DNA, 22 bp, Homo sapiens
tcaggtcttgagccatcaggat

SEQ ID NO: 9216591 - DNA, 22 bp, Homo sapiens
tcaggtctgggcacatggtaca

SEQ ID NO: 9216592 - DNA, 22 bp, Homo sapiens
tcaggtctgatgcctcatccat

SEQ ID NO: 9216593 - DNA, 22 bp, Homo sapiens
tcaggtctgtactattgtcttg

SEQ ID NO: 9216594 - DNA, 22 bp, Homo sapiens
tcaggtctatagaagaggaggg

SEQ ID NO: 9216595 - DNA, 22 bp, Homo sapiens
tcaggtctatactatgagaggc

SEQ ID NO: 9216596 - DNA, 22 bp, Homo sapiens
tcaggtcccactgctagtaagt

SEQ ID NO: 9216597 - DNA, 22 bp, Homo sapiens
tcagtgcagtgaaaggtttact

SEQ ID NO: 9216598 - DNA, 22 bp, Homo sapiens
tcagtgcagtagaactttagtt

SEQ ID NO: 9216599 - DNA, 22 bp, Homo sapiens
tcagtgcatcacagaactttgt

SEQ ID NO: 9216600 - DNA, 22 bp, Homo sapiens
tcagtgcatggacagatttaga

SEQ ID NO: 9216601 - DNA, 22 bp, Homo sapiens
tcagtgcattcatgggtggctg

SEQ ID NO: 9216602 - DNA, 22 bp, Homo sapiens
tcagtgcattaataatatcagt

SEQ ID NO: 9216603 - DNA, 22 bp, Homo sapiens
tcatctcagagaggtatgttag

SEQ ID NO: 9216604 - DNA, 22 bp, Homo sapiens
tcatccttttgcatgggaaggc

SEQ ID NO: 9216605 - DNA, 20 bp, Homo sapiens
tcataaagaggaaataaata

SEQ ID NO: 9216606 - DNA, 22 bp, Homo sapiens
tcataaaatgctcctgatattg

SEQ ID NO: 9216607 - DNA, 21 bp, Homo sapiens
tcatccaggtcctgcttcttc

SEQ ID NO: 9216608 - DNA, 22 bp, Homo sapiens
tcatccagagcttcataagtaa

SEQ ID NO: 9216609 - DNA, 22 bp, Homo sapiens
tcagtggaactgtctgggtgag

SEQ ID NO: 9216610 - DNA, 22 bp, Homo sapiens
tcaggcaaggctggtctcatac

SEQ ID NO: 9216611 - DNA, 22 bp, Homo sapiens
tcaggcaatctgacagctggag

SEQ ID NO: 9216612 - DNA, 22 bp, Homo sapiens
tcaggcaccccttgagtagggg

SEQ ID NO: 9216613 - DNA, 22 bp, Homo sapiens
tcaggcaccctctattttcatc

SEQ ID NO: 9216614 - DNA, 22 bp, Homo sapiens
tcaggaggtaggacatactggt

SEQ ID NO: 9216615 - DNA, 22 bp, Homo sapiens
tcaggcactggctgagtgatgg

SEQ ID NO: 9216616 - DNA, 22 bp, Homo sapiens
tcaggcagatgcagggatggat

SEQ ID NO: 9216617 - DNA, 23 bp, Homo sapiens
tcaggcagctggggtagttggag

SEQ ID NO: 9216618 - DNA, 22 bp, Homo sapiens
tcaggcagctccaggaatggta

SEQ ID NO: 9216619 - DNA, 22 bp, Homo sapiens
tcaggcagctccaggaatggta

SEQ ID NO: 9216620 - DNA, 22 bp, Homo sapiens
tcaggcaggaagggaggacttg

SEQ ID NO: 9216621 - DNA, 22 bp, Homo sapiens
tcaggcaggatcccagggaagg

SEQ ID NO: 9216622 - DNA, 22 bp, Homo sapiens
tcaggcaggttggctgcaggtc

SEQ ID NO: 9216623 - DNA, 22 bp, Homo sapiens
tcaggcaggctcagaggaaaac

SEQ ID NO: 9216624 - DNA, 21 bp, Homo sapiens
tcaggcaggcgcagagggaag

SEQ ID NO: 9216625 - DNA, 22 bp, Homo sapiens
tcaggagctcttccctggtgtg

SEQ ID NO: 9216626 - DNA, 22 bp, Homo sapiens
tcaggagctgtgaatacaaagg

SEQ ID NO: 9216627 - DNA, 22 bp, Homo sapiens
tcaggagctcaggctgatggaa

SEQ ID NO: 9216628 - DNA, 22 bp, Homo sapiens
tcaggagctatggactgtcaaa

SEQ ID NO: 9216629 - DNA, 22 bp, Homo sapiens
tcaggagctcttccctggtgtg

SEQ ID NO: 9216630 - DNA, 22 bp, Homo sapiens
tcaggagctcaggctgatggaa

SEQ ID NO: 9216631 - DNA, 22 bp, Homo sapiens
tcaggagcagggtctgttacca

SEQ ID NO: 9216632 - DNA, 22 bp, Homo sapiens
tcaggagcagctgtaggaaggg

SEQ ID NO: 9216633 - DNA, 19 bp, Homo sapiens
tcaggagcagcttctgaac

SEQ ID NO: 9216634 - DNA, 22 bp, Homo sapiens
tcaggagcagggggaagctctg

SEQ ID NO: 9216635 - DNA, 20 bp, Homo sapiens
tcaggagcctaggacatgat

SEQ ID NO: 9216636 - DNA, 20 bp, Homo sapiens
tcaggagcctaggacatgat

SEQ ID NO: 9216637 - DNA, 22 bp, Homo sapiens
tcaggaggatgtcggcaaattt

SEQ ID NO: 9216638 - DNA, 22 bp, Homo sapiens
tcaggaggatgtcggcaaattt

SEQ ID NO: 9216639 - DNA, 22 bp, Homo sapiens
tcaggagcttggtagtgtgatt

SEQ ID NO: 9216640 - DNA, 22 bp, Homo sapiens
tcaggagatgtaaccttagctg

SEQ ID NO: 9216641 - DNA, 22 bp, Homo sapiens
tcaggagagtgttcagtggagg

SEQ ID NO: 9216642 - DNA, 22 bp, Homo sapiens
tcaggagcaacatctttgaatc

SEQ ID NO: 9216643 - DNA, 22 bp, Homo sapiens
tcaggagcagcatgggtgagag

SEQ ID NO: 9216644 - DNA, 22 bp, Homo sapiens
tcaggagcagcatgggtgagag

SEQ ID NO: 9216645 - DNA, 22 bp, Homo sapiens
tcaggagcagccttggagagcg

SEQ ID NO: 9216646 - DNA, 22 bp, Homo sapiens
tcaggagcagccttggagagcg

SEQ ID NO: 9216647 - DNA, 22 bp, Homo sapiens
tcaggagcagctgtaggaaggg

SEQ ID NO: 9216648 - DNA, 22 bp, Homo sapiens
tcaggaaatggacatctttgct

SEQ ID NO: 9216649 - DNA, 22 bp, Homo sapiens
tcaggaaattaaacacttgaaa

SEQ ID NO: 9216650 - DNA, 22 bp, Homo sapiens
tcaggaaatggtgatttggttg

SEQ ID NO: 9216651 - DNA, 22 bp, Homo sapiens
tcaggaaagagtaatgtataca

SEQ ID NO: 9216652 - DNA, 22 bp, Homo sapiens
tcaggaaagagtgtatccatca

SEQ ID NO: 9216653 - DNA, 22 bp, Homo sapiens
tcaggaaagagttagatgatta

SEQ ID NO: 9216654 - DNA, 22 bp, Homo sapiens
tcaggaaagagttagatgatta

SEQ ID NO: 9216655 - DNA, 22 bp, Homo sapiens
tcaggaaaggtttgttgaatgg

SEQ ID NO: 9216656 - DNA, 22 bp, Homo sapiens
tcaggaaagcctagaagagaac

SEQ ID NO: 9216657 - DNA, 22 bp, Homo sapiens
tcagcttcaaatttggtgaagt

SEQ ID NO: 9216658 - DNA, 23 bp, Homo sapiens
tcagcttcattgtcttctatggc

SEQ ID NO: 9216659 - DNA, 22 bp, Homo sapiens
tcagctgtaggtatggatgtcc

SEQ ID NO: 9216660 - DNA, 21 bp, Homo sapiens
tcagctgtagagattacattc

SEQ ID NO: 9216661 - DNA, 22 bp, Homo sapiens
tcagcttccctatctgaccata

SEQ ID NO: 9216662 - DNA, 22 bp, Homo sapiens
tcagcttcctctgtggttccag

SEQ ID NO: 9216663 - DNA, 22 bp, Homo sapiens
tcagcttggacagcttggttga

SEQ ID NO: 9216664 - DNA, 22 bp, Homo sapiens
tcagcctcctaatttcctgtga

SEQ ID NO: 9216665 - DNA, 20 bp, Homo sapiens
tcagccattccttacctttc

SEQ ID NO: 9216666 - DNA, 22 bp, Homo sapiens
tcagccagggctctggcctcag

SEQ ID NO: 9216667 - DNA, 22 bp, Homo sapiens
tcagccagtatttgagtgctca

SEQ ID NO: 9216668 - DNA, 22 bp, Homo sapiens
tcagccagtatttgagtgctca

SEQ ID NO: 9216669 - DNA, 22 bp, Homo sapiens
tcagccagggcagagcaggtga

SEQ ID NO: 9216670 - DNA, 22 bp, Homo sapiens
tcagagtgaccttacatggtct

SEQ ID NO: 9216671 - DNA, 22 bp, Homo sapiens
tcagaggtcacacagcaagttt

SEQ ID NO: 9216672 - DNA, 22 bp, Homo sapiens
tcagaggtgcaagaagttctga

SEQ ID NO: 9216673 - DNA, 22 bp, Homo sapiens
tcagagagcctcaggcactgcc

SEQ ID NO: 9216674 - DNA, 21 bp, Homo sapiens
tcagaggcactgagagcaatg

SEQ ID NO: 9216675 - DNA, 22 bp, Homo sapiens
tcagaagcaaacatcactctag

SEQ ID NO: 9216676 - DNA, 23 bp, Homo sapiens
tcagagaatggtatgcttttcct

SEQ ID NO: 9216677 - DNA, 23 bp, Homo sapiens
tcagagaatggtatgcttttcct

SEQ ID NO: 9216678 - DNA, 22 bp, Homo sapiens
tcagagaatctctccttagttt

SEQ ID NO: 9216679 - DNA, 22 bp, Homo sapiens
tcagagaattgtttaatggaat

SEQ ID NO: 9216680 - DNA, 22 bp, Homo sapiens
tcagagaattcgattaaatgca

SEQ ID NO: 9216681 - DNA, 22 bp, Homo sapiens
tcagagaaggtaagtgacctgc

SEQ ID NO: 9216682 - DNA, 22 bp, Homo sapiens
tcagagaagtaggctaatggtg

SEQ ID NO: 9216683 - DNA, 22 bp, Homo sapiens
tcagaagcagatatttcaaaat

SEQ ID NO: 9216684 - DNA, 22 bp, Homo sapiens
tcagaagcaggagtgtgcacaa

SEQ ID NO: 9216685 - DNA, 22 bp, Homo sapiens
tcagaagcatgtggggagcctg

SEQ ID NO: 9216686 - DNA, 20 bp, Homo sapiens
tcagagaagggactgagatt

SEQ ID NO: 9216687 - DNA, 22 bp, Homo sapiens
tcacccaggtaatagcagtttg

SEQ ID NO: 9216688 - DNA, 22 bp, Homo sapiens
tcacctcttttttaacaggctt

SEQ ID NO: 9216689 - DNA, 22 bp, Homo sapiens
tcaccttgtgatctccctgcct

SEQ ID NO: 9216690 - DNA, 22 bp, Homo sapiens
tcaccgaggctggagtgcagtg

SEQ ID NO: 9216691 - DNA, 22 bp, Homo sapiens
tcaccggcagacgtggcctgat

SEQ ID NO: 9216692 - DNA, 22 bp, Homo sapiens
tcaccgaggctggagtgcagtg

SEQ ID NO: 9216693 - DNA, 22 bp, Homo sapiens
tcactgctttgagccactgagc

SEQ ID NO: 9216694 - DNA, 22 bp, Homo sapiens
tcactgggccctgaggtgggac

SEQ ID NO: 9216695 - DNA, 22 bp, Homo sapiens
tcactgggagatgtgggaaggg

SEQ ID NO: 9216696 - DNA, 22 bp, Homo sapiens
tcactggggccatgtgagggac

SEQ ID NO: 9216697 - DNA, 22 bp, Homo sapiens
tcactggggccatgtgagggac

SEQ ID NO: 9216698 - DNA, 22 bp, Homo sapiens
tcactgggagatgtgggaaggg

SEQ ID NO: 9216699 - DNA, 22 bp, Homo sapiens
tcactgggagagctgacaagga

SEQ ID NO: 9216700 - DNA, 22 bp, Homo sapiens
tcactgggagagctgacaagga

SEQ ID NO: 9216701 - DNA, 22 bp, Homo sapiens
tcactgggtaggacatgctgat

SEQ ID NO: 9216702 - DNA, 22 bp, Homo sapiens
tcagaacatcccagatagtaga

SEQ ID NO: 9216703 - DNA, 22 bp, Homo sapiens
tcaaacataaaactaaatcgag

SEQ ID NO: 9216704 - DNA, 22 bp, Homo sapiens
tcaaaattctagggagaatggt

SEQ ID NO: 9216705 - DNA, 22 bp, Homo sapiens
tcaaaagaaacaccatgttcct

SEQ ID NO: 9216706 - DNA, 22 bp, Homo sapiens
tcaaaaatggtctttgagctgc

SEQ ID NO: 9216707 - DNA, 22 bp, Homo sapiens
tcaattactaaccaaataatgt

SEQ ID NO: 9216708 - DNA, 22 bp, Homo sapiens
tcaattatgccattgcaatatt

SEQ ID NO: 9216709 - DNA, 22 bp, Homo sapiens
tcaattatttgatatgaaaggg

SEQ ID NO: 9216710 - DNA, 22 bp, Homo sapiens
tcacacagctagtaagggccga

SEQ ID NO: 9216711 - DNA, 22 bp, Homo sapiens
tcacacagggtcggaaagagtg

SEQ ID NO: 9216712 - DNA, 21 bp, Homo sapiens
tcacacacgtttccaagggca

SEQ ID NO: 9216713 - DNA, 22 bp, Homo sapiens
tcacacagggttctggtctcat

SEQ ID NO: 9216714 - DNA, 22 bp, Homo sapiens
tcacacagtgagaaagtgcgga

SEQ ID NO: 9216715 - DNA, 22 bp, Homo sapiens
tcacacagtggtaaaaccctga

SEQ ID NO: 9216716 - DNA, 22 bp, Homo sapiens
tcacagaattgacatgggaatc

SEQ ID NO: 9216717 - DNA, 22 bp, Homo sapiens
tcacagaatttttgcttccagt

SEQ ID NO: 9216718 - DNA, 20 bp, Homo sapiens
tcacagaatgcctgaagaag

SEQ ID NO: 9216719 - DNA, 22 bp, Homo sapiens
tcacagaatctctgataagtct

SEQ ID NO: 9216720 - DNA, 22 bp, Homo sapiens
tcacagaatctctgataagtct

SEQ ID NO: 9216721 - DNA, 22 bp, Homo sapiens
tcacagaataaattgagaagac

SEQ ID NO: 9216722 - DNA, 22 bp, Homo sapiens
tcacagaatagcactgtaagcg

SEQ ID NO: 9216723 - DNA, 22 bp, Homo sapiens
tcacagagaactataatccatc

SEQ ID NO: 9216724 - DNA, 22 bp, Homo sapiens
tcacagagaggttaagcagttg

SEQ ID NO: 9216725 - DNA, 23 bp, Homo sapiens
tcacagagcatactgcattttgc

SEQ ID NO: 9216726 - DNA, 22 bp, Homo sapiens
tcacagcctggacagttgcctg

SEQ ID NO: 9216727 - DNA, 22 bp, Homo sapiens
tcacatatttaagaaagttaaa

SEQ ID NO: 9216728 - DNA, 22 bp, Homo sapiens
tcccaggaaaacactcgaggac

SEQ ID NO: 9216729 - DNA, 17 bp, Homo sapiens
tcccaggaacagggaat

SEQ ID NO: 9216730 - DNA, 22 bp, Homo sapiens
tcccagagtttcctgtgtccca

SEQ ID NO: 9216731 - DNA, 22 bp, Homo sapiens
tcccagcacgtctgctgtttct

SEQ ID NO: 9216732 - DNA, 22 bp, Homo sapiens
tcccagcacagggcagatgtga

SEQ ID NO: 9216733 - DNA, 22 bp, Homo sapiens
tcccagcacagggcagatgtga

SEQ ID NO: 9216734 - DNA, 22 bp, Homo sapiens
tcccagcaagaaagggggtggc

SEQ ID NO: 9216735 - DNA, 22 bp, Homo sapiens
tcccagcagagccagcaagccg

SEQ ID NO: 9216736 - DNA, 22 bp, Homo sapiens
tcccagcactgtaattctttgg

SEQ ID NO: 9216737 - DNA, 22 bp, Homo sapiens
tcccagcactgtaattctttgg

SEQ ID NO: 9216738 - DNA, 22 bp, Homo sapiens
tcccagcagatgagctgaccta

SEQ ID NO: 9216739 - DNA, 22 bp, Homo sapiens
tcccagcaggagtccagttccc

SEQ ID NO: 9216740 - DNA, 22 bp, Homo sapiens
tcccagcaggagtccagttccc

SEQ ID NO: 9216741 - DNA, 22 bp, Homo sapiens
tcccagcagcatagctcagaat

SEQ ID NO: 9216742 - DNA, 22 bp, Homo sapiens
tcccagcagtcagagctatgtg

SEQ ID NO: 9216743 - DNA, 22 bp, Homo sapiens
tcccagcagtcagagctatgtg

SEQ ID NO: 9216744 - DNA, 22 bp, Homo sapiens
tcccagcagggccgaccagcct

SEQ ID NO: 9216745 - DNA, 21 bp, Homo sapiens
tcccactgccacagcttcagg

SEQ ID NO: 9216746 - DNA, 22 bp, Homo sapiens
tcccactgtgaatccaaggcct

SEQ ID NO: 9216747 - DNA, 22 bp, Homo sapiens
tccagtgtgagaagcagcatga

SEQ ID NO: 9216748 - DNA, 22 bp, Homo sapiens
tcccacagtggtacagccctga

SEQ ID NO: 9216749 - DNA, 22 bp, Homo sapiens
tcccacatatgcaatcctgaat

SEQ ID NO: 9216750 - DNA, 22 bp, Homo sapiens
tcccagaatctccagtgctaca

SEQ ID NO: 9216751 - DNA, 22 bp, Homo sapiens
tccagtccatggcctcagtctt

SEQ ID NO: 9216752 - DNA, 18 bp, Homo sapiens
tccagtcccaaggccagc

SEQ ID NO: 9216753 - DNA, 22 bp, Homo sapiens
tccagtcatggtgtcctcacaa

SEQ ID NO: 9216754 - DNA, 22 bp, Homo sapiens
tccagggcaccagcgtccccct

SEQ ID NO: 9216755 - DNA, 20 bp, Homo sapiens
tccagggcaaactcatcacc

SEQ ID NO: 9216756 - DNA, 20 bp, Homo sapiens
tccagggcaaactcatcacc

SEQ ID NO: 9216757 - DNA, 20 bp, Homo sapiens
tccagggcaaactcatcacc

SEQ ID NO: 9216758 - DNA, 22 bp, Homo sapiens
tccagggatggtaatgagcagt

SEQ ID NO: 9216759 - DNA, 22 bp, Homo sapiens
tccagggatgccagccatgttg

SEQ ID NO: 9216760 - DNA, 22 bp, Homo sapiens
tccagggagcaagtcaggccgg

SEQ ID NO: 9216761 - DNA, 22 bp, Homo sapiens
tccagtctggtatgaatcctag

SEQ ID NO: 9216762 - DNA, 22 bp, Homo sapiens
tccagtggtggctcccggacct

SEQ ID NO: 9216763 - DNA, 22 bp, Homo sapiens
tccagggacagcgctggagcta

SEQ ID NO: 9216764 - DNA, 22 bp, Homo sapiens
tccagggagatactggctgcca

SEQ ID NO: 9216765 - DNA, 22 bp, Homo sapiens
tccaggcctaggccaagtgatt

SEQ ID NO: 9216766 - DNA, 22 bp, Homo sapiens
tccaggccgcaggggcagcccc

SEQ ID NO: 9216767 - DNA, 22 bp, Homo sapiens
tccaggccctgggatgggagca

SEQ ID NO: 9216768 - DNA, 22 bp, Homo sapiens
tccaggccattgactgcatcct

SEQ ID NO: 9216769 - DNA, 22 bp, Homo sapiens
tccaggccattgactgcatcct

SEQ ID NO: 9216770 - DNA, 22 bp, Homo sapiens
tccaggcccactcagctgaaat

SEQ ID NO: 9216771 - DNA, 22 bp, Homo sapiens
tccaggcccagacggggtgagg

SEQ ID NO: 9216772 - DNA, 21 bp, Homo sapiens
tccaggccatggtggggaggc

SEQ ID NO: 9216773 - DNA, 22 bp, Homo sapiens
tccaggaggaggaaggctgcca

SEQ ID NO: 9216774 - DNA, 22 bp, Homo sapiens
tccaggaggcacctttggacca

SEQ ID NO: 9216775 - DNA, 22 bp, Homo sapiens
tccaggacagcggcaggcagat

SEQ ID NO: 9216776 - DNA, 22 bp, Homo sapiens
tccaggaatttcccctttcctg

SEQ ID NO: 9216777 - DNA, 21 bp, Homo sapiens
tccaggaatgtctgttcatct

SEQ ID NO: 9216778 - DNA, 22 bp, Homo sapiens
tccaggaatgtgtgtgggctag

SEQ ID NO: 9216779 - DNA, 22 bp, Homo sapiens
tccaggaatctgtgcctagccc

SEQ ID NO: 9216780 - DNA, 22 bp, Homo sapiens
tccaggaatctgtgcctagccc

SEQ ID NO: 9216781 - DNA, 21 bp, Homo sapiens
tccaggaatgtctgttcatct

SEQ ID NO: 9216782 - DNA, 20 bp, Homo sapiens
tccaggaatggtagaggact

SEQ ID NO: 9216783 - DNA, 23 bp, Homo sapiens
tccaggaccctggtagacacaca

SEQ ID NO: 9216784 - DNA, 22 bp, Homo sapiens
tccaggagaaaactgacggtgg

SEQ ID NO: 9216785 - DNA, 22 bp, Homo sapiens
tccaggactggttcacacggtg

SEQ ID NO: 9216786 - DNA, 22 bp, Homo sapiens
tccaggagctcatccacgtcaa

SEQ ID NO: 9216787 - DNA, 23 bp, Homo sapiens
tccaggagaacccctgtctgtcc

SEQ ID NO: 9216788 - DNA, 22 bp, Homo sapiens
tccagcctggttgcgggcatcc

SEQ ID NO: 9216789 - DNA, 22 bp, Homo sapiens
tccagccttctcaaggctggct

SEQ ID NO: 9216790 - DNA, 22 bp, Homo sapiens
tccagcctggttgcgggcatcc

SEQ ID NO: 9216791 - DNA, 22 bp, Homo sapiens
tccagcctgaactttgtccaga

SEQ ID NO: 9216792 - DNA, 22 bp, Homo sapiens
tccaggaacgagaggctgggca

SEQ ID NO: 9216793 - DNA, 22 bp, Homo sapiens
tccaggaactcttgatggtgat

SEQ ID NO: 9216794 - DNA, 22 bp, Homo sapiens
tccaggaagaggtgtgttggga

SEQ ID NO: 9216795 - DNA, 22 bp, Homo sapiens
tccaggaagcagctacagatcc

SEQ ID NO: 9216796 - DNA, 22 bp, Homo sapiens
tccaggaagcagtgtttggagc

SEQ ID NO: 9216797 - DNA, 22 bp, Homo sapiens
tccaggaagcagctacagatcc

SEQ ID NO: 9216798 - DNA, 22 bp, Homo sapiens
tccaggaactcttgatggtgat

SEQ ID NO: 9216799 - DNA, 22 bp, Homo sapiens
tccaggaactgaagccaggtgt

SEQ ID NO: 9216800 - DNA, 22 bp, Homo sapiens
tccaggaagaggtgtgttggga

SEQ ID NO: 9216801 - DNA, 22 bp, Homo sapiens
tccaggaaggactaatggtttg

SEQ ID NO: 9216802 - DNA, 22 bp, Homo sapiens
tccaggaagcagtgtttggagc

SEQ ID NO: 9216803 - DNA, 22 bp, Homo sapiens
tccaggaagccacactgggcct

SEQ ID NO: 9216804 - DNA, 22 bp, Homo sapiens
tccaggaatagtcatgttttag

SEQ ID NO: 9216805 - DNA, 22 bp, Homo sapiens
tccaggaaggactaatggtttg

SEQ ID NO: 9216806 - DNA, 22 bp, Homo sapiens
tccaggaatagtcatgttttag

SEQ ID NO: 9216807 - DNA, 22 bp, Homo sapiens
tccaggaatagatcagagattt

SEQ ID NO: 9216808 - DNA, 22 bp, Homo sapiens
tccaggaatagatcagagattt

SEQ ID NO: 9216809 - DNA, 22 bp, Homo sapiens
tccagccttgccacttttctgt

SEQ ID NO: 9216810 - DNA, 21 bp, Homo sapiens
tccagcctttccctcacttcc

SEQ ID NO: 9216811 - DNA, 22 bp, Homo sapiens
tccaggaaatcagaagtggtaa

SEQ ID NO: 9216812 - DNA, 22 bp, Homo sapiens
tccaggaaatcagaagtggtaa

SEQ ID NO: 9216813 - DNA, 22 bp, Homo sapiens
tccaggaaatcataaattgctt

SEQ ID NO: 9216814 - DNA, 22 bp, Homo sapiens
tccaggaacagaatgttagtgc

SEQ ID NO: 9216815 - DNA, 22 bp, Homo sapiens
tccaggaacagaatgttagtgc

SEQ ID NO: 9216816 - DNA, 22 bp, Homo sapiens
tccagcccctcctgagccaagc

SEQ ID NO: 9216817 - DNA, 22 bp, Homo sapiens
tccagaaaattttacagtgcct

SEQ ID NO: 9216818 - DNA, 22 bp, Homo sapiens
tccagaaacttttccagtctca

SEQ ID NO: 9216819 - DNA, 22 bp, Homo sapiens
tccagaaactgctgagataaga

SEQ ID NO: 9216820 - DNA, 22 bp, Homo sapiens
tccagccactcagcagggattg

SEQ ID NO: 9216821 - DNA, 22 bp, Homo sapiens
tccagcccgggggcaggtgacc

SEQ ID NO: 9216822 - DNA, 22 bp, Homo sapiens
tccagccctcagccaagtggaa

SEQ ID NO: 9216823 - DNA, 22 bp, Homo sapiens
tcatggcttttattatgttgag

SEQ ID NO: 9216824 - DNA, 18 bp, Homo sapiens
tcatggctttagtccctc

SEQ ID NO: 9216825 - DNA, 20 bp, Homo sapiens
tcatggctgctgagaggttc

SEQ ID NO: 9216826 - DNA, 22 bp, Homo sapiens
tcatggctggaagctcagttag

SEQ ID NO: 9216827 - DNA, 22 bp, Homo sapiens
tcattacacagttcagtggaaa

SEQ ID NO: 9216828 - DNA, 22 bp, Homo sapiens
tcattacaagatttccaatttg

SEQ ID NO: 9216829 - DNA, 22 bp, Homo sapiens
tccacagggatgcctgcggctt

SEQ ID NO: 9216830 - DNA, 22 bp, Homo sapiens
tccacaggctgaggcccttctg

SEQ ID NO: 9216831 - DNA, 22 bp, Homo sapiens
tccacaggaaagcacctcccat

SEQ ID NO: 9216832 - DNA, 22 bp, Homo sapiens
tccacaggcaagtctcttggca

SEQ ID NO: 9216833 - DNA, 22 bp, Homo sapiens
tccacaggaaagcacctcccat

SEQ ID NO: 9216834 - DNA, 22 bp, Homo sapiens
tccacagcacaaagccagtgtg

SEQ ID NO: 9216835 - DNA, 22 bp, Homo sapiens
tccaccatgtaacaagctctgt

SEQ ID NO: 9216836 - DNA, 19 bp, Homo sapiens
tccaccccagccagctctg

SEQ ID NO: 9216837 - DNA, 22 bp, Homo sapiens
tccacccagtgtttctacaggt

SEQ ID NO: 9216838 - DNA, 22 bp, Homo sapiens
tccacccagcacactgtggtag

SEQ ID NO: 9216839 - DNA, 22 bp, Homo sapiens
tccacccccagacagctggtga

SEQ ID NO: 9216840 - DNA, 22 bp, Homo sapiens
tccacagggattcacccaaaag

SEQ ID NO: 9216841 - DNA, 22 bp, Homo sapiens
tccacgccaaaatttgtagctt

SEQ ID NO: 9216842 - DNA, 21 bp, Homo sapiens
tccaccctctctgctcccagt

SEQ ID NO: 9216843 - DNA, 22 bp, Homo sapiens
tccacgtgagcttcgtgtgcag

SEQ ID NO: 9216844 - DNA, 21 bp, Homo sapiens
tccagaaaagaggtcattagc

SEQ ID NO: 9216845 - DNA, 22 bp, Homo sapiens
tccactgctcattccacaggca

SEQ ID NO: 9216846 - DNA, 22 bp, Homo sapiens
tccactgcagcttctgatggaa

SEQ ID NO: 9216847 - DNA, 22 bp, Homo sapiens
tcccttgaacgctggggctgga

SEQ ID NO: 9216848 - DNA, 22 bp, Homo sapiens
tcccttcatcagtgagcaagcc

SEQ ID NO: 9216849 - DNA, 22 bp, Homo sapiens
tcccttcacagatgcgatgttt

SEQ ID NO: 9216850 - DNA, 22 bp, Homo sapiens
tcccttcaagatttggggaaat

SEQ ID NO: 9216851 - DNA, 22 bp, Homo sapiens
tcccttcaagatttggggaaat

SEQ ID NO: 9216852 - DNA, 23 bp, Homo sapiens
tccctgtgtacagcctgcatgag

SEQ ID NO: 9216853 - DNA, 22 bp, Homo sapiens
tccctggggatgttggcctgcc

SEQ ID NO: 9216854 - DNA, 22 bp, Homo sapiens
tccctggggatgttggcctgcc

SEQ ID NO: 9216855 - DNA, 22 bp, Homo sapiens
tccctgtcctgggcaatcccag

SEQ ID NO: 9216856 - DNA, 22 bp, Homo sapiens
tccctgtctaatatgccatgaa

SEQ ID NO: 9216857 - DNA, 19 bp, Homo sapiens
tcccaggcaaaggcttctc

SEQ ID NO: 9216858 - DNA, 22 bp, Homo sapiens
tccctgagcttcatcaggcttt

SEQ ID NO: 9216859 - DNA, 22 bp, Homo sapiens
tccctgagctgagctcaacagc

SEQ ID NO: 9216860 - DNA, 22 bp, Homo sapiens
tccctgcagtaggcagccctcc

SEQ ID NO: 9216861 - DNA, 22 bp, Homo sapiens
tccctgcagtagtggctaagat

SEQ ID NO: 9216862 - DNA, 22 bp, Homo sapiens
tccctgcaggtgtgcaagctga

SEQ ID NO: 9216863 - DNA, 22 bp, Homo sapiens
tccctgcacccttgctgggccc

SEQ ID NO: 9216864 - DNA, 21 bp, Homo sapiens
tccctgagttctctgagcatc

SEQ ID NO: 9216865 - DNA, 22 bp, Homo sapiens
tcctccctaaatcctagactgt

SEQ ID NO: 9216866 - DNA, 22 bp, Homo sapiens
tcctccctaaatcctagactgt

SEQ ID NO: 9216867 - DNA, 22 bp, Homo sapiens
tcctccctgagtggggacagct

SEQ ID NO: 9216868 - DNA, 22 bp, Homo sapiens
tcctccctgagtggggacagct

SEQ ID NO: 9216869 - DNA, 23 bp, Homo sapiens
tcctccctgacttctacagcaca

SEQ ID NO: 9216870 - DNA, 22 bp, Homo sapiens
tcctccctgggagcttctgagt

SEQ ID NO: 9216871 - DNA, 22 bp, Homo sapiens
tcctcccctgcccatgaggagg

SEQ ID NO: 9216872 - DNA, 22 bp, Homo sapiens
tcctcccctgcccatgaggagg

SEQ ID NO: 9216873 - DNA, 22 bp, Homo sapiens
tcctccagtggcccagtccttc

SEQ ID NO: 9216874 - DNA, 22 bp, Homo sapiens
tcctcccttgactcctgctttt

SEQ ID NO: 9216875 - DNA, 19 bp, Homo sapiens
tcctccctttggtgtcctg

SEQ ID NO: 9216876 - DNA, 22 bp, Homo sapiens
tcctccaggataaaatgtgttg

SEQ ID NO: 9216877 - DNA, 22 bp, Homo sapiens
tcctccaggcacctcactggct

SEQ ID NO: 9216878 - DNA, 22 bp, Homo sapiens
tcctccaggcacctcactggct

SEQ ID NO: 9216879 - DNA, 23 bp, Homo sapiens
tcctccaaccagcagctgcataa

SEQ ID NO: 9216880 - DNA, 20 bp, Homo sapiens
tcctccaaccagctgctaat

SEQ ID NO: 9216881 - DNA, 22 bp, Homo sapiens
tcctccaaggcagggggagaga

SEQ ID NO: 9216882 - DNA, 22 bp, Homo sapiens
tcctccaagcgtgggtgtttga

SEQ ID NO: 9216883 - DNA, 22 bp, Homo sapiens
tcctccaagcctttgtgaagtg

SEQ ID NO: 9216884 - DNA, 22 bp, Homo sapiens
tcctccaagcagaggccctgaa

SEQ ID NO: 9216885 - DNA, 23 bp, Homo sapiens
tcctccaatctcatggcccttaa

SEQ ID NO: 9216886 - DNA, 22 bp, Homo sapiens
tccgaggccaaagctgtgaata

SEQ ID NO: 9216887 - DNA, 22 bp, Homo sapiens
tccgccaggactgagggcccat

SEQ ID NO: 9216888 - DNA, 22 bp, Homo sapiens
tccggcagcagctctgaaggag

SEQ ID NO: 9216889 - DNA, 22 bp, Homo sapiens
tccggcagcatctggagggatg

SEQ ID NO: 9216890 - DNA, 22 bp, Homo sapiens
tccgggggtggtagatttcctt

SEQ ID NO: 9216891 - DNA, 22 bp, Homo sapiens
gttttacacacctatgaaagac

SEQ ID NO: 9216892 - DNA, 22 bp, Homo sapiens
gtttatatgaacttcataccca

SEQ ID NO: 9216893 - DNA, 22 bp, Homo sapiens
gtttataaggcccaatatttct

SEQ ID NO: 9216894 - DNA, 22 bp, Homo sapiens
gtttctcacttaccaacacatg

SEQ ID NO: 9216895 - DNA, 22 bp, Homo sapiens
gttccttggaagaacttgaggt

SEQ ID NO: 9216896 - DNA, 22 bp, Homo sapiens
gttccttgggaacaacgctgaa

SEQ ID NO: 9216897 - DNA, 22 bp, Homo sapiens
gtttacaaatattttaaatggt

SEQ ID NO: 9216898 - DNA, 22 bp, Homo sapiens
gttccttgtatttcagacatga

SEQ ID NO: 9216899 - DNA, 22 bp, Homo sapiens
gttccttgtaatttgttaagga

SEQ ID NO: 9216900 - DNA, 22 bp, Homo sapiens
gttccaggtggtcacagagctc

SEQ ID NO: 9216901 - DNA, 22 bp, Homo sapiens
gttccaggcagtggcaacagct

SEQ ID NO: 9216902 - DNA, 22 bp, Homo sapiens
gttccaggcaagtgggatagga

SEQ ID NO: 9216903 - DNA, 22 bp, Homo sapiens
gtttagaagccaagatttgggt

SEQ ID NO: 9216904 - DNA, 18 bp, Homo sapiens
gtttaggctacttaaaat

SEQ ID NO: 9216905 - DNA, 22 bp, Homo sapiens
gtttagaattctaactttaagg

SEQ ID NO: 9216906 - DNA, 22 bp, Homo sapiens
gtgtgtgtctccgcggccgtag

SEQ ID NO: 9216907 - DNA, 22 bp, Homo sapiens
gtgtgtgtgcatataacatata

SEQ ID NO: 9216908 - DNA, 22 bp, Homo sapiens
gtgtgtgtgcatctcttttatt

SEQ ID NO: 9216909 - DNA, 22 bp, Homo sapiens
gtgtgtgtatctgcctatcaca

SEQ ID NO: 9216910 - DNA, 22 bp, Homo sapiens
gtgcttttaaaggcaattagta

SEQ ID NO: 9216911 - DNA, 22 bp, Homo sapiens
gtgcttttaacttttgaaagga

SEQ ID NO: 9216912 - DNA, 22 bp, Homo sapiens
gtgctttccatcctccctgctg

SEQ ID NO: 9216913 - DNA, 22 bp, Homo sapiens
gtgtgtgttcaataaatttaag

SEQ ID NO: 9216914 - DNA, 22 bp, Homo sapiens
gtgtgtgtgtaaaaatccagag

SEQ ID NO: 9216915 - DNA, 22 bp, Homo sapiens
gtgtgtgtgcctgcacacacac

SEQ ID NO: 9216916 - DNA, 22 bp, Homo sapiens
gttccaattccaaattccaagg

SEQ ID NO: 9216917 - DNA, 22 bp, Homo sapiens
gttccaaagtctctgagctgag

SEQ ID NO: 9216918 - DNA, 22 bp, Homo sapiens
gttacaaaggtcataaaagtgt

SEQ ID NO: 9216919 - DNA, 22 bp, Homo sapiens
gttacaaatgccaaagctgaga

SEQ ID NO: 9216920 - DNA, 20 bp, Homo sapiens
gttaggaggttggacatgga

SEQ ID NO: 9216921 - DNA, 22 bp, Homo sapiens
taaatacagtcatttgagccat

SEQ ID NO: 9216922 - DNA, 17 bp, Homo sapiens
taaatacacaagggtat

SEQ ID NO: 9216923 - DNA, 21 bp, Homo sapiens
taaataataagttgctgagat

SEQ ID NO: 9216924 - DNA, 22 bp, Homo sapiens
taaagacaatttcgagctgtag

SEQ ID NO: 9216925 - DNA, 22 bp, Homo sapiens
taaacatgttgacatcttacct

SEQ ID NO: 9216926 - DNA, 22 bp, Homo sapiens
taaagacaaacccactagggtt

SEQ ID NO: 9216927 - DNA, 22 bp, Homo sapiens
gttttataggtgaaatattact

SEQ ID NO: 9216928 - DNA, 22 bp, Homo sapiens
gttttatttccatgagagaccg

SEQ ID NO: 9216929 - DNA, 22 bp, Homo sapiens
gttttattggaacacagccatg

SEQ ID NO: 9216930 - DNA, 22 bp, Homo sapiens
taaacatctgtcatgtgtttat

SEQ ID NO: 9216931 - DNA, 22 bp, Homo sapiens
taaacatggctgtttcagttat

SEQ ID NO: 9216932 - DNA, 23 bp, Homo sapiens
gttttcaacacaataaatgtaac

SEQ ID NO: 9216933 - DNA, 22 bp, Homo sapiens
taaacagagtgctagttcacgg

SEQ ID NO: 9216934 - DNA, 22 bp, Homo sapiens
taacacagttctctgttgcaca

SEQ ID NO: 9216935 - DNA, 22 bp, Homo sapiens
taacacagtgtcctcagaaaca

SEQ ID NO: 9216936 - DNA, 17 bp, Homo sapiens
taacacaggctcagaga

SEQ ID NO: 9216937 - DNA, 22 bp, Homo sapiens
taacacagtgtctaccattatt

SEQ ID NO: 9216938 - DNA, 22 bp, Homo sapiens
taacacatatctacaacatgtg

SEQ ID NO: 9216939 - DNA, 22 bp, Homo sapiens
taacacagagtaagtggtcaat

SEQ ID NO: 9216940 - DNA, 22 bp, Homo sapiens
taacacagacagccactagtaa

SEQ ID NO: 9216941 - DNA, 20 bp, Homo sapiens
taacacagaaagcttccttc

SEQ ID NO: 9216942 - DNA, 22 bp, Homo sapiens
taacaatgcaaaatgaatttag

SEQ ID NO: 9216943 - DNA, 22 bp, Homo sapiens
taacaaactggaaattgacatt

SEQ ID NO: 9216944 - DNA, 22 bp, Homo sapiens
taagagttactggtttagaacc

SEQ ID NO: 9216945 - DNA, 22 bp, Homo sapiens
taagagttagggctagcaatat

SEQ ID NO: 9216946 - DNA, 22 bp, Homo sapiens
taagagttagggctagcaatat

SEQ ID NO: 9216947 - DNA, 22 bp, Homo sapiens
taagagttgaaggagattttca

SEQ ID NO: 9216948 - DNA, 22 bp, Homo sapiens
taagatgactacttaccactga

SEQ ID NO: 9216949 - DNA, 22 bp, Homo sapiens
taagatgactacttaccactga

SEQ ID NO: 9216950 - DNA, 22 bp, Homo sapiens
taagatgaaggctcacctagaa

SEQ ID NO: 9216951 - DNA, 21 bp, Homo sapiens
taagcaaggaaagggcagccc

SEQ ID NO: 9216952 - DNA, 22 bp, Homo sapiens
taagaaactatggagaagaact

SEQ ID NO: 9216953 - DNA, 22 bp, Homo sapiens
taagaaactaatgcaataagag

SEQ ID NO: 9216954 - DNA, 22 bp, Homo sapiens
taagaaacccaggaatttctta

SEQ ID NO: 9216955 - DNA, 22 bp, Homo sapiens
taacttctgcacagaaaatttg

SEQ ID NO: 9216956 - DNA, 22 bp, Homo sapiens
taagaaacttaactgggaacta

SEQ ID NO: 9216957 - DNA, 22 bp, Homo sapiens
taagaaatttagttatagaatg

SEQ ID NO: 9216958 - DNA, 22 bp, Homo sapiens
taagaaactgtcacagtactat

SEQ ID NO: 9216959 - DNA, 22 bp, Homo sapiens
taagaaactattgtctctgaac

SEQ ID NO: 9216960 - DNA, 20 bp, Homo sapiens
tacaatattcccactttgct

SEQ ID NO: 9216961 - DNA, 22 bp, Homo sapiens
taatttttccacgtacactggg

SEQ ID NO: 9216962 - DNA, 18 bp, Homo sapiens
taatttgcacagttgcaa

SEQ ID NO: 9216963 - DNA, 20 bp, Homo sapiens
taatttgatatctataagtt

SEQ ID NO: 9216964 - DNA, 22 bp, Homo sapiens
tacaatgttaaggaaagagaga

SEQ ID NO: 9216965 - DNA, 22 bp, Homo sapiens
tacaatttagtggtgtgtggtt

SEQ ID NO: 9216966 - DNA, 22 bp, Homo sapiens
tacacaaaggcactctgttgtt

SEQ ID NO: 9216967 - DNA, 22 bp, Homo sapiens
tacacataggtctgaataaaaa

SEQ ID NO: 9216968 - DNA, 22 bp, Homo sapiens
taataaatgaaagtgctggcat

SEQ ID NO: 9216969 - DNA, 22 bp, Homo sapiens
taataacaattgtaggacatga

SEQ ID NO: 9216970 - DNA, 22 bp, Homo sapiens
taataaatgaaagtgctggcat

SEQ ID NO: 9216971 - DNA, 22 bp, Homo sapiens
taagcatacattctctcctttc

SEQ ID NO: 9216972 - DNA, 20 bp, Homo sapiens
taatgcctcatgatactaga

SEQ ID NO: 9216973 - DNA, 22 bp, Homo sapiens
taatgcctttctgtactatatg

SEQ ID NO: 9216974 - DNA, 22 bp, Homo sapiens
tacagcagcatcgcagtgacct

SEQ ID NO: 9216975 - DNA, 22 bp, Homo sapiens
tacaggaagcactcaagaaatg

SEQ ID NO: 9216976 - DNA, 22 bp, Homo sapiens
tacaggaactgggcaggacatt

SEQ ID NO: 9216977 - DNA, 22 bp, Homo sapiens
tacagtttttcactgaagatgt

SEQ ID NO: 9216978 - DNA, 22 bp, Homo sapiens
tacagttactgttatatgtgct

SEQ ID NO: 9216979 - DNA, 20 bp, Homo sapiens
tacaggaatcaagactgcat

SEQ ID NO: 9216980 - DNA, 22 bp, Homo sapiens
tacatgtctacatgcatttttg

SEQ ID NO: 9216981 - DNA, 22 bp, Homo sapiens
tacattaacttacgtccacatg

SEQ ID NO: 9216982 - DNA, 22 bp, Homo sapiens
tacttgaattggtttctgcaga

SEQ ID NO: 9216983 - DNA, 23 bp, Homo sapiens
tacttgaaatcaggcttacttcc

SEQ ID NO: 9216984 - DNA, 20 bp, Homo sapiens
tactgggtctgggtcctgga

SEQ ID NO: 9216985 - DNA, 22 bp, Homo sapiens
tactgaggctgaattcttagca

SEQ ID NO: 9216986 - DNA, 17 bp, Homo sapiens
tactgaggggtctggag

SEQ ID NO: 9216987 - DNA, 22 bp, Homo sapiens
tactgcgccttcaccaagcggc

SEQ ID NO: 9216988 - DNA, 23 bp, Homo sapiens
tactgcctggggccagagagcgg

SEQ ID NO: 9216989 - DNA, 22 bp, Homo sapiens
tactgcctgggggagacagctg

SEQ ID NO: 9216990 - DNA, 22 bp, Homo sapiens
tacctgagcccagtgcagcata

SEQ ID NO: 9216991 - DNA, 22 bp, Homo sapiens
tactgaaagaatacataatttc

SEQ ID NO: 9216992 - DNA, 22 bp, Homo sapiens
tactgaaagtggtcaacagtgg

SEQ ID NO: 9216993 - DNA, 22 bp, Homo sapiens
tagcccagatgattgaaccatg

SEQ ID NO: 9216994 - DNA, 19 bp, Homo sapiens
tagcccagagcctggctac

SEQ ID NO: 9216995 - DNA, 22 bp, Homo sapiens
tagcccagagagccaggggctt

SEQ ID NO: 9216996 - DNA, 22 bp, Homo sapiens
taggaaggaagagcctcagatt

SEQ ID NO: 9216997 - DNA, 22 bp, Homo sapiens
taggaagatcaagtttatctca

SEQ ID NO: 9216998 - DNA, 22 bp, Homo sapiens
taggaagatgagtatcaacttg

SEQ ID NO: 9216999 - DNA, 22 bp, Homo sapiens
taggaagataaacatttgtatg

SEQ ID NO: 9217000 - DNA, 23 bp, Homo sapiens
taggaagacagcaaaagaatgga

SEQ ID NO: 9217001 - DNA, 22 bp, Homo sapiens
taggaatgtggcaggcagaaca

SEQ ID NO: 9217002 - DNA, 23 bp, Homo sapiens
taggctctgtaggtagagatggg

SEQ ID NO: 9217003 - DNA, 22 bp, Homo sapiens
taggctgaaaggagaggtgaag

SEQ ID NO: 9217004 - DNA, 22 bp, Homo sapiens
taggacaggatcatgatgctgg

SEQ ID NO: 9217005 - DNA, 22 bp, Homo sapiens
taggacagagttccctgatggc

SEQ ID NO: 9217006 - DNA, 22 bp, Homo sapiens
tagtggggaaggaggacaagaa

SEQ ID NO: 9217007 - DNA, 22 bp, Homo sapiens
tagtggggcctgggagggttcc

SEQ ID NO: 9217008 - DNA, 22 bp, Homo sapiens
tagtccaggttaatccctgcct

SEQ ID NO: 9217009 - DNA, 22 bp, Homo sapiens
tagtcctgaccttgccaccagc

SEQ ID NO: 9217010 - DNA, 22 bp, Homo sapiens
tagtcccggaactccttcaggt

SEQ ID NO: 9217011 - DNA, 22 bp, Homo sapiens
tagtatttataatcatgcttaa

SEQ ID NO: 9217012 - DNA, 22 bp, Homo sapiens
tagtattttagaaaaccatgaa

SEQ ID NO: 9217013 - DNA, 22 bp, Homo sapiens
tagtccagaaactgagcttata

SEQ ID NO: 9217014 - DNA, 22 bp, Homo sapiens
tagtcagacccaagagagccat

SEQ ID NO: 9217015 - DNA, 22 bp, Homo sapiens
tagtcagagtcttctctgttgt

SEQ ID NO: 9217016 - DNA, 22 bp, Homo sapiens
tagtcagatatatgacttacgt

SEQ ID NO: 9217017 - DNA, 23 bp, Homo sapiens
tagtcagtatgtaagtctaattg

SEQ ID NO: 9217018 - DNA, 22 bp, Homo sapiens
tagtagcaaaactcatctcttt

SEQ ID NO: 9217019 - DNA, 22 bp, Homo sapiens
tagtagcaggaatctgaaggta

SEQ ID NO: 9217020 - DNA, 22 bp, Homo sapiens
tagtaaacaggcaagggaccac

SEQ ID NO: 9217021 - DNA, 22 bp, Homo sapiens
tagtaaaagtttagttgaaagt

SEQ ID NO: 9217022 - DNA, 22 bp, Homo sapiens
taggtttcagaggtgccgggaa

SEQ ID NO: 9217023 - DNA, 22 bp, Homo sapiens
tagtaaaaggtcttcctttgtt

SEQ ID NO: 9217024 - DNA, 22 bp, Homo sapiens
taggttctctattgcccccaaa

SEQ ID NO: 9217025 - DNA, 22 bp, Homo sapiens
taggttcagagaactgaaaata

SEQ ID NO: 9217026 - DNA, 22 bp, Homo sapiens
taggctgaggttgatgccaggg

SEQ ID NO: 9217027 - DNA, 22 bp, Homo sapiens
taggctgagcttgtagatcgta

SEQ ID NO: 9217028 - DNA, 22 bp, Homo sapiens
taggctgagctaagagagctta

SEQ ID NO: 9217029 - DNA, 22 bp, Homo sapiens
taggctgacttgtttcataaag

SEQ ID NO: 9217030 - DNA, 21 bp, Homo sapiens
tagcacttcgctgtaattggg

SEQ ID NO: 9217031 - DNA, 21 bp, Homo sapiens
tagcagaaacagttcaggcca

SEQ ID NO: 9217032 - DNA, 22 bp, Homo sapiens
tagcagtatattttaaggaagc

SEQ ID NO: 9217033 - DNA, 22 bp, Homo sapiens
tagcagtatggagcgaggccca

SEQ ID NO: 9217034 - DNA, 22 bp, Homo sapiens
tagcaccacaatcaagatacag

SEQ ID NO: 9217035 - DNA, 22 bp, Homo sapiens
tagcacagttcctgactctttg

SEQ ID NO: 9217036 - DNA, 22 bp, Homo sapiens
tagcaccaaaactgaagaacat

SEQ ID NO: 9217037 - DNA, 22 bp, Homo sapiens
tagccaggcgaggtcagtgtcg

SEQ ID NO: 9217038 - DNA, 22 bp, Homo sapiens
tagccaggcgaggtcagtgtcg

SEQ ID NO: 9217039 - DNA, 22 bp, Homo sapiens
tagattaacagttttgttgaag

SEQ ID NO: 9217040 - DNA, 22 bp, Homo sapiens
tagattaagatgccagttttga

SEQ ID NO: 9217041 - DNA, 22 bp, Homo sapiens
tagatgttccacatatatatgt

SEQ ID NO: 9217042 - DNA, 20 bp, Homo sapiens
tagatgtttcctgtcataaa

SEQ ID NO: 9217043 - DNA, 22 bp, Homo sapiens
tagatgaccttgtgttaggcaa

SEQ ID NO: 9217044 - DNA, 22 bp, Homo sapiens
tagaggcaaccagtgttgagaa

SEQ ID NO: 9217045 - DNA, 22 bp, Homo sapiens
tagaggcacagtctatgtagag

SEQ ID NO: 9217046 - DNA, 22 bp, Homo sapiens
tagaggcaccctggaggagact

SEQ ID NO: 9217047 - DNA, 17 bp, Homo sapiens
tagagcccacccgctgg

SEQ ID NO: 9217048 - DNA, 23 bp, Homo sapiens
tagagcagtagatcaccatggga

SEQ ID NO: 9217049 - DNA, 22 bp, Homo sapiens
tagagcagtgggtaccatggca

SEQ ID NO: 9217050 - DNA, 22 bp, Homo sapiens
tagagcagtgttgtccatcaga

SEQ ID NO: 9217051 - DNA, 22 bp, Homo sapiens
tagagcagttggcagctgtatt

SEQ ID NO: 9217052 - DNA, 22 bp, Homo sapiens
tagagcagatagtgaaacagaa

SEQ ID NO: 9217053 - DNA, 22 bp, Homo sapiens
tagagcagaacttgttaacacc

SEQ ID NO: 9217054 - DNA, 22 bp, Homo sapiens
tagagcagaacttgttaacacc

SEQ ID NO: 9217055 - DNA, 22 bp, Homo sapiens
tagagcagccttcagagcagtt

SEQ ID NO: 9217056 - DNA, 22 bp, Homo sapiens
tagagcagccttcagagcagtt

SEQ ID NO: 9217057 - DNA, 23 bp, Homo sapiens
tagagcagggaaatctgtcagag

SEQ ID NO: 9217058 - DNA, 22 bp, Homo sapiens
tagaataagttgatgatatatg

SEQ ID NO: 9217059 - DNA, 22 bp, Homo sapiens
tagaagttaggaaataggaata

SEQ ID NO: 9217060 - DNA, 22 bp, Homo sapiens
tagaaggctttgagagatactt

SEQ ID NO: 9217061 - DNA, 22 bp, Homo sapiens
tatgcacattcacacaaaaatg

SEQ ID NO: 9217062 - DNA, 22 bp, Homo sapiens
tatctgtttttacagtgtcttt

SEQ ID NO: 9217063 - DNA, 22 bp, Homo sapiens
tatcttcttgccaggctggtgt

SEQ ID NO: 9217064 - DNA, 22 bp, Homo sapiens
tatcttctcagtatatgggatg

SEQ ID NO: 9217065 - DNA, 18 bp, Homo sapiens
tatatttcacacatattc

SEQ ID NO: 9217066 - DNA, 22 bp, Homo sapiens
tatattttagacaccctcacgc

SEQ ID NO: 9217067 - DNA, 20 bp, Homo sapiens
tatattttctctttggcctt

SEQ ID NO: 9217068 - DNA, 22 bp, Homo sapiens
tatctataagtactaacatggt

SEQ ID NO: 9217069 - DNA, 22 bp, Homo sapiens
tatcaacattaatattttctgg

SEQ ID NO: 9217070 - DNA, 22 bp, Homo sapiens
tatattatcataaaaccattca

SEQ ID NO: 9217071 - DNA, 22 bp, Homo sapiens
tatattacctgcctgatctata

SEQ ID NO: 9217072 - DNA, 22 bp, Homo sapiens
tatagcaactccaaagagactt

SEQ ID NO: 9217073 - DNA, 22 bp, Homo sapiens
tataccatgtgtgcacactccc

SEQ ID NO: 9217074 - DNA, 22 bp, Homo sapiens
tatacagatatctaagatgtaa

SEQ ID NO: 9217075 - DNA, 22 bp, Homo sapiens
tagtgtttagtacatatgcata

SEQ ID NO: 9217076 - DNA, 22 bp, Homo sapiens
tagttaaagccctaaattgata

SEQ ID NO: 9217077 - DNA, 22 bp, Homo sapiens
tagttaaagattctgttaagag

SEQ ID NO: 9217078 - DNA, 21 bp, Homo sapiens
tatacagaggggaacaggaga

SEQ ID NO: 9217079 - DNA, 22 bp, Homo sapiens
tatttcaacgtatgaaaagctg

SEQ ID NO: 9217080 - DNA, 22 bp, Homo sapiens
tatttcacataccacagagtgt

SEQ ID NO: 9217081 - DNA, 22 bp, Homo sapiens
tattgtacatttcaaagtagct

SEQ ID NO: 9217082 - DNA, 22 bp, Homo sapiens
tattgtactgaggaataaagct

SEQ ID NO: 9217083 - DNA, 22 bp, Homo sapiens
tattgtacatttccaaattgct

SEQ ID NO: 9217084 - DNA, 22 bp, Homo sapiens
tattgtacatttcaaaattgct

SEQ ID NO: 9217085 - DNA, 23 bp, Homo sapiens
tattgcacaaagagatgcacagg

SEQ ID NO: 9217086 - DNA, 22 bp, Homo sapiens
tatttgtatgtgtgtacatata

SEQ ID NO: 9217087 - DNA, 22 bp, Homo sapiens
tattttcaccttctctggatat

SEQ ID NO: 9217088 - DNA, 22 bp, Homo sapiens
tattttcattctgtgtgactgt

SEQ ID NO: 9217089 - DNA, 22 bp, Homo sapiens
tattttcatcttgtccttggat

SEQ ID NO: 9217090 - DNA, 22 bp, Homo sapiens
tatgcctgataactgtgtctct

SEQ ID NO: 9217091 - DNA, 22 bp, Homo sapiens
tatgcctggggtgctcaggcca

SEQ ID NO: 9217092 - DNA, 21 bp, Homo sapiens
tatgcctgatttctaatgatg

SEQ ID NO: 9217093 - DNA, 22 bp, Homo sapiens
tatgcctggaacctttctcttt

SEQ ID NO: 9217094 - DNA, 22 bp, Homo sapiens
tatgctattcttcagagtgttc

SEQ ID NO: 9217095 - DNA, 22 bp, Homo sapiens
tatgcctgtctcaccattgtat

SEQ ID NO: 9217096 - DNA, 17 bp, Homo sapiens
tatgtgtgtgtttatac

SEQ ID NO: 9217097 - DNA, 22 bp, Homo sapiens
tattcacaaaatgaggtcctca

SEQ ID NO: 9217098 - DNA, 22 bp, Homo sapiens
tattcacagctgccgcactcag

SEQ ID NO: 9217099 - DNA, 22 bp, Homo sapiens
tattcacaggctggagtgatgt

SEQ ID NO: 9217100 - DNA, 22 bp, Homo sapiens
tattcacatgtacatatgctca

SEQ ID NO: 9217101 - DNA, 22 bp, Homo sapiens
tattcacattctcaggcctggt

SEQ ID NO: 9217102 - DNA, 22 bp, Homo sapiens
tattgagttacagaaaatactt

SEQ ID NO: 9217103 - DNA, 17 bp, Homo sapiens
tattgacctttgtatgt

SEQ ID NO: 9217104 - DNA, 22 bp, Homo sapiens
cctgctcctgctattcttctgg

SEQ ID NO: 9217105 - DNA, 22 bp, Homo sapiens
tgttcccaagataagattatga

SEQ ID NO: 9217106 - DNA, 22 bp, Homo sapiens
tgttgattagtgtttagactta

SEQ ID NO: 9217107 - DNA, 22 bp, Homo sapiens
tgttggcatctctgagagagtt

SEQ ID NO: 9217108 - DNA, 22 bp, Homo sapiens
tgttgcccaggttctctcctgc

SEQ ID NO: 9217109 - DNA, 22 bp, Homo sapiens
tgttgcccaggttctctcctgc

SEQ ID NO: 9217110 - DNA, 22 bp, Homo sapiens
tggttccaatcgcactggctca

SEQ ID NO: 9217111 - DNA, 22 bp, Homo sapiens
tggttccactaacctgagagcc

SEQ ID NO: 9217112 - DNA, 22 bp, Homo sapiens
tggttccactaacctgagagcc

SEQ ID NO: 9217113 - DNA, 22 bp, Homo sapiens
tggttccagttttcaatagagc

SEQ ID NO: 9217114 - DNA, 22 bp, Homo sapiens
tggttcctacgcacattgaatt

SEQ ID NO: 9217115 - DNA, 22 bp, Homo sapiens
tggttccaagatggctgccaca

SEQ ID NO: 9217116 - DNA, 17 bp, Homo sapiens
tggttccaaccatacgc

SEQ ID NO: 9217117 - DNA, 22 bp, Homo sapiens
cctgctcagagcgtcttgtgtg

SEQ ID NO: 9217118 - DNA, 22 bp, Homo sapiens
cctgctcacctgatgtggcaac

SEQ ID NO: 9217119 - DNA, 22 bp, Homo sapiens
cctgctcagccccagctcaccc

SEQ ID NO: 9217120 - DNA, 23 bp, Homo sapiens
cctgctcaggcgtgtgccctgct

SEQ ID NO: 9217121 - DNA, 22 bp, Homo sapiens
cctggggagaagagcttccccc

SEQ ID NO: 9217122 - DNA, 22 bp, Homo sapiens
cctggggagagaaagcccagcc

SEQ ID NO: 9217123 - DNA, 22 bp, Homo sapiens
cctggggagccgcctgagcccc

SEQ ID NO: 9217124 - DNA, 23 bp, Homo sapiens
cctggggagctgtatccagagtg

SEQ ID NO: 9217125 - DNA, 23 bp, Homo sapiens
cctggggcacttgagtcctcatc

SEQ ID NO: 9217126 - DNA, 23 bp, Homo sapiens
cctggggcacttgagtcctcatc

SEQ ID NO: 9217127 - DNA, 22 bp, Homo sapiens
cctggggattctgacacggagt

SEQ ID NO: 9217128 - DNA, 22 bp, Homo sapiens
cctggggctcaagatggcgccg

SEQ ID NO: 9217129 - DNA, 22 bp, Homo sapiens
ttaaaagagcagcccagcatat

SEQ ID NO: 9217130 - DNA, 22 bp, Homo sapiens
tgttttctattacctgagattg

SEQ ID NO: 9217131 - DNA, 22 bp, Homo sapiens
cctgtaggcgagggatggacag

SEQ ID NO: 9217132 - DNA, 20 bp, Homo sapiens
ttaagcattattactcccag

SEQ ID NO: 9217133 - DNA, 22 bp, Homo sapiens
ttaatatacaattttacgggct

SEQ ID NO: 9217134 - DNA, 22 bp, Homo sapiens
ttaatagtgctaaaccattgac

SEQ ID NO: 9217135 - DNA, 23 bp, Homo sapiens
ttacaagttctgaaatttccttc

SEQ ID NO: 9217136 - DNA, 22 bp, Homo sapiens
ttacaagtttctggcttcatcc

SEQ ID NO: 9217137 - DNA, 22 bp, Homo sapiens
cctgtggcgggggccagtgcct

SEQ ID NO: 9217138 - DNA, 22 bp, Homo sapiens
cctgtggcgggggccagtgcct

SEQ ID NO: 9217139 - DNA, 22 bp, Homo sapiens
ttacaagtatttaagatgctgt

SEQ ID NO: 9217140 - DNA, 22 bp, Homo sapiens
ttacaagtactgaatatgattt

SEQ ID NO: 9217141 - DNA, 22 bp, Homo sapiens
ttatgtacaatgttaatgtaaa

SEQ ID NO: 9217142 - DNA, 22 bp, Homo sapiens
ttatgggagcaattggggaggt

SEQ ID NO: 9217143 - DNA, 22 bp, Homo sapiens
cgagcagagcagagacgtctgg

SEQ ID NO: 9217144 - DNA, 22 bp, Homo sapiens
cgagcagaagcctggtggtctg

SEQ ID NO: 9217145 - DNA, 22 bp, Homo sapiens
cgagcagaatggagggtgccga

SEQ ID NO: 9217146 - DNA, 22 bp, Homo sapiens
cctttggctgcatagggaaggg

SEQ ID NO: 9217147 - DNA, 22 bp, Homo sapiens
cctttggccgctttatggagga

SEQ ID NO: 9217148 - DNA, 22 bp, Homo sapiens
cctttggagcaactgagagcta

SEQ ID NO: 9217149 - DNA, 17 bp, Homo sapiens
ttattttttgggctgag

SEQ ID NO: 9217150 - DNA, 22 bp, Homo sapiens
cgcactggagctggaacgagtc

SEQ ID NO: 9217151 - DNA, 23 bp, Homo sapiens
ttattttgtcagaagggactttt

SEQ ID NO: 9217152 - DNA, 23 bp, Homo sapiens
ttattttgtcagaagggactttt

SEQ ID NO: 9217153 - DNA, 22 bp, Homo sapiens
ttatttttaaaagttcacacag

SEQ ID NO: 9217154 - DNA, 22 bp, Homo sapiens
ttatttttaaaagttcacacag

SEQ ID NO: 9217155 - DNA, 22 bp, Homo sapiens
ttattattttgtgtacagcaaa

SEQ ID NO: 9217156 - DNA, 20 bp, Homo sapiens
ccttctctggaattgcctcc

SEQ ID NO: 9217157 - DNA, 22 bp, Homo sapiens
ccttcttcaccagtttacctga

SEQ ID NO: 9217158 - DNA, 22 bp, Homo sapiens
ccttggtgatctgggctggaag

SEQ ID NO: 9217159 - DNA, 19 bp, Homo sapiens
ccttgcctgtccctgcagc

SEQ ID NO: 9217160 - DNA, 22 bp, Homo sapiens
ccttggctgtgttgcctgccct

SEQ ID NO: 9217161 - DNA, 22 bp, Homo sapiens
ttacctgcaactcccatggtga

SEQ ID NO: 9217162 - DNA, 22 bp, Homo sapiens
ttacctgcaactcccatggtga

SEQ ID NO: 9217163 - DNA, 22 bp, Homo sapiens
ccttgggcttgggcatagcttt

SEQ ID NO: 9217164 - DNA, 21 bp, Homo sapiens
ccttgggatgcaagtgagact

SEQ ID NO: 9217165 - DNA, 22 bp, Homo sapiens
ccttgggatttctcatgccaat

SEQ ID NO: 9217166 - DNA, 22 bp, Homo sapiens
ccttgggatgcataagagccca

SEQ ID NO: 9217167 - DNA, 22 bp, Homo sapiens
ccttgggagaaattgcagagtc

SEQ ID NO: 9217168 - DNA, 22 bp, Homo sapiens
ccttgggaggcataattacttg

SEQ ID NO: 9217169 - DNA, 22 bp, Homo sapiens
ccttgggaggctcccagggaga

SEQ ID NO: 9217170 - DNA, 22 bp, Homo sapiens
ccttgggaccctgctggaggtt

SEQ ID NO: 9217171 - DNA, 20 bp, Homo sapiens
ccttgggaaacaaagtagag

SEQ ID NO: 9217172 - DNA, 22 bp, Homo sapiens
ccttgggacagccagcttcaga

SEQ ID NO: 9217173 - DNA, 22 bp, Homo sapiens
ttgcaaaaaccacaattacttt

SEQ ID NO: 9217174 - DNA, 22 bp, Homo sapiens
ttgcaaaaactgcaattacttt

SEQ ID NO: 9217175 - DNA, 22 bp, Homo sapiens
ttgcaaaagccgaggcactcca

SEQ ID NO: 9217176 - DNA, 22 bp, Homo sapiens
ttgcaaaatcatttctcaggat

SEQ ID NO: 9217177 - DNA, 22 bp, Homo sapiens
ctcagcagtgacaagagagtat

SEQ ID NO: 9217178 - DNA, 22 bp, Homo sapiens
ctcaggcccacagcagacccac

SEQ ID NO: 9217179 - DNA, 22 bp, Homo sapiens
ctcaggccattcttccagctgc

SEQ ID NO: 9217180 - DNA, 22 bp, Homo sapiens
ctcaggccaggtttctcccaca

SEQ ID NO: 9217181 - DNA, 22 bp, Homo sapiens
ctcagccatgcaacatgctggg

SEQ ID NO: 9217182 - DNA, 22 bp, Homo sapiens
ctcagccatggggtggatcagc

SEQ ID NO: 9217183 - DNA, 22 bp, Homo sapiens
ctcagccatgtcatgcctacct

SEQ ID NO: 9217184 - DNA, 22 bp, Homo sapiens
ctcagccagacatgacccagtc

SEQ ID NO: 9217185 - DNA, 22 bp, Homo sapiens
ctcagccagtgatctttccttt

SEQ ID NO: 9217186 - DNA, 22 bp, Homo sapiens
ctcagccatgcaacatgctggg

SEQ ID NO: 9217187 - DNA, 22 bp, Homo sapiens
ctcagccagtgatctttccttt

SEQ ID NO: 9217188 - DNA, 22 bp, Homo sapiens
ctcagccaggtgggggtcggga

SEQ ID NO: 9217189 - DNA, 22 bp, Homo sapiens
ctcagccaggagagtgttcaca

SEQ ID NO: 9217190 - DNA, 22 bp, Homo sapiens
ttgctgtagctactatgtattc

SEQ ID NO: 9217191 - DNA, 22 bp, Homo sapiens
ttgctggcaatttagagatttc

SEQ ID NO: 9217192 - DNA, 22 bp, Homo sapiens
ctcaggccttgaagtcttttct

SEQ ID NO: 9217193 - DNA, 21 bp, Homo sapiens
ttgcaccatgataaattcaga

SEQ ID NO: 9217194 - DNA, 22 bp, Homo sapiens
ttgcaccaaatgagttaaaatt

SEQ ID NO: 9217195 - DNA, 22 bp, Homo sapiens
ttgcactgtaagcatctgtgtc

SEQ ID NO: 9217196 - DNA, 22 bp, Homo sapiens
ttgcactccagcccgagcaaca

SEQ ID NO: 9217197 - DNA, 23 bp, Homo sapiens
ttgcactgatcaatttgataagc

SEQ ID NO: 9217198 - DNA, 22 bp, Homo sapiens
ttcttaagcagtttggcatgtt

SEQ ID NO: 9217199 - DNA, 22 bp, Homo sapiens
ttcttaagtcagtaagatgcaa

SEQ ID NO: 9217200 - DNA, 22 bp, Homo sapiens
ttcttaagagggttaagtgaag

SEQ ID NO: 9217201 - DNA, 22 bp, Homo sapiens
ttctgaaataggagatagctgt

SEQ ID NO: 9217202 - DNA, 22 bp, Homo sapiens
ttctctttttgcatctcaacct

SEQ ID NO: 9217203 - DNA, 23 bp, Homo sapiens
ttctgaaaatagatagtggctcc

SEQ ID NO: 9217204 - DNA, 22 bp, Homo sapiens
ttgaaatatcaagttattagtg

SEQ ID NO: 9217205 - DNA, 22 bp, Homo sapiens
ttgaaatatcaagttattagtg

SEQ ID NO: 9217206 - DNA, 22 bp, Homo sapiens
ctcactgtgacctcagcagaca

SEQ ID NO: 9217207 - DNA, 22 bp, Homo sapiens
ctcactgtctgtactagctgat

SEQ ID NO: 9217208 - DNA, 22 bp, Homo sapiens
ctcactgtccaacaggctttac

SEQ ID NO: 9217209 - DNA, 22 bp, Homo sapiens
ctcactgtttaatagctggatc

SEQ ID NO: 9217210 - DNA, 22 bp, Homo sapiens
ctagtgtttggaagtcatagcc

SEQ ID NO: 9217211 - DNA, 22 bp, Homo sapiens
ttctccttgaaaagctgcatct

SEQ ID NO: 9217212 - DNA, 22 bp, Homo sapiens
ttctccttgttcccttcaattg

SEQ ID NO: 9217213 - DNA, 22 bp, Homo sapiens
ttctccttggtttatgggacat

SEQ ID NO: 9217214 - DNA, 22 bp, Homo sapiens
ttctcctttgtaattctcatcc

SEQ ID NO: 9217215 - DNA, 22 bp, Homo sapiens
ctacatttacacagttaggctt

SEQ ID NO: 9217216 - DNA, 22 bp, Homo sapiens
ttctcaggtgaggctgaggctg

SEQ ID NO: 9217217 - DNA, 22 bp, Homo sapiens
ttctcctgcgcaggcccaggga

SEQ ID NO: 9217218 - DNA, 22 bp, Homo sapiens
ctacatctcaccttccaggaca

SEQ ID NO: 9217219 - DNA, 22 bp, Homo sapiens
ctaactttagcttagattatca

SEQ ID NO: 9217220 - DNA, 22 bp, Homo sapiens
ctaactttatttgctaagtaga

SEQ ID NO: 9217221 - DNA, 21 bp, Homo sapiens
ctaactttgagtcctggcccc

SEQ ID NO: 9217222 - DNA, 22 bp, Homo sapiens
ctaactttgtcatcttcccttt

SEQ ID NO: 9217223 - DNA, 21 bp, Homo sapiens
ttctacaggatgaatgaaaac

SEQ ID NO: 9217224 - DNA, 22 bp, Homo sapiens
ctaacatttggaaggcttatga

SEQ ID NO: 9217225 - DNA, 22 bp, Homo sapiens
ctaacatttattgagcacttag

SEQ ID NO: 9217226 - DNA, 22 bp, Homo sapiens
ttcagtttcgttatctatgaga

SEQ ID NO: 9217227 - DNA, 22 bp, Homo sapiens
cgcagctcttaccctcccctta

SEQ ID NO: 9217228 - DNA, 21 bp, Homo sapiens
ttcctctgcaactgatgctca

SEQ ID NO: 9217229 - DNA, 21 bp, Homo sapiens
ttcctctgcaactgatgctca

SEQ ID NO: 9217230 - DNA, 22 bp, Homo sapiens
cgtctggcttctccacggtaaa

SEQ ID NO: 9217231 - DNA, 22 bp, Homo sapiens
ttcctccagcctggagcacttc

SEQ ID NO: 9217232 - DNA, 22 bp, Homo sapiens
ttcctccagtcagagctgtccc

SEQ ID NO: 9217233 - DNA, 22 bp, Homo sapiens
ttcctccatccttagggagagc

SEQ ID NO: 9217234 - DNA, 22 bp, Homo sapiens
ttccactggctttcagtgatct

SEQ ID NO: 9217235 - DNA, 22 bp, Homo sapiens
ttccactgattttggttgacct

SEQ ID NO: 9217236 - DNA, 22 bp, Homo sapiens
ttccagaaagttctggaactgg

SEQ ID NO: 9217237 - DNA, 22 bp, Homo sapiens
ttccagaaaactctgcctggta

SEQ ID NO: 9217238 - DNA, 22 bp, Homo sapiens
ttccagaaaaaaatgtatatct

SEQ ID NO: 9217239 - DNA, 22 bp, Homo sapiens
cgtcccagttccagccgcgctg

SEQ ID NO: 9217240 - DNA, 22 bp, Homo sapiens
ctcaggctggtccttagtgaca

SEQ ID NO: 9217241 - DNA, 22 bp, Homo sapiens
ctcaggctccagacttccgtcc

SEQ ID NO: 9217242 - DNA, 22 bp, Homo sapiens
ctcaggctctgtactccctttg

SEQ ID NO: 9217243 - DNA, 22 bp, Homo sapiens
ctcaggctaagaaggccaagtg

SEQ ID NO: 9217244 - DNA, 22 bp, Homo sapiens
ctccccaagccttggcttctcc

SEQ ID NO: 9217245 - DNA, 22 bp, Homo sapiens
ctccccaagccttggcttctcc

SEQ ID NO: 9217246 - DNA, 22 bp, Homo sapiens
ctccccaagtcatggagccagg

SEQ ID NO: 9217247 - DNA, 22 bp, Homo sapiens
ctccccacgcctggactaagag

SEQ ID NO: 9217248 - DNA, 22 bp, Homo sapiens
ctccccagctcgcgggtgacgg

SEQ ID NO: 9217249 - DNA, 22 bp, Homo sapiens
ctccccagcattctgacttcct

SEQ ID NO: 9217250 - DNA, 22 bp, Homo sapiens
ctccccaggttcaggaggtggg

SEQ ID NO: 9217251 - DNA, 22 bp, Homo sapiens
ttgtttaatgcctcatacatct

SEQ ID NO: 9217252 - DNA, 22 bp, Homo sapiens
ttgtttaatatcgtgaagtact

SEQ ID NO: 9217253 - DNA, 22 bp, Homo sapiens
ctccctctgtcttgtccagaaa

SEQ ID NO: 9217254 - DNA, 22 bp, Homo sapiens
ctccctgaaattcagatgcctc

SEQ ID NO: 9217255 - DNA, 22 bp, Homo sapiens
ctccctgaggacaggccctgtc

SEQ ID NO: 9217256 - DNA, 22 bp, Homo sapiens
ctccctgcttgtttcccttcag

SEQ ID NO: 9217257 - DNA, 22 bp, Homo sapiens
ctccctggaggtgagctggcac

SEQ ID NO: 9217258 - DNA, 22 bp, Homo sapiens
ctccctggcacagcgagaggtt

SEQ ID NO: 9217259 - DNA, 22 bp, Homo sapiens
ctccctggcagccgcactcctg

SEQ ID NO: 9217260 - DNA, 22 bp, Homo sapiens
ctccctggcagccgcactcctg

SEQ ID NO: 9217261 - DNA, 23 bp, Homo sapiens
ctccctggagtttctggaagatg

SEQ ID NO: 9217262 - DNA, 22 bp, Homo sapiens
ctccctgggcagatgtggctct

SEQ ID NO: 9217263 - DNA, 22 bp, Homo sapiens
ctccctggtgtcccctccagga

SEQ ID NO: 9217264 - DNA, 22 bp, Homo sapiens
ctccctggtctttcccatcatt

SEQ ID NO: 9217265 - DNA, 22 bp, Homo sapiens
ctccctgtgtcttcacttggcc

SEQ ID NO: 9217266 - DNA, 22 bp, Homo sapiens
ctcctcagctgggaggagtccc

SEQ ID NO: 9217267 - DNA, 21 bp, Homo sapiens
ctcctcaggaccagccacagg

SEQ ID NO: 9217268 - DNA, 22 bp, Homo sapiens
ctcctcaggaagtagcatgtgt

SEQ ID NO: 9217269 - DNA, 22 bp, Homo sapiens
ctccttcctggttagcacctta

SEQ ID NO: 9217270 - DNA, 22 bp, Homo sapiens
ctctaaaggcttgttattgcat

SEQ ID NO: 9217271 - DNA, 22 bp, Homo sapiens
ctcctgtggtcaagggtgggac

SEQ ID NO: 9217272 - DNA, 22 bp, Homo sapiens
tttatattacctggaatagctt

SEQ ID NO: 9217273 - DNA, 22 bp, Homo sapiens
ctcctgctgaatggccaggagc

SEQ ID NO: 9217274 - DNA, 22 bp, Homo sapiens
tttacacataaatgtgtagaca

SEQ ID NO: 9217275 - DNA, 22 bp, Homo sapiens
tttacacatacctctttaaagt

SEQ ID NO: 9217276 - DNA, 22 bp, Homo sapiens
tttacacaaaatgttagtagat

SEQ ID NO: 9217277 - DNA, 22 bp, Homo sapiens
tttacacaaaagatagcacacc

SEQ ID NO: 9217278 - DNA, 22 bp, Homo sapiens
tttacaagtttacagaatgatg

SEQ ID NO: 9217279 - DNA, 22 bp, Homo sapiens
tttacaattctctaccagtgtt

SEQ ID NO: 9217280 - DNA, 22 bp, Homo sapiens
tttacacaaaagatagcacacc

SEQ ID NO: 9217281 - DNA, 22 bp, Homo sapiens
ctcctggatcttagccagattc

SEQ ID NO: 9217282 - DNA, 22 bp, Homo sapiens
tttatatatggctggtctggat

SEQ ID NO: 9217283 - DNA, 22 bp, Homo sapiens
tttctctctatttagacaggta

SEQ ID NO: 9217284 - DNA, 22 bp, Homo sapiens
tttctctcagcctgtagaaact

SEQ ID NO: 9217285 - DNA, 22 bp, Homo sapiens
ctctctggaagggggagctgat

SEQ ID NO: 9217286 - DNA, 22 bp, Homo sapiens
ctctctggaattaaagcccaat

SEQ ID NO: 9217287 - DNA, 20 bp, Homo sapiens
ctctctggaaggtgggagcc

SEQ ID NO: 9217288 - DNA, 22 bp, Homo sapiens
ctctctggacctcaactatttt

SEQ ID NO: 9217289 - DNA, 22 bp, Homo sapiens
ctctctggacttgagtatcagc

SEQ ID NO: 9217290 - DNA, 20 bp, Homo sapiens
ctctattattaatttcttaa

SEQ ID NO: 9217291 - DNA, 22 bp, Homo sapiens
tttctcagaatataaaattctc

SEQ ID NO: 9217292 - DNA, 22 bp, Homo sapiens
tttctcagaatataaaattctc

SEQ ID NO: 9217293 - DNA, 18 bp, Homo sapiens
tttctcagactctctttc

SEQ ID NO: 9217294 - DNA, 22 bp, Homo sapiens
ctctaggctgcccaggagctga

SEQ ID NO: 9217295 - DNA, 22 bp, Homo sapiens
ctctaggctgcccaggagctga

SEQ ID NO: 9217296 - DNA, 22 bp, Homo sapiens
ctctagagtacgggctggcatg

SEQ ID NO: 9217297 - DNA, 22 bp, Homo sapiens
ctctgagctgaaacatgagcat

SEQ ID NO: 9217298 - DNA, 22 bp, Homo sapiens
ctctctggcccatcctgttgcc

SEQ ID NO: 9217299 - DNA, 22 bp, Homo sapiens
ctctctggcccatcctgttgcc

SEQ ID NO: 9217300 - DNA, 22 bp, Homo sapiens
ctctctggcacttcattgctgt

SEQ ID NO: 9217301 - DNA, 22 bp, Homo sapiens
ctctctggcacttcattgctgt

SEQ ID NO: 9217302 - DNA, 22 bp, Homo sapiens
ctctctggatatttgtatgctg

SEQ ID NO: 9217303 - DNA, 22 bp, Homo sapiens
ctctctggatatttgtatgctg

SEQ ID NO: 9217304 - DNA, 20 bp, Homo sapiens
ctctgctgcgcatcccactt

SEQ ID NO: 9217305 - DNA, 22 bp, Homo sapiens
ctctgctggccatgaagagaga

SEQ ID NO: 9217306 - DNA, 19 bp, Homo sapiens
ctctgcctctggctgtggc

SEQ ID NO: 9217307 - DNA, 22 bp, Homo sapiens
ctctgcttcatccaccactggc

SEQ ID NO: 9217308 - DNA, 22 bp, Homo sapiens
ctctgctgtctcagatgggcca

SEQ ID NO: 9217309 - DNA, 22 bp, Homo sapiens
tttcttcttgagtaaccagatt

SEQ ID NO: 9217310 - DNA, 22 bp, Homo sapiens
tttcttcttgatttaaacaggg

SEQ ID NO: 9217311 - DNA, 22 bp, Homo sapiens
tttcttcttgagtaaccagatt

SEQ ID NO: 9217312 - DNA, 22 bp, Homo sapiens
tttcttcttgatttaaacaggg

SEQ ID NO: 9217313 - DNA, 22 bp, Homo sapiens
tttcttgaccactatgttgata

SEQ ID NO: 9217314 - DNA, 22 bp, Homo sapiens
tttcttctgtttgtagttacac

SEQ ID NO: 9217315 - DNA, 22 bp, Homo sapiens
ctctggaggccgttggccctta

SEQ ID NO: 9217316 - DNA, 22 bp, Homo sapiens
ctctggaggccgttggccctta

SEQ ID NO: 9217317 - DNA, 22 bp, Homo sapiens
ctctggaggcctaaggaagtgg

SEQ ID NO: 9217318 - DNA, 22 bp, Homo sapiens
ctctggagggaggctgagctgg

SEQ ID NO: 9217319 - DNA, 22 bp, Homo sapiens
tttgaagggcacgacaatagtt

SEQ ID NO: 9217320 - DNA, 22 bp, Homo sapiens
ctctgcttgtgtcaggcatgct

SEQ ID NO: 9217321 - DNA, 22 bp, Homo sapiens
ctctggaattgacctgggaggg

SEQ ID NO: 9217322 - DNA, 22 bp, Homo sapiens
tttgaagtgtatgaaaatacag

SEQ ID NO: 9217323 - DNA, 22 bp, Homo sapiens
ctgagaggtaagcagcgcagtg

SEQ ID NO: 9217324 - DNA, 22 bp, Homo sapiens
ctgagagatgatatagcttaat

SEQ ID NO: 9217325 - DNA, 22 bp, Homo sapiens
ctgagctgggagtagagactct

SEQ ID NO: 9217326 - DNA, 22 bp, Homo sapiens
ctgagatctttatacgaggcac

SEQ ID NO: 9217327 - DNA, 22 bp, Homo sapiens
ctgagggaacttgggcaagtct

SEQ ID NO: 9217328 - DNA, 22 bp, Homo sapiens
ctgagggatgggctgggccgcc

SEQ ID NO: 9217329 - DNA, 22 bp, Homo sapiens
ctgagctgtttaatcccagata

SEQ ID NO: 9217330 - DNA, 22 bp, Homo sapiens
ctgagcttaaccctgttagcaa

SEQ ID NO: 9217331 - DNA, 22 bp, Homo sapiens
ctgagcttcagtgcactgggag

SEQ ID NO: 9217332 - DNA, 22 bp, Homo sapiens
ctgagctgttactctgtcctcg

SEQ ID NO: 9217333 - DNA, 22 bp, Homo sapiens
tttttctcttctgtaaagtggt

SEQ ID NO: 9217334 - DNA, 22 bp, Homo sapiens
tttttctagaccttaaaggcca

SEQ ID NO: 9217335 - DNA, 19 bp, Homo sapiens
tttttacaagtaggtgtga

SEQ ID NO: 9217336 - DNA, 22 bp, Homo sapiens
ttttctctatattgtctgtgaa

SEQ ID NO: 9217337 - DNA, 22 bp, Homo sapiens
ttttctctacaaaataaccagc

SEQ ID NO: 9217338 - DNA, 22 bp, Homo sapiens
ctctggagtgcagcctggtggc

SEQ ID NO: 9217339 - DNA, 22 bp, Homo sapiens
ttttcagttgtgctctctagtt

SEQ ID NO: 9217340 - DNA, 22 bp, Homo sapiens
ttttcagtttgcactgcagtgc

SEQ ID NO: 9217341 - DNA, 22 bp, Homo sapiens
ttttctcaggtgcttatctaag

SEQ ID NO: 9217342 - DNA, 22 bp, Homo sapiens
ctgaaggcttgttgttttctta

SEQ ID NO: 9217343 - DNA, 22 bp, Homo sapiens
ctgaaagcaaagtaattcttaa

SEQ ID NO: 9217344 - DNA, 22 bp, Homo sapiens
tttttcttgtgctggatctaat

SEQ ID NO: 9217345 - DNA, 22 bp, Homo sapiens
ctgaaaatgttacacaggaaga

SEQ ID NO: 9217346 - DNA, 22 bp, Homo sapiens
ctgaaaagctttgaaccgttaa

SEQ ID NO: 9217347 - DNA, 22 bp, Homo sapiens
ctgagggctggagctgaggcct

SEQ ID NO: 9217348 - DNA, 22 bp, Homo sapiens
ctgagggcctgaggacctagat

SEQ ID NO: 9217349 - DNA, 22 bp, Homo sapiens
ctgcagtgaaatcaggaagcaa

SEQ ID NO: 9217350 - DNA, 22 bp, Homo sapiens
ctgccctgagtcatgccagatg

SEQ ID NO: 9217351 - DNA, 22 bp, Homo sapiens
ctgccctgagtcatgccagatg

SEQ ID NO: 9217352 - DNA, 22 bp, Homo sapiens
ctgccctgcttgtttccagtgg

SEQ ID NO: 9217353 - DNA, 22 bp, Homo sapiens
ctgcctctgttgggcatggtct

SEQ ID NO: 9217354 - DNA, 22 bp, Homo sapiens
ctgcctctattcactgaggcag

SEQ ID NO: 9217355 - DNA, 22 bp, Homo sapiens
ctgcctctattcactgaggcag

SEQ ID NO: 9217356 - DNA, 22 bp, Homo sapiens
ctgctcctggtcatcctccact

SEQ ID NO: 9217357 - DNA, 22 bp, Homo sapiens
ctgctcctccccatcaggcagc

SEQ ID NO: 9217358 - DNA, 22 bp, Homo sapiens
ctgctccagtagccccatgtgg

SEQ ID NO: 9217359 - DNA, 22 bp, Homo sapiens
ctgctccaagccagccctgcag

SEQ ID NO: 9217360 - DNA, 22 bp, Homo sapiens
ctgctccaagccagccctgcag

SEQ ID NO: 9217361 - DNA, 19 bp, Homo sapiens
ctgctccaggagctgggga

SEQ ID NO: 9217362 - DNA, 22 bp, Homo sapiens
ctgcctgcgccaccaccacgtc

SEQ ID NO: 9217363 - DNA, 22 bp, Homo sapiens
ctgcctgccttggcctccagga

SEQ ID NO: 9217364 - DNA, 22 bp, Homo sapiens
ctgcgtgagcgtgcccgtcttg

SEQ ID NO: 9217365 - DNA, 22 bp, Homo sapiens
ctgcctgcctggagacagatgg

SEQ ID NO: 9217366 - DNA, 22 bp, Homo sapiens
ctgcctgcctggagacagatgg

SEQ ID NO: 9217367 - DNA, 22 bp, Homo sapiens
ctgcctgcatgctgccatagct

SEQ ID NO: 9217368 - DNA, 22 bp, Homo sapiens
ctgcctgccacgttcagctgta

SEQ ID NO: 9217369 - DNA, 22 bp, Homo sapiens
ctgcctgcatcccacagtgggg

SEQ ID NO: 9217370 - DNA, 22 bp, Homo sapiens
ctgcctgcatcccacagtgggg

SEQ ID NO: 9217371 - DNA, 22 bp, Homo sapiens
ctgcctgcaggacacctcgcta

SEQ ID NO: 9217372 - DNA, 22 bp, Homo sapiens
ctgcctgcactgcctggctcca

SEQ ID NO: 9217373 - DNA, 22 bp, Homo sapiens
ctgcctcttaagtggatggagt

SEQ ID NO: 9217374 - DNA, 22 bp, Homo sapiens
ctgcctgagtacaagtcccaga

SEQ ID NO: 9217375 - DNA, 22 bp, Homo sapiens
ctgcctgagtggaggtcgaggg

SEQ ID NO: 9217376 - DNA, 22 bp, Homo sapiens
ctgcctctgttgggcatggtct

SEQ ID NO: 9217377 - DNA, 22 bp, Homo sapiens
ctgcctcttaagtggatggagt

SEQ ID NO: 9217378 - DNA, 22 bp, Homo sapiens
ctgcctcttgacagatcgtggc

SEQ ID NO: 9217379 - DNA, 22 bp, Homo sapiens
ctgctgccttccaaaggccagg

SEQ ID NO: 9217380 - DNA, 22 bp, Homo sapiens
ctgctgcctgacaatttaggtt

SEQ ID NO: 9217381 - DNA, 22 bp, Homo sapiens
ctgctgcctgattgcagacctc

SEQ ID NO: 9217382 - DNA, 22 bp, Homo sapiens
ctgctggcaagcccagttggag

SEQ ID NO: 9217383 - DNA, 22 bp, Homo sapiens
ctgctcggcgcgcatggctgcc

SEQ ID NO: 9217384 - DNA, 22 bp, Homo sapiens
ctgctcctgtgggccagtggcc

SEQ ID NO: 9217385 - DNA, 22 bp, Homo sapiens
ctgctctgaagccaggattctg

SEQ ID NO: 9217386 - DNA, 22 bp, Homo sapiens
ctgctgcctagtccaagacgtg

SEQ ID NO: 9217387 - DNA, 22 bp, Homo sapiens
ctgctgccggcgagcctccctt

SEQ ID NO: 9217388 - DNA, 19 bp, Homo sapiens
ctgctgccggagactcgtc

SEQ ID NO: 9217389 - DNA, 20 bp, Homo sapiens
ctgctgccctgtcagcctct

SEQ ID NO: 9217390 - DNA, 20 bp, Homo sapiens
ctgctgccctgtcagcctct

SEQ ID NO: 9217391 - DNA, 22 bp, Homo sapiens
ctgctgcccctgagctcagcct

SEQ ID NO: 9217392 - DNA, 22 bp, Homo sapiens
gaaagcatgtagcctgtatcca

SEQ ID NO: 9217393 - DNA, 22 bp, Homo sapiens
gaaagcccattgacaaagaagt

SEQ ID NO: 9217394 - DNA, 22 bp, Homo sapiens
gaaacaatttttgttgtctaag

SEQ ID NO: 9217395 - DNA, 22 bp, Homo sapiens
gaaacacatatgaacagttgat

SEQ ID NO: 9217396 - DNA, 22 bp, Homo sapiens
gaaaatttagaactgaacttct

SEQ ID NO: 9217397 - DNA, 22 bp, Homo sapiens
gaaaattattgaaaatggctct

SEQ ID NO: 9217398 - DNA, 22 bp, Homo sapiens
gaaaatttaattctcttctgtg

SEQ ID NO: 9217399 - DNA, 22 bp, Homo sapiens
gaaacaatcatcatgtgatttg

SEQ ID NO: 9217400 - DNA, 22 bp, Homo sapiens
gaaacaatcatcatgtgatttg

SEQ ID NO: 9217401 - DNA, 22 bp, Homo sapiens
gaaaatttctgccacatgtgtg

SEQ ID NO: 9217402 - DNA, 22 bp, Homo sapiens
gaaaattattgaaaatggctct

SEQ ID NO: 9217403 - DNA, 22 bp, Homo sapiens
ctttgcagaaataaacttgatg

SEQ ID NO: 9217404 - DNA, 22 bp, Homo sapiens
ctttgcagaagaaacctacaaa

SEQ ID NO: 9217405 - DNA, 17 bp, Homo sapiens
ctttgcagcagacatgt

SEQ ID NO: 9217406 - DNA, 22 bp, Homo sapiens
cttttcttactcccgcaaggca

SEQ ID NO: 9217407 - DNA, 22 bp, Homo sapiens
cttttcttactcccgcaaggca

SEQ ID NO: 9217408 - DNA, 22 bp, Homo sapiens
cttttcttgtattggatgcccc

SEQ ID NO: 9217409 - DNA, 22 bp, Homo sapiens
cttttcttgtattggatgcccc

SEQ ID NO: 9217410 - DNA, 22 bp, Homo sapiens
ctttacaaatagggagggagtg

SEQ ID NO: 9217411 - DNA, 22 bp, Homo sapiens
ctttacaaattagctctcggga

SEQ ID NO: 9217412 - DNA, 22 bp, Homo sapiens
ctttacaaatagggagggagtg

SEQ ID NO: 9217413 - DNA, 22 bp, Homo sapiens
ctttacaaagcaattttgtctc

SEQ ID NO: 9217414 - DNA, 22 bp, Homo sapiens
ctttacaaagcaattttgtctc

SEQ ID NO: 9217415 - DNA, 22 bp, Homo sapiens
ctttacaaactataaagtgcgg

SEQ ID NO: 9217416 - DNA, 22 bp, Homo sapiens
ctttacaaactataaagtgcgg

SEQ ID NO: 9217417 - DNA, 22 bp, Homo sapiens
ctttaacagttccattcaattt

SEQ ID NO: 9217418 - DNA, 22 bp, Homo sapiens
ctttaaataatacaaggtccag

SEQ ID NO: 9217419 - DNA, 22 bp, Homo sapiens
ctttaattaggaagtataatga

SEQ ID NO: 9217420 - DNA, 22 bp, Homo sapiens
cttctgggttgcaggtcttggc

SEQ ID NO: 9217421 - DNA, 22 bp, Homo sapiens
cttctgggtgtggagtgaggac

SEQ ID NO: 9217422 - DNA, 22 bp, Homo sapiens
cttgttttctaaaacatcattt

SEQ ID NO: 9217423 - DNA, 22 bp, Homo sapiens
cttgttttcttctgcagtctat

SEQ ID NO: 9217424 - DNA, 21 bp, Homo sapiens
cttgttttgaaaggactggcc

SEQ ID NO: 9217425 - DNA, 22 bp, Homo sapiens
cttgttttgaaagcagtggcca

SEQ ID NO: 9217426 - DNA, 22 bp, Homo sapiens
cttgttttggctagtatgatgt

SEQ ID NO: 9217427 - DNA, 22 bp, Homo sapiens
cttgttttggaacagagtgaat

SEQ ID NO: 9217428 - DNA, 22 bp, Homo sapiens
cttgtttttaagagatgtttac

SEQ ID NO: 9217429 - DNA, 22 bp, Homo sapiens
cttctcttggtagttcttgttg

SEQ ID NO: 9217430 - DNA, 22 bp, Homo sapiens
cttctgaagtgtttgatgattg

SEQ ID NO: 9217431 - DNA, 22 bp, Homo sapiens
cttctggaggctccagggaggt

SEQ ID NO: 9217432 - DNA, 19 bp, Homo sapiens
cttctggccctgagccacc

SEQ ID NO: 9217433 - DNA, 22 bp, Homo sapiens
cttctggcgttggaggtctgag

SEQ ID NO: 9217434 - DNA, 22 bp, Homo sapiens
cttctggcaaaacaggcagaaa

SEQ ID NO: 9217435 - DNA, 23 bp, Homo sapiens
cttctggctctatatcagaattc

SEQ ID NO: 9217436 - DNA, 22 bp, Homo sapiens
cttctgggatttttgaagactc

SEQ ID NO: 9217437 - DNA, 22 bp, Homo sapiens
cttctgggcagaagttttgaga

SEQ ID NO: 9217438 - DNA, 22 bp, Homo sapiens
cttctgggcatggcagagcctg

SEQ ID NO: 9217439 - DNA, 22 bp, Homo sapiens
cttctgggccatggccttcctc

SEQ ID NO: 9217440 - DNA, 22 bp, Homo sapiens
cttaaagatgtcaaggctgttt

SEQ ID NO: 9217441 - DNA, 22 bp, Homo sapiens
cttaaagtagaatacaagacct

SEQ ID NO: 9217442 - DNA, 22 bp, Homo sapiens
cttacaaaggagaggagatagg

SEQ ID NO: 9217443 - DNA, 22 bp, Homo sapiens
cttacaaatacacttaggagag

SEQ ID NO: 9217444 - DNA, 22 bp, Homo sapiens
ctgtgcttcgcaactccaaggt

SEQ ID NO: 9217445 - DNA, 22 bp, Homo sapiens
ctgtggaaggcctgtcctgaaa

SEQ ID NO: 9217446 - DNA, 20 bp, Homo sapiens
ctgtttgctatcatgagctg

SEQ ID NO: 9217447 - DNA, 22 bp, Homo sapiens
ctgtttttgtgctgtgtctccc

SEQ ID NO: 9217448 - DNA, 22 bp, Homo sapiens
ctgtttttgtgctgtgtctccc

SEQ ID NO: 9217449 - DNA, 22 bp, Homo sapiens
cttaggaatatccacagcaggt

SEQ ID NO: 9217450 - DNA, 22 bp, Homo sapiens
cttagctttgtcctaggtctct

SEQ ID NO: 9217451 - DNA, 22 bp, Homo sapiens
cttaggagttcacttgaatagt

SEQ ID NO: 9217452 - DNA, 22 bp, Homo sapiens
cttaggatgagtttttgcgttt

SEQ ID NO: 9217453 - DNA, 22 bp, Homo sapiens
cttccaaagcactttatggacc

SEQ ID NO: 9217454 - DNA, 22 bp, Homo sapiens
cttccaaaatttatatgttgaa

SEQ ID NO: 9217455 - DNA, 22 bp, Homo sapiens
cttccagagttgcgttctcggt

SEQ ID NO: 9217456 - DNA, 22 bp, Homo sapiens
cttccagctgattacaggctat

SEQ ID NO: 9217457 - DNA, 22 bp, Homo sapiens
cttccactactcttagatctgc

SEQ ID NO: 9217458 - DNA, 22 bp, Homo sapiens
cttccaagttgctctgctgacc

SEQ ID NO: 9217459 - DNA, 22 bp, Homo sapiens
cttcctttccccaatcatatcg

SEQ ID NO: 9217460 - DNA, 22 bp, Homo sapiens
cttctaggcttctcagggggca

SEQ ID NO: 9217461 - DNA, 22 bp, Homo sapiens
cttctacaaggttgtcctctat

SEQ ID NO: 9217462 - DNA, 22 bp, Homo sapiens
cttctacacatccctcttgctt

SEQ ID NO: 9217463 - DNA, 22 bp, Homo sapiens
cttctacacatccctcttgctt

SEQ ID NO: 9217464 - DNA, 22 bp, Homo sapiens
cttctcagagcttccagaaaac

SEQ ID NO: 9217465 - DNA, 22 bp, Homo sapiens
cttctcaaactgagactgtcta

SEQ ID NO: 9217466 - DNA, 22 bp, Homo sapiens
ctgtctgtcaagttcatctcca

SEQ ID NO: 9217467 - DNA, 22 bp, Homo sapiens
ctgtctgggtctacatcctctg

SEQ ID NO: 9217468 - DNA, 17 bp, Homo sapiens
ctgtctgcgcatgaggt

SEQ ID NO: 9217469 - DNA, 22 bp, Homo sapiens
ctgtgctggagatgggccagag

SEQ ID NO: 9217470 - DNA, 22 bp, Homo sapiens
ctgtgcttacctgcccaggtga

SEQ ID NO: 9217471 - DNA, 22 bp, Homo sapiens
ctgtgctgattcagcacaggcc

SEQ ID NO: 9217472 - DNA, 22 bp, Homo sapiens
ctgtgctgattcagcacaggcc

SEQ ID NO: 9217473 - DNA, 22 bp, Homo sapiens
ctgtgccctctttgctggcctt

SEQ ID NO: 9217474 - DNA, 22 bp, Homo sapiens
ctgtcaggtttcccatctgcaa

SEQ ID NO: 9217475 - DNA, 22 bp, Homo sapiens
ctgtctctgttgcctgtaggtg

SEQ ID NO: 9217476 - DNA, 22 bp, Homo sapiens
ctgtctgccctggccagagccc

SEQ ID NO: 9217477 - DNA, 22 bp, Homo sapiens
ctgtcagcttctcctggccaga

SEQ ID NO: 9217478 - DNA, 22 bp, Homo sapiens
ctgtataaacatattttcaagt

SEQ ID NO: 9217479 - DNA, 22 bp, Homo sapiens
ctgtcaatgacagttatttggg

SEQ ID NO: 9217480 - DNA, 22 bp, Homo sapiens
ctgtattttcatgcctacgtac

SEQ ID NO: 9217481 - DNA, 23 bp, Homo sapiens
ctgtagctaaaagctgggatttg

SEQ ID NO: 9217482 - DNA, 22 bp, Homo sapiens
ctgtagcatttgttatggcaat

SEQ ID NO: 9217483 - DNA, 22 bp, Homo sapiens
ctggtgagactcagggatgctt

SEQ ID NO: 9217484 - DNA, 22 bp, Homo sapiens
ctggtgccctgtgtggcaggag

SEQ ID NO: 9217485 - DNA, 22 bp, Homo sapiens
ctggtgccattctgtggcctag

SEQ ID NO: 9217486 - DNA, 22 bp, Homo sapiens
ctgtaaaacactgtagtatctg

SEQ ID NO: 9217487 - DNA, 21 bp, Homo sapiens
ctgggctttctctcaaagaca

SEQ ID NO: 9217488 - DNA, 22 bp, Homo sapiens
ctgggcttttgagtcacaaggg

SEQ ID NO: 9217489 - DNA, 22 bp, Homo sapiens
ctggggaaggcggtgactgcgc

SEQ ID NO: 9217490 - DNA, 22 bp, Homo sapiens
ctgggcttgtgttagctgacaa

SEQ ID NO: 9217491 - DNA, 22 bp, Homo sapiens
ctgggcttgagttcctgctcgt

SEQ ID NO: 9217492 - DNA, 22 bp, Homo sapiens
ctgggcttaggacctggtgcgg

SEQ ID NO: 9217493 - DNA, 22 bp, Homo sapiens
ctggggagacgatcgatgttct

SEQ ID NO: 9217494 - DNA, 22 bp, Homo sapiens
ctggggagaagcgactcggctg

SEQ ID NO: 9217495 - DNA, 22 bp, Homo sapiens
ctggtctgcaaggccatataga

SEQ ID NO: 9217496 - DNA, 19 bp, Homo sapiens
ctggtctgctgcttccagg

SEQ ID NO: 9217497 - DNA, 19 bp, Homo sapiens
ctggtctgtcatgctcccc

SEQ ID NO: 9217498 - DNA, 22 bp, Homo sapiens
ctggtctggctacccagcgaat

SEQ ID NO: 9217499 - DNA, 22 bp, Homo sapiens
ctggtccttgctacccagcaag

SEQ ID NO: 9217500 - DNA, 22 bp, Homo sapiens
ctggtcagagcaactgctcaca

SEQ ID NO: 9217501 - DNA, 23 bp, Homo sapiens
ctggtcagaggctgctggaaggg

SEQ ID NO: 9217502 - DNA, 22 bp, Homo sapiens
ctgggacttgcagagcaggagg

SEQ ID NO: 9217503 - DNA, 22 bp, Homo sapiens
ctgggacagctgagacaggaga

SEQ ID NO: 9217504 - DNA, 22 bp, Homo sapiens
ctgctgtgcacccaggaaggct

SEQ ID NO: 9217505 - DNA, 21 bp, Homo sapiens
ctgcttcctctcttcatggca

SEQ ID NO: 9217506 - DNA, 22 bp, Homo sapiens
ctgcttccaagaaagagatagg

SEQ ID NO: 9217507 - DNA, 22 bp, Homo sapiens
ctgcttccacacaagcaaagct

SEQ ID NO: 9217508 - DNA, 22 bp, Homo sapiens
ctgcttcctgctgggatactga

SEQ ID NO: 9217509 - DNA, 22 bp, Homo sapiens
ctgggacagagcagcagtgggg

SEQ ID NO: 9217510 - DNA, 22 bp, Homo sapiens
ctgggagcgcagcaggcacaac

SEQ ID NO: 9217511 - DNA, 22 bp, Homo sapiens
ctgggcaaattgtgccagctat

SEQ ID NO: 9217512 - DNA, 17 bp, Homo sapiens
ctgggatgtggactctt

SEQ ID NO: 9217513 - DNA, 22 bp, Homo sapiens
ctgggcactgcagcaggcatca

SEQ ID NO: 9217514 - DNA, 22 bp, Homo sapiens
ctgggcagagtccggaagatgg

SEQ ID NO: 9217515 - DNA, 22 bp, Homo sapiens
ctgggcagcacatcatcgtatc

SEQ ID NO: 9217516 - DNA, 22 bp, Homo sapiens
ctgggcagaattttaggatggc

SEQ ID NO: 9217517 - DNA, 22 bp, Homo sapiens
ctgggcagctgtatcagggagt

SEQ ID NO: 9217518 - DNA, 22 bp, Homo sapiens
ctgggcagcctcacacaatgtt

SEQ ID NO: 9217519 - DNA, 22 bp, Homo sapiens
ctgggcttagcagctcctggtc

SEQ ID NO: 9217520 - DNA, 22 bp, Homo sapiens
ctgggcttagcagctcctggtc

SEQ ID NO: 9217521 - DNA, 22 bp, Homo sapiens
ctgggctagaaggaccaggatg

SEQ ID NO: 9217522 - DNA, 22 bp, Homo sapiens
ctgggctacgtgttgacagcat

SEQ ID NO: 9217523 - DNA, 22 bp, Homo sapiens
ctgggctaattaagcacagctg

SEQ ID NO: 9217524 - DNA, 22 bp, Homo sapiens
ctgggcctggtgtggcacctgc

SEQ ID NO: 9217525 - DNA, 22 bp, Homo sapiens
ctgggcctcctctgcccaagct

SEQ ID NO: 9217526 - DNA, 22 bp, Homo sapiens
ctgggcctccagctctgccagc

SEQ ID NO: 9217527 - DNA, 17 bp, Homo sapiens
ctgggcctcccctgtcc

SEQ ID NO: 9217528 - DNA, 22 bp, Homo sapiens
ctgggcctgtgggcacacggac

SEQ ID NO: 9217529 - DNA, 22 bp, Homo sapiens
ctgggcctgtgactcccatcct

SEQ ID NO: 9217530 - DNA, 22 bp, Homo sapiens
ctgggccttcattgctctccca

SEQ ID NO: 9217531 - DNA, 22 bp, Homo sapiens
ctgggccttgcatcccagagcc

SEQ ID NO: 9217532 - DNA, 22 bp, Homo sapiens
gaggaaagaaccccagtcaata

SEQ ID NO: 9217533 - DNA, 18 bp, Homo sapiens
gaggaaacaaggcagagg

SEQ ID NO: 9217534 - DNA, 23 bp, Homo sapiens
gaggaaagaatatagatgcaatc

SEQ ID NO: 9217535 - DNA, 22 bp, Homo sapiens
gagctgcctgttgcatagcaac

SEQ ID NO: 9217536 - DNA, 22 bp, Homo sapiens
gaggaagaagcaaaccagctaa

SEQ ID NO: 9217537 - DNA, 22 bp, Homo sapiens
gaggaagaagggattagaactc

SEQ ID NO: 9217538 - DNA, 22 bp, Homo sapiens
gaggaagaagcaaaccagctaa

SEQ ID NO: 9217539 - DNA, 22 bp, Homo sapiens
gaggaaccaccttgggtaggct

SEQ ID NO: 9217540 - DNA, 20 bp, Homo sapiens
gaggaaccactgggaggaga

SEQ ID NO: 9217541 - DNA, 20 bp, Homo sapiens
gaggaaccactgggaggaga

SEQ ID NO: 9217542 - DNA, 22 bp, Homo sapiens
gaggaacccagctggggttgcc

SEQ ID NO: 9217543 - DNA, 22 bp, Homo sapiens
gagctgagggtctaggagggtt

SEQ ID NO: 9217544 - DNA, 22 bp, Homo sapiens
gagctgaggtgatgtggtcgtt

SEQ ID NO: 9217545 - DNA, 22 bp, Homo sapiens
gagctgagtatcccactgaagt

SEQ ID NO: 9217546 - DNA, 22 bp, Homo sapiens
gagctgcctacattgccaagag

SEQ ID NO: 9217547 - DNA, 22 bp, Homo sapiens
gagctgagatttgaagcaagtt

SEQ ID NO: 9217548 - DNA, 22 bp, Homo sapiens
gagccctgcgtgtctgggggca

SEQ ID NO: 9217549 - DNA, 22 bp, Homo sapiens
gagccctggcagtctgggatgg

SEQ ID NO: 9217550 - DNA, 18 bp, Homo sapiens
gagccctgagtctgcaca

SEQ ID NO: 9217551 - DNA, 18 bp, Homo sapiens
gagccctgagtctgcaca

SEQ ID NO: 9217552 - DNA, 22 bp, Homo sapiens
gagctgagatcatgtacactag

SEQ ID NO: 9217553 - DNA, 22 bp, Homo sapiens
gagccctgttcaggcctcctca

SEQ ID NO: 9217554 - DNA, 22 bp, Homo sapiens
gagccctgtgaggaaagagggt

SEQ ID NO: 9217555 - DNA, 22 bp, Homo sapiens
gagccctgtagcaagtcatgtc

SEQ ID NO: 9217556 - DNA, 22 bp, Homo sapiens
gagccctgtagcaagtcatgtc

SEQ ID NO: 9217557 - DNA, 22 bp, Homo sapiens
gagaggggacctgtgtgtctag

SEQ ID NO: 9217558 - DNA, 22 bp, Homo sapiens
gagaggggcgcgcagctcgcga

SEQ ID NO: 9217559 - DNA, 22 bp, Homo sapiens
gagaggggcccaagccacatag

SEQ ID NO: 9217560 - DNA, 22 bp, Homo sapiens
gagaggggcccaagccacatag

SEQ ID NO: 9217561 - DNA, 20 bp, Homo sapiens
gagcagtgagccagggaaag

SEQ ID NO: 9217562 - DNA, 22 bp, Homo sapiens
gagcagtgagtgaatgttgcct

SEQ ID NO: 9217563 - DNA, 22 bp, Homo sapiens
gagcagtgggaaggaacagggt

SEQ ID NO: 9217564 - DNA, 22 bp, Homo sapiens
gagcaggcttgcagagaagggg

SEQ ID NO: 9217565 - DNA, 22 bp, Homo sapiens
gagaggggcgcgcagctcgcga

SEQ ID NO: 9217566 - DNA, 22 bp, Homo sapiens
gagaggggtttgccatcctatg

SEQ ID NO: 9217567 - DNA, 22 bp, Homo sapiens
gagcatgcccctcacaggaaca

SEQ ID NO: 9217568 - DNA, 22 bp, Homo sapiens
gagcatggatagaaggtgggat

SEQ ID NO: 9217569 - DNA, 22 bp, Homo sapiens
gagcatgcgcgtgggagacacc

SEQ ID NO: 9217570 - DNA, 22 bp, Homo sapiens
gagcccagggcaggcaaggcag

SEQ ID NO: 9217571 - DNA, 22 bp, Homo sapiens
gagcccagggcaggcaaggcag

SEQ ID NO: 9217572 - DNA, 22 bp, Homo sapiens
gagcccaggctggggttcagag

SEQ ID NO: 9217573 - DNA, 22 bp, Homo sapiens
gagcccaggcagaggttgcagt

SEQ ID NO: 9217574 - DNA, 22 bp, Homo sapiens
gagcccaggatggtgtatggct

SEQ ID NO: 9217575 - DNA, 22 bp, Homo sapiens
gagcccaggatggtgtatggct

SEQ ID NO: 9217576 - DNA, 22 bp, Homo sapiens
gagcccaggcagaggttgcagt

SEQ ID NO: 9217577 - DNA, 21 bp, Homo sapiens
gagcccaggcatctcattaat

SEQ ID NO: 9217578 - DNA, 22 bp, Homo sapiens
gagccctgacactgagggagtt

SEQ ID NO: 9217579 - DNA, 22 bp, Homo sapiens
gagccctgagagttgtgaggcc

SEQ ID NO: 9217580 - DNA, 22 bp, Homo sapiens
gagccctgaacaacagcaggaa

SEQ ID NO: 9217581 - DNA, 22 bp, Homo sapiens
gagccctgaacaacagcaggaa

SEQ ID NO: 9217582 - DNA, 22 bp, Homo sapiens
gagcccaggttctgcttccagc

SEQ ID NO: 9217583 - DNA, 22 bp, Homo sapiens
gagcccaggttctgcttccagc

SEQ ID NO: 9217584 - DNA, 22 bp, Homo sapiens
gagccagtgatcagacagggag

SEQ ID NO: 9217585 - DNA, 22 bp, Homo sapiens
gagcccagctctacctcagact

SEQ ID NO: 9217586 - DNA, 22 bp, Homo sapiens
gagcccagctctacctcagact

SEQ ID NO: 9217587 - DNA, 22 bp, Homo sapiens
gagcccagcttgcacatggagc

SEQ ID NO: 9217588 - DNA, 22 bp, Homo sapiens
gagcccagctgtccttggcaaa

SEQ ID NO: 9217589 - DNA, 22 bp, Homo sapiens
gagcccagctgtccttggcaaa

SEQ ID NO: 9217590 - DNA, 22 bp, Homo sapiens
gagcccagctgcggccctcagc

SEQ ID NO: 9217591 - DNA, 22 bp, Homo sapiens
gagcccagctgcggccctcagc

SEQ ID NO: 9217592 - DNA, 22 bp, Homo sapiens
gagcccaggaagtggaggctga

SEQ ID NO: 9217593 - DNA, 22 bp, Homo sapiens
gagggagagtgatggaccattg

SEQ ID NO: 9217594 - DNA, 22 bp, Homo sapiens
gagggaggcatcatgaatccag

SEQ ID NO: 9217595 - DNA, 22 bp, Homo sapiens
gagggaggcatcatgaatccag

SEQ ID NO: 9217596 - DNA, 22 bp, Homo sapiens
gagggagggactagcattctct

SEQ ID NO: 9217597 - DNA, 22 bp, Homo sapiens
gagggagggaaagtttaacact

SEQ ID NO: 9217598 - DNA, 22 bp, Homo sapiens
gagggagggccaggtcccaacc

SEQ ID NO: 9217599 - DNA, 22 bp, Homo sapiens
gagggaggggagctccaccctc

SEQ ID NO: 9217600 - DNA, 22 bp, Homo sapiens
gaggctgaggcggatggatcac

SEQ ID NO: 9217601 - DNA, 22 bp, Homo sapiens
gaggctgaggcaggaggatcac

SEQ ID NO: 9217602 - DNA, 22 bp, Homo sapiens
gaggctgagggttagagagtca

SEQ ID NO: 9217603 - DNA, 22 bp, Homo sapiens
gaggctgaggcggatggatcac

SEQ ID NO: 9217604 - DNA, 22 bp, Homo sapiens
gaggctgagggttagagagtca

SEQ ID NO: 9217605 - DNA, 22 bp, Homo sapiens
gaggctgaggttgcagtgagct

SEQ ID NO: 9217606 - DNA, 22 bp, Homo sapiens
gaggctgaggttgcagtgagcc

SEQ ID NO: 9217607 - DNA, 22 bp, Homo sapiens
gaggctgattcggggaacagca

SEQ ID NO: 9217608 - DNA, 22 bp, Homo sapiens
gaggctgatgctgcctcacaga

SEQ ID NO: 9217609 - DNA, 22 bp, Homo sapiens
gaggctgagtagctttgtgctc

SEQ ID NO: 9217610 - DNA, 22 bp, Homo sapiens
gaggctgcaggcaatgctgccc

SEQ ID NO: 9217611 - DNA, 22 bp, Homo sapiens
gaggctgcattcttcccactgc

SEQ ID NO: 9217612 - DNA, 22 bp, Homo sapiens
gagggaggtgatactgaacgta

SEQ ID NO: 9217613 - DNA, 22 bp, Homo sapiens
gaggctcaacccacaggggttg

SEQ ID NO: 9217614 - DNA, 20 bp, Homo sapiens
gaggctgaagtgtttttgct

SEQ ID NO: 9217615 - DNA, 22 bp, Homo sapiens
gaggctgaagtgtacatgggtg

SEQ ID NO: 9217616 - DNA, 22 bp, Homo sapiens
gaggctgaatggccagaagcca

SEQ ID NO: 9217617 - DNA, 22 bp, Homo sapiens
gaggctgacggcaccatcttct

SEQ ID NO: 9217618 - DNA, 22 bp, Homo sapiens
gaggctgagactctgaattttt

SEQ ID NO: 9217619 - DNA, 22 bp, Homo sapiens
gaggctgagagtttgttctact

SEQ ID NO: 9217620 - DNA, 22 bp, Homo sapiens
gaggctgaacaggttctcatga

SEQ ID NO: 9217621 - DNA, 22 bp, Homo sapiens
gaggctcagagggagcatggtc

SEQ ID NO: 9217622 - DNA, 20 bp, Homo sapiens
gaggagccaccttgagctgg

SEQ ID NO: 9217623 - DNA, 20 bp, Homo sapiens
gaggagccaccttgagctgg

SEQ ID NO: 9217624 - DNA, 22 bp, Homo sapiens
gaggagcacatgaggctgaggg

SEQ ID NO: 9217625 - DNA, 22 bp, Homo sapiens
gaggagcacatgaggctgaggg

SEQ ID NO: 9217626 - DNA, 22 bp, Homo sapiens
gaggcaggaggattgcttgagc

SEQ ID NO: 9217627 - DNA, 22 bp, Homo sapiens
gaggcaggcagattgcttgagg

SEQ ID NO: 9217628 - DNA, 22 bp, Homo sapiens
gaggcagcttagggtactgact

SEQ ID NO: 9217629 - DNA, 16 bp, Homo sapiens
gaggagcccctctgcc

SEQ ID NO: 9217630 - DNA, 22 bp, Homo sapiens
gaggagcccagcaccatcactt

SEQ ID NO: 9217631 - DNA, 22 bp, Homo sapiens
gaggagcccagcaccatcactt

SEQ ID NO: 9217632 - DNA, 18 bp, Homo sapiens
gagagggatccctcagga

SEQ ID NO: 9217633 - DNA, 18 bp, Homo sapiens
gagagggatccctcagga

SEQ ID NO: 9217634 - DNA, 22 bp, Homo sapiens
gagagggcaaacttgtagctaa

SEQ ID NO: 9217635 - DNA, 22 bp, Homo sapiens
gagagggccgggggccagctcc

SEQ ID NO: 9217636 - DNA, 22 bp, Homo sapiens
gagagggcaaggtagatgctac

SEQ ID NO: 9217637 - DNA, 22 bp, Homo sapiens
gagactggtgtttgctgggctg

SEQ ID NO: 9217638 - DNA, 22 bp, Homo sapiens
gagactgggggcttggcctttt

SEQ ID NO: 9217639 - DNA, 22 bp, Homo sapiens
gagaccccagctcagcctccag

SEQ ID NO: 9217640 - DNA, 22 bp, Homo sapiens
gagaaagcttctttcccacagg

SEQ ID NO: 9217641 - DNA, 22 bp, Homo sapiens
gagaaagcttcagaaatggcct

SEQ ID NO: 9217642 - DNA, 22 bp, Homo sapiens
gagacagatgctgctggagcat

SEQ ID NO: 9217643 - DNA, 19 bp, Homo sapiens
gagaaagcaggcacagcac

SEQ ID NO: 9217644 - DNA, 22 bp, Homo sapiens
gagaaagctaataggaatccta

SEQ ID NO: 9217645 - DNA, 22 bp, Homo sapiens
gagaaagctaaataagttgatt

SEQ ID NO: 9217646 - DNA, 23 bp, Homo sapiens
gagaaagccggctatgatcctgg

SEQ ID NO: 9217647 - DNA, 18 bp, Homo sapiens
gagaaagcagggaatgtt

SEQ ID NO: 9217648 - DNA, 22 bp, Homo sapiens
gagaaacttggagttattctgg

SEQ ID NO: 9217649 - DNA, 22 bp, Homo sapiens
gagaaacttggagttattctgg

SEQ ID NO: 9217650 - DNA, 22 bp, Homo sapiens
gagaaacctgtaaggaaggaag

SEQ ID NO: 9217651 - DNA, 18 bp, Homo sapiens
gagaaacctgtgaatgct

SEQ ID NO: 9217652 - DNA, 22 bp, Homo sapiens
gagaaactgaaacatagggcca

SEQ ID NO: 9217653 - DNA, 22 bp, Homo sapiens
gagaaactgaatatttaacggg

SEQ ID NO: 9217654 - DNA, 23 bp, Homo sapiens
gagaaacctcggtaagcaggagg

SEQ ID NO: 9217655 - DNA, 22 bp, Homo sapiens
gagaaaccgattctgcatgtca

SEQ ID NO: 9217656 - DNA, 19 bp, Homo sapiens
gagaaaccccgtctttagg

SEQ ID NO: 9217657 - DNA, 22 bp, Homo sapiens
gactgccagaatgtgaggcctg

SEQ ID NO: 9217658 - DNA, 22 bp, Homo sapiens
gactgaggtgcccagaggtgac

SEQ ID NO: 9217659 - DNA, 22 bp, Homo sapiens
gactgaggtgacctaggactac

SEQ ID NO: 9217660 - DNA, 22 bp, Homo sapiens
gacagagctgctctagattctg

SEQ ID NO: 9217661 - DNA, 22 bp, Homo sapiens
gacatttaatagtattgtggga

SEQ ID NO: 9217662 - DNA, 22 bp, Homo sapiens
gacattctaaaaaatatggaag

SEQ ID NO: 9217663 - DNA, 22 bp, Homo sapiens
gaccaggacacagtggcaaggt

SEQ ID NO: 9217664 - DNA, 22 bp, Homo sapiens
gactccaggtgtccaggcctcc

SEQ ID NO: 9217665 - DNA, 22 bp, Homo sapiens
gactccaggtgcaggaggagcc

SEQ ID NO: 9217666 - DNA, 22 bp, Homo sapiens
gaccaggctagttcagagcttc

SEQ ID NO: 9217667 - DNA, 22 bp, Homo sapiens
gactcccctgggccccatccag

SEQ ID NO: 9217668 - DNA, 22 bp, Homo sapiens
gacatttagctgttttgcattt

SEQ ID NO: 9217669 - DNA, 22 bp, Homo sapiens
gacatttagaagttagattcaa

SEQ ID NO: 9217670 - DNA, 22 bp, Homo sapiens
gaccacagcagtgcaagaggag

SEQ ID NO: 9217671 - DNA, 22 bp, Homo sapiens
gacatttagctgttttgcattt

SEQ ID NO: 9217672 - DNA, 22 bp, Homo sapiens
gaccacagctacaagggcaagg

SEQ ID NO: 9217673 - DNA, 21 bp, Homo sapiens
gaccacagggaaggtcttgca

SEQ ID NO: 9217674 - DNA, 22 bp, Homo sapiens
gaccacaggtatgggcttggca

SEQ ID NO: 9217675 - DNA, 22 bp, Homo sapiens
gaccacaggtatgggcttggca

SEQ ID NO: 9217676 - DNA, 22 bp, Homo sapiens
gaccactggggtgagggccatc

SEQ ID NO: 9217677 - DNA, 22 bp, Homo sapiens
gactgaggcctttattgagaca

SEQ ID NO: 9217678 - DNA, 22 bp, Homo sapiens
gactgaggtattaagatggctt

SEQ ID NO: 9217679 - DNA, 22 bp, Homo sapiens
gacacaggtagaataaagtact

SEQ ID NO: 9217680 - DNA, 22 bp, Homo sapiens
gaaggttatgggggttggatta

SEQ ID NO: 9217681 - DNA, 22 bp, Homo sapiens
gaatccagggttgtttgagcta

SEQ ID NO: 9217682 - DNA, 22 bp, Homo sapiens
gaatccagggtgtttgctgagg

SEQ ID NO: 9217683 - DNA, 22 bp, Homo sapiens
gaatcccttgcaagttgttgta

SEQ ID NO: 9217684 - DNA, 18 bp, Homo sapiens
gaagggagctggaatgca

SEQ ID NO: 9217685 - DNA, 22 bp, Homo sapiens
gaagggcttggctgggaggcca

SEQ ID NO: 9217686 - DNA, 22 bp, Homo sapiens
gaagggtgcatggagggaagtc

SEQ ID NO: 9217687 - DNA, 22 bp, Homo sapiens
gaagggtgcatggagggaagtc

SEQ ID NO: 9217688 - DNA, 22 bp, Homo sapiens
gaaaggagggaaacagagcggt

SEQ ID NO: 9217689 - DNA, 17 bp, Homo sapiens
gaaaggaggcaacactg

SEQ ID NO: 9217690 - DNA, 22 bp, Homo sapiens
gaagccaacattccaagtagaa

SEQ ID NO: 9217691 - DNA, 22 bp, Homo sapiens
gaagccaagccagctgatggag

SEQ ID NO: 9217692 - DNA, 22 bp, Homo sapiens
gaagccaagggctgcttttcct

SEQ ID NO: 9217693 - DNA, 22 bp, Homo sapiens
gaagccaagggctgcttttcct

SEQ ID NO: 9217694 - DNA, 22 bp, Homo sapiens
gaagccaagtgcaaatgcctta

SEQ ID NO: 9217695 - DNA, 22 bp, Homo sapiens
gaagcatataggtactgaacta

SEQ ID NO: 9217696 - DNA, 22 bp, Homo sapiens
gaagcagtgtgaacccatgtaa

SEQ ID NO: 9217697 - DNA, 22 bp, Homo sapiens
gaagcagtatcctgacagcacc

SEQ ID NO: 9217698 - DNA, 22 bp, Homo sapiens
gaaaggcaggcagggtgtccat

SEQ ID NO: 9217699 - DNA, 22 bp, Homo sapiens
gaagcaaagagctagtgccgct

SEQ ID NO: 9217700 - DNA, 22 bp, Homo sapiens
gaagcaagtggcctgattcaga

SEQ ID NO: 9217701 - DNA, 22 bp, Homo sapiens
gaagcaagtggcctgattcaga

SEQ ID NO: 9217702 - DNA, 22 bp, Homo sapiens
gaagcagcagctggggacagtt

SEQ ID NO: 9217703 - DNA, 22 bp, Homo sapiens
gaagcaagtgcaaggaagaggc

SEQ ID NO: 9217704 - DNA, 22 bp, Homo sapiens
gaagggagaaggttgggtgacg

SEQ ID NO: 9217705 - DNA, 22 bp, Homo sapiens
gaaggcccagcttgaatgctgc

SEQ ID NO: 9217706 - DNA, 22 bp, Homo sapiens
gaaggcattctattctacatat

SEQ ID NO: 9217707 - DNA, 22 bp, Homo sapiens
gaaggcaggcttctgattaggt

SEQ ID NO: 9217708 - DNA, 22 bp, Homo sapiens
gaaggagctaccaagactgaat

SEQ ID NO: 9217709 - DNA, 22 bp, Homo sapiens
gaagccaagtgcaaatgcctta

SEQ ID NO: 9217710 - DNA, 22 bp, Homo sapiens
tctgttccatgttttgttccat

SEQ ID NO: 9217711 - DNA, 22 bp, Homo sapiens
ccaggagccctgccacaatggt

SEQ ID NO: 9217712 - DNA, 22 bp, Homo sapiens
ccaggagcagatatggacataa

SEQ ID NO: 9217713 - DNA, 22 bp, Homo sapiens
ccaggagcagagtaggtgttca

SEQ ID NO: 9217714 - DNA, 22 bp, Homo sapiens
ccaggagcaccaggcctgtgcc

SEQ ID NO: 9217715 - DNA, 22 bp, Homo sapiens
ccaggagcagccggcccacctg

SEQ ID NO: 9217716 - DNA, 22 bp, Homo sapiens
ccaggagcagccggcccacctg

SEQ ID NO: 9217717 - DNA, 22 bp, Homo sapiens
ccaggagcaggagctgcagctg

SEQ ID NO: 9217718 - DNA, 22 bp, Homo sapiens
ccaggagcaggagctgcagctg

SEQ ID NO: 9217719 - DNA, 22 bp, Homo sapiens
ccaggagcaggagctgcagctg

SEQ ID NO: 9217720 - DNA, 22 bp, Homo sapiens
ccaggagcaggagctggacaga

SEQ ID NO: 9217721 - DNA, 22 bp, Homo sapiens
ccaggagcaggagctggacaga

SEQ ID NO: 9217722 - DNA, 22 bp, Homo sapiens
ccaggagcagggctggctgcac

SEQ ID NO: 9217723 - DNA, 19 bp, Homo sapiens
ccaggagcagtggtgagct

SEQ ID NO: 9217724 - DNA, 22 bp, Homo sapiens
ccaggagcagggctggctgcac

SEQ ID NO: 9217725 - DNA, 22 bp, Homo sapiens
ccaggagcagggctggctgcac

SEQ ID NO: 9217726 - DNA, 22 bp, Homo sapiens
ccaggagcattaagagaacata

SEQ ID NO: 9217727 - DNA, 22 bp, Homo sapiens
ccaggagcattaagagaacata

SEQ ID NO: 9217728 - DNA, 19 bp, Homo sapiens
ccaggagcagtggtgagct

SEQ ID NO: 9217729 - DNA, 22 bp, Homo sapiens
ccaggagcagggctggctgcac

SEQ ID NO: 9217730 - DNA, 22 bp, Homo sapiens
ccaggagccactcaggcccaca

SEQ ID NO: 9217731 - DNA, 22 bp, Homo sapiens
ccaggagccactcaggcccaca

SEQ ID NO: 9217732 - DNA, 22 bp, Homo sapiens
tctgggctctgcgaagcccttc

SEQ ID NO: 9217733 - DNA, 22 bp, Homo sapiens
tctgggctctgggaattaggga

SEQ ID NO: 9217734 - DNA, 22 bp, Homo sapiens
tctgggctcacgagtctggaca

SEQ ID NO: 9217735 - DNA, 22 bp, Homo sapiens
tctgggctatatggtctctgct

SEQ ID NO: 9217736 - DNA, 22 bp, Homo sapiens
tctgggctatatggtctctgct

SEQ ID NO: 9217737 - DNA, 22 bp, Homo sapiens
tctgggcctgtctcagagctgg

SEQ ID NO: 9217738 - DNA, 22 bp, Homo sapiens
tctgggcctcacctgctgctca

SEQ ID NO: 9217739 - DNA, 22 bp, Homo sapiens
ccagcaccttgatcttggagtt

SEQ ID NO: 9217740 - DNA, 22 bp, Homo sapiens
ccagcaccttgatcttggagtt

SEQ ID NO: 9217741 - DNA, 22 bp, Homo sapiens
tctgggccctgagatgttcttc

SEQ ID NO: 9217742 - DNA, 20 bp, Homo sapiens
tctgggagggacaagtctcc

SEQ ID NO: 9217743 - DNA, 22 bp, Homo sapiens
tctgggccctaaaccagctcta

SEQ ID NO: 9217744 - DNA, 22 bp, Homo sapiens
tctgggcttttgcactggccat

SEQ ID NO: 9217745 - DNA, 22 bp, Homo sapiens
tctgggcttttccatgcctgtg

SEQ ID NO: 9217746 - DNA, 22 bp, Homo sapiens
tctgggctctgtcagcacctct

SEQ ID NO: 9217747 - DNA, 22 bp, Homo sapiens
tctgggctctgtcagcacctct

SEQ ID NO: 9217748 - DNA, 22 bp, Homo sapiens
tctgggctctgtcagcacctct

SEQ ID NO: 9217749 - DNA, 22 bp, Homo sapiens
tctgggcttttgcactggccat

SEQ ID NO: 9217750 - DNA, 22 bp, Homo sapiens
tctgggcttttgcactggccat

SEQ ID NO: 9217751 - DNA, 22 bp, Homo sapiens
ccaggagcaaagatcactggga

SEQ ID NO: 9217752 - DNA, 22 bp, Homo sapiens
ccaggagcaaagatcactggga

SEQ ID NO: 9217753 - DNA, 22 bp, Homo sapiens
ccaggagcaacttgaaggcaag

SEQ ID NO: 9217754 - DNA, 22 bp, Homo sapiens
ccaggagcaacttgaaggcaag

SEQ ID NO: 9217755 - DNA, 22 bp, Homo sapiens
tctggggagtgcctaagtggaa

SEQ ID NO: 9217756 - DNA, 22 bp, Homo sapiens
ccaggcaggcgatggtgcagtg

SEQ ID NO: 9217757 - DNA, 22 bp, Homo sapiens
ccaggcctcccttttccagcca

SEQ ID NO: 9217758 - DNA, 22 bp, Homo sapiens
tcttctgatgccagtaaccatg

SEQ ID NO: 9217759 - DNA, 22 bp, Homo sapiens
tcttctgaaggtaggaagcatt

SEQ ID NO: 9217760 - DNA, 22 bp, Homo sapiens
tcttcctcatgaattctcgtat

SEQ ID NO: 9217761 - DNA, 22 bp, Homo sapiens
ccaggaggcggaggttgcagtg

SEQ ID NO: 9217762 - DNA, 22 bp, Homo sapiens
ccaggaggctctgcccatccca

SEQ ID NO: 9217763 - DNA, 22 bp, Homo sapiens
ccaggcagaatgaaacccctgt

SEQ ID NO: 9217764 - DNA, 22 bp, Homo sapiens
ccaggcacttgtttgccaggca

SEQ ID NO: 9217765 - DNA, 22 bp, Homo sapiens
ccaggcacttgtttgccaggca

SEQ ID NO: 9217766 - DNA, 22 bp, Homo sapiens
ccaggcagagggatccccatcc

SEQ ID NO: 9217767 - DNA, 22 bp, Homo sapiens
ccaggcagagtgctccagaaag

SEQ ID NO: 9217768 - DNA, 22 bp, Homo sapiens
ccaggctgtaagagtgatgttg

SEQ ID NO: 9217769 - DNA, 22 bp, Homo sapiens
ccaggctgtgcttttcataaat

SEQ ID NO: 9217770 - DNA, 22 bp, Homo sapiens
ccaggctgtgcttttcataaat

SEQ ID NO: 9217771 - DNA, 22 bp, Homo sapiens
ccaggctgtgcttttcataaat

SEQ ID NO: 9217772 - DNA, 22 bp, Homo sapiens
ccaggctgtggtttagatagag

SEQ ID NO: 9217773 - DNA, 22 bp, Homo sapiens
ccaggctgtggtttagatagag

SEQ ID NO: 9217774 - DNA, 22 bp, Homo sapiens
ccaggctgttttcaaacttggg

SEQ ID NO: 9217775 - DNA, 22 bp, Homo sapiens
ccaggctgttttcaaacttggg

SEQ ID NO: 9217776 - DNA, 22 bp, Homo sapiens
ccaggctgtggtttagatagag

SEQ ID NO: 9217777 - DNA, 22 bp, Homo sapiens
ccaggcttcctaatgtgtgcag

SEQ ID NO: 9217778 - DNA, 22 bp, Homo sapiens
ccaggcttcctaatgtgtgcag

SEQ ID NO: 9217779 - DNA, 22 bp, Homo sapiens
ccaggcttctgattccaggcac

SEQ ID NO: 9217780 - DNA, 22 bp, Homo sapiens
ccaggcttccctgagaggctgc

SEQ ID NO: 9217781 - DNA, 22 bp, Homo sapiens
tgaaacagaagatgttcatgtg

SEQ ID NO: 9217782 - DNA, 22 bp, Homo sapiens
tgaaacaaatttggaaaatcta

SEQ ID NO: 9217783 - DNA, 23 bp, Homo sapiens
ccaggcctctcagagggtgtgcc

SEQ ID NO: 9217784 - DNA, 19 bp, Homo sapiens
tcttgcagccccagcaggc

SEQ ID NO: 9217785 - DNA, 22 bp, Homo sapiens
tcttgcagaggcactgtgtcag

SEQ ID NO: 9217786 - DNA, 22 bp, Homo sapiens
tcttgccctcaacaagagcatg

SEQ ID NO: 9217787 - DNA, 22 bp, Homo sapiens
tctttgtaaatgcctagcataa

SEQ ID NO: 9217788 - DNA, 23 bp, Homo sapiens
ccagggaaggccatcttcaactg

SEQ ID NO: 9217789 - DNA, 22 bp, Homo sapiens
ccagggaagattagaagccact

SEQ ID NO: 9217790 - DNA, 22 bp, Homo sapiens
ccagggaagctggtcacgcagg

SEQ ID NO: 9217791 - DNA, 23 bp, Homo sapiens
ccagggaggttgattggttaccc

SEQ ID NO: 9217792 - DNA, 22 bp, Homo sapiens
ccagggagggtcctgtggcttc

SEQ ID NO: 9217793 - DNA, 22 bp, Homo sapiens
ccagggatgctttcccaggact

SEQ ID NO: 9217794 - DNA, 23 bp, Homo sapiens
ccagggagtgctactatcaagcc

SEQ ID NO: 9217795 - DNA, 22 bp, Homo sapiens
ccagggcaacgctgtctcagag

SEQ ID NO: 9217796 - DNA, 22 bp, Homo sapiens
ccagggcacgttgggacagtac

SEQ ID NO: 9217797 - DNA, 22 bp, Homo sapiens
ccagggctctgcttctgccatg

SEQ ID NO: 9217798 - DNA, 22 bp, Homo sapiens
ccagggctctatgagggtggag

SEQ ID NO: 9217799 - DNA, 22 bp, Homo sapiens
ccagggctctatgagggtggag

SEQ ID NO: 9217800 - DNA, 22 bp, Homo sapiens
ccagggctgagctgtgaccatg

SEQ ID NO: 9217801 - DNA, 22 bp, Homo sapiens
ccagggctgagctgtgaccatg

SEQ ID NO: 9217802 - DNA, 22 bp, Homo sapiens
ccagggctccattgctcatcct

SEQ ID NO: 9217803 - DNA, 22 bp, Homo sapiens
ccagggctccattgctcatcct

SEQ ID NO: 9217804 - DNA, 22 bp, Homo sapiens
ccagggctccattgctcatcct

SEQ ID NO: 9217805 - DNA, 22 bp, Homo sapiens
ccagggcctacagcttaagtcc

SEQ ID NO: 9217806 - DNA, 22 bp, Homo sapiens
tgaagtctttcagggctagaat

SEQ ID NO: 9217807 - DNA, 22 bp, Homo sapiens
tgaagtcctaacttccagtaca

SEQ ID NO: 9217808 - DNA, 22 bp, Homo sapiens
ccagggcagtgggagaaggtgc

SEQ ID NO: 9217809 - DNA, 22 bp, Homo sapiens
tgagtctgatttttctagcatt

SEQ ID NO: 9217810 - DNA, 22 bp, Homo sapiens
tgagtctgctcctggtagcaga

SEQ ID NO: 9217811 - DNA, 22 bp, Homo sapiens
tgagttgctatctagatccaga

SEQ ID NO: 9217812 - DNA, 22 bp, Homo sapiens
ccatccctcctccaccagctag

SEQ ID NO: 9217813 - DNA, 22 bp, Homo sapiens
ccatccctgccattatagccca

SEQ ID NO: 9217814 - DNA, 22 bp, Homo sapiens
ccatccctgggccatgtcccct

SEQ ID NO: 9217815 - DNA, 22 bp, Homo sapiens
ccatccagaccagtccatgggt

SEQ ID NO: 9217816 - DNA, 22 bp, Homo sapiens
ccatccagaccagtccatgggt

SEQ ID NO: 9217817 - DNA, 22 bp, Homo sapiens
tgagtcagtctgccctggcttc

SEQ ID NO: 9217818 - DNA, 22 bp, Homo sapiens
ccatcctgcaggacctccatat

SEQ ID NO: 9217819 - DNA, 22 bp, Homo sapiens
ccatcacagtccccatcgtgat

SEQ ID NO: 9217820 - DNA, 18 bp, Homo sapiens
ccatcaccctaactagtg

SEQ ID NO: 9217821 - DNA, 22 bp, Homo sapiens
ccagtgttttccagtttgccca

SEQ ID NO: 9217822 - DNA, 22 bp, Homo sapiens
ccagttaaacaacatccatttc

SEQ ID NO: 9217823 - DNA, 22 bp, Homo sapiens
tgaggccatgcccgtgccggcc

SEQ ID NO: 9217824 - DNA, 17 bp, Homo sapiens
tgaggccatggcaccat

SEQ ID NO: 9217825 - DNA, 22 bp, Homo sapiens
tgaggccatggaactagcttgg

SEQ ID NO: 9217826 - DNA, 22 bp, Homo sapiens
tgaggccatggaactagcttgg

SEQ ID NO: 9217827 - DNA, 22 bp, Homo sapiens
tgaggccatggtcttcccagtc

SEQ ID NO: 9217828 - DNA, 17 bp, Homo sapiens
tgaggccatggcaccat

SEQ ID NO: 9217829 - DNA, 22 bp, Homo sapiens
tgaggccagtgacatatattaa

SEQ ID NO: 9217830 - DNA, 22 bp, Homo sapiens
tgaggccatgcccgtgccggcc

SEQ ID NO: 9217831 - DNA, 22 bp, Homo sapiens
tgaggccagtctcatcacaggc

SEQ ID NO: 9217832 - DNA, 22 bp, Homo sapiens
tgaggccagggattccatcatt

SEQ ID NO: 9217833 - DNA, 22 bp, Homo sapiens
tgaggccagggattccatcatt

SEQ ID NO: 9217834 - DNA, 22 bp, Homo sapiens
tgaggccaggcaaaggcgatct

SEQ ID NO: 9217835 - DNA, 22 bp, Homo sapiens
tgaggccaggcaaaggcgatct

SEQ ID NO: 9217836 - DNA, 22 bp, Homo sapiens
tgaggctgaaactggcgataga

SEQ ID NO: 9217837 - DNA, 22 bp, Homo sapiens
tgaggcccagccgccctgagag

SEQ ID NO: 9217838 - DNA, 22 bp, Homo sapiens
ccagtgcccagctgcccaggca

SEQ ID NO: 9217839 - DNA, 22 bp, Homo sapiens
ccagtgcataatcaatacagcc

SEQ ID NO: 9217840 - DNA, 22 bp, Homo sapiens
ccagtgcattgccgtgtctagg

SEQ ID NO: 9217841 - DNA, 22 bp, Homo sapiens
tgaggcagtgctgggaagcctg

SEQ ID NO: 9217842 - DNA, 22 bp, Homo sapiens
ccagtggacttctccctgtggt

SEQ ID NO: 9217843 - DNA, 22 bp, Homo sapiens
ccagtggagtttttatacccag

SEQ ID NO: 9217844 - DNA, 22 bp, Homo sapiens
tgaggcagtgctgggaagcctg

SEQ ID NO: 9217845 - DNA, 22 bp, Homo sapiens
ccagtcccaggcagaaatccag

SEQ ID NO: 9217846 - DNA, 19 bp, Homo sapiens
ccagtcccatacaggagat

SEQ ID NO: 9217847 - DNA, 22 bp, Homo sapiens
tgagccagtgtggtaaagctga

SEQ ID NO: 9217848 - DNA, 22 bp, Homo sapiens
tgagccagtggaagatggcagt

SEQ ID NO: 9217849 - DNA, 22 bp, Homo sapiens
tgagccagtggaagatggcagt

SEQ ID NO: 9217850 - DNA, 22 bp, Homo sapiens
tgagccatgggactccaaggga

SEQ ID NO: 9217851 - DNA, 22 bp, Homo sapiens
ccagtctgaggcctggtgaggg

SEQ ID NO: 9217852 - DNA, 22 bp, Homo sapiens
tgagcccaggagtatgaggctg

SEQ ID NO: 9217853 - DNA, 22 bp, Homo sapiens
ccagtctgcagcccctggggac

SEQ ID NO: 9217854 - DNA, 22 bp, Homo sapiens
ccagtgcagtccccctgaactg

SEQ ID NO: 9217855 - DNA, 22 bp, Homo sapiens
ccagtgcaggtgagcaccaggt

SEQ ID NO: 9217856 - DNA, 23 bp, Homo sapiens
tgagcccaggaggtcaaggctgc

SEQ ID NO: 9217857 - DNA, 22 bp, Homo sapiens
tgagcccagaagcccactcggc

SEQ ID NO: 9217858 - DNA, 22 bp, Homo sapiens
ccaggtggcttctgcccgatgt

SEQ ID NO: 9217859 - DNA, 22 bp, Homo sapiens
tgagcagagacgggggcctcca

SEQ ID NO: 9217860 - DNA, 22 bp, Homo sapiens
tgagcaggtgagtctagggcag

SEQ ID NO: 9217861 - DNA, 22 bp, Homo sapiens
tgagcagtaacagctcacaggg

SEQ ID NO: 9217862 - DNA, 21 bp, Homo sapiens
tgcaggcaggcagagatgctg

SEQ ID NO: 9217863 - DNA, 22 bp, Homo sapiens
tgcaggcctatggtggggcccc

SEQ ID NO: 9217864 - DNA, 22 bp, Homo sapiens
tgcaggcccagtgtagaggctc

SEQ ID NO: 9217865 - DNA, 22 bp, Homo sapiens
cccagcagcctggatgttcttt

SEQ ID NO: 9217866 - DNA, 22 bp, Homo sapiens
tgcagggatcctagctgaagag

SEQ ID NO: 9217867 - DNA, 22 bp, Homo sapiens
cccagcagcttgcacagtgctg

SEQ ID NO: 9217868 - DNA, 22 bp, Homo sapiens
cccagcaggcatgttgggagga

SEQ ID NO: 9217869 - DNA, 22 bp, Homo sapiens
cccagcaggcatgttgggagga

SEQ ID NO: 9217870 - DNA, 22 bp, Homo sapiens
cccagcagggtctctgtgtcta

SEQ ID NO: 9217871 - DNA, 22 bp, Homo sapiens
cccagcaggtcggtgctgcctg

SEQ ID NO: 9217872 - DNA, 22 bp, Homo sapiens
tgcaggaatagctacagagctg

SEQ ID NO: 9217873 - DNA, 22 bp, Homo sapiens
tgcagctgctcattctctcagt

SEQ ID NO: 9217874 - DNA, 22 bp, Homo sapiens
tgcagctgcctagggctggctt

SEQ ID NO: 9217875 - DNA, 23 bp, Homo sapiens
tgcagctgcctctggcgggccgg

SEQ ID NO: 9217876 - DNA, 22 bp, Homo sapiens
cccagagggaagggaatgaggt

SEQ ID NO: 9217877 - DNA, 22 bp, Homo sapiens
cccagagggctgaggatatgaa

SEQ ID NO: 9217878 - DNA, 22 bp, Homo sapiens
cccagaggggtcgtctgagggg

SEQ ID NO: 9217879 - DNA, 22 bp, Homo sapiens
cccagaggctgagttgggagca

SEQ ID NO: 9217880 - DNA, 20 bp, Homo sapiens
tgcagctgcaggagggtggg

SEQ ID NO: 9217881 - DNA, 22 bp, Homo sapiens
tgcagctgattaaagggcagac

SEQ ID NO: 9217882 - DNA, 22 bp, Homo sapiens
tgcagctgattaaagggcagac

SEQ ID NO: 9217883 - DNA, 22 bp, Homo sapiens
tgcagagaagaggacagttcta

SEQ ID NO: 9217884 - DNA, 22 bp, Homo sapiens
tgcagagaaagtgtagacaggc

SEQ ID NO: 9217885 - DNA, 22 bp, Homo sapiens
tgcagagaccactgtgccttcc

SEQ ID NO: 9217886 - DNA, 19 bp, Homo sapiens
tgcagagagaggcaaagaa

SEQ ID NO: 9217887 - DNA, 22 bp, Homo sapiens
tgcagagagacccctgggccag

SEQ ID NO: 9217888 - DNA, 22 bp, Homo sapiens
tgcagagagatatggcaagagg

SEQ ID NO: 9217889 - DNA, 22 bp, Homo sapiens
tgcagagagatcctcagggttt

SEQ ID NO: 9217890 - DNA, 22 bp, Homo sapiens
tgcactggtggtgagtgaggga

SEQ ID NO: 9217891 - DNA, 22 bp, Homo sapiens
tgcactttgcaggcatggaaac

SEQ ID NO: 9217892 - DNA, 22 bp, Homo sapiens
tgcactgggaaagaaggaggga

SEQ ID NO: 9217893 - DNA, 22 bp, Homo sapiens
tgcactggggtcccagcgcacg

SEQ ID NO: 9217894 - DNA, 22 bp, Homo sapiens
tgcactccaggctgggtgacag

SEQ ID NO: 9217895 - DNA, 22 bp, Homo sapiens
cccagagctgggtgggcagcgg

SEQ ID NO: 9217896 - DNA, 23 bp, Homo sapiens
cccagaggagcagggcgtgagat

SEQ ID NO: 9217897 - DNA, 22 bp, Homo sapiens
cccagagctgagggggcacgtt

SEQ ID NO: 9217898 - DNA, 22 bp, Homo sapiens
tgcagagagccagctctctcgg

SEQ ID NO: 9217899 - DNA, 16 bp, Homo sapiens
tgcagagagcatggtg

SEQ ID NO: 9217900 - DNA, 22 bp, Homo sapiens
tgcagagagccctgccttcctc

SEQ ID NO: 9217901 - DNA, 21 bp, Homo sapiens
cccagagcctagggagggcac

SEQ ID NO: 9217902 - DNA, 22 bp, Homo sapiens
cccagagatgggaggtgatcgg

SEQ ID NO: 9217903 - DNA, 17 bp, Homo sapiens
cccagagatgctgcctt

SEQ ID NO: 9217904 - DNA, 21 bp, Homo sapiens
cccaagggaggcaggataagg

SEQ ID NO: 9217905 - DNA, 22 bp, Homo sapiens
cccaaggctgcagtgagcatga

SEQ ID NO: 9217906 - DNA, 22 bp, Homo sapiens
cccaaggaataggatcccagga

SEQ ID NO: 9217907 - DNA, 22 bp, Homo sapiens
cccaaggaagacgcttgtgata

SEQ ID NO: 9217908 - DNA, 23 bp, Homo sapiens
cccaagcctgtgccctctgactc

SEQ ID NO: 9217909 - DNA, 22 bp, Homo sapiens
tgcacagatgggcttgttcata

SEQ ID NO: 9217910 - DNA, 18 bp, Homo sapiens
tgcactagatgctggcag

SEQ ID NO: 9217911 - DNA, 21 bp, Homo sapiens
tgcacagcaaaagttgagtaa

SEQ ID NO: 9217912 - DNA, 22 bp, Homo sapiens
cccaaggggtgttgatggagga

SEQ ID NO: 9217913 - DNA, 22 bp, Homo sapiens
tgcacagatctggtggcaagga

SEQ ID NO: 9217914 - DNA, 22 bp, Homo sapiens
cccaagggatgcttgagtagtt

SEQ ID NO: 9217915 - DNA, 22 bp, Homo sapiens
tgataatattttgaatcataag

SEQ ID NO: 9217916 - DNA, 22 bp, Homo sapiens
tgataacttgtaaattagattc

SEQ ID NO: 9217917 - DNA, 22 bp, Homo sapiens
tgataaatccatgtaaatggta

SEQ ID NO: 9217918 - DNA, 22 bp, Homo sapiens
tgcaagtgccatgtgcacagtg

SEQ ID NO: 9217919 - DNA, 22 bp, Homo sapiens
cctccaggctggttatcagctg

SEQ ID NO: 9217920 - DNA, 20 bp, Homo sapiens
tggccaagtatccaactgga

SEQ ID NO: 9217921 - DNA, 22 bp, Homo sapiens
cctccagggcccctctcactgg

SEQ ID NO: 9217922 - DNA, 21 bp, Homo sapiens
cctccaggtgattccgtgctc

SEQ ID NO: 9217923 - DNA, 22 bp, Homo sapiens
cctccagggcccctctcactgg

SEQ ID NO: 9217924 - DNA, 22 bp, Homo sapiens
tggcatttggcttacttatgtt

SEQ ID NO: 9217925 - DNA, 22 bp, Homo sapiens
tggcatttgggctggcttttct

SEQ ID NO: 9217926 - DNA, 22 bp, Homo sapiens
tggcattttgtagctgtgtatc

SEQ ID NO: 9217927 - DNA, 22 bp, Homo sapiens
tggcattttgttcagtatatgg

SEQ ID NO: 9217928 - DNA, 22 bp, Homo sapiens
tggccaaatttggtgtaacttg

SEQ ID NO: 9217929 - DNA, 22 bp, Homo sapiens
tggccaagccactgctgggtct

SEQ ID NO: 9217930 - DNA, 19 bp, Homo sapiens
tggcatttggaggcaacct

SEQ ID NO: 9217931 - DNA, 22 bp, Homo sapiens
tggcagtgtgggaggaaggtac

SEQ ID NO: 9217932 - DNA, 22 bp, Homo sapiens
tggcatttctgttagactctca

SEQ ID NO: 9217933 - DNA, 22 bp, Homo sapiens
tggcagtgggaagctggaagtc

SEQ ID NO: 9217934 - DNA, 22 bp, Homo sapiens
cctccaggtgttacatatgact

SEQ ID NO: 9217935 - DNA, 22 bp, Homo sapiens
cctccatctccagcttctgcct

SEQ ID NO: 9217936 - DNA, 22 bp, Homo sapiens
cctcccacatcctagctctgct

SEQ ID NO: 9217937 - DNA, 17 bp, Homo sapiens
cctcccacaccgccctg

SEQ ID NO: 9217938 - DNA, 22 bp, Homo sapiens
cctcccacttcttgctgaggtc

SEQ ID NO: 9217939 - DNA, 22 bp, Homo sapiens
cctcccaccgtatctcagtggc

SEQ ID NO: 9217940 - DNA, 23 bp, Homo sapiens
cctcccacctatttcactttctt

SEQ ID NO: 9217941 - DNA, 19 bp, Homo sapiens
cctcccacggattccttcc

SEQ ID NO: 9217942 - DNA, 22 bp, Homo sapiens
cctcccaccgtatctcagtggc

SEQ ID NO: 9217943 - DNA, 22 bp, Homo sapiens
cctcccaccatttagagagagc

SEQ ID NO: 9217944 - DNA, 22 bp, Homo sapiens
cctcccacattgaggacatgct

SEQ ID NO: 9217945 - DNA, 22 bp, Homo sapiens
cctcccacattgaggacatgct

SEQ ID NO: 9217946 - DNA, 23 bp, Homo sapiens
cctcctgggcacaggcctgatgg

SEQ ID NO: 9217947 - DNA, 22 bp, Homo sapiens
cctcctgggagagcacggaggg

SEQ ID NO: 9217948 - DNA, 22 bp, Homo sapiens
cctcctgggctcctgtctgcac

SEQ ID NO: 9217949 - DNA, 22 bp, Homo sapiens
cctcctggcctgtgcagagccc

SEQ ID NO: 9217950 - DNA, 22 bp, Homo sapiens
cctcctggccctgggcctggaa

SEQ ID NO: 9217951 - DNA, 22 bp, Homo sapiens
cctcctggcttttcccattgaa

SEQ ID NO: 9217952 - DNA, 22 bp, Homo sapiens
cctcctgggacaggctggcaca

SEQ ID NO: 9217953 - DNA, 22 bp, Homo sapiens
cctcctgggactcattagcacc

SEQ ID NO: 9217954 - DNA, 23 bp, Homo sapiens
tgggatagaatttcatggctgct

SEQ ID NO: 9217955 - DNA, 21 bp, Homo sapiens
tgggatagaaatatggctgct

SEQ ID NO: 9217956 - DNA, 22 bp, Homo sapiens
tgggcactgtagctggtgctgg

SEQ ID NO: 9217957 - DNA, 22 bp, Homo sapiens
tgggacagagtgagctttggcc

SEQ ID NO: 9217958 - DNA, 22 bp, Homo sapiens
tgggacagattataagtctgca

SEQ ID NO: 9217959 - DNA, 22 bp, Homo sapiens
tgggacaggaggcctctggaga

SEQ ID NO: 9217960 - DNA, 22 bp, Homo sapiens
tgggagagaattctggtgactg

SEQ ID NO: 9217961 - DNA, 22 bp, Homo sapiens
tgggacagggaatctgatcccc

SEQ ID NO: 9217962 - DNA, 20 bp, Homo sapiens
tggcttgtttctatgggcag

SEQ ID NO: 9217963 - DNA, 22 bp, Homo sapiens
tggcttggctaagatctaagct

SEQ ID NO: 9217964 - DNA, 22 bp, Homo sapiens
tggcttcccatagcttgctagt

SEQ ID NO: 9217965 - DNA, 22 bp, Homo sapiens
cctcctgggttcaagcgattct

SEQ ID NO: 9217966 - DNA, 20 bp, Homo sapiens
cctcctggtcaggtgtgcag

SEQ ID NO: 9217967 - DNA, 19 bp, Homo sapiens
cctctcccatgcttacctc

SEQ ID NO: 9217968 - DNA, 22 bp, Homo sapiens
tgggaaggcagtcactgtccta

SEQ ID NO: 9217969 - DNA, 22 bp, Homo sapiens
tggctttaggagctatatacct

SEQ ID NO: 9217970 - DNA, 22 bp, Homo sapiens
tggctttacttaaactgaatca

SEQ ID NO: 9217971 - DNA, 22 bp, Homo sapiens
cctctccagttttaacgtgacc

SEQ ID NO: 9217972 - DNA, 22 bp, Homo sapiens
tgggtccacaaacatcagatat

SEQ ID NO: 9217973 - DNA, 22 bp, Homo sapiens
tgggtggaataaatcagttctg

SEQ ID NO: 9217974 - DNA, 18 bp, Homo sapiens
tgggtggctagggagttt

SEQ ID NO: 9217975 - DNA, 22 bp, Homo sapiens
tgggtggcacttctggggtcca

SEQ ID NO: 9217976 - DNA, 22 bp, Homo sapiens
tgggtgggagcaccctgtctgg

SEQ ID NO: 9217977 - DNA, 22 bp, Homo sapiens
tgggtgggagcaccctgtctgg

SEQ ID NO: 9217978 - DNA, 22 bp, Homo sapiens
tggtacaatggcatctatctat

SEQ ID NO: 9217979 - DNA, 22 bp, Homo sapiens
tggtacaatcacagctcactgt

SEQ ID NO: 9217980 - DNA, 22 bp, Homo sapiens
tggtacaactgtattaggcaaa

SEQ ID NO: 9217981 - DNA, 22 bp, Homo sapiens
tggtacaagatgttctaactga

SEQ ID NO: 9217982 - DNA, 22 bp, Homo sapiens
tggtacaagcagactcagcaga

SEQ ID NO: 9217983 - DNA, 22 bp, Homo sapiens
cctgcctcccagaggtcctcta

SEQ ID NO: 9217984 - DNA, 23 bp, Homo sapiens
cctgcctccccatcagttataca

SEQ ID NO: 9217985 - DNA, 22 bp, Homo sapiens
cctgcctgacagagaaggttca

SEQ ID NO: 9217986 - DNA, 22 bp, Homo sapiens
cctgcctgacagagaaggttca

SEQ ID NO: 9217987 - DNA, 22 bp, Homo sapiens
cctgcctgcaccttctctgggg

SEQ ID NO: 9217988 - DNA, 22 bp, Homo sapiens
cctgcctgattccaggatggct

SEQ ID NO: 9217989 - DNA, 22 bp, Homo sapiens
tggtgggacatctgaggagagg

SEQ ID NO: 9217990 - DNA, 22 bp, Homo sapiens
cctgcctgcagaaagtatctcc

SEQ ID NO: 9217991 - DNA, 22 bp, Homo sapiens
tggtgggagtccgctgtgctgc

SEQ ID NO: 9217992 - DNA, 22 bp, Homo sapiens
tggttacccagtcgctggagtt

SEQ ID NO: 9217993 - DNA, 22 bp, Homo sapiens
cctgcctcatcaacttgtcgtg

SEQ ID NO: 9217994 - DNA, 22 bp, Homo sapiens
cctgcctatgtaagtggtttct

SEQ ID NO: 9217995 - DNA, 22 bp, Homo sapiens
cctgcctactgagttttatatt

SEQ ID NO: 9217996 - DNA, 22 bp, Homo sapiens
cctgcctatgagacgttttgcc

SEQ ID NO: 9217997 - DNA, 22 bp, Homo sapiens
cctgcccttctttccccagcat

SEQ ID NO: 9217998 - DNA, 22 bp, Homo sapiens
cctgcccttctttccccagcat

SEQ ID NO: 9217999 - DNA, 22 bp, Homo sapiens
tggtaggaatgattacgacttt

SEQ ID NO: 9218000 - DNA, 22 bp, Homo sapiens
tggtagcaggtgtgatagaaat

SEQ ID NO: 9218001 - DNA, 22 bp, Homo sapiens
cctgcccagcttcacctcaggc

SEQ ID NO: 9218002 - DNA, 22 bp, Homo sapiens
tggtaccatttcccaggagtgt

SEQ ID NO: 9218003 - DNA, 22 bp, Homo sapiens
tggtagcaacatctcagtggct

SEQ ID NO: 9218004 - DNA, 22 bp, Homo sapiens
tggtacacatgtccaaggtcag

SEQ ID NO: 9218005 - DNA, 22 bp, Homo sapiens
tgggcaggcaagtgaatacctt

SEQ ID NO: 9218006 - DNA, 22 bp, Homo sapiens
tgggcaggcaagtgaatacctt

SEQ ID NO: 9218007 - DNA, 22 bp, Homo sapiens
tgggcaggagagaagctaaaga

SEQ ID NO: 9218008 - DNA, 22 bp, Homo sapiens
tgggcaggataatatctcatgt

SEQ ID NO: 9218009 - DNA, 22 bp, Homo sapiens
tgggcctggagtttgtccagag

SEQ ID NO: 9218010 - DNA, 22 bp, Homo sapiens
tgggcctggacaaggccactag

SEQ ID NO: 9218011 - DNA, 22 bp, Homo sapiens
tgggcctggacaaggccactag

SEQ ID NO: 9218012 - DNA, 21 bp, Homo sapiens
tgggcctcaagtgggtggcag

SEQ ID NO: 9218013 - DNA, 22 bp, Homo sapiens
tgggcctgggagggcagacgct

SEQ ID NO: 9218014 - DNA, 22 bp, Homo sapiens
tgggctcatggcccagcactgg

SEQ ID NO: 9218015 - DNA, 23 bp, Homo sapiens
tgggcctggcctcccagtccagc

SEQ ID NO: 9218016 - DNA, 22 bp, Homo sapiens
tgggctcctcgtcactcgctgt

SEQ ID NO: 9218017 - DNA, 22 bp, Homo sapiens
tgggctccggcggcctcaggct

SEQ ID NO: 9218018 - DNA, 22 bp, Homo sapiens
tgggctccggcggcctcaggct

SEQ ID NO: 9218019 - DNA, 22 bp, Homo sapiens
tgggctccggcggcctcaggct

SEQ ID NO: 9218020 - DNA, 22 bp, Homo sapiens
tgggctcatggcccagcactgg

SEQ ID NO: 9218021 - DNA, 22 bp, Homo sapiens
tgggctcatgtttctttgagga

SEQ ID NO: 9218022 - DNA, 22 bp, Homo sapiens
tgggctccagcacctgtgctct

SEQ ID NO: 9218023 - DNA, 22 bp, Homo sapiens
tgggctccagcacctgtgctct

SEQ ID NO: 9218024 - DNA, 22 bp, Homo sapiens
cctgcagacacttgtccagcaa

SEQ ID NO: 9218025 - DNA, 22 bp, Homo sapiens
cctgagtctttcccattgcgct

SEQ ID NO: 9218026 - DNA, 22 bp, Homo sapiens
cctgaggtcatggtccagtgtt

SEQ ID NO: 9218027 - DNA, 22 bp, Homo sapiens
cctgagtgacctgaggtctagt

SEQ ID NO: 9218028 - DNA, 22 bp, Homo sapiens
cctgagtgcttccagagtcatg

SEQ ID NO: 9218029 - DNA, 22 bp, Homo sapiens
cctgagtggccaggcagctgtg

SEQ ID NO: 9218030 - DNA, 17 bp, Homo sapiens
cctgagtgggagaggaa

SEQ ID NO: 9218031 - DNA, 22 bp, Homo sapiens
cctgagttagttgctgtgtctc

SEQ ID NO: 9218032 - DNA, 22 bp, Homo sapiens
cctgatggagccctgctgcatg

SEQ ID NO: 9218033 - DNA, 22 bp, Homo sapiens
cctgatcaaaaatgtattgttg

SEQ ID NO: 9218034 - DNA, 22 bp, Homo sapiens
cctgatcaagttttctggctcc

SEQ ID NO: 9218035 - DNA, 20 bp, Homo sapiens
cctgatcacaagggtccttg

SEQ ID NO: 9218036 - DNA, 22 bp, Homo sapiens
cctgatcaaagaggtcagcatt

SEQ ID NO: 9218037 - DNA, 22 bp, Homo sapiens
ccctcctcaactctggcttcca

SEQ ID NO: 9218038 - DNA, 22 bp, Homo sapiens
ccctcctcaactctggcttcca

SEQ ID NO: 9218039 - DNA, 23 bp, Homo sapiens
tggaaacattctgaatgtccatc

SEQ ID NO: 9218040 - DNA, 22 bp, Homo sapiens
ccctccctttgcagcagtgcat

SEQ ID NO: 9218041 - DNA, 22 bp, Homo sapiens
ccctccctttgcagcagtgcat

SEQ ID NO: 9218042 - DNA, 22 bp, Homo sapiens
ccctccctgaagaagttactct

SEQ ID NO: 9218043 - DNA, 22 bp, Homo sapiens
ccctccctgaagaagttactct

SEQ ID NO: 9218044 - DNA, 22 bp, Homo sapiens
ccctccctgaagaagttactct

SEQ ID NO: 9218045 - DNA, 22 bp, Homo sapiens
tggagacatgggcgaatctaag

SEQ ID NO: 9218046 - DNA, 22 bp, Homo sapiens
ccctggagggatttctcaatca

SEQ ID NO: 9218047 - DNA, 22 bp, Homo sapiens
ccctggaggaagaaacaatggc

SEQ ID NO: 9218048 - DNA, 22 bp, Homo sapiens
tggaggcataggcctgggccct

SEQ ID NO: 9218049 - DNA, 23 bp, Homo sapiens
tggaggaaacacatcagaagacc

SEQ ID NO: 9218050 - DNA, 21 bp, Homo sapiens
tggaggaataaagcacagaag

SEQ ID NO: 9218051 - DNA, 18 bp, Homo sapiens
tggaggaatcacaatggc

SEQ ID NO: 9218052 - DNA, 18 bp, Homo sapiens
tggagctgagggcaatgc

SEQ ID NO: 9218053 - DNA, 22 bp, Homo sapiens
ccctggagtgccggaatcaaga

SEQ ID NO: 9218054 - DNA, 22 bp, Homo sapiens
ccctggagtccggagctcacct

SEQ ID NO: 9218055 - DNA, 22 bp, Homo sapiens
ccctggaggtcagaggcctggg

SEQ ID NO: 9218056 - DNA, 22 bp, Homo sapiens
ccctggagtgtgacgaggcatt

SEQ ID NO: 9218057 - DNA, 22 bp, Homo sapiens
tggcacttgggagtcgtggcga

SEQ ID NO: 9218058 - DNA, 22 bp, Homo sapiens
tggcacttggctgagaggttct

SEQ ID NO: 9218059 - DNA, 22 bp, Homo sapiens
tggcacttgcttcagatgatgt

SEQ ID NO: 9218060 - DNA, 22 bp, Homo sapiens
tggcacttgatatttgatttgc

SEQ ID NO: 9218061 - DNA, 22 bp, Homo sapiens
ccctggagtgtgacgaggcatt

SEQ ID NO: 9218062 - DNA, 22 bp, Homo sapiens
tggcacttggtaaatatgtgtt

SEQ ID NO: 9218063 - DNA, 22 bp, Homo sapiens
tggcactttacttcctcaggag

SEQ ID NO: 9218064 - DNA, 22 bp, Homo sapiens
tggcactttacacccatttggc

SEQ ID NO: 9218065 - DNA, 22 bp, Homo sapiens
tggcacttttcccagttttggt

SEQ ID NO: 9218066 - DNA, 22 bp, Homo sapiens
tggcagaagtacacaagcatgc

SEQ ID NO: 9218067 - DNA, 22 bp, Homo sapiens
tggcagaagtacacaagcatgc

SEQ ID NO: 9218068 - DNA, 22 bp, Homo sapiens
tggcagaaagaaccatgtgcaa

SEQ ID NO: 9218069 - DNA, 22 bp, Homo sapiens
tggcagaattttaaagacagat

SEQ ID NO: 9218070 - DNA, 22 bp, Homo sapiens
tggcagaagttcactagtagct

SEQ ID NO: 9218071 - DNA, 22 bp, Homo sapiens
tggcagaatttctagcagattc

SEQ ID NO: 9218072 - DNA, 22 bp, Homo sapiens
ccctggctgctaccaggtagct

SEQ ID NO: 9218073 - DNA, 22 bp, Homo sapiens
tggcaggaaaaacattggagat

SEQ ID NO: 9218074 - DNA, 22 bp, Homo sapiens
ccctgggaggcttccaggcaga

SEQ ID NO: 9218075 - DNA, 22 bp, Homo sapiens
ccctgggagaagttgagggctg

SEQ ID NO: 9218076 - DNA, 19 bp, Homo sapiens
tggcagggagagtttgaag

SEQ ID NO: 9218077 - DNA, 22 bp, Homo sapiens
tggcagggaatacagatgttta

SEQ ID NO: 9218078 - DNA, 22 bp, Homo sapiens
cccttgcttgcccagtcacagg

SEQ ID NO: 9218079 - DNA, 22 bp, Homo sapiens
ccctttagcccctgcagagact

SEQ ID NO: 9218080 - DNA, 22 bp, Homo sapiens
cccagtggaaggagtagaagac

SEQ ID NO: 9218081 - DNA, 22 bp, Homo sapiens
cccagtggctgtccccatgggc

SEQ ID NO: 9218082 - DNA, 22 bp, Homo sapiens
tgctctgcaagcaggagcaaga

SEQ ID NO: 9218083 - DNA, 22 bp, Homo sapiens
tgctctgcacatccctcacaaa

SEQ ID NO: 9218084 - DNA, 22 bp, Homo sapiens
cccaggtctcctgcttcccagg

SEQ ID NO: 9218085 - DNA, 22 bp, Homo sapiens
cccaggtctccctgcagccctg

SEQ ID NO: 9218086 - DNA, 22 bp, Homo sapiens
tgctcaggtgccttggctgctg

SEQ ID NO: 9218087 - DNA, 22 bp, Homo sapiens
tgctcaggtcgttctgcccctt

SEQ ID NO: 9218088 - DNA, 22 bp, Homo sapiens
tgctctggaaataaatgattta

SEQ ID NO: 9218089 - DNA, 22 bp, Homo sapiens
tgctctggagggtgaagctttt

SEQ ID NO: 9218090 - DNA, 22 bp, Homo sapiens
tgctctggacgctgagtggttt

SEQ ID NO: 9218091 - DNA, 22 bp, Homo sapiens
tgctgcctggagccttttgttt

SEQ ID NO: 9218092 - DNA, 22 bp, Homo sapiens
tgctgcctgctacgagggaaga

SEQ ID NO: 9218093 - DNA, 22 bp, Homo sapiens
tgctgcctggagccttttgttt

SEQ ID NO: 9218094 - DNA, 22 bp, Homo sapiens
tgctgcctgatgctttctggac

SEQ ID NO: 9218095 - DNA, 22 bp, Homo sapiens
tgctgcctggtttcttcttgct

SEQ ID NO: 9218096 - DNA, 22 bp, Homo sapiens
tgctgcctggtttcttcttgct

SEQ ID NO: 9218097 - DNA, 22 bp, Homo sapiens
tgctgcctgtgccaggagggtc

SEQ ID NO: 9218098 - DNA, 21 bp, Homo sapiens
tgctgcctgtgggtgtttacc

SEQ ID NO: 9218099 - DNA, 22 bp, Homo sapiens
tgctgcctgttgtggggccacg

SEQ ID NO: 9218100 - DNA, 22 bp, Homo sapiens
tgctgccttgtgctgcctttca

SEQ ID NO: 9218101 - DNA, 22 bp, Homo sapiens
tgctgccttgacctcctgggct

SEQ ID NO: 9218102 - DNA, 22 bp, Homo sapiens
tgctgcctttactgggatttaa

SEQ ID NO: 9218103 - DNA, 22 bp, Homo sapiens
tgctgcctttctgaatggtgga

SEQ ID NO: 9218104 - DNA, 22 bp, Homo sapiens
tgctgcctttcaatgttgtcat

SEQ ID NO: 9218105 - DNA, 22 bp, Homo sapiens
tgctgcctttgcttagcgaata

SEQ ID NO: 9218106 - DNA, 22 bp, Homo sapiens
tgctgccttagcagccaggcaa

SEQ ID NO: 9218107 - DNA, 22 bp, Homo sapiens
tgctgccttctaggcgtgccct

SEQ ID NO: 9218108 - DNA, 20 bp, Homo sapiens
tgctgcctgtttttgtgaat

SEQ ID NO: 9218109 - DNA, 22 bp, Homo sapiens
tgctgccttagaaatggctata

SEQ ID NO: 9218110 - DNA, 22 bp, Homo sapiens
tgctaggggtcagcaccatatc

SEQ ID NO: 9218111 - DNA, 22 bp, Homo sapiens
tgctaggggcactaaaagctga

SEQ ID NO: 9218112 - DNA, 22 bp, Homo sapiens
tgctcaggaggaggctgtgagg

SEQ ID NO: 9218113 - DNA, 22 bp, Homo sapiens
tgcttgtccctctttatgatgg

SEQ ID NO: 9218114 - DNA, 22 bp, Homo sapiens
ccctccccacaaagcttcacac

SEQ ID NO: 9218115 - DNA, 22 bp, Homo sapiens
ccctccccagggtcatattgaa

SEQ ID NO: 9218116 - DNA, 22 bp, Homo sapiens
ccctccctatgtagatgatgtt

SEQ ID NO: 9218117 - DNA, 22 bp, Homo sapiens
ccctccctatgtagatgatgtt

SEQ ID NO: 9218118 - DNA, 21 bp, Homo sapiens
tgcttgggggcttcaggagct

SEQ ID NO: 9218119 - DNA, 22 bp, Homo sapiens
tgcttgggcggccagcatggcg

SEQ ID NO: 9218120 - DNA, 22 bp, Homo sapiens
tgcttcctatccacacaatgcc

SEQ ID NO: 9218121 - DNA, 22 bp, Homo sapiens
tgcttcctatccacacaatgcc

SEQ ID NO: 9218122 - DNA, 22 bp, Homo sapiens
tgcttccctgctctgcacacct

SEQ ID NO: 9218123 - DNA, 21 bp, Homo sapiens
tgcttccctgggccacactga

SEQ ID NO: 9218124 - DNA, 19 bp, Homo sapiens
tgcttcctcaccatctccc

SEQ ID NO: 9218125 - DNA, 22 bp, Homo sapiens
tgcttcctgaggccgtcttctc

SEQ ID NO: 9218126 - DNA, 22 bp, Homo sapiens
tgcttcctgaggccgtcttctc

SEQ ID NO: 9218127 - DNA, 22 bp, Homo sapiens
tgcttcctgaggccgtcttctc

SEQ ID NO: 9218128 - DNA, 22 bp, Homo sapiens
tgcttcctgctaaggctgcctg

SEQ ID NO: 9218129 - DNA, 22 bp, Homo sapiens
tgcttccttcccgttcttctcc

SEQ ID NO: 9218130 - DNA, 22 bp, Homo sapiens
tgcttccttcccgttcttctcc

SEQ ID NO: 9218131 - DNA, 20 bp, Homo sapiens
tgcttcctggccactgcggg

SEQ ID NO: 9218132 - DNA, 22 bp, Homo sapiens
tgcttccttcccgttcttctcc

SEQ ID NO: 9218133 - DNA, 22 bp, Homo sapiens
tgcttccttcccgttcttctcc

SEQ ID NO: 9218134 - DNA, 22 bp, Homo sapiens
tgcttccttcccgttcttctcc

SEQ ID NO: 9218135 - DNA, 22 bp, Homo sapiens
tgcttccttgagctctccaatc

SEQ ID NO: 9218136 - DNA, 22 bp, Homo sapiens
tgcttccttgagctctccaatc

SEQ ID NO: 9218137 - DNA, 22 bp, Homo sapiens
tgcttccttgatcattcccaaa

SEQ ID NO: 9218138 - DNA, 22 bp, Homo sapiens
tgcttccttgatcattcccaaa

SEQ ID NO: 9218139 - DNA, 22 bp, Homo sapiens
ccccaggacacatggaccaagt

SEQ ID NO: 9218140 - DNA, 22 bp, Homo sapiens
ccccaggagaaatcttaaacta

SEQ ID NO: 9218141 - DNA, 22 bp, Homo sapiens
tgcttccctgctctgcacacct

SEQ ID NO: 9218142 - DNA, 22 bp, Homo sapiens
cccagtgtgcccctcctgcagc

SEQ ID NO: 9218143 - DNA, 22 bp, Homo sapiens
tgctgcctttgggacctggcct

SEQ ID NO: 9218144 - DNA, 22 bp, Homo sapiens
tgctgcctttgtggggtcactg

SEQ ID NO: 9218145 - DNA, 22 bp, Homo sapiens
cccagtggggaaatagctagct

SEQ ID NO: 9218146 - DNA, 22 bp, Homo sapiens
cccagtggcttttgcccaggtt

SEQ ID NO: 9218147 - DNA, 22 bp, Homo sapiens
cccagtggtgctggcatctgtg

SEQ ID NO: 9218148 - DNA, 22 bp, Homo sapiens
cccagtggtgctggcatctgtg

SEQ ID NO: 9218149 - DNA, 22 bp, Homo sapiens
cccagtggtttgcagaaccaag

SEQ ID NO: 9218150 - DNA, 22 bp, Homo sapiens
tgctgggggttcagatgagtaa

SEQ ID NO: 9218151 - DNA, 22 bp, Homo sapiens
ccccagctcagtgcagggacat

SEQ ID NO: 9218152 - DNA, 22 bp, Homo sapiens
ccccagctgagatttgaggaga

SEQ ID NO: 9218153 - DNA, 22 bp, Homo sapiens
ccccagctgcatacttgccaag

SEQ ID NO: 9218154 - DNA, 22 bp, Homo sapiens
tcactgttgatgggcatgcagg

SEQ ID NO: 9218155 - DNA, 22 bp, Homo sapiens
tcacttagatggggatcatcac

SEQ ID NO: 9218156 - DNA, 22 bp, Homo sapiens
tcaggaggcgtgctggggtaca

SEQ ID NO: 9218157 - DNA, 22 bp, Homo sapiens
tcaggaggccaccaggacctgt

SEQ ID NO: 9218158 - DNA, 22 bp, Homo sapiens
tcaggaggcctgagtagctcta

SEQ ID NO: 9218159 - DNA, 22 bp, Homo sapiens
tcaggaggcggaggttgcagtg

SEQ ID NO: 9218160 - DNA, 22 bp, Homo sapiens
tcaggctgcagctgtcagcagc

SEQ ID NO: 9218161 - DNA, 22 bp, Homo sapiens
tcaggctgcagctgtcagcagc

SEQ ID NO: 9218162 - DNA, 22 bp, Homo sapiens
tcaggctgcagtggcaaaagac

SEQ ID NO: 9218163 - DNA, 22 bp, Homo sapiens
tcaggctgatttcttttgaggg

SEQ ID NO: 9218164 - DNA, 18 bp, Homo sapiens
tcaggctgccctgtgtct

SEQ ID NO: 9218165 - DNA, 22 bp, Homo sapiens
tcaggctgcctatcagactgtg

SEQ ID NO: 9218166 - DNA, 22 bp, Homo sapiens
tcaggctgcctatcagactgtg

SEQ ID NO: 9218167 - DNA, 22 bp, Homo sapiens
tcaggctgcatctgtaagggtg

SEQ ID NO: 9218168 - DNA, 22 bp, Homo sapiens
tcaggctgcccgttcagggctc

SEQ ID NO: 9218169 - DNA, 22 bp, Homo sapiens
tcaggctgcccgttcagggctc

SEQ ID NO: 9218170 - DNA, 22 bp, Homo sapiens
catcaaatggcaagtgaaagct

SEQ ID NO: 9218171 - DNA, 22 bp, Homo sapiens
catcaaattatgtgtcaaagca

SEQ ID NO: 9218172 - DNA, 22 bp, Homo sapiens
tcaggcagagggagaagccaag

SEQ ID NO: 9218173 - DNA, 22 bp, Homo sapiens
catatgttgacatttaaacctc

SEQ ID NO: 9218174 - DNA, 22 bp, Homo sapiens
tcaggcagaccaccgtgggcag

SEQ ID NO: 9218175 - DNA, 22 bp, Homo sapiens
tcaggcagaccaccgtgggcag

SEQ ID NO: 9218176 - DNA, 22 bp, Homo sapiens
catcagagtggtggcctggtgt

SEQ ID NO: 9218177 - DNA, 22 bp, Homo sapiens
catcaggaataaatgaggctgt

SEQ ID NO: 9218178 - DNA, 22 bp, Homo sapiens
catcaggaaaaaactggagcca

SEQ ID NO: 9218179 - DNA, 22 bp, Homo sapiens
catcagtgtggcagttcactgt

SEQ ID NO: 9218180 - DNA, 22 bp, Homo sapiens
catcagtgttgatccaccagca

SEQ ID NO: 9218181 - DNA, 22 bp, Homo sapiens
catcagtctagattctagtacc

SEQ ID NO: 9218182 - DNA, 22 bp, Homo sapiens
catcgtatggccgaatgtacat

SEQ ID NO: 9218183 - DNA, 22 bp, Homo sapiens
tccaggctgggctgaagggtgc

SEQ ID NO: 9218184 - DNA, 22 bp, Homo sapiens
tccaggctgggctgaagggtgc

SEQ ID NO: 9218185 - DNA, 20 bp, Homo sapiens
tccaggctcctccacttagt

SEQ ID NO: 9218186 - DNA, 22 bp, Homo sapiens
tccaggctgtgcatgagtttag

SEQ ID NO: 9218187 - DNA, 22 bp, Homo sapiens
tccaggctgtgcgcaccgtgtg

SEQ ID NO: 9218188 - DNA, 22 bp, Homo sapiens
tccaggcttcacgtctgccctc

SEQ ID NO: 9218189 - DNA, 23 bp, Homo sapiens
catgtacacacagctgtacagtg

SEQ ID NO: 9218190 - DNA, 22 bp, Homo sapiens
tccaggcttgagaccaggctct

SEQ ID NO: 9218191 - DNA, 22 bp, Homo sapiens
tccaggctttggggcaggagcg

SEQ ID NO: 9218192 - DNA, 22 bp, Homo sapiens
tccaggctttggggcaggagcg

SEQ ID NO: 9218193 - DNA, 22 bp, Homo sapiens
tccaggctttttcatgctgtct

SEQ ID NO: 9218194 - DNA, 22 bp, Homo sapiens
catgtgcattggggccagggag

SEQ ID NO: 9218195 - DNA, 22 bp, Homo sapiens
catgtgggaagaggccagctgg

SEQ ID NO: 9218196 - DNA, 22 bp, Homo sapiens
catgttttgtgtacagaatatt

SEQ ID NO: 9218197 - DNA, 22 bp, Homo sapiens
tccagggcatgctcagactcag

SEQ ID NO: 9218198 - DNA, 22 bp, Homo sapiens
tccagggcatgctcagactcag

SEQ ID NO: 9218199 - DNA, 22 bp, Homo sapiens
tccagggcatgctcagactcag

SEQ ID NO: 9218200 - DNA, 23 bp, Homo sapiens
tccagggcagtggctgggtctgc

SEQ ID NO: 9218201 - DNA, 22 bp, Homo sapiens
tccaggtcagacttctgtgccc

SEQ ID NO: 9218202 - DNA, 22 bp, Homo sapiens
tccaggtatctggcttccacat

SEQ ID NO: 9218203 - DNA, 22 bp, Homo sapiens
tccaggtatgacaggccactcc

SEQ ID NO: 9218204 - DNA, 20 bp, Homo sapiens
tccaggtaacatctctctgg

SEQ ID NO: 9218205 - DNA, 22 bp, Homo sapiens
tccaggtaggccaagacagcta

SEQ ID NO: 9218206 - DNA, 22 bp, Homo sapiens
tccaggtagatttattccagcc

SEQ ID NO: 9218207 - DNA, 22 bp, Homo sapiens
tccaggtaatttggatgctagt

SEQ ID NO: 9218208 - DNA, 18 bp, Homo sapiens
tccaggtcccaggggaag

SEQ ID NO: 9218209 - DNA, 22 bp, Homo sapiens
tccaggtcccagactgggcagc

SEQ ID NO: 9218210 - DNA, 22 bp, Homo sapiens
tccaggtcatcttggagagctg

SEQ ID NO: 9218211 - DNA, 22 bp, Homo sapiens
cattaataaacatttcagaaga

SEQ ID NO: 9218212 - DNA, 22 bp, Homo sapiens
cattacaaagttataaacagtt

SEQ ID NO: 9218213 - DNA, 22 bp, Homo sapiens
tccagggcagtgactacagcgg

SEQ ID NO: 9218214 - DNA, 22 bp, Homo sapiens
tccagggcagtgactacagcgg

SEQ ID NO: 9218215 - DNA, 22 bp, Homo sapiens
tccagggcaggtgctgggctct

SEQ ID NO: 9218216 - DNA, 22 bp, Homo sapiens
catgtaaaacactcagaacagt

SEQ ID NO: 9218217 - DNA, 22 bp, Homo sapiens
catgtaaagcacttcataacag

SEQ ID NO: 9218218 - DNA, 22 bp, Homo sapiens
catggtttcatgagaattaccc

SEQ ID NO: 9218219 - DNA, 19 bp, Homo sapiens
catggtgaaaccccgtctc

SEQ ID NO: 9218220 - DNA, 23 bp, Homo sapiens
catggaaaactgaaagctgacct

SEQ ID NO: 9218221 - DNA, 22 bp, Homo sapiens
catggaaagcactcagcccagt

SEQ ID NO: 9218222 - DNA, 22 bp, Homo sapiens
catggaaagcactcagcccagt

SEQ ID NO: 9218223 - DNA, 22 bp, Homo sapiens
tccagcaccaccacagggaaga

SEQ ID NO: 9218224 - DNA, 22 bp, Homo sapiens
tccagcacccaatgtggctaag

SEQ ID NO: 9218225 - DNA, 22 bp, Homo sapiens
tccagcacccaatgtggctaag

SEQ ID NO: 9218226 - DNA, 22 bp, Homo sapiens
tccagcactcgcccagggcttg

SEQ ID NO: 9218227 - DNA, 22 bp, Homo sapiens
tccagcagaaccagagacctgg

SEQ ID NO: 9218228 - DNA, 22 bp, Homo sapiens
tccagcactcgcccagggcttg

SEQ ID NO: 9218229 - DNA, 22 bp, Homo sapiens
catgctttgggtcagaaatgcc

SEQ ID NO: 9218230 - DNA, 22 bp, Homo sapiens
catgctgttgaatatgacattg

SEQ ID NO: 9218231 - DNA, 22 bp, Homo sapiens
tccaagcatgtggtcaggagcc

SEQ ID NO: 9218232 - DNA, 22 bp, Homo sapiens
tccaagcactgttaattaaact

SEQ ID NO: 9218233 - DNA, 18 bp, Homo sapiens
tccagagagggagaagtg

SEQ ID NO: 9218234 - DNA, 22 bp, Homo sapiens
tccagaggtgaacacccaggca

SEQ ID NO: 9218235 - DNA, 18 bp, Homo sapiens
tccagaggtgttggagcc

SEQ ID NO: 9218236 - DNA, 22 bp, Homo sapiens
tccaagagtaagaggactcttt

SEQ ID NO: 9218237 - DNA, 20 bp, Homo sapiens
catgccagaatgtgaggtag

SEQ ID NO: 9218238 - DNA, 22 bp, Homo sapiens
catgctcacttttatactgtaa

SEQ ID NO: 9218239 - DNA, 22 bp, Homo sapiens
catgctcacttttatactgtaa

SEQ ID NO: 9218240 - DNA, 22 bp, Homo sapiens
catgctgtcctgccagggatgg

SEQ ID NO: 9218241 - DNA, 22 bp, Homo sapiens
catgctggtcagccagtggatg

SEQ ID NO: 9218242 - DNA, 20 bp, Homo sapiens
catgctgcctccattgatgc

SEQ ID NO: 9218243 - DNA, 22 bp, Homo sapiens
catgctgggtaaaggtggtgaa

SEQ ID NO: 9218244 - DNA, 22 bp, Homo sapiens
ccacaggctgctgcaggtcccg

SEQ ID NO: 9218245 - DNA, 22 bp, Homo sapiens
ccacaggcggagtggcgggcag

SEQ ID NO: 9218246 - DNA, 22 bp, Homo sapiens
ccacagggaacatgacagcctt

SEQ ID NO: 9218247 - DNA, 22 bp, Homo sapiens
ccacagggcctttcctgctggc

SEQ ID NO: 9218248 - DNA, 22 bp, Homo sapiens
ccacagctgacaatggatagac

SEQ ID NO: 9218249 - DNA, 22 bp, Homo sapiens
tcctggctagttttgctgaaat

SEQ ID NO: 9218250 - DNA, 22 bp, Homo sapiens
ccaccaggacagccctgagggg

SEQ ID NO: 9218251 - DNA, 22 bp, Homo sapiens
tcctggccttgctcctgatgcc

SEQ ID NO: 9218252 - DNA, 20 bp, Homo sapiens
tcctggccttctcgggcagt

SEQ ID NO: 9218253 - DNA, 22 bp, Homo sapiens
tcctggccttagcgaggcggtc

SEQ ID NO: 9218254 - DNA, 22 bp, Homo sapiens
tcctggccttatccccaaactg

SEQ ID NO: 9218255 - DNA, 22 bp, Homo sapiens
ccacagggcctttcctgctggc

SEQ ID NO: 9218256 - DNA, 21 bp, Homo sapiens
ccacaggggctcccctgtcag

SEQ ID NO: 9218257 - DNA, 21 bp, Homo sapiens
ccacaggggctcccctgtcag

SEQ ID NO: 9218258 - DNA, 22 bp, Homo sapiens
ccacaggggtctctgtagctga

SEQ ID NO: 9218259 - DNA, 22 bp, Homo sapiens
ccaagaggcagaatgcagagaa

SEQ ID NO: 9218260 - DNA, 21 bp, Homo sapiens
ccaagactcccatctagtggt

SEQ ID NO: 9218261 - DNA, 22 bp, Homo sapiens
tcctgagggctgcagtcatagg

SEQ ID NO: 9218262 - DNA, 22 bp, Homo sapiens
tcctgctctgatgggttctcct

SEQ ID NO: 9218263 - DNA, 22 bp, Homo sapiens
tcctgctccaccgtgggctgga

SEQ ID NO: 9218264 - DNA, 22 bp, Homo sapiens
tcctgccttcatactgctgtat

SEQ ID NO: 9218265 - DNA, 22 bp, Homo sapiens
tcctgccttgcctgggacatca

SEQ ID NO: 9218266 - DNA, 22 bp, Homo sapiens
tcctgccttcatactgctgtat

SEQ ID NO: 9218267 - DNA, 22 bp, Homo sapiens
tcctgccttagagcaaggaaaa

SEQ ID NO: 9218268 - DNA, 21 bp, Homo sapiens
tcctgccttagtccagagcag

SEQ ID NO: 9218269 - DNA, 22 bp, Homo sapiens
catttgtcatcactgagctgcc

SEQ ID NO: 9218270 - DNA, 22 bp, Homo sapiens
cattttatcctctgggaagcta

SEQ ID NO: 9218271 - DNA, 22 bp, Homo sapiens
cattttcagcacccatctgaaa

SEQ ID NO: 9218272 - DNA, 22 bp, Homo sapiens
cattttgtaagtctctcttgtt

SEQ ID NO: 9218273 - DNA, 22 bp, Homo sapiens
cattttcatgagtttctgttca

SEQ ID NO: 9218274 - DNA, 19 bp, Homo sapiens
tccagtttggcaggaagac

SEQ ID NO: 9218275 - DNA, 22 bp, Homo sapiens
tccaggtccctggggagatttt

SEQ ID NO: 9218276 - DNA, 22 bp, Homo sapiens
tccaggtcctactggcccatag

SEQ ID NO: 9218277 - DNA, 22 bp, Homo sapiens
tccatataatgggattccttat

SEQ ID NO: 9218278 - DNA, 22 bp, Homo sapiens
tccatatacaacttaatcttta

SEQ ID NO: 9218279 - DNA, 22 bp, Homo sapiens
catttcatagttgtcacaataa

SEQ ID NO: 9218280 - DNA, 22 bp, Homo sapiens
catttccagctcctgcatcatg

SEQ ID NO: 9218281 - DNA, 22 bp, Homo sapiens
ccagagccggctccctcagctt

SEQ ID NO: 9218282 - DNA, 20 bp, Homo sapiens
ccagagcagccactgaagtt

SEQ ID NO: 9218283 - DNA, 22 bp, Homo sapiens
ccagaggctgggttcacctcag

SEQ ID NO: 9218284 - DNA, 22 bp, Homo sapiens
ccagaggctggggaaggataca

SEQ ID NO: 9218285 - DNA, 22 bp, Homo sapiens
ccagaggctggcagccagctga

SEQ ID NO: 9218286 - DNA, 22 bp, Homo sapiens
ccagagcctcgcccggagcctc

SEQ ID NO: 9218287 - DNA, 22 bp, Homo sapiens
ccagaggctggcaagggctcct

SEQ ID NO: 9218288 - DNA, 22 bp, Homo sapiens
tctctgggataaactgggccag

SEQ ID NO: 9218289 - DNA, 20 bp, Homo sapiens
ccagcaccctctcagctgaa

SEQ ID NO: 9218290 - DNA, 22 bp, Homo sapiens
ccagcacacagtgggtgcccag

SEQ ID NO: 9218291 - DNA, 22 bp, Homo sapiens
tctctgggataaactgggccag

SEQ ID NO: 9218292 - DNA, 22 bp, Homo sapiens
ccagaggtgaacaggaggctgt

SEQ ID NO: 9218293 - DNA, 22 bp, Homo sapiens
ccagaggtctcctgcacgggat

SEQ ID NO: 9218294 - DNA, 22 bp, Homo sapiens
ccagaggtcctgctcactggtg

SEQ ID NO: 9218295 - DNA, 22 bp, Homo sapiens
ccagaggtcccctgccaggagg

SEQ ID NO: 9218296 - DNA, 22 bp, Homo sapiens
tctcaggaatagagtggcagca

SEQ ID NO: 9218297 - DNA, 22 bp, Homo sapiens
tctcaggaaaaatccctagctt

SEQ ID NO: 9218298 - DNA, 22 bp, Homo sapiens
tctcaggactcctctggccata

SEQ ID NO: 9218299 - DNA, 22 bp, Homo sapiens
tctcaggactcctctggccata

SEQ ID NO: 9218300 - DNA, 22 bp, Homo sapiens
tctcaggagccacagcgggagt

SEQ ID NO: 9218301 - DNA, 22 bp, Homo sapiens
tctcaggactttgggaagctca

SEQ ID NO: 9218302 - DNA, 22 bp, Homo sapiens
tctcaggagtagtgggatccat

SEQ ID NO: 9218303 - DNA, 22 bp, Homo sapiens
tctcagtggtgttttgagtcca

SEQ ID NO: 9218304 - DNA, 22 bp, Homo sapiens
tctcagttcttctcattccaga

SEQ ID NO: 9218305 - DNA, 22 bp, Homo sapiens
ccaccccaaatgaagacctctc

SEQ ID NO: 9218306 - DNA, 22 bp, Homo sapiens
ccaccccaaatgaagacctctc

SEQ ID NO: 9218307 - DNA, 18 bp, Homo sapiens
ccacccagggggagagga

SEQ ID NO: 9218308 - DNA, 22 bp, Homo sapiens
ccacccctgggtgcagggagcg

SEQ ID NO: 9218309 - DNA, 22 bp, Homo sapiens
ccacccctgggtgcagggagcg

SEQ ID NO: 9218310 - DNA, 22 bp, Homo sapiens
ccacccctgggtgcagggagcg

SEQ ID NO: 9218311 - DNA, 22 bp, Homo sapiens
ccacccctgtagagggacagac

SEQ ID NO: 9218312 - DNA, 19 bp, Homo sapiens
ccacccctttgctgggccc

SEQ ID NO: 9218313 - DNA, 19 bp, Homo sapiens
ccacccctttgctgggccc

SEQ ID NO: 9218314 - DNA, 22 bp, Homo sapiens
ccaccctgccttgggccagtga

SEQ ID NO: 9218315 - DNA, 22 bp, Homo sapiens
tctagaaagtactagagctggt

SEQ ID NO: 9218316 - DNA, 22 bp, Homo sapiens
tctagaaagtttgtactgattt

SEQ ID NO: 9218317 - DNA, 23 bp, Homo sapiens
tctaatgcaattagaaattaggg

SEQ ID NO: 9218318 - DNA, 22 bp, Homo sapiens
caggctcaaggctgacttccat

SEQ ID NO: 9218319 - DNA, 22 bp, Homo sapiens
tacagtttctgtccttgtggag

SEQ ID NO: 9218320 - DNA, 22 bp, Homo sapiens
tacagttatatgtgataagtaa

SEQ ID NO: 9218321 - DNA, 22 bp, Homo sapiens
caggctcctcactcatgctccc

SEQ ID NO: 9218322 - DNA, 22 bp, Homo sapiens
caggctcggaagtgctggcttt

SEQ ID NO: 9218323 - DNA, 22 bp, Homo sapiens
tacagagaggtgacccttgggc

SEQ ID NO: 9218324 - DNA, 22 bp, Homo sapiens
caggcctgtctgcacatgaggc

SEQ ID NO: 9218325 - DNA, 22 bp, Homo sapiens
caggcctgtgagttgaggcccc

SEQ ID NO: 9218326 - DNA, 22 bp, Homo sapiens
gtggagcaggactagctgagaa

SEQ ID NO: 9218327 - DNA, 22 bp, Homo sapiens
gtggagccaggatctccgcaca

SEQ ID NO: 9218328 - DNA, 22 bp, Homo sapiens
tacacagatatgtgatcaatca

SEQ ID NO: 9218329 - DNA, 22 bp, Homo sapiens
tacacagaggctgatgtcttag

SEQ ID NO: 9218330 - DNA, 22 bp, Homo sapiens
caggccaaagatcccattgaca

SEQ ID NO: 9218331 - DNA, 22 bp, Homo sapiens
caggccaactgcatggtgacca

SEQ ID NO: 9218332 - DNA, 22 bp, Homo sapiens
caggccaataaatgtgatggcc

SEQ ID NO: 9218333 - DNA, 22 bp, Homo sapiens
caggccaagtcccaagtgcggg

SEQ ID NO: 9218334 - DNA, 22 bp, Homo sapiens
tacacaggggagcatggttgac

SEQ ID NO: 9218335 - DNA, 22 bp, Homo sapiens
tacacagggtatggcttgagga

SEQ ID NO: 9218336 - DNA, 22 bp, Homo sapiens
tacacagggagagattggaaac

SEQ ID NO: 9218337 - DNA, 17 bp, Homo sapiens
cagctctgcatcttcct

SEQ ID NO: 9218338 - DNA, 22 bp, Homo sapiens
cagctctgccacttcctagcta

SEQ ID NO: 9218339 - DNA, 22 bp, Homo sapiens
cagctctgcctctggggctgag

SEQ ID NO: 9218340 - DNA, 22 bp, Homo sapiens
gtggagcaatcagagggtcagt

SEQ ID NO: 9218341 - DNA, 22 bp, Homo sapiens
gtggagcaggactagctgagaa

SEQ ID NO: 9218342 - DNA, 22 bp, Homo sapiens
gtggagcataacacactagcct

SEQ ID NO: 9218343 - DNA, 22 bp, Homo sapiens
gtggagcatgtgaggactgagt

SEQ ID NO: 9218344 - DNA, 22 bp, Homo sapiens
caggccacagctaaagaggatt

SEQ ID NO: 9218345 - DNA, 22 bp, Homo sapiens
caggccaccagatacatgcccc

SEQ ID NO: 9218346 - DNA, 22 bp, Homo sapiens
caggccacacggcggctccctg

SEQ ID NO: 9218347 - DNA, 22 bp, Homo sapiens
caggccacaagttgggttcaag

SEQ ID NO: 9218348 - DNA, 22 bp, Homo sapiens
caggccaatatcacatgctatg

SEQ ID NO: 9218349 - DNA, 22 bp, Homo sapiens
caggccccattcctcttgggac

SEQ ID NO: 9218350 - DNA, 22 bp, Homo sapiens
caggccaccagatacatgcccc

SEQ ID NO: 9218351 - DNA, 22 bp, Homo sapiens
caggccacgccccggcgtgtga

SEQ ID NO: 9218352 - DNA, 22 bp, Homo sapiens
tacactgtgacaatcatgacag

SEQ ID NO: 9218353 - DNA, 22 bp, Homo sapiens
tacactgtgtaaaatgcacttt

SEQ ID NO: 9218354 - DNA, 22 bp, Homo sapiens
tacagaccagtagttctcagcg

SEQ ID NO: 9218355 - DNA, 22 bp, Homo sapiens
cagggcagtgaagaacacacgt

SEQ ID NO: 9218356 - DNA, 22 bp, Homo sapiens
cagggcagtgaagaacacacgt

SEQ ID NO: 9218357 - DNA, 22 bp, Homo sapiens
cagggcagtaccgccctctggc

SEQ ID NO: 9218358 - DNA, 18 bp, Homo sapiens
tagcagcactggccgctt

SEQ ID NO: 9218359 - DNA, 22 bp, Homo sapiens
tagcagtgtctaggtaggccat

SEQ ID NO: 9218360 - DNA, 22 bp, Homo sapiens
tagcagttaatctgagccaaga

SEQ ID NO: 9218361 - DNA, 22 bp, Homo sapiens
tagcataacaggtaagagtgag

SEQ ID NO: 9218362 - DNA, 23 bp, Homo sapiens
tagcatgcaggtcccgcgaatgc

SEQ ID NO: 9218363 - DNA, 22 bp, Homo sapiens
cagggatggcctggcgggccac

SEQ ID NO: 9218364 - DNA, 22 bp, Homo sapiens
tagcagcaattcaggtgtgatg

SEQ ID NO: 9218365 - DNA, 22 bp, Homo sapiens
tagcagcaagaatgggatgtgt

SEQ ID NO: 9218366 - DNA, 22 bp, Homo sapiens
tagcagcaatttcagaagtttg

SEQ ID NO: 9218367 - DNA, 22 bp, Homo sapiens
tagcagcacagaaagcctggag

SEQ ID NO: 9218368 - DNA, 22 bp, Homo sapiens
cagggatgagcagatggagcaa

SEQ ID NO: 9218369 - DNA, 22 bp, Homo sapiens
cagggatgctgcttaggcagtt

SEQ ID NO: 9218370 - DNA, 23 bp, Homo sapiens
cagggaggagatactgtgtatct

SEQ ID NO: 9218371 - DNA, 22 bp, Homo sapiens
cagggaggatgggctgttttgc

SEQ ID NO: 9218372 - DNA, 22 bp, Homo sapiens
cagggagctttgtcttctcatt

SEQ ID NO: 9218373 - DNA, 22 bp, Homo sapiens
cagggagctttgtcttctcatt

SEQ ID NO: 9218374 - DNA, 22 bp, Homo sapiens
cagggagggaggaaaatttgct

SEQ ID NO: 9218375 - DNA, 22 bp, Homo sapiens
cagggaggctgtcttatgcctg

SEQ ID NO: 9218376 - DNA, 22 bp, Homo sapiens
cagggagggacaattgtcacct

SEQ ID NO: 9218377 - DNA, 22 bp, Homo sapiens
cagggatgagaaagctctctaa

SEQ ID NO: 9218378 - DNA, 22 bp, Homo sapiens
cagggatgaccagagggatgtg

SEQ ID NO: 9218379 - DNA, 22 bp, Homo sapiens
caggctgcagcagcagtggccc

SEQ ID NO: 9218380 - DNA, 22 bp, Homo sapiens
tacccaggggctgagcagaggt

SEQ ID NO: 9218381 - DNA, 22 bp, Homo sapiens
caggctgcaagaaaggcattca

SEQ ID NO: 9218382 - DNA, 22 bp, Homo sapiens
caggctgcagaggcctttcatg

SEQ ID NO: 9218383 - DNA, 22 bp, Homo sapiens
caggctgattaggcctcgtcca

SEQ ID NO: 9218384 - DNA, 22 bp, Homo sapiens
caggctgcagcagcagtggccc

SEQ ID NO: 9218385 - DNA, 22 bp, Homo sapiens
caggctgatcagggctgggatg

SEQ ID NO: 9218386 - DNA, 22 bp, Homo sapiens
caggctgatagggtccaaagtt

SEQ ID NO: 9218387 - DNA, 22 bp, Homo sapiens
caggctgagggttaggccttag

SEQ ID NO: 9218388 - DNA, 22 bp, Homo sapiens
caggctgaggcagtagggtttg

SEQ ID NO: 9218389 - DNA, 22 bp, Homo sapiens
caggctgatagggtccaaagtt

SEQ ID NO: 9218390 - DNA, 22 bp, Homo sapiens
caggctgagggttaggccttag

SEQ ID NO: 9218391 - DNA, 22 bp, Homo sapiens
tagaaagcaaaatcctaccaag

SEQ ID NO: 9218392 - DNA, 22 bp, Homo sapiens
tagaaagcagaaaccatcagag

SEQ ID NO: 9218393 - DNA, 22 bp, Homo sapiens
tagacatttgtcaagaatgact

SEQ ID NO: 9218394 - DNA, 22 bp, Homo sapiens
tagacatttggcatggttttca

SEQ ID NO: 9218395 - DNA, 22 bp, Homo sapiens
tagacatttggcatggttttca

SEQ ID NO: 9218396 - DNA, 22 bp, Homo sapiens
tagacatttgaatgtgaaatga

SEQ ID NO: 9218397 - DNA, 22 bp, Homo sapiens
cagggagaggcatcatagggaa

SEQ ID NO: 9218398 - DNA, 22 bp, Homo sapiens
tagaacagagttccagtgatca

SEQ ID NO: 9218399 - DNA, 22 bp, Homo sapiens
tagaaatgtgataatagcttaa

SEQ ID NO: 9218400 - DNA, 22 bp, Homo sapiens
tagaaatgttagatgtattgag

SEQ ID NO: 9218401 - DNA, 22 bp, Homo sapiens
tatgatttgtagacatttgatt

SEQ ID NO: 9218402 - DNA, 22 bp, Homo sapiens
tatgcacaacatgcaggtttgt

SEQ ID NO: 9218403 - DNA, 22 bp, Homo sapiens
caggtgggcgtggcgagaaggc

SEQ ID NO: 9218404 - DNA, 22 bp, Homo sapiens
caggtgggctgcctctccagct

SEQ ID NO: 9218405 - DNA, 22 bp, Homo sapiens
caggtgggctgcctctccagct

SEQ ID NO: 9218406 - DNA, 22 bp, Homo sapiens
caggtggggcgccctcaggcag

SEQ ID NO: 9218407 - DNA, 22 bp, Homo sapiens
tatgtacatcgttgaattcaaa

SEQ ID NO: 9218408 - DNA, 22 bp, Homo sapiens
tatgtacatggagagcaattga

SEQ ID NO: 9218409 - DNA, 22 bp, Homo sapiens
cagggctggatcctccagactc

SEQ ID NO: 9218410 - DNA, 22 bp, Homo sapiens
cagggctgctggccgtgccctc

SEQ ID NO: 9218411 - DNA, 22 bp, Homo sapiens
cagggctgagaatttagagaca

SEQ ID NO: 9218412 - DNA, 22 bp, Homo sapiens
cagggctgaggacacaagtaaa

SEQ ID NO: 9218413 - DNA, 22 bp, Homo sapiens
cagggccaagctgcagcatctg

SEQ ID NO: 9218414 - DNA, 22 bp, Homo sapiens
taggtaggtgtcataatccatg

SEQ ID NO: 9218415 - DNA, 20 bp, Homo sapiens
cagggccacgctccaaggca

SEQ ID NO: 9218416 - DNA, 22 bp, Homo sapiens
tagtttcttcacctgtaaaatg

SEQ ID NO: 9218417 - DNA, 22 bp, Homo sapiens
tagtttctgaggattgaaagat

SEQ ID NO: 9218418 - DNA, 22 bp, Homo sapiens
tagtgttctaagaacatccatg

SEQ ID NO: 9218419 - DNA, 22 bp, Homo sapiens
tatatagaaaagcagatgttgg

SEQ ID NO: 9218420 - DNA, 22 bp, Homo sapiens
tatataactactattttgctca

SEQ ID NO: 9218421 - DNA, 22 bp, Homo sapiens
tatacagtttgagttcttgcat

SEQ ID NO: 9218422 - DNA, 22 bp, Homo sapiens
tatataattttctgccatatcc

SEQ ID NO: 9218423 - DNA, 22 bp, Homo sapiens
tatataattttctgccatatcc

SEQ ID NO: 9218424 - DNA, 22 bp, Homo sapiens
tcaaagcctgtggatagtttgg

SEQ ID NO: 9218425 - DNA, 22 bp, Homo sapiens
tcaaagcatggttttgaaagac

SEQ ID NO: 9218426 - DNA, 22 bp, Homo sapiens
tcaaagcatggttttgaaagac

SEQ ID NO: 9218427 - DNA, 22 bp, Homo sapiens
tcaaagcatcagtcaatttagg

SEQ ID NO: 9218428 - DNA, 22 bp, Homo sapiens
tcaaagcatcagtcaatttagg

SEQ ID NO: 9218429 - DNA, 22 bp, Homo sapiens
tcaaagcagcacattcgcaagc

SEQ ID NO: 9218430 - DNA, 22 bp, Homo sapiens
tcaaagcttagataatttcttt

SEQ ID NO: 9218431 - DNA, 19 bp, Homo sapiens
tcaaagcaagcatgttctg

SEQ ID NO: 9218432 - DNA, 19 bp, Homo sapiens
tcaaagcaagcatgttctg

SEQ ID NO: 9218433 - DNA, 22 bp, Homo sapiens
tcaaagcacacttagtggtaga

SEQ ID NO: 9218434 - DNA, 22 bp, Homo sapiens
tcaaagcacacttagtggtaga

SEQ ID NO: 9218435 - DNA, 22 bp, Homo sapiens
tcaaagcaatttcaccagtgcc

SEQ ID NO: 9218436 - DNA, 22 bp, Homo sapiens
tcaaagcactggggaaagcctg

SEQ ID NO: 9218437 - DNA, 20 bp, Homo sapiens
tcaaagcactgcctgtcatc

SEQ ID NO: 9218438 - DNA, 20 bp, Homo sapiens
tcaaagcactgcctgtcatc

SEQ ID NO: 9218439 - DNA, 21 bp, Homo sapiens
tcaaagcacatatttgcacat

SEQ ID NO: 9218440 - DNA, 22 bp, Homo sapiens
tcaaattgtcatcttgataatg

SEQ ID NO: 9218441 - DNA, 22 bp, Homo sapiens
tcaaattttaacatgcattaga

SEQ ID NO: 9218442 - DNA, 22 bp, Homo sapiens
tcaaattagtggaataataatg

SEQ ID NO: 9218443 - DNA, 22 bp, Homo sapiens
tcaaatgctgcctttgtgtgcc

SEQ ID NO: 9218444 - DNA, 22 bp, Homo sapiens
cagtcttctgagaaggcaaggg

SEQ ID NO: 9218445 - DNA, 22 bp, Homo sapiens
cagtcccagggttggttcagct

SEQ ID NO: 9218446 - DNA, 22 bp, Homo sapiens
cagtcccagctgctcagaaggc

SEQ ID NO: 9218447 - DNA, 22 bp, Homo sapiens
cagtctgggactgagctccacc

SEQ ID NO: 9218448 - DNA, 22 bp, Homo sapiens
cagtctgggactgagctccacc

SEQ ID NO: 9218449 - DNA, 22 bp, Homo sapiens
cagtctgggactgagctccacc

SEQ ID NO: 9218450 - DNA, 22 bp, Homo sapiens
cagtctggctcagcacaaaggg

SEQ ID NO: 9218451 - DNA, 23 bp, Homo sapiens
cagtctctccccggacagcaaaa

SEQ ID NO: 9218452 - DNA, 22 bp, Homo sapiens
cagtctggactcaggcatacct

SEQ ID NO: 9218453 - DNA, 22 bp, Homo sapiens
cagtctggaggtcagctggctt

SEQ ID NO: 9218454 - DNA, 22 bp, Homo sapiens
cagtgcagtttcccagatgctg

SEQ ID NO: 9218455 - DNA, 22 bp, Homo sapiens
cagtgcagtttcccagatgctg

SEQ ID NO: 9218456 - DNA, 22 bp, Homo sapiens
cagtgcagaggtgcaagcatgt

SEQ ID NO: 9218457 - DNA, 22 bp, Homo sapiens
cagtgcagtcaaggaagaacca

SEQ ID NO: 9218458 - DNA, 19 bp, Homo sapiens
cagtggagattggaggagg

SEQ ID NO: 9218459 - DNA, 22 bp, Homo sapiens
cagtggcacccacgggctgggc

SEQ ID NO: 9218460 - DNA, 22 bp, Homo sapiens
cagtggcagagaacagagacct

SEQ ID NO: 9218461 - DNA, 22 bp, Homo sapiens
tcacatgtgtggcagtgcaagt

SEQ ID NO: 9218462 - DNA, 18 bp, Homo sapiens
tcacattataatgtaaca

SEQ ID NO: 9218463 - DNA, 22 bp, Homo sapiens
tcactgcaagctccacctcccg

SEQ ID NO: 9218464 - DNA, 22 bp, Homo sapiens
tcactgcaacctccacctcctg

SEQ ID NO: 9218465 - DNA, 22 bp, Homo sapiens
tcactctgaatggtactgagga

SEQ ID NO: 9218466 - DNA, 22 bp, Homo sapiens
ttgagaaactctgggttagaat

SEQ ID NO: 9218467 - DNA, 18 bp, Homo sapiens
ttgagaaataagcactaa

SEQ ID NO: 9218468 - DNA, 18 bp, Homo sapiens
ttgagaaataagcactaa

SEQ ID NO: 9218469 - DNA, 22 bp, Homo sapiens
ttgagaaataagcatgtctaga

SEQ ID NO: 9218470 - DNA, 22 bp, Homo sapiens
ttgagggtctggatctgctgct

SEQ ID NO: 9218471 - DNA, 22 bp, Homo sapiens
ttgaggcctgctggaaggtgtt

SEQ ID NO: 9218472 - DNA, 22 bp, Homo sapiens
ttgaggccccatggatgagaac

SEQ ID NO: 9218473 - DNA, 22 bp, Homo sapiens
ttgaggcccggcaggccgagcg

SEQ ID NO: 9218474 - DNA, 22 bp, Homo sapiens
ttgacataagacttagagtatt

SEQ ID NO: 9218475 - DNA, 23 bp, Homo sapiens
ttgaaagattgctaagtaaaaat

SEQ ID NO: 9218476 - DNA, 22 bp, Homo sapiens
ttgacatatagcataaggataa

SEQ ID NO: 9218477 - DNA, 17 bp, Homo sapiens
ttgaccaaaatgcagcc

SEQ ID NO: 9218478 - DNA, 22 bp, Homo sapiens
ttgaaacagtagctcatagacc

SEQ ID NO: 9218479 - DNA, 22 bp, Homo sapiens
ttgaaacatatacaaagtggtg

SEQ ID NO: 9218480 - DNA, 22 bp, Homo sapiens
ttctttttatcttcccataaga

SEQ ID NO: 9218481 - DNA, 22 bp, Homo sapiens
ttctgggaacaaagtggagtgg

SEQ ID NO: 9218482 - DNA, 22 bp, Homo sapiens
ttctgggacatctggacagttt

SEQ ID NO: 9218483 - DNA, 22 bp, Homo sapiens
ttctttgcccttaatgaaataa

SEQ ID NO: 9218484 - DNA, 22 bp, Homo sapiens
ttcttcttcaagtgctgcattc

SEQ ID NO: 9218485 - DNA, 22 bp, Homo sapiens
ttcttcttgaaactttaggttg

SEQ ID NO: 9218486 - DNA, 22 bp, Homo sapiens
ttcttctgtgaggtgtgtgcct

SEQ ID NO: 9218487 - DNA, 22 bp, Homo sapiens
ttcttctgaaacagtgacagac

SEQ ID NO: 9218488 - DNA, 22 bp, Homo sapiens
ttctcaaggacaaaatgacatg

SEQ ID NO: 9218489 - DNA, 22 bp, Homo sapiens
ttctcaagtgagtggtaaatga

SEQ ID NO: 9218490 - DNA, 22 bp, Homo sapiens
ttctccagagtttctctcactg

SEQ ID NO: 9218491 - DNA, 22 bp, Homo sapiens
ttctcagagctcactgtagtaa

SEQ ID NO: 9218492 - DNA, 19 bp, Homo sapiens
ttctcagagcttgcagcac

SEQ ID NO: 9218493 - DNA, 22 bp, Homo sapiens
ttctaaaataagtttatctggt

SEQ ID NO: 9218494 - DNA, 22 bp, Homo sapiens
ttctaaaaccaattctgcttct

SEQ ID NO: 9218495 - DNA, 22 bp, Homo sapiens
ttcccctttttgtgtgcagctg

SEQ ID NO: 9218496 - DNA, 22 bp, Homo sapiens
ttccctcccccagcctggcagg

SEQ ID NO: 9218497 - DNA, 22 bp, Homo sapiens
ttccctccgaacctcagtgctg

SEQ ID NO: 9218498 - DNA, 22 bp, Homo sapiens
ttccctccctggctgccatttc

SEQ ID NO: 9218499 - DNA, 22 bp, Homo sapiens
ttccctccctggctgccatttc

SEQ ID NO: 9218500 - DNA, 22 bp, Homo sapiens
ttccctctccaggagccctgag

SEQ ID NO: 9218501 - DNA, 22 bp, Homo sapiens
ttccctctcacttaaagcttgg

SEQ ID NO: 9218502 - DNA, 22 bp, Homo sapiens
ttccctctgcgcattgaatttc

SEQ ID NO: 9218503 - DNA, 20 bp, Homo sapiens
ttcgctgggagtggccaggc

SEQ ID NO: 9218504 - DNA, 22 bp, Homo sapiens
ttccctcttttccaacagttgt

SEQ ID NO: 9218505 - DNA, 22 bp, Homo sapiens
ttccctctttcactgtgatttt

SEQ ID NO: 9218506 - DNA, 22 bp, Homo sapiens
ttccctctgcgcattgaatttc

SEQ ID NO: 9218507 - DNA, 22 bp, Homo sapiens
ttctgcacattttagcaaagta

SEQ ID NO: 9218508 - DNA, 22 bp, Homo sapiens
ttctgcagcatgaggctggagc

SEQ ID NO: 9218509 - DNA, 22 bp, Homo sapiens
ttctgccattgccatgagggct

SEQ ID NO: 9218510 - DNA, 22 bp, Homo sapiens
ttctgagggctaatgtactgta

SEQ ID NO: 9218511 - DNA, 22 bp, Homo sapiens
ttctgaggtccatgcagtactg

SEQ ID NO: 9218512 - DNA, 22 bp, Homo sapiens
ttctctttgacattattcaggt

SEQ ID NO: 9218513 - DNA, 22 bp, Homo sapiens
ttctctttctacagtgtgattg

SEQ ID NO: 9218514 - DNA, 22 bp, Homo sapiens
ttctctttctgctgggctggaa

SEQ ID NO: 9218515 - DNA, 22 bp, Homo sapiens
ttctctttatgtatttagtggg

SEQ ID NO: 9218516 - DNA, 22 bp, Homo sapiens
ttctctttctacagtgtgattg

SEQ ID NO: 9218517 - DNA, 20 bp, Homo sapiens
ttctctttgggtccagagaa

SEQ ID NO: 9218518 - DNA, 22 bp, Homo sapiens
ttctgaggccattaccaataaa

SEQ ID NO: 9218519 - DNA, 22 bp, Homo sapiens
ttctgaggcatagaggatgaga

SEQ ID NO: 9218520 - DNA, 22 bp, Homo sapiens
ttctgaggaggagcaaaaactc

SEQ ID NO: 9218521 - DNA, 22 bp, Homo sapiens
ttctcttcccactttctgtatt

SEQ ID NO: 9218522 - DNA, 17 bp, Homo sapiens
ttctcttcctggatagt

SEQ ID NO: 9218523 - DNA, 23 bp, Homo sapiens
ttctctttagatttacattactc

SEQ ID NO: 9218524 - DNA, 22 bp, Homo sapiens
ttctcttgagctggtcatgttt

SEQ ID NO: 9218525 - DNA, 22 bp, Homo sapiens
ttctcttctgttcagtgcccaa

SEQ ID NO: 9218526 - DNA, 22 bp, Homo sapiens
ttctctggtttgctgtttctga

SEQ ID NO: 9218527 - DNA, 22 bp, Homo sapiens
ttctcttcacagggatcatcct

SEQ ID NO: 9218528 - DNA, 18 bp, Homo sapiens
ttctctggtggatgttat

SEQ ID NO: 9218529 - DNA, 22 bp, Homo sapiens
ttctccgctaagttctctgcag

SEQ ID NO: 9218530 - DNA, 22 bp, Homo sapiens
ttctccccgtctctctgaggcc

SEQ ID NO: 9218531 - DNA, 21 bp, Homo sapiens
ttctccagggggagctctctc

SEQ ID NO: 9218532 - DNA, 22 bp, Homo sapiens
ttctccagttatattatgttaa

SEQ ID NO: 9218533 - DNA, 22 bp, Homo sapiens
ttatgtttgagtatatgactca

SEQ ID NO: 9218534 - DNA, 22 bp, Homo sapiens
ttattgtttgggtataatttga

SEQ ID NO: 9218535 - DNA, 22 bp, Homo sapiens
ttattgtttgggtataatttga

SEQ ID NO: 9218536 - DNA, 22 bp, Homo sapiens
ttatttaaaagtggtaagattc

SEQ ID NO: 9218537 - DNA, 22 bp, Homo sapiens
ttatttaatgtgatctgaagag

SEQ ID NO: 9218538 - DNA, 22 bp, Homo sapiens
ttcaagaaggtacatttacatc

SEQ ID NO: 9218539 - DNA, 18 bp, Homo sapiens
ttcaagagtttctctagg

SEQ ID NO: 9218540 - DNA, 22 bp, Homo sapiens
ttcaagcagagatatttcaaga

SEQ ID NO: 9218541 - DNA, 22 bp, Homo sapiens
ttcaagcagagatatttcaaga

SEQ ID NO: 9218542 - DNA, 22 bp, Homo sapiens
ttattttgagagaatgtgtgct

SEQ ID NO: 9218543 - DNA, 22 bp, Homo sapiens
ttattttgccacaggtgacctt

SEQ ID NO: 9218544 - DNA, 22 bp, Homo sapiens
ttattttgagagaatgtgtgct

SEQ ID NO: 9218545 - DNA, 22 bp, Homo sapiens
ttattttgccacaggtgacctt

SEQ ID NO: 9218546 - DNA, 22 bp, Homo sapiens
ttcaaaagtaatcagtattaga

SEQ ID NO: 9218547 - DNA, 22 bp, Homo sapiens
ttattttgtagctctgatcttt

SEQ ID NO: 9218548 - DNA, 22 bp, Homo sapiens
ttattttggtaaatgtttgcct

SEQ ID NO: 9218549 - DNA, 22 bp, Homo sapiens
ttattttggtaaatgtttgcct

SEQ ID NO: 9218550 - DNA, 22 bp, Homo sapiens
ttattttgtagctctgatcttt

SEQ ID NO: 9218551 - DNA, 22 bp, Homo sapiens
ttagtggtactcagggagggaa

SEQ ID NO: 9218552 - DNA, 22 bp, Homo sapiens
tcctctgctccatctttactgt

SEQ ID NO: 9218553 - DNA, 22 bp, Homo sapiens
tcctctgctgttctggttcttt

SEQ ID NO: 9218554 - DNA, 21 bp, Homo sapiens
tcctctgctctcataccacaa

SEQ ID NO: 9218555 - DNA, 23 bp, Homo sapiens
tcctcgcaggagggagatgatgc

SEQ ID NO: 9218556 - DNA, 22 bp, Homo sapiens
tcctctgctcagcattcctcac

SEQ ID NO: 9218557 - DNA, 22 bp, Homo sapiens
tcctctgccaaagggagttgcc

SEQ ID NO: 9218558 - DNA, 22 bp, Homo sapiens
tcctctgccccagatgaaattt

SEQ ID NO: 9218559 - DNA, 21 bp, Homo sapiens
tcctcctggccaggcggcccc

SEQ ID NO: 9218560 - DNA, 22 bp, Homo sapiens
ttataattctggcataggctgt

SEQ ID NO: 9218561 - DNA, 22 bp, Homo sapiens
ttagttatactactgaatggag

SEQ ID NO: 9218562 - DNA, 22 bp, Homo sapiens
ttcatatatatgcactacgtac

SEQ ID NO: 9218563 - DNA, 22 bp, Homo sapiens
ttcatagtgcttaatttgataa

SEQ ID NO: 9218564 - DNA, 22 bp, Homo sapiens
ttcagaatctatgtgccagctc

SEQ ID NO: 9218565 - DNA, 22 bp, Homo sapiens
ttcagaatgacttatgtaaggc

SEQ ID NO: 9218566 - DNA, 22 bp, Homo sapiens
ttcagaatgagaatggatgggt

SEQ ID NO: 9218567 - DNA, 22 bp, Homo sapiens
ttcagaatgtactgatagaaca

SEQ ID NO: 9218568 - DNA, 22 bp, Homo sapiens
ttcagaatgctatttctgaaat

SEQ ID NO: 9218569 - DNA, 22 bp, Homo sapiens
ttcagaatgattacattctggt

SEQ ID NO: 9218570 - DNA, 22 bp, Homo sapiens
ttcagaatgatttcagcgagca

SEQ ID NO: 9218571 - DNA, 22 bp, Homo sapiens
ttcagacaggcagctgggctgg

SEQ ID NO: 9218572 - DNA, 22 bp, Homo sapiens
ttcagacagttttcagattcat

SEQ ID NO: 9218573 - DNA, 22 bp, Homo sapiens
ttcagacagtaagaaagaggtt

SEQ ID NO: 9218574 - DNA, 22 bp, Homo sapiens
ttcagacacagcgctgggaaat

SEQ ID NO: 9218575 - DNA, 19 bp, Homo sapiens
ttcagacagactaggtata

SEQ ID NO: 9218576 - DNA, 22 bp, Homo sapiens
ttcagacaataagagtcatctc

SEQ ID NO: 9218577 - DNA, 22 bp, Homo sapiens
ttcagacaaatttgaggaagct

SEQ ID NO: 9218578 - DNA, 22 bp, Homo sapiens
ttcagaatgtgaccttatttgg

SEQ ID NO: 9218579 - DNA, 16 bp, Homo sapiens
ttcagaatttgtagaa

SEQ ID NO: 9218580 - DNA, 19 bp, Homo sapiens
ttcagaattgggaggtgat

SEQ ID NO: 9218581 - DNA, 22 bp, Homo sapiens
ttcatacatgagactagatgca

SEQ ID NO: 9218582 - DNA, 22 bp, Homo sapiens
ttcagacatgcaggctgaggct

SEQ ID NO: 9218583 - DNA, 22 bp, Homo sapiens
ttcagacattgctctccaccca

SEQ ID NO: 9218584 - DNA, 22 bp, Homo sapiens
ttcatagagcagctcactgaat

SEQ ID NO: 9218585 - DNA, 22 bp, Homo sapiens
ttcaatatctctaagaatgagg

SEQ ID NO: 9218586 - DNA, 22 bp, Homo sapiens
ttcactgtactttggcaatgct

SEQ ID NO: 9218587 - DNA, 22 bp, Homo sapiens
ttcactgtatgagagggcttga

SEQ ID NO: 9218588 - DNA, 22 bp, Homo sapiens
ttcactgtactgactgtcttat

SEQ ID NO: 9218589 - DNA, 22 bp, Homo sapiens
ttcactgttgagttcctgatat

SEQ ID NO: 9218590 - DNA, 22 bp, Homo sapiens
ttcactgttatgaagctctggg

SEQ ID NO: 9218591 - DNA, 22 bp, Homo sapiens
ttcactgtgatggtgcagaggc

SEQ ID NO: 9218592 - DNA, 22 bp, Homo sapiens
ttcactgtgatgtttaagagaa

SEQ ID NO: 9218593 - DNA, 22 bp, Homo sapiens
ttcactgtgaactcatattcag

SEQ ID NO: 9218594 - DNA, 22 bp, Homo sapiens
ttcactgtcctgcaactctaga

SEQ ID NO: 9218595 - DNA, 22 bp, Homo sapiens
ttcagaataactttttattgaa

SEQ ID NO: 9218596 - DNA, 22 bp, Homo sapiens
ttcagaagttttcaaaactaag

SEQ ID NO: 9218597 - DNA, 22 bp, Homo sapiens
ttcagaatattattttaaaggc

SEQ ID NO: 9218598 - DNA, 22 bp, Homo sapiens
ttcagaatatccgtttaagttt

SEQ ID NO: 9218599 - DNA, 22 bp, Homo sapiens
ttcagaataatgtgttagagaa

SEQ ID NO: 9218600 - DNA, 22 bp, Homo sapiens
ttcagaatatttgttttacatg

SEQ ID NO: 9218601 - DNA, 17 bp, Homo sapiens
ttcagaagcattttggc

SEQ ID NO: 9218602 - DNA, 22 bp, Homo sapiens
ttcagaaggattttaacacatg

SEQ ID NO: 9218603 - DNA, 22 bp, Homo sapiens
ttcagaagtagctaagcagtca

SEQ ID NO: 9218604 - DNA, 22 bp, Homo sapiens
ttccccaggggctcctgccttt

SEQ ID NO: 9218605 - DNA, 22 bp, Homo sapiens
ttccccaggctggagtgcagtg

SEQ ID NO: 9218606 - DNA, 22 bp, Homo sapiens
ttccccagggaagctcctgcgc

SEQ ID NO: 9218607 - DNA, 22 bp, Homo sapiens
ttccccttataagtctggcttc

SEQ ID NO: 9218608 - DNA, 22 bp, Homo sapiens
ttccccttatcaccagcctgtc

SEQ ID NO: 9218609 - DNA, 22 bp, Homo sapiens
ttcccctgtcacagtggttctc

SEQ ID NO: 9218610 - DNA, 22 bp, Homo sapiens
ttccccttgggctgtggaggag

SEQ ID NO: 9218611 - DNA, 22 bp, Homo sapiens
ttccccttgcactatcaccctg

SEQ ID NO: 9218612 - DNA, 22 bp, Homo sapiens
ttccccttgataatgcagtaag

SEQ ID NO: 9218613 - DNA, 22 bp, Homo sapiens
ttccccttgataagcagggttg

SEQ ID NO: 9218614 - DNA, 22 bp, Homo sapiens
ttcccagtgattgaacatccct

SEQ ID NO: 9218615 - DNA, 22 bp, Homo sapiens
ttcccaggtaattctgaggcag

SEQ ID NO: 9218616 - DNA, 22 bp, Homo sapiens
ttcccaggctgtgctaccagag

SEQ ID NO: 9218617 - DNA, 22 bp, Homo sapiens
ttccatgaaagtgaaatggagc

SEQ ID NO: 9218618 - DNA, 19 bp, Homo sapiens
ttccaaaatcaggatttga

SEQ ID NO: 9218619 - DNA, 22 bp, Homo sapiens
ttccaaaacagtatggcatgtg

SEQ ID NO: 9218620 - DNA, 22 bp, Homo sapiens
ttccaaaacaatattctgtgaa

SEQ ID NO: 9218621 - DNA, 22 bp, Homo sapiens
ttccaatgactagtggcatcct

SEQ ID NO: 9218622 - DNA, 22 bp, Homo sapiens
ttccaagtgcccatatttcatc

SEQ ID NO: 9218623 - DNA, 22 bp, Homo sapiens
ttccaagtgcccatatttcatc

SEQ ID NO: 9218624 - DNA, 22 bp, Homo sapiens
ttgtatcagtgcctataaaatg

SEQ ID NO: 9218625 - DNA, 22 bp, Homo sapiens
ttgtatcagtgcctataaaatg

SEQ ID NO: 9218626 - DNA, 22 bp, Homo sapiens
ttgtattaaaatgtgtttctgt

SEQ ID NO: 9218627 - DNA, 22 bp, Homo sapiens
ttgtatgtttctgtgcacatga

SEQ ID NO: 9218628 - DNA, 22 bp, Homo sapiens
ttgtactatgtctaagtcactg

SEQ ID NO: 9218629 - DNA, 22 bp, Homo sapiens
ttggggggttgaggagtagata

SEQ ID NO: 9218630 - DNA, 22 bp, Homo sapiens
ttggggggttgaggagtagata

SEQ ID NO: 9218631 - DNA, 20 bp, Homo sapiens
ttggggcatccaccgaatgg

SEQ ID NO: 9218632 - DNA, 22 bp, Homo sapiens
ttgggggcatattgagtagtgg

SEQ ID NO: 9218633 - DNA, 22 bp, Homo sapiens
ttgggggcagagggagcatctg

SEQ ID NO: 9218634 - DNA, 22 bp, Homo sapiens
ttgtatttcctataacctttct

SEQ ID NO: 9218635 - DNA, 22 bp, Homo sapiens
ttgttatttaggtctgggttag

SEQ ID NO: 9218636 - DNA, 22 bp, Homo sapiens
ttggctttagacctgagactgt

SEQ ID NO: 9218637 - DNA, 22 bp, Homo sapiens
ttgggaaagaatgagaaggtga

SEQ ID NO: 9218638 - DNA, 22 bp, Homo sapiens
ttggcttcccagagcttacgct

SEQ ID NO: 9218639 - DNA, 22 bp, Homo sapiens
ttggcttcctgcacttgagttt

SEQ ID NO: 9218640 - DNA, 22 bp, Homo sapiens
ttggcttggagagttgaaatgt

SEQ ID NO: 9218641 - DNA, 22 bp, Homo sapiens
ttgggctcaggagtttgagacc

SEQ ID NO: 9218642 - DNA, 22 bp, Homo sapiens
ttgggctcaggagtttgagacc

SEQ ID NO: 9218643 - DNA, 22 bp, Homo sapiens
ttgggctgatctgtggaagaag

SEQ ID NO: 9218644 - DNA, 22 bp, Homo sapiens
ttgggctggcagaggtggtctt

SEQ ID NO: 9218645 - DNA, 22 bp, Homo sapiens
ttgggctggcccttgtctctgg

SEQ ID NO: 9218646 - DNA, 22 bp, Homo sapiens
ttggggcacctccccagcattt

SEQ ID NO: 9218647 - DNA, 22 bp, Homo sapiens
ttggcagagagtatgctgaaga

SEQ ID NO: 9218648 - DNA, 22 bp, Homo sapiens
ttggcagagggaccagcctaca

SEQ ID NO: 9218649 - DNA, 22 bp, Homo sapiens
ttggcagagccccagccttgga

SEQ ID NO: 9218650 - DNA, 22 bp, Homo sapiens
ttggcagatgaacacaactgga

SEQ ID NO: 9218651 - DNA, 22 bp, Homo sapiens
ttggcagaggggccacctgccc

SEQ ID NO: 9218652 - DNA, 22 bp, Homo sapiens
ttggcctcatggacagctcatc

SEQ ID NO: 9218653 - DNA, 22 bp, Homo sapiens
ttggcctcatggacagctcatc

SEQ ID NO: 9218654 - DNA, 22 bp, Homo sapiens
ttggcctccacattttccaggt

SEQ ID NO: 9218655 - DNA, 22 bp, Homo sapiens
ttggccctttatgggatgggca

SEQ ID NO: 9218656 - DNA, 22 bp, Homo sapiens
ttggccttccctacctgggcca

SEQ ID NO: 9218657 - DNA, 21 bp, Homo sapiens
ttggcctgatatcttggagca

SEQ ID NO: 9218658 - DNA, 22 bp, Homo sapiens
ttggcaatttaaatagcaggag

SEQ ID NO: 9218659 - DNA, 22 bp, Homo sapiens
ttggcacaggggacttatgtgt

SEQ ID NO: 9218660 - DNA, 22 bp, Homo sapiens
ttggcacagctccatggctttg

SEQ ID NO: 9218661 - DNA, 22 bp, Homo sapiens
ttggcacagccacttctgctgc

SEQ ID NO: 9218662 - DNA, 22 bp, Homo sapiens
ttggcactattcactccatggg

SEQ ID NO: 9218663 - DNA, 22 bp, Homo sapiens
ttggcacagtaatctctcttca

SEQ ID NO: 9218664 - DNA, 22 bp, Homo sapiens
ttggcacataatttgggaactc

SEQ ID NO: 9218665 - DNA, 22 bp, Homo sapiens
ttggcacaagcagttgggccca

SEQ ID NO: 9218666 - DNA, 22 bp, Homo sapiens
ttggcacagagctgcagcctgg

SEQ ID NO: 9218667 - DNA, 22 bp, Homo sapiens
ttggcacaaatttctgaaataa

SEQ ID NO: 9218668 - DNA, 22 bp, Homo sapiens
ttggcacagaaaaactcactgt

SEQ ID NO: 9218669 - DNA, 22 bp, Homo sapiens
ttggcacacagtaagccctaag

SEQ ID NO: 9218670 - DNA, 22 bp, Homo sapiens
ttggcactcatcctggttgttt

SEQ ID NO: 9218671 - DNA, 22 bp, Homo sapiens
ttggcactctccctgcactggt

SEQ ID NO: 9218672 - DNA, 22 bp, Homo sapiens
ttggcactctccctgcactggt

SEQ ID NO: 9218673 - DNA, 22 bp, Homo sapiens
ttggcactgcattgaccacacc

SEQ ID NO: 9218674 - DNA, 22 bp, Homo sapiens
ttggcactgcagatgaattgca

SEQ ID NO: 9218675 - DNA, 22 bp, Homo sapiens
ttggcactgaccaaagaagtcc

SEQ ID NO: 9218676 - DNA, 22 bp, Homo sapiens
ttggcactcaactgtcgttgtt

SEQ ID NO: 9218677 - DNA, 22 bp, Homo sapiens
ttggcactcaaagccctctgca

SEQ ID NO: 9218678 - DNA, 22 bp, Homo sapiens
ttggcactcagcaagtgttaat

SEQ ID NO: 9218679 - DNA, 22 bp, Homo sapiens
ttggcactcaaaattttatcgg

SEQ ID NO: 9218680 - DNA, 22 bp, Homo sapiens
ttggcactcaaaatagatggtt

SEQ ID NO: 9218681 - DNA, 22 bp, Homo sapiens
ttggcactattgacattttggg

SEQ ID NO: 9218682 - DNA, 22 bp, Homo sapiens
ttggcacttcacgagacagcta

SEQ ID NO: 9218683 - DNA, 22 bp, Homo sapiens
ttggcactttctcagcagcctg

SEQ ID NO: 9218684 - DNA, 22 bp, Homo sapiens
ttggcactgtgcctggcacatt

SEQ ID NO: 9218685 - DNA, 22 bp, Homo sapiens
ttggcactttgaatgagctcag

SEQ ID NO: 9218686 - DNA, 22 bp, Homo sapiens
ttggcactttgaatgagctcag

SEQ ID NO: 9218687 - DNA, 22 bp, Homo sapiens
ttggcacttttaggcagtaccg

SEQ ID NO: 9218688 - DNA, 22 bp, Homo sapiens
ttggcagactgacaatctgttt

SEQ ID NO: 9218689 - DNA, 22 bp, Homo sapiens
ttggcagactgggtcctgggga

SEQ ID NO: 9218690 - DNA, 22 bp, Homo sapiens
ttggcagaatgggcagcttgag

SEQ ID NO: 9218691 - DNA, 22 bp, Homo sapiens
ttggcagaattaaccactgaag

SEQ ID NO: 9218692 - DNA, 18 bp, Homo sapiens
ttggaggatgtccatgaa

SEQ ID NO: 9218693 - DNA, 22 bp, Homo sapiens
ttggaattcaagttgtagctta

SEQ ID NO: 9218694 - DNA, 22 bp, Homo sapiens
ttgcttcctttacagatgggca

SEQ ID NO: 9218695 - DNA, 22 bp, Homo sapiens
ttgcttctggaactttctgttc

SEQ ID NO: 9218696 - DNA, 22 bp, Homo sapiens
ttgcttctaagtataaatatga

SEQ ID NO: 9218697 - DNA, 23 bp, Homo sapiens
ttgcttctgtgcaattcagtact

SEQ ID NO: 9218698 - DNA, 23 bp, Homo sapiens
ttgcttctgtgcaattcagtact

SEQ ID NO: 9218699 - DNA, 18 bp, Homo sapiens
ttgcttcttttctctagg

SEQ ID NO: 9218700 - DNA, 22 bp, Homo sapiens
ttgcttcttagatattcctctc

SEQ ID NO: 9218701 - DNA, 22 bp, Homo sapiens
ttgcttgtcttccctttacctc

SEQ ID NO: 9218702 - DNA, 22 bp, Homo sapiens
ttggaacatgccggggtccagg

SEQ ID NO: 9218703 - DNA, 20 bp, Homo sapiens
ttggaacagtggatcagcag

SEQ ID NO: 9218704 - DNA, 22 bp, Homo sapiens
ttggaacatgccggggtccagg

SEQ ID NO: 9218705 - DNA, 22 bp, Homo sapiens
ttgccttactgcattcagtaaa

SEQ ID NO: 9218706 - DNA, 22 bp, Homo sapiens
ttgccttcctgcccagcttctg

SEQ ID NO: 9218707 - DNA, 22 bp, Homo sapiens
ttgcctttgacggtgcagcagt

SEQ ID NO: 9218708 - DNA, 22 bp, Homo sapiens
ttgcctttaagtataactgctg

SEQ ID NO: 9218709 - DNA, 22 bp, Homo sapiens
ttgcctgtgaggattctggttg

SEQ ID NO: 9218710 - DNA, 22 bp, Homo sapiens
ttgcctgtgaacgctgagtcct

SEQ ID NO: 9218711 - DNA, 22 bp, Homo sapiens
ttgcctgtgtcagcaggtggaa

SEQ ID NO: 9218712 - DNA, 22 bp, Homo sapiens
ttgcctgtttgagagctgtgtt

SEQ ID NO: 9218713 - DNA, 22 bp, Homo sapiens
ttgcctgctacggtcttcactg

SEQ ID NO: 9218714 - DNA, 22 bp, Homo sapiens
ttgccatttatactgcaagtca

SEQ ID NO: 9218715 - DNA, 22 bp, Homo sapiens
ttgcttccagtccaagtctgtt

SEQ ID NO: 9218716 - DNA, 23 bp, Homo sapiens
ttgcttccactgtaagtggagaa

SEQ ID NO: 9218717 - DNA, 22 bp, Homo sapiens
ttgctcatatttgcatgtgttt

SEQ ID NO: 9218718 - DNA, 22 bp, Homo sapiens
ttgctaaaaatggaattatagg

SEQ ID NO: 9218719 - DNA, 22 bp, Homo sapiens
ttgctataaatggtttcatatt

SEQ ID NO: 9218720 - DNA, 22 bp, Homo sapiens
ttgctaatgccctagaagtatt

SEQ ID NO: 9218721 - DNA, 22 bp, Homo sapiens
ttgccaggagacaaagtgggcc

SEQ ID NO: 9218722 - DNA, 22 bp, Homo sapiens
ttgccaggagacatctggagcc

SEQ ID NO: 9218723 - DNA, 22 bp, Homo sapiens
ttgccaggagacatctggagcc

SEQ ID NO: 9218724 - DNA, 22 bp, Homo sapiens
ttgccaggctctggttccagcc

SEQ ID NO: 9218725 - DNA, 22 bp, Homo sapiens
ttgccaggcttgtttctaggct

SEQ ID NO: 9218726 - DNA, 22 bp, Homo sapiens
ttgccagggaacagggagaggc

SEQ ID NO: 9218727 - DNA, 22 bp, Homo sapiens
ttgccagggctttggtggcatc

SEQ ID NO: 9218728 - DNA, 22 bp, Homo sapiens
ttgccagggccagtgggggtgt

SEQ ID NO: 9218729 - DNA, 22 bp, Homo sapiens
ttgccagggtcaggatgagatc

SEQ ID NO: 9218730 - DNA, 22 bp, Homo sapiens
ttgccaggggacatctggagcc

SEQ ID NO: 9218731 - DNA, 22 bp, Homo sapiens
ttgccaggggacatctggagcc

SEQ ID NO: 9218732 - DNA, 22 bp, Homo sapiens
ttgcattttggttgtaaatatg

SEQ ID NO: 9218733 - DNA, 22 bp, Homo sapiens
tttcataatactgtacatgaaa

SEQ ID NO: 9218734 - DNA, 22 bp, Homo sapiens
tttcatctaacactacataggg

SEQ ID NO: 9218735 - DNA, 23 bp, Homo sapiens
tttcatcagttgatctggacagc

SEQ ID NO: 9218736 - DNA, 22 bp, Homo sapiens
tttcatatgggcattggcaata

SEQ ID NO: 9218737 - DNA, 23 bp, Homo sapiens
tttcatatggtgtggatgaagaa

SEQ ID NO: 9218738 - DNA, 22 bp, Homo sapiens
tttccagtctctgcctccaagg

SEQ ID NO: 9218739 - DNA, 22 bp, Homo sapiens
tttccagtctcagccctgtaac

SEQ ID NO: 9218740 - DNA, 22 bp, Homo sapiens
tttccagtcaccactagatcag

SEQ ID NO: 9218741 - DNA, 22 bp, Homo sapiens
tttccagtaagtggcaaggagc

SEQ ID NO: 9218742 - DNA, 22 bp, Homo sapiens
tttccagtgatggggtctggct

SEQ ID NO: 9218743 - DNA, 22 bp, Homo sapiens
tttccagtgattgctgctctca

SEQ ID NO: 9218744 - DNA, 22 bp, Homo sapiens
tttccaggtatcaagcttcagg

SEQ ID NO: 9218745 - DNA, 22 bp, Homo sapiens
tttccaggtatcaagcttcagg

SEQ ID NO: 9218746 - DNA, 22 bp, Homo sapiens
tttccaggtgcatagaaaacag

SEQ ID NO: 9218747 - DNA, 22 bp, Homo sapiens
tttccaaataaggtcacattct

SEQ ID NO: 9218748 - DNA, 22 bp, Homo sapiens
tttccaggaagtaaggataatc

SEQ ID NO: 9218749 - DNA, 22 bp, Homo sapiens
tttccaggcagaggagttgtga

SEQ ID NO: 9218750 - DNA, 22 bp, Homo sapiens
tttccaggagaaagagagcctt

SEQ ID NO: 9218751 - DNA, 22 bp, Homo sapiens
tttcatcttatttgtctacatc

SEQ ID NO: 9218752 - DNA, 22 bp, Homo sapiens
tttccaaataaggtcacactca

SEQ ID NO: 9218753 - DNA, 22 bp, Homo sapiens
tttctaaactggattcagcctg

SEQ ID NO: 9218754 - DNA, 22 bp, Homo sapiens
tttccttttataaggcttgagg

SEQ ID NO: 9218755 - DNA, 22 bp, Homo sapiens
tttcccaaagcctggggtgagt

SEQ ID NO: 9218756 - DNA, 22 bp, Homo sapiens
tttccagttgtcctatcacctg

SEQ ID NO: 9218757 - DNA, 22 bp, Homo sapiens
tttccagtgggccccttgaaat

SEQ ID NO: 9218758 - DNA, 22 bp, Homo sapiens
tttccagtgcatggcaaatgct

SEQ ID NO: 9218759 - DNA, 22 bp, Homo sapiens
tttccagtgcatggcaaatgct

SEQ ID NO: 9218760 - DNA, 22 bp, Homo sapiens
tttcccaagaaaaataattgga

SEQ ID NO: 9218761 - DNA, 22 bp, Homo sapiens
tttcccaagtgtaaacatggca

SEQ ID NO: 9218762 - DNA, 22 bp, Homo sapiens
tttcccaattgagaggttctgt

SEQ ID NO: 9218763 - DNA, 22 bp, Homo sapiens
tttccttgcacattggtttcca

SEQ ID NO: 9218764 - DNA, 22 bp, Homo sapiens
tttcaagtcattctataatatc

SEQ ID NO: 9218765 - DNA, 22 bp, Homo sapiens
tttcaagtactgtaaacatgct

SEQ ID NO: 9218766 - DNA, 22 bp, Homo sapiens
tttcaaggatgttatataaatg

SEQ ID NO: 9218767 - DNA, 22 bp, Homo sapiens
tttcaagcataactgggaagag

SEQ ID NO: 9218768 - DNA, 22 bp, Homo sapiens
tttcaaggctagttttaattag

SEQ ID NO: 9218769 - DNA, 22 bp, Homo sapiens
tttcaagttgttgcattaaatg

SEQ ID NO: 9218770 - DNA, 22 bp, Homo sapiens
tttcacaacgttgtggtgagag

SEQ ID NO: 9218771 - DNA, 22 bp, Homo sapiens
tttcacatgtggaatgccaggt

SEQ ID NO: 9218772 - DNA, 22 bp, Homo sapiens
tttaggatctctcttgttacat

SEQ ID NO: 9218773 - DNA, 22 bp, Homo sapiens
tttaggatattaatgttcagag

SEQ ID NO: 9218774 - DNA, 22 bp, Homo sapiens
tttatctttaggactttgcaga

SEQ ID NO: 9218775 - DNA, 22 bp, Homo sapiens
tttattgtcttcgtggtgccta

SEQ ID NO: 9218776 - DNA, 22 bp, Homo sapiens
tttattgtgttgaaactgaatt

SEQ ID NO: 9218777 - DNA, 22 bp, Homo sapiens
tttatctttggatcttcagaaa

SEQ ID NO: 9218778 - DNA, 22 bp, Homo sapiens
tttaagatcatttgtattatcc

SEQ ID NO: 9218779 - DNA, 22 bp, Homo sapiens
tttaagagcatttgcaatttat

SEQ ID NO: 9218780 - DNA, 22 bp, Homo sapiens
tttacacattattttcagtgtg

SEQ ID NO: 9218781 - DNA, 22 bp, Homo sapiens
tttacagatgaggaaactgaga

SEQ ID NO: 9218782 - DNA, 22 bp, Homo sapiens
tttacagatgaggatactgagg

SEQ ID NO: 9218783 - DNA, 22 bp, Homo sapiens
tttacagatgaggatactgagg

SEQ ID NO: 9218784 - DNA, 22 bp, Homo sapiens
tttacacttgaggaaactgagg

SEQ ID NO: 9218785 - DNA, 22 bp, Homo sapiens
tttacagagagagaactggact

SEQ ID NO: 9218786 - DNA, 22 bp, Homo sapiens
tttacagacaacttaatagggg

SEQ ID NO: 9218787 - DNA, 22 bp, Homo sapiens
tttaacttagaagagatatcct

SEQ ID NO: 9218788 - DNA, 22 bp, Homo sapiens
tttaacatgtgaattttggaag

SEQ ID NO: 9218789 - DNA, 22 bp, Homo sapiens
tttaaatgtttatagagagtac

SEQ ID NO: 9218790 - DNA, 22 bp, Homo sapiens
ttgttctttttctccatgagat

SEQ ID NO: 9218791 - DNA, 22 bp, Homo sapiens
ttgttcttttgcttagacagat

SEQ ID NO: 9218792 - DNA, 22 bp, Homo sapiens
ttgttcttacttaagagtgaat

SEQ ID NO: 9218793 - DNA, 22 bp, Homo sapiens
ttgttcttggagcaggcagaga

SEQ ID NO: 9218794 - DNA, 23 bp, Homo sapiens
ttgttcttggatcttcctgaagc

SEQ ID NO: 9218795 - DNA, 22 bp, Homo sapiens
ttgttcttctctagagaagtgg

SEQ ID NO: 9218796 - DNA, 22 bp, Homo sapiens
ttgttgttataggtggtacaag

SEQ ID NO: 9218797 - DNA, 22 bp, Homo sapiens
ttgtttaaaagaaatcatagaa

SEQ ID NO: 9218798 - DNA, 22 bp, Homo sapiens
ttttggttctgggatacagaga

SEQ ID NO: 9218799 - DNA, 22 bp, Homo sapiens
ttttcctactgataaacagtta

SEQ ID NO: 9218800 - DNA, 22 bp, Homo sapiens
ttttttccaacttaagacttca

SEQ ID NO: 9218801 - DNA, 22 bp, Homo sapiens
ttttttatctatggtagtacca

SEQ ID NO: 9218802 - DNA, 22 bp, Homo sapiens
ttttttatagcaatgaacccac

SEQ ID NO: 9218803 - DNA, 22 bp, Homo sapiens
ttttttatatcaactgaagtct

SEQ ID NO: 9218804 - DNA, 22 bp, Homo sapiens
tttttgtctagcgtctctagtt

SEQ ID NO: 9218805 - DNA, 19 bp, Homo sapiens
ttttgtgtagctgctggtt

SEQ ID NO: 9218806 - DNA, 22 bp, Homo sapiens
ttttgtgtccttcacatcatgt

SEQ ID NO: 9218807 - DNA, 23 bp, Homo sapiens
ttttgtgtgacttaatatctctt

SEQ ID NO: 9218808 - DNA, 22 bp, Homo sapiens
ttttgtgttgccatgttaagca

SEQ ID NO: 9218809 - DNA, 22 bp, Homo sapiens
tttttgtatagaaatgaactaa

SEQ ID NO: 9218810 - DNA, 22 bp, Homo sapiens
tttttgtagtcattagaagagg

SEQ ID NO: 9218811 - DNA, 22 bp, Homo sapiens
ttttgtgttgtaatgtcagcta

SEQ ID NO: 9218812 - DNA, 22 bp, Homo sapiens
ttttgtatagtcaaagacaaga

SEQ ID NO: 9218813 - DNA, 22 bp, Homo sapiens
ttttgtcagtgagaacagagtt

SEQ ID NO: 9218814 - DNA, 22 bp, Homo sapiens
tttgtgcaggtataggcggaga

SEQ ID NO: 9218815 - DNA, 22 bp, Homo sapiens
ttttacaagctgagtcgttaaa

SEQ ID NO: 9218816 - DNA, 22 bp, Homo sapiens
ttttacaaatgaggagctggag

SEQ ID NO: 9218817 - DNA, 22 bp, Homo sapiens
ttttacaagctgagtcgttaaa

SEQ ID NO: 9218818 - DNA, 22 bp, Homo sapiens
ttttagaaatactgatttagtg

SEQ ID NO: 9218819 - DNA, 22 bp, Homo sapiens
ttttattggtaatgataaaagt

SEQ ID NO: 9218820 - DNA, 22 bp, Homo sapiens
tttctattgatctaataaacat

SEQ ID NO: 9218821 - DNA, 22 bp, Homo sapiens
tttctagttctaccacagtaat

SEQ ID NO: 9218822 - DNA, 22 bp, Homo sapiens
tttctagtcttccctacctccc

SEQ ID NO: 9218823 - DNA, 22 bp, Homo sapiens
tttctagtcttccctacctccc

SEQ ID NO: 9218824 - DNA, 22 bp, Homo sapiens
tttctagtatataactagatct

SEQ ID NO: 9218825 - DNA, 22 bp, Homo sapiens
tttctagtcagccatatctagt

SEQ ID NO: 9218826 - DNA, 22 bp, Homo sapiens
tttctagagtgggcatgtctta

SEQ ID NO: 9218827 - DNA, 22 bp, Homo sapiens
tttgacagtcccctgatgtttg

SEQ ID NO: 9218828 - DNA, 22 bp, Homo sapiens
tttgacagtgacgcctgtatga

SEQ ID NO: 9218829 - DNA, 22 bp, Homo sapiens
tttgacaggactaacatatggc

SEQ ID NO: 9218830 - DNA, 22 bp, Homo sapiens
tttgaagactactgggagtgaa

SEQ ID NO: 9218831 - DNA, 22 bp, Homo sapiens
tttgaagacatttgaatacttt

SEQ ID NO: 9218832 - DNA, 22 bp, Homo sapiens
tttgaaattggctcattggttt

SEQ ID NO: 9218833 - DNA, 22 bp, Homo sapiens
tttgcataggatggacatttta

SEQ ID NO: 9218834 - DNA, 22 bp, Homo sapiens
tttgcttcacaagtatggttct

SEQ ID NO: 9218835 - DNA, 22 bp, Homo sapiens
tttgctcttgctggaaaagttg

SEQ ID NO: 9218836 - DNA, 22 bp, Homo sapiens
tttgggctggtttgccatgccc

SEQ ID NO: 9218837 - DNA, 22 bp, Homo sapiens
tttgggcaggcttttccctaga

SEQ ID NO: 9218838 - DNA, 22 bp, Homo sapiens
tttggccatgctcaagggtata

SEQ ID NO: 9218839 - DNA, 22 bp, Homo sapiens
tttggctctggttctggctcca

SEQ ID NO: 9218840 - DNA, 22 bp, Homo sapiens
ttttttggataataaacgatct

SEQ ID NO: 9218841 - DNA, 21 bp, Homo sapiens
ttttttcttgcgtgaggcctg

SEQ ID NO: 9218842 - DNA, 21 bp, Homo sapiens
ttttttcttgcgtgaggcctg

SEQ ID NO: 9218843 - DNA, 21 bp, Homo sapiens
ttttttcttgcgtgaggcctg

SEQ ID NO: 9218844 - DNA, 22 bp, Homo sapiens
ttttttgcacactctgctaaat

SEQ ID NO: 9218845 - DNA, 22 bp, Homo sapiens
ctgtcctccggccacctacagt

SEQ ID NO: 9218846 - DNA, 22 bp, Homo sapiens
ctgtcctccagacgacagtccc

SEQ ID NO: 9218847 - DNA, 22 bp, Homo sapiens
ctgtcctcaacccatccttctc

SEQ ID NO: 9218848 - DNA, 22 bp, Homo sapiens
ctgtcctcaccttggcaggggg

SEQ ID NO: 9218849 - DNA, 21 bp, Homo sapiens
ctgtcctcagatgtggacgag

SEQ ID NO: 9218850 - DNA, 22 bp, Homo sapiens
ctgtcctcatctgccccaaggg

SEQ ID NO: 9218851 - DNA, 22 bp, Homo sapiens
atcacatctcaccactgcaacc

SEQ ID NO: 9218852 - DNA, 22 bp, Homo sapiens
ctgggtcccggcttctatccac

SEQ ID NO: 9218853 - DNA, 22 bp, Homo sapiens
ctgggtcagtctgtccctaggg

SEQ ID NO: 9218854 - DNA, 22 bp, Homo sapiens
ctgggtctaaaaattctcagat

SEQ ID NO: 9218855 - DNA, 22 bp, Homo sapiens
ctgggtctcaggagttctgagg

SEQ ID NO: 9218856 - DNA, 22 bp, Homo sapiens
ctgtccagtcagaacgtcatta

SEQ ID NO: 9218857 - DNA, 22 bp, Homo sapiens
ctgggtcccacagcctgctggg

SEQ ID NO: 9218858 - DNA, 22 bp, Homo sapiens
ctgggtataggaaacagttaag

SEQ ID NO: 9218859 - DNA, 22 bp, Homo sapiens
ctgtgatttctaaagagtagca

SEQ ID NO: 9218860 - DNA, 22 bp, Homo sapiens
ctgtgatggtcaggccctatct

SEQ ID NO: 9218861 - DNA, 22 bp, Homo sapiens
atcatgcagagtctgggcttca

SEQ ID NO: 9218862 - DNA, 22 bp, Homo sapiens
ctgtctttttagagagtaggat

SEQ ID NO: 9218863 - DNA, 22 bp, Homo sapiens
ctgtgatcattcttgatttaag

SEQ ID NO: 9218864 - DNA, 22 bp, Homo sapiens
atcacattatgtagtgaaaagg

SEQ ID NO: 9218865 - DNA, 22 bp, Homo sapiens
ctgtcttcccgaggccctggag

SEQ ID NO: 9218866 - DNA, 22 bp, Homo sapiens
ctgtctgttttgtatacaggcc

SEQ ID NO: 9218867 - DNA, 22 bp, Homo sapiens
ctgtcttctcctttgtttcagg

SEQ ID NO: 9218868 - DNA, 22 bp, Homo sapiens
ctgtcttctcctttgtttcagg

SEQ ID NO: 9218869 - DNA, 22 bp, Homo sapiens
ctgtggagcagggcagggtcac

SEQ ID NO: 9218870 - DNA, 22 bp, Homo sapiens
ctgtggagtgcttggctcagtg

SEQ ID NO: 9218871 - DNA, 22 bp, Homo sapiens
ctgtggagtggggagtactggt

SEQ ID NO: 9218872 - DNA, 22 bp, Homo sapiens
atccctggacggcgcctcccca

SEQ ID NO: 9218873 - DNA, 17 bp, Homo sapiens
atccccagcatctagaa

SEQ ID NO: 9218874 - DNA, 22 bp, Homo sapiens
atccatttgccgtgctatgtgc

SEQ ID NO: 9218875 - DNA, 22 bp, Homo sapiens
atccccaggggcattcaagctt

SEQ ID NO: 9218876 - DNA, 22 bp, Homo sapiens
atccccaggggcattcaagctt

SEQ ID NO: 9218877 - DNA, 22 bp, Homo sapiens
atccctctctgcatgactgtgt

SEQ ID NO: 9218878 - DNA, 20 bp, Homo sapiens
atccctcttcctagagtccc

SEQ ID NO: 9218879 - DNA, 23 bp, Homo sapiens
atatgtcatgcaccagcacttta

SEQ ID NO: 9218880 - DNA, 23 bp, Homo sapiens
atatgtcatgcaccagcacttta

SEQ ID NO: 9218881 - DNA, 23 bp, Homo sapiens
atatgtcatgcaccagcacttta

SEQ ID NO: 9218882 - DNA, 22 bp, Homo sapiens
atatgtatgtacgcacatattc

SEQ ID NO: 9218883 - DNA, 22 bp, Homo sapiens
atatgtactgaaactgcttttc

SEQ ID NO: 9218884 - DNA, 22 bp, Homo sapiens
atatttcttgagcacctggtat

SEQ ID NO: 9218885 - DNA, 22 bp, Homo sapiens
ctgggcagtggtggcccttccc

SEQ ID NO: 9218886 - DNA, 22 bp, Homo sapiens
ctgggcagtggtggcatctttg

SEQ ID NO: 9218887 - DNA, 22 bp, Homo sapiens
ctgggcagtggtggcatctttg

SEQ ID NO: 9218888 - DNA, 22 bp, Homo sapiens
atatgcaagcacatagaatact

SEQ ID NO: 9218889 - DNA, 22 bp, Homo sapiens
atatgattgtccttagcaaatt

SEQ ID NO: 9218890 - DNA, 22 bp, Homo sapiens
ctgggcaggatacttcatggga

SEQ ID NO: 9218891 - DNA, 20 bp, Homo sapiens
ctgggcaggtgtttgatctc

SEQ ID NO: 9218892 - DNA, 22 bp, Homo sapiens
atatgattccactattgtatgg

SEQ ID NO: 9218893 - DNA, 22 bp, Homo sapiens
atatatattgcccaggctggtt

SEQ ID NO: 9218894 - DNA, 22 bp, Homo sapiens
atatatatgctgatggctgcca

SEQ ID NO: 9218895 - DNA, 22 bp, Homo sapiens
atatatatcgagttcatgtctc

SEQ ID NO: 9218896 - DNA, 22 bp, Homo sapiens
ctgggcaatatgctgggcctgg

SEQ ID NO: 9218897 - DNA, 19 bp, Homo sapiens
ctgggaggtgttcagagaa

SEQ ID NO: 9218898 - DNA, 22 bp, Homo sapiens
ctgggagagcctttcctgagtc

SEQ ID NO: 9218899 - DNA, 22 bp, Homo sapiens
ctgggactttgtaggccagttg

SEQ ID NO: 9218900 - DNA, 22 bp, Homo sapiens
atataacatacatacagaaaag

SEQ ID NO: 9218901 - DNA, 22 bp, Homo sapiens
ctgggacacccaaggaaagagc

SEQ ID NO: 9218902 - DNA, 22 bp, Homo sapiens
ctggcagctggaggctagaggc

SEQ ID NO: 9218903 - DNA, 22 bp, Homo sapiens
ctggcttgaagttatgcaccag

SEQ ID NO: 9218904 - DNA, 22 bp, Homo sapiens
atacttcatgcttcatgtctgt

SEQ ID NO: 9218905 - DNA, 22 bp, Homo sapiens
ctggagtgaagtctggcagctt

SEQ ID NO: 9218906 - DNA, 22 bp, Homo sapiens
ctggagtcttaggttatggtga

SEQ ID NO: 9218907 - DNA, 22 bp, Homo sapiens
ctggcagctctactcagagcct

SEQ ID NO: 9218908 - DNA, 22 bp, Homo sapiens
ctggcagctctactcagagcct

SEQ ID NO: 9218909 - DNA, 22 bp, Homo sapiens
ctggcagcgtgagcagcatcca

SEQ ID NO: 9218910 - DNA, 22 bp, Homo sapiens
ctggcagcgtgagcagcatcca

SEQ ID NO: 9218911 - DNA, 19 bp, Homo sapiens
ctggcagcctgtctgtgtc

SEQ ID NO: 9218912 - DNA, 22 bp, Homo sapiens
ctggcagcggtttgcagcctgg

SEQ ID NO: 9218913 - DNA, 22 bp, Homo sapiens
atacagaattcactacagtttc

SEQ ID NO: 9218914 - DNA, 22 bp, Homo sapiens
ctggagggaggaggctgctatt

SEQ ID NO: 9218915 - DNA, 22 bp, Homo sapiens
ctggagggaggaggctgctatt

SEQ ID NO: 9218916 - DNA, 22 bp, Homo sapiens
ctggaggaaaacaactgcagac

SEQ ID NO: 9218917 - DNA, 22 bp, Homo sapiens
ctggagagaccgaaagaggctg

SEQ ID NO: 9218918 - DNA, 22 bp, Homo sapiens
atacagaatactaattcctgag

SEQ ID NO: 9218919 - DNA, 22 bp, Homo sapiens
atacaagactcagcacagacgg

SEQ ID NO: 9218920 - DNA, 22 bp, Homo sapiens
atacaaggtggagtcaggaaaa

SEQ ID NO: 9218921 - DNA, 22 bp, Homo sapiens
atacaaggtcatgaaggtttac

SEQ ID NO: 9218922 - DNA, 22 bp, Homo sapiens
ataatcaaagtcctatgacatc

SEQ ID NO: 9218923 - DNA, 22 bp, Homo sapiens
ctgcttggagtcctccagcacc

SEQ ID NO: 9218924 - DNA, 22 bp, Homo sapiens
ctgcttggagtcctccagcacc

SEQ ID NO: 9218925 - DNA, 22 bp, Homo sapiens
ctgctcagtaatagtcctatct

SEQ ID NO: 9218926 - DNA, 22 bp, Homo sapiens
ctgcccagaagccagatgggca

SEQ ID NO: 9218927 - DNA, 22 bp, Homo sapiens
ctgcccagaagcttagagctta

SEQ ID NO: 9218928 - DNA, 22 bp, Homo sapiens
ctgcccagaatcactcactcga

SEQ ID NO: 9218929 - DNA, 22 bp, Homo sapiens
ctgcagctatattttcccacag

SEQ ID NO: 9218930 - DNA, 22 bp, Homo sapiens
agttgtcccggtctagccactt

SEQ ID NO: 9218931 - DNA, 22 bp, Homo sapiens
ataaatatcactgttgtccctc

SEQ ID NO: 9218932 - DNA, 22 bp, Homo sapiens
ataaatatcactgttgtccctc

SEQ ID NO: 9218933 - DNA, 21 bp, Homo sapiens
ctgccaggatagcatgcaggc

SEQ ID NO: 9218934 - DNA, 22 bp, Homo sapiens
ctgccaggactgacgtcttcag

SEQ ID NO: 9218935 - DNA, 22 bp, Homo sapiens
ctgccaaaaggtgcacctgctg

SEQ ID NO: 9218936 - DNA, 22 bp, Homo sapiens
ctgcatttccacctggccacag

SEQ ID NO: 9218937 - DNA, 22 bp, Homo sapiens
ctgccaggattctgtgaacccc

SEQ ID NO: 9218938 - DNA, 22 bp, Homo sapiens
ctgccaggcacgtgcagcatca

SEQ ID NO: 9218939 - DNA, 22 bp, Homo sapiens
ctgccaggcactgggctctgca

SEQ ID NO: 9218940 - DNA, 22 bp, Homo sapiens
ctgccaggcactgggctctgca

SEQ ID NO: 9218941 - DNA, 22 bp, Homo sapiens
ctgccaggcagggagatggctg

SEQ ID NO: 9218942 - DNA, 22 bp, Homo sapiens
ctgccaggcctcatcccagcca

SEQ ID NO: 9218943 - DNA, 22 bp, Homo sapiens
ataaaagtaggaccaacttaca

SEQ ID NO: 9218944 - DNA, 22 bp, Homo sapiens
ctgaggctttgtgtgcatgcct

SEQ ID NO: 9218945 - DNA, 22 bp, Homo sapiens
ctgaggcttgtcctctcagctt

SEQ ID NO: 9218946 - DNA, 22 bp, Homo sapiens
ctgaggcctctgttcaccagaa

SEQ ID NO: 9218947 - DNA, 22 bp, Homo sapiens
ctgaggcctctctccttggctt

SEQ ID NO: 9218948 - DNA, 22 bp, Homo sapiens
ctgaggcctctgttcaccagaa

SEQ ID NO: 9218949 - DNA, 22 bp, Homo sapiens
ctgaggcctctttccttggctt

SEQ ID NO: 9218950 - DNA, 22 bp, Homo sapiens
ctgaggcctctctcctgggctt

SEQ ID NO: 9218951 - DNA, 22 bp, Homo sapiens
ctgaggcctcgttggctggaac

SEQ ID NO: 9218952 - DNA, 22 bp, Homo sapiens
ctgaggcctcgttggctggaac

SEQ ID NO: 9218953 - DNA, 22 bp, Homo sapiens
ctgaggcctctcccactccagc

SEQ ID NO: 9218954 - DNA, 22 bp, Homo sapiens
ctgaggcctctccttggcttgt

SEQ ID NO: 9218955 - DNA, 19 bp, Homo sapiens
agttggggcagggaagaga

SEQ ID NO: 9218956 - DNA, 18 bp, Homo sapiens
agttgcttattctgtgca

SEQ ID NO: 9218957 - DNA, 22 bp, Homo sapiens
agttctttctagacacgtagac

SEQ ID NO: 9218958 - DNA, 19 bp, Homo sapiens
agttcttgtcctgtctgtt

SEQ ID NO: 9218959 - DNA, 21 bp, Homo sapiens
ctgaggcagcacagctagtca

SEQ ID NO: 9218960 - DNA, 22 bp, Homo sapiens
ctgaggcctaagacatgaatga

SEQ ID NO: 9218961 - DNA, 22 bp, Homo sapiens
ctgaggcctcactgtagtccct

SEQ ID NO: 9218962 - DNA, 22 bp, Homo sapiens
ctgaggcatgaatgtgggcttt

SEQ ID NO: 9218963 - DNA, 22 bp, Homo sapiens
ctgaggcatcatggagaacagt

SEQ ID NO: 9218964 - DNA, 22 bp, Homo sapiens
cctggccacagggctctgcatt

SEQ ID NO: 9218965 - DNA, 22 bp, Homo sapiens
cctggccacagggctctgcatt

SEQ ID NO: 9218966 - DNA, 21 bp, Homo sapiens
cctggccaatctgatagggtt

SEQ ID NO: 9218967 - DNA, 20 bp, Homo sapiens
cctggccaatgagataggaa

SEQ ID NO: 9218968 - DNA, 22 bp, Homo sapiens
cctggccacccagccttggcca

SEQ ID NO: 9218969 - DNA, 22 bp, Homo sapiens
cctggccacccagccttggcca

SEQ ID NO: 9218970 - DNA, 22 bp, Homo sapiens
cctggccacccagccttggcca

SEQ ID NO: 9218971 - DNA, 22 bp, Homo sapiens
cctggccactcaggtgtggggc

SEQ ID NO: 9218972 - DNA, 19 bp, Homo sapiens
cctggccagacttctgccc

SEQ ID NO: 9218973 - DNA, 22 bp, Homo sapiens
cctggccagaggcgtgcctgtg

SEQ ID NO: 9218974 - DNA, 22 bp, Homo sapiens
cctggccagaggcgtgcctgtg

SEQ ID NO: 9218975 - DNA, 22 bp, Homo sapiens
cctggccagaggcgtgcctgtg

SEQ ID NO: 9218976 - DNA, 22 bp, Homo sapiens
cctggctctgtcctcgcgcaaa

SEQ ID NO: 9218977 - DNA, 22 bp, Homo sapiens
cctggctcttcagaggttccta

SEQ ID NO: 9218978 - DNA, 22 bp, Homo sapiens
cctgggaagtcagccaaggacg

SEQ ID NO: 9218979 - DNA, 22 bp, Homo sapiens
cctggaccaaacactggcctgg

SEQ ID NO: 9218980 - DNA, 22 bp, Homo sapiens
cctggaagtcattcctcgttcc

SEQ ID NO: 9218981 - DNA, 22 bp, Homo sapiens
cctggaccaaacactggcctgg

SEQ ID NO: 9218982 - DNA, 22 bp, Homo sapiens
cctggcagcgtgccgagctgcg

SEQ ID NO: 9218983 - DNA, 22 bp, Homo sapiens
cctggcagcgccgaagctggcc

SEQ ID NO: 9218984 - DNA, 22 bp, Homo sapiens
cctgctgctatgaaggtgacag

SEQ ID NO: 9218985 - DNA, 22 bp, Homo sapiens
cctgctctgccaagtcctcttt

SEQ ID NO: 9218986 - DNA, 22 bp, Homo sapiens
cctgctctaaatctcatggaac

SEQ ID NO: 9218987 - DNA, 22 bp, Homo sapiens
cctgcctggcttccagaagaga

SEQ ID NO: 9218988 - DNA, 22 bp, Homo sapiens
cctgctctccatacactttcta

SEQ ID NO: 9218989 - DNA, 22 bp, Homo sapiens
cctgctctagactctgggaagg

SEQ ID NO: 9218990 - DNA, 22 bp, Homo sapiens
cctgcccagggtcaccacagag

SEQ ID NO: 9218991 - DNA, 22 bp, Homo sapiens
cctgccaggacattgcttgaag

SEQ ID NO: 9218992 - DNA, 22 bp, Homo sapiens
cctgccaggacattgcttgaag

SEQ ID NO: 9218993 - DNA, 19 bp, Homo sapiens
cctctgccagcccgcctct

SEQ ID NO: 9218994 - DNA, 22 bp, Homo sapiens
cctgccctatgaccagcttcac

SEQ ID NO: 9218995 - DNA, 22 bp, Homo sapiens
cctgccctaatccagagactag

SEQ ID NO: 9218996 - DNA, 22 bp, Homo sapiens
cctgcccccgtcagaggtgatg

SEQ ID NO: 9218997 - DNA, 22 bp, Homo sapiens
cctctgcaaagaatttgtctcc

SEQ ID NO: 9218998 - DNA, 22 bp, Homo sapiens
cctctgccacctcccacgaggc

SEQ ID NO: 9218999 - DNA, 22 bp, Homo sapiens
cctctgcatgtgcagtaccgag

SEQ ID NO: 9219000 - DNA, 22 bp, Homo sapiens
cctctgcatctggctgctgcag

SEQ ID NO: 9219001 - DNA, 22 bp, Homo sapiens
cctctgcacttcaccttagctc

SEQ ID NO: 9219002 - DNA, 22 bp, Homo sapiens
cctctgcaccatagccttcagc

SEQ ID NO: 9219003 - DNA, 22 bp, Homo sapiens
cctctgcagcagagagccagag

SEQ ID NO: 9219004 - DNA, 21 bp, Homo sapiens
agggtcaggaaccagggtacc

SEQ ID NO: 9219005 - DNA, 21 bp, Homo sapiens
agggtcaggaaccagggtacc

SEQ ID NO: 9219006 - DNA, 19 bp, Homo sapiens
agggtcaggacaaggactt

SEQ ID NO: 9219007 - DNA, 22 bp, Homo sapiens
agggtcctgagcctggggcgca

SEQ ID NO: 9219008 - DNA, 21 bp, Homo sapiens
agggtcctacagggctcagga

SEQ ID NO: 9219009 - DNA, 22 bp, Homo sapiens
agggtccttctgttcctgagca

SEQ ID NO: 9219010 - DNA, 22 bp, Homo sapiens
agggtcctgggtgcagttgctt

SEQ ID NO: 9219011 - DNA, 22 bp, Homo sapiens
agggtctgttgtttgttctgga

SEQ ID NO: 9219012 - DNA, 22 bp, Homo sapiens
agggtctgtatttctggcaagc

SEQ ID NO: 9219013 - DNA, 22 bp, Homo sapiens
agggtctgtatttctggcaagc

SEQ ID NO: 9219014 - DNA, 22 bp, Homo sapiens
agggtctgaccaccagtaggga

SEQ ID NO: 9219015 - DNA, 20 bp, Homo sapiens
agggtctgatgtggtggccc

SEQ ID NO: 9219016 - DNA, 22 bp, Homo sapiens
agggtctgactcctctggcaag

SEQ ID NO: 9219017 - DNA, 22 bp, Homo sapiens
cctttgtggtggcccagtgtgg

SEQ ID NO: 9219018 - DNA, 22 bp, Homo sapiens
cctttgtggggcggtgggtaat

SEQ ID NO: 9219019 - DNA, 22 bp, Homo sapiens
cctttgtgaatatgcagaaaat

SEQ ID NO: 9219020 - DNA, 22 bp, Homo sapiens
cctttgtgaggtcctgtggggg

SEQ ID NO: 9219021 - DNA, 22 bp, Homo sapiens
aggtgggggctgtgtccttgac

SEQ ID NO: 9219022 - DNA, 22 bp, Homo sapiens
aggtgggggctgtgtccttgac

SEQ ID NO: 9219023 - DNA, 22 bp, Homo sapiens
aggtgggggctgtgtccttgac

SEQ ID NO: 9219024 - DNA, 22 bp, Homo sapiens
aggtggggtgttggatgtttat

SEQ ID NO: 9219025 - DNA, 22 bp, Homo sapiens
aggtggggtgagctgcagacta

SEQ ID NO: 9219026 - DNA, 20 bp, Homo sapiens
cgaggccaaggggctgggcc

SEQ ID NO: 9219027 - DNA, 22 bp, Homo sapiens
cgaggccacacctgcttctggg

SEQ ID NO: 9219028 - DNA, 22 bp, Homo sapiens
cgaggccaatgtgttttatgaa

SEQ ID NO: 9219029 - DNA, 22 bp, Homo sapiens
cgctcagactcatgatatgctg

SEQ ID NO: 9219030 - DNA, 23 bp, Homo sapiens
cgctcagaggttctgtccttggt

SEQ ID NO: 9219031 - DNA, 22 bp, Homo sapiens
cgaggccaccgtggtttccgag

SEQ ID NO: 9219032 - DNA, 22 bp, Homo sapiens
cgaggccagctctaagccctac

SEQ ID NO: 9219033 - DNA, 22 bp, Homo sapiens
agtatatcacatgtagtaatgg

SEQ ID NO: 9219034 - DNA, 22 bp, Homo sapiens
cggccgcagcagtgtcggccca

SEQ ID NO: 9219035 - DNA, 22 bp, Homo sapiens
cggctcactgcagctccgcctc

SEQ ID NO: 9219036 - DNA, 22 bp, Homo sapiens
cggctcagacttcccaagaaca

SEQ ID NO: 9219037 - DNA, 22 bp, Homo sapiens
cggctcactgcagctccgcctc

SEQ ID NO: 9219038 - DNA, 22 bp, Homo sapiens
cggcatgggcgtccccctcact

SEQ ID NO: 9219039 - DNA, 22 bp, Homo sapiens
cggccaagccggggccccgaag

SEQ ID NO: 9219040 - DNA, 22 bp, Homo sapiens
cggccaagccggggccccgaag

SEQ ID NO: 9219041 - DNA, 19 bp, Homo sapiens
cggcccctcctctcgcgcc

SEQ ID NO: 9219042 - DNA, 22 bp, Homo sapiens
cggagcctgcttgttgcagctg

SEQ ID NO: 9219043 - DNA, 22 bp, Homo sapiens
aggtggggctgggaaagattcc

SEQ ID NO: 9219044 - DNA, 22 bp, Homo sapiens
ccttggccctagcctcaggcaa

SEQ ID NO: 9219045 - DNA, 22 bp, Homo sapiens
ccttgctgaccatcacctttga

SEQ ID NO: 9219046 - DNA, 22 bp, Homo sapiens
ccttgctgcgtgctagcacaga

SEQ ID NO: 9219047 - DNA, 22 bp, Homo sapiens
aggtgggaacccagcagggccc

SEQ ID NO: 9219048 - DNA, 22 bp, Homo sapiens
aggtgggacccgtggggtgcga

SEQ ID NO: 9219049 - DNA, 21 bp, Homo sapiens
aggtgggagaccatgtaggtc

SEQ ID NO: 9219050 - DNA, 22 bp, Homo sapiens
aggtggctggtccaggctgcag

SEQ ID NO: 9219051 - DNA, 21 bp, Homo sapiens
aggtggctgcatcctcagaag

SEQ ID NO: 9219052 - DNA, 22 bp, Homo sapiens
aggtggctgaagagtgggtgag

SEQ ID NO: 9219053 - DNA, 22 bp, Homo sapiens
cctgggagaactgctgggttgg

SEQ ID NO: 9219054 - DNA, 22 bp, Homo sapiens
cctgggactcggccaggacaga

SEQ ID NO: 9219055 - DNA, 22 bp, Homo sapiens
cctgggactcggccaggacaga

SEQ ID NO: 9219056 - DNA, 22 bp, Homo sapiens
aggtgccagctctcaggcagga

SEQ ID NO: 9219057 - DNA, 22 bp, Homo sapiens
aggtgccagctctcaggcagga

SEQ ID NO: 9219058 - DNA, 17 bp, Homo sapiens
aggtgccagtgatatac

SEQ ID NO: 9219059 - DNA, 22 bp, Homo sapiens
aggtgccttccgcggagctcgc

SEQ ID NO: 9219060 - DNA, 22 bp, Homo sapiens
aggtgctggagtctgggcagga

SEQ ID NO: 9219061 - DNA, 22 bp, Homo sapiens
aggtgctgaactggtgaggtct

SEQ ID NO: 9219062 - DNA, 17 bp, Homo sapiens
ctctccttcctctgagg

SEQ ID NO: 9219063 - DNA, 22 bp, Homo sapiens
ctctcccagtcaggctcaggat

SEQ ID NO: 9219064 - DNA, 20 bp, Homo sapiens
ctctcccagcacagcttcct

SEQ ID NO: 9219065 - DNA, 22 bp, Homo sapiens
ctctcgccagcggggctgcgct

SEQ ID NO: 9219066 - DNA, 22 bp, Homo sapiens
agtgctggcccatagctgctgg

SEQ ID NO: 9219067 - DNA, 22 bp, Homo sapiens
agtgctggcccatagctgctgg

SEQ ID NO: 9219068 - DNA, 22 bp, Homo sapiens
agtgctgggattacaggcataa

SEQ ID NO: 9219069 - DNA, 22 bp, Homo sapiens
ctctccattccctacagttttc

SEQ ID NO: 9219070 - DNA, 22 bp, Homo sapiens
agtgctgggattgcaggcatga

SEQ ID NO: 9219071 - DNA, 22 bp, Homo sapiens
agtgctgggctatctactgcta

SEQ ID NO: 9219072 - DNA, 22 bp, Homo sapiens
agtgctgggctatctactgcta

SEQ ID NO: 9219073 - DNA, 22 bp, Homo sapiens
ctccagagagtccagctctggg

SEQ ID NO: 9219074 - DNA, 22 bp, Homo sapiens
agtgctgaggccatactccata

SEQ ID NO: 9219075 - DNA, 22 bp, Homo sapiens
agtgctggattacaggcgtgag

SEQ ID NO: 9219076 - DNA, 22 bp, Homo sapiens
agtgctggagggaggcaggttc

SEQ ID NO: 9219077 - DNA, 22 bp, Homo sapiens
ctccttggtgtagtactgagca

SEQ ID NO: 9219078 - DNA, 18 bp, Homo sapiens
ctccttggagaagaggcc

SEQ ID NO: 9219079 - DNA, 19 bp, Homo sapiens
ctccttgccatttcttttc

SEQ ID NO: 9219080 - DNA, 22 bp, Homo sapiens
ctcctgagtagtagcattgtca

SEQ ID NO: 9219081 - DNA, 22 bp, Homo sapiens
ctcctggttcagagagctgaga

SEQ ID NO: 9219082 - DNA, 22 bp, Homo sapiens
ctccttctgggcctggcagtgg

SEQ ID NO: 9219083 - DNA, 22 bp, Homo sapiens
agtggctgtgaaatacatggga

SEQ ID NO: 9219084 - DNA, 22 bp, Homo sapiens
agtggctgttccaggtgaggac

SEQ ID NO: 9219085 - DNA, 22 bp, Homo sapiens
ctctggagaggttcccatggga

SEQ ID NO: 9219086 - DNA, 22 bp, Homo sapiens
ctctgctgcaggaaggcgtgca

SEQ ID NO: 9219087 - DNA, 22 bp, Homo sapiens
ctctggacagcaggtgctgtgg

SEQ ID NO: 9219088 - DNA, 22 bp, Homo sapiens
ctctgtgagggtctgtacagaa

SEQ ID NO: 9219089 - DNA, 22 bp, Homo sapiens
ctctgtgaacccctcctttctt

SEQ ID NO: 9219090 - DNA, 22 bp, Homo sapiens
ctctgtcccagacccacctctc

SEQ ID NO: 9219091 - DNA, 22 bp, Homo sapiens
ctctgtcctatgcttgatagaa

SEQ ID NO: 9219092 - DNA, 22 bp, Homo sapiens
ctctgtcctccacctgctttca

SEQ ID NO: 9219093 - DNA, 22 bp, Homo sapiens
agtggtggagccaggaaatgtg

SEQ ID NO: 9219094 - DNA, 22 bp, Homo sapiens
agtggtgctgcgcgcggagctc

SEQ ID NO: 9219095 - DNA, 22 bp, Homo sapiens
ctcttctttagtccagaccatc

SEQ ID NO: 9219096 - DNA, 22 bp, Homo sapiens
ctcttagctgctgttctttgag

SEQ ID NO: 9219097 - DNA, 21 bp, Homo sapiens
ctcttgctgatgtctccttta

SEQ ID NO: 9219098 - DNA, 21 bp, Homo sapiens
ctcttgctgatgtctccttta

SEQ ID NO: 9219099 - DNA, 22 bp, Homo sapiens
ctcttgaactttctagtttcat

SEQ ID NO: 9219100 - DNA, 19 bp, Homo sapiens
ctcttgggtggcagaggcc

SEQ ID NO: 9219101 - DNA, 22 bp, Homo sapiens
ctcttgtattggagttagtggg

SEQ ID NO: 9219102 - DNA, 22 bp, Homo sapiens
ctcttgggtgggcagtgggcct

SEQ ID NO: 9219103 - DNA, 22 bp, Homo sapiens
ctcagtggagagcggtcctggg

SEQ ID NO: 9219104 - DNA, 22 bp, Homo sapiens
ctccagaagacccatcctcatg

SEQ ID NO: 9219105 - DNA, 22 bp, Homo sapiens
ctccagaattgtccattggaaa

SEQ ID NO: 9219106 - DNA, 22 bp, Homo sapiens
ctcagctcaaaattcacctttg

SEQ ID NO: 9219107 - DNA, 22 bp, Homo sapiens
ctcagctcactcttttgtgctt

SEQ ID NO: 9219108 - DNA, 22 bp, Homo sapiens
ctcagcaattacctgtgtctct

SEQ ID NO: 9219109 - DNA, 22 bp, Homo sapiens
ctcagcacatctttacatttcc

SEQ ID NO: 9219110 - DNA, 22 bp, Homo sapiens
ctcagcacattcctaagggatg

SEQ ID NO: 9219111 - DNA, 22 bp, Homo sapiens
ctcagctctgtcacttactagc

SEQ ID NO: 9219112 - DNA, 23 bp, Homo sapiens
agtctcagctggaaacatgtgtc

SEQ ID NO: 9219113 - DNA, 21 bp, Homo sapiens
ctcaggcatttgaggagagtc

SEQ ID NO: 9219114 - DNA, 22 bp, Homo sapiens
ctcagggaattgaatctccttg

SEQ ID NO: 9219115 - DNA, 22 bp, Homo sapiens
agtctccacactggcagatgcc

SEQ ID NO: 9219116 - DNA, 22 bp, Homo sapiens
ctcagggaggcctctgctggtt

SEQ ID NO: 9219117 - DNA, 22 bp, Homo sapiens
ctcagggaggccctgggaccct

SEQ ID NO: 9219118 - DNA, 22 bp, Homo sapiens
ctcagggacaaggggagacccc

SEQ ID NO: 9219119 - DNA, 22 bp, Homo sapiens
ctcagcaacacggcctattaag

SEQ ID NO: 9219120 - DNA, 22 bp, Homo sapiens
ctcagacatttgtagaaagtgc

SEQ ID NO: 9219121 - DNA, 22 bp, Homo sapiens
ctcagacaaatgattaaggtta

SEQ ID NO: 9219122 - DNA, 22 bp, Homo sapiens
ctcagacccccagagctgctaa

SEQ ID NO: 9219123 - DNA, 18 bp, Homo sapiens
ctcagacatgcttctttt

SEQ ID NO: 9219124 - DNA, 22 bp, Homo sapiens
ctcagacatctgaaatgggtta

SEQ ID NO: 9219125 - DNA, 21 bp, Homo sapiens
ctcagacagggaggctctggg

SEQ ID NO: 9219126 - DNA, 22 bp, Homo sapiens
ctcagactaaaatgggaatgta

SEQ ID NO: 9219127 - DNA, 22 bp, Homo sapiens
ctcagaggtcaagagcagagct

SEQ ID NO: 9219128 - DNA, 22 bp, Homo sapiens
ctcagagggtctcctccagaat

SEQ ID NO: 9219129 - DNA, 22 bp, Homo sapiens
ctcagacttttgttcaacgagt

SEQ ID NO: 9219130 - DNA, 22 bp, Homo sapiens
ctcagaatctgccaagttcagg

SEQ ID NO: 9219131 - DNA, 22 bp, Homo sapiens
ctcagacacagccccacgaagt

SEQ ID NO: 9219132 - DNA, 18 bp, Homo sapiens
ctcagacaggctgtgcta

SEQ ID NO: 9219133 - DNA, 22 bp, Homo sapiens
ctcagaagccttcagtcttggc

SEQ ID NO: 9219134 - DNA, 22 bp, Homo sapiens
ctcagaagaacaaaggctctac

SEQ ID NO: 9219135 - DNA, 22 bp, Homo sapiens
ctcagaagaatcagcagctatt

SEQ ID NO: 9219136 - DNA, 22 bp, Homo sapiens
agtcccagcctgtaggattggg

SEQ ID NO: 9219137 - DNA, 22 bp, Homo sapiens
agtcccagatctacaggaggga

SEQ ID NO: 9219138 - DNA, 22 bp, Homo sapiens
agtcccagatctacaggaggga

SEQ ID NO: 9219139 - DNA, 22 bp, Homo sapiens
agtcccagagaggtcggggcca

SEQ ID NO: 9219140 - DNA, 22 bp, Homo sapiens
ctcaagaaggatgagctattgc

SEQ ID NO: 9219141 - DNA, 20 bp, Homo sapiens
agtcccaacattcagctctg

SEQ ID NO: 9219142 - DNA, 22 bp, Homo sapiens
agtcccaacagcttacaaggaa

SEQ ID NO: 9219143 - DNA, 20 bp, Homo sapiens
agtcccaacattcagctctg

SEQ ID NO: 9219144 - DNA, 22 bp, Homo sapiens
ctcaaatatgtggtcagaaagc

SEQ ID NO: 9219145 - DNA, 22 bp, Homo sapiens
ctcaaatccccgttcctcattc

SEQ ID NO: 9219146 - DNA, 21 bp, Homo sapiens
ctcaaagaccaaaagtgtaga

SEQ ID NO: 9219147 - DNA, 22 bp, Homo sapiens
ctcaaagacaaaaatctgaggt

SEQ ID NO: 9219148 - DNA, 22 bp, Homo sapiens
ctcaaatagaactgatctataa

SEQ ID NO: 9219149 - DNA, 22 bp, Homo sapiens
ctcaaagagccaggtaatcacc

SEQ ID NO: 9219150 - DNA, 22 bp, Homo sapiens
ctcaaatataagctaaatgtgg

SEQ ID NO: 9219151 - DNA, 22 bp, Homo sapiens
ctcaaatagaactgatctataa

SEQ ID NO: 9219152 - DNA, 22 bp, Homo sapiens
cgggttcacgccattctcctgc

SEQ ID NO: 9219153 - DNA, 22 bp, Homo sapiens
cgggttcacgccattctcctgc

SEQ ID NO: 9219154 - DNA, 22 bp, Homo sapiens
cggggtgggaatagacctgtct

SEQ ID NO: 9219155 - DNA, 22 bp, Homo sapiens
cggggtggcactctaaatagaa

SEQ ID NO: 9219156 - DNA, 22 bp, Homo sapiens
cggggttcatccatgctgtggc

SEQ ID NO: 9219157 - DNA, 21 bp, Homo sapiens
aggctcccagaaatgggcatc

SEQ ID NO: 9219158 - DNA, 22 bp, Homo sapiens
aggctcccatggtgtggcagga

SEQ ID NO: 9219159 - DNA, 22 bp, Homo sapiens
aggctcccaagcactgacccca

SEQ ID NO: 9219160 - DNA, 22 bp, Homo sapiens
ccaggctctgcaaaatcaggct

SEQ ID NO: 9219161 - DNA, 22 bp, Homo sapiens
ccaggctctgccaggcccttga

SEQ ID NO: 9219162 - DNA, 22 bp, Homo sapiens
aggctccttgctcacaggctca

SEQ ID NO: 9219163 - DNA, 22 bp, Homo sapiens
ccaggctctgccaggcccttga

SEQ ID NO: 9219164 - DNA, 22 bp, Homo sapiens
ccaggctctgagaggaatgtga

SEQ ID NO: 9219165 - DNA, 22 bp, Homo sapiens
ccaggctctgcaaaatcaggct

SEQ ID NO: 9219166 - DNA, 22 bp, Homo sapiens
ccaggccctgctcctcacacca

SEQ ID NO: 9219167 - DNA, 22 bp, Homo sapiens
aggctccacggcaggatgctgt

SEQ ID NO: 9219168 - DNA, 22 bp, Homo sapiens
aggctccatgcaaaggctgttt

SEQ ID NO: 9219169 - DNA, 22 bp, Homo sapiens
ccaggcacttcatcattagggt

SEQ ID NO: 9219170 - DNA, 22 bp, Homo sapiens
aggcctcctggctccaggcctt

SEQ ID NO: 9219171 - DNA, 22 bp, Homo sapiens
ccaggcacttcatcattagggt

SEQ ID NO: 9219172 - DNA, 22 bp, Homo sapiens
ccaggccaaattcagtcagcag

SEQ ID NO: 9219173 - DNA, 21 bp, Homo sapiens
ccaggcatgactgcagagagc

SEQ ID NO: 9219174 - DNA, 22 bp, Homo sapiens
ccaggcatggggagagccagat

SEQ ID NO: 9219175 - DNA, 22 bp, Homo sapiens
ccaggcatcacgggcatgtggc

SEQ ID NO: 9219176 - DNA, 17 bp, Homo sapiens
aggcctccctccaggcc

SEQ ID NO: 9219177 - DNA, 22 bp, Homo sapiens
aggcctagaggaatggccaggg

SEQ ID NO: 9219178 - DNA, 22 bp, Homo sapiens
aggcctcagttcttgccaggtg

SEQ ID NO: 9219179 - DNA, 22 bp, Homo sapiens
aggcctcagctcagtgtgacag

SEQ ID NO: 9219180 - DNA, 22 bp, Homo sapiens
aggctctgagtagagctgccag

SEQ ID NO: 9219181 - DNA, 22 bp, Homo sapiens
aggctctgaggcagattttcgt

SEQ ID NO: 9219182 - DNA, 22 bp, Homo sapiens
aggctctgagtctggtgtctgc

SEQ ID NO: 9219183 - DNA, 22 bp, Homo sapiens
aggctctgatcaggtggctgtg

SEQ ID NO: 9219184 - DNA, 22 bp, Homo sapiens
aggctctgcaggtatttcttga

SEQ ID NO: 9219185 - DNA, 22 bp, Homo sapiens
aggctctgcagaccccagctgt

SEQ ID NO: 9219186 - DNA, 22 bp, Homo sapiens
aggctctgatgcaagcccaggg

SEQ ID NO: 9219187 - DNA, 20 bp, Homo sapiens
aggctctgcatttctgagtg

SEQ ID NO: 9219188 - DNA, 22 bp, Homo sapiens
aggctctgccaattccttcctc

SEQ ID NO: 9219189 - DNA, 20 bp, Homo sapiens
aggctctgccattgtccctg

SEQ ID NO: 9219190 - DNA, 20 bp, Homo sapiens
aggctctgccattgtccctg

SEQ ID NO: 9219191 - DNA, 23 bp, Homo sapiens
ccagtgattgcctggaaggaggt

SEQ ID NO: 9219192 - DNA, 22 bp, Homo sapiens
ccagtgcacagccaggcaggtg

SEQ ID NO: 9219193 - DNA, 22 bp, Homo sapiens
ccagtgcacaatggaacaactc

SEQ ID NO: 9219194 - DNA, 19 bp, Homo sapiens
ccagtgcaaggtaagatag

SEQ ID NO: 9219195 - DNA, 23 bp, Homo sapiens
ccagtgagcatggctgtgttcca

SEQ ID NO: 9219196 - DNA, 22 bp, Homo sapiens
ccagtgagatatctgggcatta

SEQ ID NO: 9219197 - DNA, 22 bp, Homo sapiens
ccagtctgttctcacctctgag

SEQ ID NO: 9219198 - DNA, 22 bp, Homo sapiens
ccagtctgtgtgccagcctgcg

SEQ ID NO: 9219199 - DNA, 22 bp, Homo sapiens
ccagtctgtgtgccagcctgcg

SEQ ID NO: 9219200 - DNA, 22 bp, Homo sapiens
ccagtctgtgtgccagcctgcg

SEQ ID NO: 9219201 - DNA, 22 bp, Homo sapiens
ccagtctgtactttgctctgtt

SEQ ID NO: 9219202 - DNA, 23 bp, Homo sapiens
aggctgagctctcccagcttcag

SEQ ID NO: 9219203 - DNA, 22 bp, Homo sapiens
aggctgagcggggtcccagagc

SEQ ID NO: 9219204 - DNA, 23 bp, Homo sapiens
aggctgagctctcccagcttcag

SEQ ID NO: 9219205 - DNA, 22 bp, Homo sapiens
aggctgaggcgggaggatcact

SEQ ID NO: 9219206 - DNA, 22 bp, Homo sapiens
ccagttcaccagtggcagaagt

SEQ ID NO: 9219207 - DNA, 22 bp, Homo sapiens
ccagtgcaccatttccctctgt

SEQ ID NO: 9219208 - DNA, 22 bp, Homo sapiens
ccagtgcaccaagaggcctaga

SEQ ID NO: 9219209 - DNA, 22 bp, Homo sapiens
aggcagtttaggcagcgattta

SEQ ID NO: 9219210 - DNA, 21 bp, Homo sapiens
aggcatctaaagagagtagac

SEQ ID NO: 9219211 - DNA, 22 bp, Homo sapiens
aggcatctatacattatgttca

SEQ ID NO: 9219212 - DNA, 22 bp, Homo sapiens
aggcatctaacagagatcttta

SEQ ID NO: 9219213 - DNA, 22 bp, Homo sapiens
aggcatctgagtttgcaagctt

SEQ ID NO: 9219214 - DNA, 22 bp, Homo sapiens
aggcatgatgtgcagtggcaaa

SEQ ID NO: 9219215 - DNA, 21 bp, Homo sapiens
aggcatgagccctgcatggac

SEQ ID NO: 9219216 - DNA, 22 bp, Homo sapiens
aggcatttggctgtcatttgta

SEQ ID NO: 9219217 - DNA, 22 bp, Homo sapiens
aggcattagttgtaaagtattg

SEQ ID NO: 9219218 - DNA, 19 bp, Homo sapiens
ccactggggctccacatta

SEQ ID NO: 9219219 - DNA, 22 bp, Homo sapiens
ccactggcagttggctagcctt

SEQ ID NO: 9219220 - DNA, 22 bp, Homo sapiens
aggcagtgcagagtcctcttct

SEQ ID NO: 9219221 - DNA, 22 bp, Homo sapiens
aggcagtgctcaagacagcagc

SEQ ID NO: 9219222 - DNA, 22 bp, Homo sapiens
aggcagccctgtgctggatgct

SEQ ID NO: 9219223 - DNA, 22 bp, Homo sapiens
aggcagcctatggggagctcag

SEQ ID NO: 9219224 - DNA, 22 bp, Homo sapiens
aggcagccctgtgctggatgct

SEQ ID NO: 9219225 - DNA, 22 bp, Homo sapiens
aggcccatgttcacttgctcag

SEQ ID NO: 9219226 - DNA, 22 bp, Homo sapiens
aggcccagtgtggcttcctgga

SEQ ID NO: 9219227 - DNA, 22 bp, Homo sapiens
aggcccagttatcctacttgtt

SEQ ID NO: 9219228 - DNA, 22 bp, Homo sapiens
aggcccatgtgagtcttgtcct

SEQ ID NO: 9219229 - DNA, 22 bp, Homo sapiens
aggcccatagtagctctgggca

SEQ ID NO: 9219230 - DNA, 22 bp, Homo sapiens
aggcccagttatcctacttgtt

SEQ ID NO: 9219231 - DNA, 22 bp, Homo sapiens
aggccctgaagtcggcccctca

SEQ ID NO: 9219232 - DNA, 22 bp, Homo sapiens
aggccctgaagtcggcccctca

SEQ ID NO: 9219233 - DNA, 22 bp, Homo sapiens
aggccgaagtggatgggcatct

SEQ ID NO: 9219234 - DNA, 22 bp, Homo sapiens
aggccaggatagcatggatcag

SEQ ID NO: 9219235 - DNA, 22 bp, Homo sapiens
aggcccagctggacaaactgct

SEQ ID NO: 9219236 - DNA, 22 bp, Homo sapiens
aggccaggaatccttgtcccag

SEQ ID NO: 9219237 - DNA, 22 bp, Homo sapiens
aggccaggacacttaagtaaga

SEQ ID NO: 9219238 - DNA, 20 bp, Homo sapiens
aggccaggaaatgtagttct

SEQ ID NO: 9219239 - DNA, 20 bp, Homo sapiens
aggccaggaaatgtagttct

SEQ ID NO: 9219240 - DNA, 22 bp, Homo sapiens
aggcattttgttcaagatgaca

SEQ ID NO: 9219241 - DNA, 22 bp, Homo sapiens
aggcatttttgttaatctttgg

SEQ ID NO: 9219242 - DNA, 22 bp, Homo sapiens
aggccaaagcacagagctggaa

SEQ ID NO: 9219243 - DNA, 22 bp, Homo sapiens
aggccaagctcccagagaagct

SEQ ID NO: 9219244 - DNA, 22 bp, Homo sapiens
aggccaagattttggatcagct

SEQ ID NO: 9219245 - DNA, 22 bp, Homo sapiens
aggccaagttacttgggaaagc

SEQ ID NO: 9219246 - DNA, 22 bp, Homo sapiens
aggccaagtgctgggacaggtg

SEQ ID NO: 9219247 - DNA, 22 bp, Homo sapiens
aggccaagtgctgggacaggtg

SEQ ID NO: 9219248 - DNA, 22 bp, Homo sapiens
aggccaagtgaacaatgctagt

SEQ ID NO: 9219249 - DNA, 22 bp, Homo sapiens
aggccaagggcaaagcggagag

SEQ ID NO: 9219250 - DNA, 22 bp, Homo sapiens
aggccaagtagctagcattgaa

SEQ ID NO: 9219251 - DNA, 22 bp, Homo sapiens
aggccaagtagctagcattgaa

SEQ ID NO: 9219252 - DNA, 22 bp, Homo sapiens
aggccaagtagccgctgtccta

SEQ ID NO: 9219253 - DNA, 23 bp, Homo sapiens
aggccagcgcagacaccgagcac

SEQ ID NO: 9219254 - DNA, 22 bp, Homo sapiens
aggccacaaccaccctgtgccc

SEQ ID NO: 9219255 - DNA, 22 bp, Homo sapiens
aggccacaagaaaatgcttcat

SEQ ID NO: 9219256 - DNA, 22 bp, Homo sapiens
agggcagagggtgcctcacctg

SEQ ID NO: 9219257 - DNA, 22 bp, Homo sapiens
agggaggagaatggactccttc

SEQ ID NO: 9219258 - DNA, 22 bp, Homo sapiens
agggaggagaatggactccttc

SEQ ID NO: 9219259 - DNA, 22 bp, Homo sapiens
agggaggagaatggactccttc

SEQ ID NO: 9219260 - DNA, 22 bp, Homo sapiens
agggaggaaggatgttccaaag

SEQ ID NO: 9219261 - DNA, 22 bp, Homo sapiens
agggaggaaggatgttccaaag

SEQ ID NO: 9219262 - DNA, 22 bp, Homo sapiens
agggaggaccaatgtgtggtta

SEQ ID NO: 9219263 - DNA, 22 bp, Homo sapiens
agggccagggaaacgatcagca

SEQ ID NO: 9219264 - DNA, 22 bp, Homo sapiens
ccctggcccctcactccgaggc

SEQ ID NO: 9219265 - DNA, 22 bp, Homo sapiens
agggccagggaagctgtatttt

SEQ ID NO: 9219266 - DNA, 22 bp, Homo sapiens
ccctggggagcaggcgaaggag

SEQ ID NO: 9219267 - DNA, 22 bp, Homo sapiens
agggccagccgacttccagcct

SEQ ID NO: 9219268 - DNA, 19 bp, Homo sapiens
agggccaggattctggaac

SEQ ID NO: 9219269 - DNA, 23 bp, Homo sapiens
cctcccaggctgcgagtcccgag

SEQ ID NO: 9219270 - DNA, 22 bp, Homo sapiens
cctccaggctgaatatctagaa

SEQ ID NO: 9219271 - DNA, 20 bp, Homo sapiens
cctccaggcacacccatgtg

SEQ ID NO: 9219272 - DNA, 20 bp, Homo sapiens
cctccaggcacacccatgtg

SEQ ID NO: 9219273 - DNA, 22 bp, Homo sapiens
cctccaggaacttgagagacac

SEQ ID NO: 9219274 - DNA, 22 bp, Homo sapiens
cctccagctgcctcagtctctt

SEQ ID NO: 9219275 - DNA, 22 bp, Homo sapiens
cctccaggaggaaatggaacac

SEQ ID NO: 9219276 - DNA, 22 bp, Homo sapiens
cctccaggaggaaatggaacac

SEQ ID NO: 9219277 - DNA, 21 bp, Homo sapiens
cctccaggagcagagccctga

SEQ ID NO: 9219278 - DNA, 21 bp, Homo sapiens
cctccaggagcagagccctga

SEQ ID NO: 9219279 - DNA, 22 bp, Homo sapiens
cctccccacccacggctggtgg

SEQ ID NO: 9219280 - DNA, 22 bp, Homo sapiens
cctctctccaattttcacctca

SEQ ID NO: 9219281 - DNA, 23 bp, Homo sapiens
cctccccaccagactctaacata

SEQ ID NO: 9219282 - DNA, 22 bp, Homo sapiens
cctccccacagcccaggagact

SEQ ID NO: 9219283 - DNA, 22 bp, Homo sapiens
cctcccagtgcctccagagcag

SEQ ID NO: 9219284 - DNA, 22 bp, Homo sapiens
cctcagagcagcacccagatga

SEQ ID NO: 9219285 - DNA, 23 bp, Homo sapiens
cctcagagaggcagagccacatg

SEQ ID NO: 9219286 - DNA, 22 bp, Homo sapiens
cctcagactcagtgcgttgtga

SEQ ID NO: 9219287 - DNA, 22 bp, Homo sapiens
cctcagacccctgctgagcttc

SEQ ID NO: 9219288 - DNA, 22 bp, Homo sapiens
cctcagacgcaggcctatgggc

SEQ ID NO: 9219289 - DNA, 22 bp, Homo sapiens
cctcaagaacaatccaccatta

SEQ ID NO: 9219290 - DNA, 18 bp, Homo sapiens
cctcacagacttccatgt

SEQ ID NO: 9219291 - DNA, 18 bp, Homo sapiens
cctcacagacttccatgt

SEQ ID NO: 9219292 - DNA, 20 bp, Homo sapiens
cctcaagcagactgacagct

SEQ ID NO: 9219293 - DNA, 21 bp, Homo sapiens
cctcaagtgcctcctgctgct

SEQ ID NO: 9219294 - DNA, 22 bp, Homo sapiens
cctcaaagcggtatgcagacgg

SEQ ID NO: 9219295 - DNA, 22 bp, Homo sapiens
cctcaaagtagagggagatgag

SEQ ID NO: 9219296 - DNA, 22 bp, Homo sapiens
cctcaaaggcctggcaccagaa

SEQ ID NO: 9219297 - DNA, 22 bp, Homo sapiens
cccttcaagctctctgggtttt

SEQ ID NO: 9219298 - DNA, 22 bp, Homo sapiens
cccttcagctgagtgggacagc

SEQ ID NO: 9219299 - DNA, 22 bp, Homo sapiens
ccctggggctgagggatggccg

SEQ ID NO: 9219300 - DNA, 19 bp, Homo sapiens
ccctgggggtttctggtac

SEQ ID NO: 9219301 - DNA, 22 bp, Homo sapiens
cccagcctgatctcggccagct

SEQ ID NO: 9219302 - DNA, 22 bp, Homo sapiens
cccagcctgatctcggccagct

SEQ ID NO: 9219303 - DNA, 22 bp, Homo sapiens
cccagcctctgtttgctcctct

SEQ ID NO: 9219304 - DNA, 22 bp, Homo sapiens
cccagcctctgtttgctcctct

SEQ ID NO: 9219305 - DNA, 22 bp, Homo sapiens
cccagcctctgggctcacccaa

SEQ ID NO: 9219306 - DNA, 22 bp, Homo sapiens
cccagcctctgggttctgccgg

SEQ ID NO: 9219307 - DNA, 18 bp, Homo sapiens
cccagcctctcctttcta

SEQ ID NO: 9219308 - DNA, 22 bp, Homo sapiens
cccagcctctggattctgccct

SEQ ID NO: 9219309 - DNA, 22 bp, Homo sapiens
cccagctctctcagttctgctt

SEQ ID NO: 9219310 - DNA, 22 bp, Homo sapiens
cccagctctgcagacctgccct

SEQ ID NO: 9219311 - DNA, 22 bp, Homo sapiens
cccagctctgccatctacccac

SEQ ID NO: 9219312 - DNA, 22 bp, Homo sapiens
ccagtttttccagtgctttctg

SEQ ID NO: 9219313 - DNA, 22 bp, Homo sapiens
ccatgaattcactccatgctag

SEQ ID NO: 9219314 - DNA, 22 bp, Homo sapiens
ccatgaattcactccatgctag

SEQ ID NO: 9219315 - DNA, 22 bp, Homo sapiens
cccagcagtaaccagtggaaat

SEQ ID NO: 9219316 - DNA, 22 bp, Homo sapiens
cccagcactcagcaggctcata

SEQ ID NO: 9219317 - DNA, 22 bp, Homo sapiens
cccagcagtgacccagtgatac

SEQ ID NO: 9219318 - DNA, 22 bp, Homo sapiens
cccagcagtacccaagcccttg

SEQ ID NO: 9219319 - DNA, 22 bp, Homo sapiens
cccagcatcctcagggagcggg

SEQ ID NO: 9219320 - DNA, 22 bp, Homo sapiens
cccagcctcagctttacttcca

SEQ ID NO: 9219321 - DNA, 22 bp, Homo sapiens
cccagcatcccagtgggcagca

SEQ ID NO: 9219322 - DNA, 22 bp, Homo sapiens
cccagcatcccagtgggcagca

SEQ ID NO: 9219323 - DNA, 22 bp, Homo sapiens
cccagcagttgttggtgcacat

SEQ ID NO: 9219324 - DNA, 22 bp, Homo sapiens
agggagaggttgaaacctcagt

SEQ ID NO: 9219325 - DNA, 22 bp, Homo sapiens
ccccagggactggtttcatgga

SEQ ID NO: 9219326 - DNA, 22 bp, Homo sapiens
ccccagggaagctttgcttact

SEQ ID NO: 9219327 - DNA, 22 bp, Homo sapiens
ccccagggactggtttcatgga

SEQ ID NO: 9219328 - DNA, 22 bp, Homo sapiens
ccccagggtcagtgtgtggagg

SEQ ID NO: 9219329 - DNA, 22 bp, Homo sapiens
ccccaggtggatggctcgcata

SEQ ID NO: 9219330 - DNA, 22 bp, Homo sapiens
ccccagggtcagtgtgtggagg

SEQ ID NO: 9219331 - DNA, 19 bp, Homo sapiens
ccccagggtaggctagggg

SEQ ID NO: 9219332 - DNA, 19 bp, Homo sapiens
ccccagggtaggctagggg

SEQ ID NO: 9219333 - DNA, 22 bp, Homo sapiens
agggaggaaggaactccttcta

SEQ ID NO: 9219334 - DNA, 22 bp, Homo sapiens
agggaggaaggaactccttcta

SEQ ID NO: 9219335 - DNA, 22 bp, Homo sapiens
agggaggaaggaactccttcta

SEQ ID NO: 9219336 - DNA, 22 bp, Homo sapiens
ccccaggtggatggctcgcata

SEQ ID NO: 9219337 - DNA, 22 bp, Homo sapiens
ccccagtggaggtgagggtcct

SEQ ID NO: 9219338 - DNA, 22 bp, Homo sapiens
ccccatgaagtagggtctctga

SEQ ID NO: 9219339 - DNA, 22 bp, Homo sapiens
ccccatgaagtagggtctctga

SEQ ID NO: 9219340 - DNA, 21 bp, Homo sapiens
agggagcatgttagctttcga

SEQ ID NO: 9219341 - DNA, 22 bp, Homo sapiens
agggagcatgggtgaagcaggc

SEQ ID NO: 9219342 - DNA, 22 bp, Homo sapiens
agggagccagagttgggagctc

SEQ ID NO: 9219343 - DNA, 18 bp, Homo sapiens
agggagcatctggttgcc

SEQ ID NO: 9219344 - DNA, 22 bp, Homo sapiens
agggagcagggctcctttgggt

SEQ ID NO: 9219345 - DNA, 22 bp, Homo sapiens
agggagcagcagccacaggatg

SEQ ID NO: 9219346 - DNA, 22 bp, Homo sapiens
agggagcagcagccacaggatg

SEQ ID NO: 9219347 - DNA, 23 bp, Homo sapiens
agggagatgccacaaagatgccc

SEQ ID NO: 9219348 - DNA, 22 bp, Homo sapiens
agggagagtttgatgtttcctc

SEQ ID NO: 9219349 - DNA, 22 bp, Homo sapiens
aggaaagatggaaggaggataa

SEQ ID NO: 9219350 - DNA, 22 bp, Homo sapiens
aggaaagactggggccccagaa

SEQ ID NO: 9219351 - DNA, 22 bp, Homo sapiens
aggaaagactggggccccagaa

SEQ ID NO: 9219352 - DNA, 21 bp, Homo sapiens
aggaaaggaagtccccagggt

SEQ ID NO: 9219353 - DNA, 20 bp, Homo sapiens
aggaaagcctgtgtgagtct

SEQ ID NO: 9219354 - DNA, 22 bp, Homo sapiens
aggaaagctcccagtagggctc

SEQ ID NO: 9219355 - DNA, 22 bp, Homo sapiens
aggaaagactggggccccagaa

SEQ ID NO: 9219356 - DNA, 22 bp, Homo sapiens
aggaaagaagtacattctcatg

SEQ ID NO: 9219357 - DNA, 21 bp, Homo sapiens
agcttgtgtgtatcacagtgt

SEQ ID NO: 9219358 - DNA, 21 bp, Homo sapiens
agcttgtgtgtatcacagtgt

SEQ ID NO: 9219359 - DNA, 22 bp, Homo sapiens
aggaaataggaccagacaaagc

SEQ ID NO: 9219360 - DNA, 22 bp, Homo sapiens
aggaaataggaccagacaaagc

SEQ ID NO: 9219361 - DNA, 22 bp, Homo sapiens
aggaaatgtacaaatgaagatg

SEQ ID NO: 9219362 - DNA, 22 bp, Homo sapiens
aggaacaattgataaactcaca

SEQ ID NO: 9219363 - DNA, 22 bp, Homo sapiens
aggaacaactgattcagtcaac

SEQ ID NO: 9219364 - DNA, 22 bp, Homo sapiens
aggaactagtgcaacaggagcg

SEQ ID NO: 9219365 - DNA, 22 bp, Homo sapiens
aggaaccagaggttgagcaact

SEQ ID NO: 9219366 - DNA, 23 bp, Homo sapiens
aggaaccttagaattcactgcca

SEQ ID NO: 9219367 - DNA, 22 bp, Homo sapiens
aggaacctaagagcctgcagtc

SEQ ID NO: 9219368 - DNA, 22 bp, Homo sapiens
aggaacagaagagcaatgcagg

SEQ ID NO: 9219369 - DNA, 22 bp, Homo sapiens
aggaagctcctggagagccagt

SEQ ID NO: 9219370 - DNA, 22 bp, Homo sapiens
aggaagctcggagagggcaaat

SEQ ID NO: 9219371 - DNA, 18 bp, Homo sapiens
aggaagcaggaggaaggc

SEQ ID NO: 9219372 - DNA, 22 bp, Homo sapiens
aggaagcactggaaggggttgg

SEQ ID NO: 9219373 - DNA, 18 bp, Homo sapiens
agcttgcctcaagctttt

SEQ ID NO: 9219374 - DNA, 22 bp, Homo sapiens
agcttgagttttggatgaagtg

SEQ ID NO: 9219375 - DNA, 22 bp, Homo sapiens
agcttgcctccccctcttagga

SEQ ID NO: 9219376 - DNA, 23 bp, Homo sapiens
agcttgcttttcccagtactgca

SEQ ID NO: 9219377 - DNA, 22 bp, Homo sapiens
agcttggtgttgcctgcttgag

SEQ ID NO: 9219378 - DNA, 22 bp, Homo sapiens
agcttcttttacagctcatgct

SEQ ID NO: 9219379 - DNA, 22 bp, Homo sapiens
agcttctgttcatcttccaggc

SEQ ID NO: 9219380 - DNA, 20 bp, Homo sapiens
agctgtttacatggatttct

SEQ ID NO: 9219381 - DNA, 22 bp, Homo sapiens
agctgtttgtacttagatagta

SEQ ID NO: 9219382 - DNA, 22 bp, Homo sapiens
agctgttttcttctaggaagac

SEQ ID NO: 9219383 - DNA, 22 bp, Homo sapiens
agctggcttttgtgaaggtttt

SEQ ID NO: 9219384 - DNA, 21 bp, Homo sapiens
caggccccaggcctggggtgc

SEQ ID NO: 9219385 - DNA, 22 bp, Homo sapiens
caggcctcaggggctcaggctg

SEQ ID NO: 9219386 - DNA, 21 bp, Homo sapiens
caggccgggtgagcaggcagc

SEQ ID NO: 9219387 - DNA, 22 bp, Homo sapiens
agctgtggcagcagccgtggca

SEQ ID NO: 9219388 - DNA, 22 bp, Homo sapiens
caggcctggggctggcttccag

SEQ ID NO: 9219389 - DNA, 22 bp, Homo sapiens
caggcctggggctggcttccag

SEQ ID NO: 9219390 - DNA, 22 bp, Homo sapiens
caggcctggttgagccctgaga

SEQ ID NO: 9219391 - DNA, 22 bp, Homo sapiens
caggcctggctgcagctcgcct

SEQ ID NO: 9219392 - DNA, 22 bp, Homo sapiens
caggcctggcccccggcacacc

SEQ ID NO: 9219393 - DNA, 22 bp, Homo sapiens
caggcctggcccccggcacacc

SEQ ID NO: 9219394 - DNA, 22 bp, Homo sapiens
caggcctggctgcagctcgcct

SEQ ID NO: 9219395 - DNA, 22 bp, Homo sapiens
caggcctggctgcagctcgcct

SEQ ID NO: 9219396 - DNA, 22 bp, Homo sapiens
caggcctggagtgcaatggcac

SEQ ID NO: 9219397 - DNA, 22 bp, Homo sapiens
caggcctggagtgcaatggcac

SEQ ID NO: 9219398 - DNA, 22 bp, Homo sapiens
agctggaggataactcacttct

SEQ ID NO: 9219399 - DNA, 22 bp, Homo sapiens
agctggaggataactcacttct

SEQ ID NO: 9219400 - DNA, 23 bp, Homo sapiens
agctggaggctgtctactcccaa

SEQ ID NO: 9219401 - DNA, 22 bp, Homo sapiens
agctggcatactttgctaggaa

SEQ ID NO: 9219402 - DNA, 19 bp, Homo sapiens
caggacagacttcaaagcc

SEQ ID NO: 9219403 - DNA, 22 bp, Homo sapiens
caggacagacagaatgcctaac

SEQ ID NO: 9219404 - DNA, 22 bp, Homo sapiens
caggaaaaggagactttagcac

SEQ ID NO: 9219405 - DNA, 22 bp, Homo sapiens
agctgcctggagtcatttcctg

SEQ ID NO: 9219406 - DNA, 22 bp, Homo sapiens
caggaaaaggagactttagcac

SEQ ID NO: 9219407 - DNA, 22 bp, Homo sapiens
caggaaaaatgccaggagtcag

SEQ ID NO: 9219408 - DNA, 22 bp, Homo sapiens
agctgcctggccggagccactg

SEQ ID NO: 9219409 - DNA, 22 bp, Homo sapiens
agctgctgaatgacactgcaag

SEQ ID NO: 9219410 - DNA, 22 bp, Homo sapiens
agctggcattacaggagcatgc

SEQ ID NO: 9219411 - DNA, 22 bp, Homo sapiens
agctggcatctgaagtcagggc

SEQ ID NO: 9219412 - DNA, 22 bp, Homo sapiens
agctggccagcacctccaggtc

SEQ ID NO: 9219413 - DNA, 22 bp, Homo sapiens
agctggcattgcagggagctgc

SEQ ID NO: 9219414 - DNA, 22 bp, Homo sapiens
agctggctttgagctgggaggt

SEQ ID NO: 9219415 - DNA, 22 bp, Homo sapiens
agctggctttgagctgggaggt

SEQ ID NO: 9219416 - DNA, 22 bp, Homo sapiens
agctggctttatggttggctaa

SEQ ID NO: 9219417 - DNA, 22 bp, Homo sapiens
agctggcttgcatgctaaggag

SEQ ID NO: 9219418 - DNA, 22 bp, Homo sapiens
agctggcttctctgcagacatt

SEQ ID NO: 9219419 - DNA, 22 bp, Homo sapiens
agctggcttgcatgctaaggag

SEQ ID NO: 9219420 - DNA, 22 bp, Homo sapiens
agctggcttctctgcagacatt

SEQ ID NO: 9219421 - DNA, 22 bp, Homo sapiens
agctggcttctctgcagacatt

SEQ ID NO: 9219422 - DNA, 22 bp, Homo sapiens
agctggcttcacaggcagtgtg

SEQ ID NO: 9219423 - DNA, 22 bp, Homo sapiens
agctggctgggtgccagtctcc

SEQ ID NO: 9219424 - DNA, 22 bp, Homo sapiens
agctggctgccttctccttagg

SEQ ID NO: 9219425 - DNA, 22 bp, Homo sapiens
agctggctgccttctccttagg

SEQ ID NO: 9219426 - DNA, 22 bp, Homo sapiens
agctggctggccccttcctgcc

SEQ ID NO: 9219427 - DNA, 22 bp, Homo sapiens
agctggctggccccttcctgcc

SEQ ID NO: 9219428 - DNA, 22 bp, Homo sapiens
cagctctccaccctcctggttc

SEQ ID NO: 9219429 - DNA, 22 bp, Homo sapiens
cagctctcacaccctcctccca

SEQ ID NO: 9219430 - DNA, 22 bp, Homo sapiens
cagctctgaagaaaggtgtcta

SEQ ID NO: 9219431 - DNA, 22 bp, Homo sapiens
cagctgttgtctctcacatatt

SEQ ID NO: 9219432 - DNA, 22 bp, Homo sapiens
cagctctgacacagtacaaaat

SEQ ID NO: 9219433 - DNA, 22 bp, Homo sapiens
cagctctgaagaaaggtgtcta

SEQ ID NO: 9219434 - DNA, 22 bp, Homo sapiens
cagcttctgtttctagcccctg

SEQ ID NO: 9219435 - DNA, 22 bp, Homo sapiens
cagcttcttacgagctggtact

SEQ ID NO: 9219436 - DNA, 22 bp, Homo sapiens
cagcttcttcagtcctggagct

SEQ ID NO: 9219437 - DNA, 22 bp, Homo sapiens
cagcttctgctcatggaggggt

SEQ ID NO: 9219438 - DNA, 22 bp, Homo sapiens
cagcttctgtttattgtgtgcc

SEQ ID NO: 9219439 - DNA, 22 bp, Homo sapiens
cagctcctgggccatctcctag

SEQ ID NO: 9219440 - DNA, 22 bp, Homo sapiens
agctctggaactcccggctgct

SEQ ID NO: 9219441 - DNA, 22 bp, Homo sapiens
agctctggaagccctggtagtt

SEQ ID NO: 9219442 - DNA, 22 bp, Homo sapiens
agctctgcttcttgggaagatg

SEQ ID NO: 9219443 - DNA, 22 bp, Homo sapiens
agctctgctactctgtggggtg

SEQ ID NO: 9219444 - DNA, 22 bp, Homo sapiens
agctctgcagcccagcaggtgg

SEQ ID NO: 9219445 - DNA, 22 bp, Homo sapiens
agctctgccgcctttcaggctg

SEQ ID NO: 9219446 - DNA, 22 bp, Homo sapiens
agctctgcaggcacagctgagg

SEQ ID NO: 9219447 - DNA, 22 bp, Homo sapiens
agctctgcctaggttccacgat

SEQ ID NO: 9219448 - DNA, 22 bp, Homo sapiens
agctctcccatagggcaagatc

SEQ ID NO: 9219449 - DNA, 22 bp, Homo sapiens
agctctctgataaattgataaa

SEQ ID NO: 9219450 - DNA, 22 bp, Homo sapiens
cagcttgaaatattaggagatg

SEQ ID NO: 9219451 - DNA, 22 bp, Homo sapiens
agctgaggccacgagtgaaggg

SEQ ID NO: 9219452 - DNA, 21 bp, Homo sapiens
agctgcaggcctcccagggat

SEQ ID NO: 9219453 - DNA, 22 bp, Homo sapiens
agctgcaggcctctcctgggga

SEQ ID NO: 9219454 - DNA, 21 bp, Homo sapiens
agctgcagcccaaaggcctgt

SEQ ID NO: 9219455 - DNA, 22 bp, Homo sapiens
agctgcaggcccatgctcagtc

SEQ ID NO: 9219456 - DNA, 22 bp, Homo sapiens
agctgcagtaaagctctccagg

SEQ ID NO: 9219457 - DNA, 22 bp, Homo sapiens
agctgcagtaaagctctccagg

SEQ ID NO: 9219458 - DNA, 22 bp, Homo sapiens
agctgcaggcgccggggccgat

SEQ ID NO: 9219459 - DNA, 22 bp, Homo sapiens
agctgcagtatgaggctggtgg

SEQ ID NO: 9219460 - DNA, 21 bp, Homo sapiens
agctgcagtcaagccagaggt

SEQ ID NO: 9219461 - DNA, 22 bp, Homo sapiens
cagctttgtgcaatgcagtctc

SEQ ID NO: 9219462 - DNA, 22 bp, Homo sapiens
cagctttgtggccttgacctcg

SEQ ID NO: 9219463 - DNA, 22 bp, Homo sapiens
cagctttgtgacttcggacaag

SEQ ID NO: 9219464 - DNA, 22 bp, Homo sapiens
cagctttgtctgattcctcttt

SEQ ID NO: 9219465 - DNA, 21 bp, Homo sapiens
cagctttgtctgtcttcgggg

SEQ ID NO: 9219466 - DNA, 22 bp, Homo sapiens
caggaaaaatgccaggagtcag

SEQ ID NO: 9219467 - DNA, 22 bp, Homo sapiens
cagctttgattctttctgccat

SEQ ID NO: 9219468 - DNA, 22 bp, Homo sapiens
cagctttgcaggctggtcagtg

SEQ ID NO: 9219469 - DNA, 22 bp, Homo sapiens
cagctttgccaagtaaggtctt

SEQ ID NO: 9219470 - DNA, 22 bp, Homo sapiens
cagctttgccctttgcccaatc

SEQ ID NO: 9219471 - DNA, 22 bp, Homo sapiens
cagctttggagtgtgagtgctg

SEQ ID NO: 9219472 - DNA, 22 bp, Homo sapiens
cagctttggcccagtcgggagg

SEQ ID NO: 9219473 - DNA, 22 bp, Homo sapiens
cagctttgtcatttgatttggg

SEQ ID NO: 9219474 - DNA, 22 bp, Homo sapiens
cagctttgtcctgcaaacctga

SEQ ID NO: 9219475 - DNA, 16 bp, Homo sapiens
cagctttgtctcctcg

SEQ ID NO: 9219476 - DNA, 22 bp, Homo sapiens
cagtctctgtgccagatcctgg

SEQ ID NO: 9219477 - DNA, 22 bp, Homo sapiens
cagtctctggtgagttgacagt

SEQ ID NO: 9219478 - DNA, 22 bp, Homo sapiens
cagtctctctccttgcaggcgt

SEQ ID NO: 9219479 - DNA, 22 bp, Homo sapiens
cagtctctcttgtagtgcagct

SEQ ID NO: 9219480 - DNA, 23 bp, Homo sapiens
aggagaagagatttccacatgca

SEQ ID NO: 9219481 - DNA, 23 bp, Homo sapiens
aggagaagagatttccacatgca

SEQ ID NO: 9219482 - DNA, 22 bp, Homo sapiens
aggacagcccccaacagcaaca

SEQ ID NO: 9219483 - DNA, 22 bp, Homo sapiens
aggacagcagttggtgaggttc

SEQ ID NO: 9219484 - DNA, 22 bp, Homo sapiens
aggacagcccttgagagcacat

SEQ ID NO: 9219485 - DNA, 22 bp, Homo sapiens
aggagaaagactggacagccaa

SEQ ID NO: 9219486 - DNA, 20 bp, Homo sapiens
aggaaggaagtttgcatgga

SEQ ID NO: 9219487 - DNA, 19 bp, Homo sapiens
aggaaggaacctgagtctg

SEQ ID NO: 9219488 - DNA, 22 bp, Homo sapiens
aggacagcagccattggcagtc

SEQ ID NO: 9219489 - DNA, 22 bp, Homo sapiens
cagtcctgggcacagccctggg

SEQ ID NO: 9219490 - DNA, 22 bp, Homo sapiens
aggacagcagccattggcagtc

SEQ ID NO: 9219491 - DNA, 22 bp, Homo sapiens
cagtcctgctagtgtgaaaagc

SEQ ID NO: 9219492 - DNA, 22 bp, Homo sapiens
cagtcctgggagacttacccag

SEQ ID NO: 9219493 - DNA, 22 bp, Homo sapiens
cagtcctgctggccttccctgg

SEQ ID NO: 9219494 - DNA, 22 bp, Homo sapiens
cagtcctgagctcctgggctga

SEQ ID NO: 9219495 - DNA, 22 bp, Homo sapiens
aggaggaatacaatccagcagc

SEQ ID NO: 9219496 - DNA, 22 bp, Homo sapiens
aggagctgtgaatgggaggggt

SEQ ID NO: 9219497 - DNA, 22 bp, Homo sapiens
aggagctgagtcagcccgacag

SEQ ID NO: 9219498 - DNA, 20 bp, Homo sapiens
aggagctctgtgctgggaag

SEQ ID NO: 9219499 - DNA, 22 bp, Homo sapiens
aggagctctgggcagggcctcc

SEQ ID NO: 9219500 - DNA, 22 bp, Homo sapiens
aggagctctgggcagggcctcc

SEQ ID NO: 9219501 - DNA, 22 bp, Homo sapiens
aggagctctcccatgctgcaga

SEQ ID NO: 9219502 - DNA, 22 bp, Homo sapiens
aggagctcttgatgcttgaggg

SEQ ID NO: 9219503 - DNA, 22 bp, Homo sapiens
aggagagaatgttccaggcttg

SEQ ID NO: 9219504 - DNA, 22 bp, Homo sapiens
aggagagagaacacttgggtcc

SEQ ID NO: 9219505 - DNA, 22 bp, Homo sapiens
aggagaggcatcaagaaaatcg

SEQ ID NO: 9219506 - DNA, 22 bp, Homo sapiens
aggagagtaccattgggccgca

SEQ ID NO: 9219507 - DNA, 22 bp, Homo sapiens
aggagagttcacactggtcaga

SEQ ID NO: 9219508 - DNA, 22 bp, Homo sapiens
aggagagtcttgagtcactggt

SEQ ID NO: 9219509 - DNA, 22 bp, Homo sapiens
aggagccatgagcaggaggcaa

SEQ ID NO: 9219510 - DNA, 22 bp, Homo sapiens
aggagatcagcctccctgcaac

SEQ ID NO: 9219511 - DNA, 22 bp, Homo sapiens
aggagctccagcccagggaagt

SEQ ID NO: 9219512 - DNA, 21 bp, Homo sapiens
aggagctctccaaggacaaag

SEQ ID NO: 9219513 - DNA, 22 bp, Homo sapiens
aggagctcccgtgaggagacca

SEQ ID NO: 9219514 - DNA, 22 bp, Homo sapiens
aggagctcaaagatgccaggag

SEQ ID NO: 9219515 - DNA, 22 bp, Homo sapiens
aggagctcagcctgcagggagc

SEQ ID NO: 9219516 - DNA, 22 bp, Homo sapiens
aggagctcagctaagttggaga

SEQ ID NO: 9219517 - DNA, 22 bp, Homo sapiens
aggagctcatgtggctgcctgt

SEQ ID NO: 9219518 - DNA, 22 bp, Homo sapiens
aggagctaattcataagccact

SEQ ID NO: 9219519 - DNA, 22 bp, Homo sapiens
catttacataacagtaacgctg

SEQ ID NO: 9219520 - DNA, 21 bp, Homo sapiens
catttacatgacagattggtt

SEQ ID NO: 9219521 - DNA, 22 bp, Homo sapiens
catttacagtgagagtttttac

SEQ ID NO: 9219522 - DNA, 22 bp, Homo sapiens
catttacataacagtaacgctg

SEQ ID NO: 9219523 - DNA, 22 bp, Homo sapiens
catttacagcagactgatgaaa

SEQ ID NO: 9219524 - DNA, 22 bp, Homo sapiens
catttacagtgagagtttttac

SEQ ID NO: 9219525 - DNA, 21 bp, Homo sapiens
aggcagccagtcatgctccct

SEQ ID NO: 9219526 - DNA, 22 bp, Homo sapiens
aggcagccagatggcagcctgc

SEQ ID NO: 9219527 - DNA, 22 bp, Homo sapiens
aggcagccacatgagctcctga

SEQ ID NO: 9219528 - DNA, 19 bp, Homo sapiens
aggcagcattctggggctt

SEQ ID NO: 9219529 - DNA, 22 bp, Homo sapiens
catttacatttaaggttaatat

SEQ ID NO: 9219530 - DNA, 21 bp, Homo sapiens
catttacatgacagattggtt

SEQ ID NO: 9219531 - DNA, 22 bp, Homo sapiens
catttacatttaaggttaatat

SEQ ID NO: 9219532 - DNA, 22 bp, Homo sapiens
cattcaaacattaatttattca

SEQ ID NO: 9219533 - DNA, 19 bp, Homo sapiens
aggcagaggcttggctagc

SEQ ID NO: 9219534 - DNA, 22 bp, Homo sapiens
catggctcacaggatgggctag

SEQ ID NO: 9219535 - DNA, 22 bp, Homo sapiens
catggcggtcaggatgtaggtg

SEQ ID NO: 9219536 - DNA, 22 bp, Homo sapiens
catggcctgcctcctcctggtg

SEQ ID NO: 9219537 - DNA, 22 bp, Homo sapiens
catggccctcttctggagcaat

SEQ ID NO: 9219538 - DNA, 22 bp, Homo sapiens
catggccagggcagatggcagg

SEQ ID NO: 9219539 - DNA, 22 bp, Homo sapiens
cattatgttcagtagcttaaaa

SEQ ID NO: 9219540 - DNA, 22 bp, Homo sapiens
aggcacagcctcccccaactcc

SEQ ID NO: 9219541 - DNA, 22 bp, Homo sapiens
aggcacaaaagcagggtgacca

SEQ ID NO: 9219542 - DNA, 22 bp, Homo sapiens
aggcacagcctcccttcacatg

SEQ ID NO: 9219543 - DNA, 22 bp, Homo sapiens
aggcacagcctcccttcacatg

SEQ ID NO: 9219544 - DNA, 22 bp, Homo sapiens
aggcacaggaacaggaaaagag

SEQ ID NO: 9219545 - DNA, 22 bp, Homo sapiens
aggcacaggaggtggtaagaag

SEQ ID NO: 9219546 - DNA, 22 bp, Homo sapiens
aggcacaggaatgtcatccagt

SEQ ID NO: 9219547 - DNA, 22 bp, Homo sapiens
aggcacaggaatgtcatccagt

SEQ ID NO: 9219548 - DNA, 22 bp, Homo sapiens
aggcacaggcctcagcacccag

SEQ ID NO: 9219549 - DNA, 22 bp, Homo sapiens
catggccagggcagatggcagg

SEQ ID NO: 9219550 - DNA, 22 bp, Homo sapiens
catgccagggcttgctgcctgg

SEQ ID NO: 9219551 - DNA, 22 bp, Homo sapiens
catgccaggtttgagtatcttg

SEQ ID NO: 9219552 - DNA, 22 bp, Homo sapiens
catgccagggcttgctgcctgg

SEQ ID NO: 9219553 - DNA, 22 bp, Homo sapiens
catgccaggattaggacccagc

SEQ ID NO: 9219554 - DNA, 23 bp, Homo sapiens
catgccagtttgtgcaggcagat

SEQ ID NO: 9219555 - DNA, 22 bp, Homo sapiens
catgccattaacattagctagc

SEQ ID NO: 9219556 - DNA, 22 bp, Homo sapiens
catgccatttacttggaggaga

SEQ ID NO: 9219557 - DNA, 22 bp, Homo sapiens
catgccagttttgagatgcacc

SEQ ID NO: 9219558 - DNA, 20 bp, Homo sapiens
catgccatgtctactgaggc

SEQ ID NO: 9219559 - DNA, 22 bp, Homo sapiens
catgccatttcttctctttatg

SEQ ID NO: 9219560 - DNA, 22 bp, Homo sapiens
catgccatttggtggattgaga

SEQ ID NO: 9219561 - DNA, 22 bp, Homo sapiens
catgccatttttctagattgag

SEQ ID NO: 9219562 - DNA, 20 bp, Homo sapiens
catgcctgctggtatctggc

SEQ ID NO: 9219563 - DNA, 22 bp, Homo sapiens
catgcctgtaatcccagctctt

SEQ ID NO: 9219564 - DNA, 20 bp, Homo sapiens
catgcctgctggtatctggc

SEQ ID NO: 9219565 - DNA, 22 bp, Homo sapiens
catgcactttgatggagagcgt

SEQ ID NO: 9219566 - DNA, 22 bp, Homo sapiens
catgcaggaggaaaaagcagct

SEQ ID NO: 9219567 - DNA, 21 bp, Homo sapiens
catgcaggatttaacctagaa

SEQ ID NO: 9219568 - DNA, 22 bp, Homo sapiens
catgcactctttgagaaggatg

SEQ ID NO: 9219569 - DNA, 22 bp, Homo sapiens
catgcacagagcttggtcattg

SEQ ID NO: 9219570 - DNA, 22 bp, Homo sapiens
catgagtgagtatctcaagata

SEQ ID NO: 9219571 - DNA, 17 bp, Homo sapiens
catctttaaaatcctga

SEQ ID NO: 9219572 - DNA, 22 bp, Homo sapiens
catgaaatgttagaattagaca

SEQ ID NO: 9219573 - DNA, 22 bp, Homo sapiens
cagcaggatttgaaaggaagag

SEQ ID NO: 9219574 - DNA, 22 bp, Homo sapiens
cagcaggattggatacatctca

SEQ ID NO: 9219575 - DNA, 22 bp, Homo sapiens
cagcaggatatggtggagagag

SEQ ID NO: 9219576 - DNA, 22 bp, Homo sapiens
cagcaggccatgctgcttttca

SEQ ID NO: 9219577 - DNA, 22 bp, Homo sapiens
cagcaggacatggaggagtaaa

SEQ ID NO: 9219578 - DNA, 22 bp, Homo sapiens
cagcaggacatggaggagtaaa

SEQ ID NO: 9219579 - DNA, 22 bp, Homo sapiens
cagcagctacctgctcttgtgg

SEQ ID NO: 9219580 - DNA, 22 bp, Homo sapiens
cagcagctaaggcatgttcctg

SEQ ID NO: 9219581 - DNA, 22 bp, Homo sapiens
cagcagcctggagggggccacg

SEQ ID NO: 9219582 - DNA, 22 bp, Homo sapiens
cagcagcctgccttgggagctt

SEQ ID NO: 9219583 - DNA, 22 bp, Homo sapiens
gtatctttgtcttcatgttgga

SEQ ID NO: 9219584 - DNA, 22 bp, Homo sapiens
cagcagcctccactcgccccac

SEQ ID NO: 9219585 - DNA, 22 bp, Homo sapiens
gtatgcatcgactcaagtctga

SEQ ID NO: 9219586 - DNA, 22 bp, Homo sapiens
cagcagcctcttgtgcctgtgg

SEQ ID NO: 9219587 - DNA, 22 bp, Homo sapiens
cagcagagtaattctcacctct

SEQ ID NO: 9219588 - DNA, 22 bp, Homo sapiens
cagcagagctgtgtgggaaggg

SEQ ID NO: 9219589 - DNA, 22 bp, Homo sapiens
cagcagcaaatctagaagagga

SEQ ID NO: 9219590 - DNA, 22 bp, Homo sapiens
cagcagcaaatctagaagagga

SEQ ID NO: 9219591 - DNA, 22 bp, Homo sapiens
cagcagcaacaacggaagcctt

SEQ ID NO: 9219592 - DNA, 22 bp, Homo sapiens
cagcagcaacaacggaagcctt

SEQ ID NO: 9219593 - DNA, 22 bp, Homo sapiens
cagcagcaacaacggaagcctt

SEQ ID NO: 9219594 - DNA, 22 bp, Homo sapiens
gtatatgtgtgggcctgcatat

SEQ ID NO: 9219595 - DNA, 22 bp, Homo sapiens
gtatctatgatcctttatatct

SEQ ID NO: 9219596 - DNA, 22 bp, Homo sapiens
gtatcacttttgagagtgagaa

SEQ ID NO: 9219597 - DNA, 22 bp, Homo sapiens
cagcagcaaggtgagggtggag

SEQ ID NO: 9219598 - DNA, 22 bp, Homo sapiens
cagcagcaaggtgagggtggag

SEQ ID NO: 9219599 - DNA, 22 bp, Homo sapiens
cagcagcaaggtgagggtggag

SEQ ID NO: 9219600 - DNA, 22 bp, Homo sapiens
cagcagcaaggtgagggtggag

SEQ ID NO: 9219601 - DNA, 22 bp, Homo sapiens
gtaaaattctagcatctgaaag

SEQ ID NO: 9219602 - DNA, 22 bp, Homo sapiens
gtaaaattctagcatctgaaag

SEQ ID NO: 9219603 - DNA, 22 bp, Homo sapiens
gtaaaattgcaattacttttgc

SEQ ID NO: 9219604 - DNA, 22 bp, Homo sapiens
cagcaagggttatatcaaagat

SEQ ID NO: 9219605 - DNA, 22 bp, Homo sapiens
cagcaagggttatatcaaagat

SEQ ID NO: 9219606 - DNA, 22 bp, Homo sapiens
cagcaagtcatccaggatgatg

SEQ ID NO: 9219607 - DNA, 22 bp, Homo sapiens
ggttctctaactttgactggag

SEQ ID NO: 9219608 - DNA, 22 bp, Homo sapiens
ggttctcttcctcctgactgag

SEQ ID NO: 9219609 - DNA, 22 bp, Homo sapiens
ggttccagagtgggctgggaaa

SEQ ID NO: 9219610 - DNA, 22 bp, Homo sapiens
ggttccagagtatttcatttca

SEQ ID NO: 9219611 - DNA, 22 bp, Homo sapiens
ggttccagaccacgggtgttct

SEQ ID NO: 9219612 - DNA, 22 bp, Homo sapiens
ggttccaggcatggcaggatgt

SEQ ID NO: 9219613 - DNA, 22 bp, Homo sapiens
ggtgggtattgaatacaggtgt

SEQ ID NO: 9219614 - DNA, 22 bp, Homo sapiens
cagcaaggccattggatgcagt

SEQ ID NO: 9219615 - DNA, 22 bp, Homo sapiens
cagcaagggataaacaaggacg

SEQ ID NO: 9219616 - DNA, 22 bp, Homo sapiens
ggtggggtcacgacagagggaa

SEQ ID NO: 9219617 - DNA, 22 bp, Homo sapiens
ggtgggggagacttggtcaaga

SEQ ID NO: 9219618 - DNA, 22 bp, Homo sapiens
ggtgggggagacttggtcaaga

SEQ ID NO: 9219619 - DNA, 22 bp, Homo sapiens
gggtgggagtctggccctcaaa

SEQ ID NO: 9219620 - DNA, 21 bp, Homo sapiens
gggtgggaggacacagcaggc

SEQ ID NO: 9219621 - DNA, 20 bp, Homo sapiens
gggtgggagagtctgagggt

SEQ ID NO: 9219622 - DNA, 22 bp, Homo sapiens
gggtgggagaaatgagtatcta

SEQ ID NO: 9219623 - DNA, 22 bp, Homo sapiens
gggtgggactgaagtctgaggg

SEQ ID NO: 9219624 - DNA, 22 bp, Homo sapiens
gggtgggaaggctaagggattg

SEQ ID NO: 9219625 - DNA, 22 bp, Homo sapiens
gggtgggactctttggcctgag

SEQ ID NO: 9219626 - DNA, 22 bp, Homo sapiens
cagagtcaatgtccaagaagct

SEQ ID NO: 9219627 - DNA, 22 bp, Homo sapiens
gtattttactgctcaaagctct

SEQ ID NO: 9219628 - DNA, 22 bp, Homo sapiens
cagcatgcccagactgagctaa

SEQ ID NO: 9219629 - DNA, 22 bp, Homo sapiens
cagcatgcttgggggagggagc

SEQ ID NO: 9219630 - DNA, 22 bp, Homo sapiens
cagcatgcctgggctgcctgcc

SEQ ID NO: 9219631 - DNA, 22 bp, Homo sapiens
cagcatgttcttgtctcactgg

SEQ ID NO: 9219632 - DNA, 22 bp, Homo sapiens
cagcattgatcccaggctgtgg

SEQ ID NO: 9219633 - DNA, 22 bp, Homo sapiens
cagcattgatcccaggctgtgg

SEQ ID NO: 9219634 - DNA, 22 bp, Homo sapiens
cagcattttccatagaaagaag

SEQ ID NO: 9219635 - DNA, 22 bp, Homo sapiens
cagccactacaattggttccat

SEQ ID NO: 9219636 - DNA, 22 bp, Homo sapiens
cagccactctcagacagtccca

SEQ ID NO: 9219637 - DNA, 22 bp, Homo sapiens
cagccactgaactcctggctat

SEQ ID NO: 9219638 - DNA, 22 bp, Homo sapiens
cagccactgaactcctggctat

SEQ ID NO: 9219639 - DNA, 22 bp, Homo sapiens
cagccactggtgccaggctgtt

SEQ ID NO: 9219640 - DNA, 22 bp, Homo sapiens
cagccactgtggtctagctgca

SEQ ID NO: 9219641 - DNA, 22 bp, Homo sapiens
cagccactgtggtctagctgca

SEQ ID NO: 9219642 - DNA, 22 bp, Homo sapiens
cagccacttcgagcttcctgat

SEQ ID NO: 9219643 - DNA, 21 bp, Homo sapiens
cagcccagagcagtggggcca

SEQ ID NO: 9219644 - DNA, 22 bp, Homo sapiens
cagccacttgtgatgctgggga

SEQ ID NO: 9219645 - DNA, 21 bp, Homo sapiens
cagcccagcccattgacagtg

SEQ ID NO: 9219646 - DNA, 22 bp, Homo sapiens
cagcccagcagtcttagcctgc

SEQ ID NO: 9219647 - DNA, 22 bp, Homo sapiens
cagcccagcactaagtagattt

SEQ ID NO: 9219648 - DNA, 22 bp, Homo sapiens
cagcccagagccagttcccgct

SEQ ID NO: 9219649 - DNA, 22 bp, Homo sapiens
cagagccagctgtccttggcat

SEQ ID NO: 9219650 - DNA, 22 bp, Homo sapiens
gggcacagagaaggttttagtg

SEQ ID NO: 9219651 - DNA, 22 bp, Homo sapiens
gggcacagaagtctaagacatc

SEQ ID NO: 9219652 - DNA, 22 bp, Homo sapiens
gggcacagagggtcttgaagaa

SEQ ID NO: 9219653 - DNA, 22 bp, Homo sapiens
gggcacagagggtcttgaagaa

SEQ ID NO: 9219654 - DNA, 22 bp, Homo sapiens
cagagccctgcatgctccatct

SEQ ID NO: 9219655 - DNA, 22 bp, Homo sapiens
cagagccctagtcctgatggcc

SEQ ID NO: 9219656 - DNA, 22 bp, Homo sapiens
cagagcccctcgtctccaccac

SEQ ID NO: 9219657 - DNA, 22 bp, Homo sapiens
cagagcccctgggttgggagct

SEQ ID NO: 9219658 - DNA, 22 bp, Homo sapiens
cagagcccctcagctctctccc

SEQ ID NO: 9219659 - DNA, 22 bp, Homo sapiens
cagagcccttcctcccacgggg

SEQ ID NO: 9219660 - DNA, 22 bp, Homo sapiens
gggcgagggcgaaagcgagagc

SEQ ID NO: 9219661 - DNA, 21 bp, Homo sapiens
gggcgaggcctgatgtggctc

SEQ ID NO: 9219662 - DNA, 22 bp, Homo sapiens
ggggaaagccagccctgcttcc

SEQ ID NO: 9219663 - DNA, 23 bp, Homo sapiens
ggggaaagaccatgcttgaggac

SEQ ID NO: 9219664 - DNA, 22 bp, Homo sapiens
ggggaaaggccatggcaagaac

SEQ ID NO: 9219665 - DNA, 22 bp, Homo sapiens
cagagctgcgctttttcctggt

SEQ ID NO: 9219666 - DNA, 22 bp, Homo sapiens
cagagctgcagattgaaggcat

SEQ ID NO: 9219667 - DNA, 19 bp, Homo sapiens
cagagctgctggcctcgtc

SEQ ID NO: 9219668 - DNA, 22 bp, Homo sapiens
gggcgcatcacctgaggtcagg

SEQ ID NO: 9219669 - DNA, 22 bp, Homo sapiens
cagagcctgctgccttctgaag

SEQ ID NO: 9219670 - DNA, 22 bp, Homo sapiens
cagagctgacccaaggattgaa

SEQ ID NO: 9219671 - DNA, 22 bp, Homo sapiens
cagagctgcaaatgcccctccg

SEQ ID NO: 9219672 - DNA, 22 bp, Homo sapiens
cagagctgattggatccagaga

SEQ ID NO: 9219673 - DNA, 22 bp, Homo sapiens
cagagctgagtcttcaaggttg

SEQ ID NO: 9219674 - DNA, 23 bp, Homo sapiens
cagaggtgtcagtgcccagtgtc

SEQ ID NO: 9219675 - DNA, 22 bp, Homo sapiens
cagaggtgtacagagggaggcc

SEQ ID NO: 9219676 - DNA, 22 bp, Homo sapiens
cagaggtgtacagagggaggcc

SEQ ID NO: 9219677 - DNA, 22 bp, Homo sapiens
cagaggtgtacagagggaggcc

SEQ ID NO: 9219678 - DNA, 21 bp, Homo sapiens
cagaggtggcctgacctctga

SEQ ID NO: 9219679 - DNA, 22 bp, Homo sapiens
cagaggctgggacctcaggcat

SEQ ID NO: 9219680 - DNA, 22 bp, Homo sapiens
cagaggcttcaagtcattctcc

SEQ ID NO: 9219681 - DNA, 22 bp, Homo sapiens
cagaggctgtgtaggcagactg

SEQ ID NO: 9219682 - DNA, 22 bp, Homo sapiens
gggtgccacagagcttccactt

SEQ ID NO: 9219683 - DNA, 22 bp, Homo sapiens
gggtgccacagagcttccactt

SEQ ID NO: 9219684 - DNA, 22 bp, Homo sapiens
gggtgcagtggttcacgcctgt

SEQ ID NO: 9219685 - DNA, 22 bp, Homo sapiens
cagagctggtgttacaagtcca

SEQ ID NO: 9219686 - DNA, 20 bp, Homo sapiens
cagaggcattttcagactct

SEQ ID NO: 9219687 - DNA, 22 bp, Homo sapiens
cagaggccacctgtggccactg

SEQ ID NO: 9219688 - DNA, 22 bp, Homo sapiens
cagagctgtcatttgccagtga

SEQ ID NO: 9219689 - DNA, 22 bp, Homo sapiens
cagaggcaggataagaactgcg

SEQ ID NO: 9219690 - DNA, 22 bp, Homo sapiens
cagagctggtgtgtcctggcat

SEQ ID NO: 9219691 - DNA, 22 bp, Homo sapiens
cagagctggtgtgtcctggcat

SEQ ID NO: 9219692 - DNA, 20 bp, Homo sapiens
ggggaagaaaaggatgtgat

SEQ ID NO: 9219693 - DNA, 22 bp, Homo sapiens
ggggaagaatgctctctagaga

SEQ ID NO: 9219694 - DNA, 22 bp, Homo sapiens
ggggaagaaccgggattcccat

SEQ ID NO: 9219695 - DNA, 22 bp, Homo sapiens
ggggaagaaatctgggttcttc

SEQ ID NO: 9219696 - DNA, 22 bp, Homo sapiens
cagaggcctcacttccagccag

SEQ ID NO: 9219697 - DNA, 22 bp, Homo sapiens
cagaggcctatccagtgtccat

SEQ ID NO: 9219698 - DNA, 22 bp, Homo sapiens
cagaggcccagtgagagggctg

SEQ ID NO: 9219699 - DNA, 21 bp, Homo sapiens
cagaggcctatcacagactcc

SEQ ID NO: 9219700 - DNA, 22 bp, Homo sapiens
cagaggccagggggctcacaaa

SEQ ID NO: 9219701 - DNA, 22 bp, Homo sapiens
cagaggccaggctgcctgactg

SEQ ID NO: 9219702 - DNA, 22 bp, Homo sapiens
cagaggccaggctgcctgactg

SEQ ID NO: 9219703 - DNA, 19 bp, Homo sapiens
cagaggccagaagcacagg

SEQ ID NO: 9219704 - DNA, 22 bp, Homo sapiens
cagaggccacctgtggccactg

SEQ ID NO: 9219705 - DNA, 22 bp, Homo sapiens
cagaggccacctgtggccactg

SEQ ID NO: 9219706 - DNA, 22 bp, Homo sapiens
gggaggtgaaaggtcatgtgtg

SEQ ID NO: 9219707 - DNA, 22 bp, Homo sapiens
gggcacaccttgtctgagcaca

SEQ ID NO: 9219708 - DNA, 22 bp, Homo sapiens
gggcaaggcagaagagttggag

SEQ ID NO: 9219709 - DNA, 22 bp, Homo sapiens
cagaagtggcatcattcaagag

SEQ ID NO: 9219710 - DNA, 22 bp, Homo sapiens
cagaagtgcaatttaaattagg

SEQ ID NO: 9219711 - DNA, 22 bp, Homo sapiens
cagaagtgatgttgagctagtc

SEQ ID NO: 9219712 - DNA, 22 bp, Homo sapiens
cagaagtgatgttgagctagtc

SEQ ID NO: 9219713 - DNA, 22 bp, Homo sapiens
gggagcaggagcctgcctgcca

SEQ ID NO: 9219714 - DNA, 22 bp, Homo sapiens
gggagcaggagcctgcctgcca

SEQ ID NO: 9219715 - DNA, 22 bp, Homo sapiens
gggagcaggacataatagcaat

SEQ ID NO: 9219716 - DNA, 19 bp, Homo sapiens
gggagcaggaaagctgtgg

SEQ ID NO: 9219717 - DNA, 19 bp, Homo sapiens
gggagcaggaaagctgtgg

SEQ ID NO: 9219718 - DNA, 22 bp, Homo sapiens
gggagcagcctgcctcccacct

SEQ ID NO: 9219719 - DNA, 22 bp, Homo sapiens
gggaaagaccctgagtcttatt

SEQ ID NO: 9219720 - DNA, 22 bp, Homo sapiens
gggaaagaccttcctggggtgt

SEQ ID NO: 9219721 - DNA, 22 bp, Homo sapiens
gggaaagagtgcttgtccagag

SEQ ID NO: 9219722 - DNA, 22 bp, Homo sapiens
gggaaagaagaagagccatttt

SEQ ID NO: 9219723 - DNA, 22 bp, Homo sapiens
cagaagtcaccctcagaataac

SEQ ID NO: 9219724 - DNA, 22 bp, Homo sapiens
cagaagtctttctgtttcacct

SEQ ID NO: 9219725 - DNA, 22 bp, Homo sapiens
cagaaggtttgaaagatgtctt

SEQ ID NO: 9219726 - DNA, 22 bp, Homo sapiens
cagaagggcagcactgggaagg

SEQ ID NO: 9219727 - DNA, 22 bp, Homo sapiens
cagaagggcagcactgggaagg

SEQ ID NO: 9219728 - DNA, 22 bp, Homo sapiens
cactgggacctaggactgagct

SEQ ID NO: 9219729 - DNA, 22 bp, Homo sapiens
cactgggaatctgggaaagaga

SEQ ID NO: 9219730 - DNA, 22 bp, Homo sapiens
gggacaatggaggcctctctcc

SEQ ID NO: 9219731 - DNA, 22 bp, Homo sapiens
gggacacagagaaactggagaa

SEQ ID NO: 9219732 - DNA, 22 bp, Homo sapiens
gggaaggaggtggcttgaagtg

SEQ ID NO: 9219733 - DNA, 22 bp, Homo sapiens
gggaaggaggtggacctgcccc

SEQ ID NO: 9219734 - DNA, 22 bp, Homo sapiens
gggaaggaaagttattagcaga

SEQ ID NO: 9219735 - DNA, 22 bp, Homo sapiens
gggaaggacacagccatgactg

SEQ ID NO: 9219736 - DNA, 23 bp, Homo sapiens
gggaagctccatggaggtgctgg

SEQ ID NO: 9219737 - DNA, 22 bp, Homo sapiens
caagaggcaaattgtctagaag

SEQ ID NO: 9219738 - DNA, 22 bp, Homo sapiens
caagaggctaaactgggctatt

SEQ ID NO: 9219739 - DNA, 22 bp, Homo sapiens
caagagctttagaaatgctcat

SEQ ID NO: 9219740 - DNA, 22 bp, Homo sapiens
caagaggagcaggcaggtgtgc

SEQ ID NO: 9219741 - DNA, 22 bp, Homo sapiens
caagatgaaactacagggagga

SEQ ID NO: 9219742 - DNA, 22 bp, Homo sapiens
caagatgatccctgaaggcagc

SEQ ID NO: 9219743 - DNA, 22 bp, Homo sapiens
caagatgacaaggctggaggct

SEQ ID NO: 9219744 - DNA, 22 bp, Homo sapiens
caaggacactgatgttcatcct

SEQ ID NO: 9219745 - DNA, 22 bp, Homo sapiens
caaggacagcgtcaggtgcaac

SEQ ID NO: 9219746 - DNA, 22 bp, Homo sapiens
caaggacactgagctttgtaaa

SEQ ID NO: 9219747 - DNA, 22 bp, Homo sapiens
caagatgtggtgggctgagttt

SEQ ID NO: 9219748 - DNA, 22 bp, Homo sapiens
caagatgtggtgggctgagttt

SEQ ID NO: 9219749 - DNA, 22 bp, Homo sapiens
caagatgcccctggtagggatc

SEQ ID NO: 9219750 - DNA, 22 bp, Homo sapiens
gctgccttgccaggggcagaaa

SEQ ID NO: 9219751 - DNA, 20 bp, Homo sapiens
gctgccttgtcctgcttggt

SEQ ID NO: 9219752 - DNA, 20 bp, Homo sapiens
gctgccttgtcctgcttggt

SEQ ID NO: 9219753 - DNA, 22 bp, Homo sapiens
gctgccttcccaggcctttgct

SEQ ID NO: 9219754 - DNA, 22 bp, Homo sapiens
gctgccttcccggaatgtcatc

SEQ ID NO: 9219755 - DNA, 22 bp, Homo sapiens
gctgcctgccttgcctggagga

SEQ ID NO: 9219756 - DNA, 22 bp, Homo sapiens
gctgcctgccttgcctggagga

SEQ ID NO: 9219757 - DNA, 22 bp, Homo sapiens
gctgccttcccaggcctttgct

SEQ ID NO: 9219758 - DNA, 22 bp, Homo sapiens
gctgctggccccacatgctcca

SEQ ID NO: 9219759 - DNA, 22 bp, Homo sapiens
caagacaagatctaagcatgct

SEQ ID NO: 9219760 - DNA, 22 bp, Homo sapiens
caagagctgcaaatagcgtgac

SEQ ID NO: 9219761 - DNA, 22 bp, Homo sapiens
caagagctcaccggagagcatt

SEQ ID NO: 9219762 - DNA, 22 bp, Homo sapiens
gctgctggagctttgcagaagg

SEQ ID NO: 9219763 - DNA, 22 bp, Homo sapiens
gctgctggcactggagtgagcc

SEQ ID NO: 9219764 - DNA, 22 bp, Homo sapiens
gctgccttttgctcctcccacc

SEQ ID NO: 9219765 - DNA, 22 bp, Homo sapiens
gctgctggagagcgagactgtt

SEQ ID NO: 9219766 - DNA, 22 bp, Homo sapiens
caacattatatagccacatgcc

SEQ ID NO: 9219767 - DNA, 22 bp, Homo sapiens
caacatataatatttgagttct

SEQ ID NO: 9219768 - DNA, 22 bp, Homo sapiens
gctgcaggtttgtctagtctgg

SEQ ID NO: 9219769 - DNA, 22 bp, Homo sapiens
gctgcagtgagccaagatcgtg

SEQ ID NO: 9219770 - DNA, 19 bp, Homo sapiens
gctgcattcatggtgagtg

SEQ ID NO: 9219771 - DNA, 18 bp, Homo sapiens
gctcctggaccaggtcac

SEQ ID NO: 9219772 - DNA, 22 bp, Homo sapiens
caaagtaatttggagatatata

SEQ ID NO: 9219773 - DNA, 22 bp, Homo sapiens
caaagtacagtgcttcctggga

SEQ ID NO: 9219774 - DNA, 19 bp, Homo sapiens
caaagtacctggcacagtg

SEQ ID NO: 9219775 - DNA, 22 bp, Homo sapiens
gctcctggagagattgagaaag

SEQ ID NO: 9219776 - DNA, 22 bp, Homo sapiens
gctcctggagagattgagaaag

SEQ ID NO: 9219777 - DNA, 19 bp, Homo sapiens
gctcctggatgacctgtgg

SEQ ID NO: 9219778 - DNA, 19 bp, Homo sapiens
gctcctggatgacctgtgg

SEQ ID NO: 9219779 - DNA, 22 bp, Homo sapiens
gctgcagcagaagttctcagag

SEQ ID NO: 9219780 - DNA, 22 bp, Homo sapiens
gctgcagccaaattcattgtca

SEQ ID NO: 9219781 - DNA, 22 bp, Homo sapiens
cacacgtgtgagagctgtggca

SEQ ID NO: 9219782 - DNA, 22 bp, Homo sapiens
cacaccttaggcctgagcgctt

SEQ ID NO: 9219783 - DNA, 22 bp, Homo sapiens
cacacctgtaataccagctact

SEQ ID NO: 9219784 - DNA, 19 bp, Homo sapiens
cacacccatgcttgccaag

SEQ ID NO: 9219785 - DNA, 22 bp, Homo sapiens
cacacccaaatttctctctcag

SEQ ID NO: 9219786 - DNA, 22 bp, Homo sapiens
cacacattagagccaatgtcag

SEQ ID NO: 9219787 - DNA, 22 bp, Homo sapiens
cacaccagatggcagcgtggga

SEQ ID NO: 9219788 - DNA, 21 bp, Homo sapiens
cacaccaggcatgtcttgagc

SEQ ID NO: 9219789 - DNA, 23 bp, Homo sapiens
cacaccaggagccgtctgggcca

SEQ ID NO: 9219790 - DNA, 22 bp, Homo sapiens
cacaaaatatcaagcactttta

SEQ ID NO: 9219791 - DNA, 22 bp, Homo sapiens
cacaaaggagaatgtcagcata

SEQ ID NO: 9219792 - DNA, 22 bp, Homo sapiens
cacaaacctgccagccctgccc

SEQ ID NO: 9219793 - DNA, 22 bp, Homo sapiens
cacaaaccttctgcagcctgta

SEQ ID NO: 9219794 - DNA, 22 bp, Homo sapiens
cacaaaatatcaagcactttta

SEQ ID NO: 9219795 - DNA, 21 bp, Homo sapiens
ggaaaactttccttgtctgaa

SEQ ID NO: 9219796 - DNA, 22 bp, Homo sapiens
cacaaagtgggtggaaaactaa

SEQ ID NO: 9219797 - DNA, 22 bp, Homo sapiens
cacaagtcattttcagcaggct

SEQ ID NO: 9219798 - DNA, 22 bp, Homo sapiens
cacaagggagcttagaaaacat

SEQ ID NO: 9219799 - DNA, 22 bp, Homo sapiens
caaggcagcccgctgaaccaca

SEQ ID NO: 9219800 - DNA, 20 bp, Homo sapiens
caaggcagaccagagtgagt

SEQ ID NO: 9219801 - DNA, 22 bp, Homo sapiens
gctgtctgagaacatggtggaa

SEQ ID NO: 9219802 - DNA, 22 bp, Homo sapiens
gctgtctgcatctctagagctt

SEQ ID NO: 9219803 - DNA, 22 bp, Homo sapiens
gctgtgctgcgggaggattccg

SEQ ID NO: 9219804 - DNA, 22 bp, Homo sapiens
gcttctctggctggtctgccac

SEQ ID NO: 9219805 - DNA, 22 bp, Homo sapiens
gcttctctggctggtctgccac

SEQ ID NO: 9219806 - DNA, 22 bp, Homo sapiens
gcttctctcaggagcatcagcc

SEQ ID NO: 9219807 - DNA, 22 bp, Homo sapiens
gcttctccagaccttcatcccc

SEQ ID NO: 9219808 - DNA, 22 bp, Homo sapiens
gcttccaggtcattctcaccct

SEQ ID NO: 9219809 - DNA, 22 bp, Homo sapiens
gcttccaggggtgctttgaagg

SEQ ID NO: 9219810 - DNA, 22 bp, Homo sapiens
gcttggctcctggctcacaggt

SEQ ID NO: 9219811 - DNA, 22 bp, Homo sapiens
gcttggctctaagacacctatt

SEQ ID NO: 9219812 - DNA, 22 bp, Homo sapiens
gcttggctggaaataggttgag

SEQ ID NO: 9219813 - DNA, 22 bp, Homo sapiens
gcttgggatatgctgatgtaaa

SEQ ID NO: 9219814 - DNA, 19 bp, Homo sapiens
gcttgggagagggagctaa

SEQ ID NO: 9219815 - DNA, 22 bp, Homo sapiens
gcttgggagaggcttcctcttt

SEQ ID NO: 9219816 - DNA, 22 bp, Homo sapiens
gcttgggagagggtccccagga

SEQ ID NO: 9219817 - DNA, 22 bp, Homo sapiens
gcttgggaggcaagcattccat

SEQ ID NO: 9219818 - DNA, 22 bp, Homo sapiens
gcttggctgtgagctttgctgt

SEQ ID NO: 9219819 - DNA, 22 bp, Homo sapiens
gcttggctggagaaagttacct

SEQ ID NO: 9219820 - DNA, 22 bp, Homo sapiens
gcttgggacaggcttaggtgac

SEQ ID NO: 9219821 - DNA, 22 bp, Homo sapiens
gcttgggaagggccctgtgtac

SEQ ID NO: 9219822 - DNA, 22 bp, Homo sapiens
gcttgggaaacgtagttcctag

SEQ ID NO: 9219823 - DNA, 22 bp, Homo sapiens
gcttgggaaactggggaaacca

SEQ ID NO: 9219824 - DNA, 22 bp, Homo sapiens
gcttgggactggagaatagggt

SEQ ID NO: 9219825 - DNA, 22 bp, Homo sapiens
ggcctcctgttggctagtgtga

SEQ ID NO: 9219826 - DNA, 22 bp, Homo sapiens
ggcctcctcaccctgctcaggc

SEQ ID NO: 9219827 - DNA, 22 bp, Homo sapiens
cactgaaggctaggattagatg

SEQ ID NO: 9219828 - DNA, 22 bp, Homo sapiens
cactgaaggctgcagctcagcc

SEQ ID NO: 9219829 - DNA, 22 bp, Homo sapiens
cactgaagatgcgactagtgct

SEQ ID NO: 9219830 - DNA, 22 bp, Homo sapiens
cactgaaggaaggactactgca

SEQ ID NO: 9219831 - DNA, 22 bp, Homo sapiens
cactgcagcaccatgcagggct

SEQ ID NO: 9219832 - DNA, 23 bp, Homo sapiens
cactgcagcgtggtctggcagga

SEQ ID NO: 9219833 - DNA, 21 bp, Homo sapiens
cactgcagccttgacctgggc

SEQ ID NO: 9219834 - DNA, 22 bp, Homo sapiens
cactgcactccagcttgggtga

SEQ ID NO: 9219835 - DNA, 22 bp, Homo sapiens
ggcctctcatgtcctgggcttc

SEQ ID NO: 9219836 - DNA, 22 bp, Homo sapiens
ggcctcgcggcttctggtggct

SEQ ID NO: 9219837 - DNA, 22 bp, Homo sapiens
ggcctcgcggcttctggtggct

SEQ ID NO: 9219838 - DNA, 22 bp, Homo sapiens
ggcctcgcggcttctggtggct

SEQ ID NO: 9219839 - DNA, 22 bp, Homo sapiens
ggcctctcagggcagagaccct

SEQ ID NO: 9219840 - DNA, 22 bp, Homo sapiens
ggcctctcatgcccagagccaa

SEQ ID NO: 9219841 - DNA, 22 bp, Homo sapiens
ggcctctcatgcccagagccaa

SEQ ID NO: 9219842 - DNA, 22 bp, Homo sapiens
cactggcattagtcacgaggca

SEQ ID NO: 9219843 - DNA, 22 bp, Homo sapiens
cactggcaaatggagagaatgt

SEQ ID NO: 9219844 - DNA, 22 bp, Homo sapiens
cactggaggtcagtggagcact

SEQ ID NO: 9219845 - DNA, 21 bp, Homo sapiens
cactggaattttctgtgacat

SEQ ID NO: 9219846 - DNA, 22 bp, Homo sapiens
cactgctttttctcctcactgg

SEQ ID NO: 9219847 - DNA, 22 bp, Homo sapiens
cactggaagttcattctcagaa

SEQ ID NO: 9219848 - DNA, 22 bp, Homo sapiens
cactggaatggatagagcagag

SEQ ID NO: 9219849 - DNA, 22 bp, Homo sapiens
ggctcaagcagtctgcctgcct

SEQ ID NO: 9219850 - DNA, 22 bp, Homo sapiens
ggctagggatctagaccaggac

SEQ ID NO: 9219851 - DNA, 20 bp, Homo sapiens
cactgccagaatacactgtc

SEQ ID NO: 9219852 - DNA, 22 bp, Homo sapiens
cactgccacctgcatgccctga

SEQ ID NO: 9219853 - DNA, 22 bp, Homo sapiens
ggctagggagacagagggcatg

SEQ ID NO: 9219854 - DNA, 22 bp, Homo sapiens
ggctagggagacagagggcatg

SEQ ID NO: 9219855 - DNA, 22 bp, Homo sapiens
caccccaagttctgtccactgc

SEQ ID NO: 9219856 - DNA, 22 bp, Homo sapiens
cacccaggttggagtgcagtgg

SEQ ID NO: 9219857 - DNA, 22 bp, Homo sapiens
cacccaggttggagtgcagtgg

SEQ ID NO: 9219858 - DNA, 22 bp, Homo sapiens
cacccaggctagagtgcagtgg

SEQ ID NO: 9219859 - DNA, 22 bp, Homo sapiens
cacccaggctagagtgcagtgg

SEQ ID NO: 9219860 - DNA, 22 bp, Homo sapiens
cacccaggctggaatgcaatgg

SEQ ID NO: 9219861 - DNA, 22 bp, Homo sapiens
cactctgactggccctgcagga

SEQ ID NO: 9219862 - DNA, 22 bp, Homo sapiens
cactctgagaagtacaagctcc

SEQ ID NO: 9219863 - DNA, 22 bp, Homo sapiens
cactctgagaaacactaaacca

SEQ ID NO: 9219864 - DNA, 22 bp, Homo sapiens
caccctggctggaggtgcagtg

SEQ ID NO: 9219865 - DNA, 22 bp, Homo sapiens
caccccccaattctgccagctg

SEQ ID NO: 9219866 - DNA, 22 bp, Homo sapiens
cacccctgtggagcatggtggc

SEQ ID NO: 9219867 - DNA, 20 bp, Homo sapiens
caccctcccagcacctatgc

SEQ ID NO: 9219868 - DNA, 22 bp, Homo sapiens
ggcagtggttagaaacatgagc

SEQ ID NO: 9219869 - DNA, 22 bp, Homo sapiens
ggcagccagagggcagctggat

SEQ ID NO: 9219870 - DNA, 22 bp, Homo sapiens
ggcagctgagatcatgctgttg

SEQ ID NO: 9219871 - DNA, 22 bp, Homo sapiens
caccaggctggagtgcagtggc

SEQ ID NO: 9219872 - DNA, 22 bp, Homo sapiens
ggcagctgagcatggctacctt

SEQ ID NO: 9219873 - DNA, 22 bp, Homo sapiens
ggcagctgagcatggctacctt

SEQ ID NO: 9219874 - DNA, 22 bp, Homo sapiens
ggcagctgattagcatcaagga

SEQ ID NO: 9219875 - DNA, 22 bp, Homo sapiens
ggaggcggaagttgcagtgagc

SEQ ID NO: 9219876 - DNA, 22 bp, Homo sapiens
ggaggcggagcttgcagtgagc

SEQ ID NO: 9219877 - DNA, 22 bp, Homo sapiens
cacagcttctgagtgaggattt

SEQ ID NO: 9219878 - DNA, 22 bp, Homo sapiens
cacagcttgggctctgacaata

SEQ ID NO: 9219879 - DNA, 20 bp, Homo sapiens
cacagcttgccttttatgac

SEQ ID NO: 9219880 - DNA, 22 bp, Homo sapiens
ggaggccaaggcaggtggatcg

SEQ ID NO: 9219881 - DNA, 22 bp, Homo sapiens
ggaggccaaggcaggtggatca

SEQ ID NO: 9219882 - DNA, 22 bp, Homo sapiens
cacagctgaagtagccatgtgg

SEQ ID NO: 9219883 - DNA, 22 bp, Homo sapiens
cacagctggtgcactagctctg

SEQ ID NO: 9219884 - DNA, 22 bp, Homo sapiens
cacagctgtgagaagggagcct

SEQ ID NO: 9219885 - DNA, 22 bp, Homo sapiens
cacagctgttttctccaggcag

SEQ ID NO: 9219886 - DNA, 22 bp, Homo sapiens
cacagctgtatccaggagatcc

SEQ ID NO: 9219887 - DNA, 22 bp, Homo sapiens
cacagcttccattagaatgaga

SEQ ID NO: 9219888 - DNA, 22 bp, Homo sapiens
cacagcttatgccactgattgg

SEQ ID NO: 9219889 - DNA, 22 bp, Homo sapiens
ggatgtgaatctgggctgagac

SEQ ID NO: 9219890 - DNA, 22 bp, Homo sapiens
ggatgggctgaaaggtagcccc

SEQ ID NO: 9219891 - DNA, 22 bp, Homo sapiens
cacagggaggcggtcactggct

SEQ ID NO: 9219892 - DNA, 22 bp, Homo sapiens
ggaggcggaggctgcagtgagc

SEQ ID NO: 9219893 - DNA, 22 bp, Homo sapiens
ggagggagcatccccttgctga

SEQ ID NO: 9219894 - DNA, 22 bp, Homo sapiens
ggagggagggctagaccaaaga

SEQ ID NO: 9219895 - DNA, 22 bp, Homo sapiens
ggagggagtcagctgattagaa

SEQ ID NO: 9219896 - DNA, 22 bp, Homo sapiens
ggagggagtttcattcctgccc

SEQ ID NO: 9219897 - DNA, 22 bp, Homo sapiens
ggatctgggctctgccaatcag

SEQ ID NO: 9219898 - DNA, 22 bp, Homo sapiens
ggatctgggctctgccaatcag

SEQ ID NO: 9219899 - DNA, 22 bp, Homo sapiens
ggatctgggctgcagtctaggc

SEQ ID NO: 9219900 - DNA, 22 bp, Homo sapiens
ggatgggagcagaggacgacca

SEQ ID NO: 9219901 - DNA, 22 bp, Homo sapiens
cacagggcagagacctgggtgc

SEQ ID NO: 9219902 - DNA, 22 bp, Homo sapiens
ggcacagggagccgcagttgca

SEQ ID NO: 9219903 - DNA, 22 bp, Homo sapiens
ggcactgggagaggtgagacgg

SEQ ID NO: 9219904 - DNA, 22 bp, Homo sapiens
ggcactgggaatgcagtgatga

SEQ ID NO: 9219905 - DNA, 22 bp, Homo sapiens
ggcactgggaatgcagtgatga

SEQ ID NO: 9219906 - DNA, 22 bp, Homo sapiens
ggcactggaaggatcatgtgag

SEQ ID NO: 9219907 - DNA, 22 bp, Homo sapiens
ggcactggaaggatcatgtgag

SEQ ID NO: 9219908 - DNA, 22 bp, Homo sapiens
ggcactggaaggatcatgtgag

SEQ ID NO: 9219909 - DNA, 22 bp, Homo sapiens
ggcactggaagtcccattgtct

SEQ ID NO: 9219910 - DNA, 22 bp, Homo sapiens
ggcactggagactgttatgaga

SEQ ID NO: 9219911 - DNA, 16 bp, Homo sapiens
ggcactggcaggtcct

SEQ ID NO: 9219912 - DNA, 22 bp, Homo sapiens
ggcactggcaaagcaaagtctg

SEQ ID NO: 9219913 - DNA, 20 bp, Homo sapiens
ggcactggaagcacacagga

SEQ ID NO: 9219914 - DNA, 17 bp, Homo sapiens
ggcagagctgacagggc

SEQ ID NO: 9219915 - DNA, 22 bp, Homo sapiens
cacagtgctcaaacacaagtgc

SEQ ID NO: 9219916 - DNA, 22 bp, Homo sapiens
cacagtgctcgggttttatgtc

SEQ ID NO: 9219917 - DNA, 22 bp, Homo sapiens
cacagtgctgtttgtaaagaga

SEQ ID NO: 9219918 - DNA, 22 bp, Homo sapiens
cacagtgctttatgagagatct

SEQ ID NO: 9219919 - DNA, 22 bp, Homo sapiens
cacagtggcaggtgtgggttgt

SEQ ID NO: 9219920 - DNA, 22 bp, Homo sapiens
cacagtgtagactaataataga

SEQ ID NO: 9219921 - DNA, 22 bp, Homo sapiens
ggcagcatgggtgcctttgtga

SEQ ID NO: 9219922 - DNA, 20 bp, Homo sapiens
ggcagccaatcagcgtgccg

SEQ ID NO: 9219923 - DNA, 22 bp, Homo sapiens
ggcagcagttacaaatgtgcag

SEQ ID NO: 9219924 - DNA, 22 bp, Homo sapiens
ggcagatggaagaggctgggtc

SEQ ID NO: 9219925 - DNA, 22 bp, Homo sapiens
cacagtgtgactgaccttcagc

SEQ ID NO: 9219926 - DNA, 22 bp, Homo sapiens
cacagtgtctgtgcttcagtgt

SEQ ID NO: 9219927 - DNA, 22 bp, Homo sapiens
gcctggaggaatgtagctgagg

SEQ ID NO: 9219928 - DNA, 22 bp, Homo sapiens
gcctggagctctccacttgggg

SEQ ID NO: 9219929 - DNA, 22 bp, Homo sapiens
gcctgggagattaattaggaag

SEQ ID NO: 9219930 - DNA, 22 bp, Homo sapiens
gcctggagctcatgtgggcatt

SEQ ID NO: 9219931 - DNA, 18 bp, Homo sapiens
gcctgctctgctctcccc

SEQ ID NO: 9219932 - DNA, 22 bp, Homo sapiens
gcctctctgggctgccgaggct

SEQ ID NO: 9219933 - DNA, 22 bp, Homo sapiens
gcctctctgggctgccgaggct

SEQ ID NO: 9219934 - DNA, 18 bp, Homo sapiens
gcctgcctagagcttgcc

SEQ ID NO: 9219935 - DNA, 18 bp, Homo sapiens
gcctgcctagagcttgcc

SEQ ID NO: 9219936 - DNA, 22 bp, Homo sapiens
gcctccatgtgtcctgagtcgc

SEQ ID NO: 9219937 - DNA, 22 bp, Homo sapiens
gcctccattgaaagctgtctat

SEQ ID NO: 9219938 - DNA, 22 bp, Homo sapiens
gcctccccaaagtgctgacagc

SEQ ID NO: 9219939 - DNA, 22 bp, Homo sapiens
gcctccccaagcagcagggatt

SEQ ID NO: 9219940 - DNA, 22 bp, Homo sapiens
gcctctctccttggcttgcagt

SEQ ID NO: 9219941 - DNA, 21 bp, Homo sapiens
gcctctccaaatcctgccttc

SEQ ID NO: 9219942 - DNA, 22 bp, Homo sapiens
atttctcagtgaaatgacaggc

SEQ ID NO: 9219943 - DNA, 22 bp, Homo sapiens
atttctcagtaggtgcacagtg

SEQ ID NO: 9219944 - DNA, 22 bp, Homo sapiens
atttctcagggctgaggaggag

SEQ ID NO: 9219945 - DNA, 22 bp, Homo sapiens
atttctcactgagcagataaaa

SEQ ID NO: 9219946 - DNA, 22 bp, Homo sapiens
gctcaggactggaggagcgggg

SEQ ID NO: 9219947 - DNA, 22 bp, Homo sapiens
gctcaggaccgaggggtgggaa

SEQ ID NO: 9219948 - DNA, 22 bp, Homo sapiens
gctcaggaaacagcagggcttg

SEQ ID NO: 9219949 - DNA, 22 bp, Homo sapiens
gctcaggaaacagcagggcttg

SEQ ID NO: 9219950 - DNA, 22 bp, Homo sapiens
gctcagcttgggagcgcccggt

SEQ ID NO: 9219951 - DNA, 22 bp, Homo sapiens
gctcaggatcccaggggtgtgc

SEQ ID NO: 9219952 - DNA, 22 bp, Homo sapiens
gctcaggatttcatccatgtgt

SEQ ID NO: 9219953 - DNA, 22 bp, Homo sapiens
gctcaggatttcatccatgtgt

SEQ ID NO: 9219954 - DNA, 22 bp, Homo sapiens
gctcaggagctgacagcctcaa

SEQ ID NO: 9219955 - DNA, 22 bp, Homo sapiens
gctcaggagctcttggtggcgc

SEQ ID NO: 9219956 - DNA, 22 bp, Homo sapiens
caaaccttgcagaactgggcag

SEQ ID NO: 9219957 - DNA, 22 bp, Homo sapiens
caaaccttgttccagtcaactc

SEQ ID NO: 9219958 - DNA, 22 bp, Homo sapiens
caaactgagcatcagaaagttt

SEQ ID NO: 9219959 - DNA, 22 bp, Homo sapiens
gcgcagagtagcagagtgctga

SEQ ID NO: 9219960 - DNA, 22 bp, Homo sapiens
gcgcaccacctccaggtggccg

SEQ ID NO: 9219961 - DNA, 22 bp, Homo sapiens
caaacattgcactttctgctat

SEQ ID NO: 9219962 - DNA, 22 bp, Homo sapiens
gcgcagctcagtgagggaactt

SEQ ID NO: 9219963 - DNA, 22 bp, Homo sapiens
gcgagggcacgcggttgaaggc

SEQ ID NO: 9219964 - DNA, 22 bp, Homo sapiens
gcgagtgccgagagggcagggc

SEQ ID NO: 9219965 - DNA, 22 bp, Homo sapiens
gcctgtgacccagggcccagga

SEQ ID NO: 9219966 - DNA, 22 bp, Homo sapiens
gcctgtccttgtgaggtcccag

SEQ ID NO: 9219967 - DNA, 22 bp, Homo sapiens
caaaactatcaggctcaaagct

SEQ ID NO: 9219968 - DNA, 22 bp, Homo sapiens
caaaacattctctgcagcaggg

SEQ ID NO: 9219969 - DNA, 22 bp, Homo sapiens
gcgagcctctggagtcctctgg

SEQ ID NO: 9219970 - DNA, 22 bp, Homo sapiens
caaaaactgcaattacttttac

SEQ ID NO: 9219971 - DNA, 22 bp, Homo sapiens
caaaaagcttaggtaacaagcc

SEQ ID NO: 9219972 - DNA, 22 bp, Homo sapiens
caaaacattcagagagctcact

SEQ ID NO: 9219973 - DNA, 22 bp, Homo sapiens
gcctgtgcctcagcctgcagcc

SEQ ID NO: 9219974 - DNA, 22 bp, Homo sapiens
gccaggaggggagagtgtgtca

SEQ ID NO: 9219975 - DNA, 22 bp, Homo sapiens
atttagaaattccaaaagtatt

SEQ ID NO: 9219976 - DNA, 22 bp, Homo sapiens
atttagaaattccaaaagtatt

SEQ ID NO: 9219977 - DNA, 22 bp, Homo sapiens
atttagaactttgtttgccaat

SEQ ID NO: 9219978 - DNA, 22 bp, Homo sapiens
atttagaagctaatttttcaga

SEQ ID NO: 9219979 - DNA, 22 bp, Homo sapiens
gccagctggctgcaggtcccag

SEQ ID NO: 9219980 - DNA, 22 bp, Homo sapiens
gccagctggctgcaggtcccag

SEQ ID NO: 9219981 - DNA, 22 bp, Homo sapiens
gccaggaggcttaactggacag

SEQ ID NO: 9219982 - DNA, 19 bp, Homo sapiens
gccaggagggctctggctg

SEQ ID NO: 9219983 - DNA, 22 bp, Homo sapiens
gccagctggagtgagagtgggc

SEQ ID NO: 9219984 - DNA, 22 bp, Homo sapiens
atttacacattcataagatttc

SEQ ID NO: 9219985 - DNA, 22 bp, Homo sapiens
atttacacttggtttactagag

SEQ ID NO: 9219986 - DNA, 22 bp, Homo sapiens
atttacacttggtttactagag

SEQ ID NO: 9219987 - DNA, 21 bp, Homo sapiens
atttacaaaacagtcccttcc

SEQ ID NO: 9219988 - DNA, 21 bp, Homo sapiens
atttacaaaacagtcccttcc

SEQ ID NO: 9219989 - DNA, 22 bp, Homo sapiens
attggaaatacagtagaaaaat

SEQ ID NO: 9219990 - DNA, 22 bp, Homo sapiens
atttcagcccagtatgagcccc

SEQ ID NO: 9219991 - DNA, 22 bp, Homo sapiens
atttcagctaaaattcttaatt

SEQ ID NO: 9219992 - DNA, 22 bp, Homo sapiens
atttcagtgtcttcttctccct

SEQ ID NO: 9219993 - DNA, 22 bp, Homo sapiens
gccaggcatttgttaggtgctg

SEQ ID NO: 9219994 - DNA, 22 bp, Homo sapiens
atttattgagacttaacaaccc

SEQ ID NO: 9219995 - DNA, 22 bp, Homo sapiens
gccaggccctgggcacttcgtg

SEQ ID NO: 9219996 - DNA, 22 bp, Homo sapiens
gccaggccactcccgggtcctg

SEQ ID NO: 9219997 - DNA, 22 bp, Homo sapiens
gccaggcctgcaagtgctggtg

SEQ ID NO: 9219998 - DNA, 19 bp, Homo sapiens
gccaggcctggacctgcag

SEQ ID NO: 9219999 - DNA, 22 bp, Homo sapiens
atgttaaaaaccagtacagttg

SEQ ID NO: 9220000 - DNA, 22 bp, Homo sapiens
atgtgtgtgtttaatcctcaaa

SEQ ID NO: 9220001 - DNA, 22 bp, Homo sapiens
atgtgtgtgtgcgcgcgcagga

SEQ ID NO: 9220002 - DNA, 22 bp, Homo sapiens
atgtgtgtgtatatacacacat

SEQ ID NO: 9220003 - DNA, 22 bp, Homo sapiens
atgttttatattttgcagcagt

SEQ ID NO: 9220004 - DNA, 22 bp, Homo sapiens
atgttttaccctttgcacaaac

SEQ ID NO: 9220005 - DNA, 22 bp, Homo sapiens
atgttttcaaagtaaacttgta

SEQ ID NO: 9220006 - DNA, 22 bp, Homo sapiens
atgttttctccatgttatgctt

SEQ ID NO: 9220007 - DNA, 22 bp, Homo sapiens
attaaatgttccttaaattata

SEQ ID NO: 9220008 - DNA, 22 bp, Homo sapiens
attaaatgttccttaaattata

SEQ ID NO: 9220009 - DNA, 22 bp, Homo sapiens
attaaatgttccttaaattata

SEQ ID NO: 9220010 - DNA, 22 bp, Homo sapiens
attaaatgttggcatattttgt

SEQ ID NO: 9220011 - DNA, 22 bp, Homo sapiens
attaaatgttggcatattttgt

SEQ ID NO: 9220012 - DNA, 22 bp, Homo sapiens
attaaatgttggacgtatacat

SEQ ID NO: 9220013 - DNA, 22 bp, Homo sapiens
gatgagggcctggtggctgtgc

SEQ ID NO: 9220014 - DNA, 22 bp, Homo sapiens
gatgaggcaagccagaggactg

SEQ ID NO: 9220015 - DNA, 22 bp, Homo sapiens
atgtttttggcttcaagtttct

SEQ ID NO: 9220016 - DNA, 22 bp, Homo sapiens
atgtttttcataccagtgttgg

SEQ ID NO: 9220017 - DNA, 22 bp, Homo sapiens
attaaatactgcaggctaagca

SEQ ID NO: 9220018 - DNA, 22 bp, Homo sapiens
attaaatgatggcatgtcttat

SEQ ID NO: 9220019 - DNA, 22 bp, Homo sapiens
attaaatggtggtcattcattt

SEQ ID NO: 9220020 - DNA, 22 bp, Homo sapiens
attaaatggtggtcattcattt

SEQ ID NO: 9220021 - DNA, 19 bp, Homo sapiens
gcaaggttcactcccagag

SEQ ID NO: 9220022 - DNA, 22 bp, Homo sapiens
gcaagggtgtgaaccaatgaga

SEQ ID NO: 9220023 - DNA, 17 bp, Homo sapiens
gcaagggatgggagatt

SEQ ID NO: 9220024 - DNA, 21 bp, Homo sapiens
gcaaggcttttgtgtttccca

SEQ ID NO: 9220025 - DNA, 22 bp, Homo sapiens
gcaaggctttgtgaattttaaa

SEQ ID NO: 9220026 - DNA, 22 bp, Homo sapiens
gcaaggctgttgctgctgcaag

SEQ ID NO: 9220027 - DNA, 20 bp, Homo sapiens
attattcatacatgtgtgac

SEQ ID NO: 9220028 - DNA, 22 bp, Homo sapiens
attattcttatgtcatcatggc

SEQ ID NO: 9220029 - DNA, 22 bp, Homo sapiens
attaattttacctttgtaaaca

SEQ ID NO: 9220030 - DNA, 22 bp, Homo sapiens
attaagcattcagggctagaga

SEQ ID NO: 9220031 - DNA, 22 bp, Homo sapiens
gcaaggctgtgcactttgcatt

SEQ ID NO: 9220032 - DNA, 22 bp, Homo sapiens
gcaaggctgctgccacccatct

SEQ ID NO: 9220033 - DNA, 22 bp, Homo sapiens
gcaagaaaaaggcttcatgaac

SEQ ID NO: 9220034 - DNA, 22 bp, Homo sapiens
gcaaggctgagcacatttgcat

SEQ ID NO: 9220035 - DNA, 22 bp, Homo sapiens
attacaataatacatgctcatt

SEQ ID NO: 9220036 - DNA, 22 bp, Homo sapiens
attacaaaagaagggagaaggt

SEQ ID NO: 9220037 - DNA, 20 bp, Homo sapiens
gcagagctgttctgtgggga

SEQ ID NO: 9220038 - DNA, 22 bp, Homo sapiens
gcagagctgttaatggagctga

SEQ ID NO: 9220039 - DNA, 22 bp, Homo sapiens
gcagagctgttaatggagctga

SEQ ID NO: 9220040 - DNA, 18 bp, Homo sapiens
gcagagctgggattccca

SEQ ID NO: 9220041 - DNA, 22 bp, Homo sapiens
gcagagctgcagcgaggcctgg

SEQ ID NO: 9220042 - DNA, 23 bp, Homo sapiens
gcagagctgccctattgccttgg

SEQ ID NO: 9220043 - DNA, 21 bp, Homo sapiens
gcagagctggaaccaggaccc

SEQ ID NO: 9220044 - DNA, 22 bp, Homo sapiens
attccttgtttcactgaaaagg

SEQ ID NO: 9220045 - DNA, 19 bp, Homo sapiens
attcctcaaggacagaaat

SEQ ID NO: 9220046 - DNA, 22 bp, Homo sapiens
attgaaaaatgactattgctta

SEQ ID NO: 9220047 - DNA, 22 bp, Homo sapiens
attgaaaaatgactattgctta

SEQ ID NO: 9220048 - DNA, 23 bp, Homo sapiens
attgaacagagagaaaaacatcc

SEQ ID NO: 9220049 - DNA, 22 bp, Homo sapiens
attgaagattaaatgcttcctt

SEQ ID NO: 9220050 - DNA, 22 bp, Homo sapiens
attgaagattaaatgcttcctt

SEQ ID NO: 9220051 - DNA, 22 bp, Homo sapiens
attgaagattctgacatcagaa

SEQ ID NO: 9220052 - DNA, 22 bp, Homo sapiens
attgacaagaaagatattttta

SEQ ID NO: 9220053 - DNA, 22 bp, Homo sapiens
attgacagaaaattggatggca

SEQ ID NO: 9220054 - DNA, 22 bp, Homo sapiens
attgacaattctatgcagagca

SEQ ID NO: 9220055 - DNA, 22 bp, Homo sapiens
attcttcactgtttcagaatga

SEQ ID NO: 9220056 - DNA, 22 bp, Homo sapiens
attctgttacttggtgatcttc

SEQ ID NO: 9220057 - DNA, 22 bp, Homo sapiens
attcttaattccaaagactgag

SEQ ID NO: 9220058 - DNA, 22 bp, Homo sapiens
attcttaattgccatgctgtat

SEQ ID NO: 9220059 - DNA, 22 bp, Homo sapiens
attctagtgtttccattacaag

SEQ ID NO: 9220060 - DNA, 22 bp, Homo sapiens
atgaaacagtgtgtatagcaaa

SEQ ID NO: 9220061 - DNA, 23 bp, Homo sapiens
atgaaacatcacaatggtaccat

SEQ ID NO: 9220062 - DNA, 22 bp, Homo sapiens
atgaaacatgagaaatggagag

SEQ ID NO: 9220063 - DNA, 22 bp, Homo sapiens
atgaaatatcttgaagaaattc

SEQ ID NO: 9220064 - DNA, 22 bp, Homo sapiens
atgaaataaatacccacacata

SEQ ID NO: 9220065 - DNA, 22 bp, Homo sapiens
cttgtggcaggtggatggtgcc

SEQ ID NO: 9220066 - DNA, 22 bp, Homo sapiens
cttgttattggaaatgtcatgc

SEQ ID NO: 9220067 - DNA, 22 bp, Homo sapiens
atgaaaacggaccagagctatt

SEQ ID NO: 9220068 - DNA, 22 bp, Homo sapiens
atgaaatgttggtcccaatcgc

SEQ ID NO: 9220069 - DNA, 22 bp, Homo sapiens
cttttattttgaattaagggct

SEQ ID NO: 9220070 - DNA, 22 bp, Homo sapiens
atgaaatgctgagaggtgcttc

SEQ ID NO: 9220071 - DNA, 22 bp, Homo sapiens
atgaaatatcttgaagaaattc

SEQ ID NO: 9220072 - DNA, 22 bp, Homo sapiens
atgaaatatcttgaagaaattc

SEQ ID NO: 9220073 - DNA, 22 bp, Homo sapiens
atgaaatatttcagagcagagt

SEQ ID NO: 9220074 - DNA, 22 bp, Homo sapiens
atgaaatattctttggtaagaa

SEQ ID NO: 9220075 - DNA, 23 bp, Homo sapiens
atgaaatgatactttattcactg

SEQ ID NO: 9220076 - DNA, 23 bp, Homo sapiens
cttgcctggcctctctgcccaga

SEQ ID NO: 9220077 - DNA, 22 bp, Homo sapiens
cttgcctgtggctagttggctc

SEQ ID NO: 9220078 - DNA, 22 bp, Homo sapiens
cttgcctgtggctagttggctc

SEQ ID NO: 9220079 - DNA, 19 bp, Homo sapiens
cttgcctgttcctacagct

SEQ ID NO: 9220080 - DNA, 22 bp, Homo sapiens
cttgcctgctggagcagggctc

SEQ ID NO: 9220081 - DNA, 22 bp, Homo sapiens
atctatgtgcctttgtatagaa

SEQ ID NO: 9220082 - DNA, 22 bp, Homo sapiens
cttgccttcttttcctatagaa

SEQ ID NO: 9220083 - DNA, 22 bp, Homo sapiens
cttgccttctgttcctatagaa

SEQ ID NO: 9220084 - DNA, 22 bp, Homo sapiens
atctacagtgcacaggacagcc

SEQ ID NO: 9220085 - DNA, 22 bp, Homo sapiens
atctacaggctgaggtgggagg

SEQ ID NO: 9220086 - DNA, 22 bp, Homo sapiens
atctacaggattttacagagtt

SEQ ID NO: 9220087 - DNA, 22 bp, Homo sapiens
atctacaggattttacagagtt

SEQ ID NO: 9220088 - DNA, 22 bp, Homo sapiens
atctacagctgtctgcacagta

SEQ ID NO: 9220089 - DNA, 22 bp, Homo sapiens
atctacagctgtctgcacagta

SEQ ID NO: 9220090 - DNA, 22 bp, Homo sapiens
cttggcccagttgccaaggaaa

SEQ ID NO: 9220091 - DNA, 22 bp, Homo sapiens
cttggcccagttgccaaggaaa

SEQ ID NO: 9220092 - DNA, 20 bp, Homo sapiens
cttggcctacttagctttgt

SEQ ID NO: 9220093 - DNA, 21 bp, Homo sapiens
cttggcctctagctagagctg

SEQ ID NO: 9220094 - DNA, 22 bp, Homo sapiens
cttgctggcagtcactgttgcg

SEQ ID NO: 9220095 - DNA, 22 bp, Homo sapiens
cttggctccaatcccagctctg

SEQ ID NO: 9220096 - DNA, 22 bp, Homo sapiens
cttggcctgggccgcagccact

SEQ ID NO: 9220097 - DNA, 22 bp, Homo sapiens
cttggcctcttctcagggtggg

SEQ ID NO: 9220098 - DNA, 22 bp, Homo sapiens
cttggcctgacatgtggcaggg

SEQ ID NO: 9220099 - DNA, 22 bp, Homo sapiens
cttggcctgcaggcagcagcgc

SEQ ID NO: 9220100 - DNA, 22 bp, Homo sapiens
cttggcctgcccagccagaagg

SEQ ID NO: 9220101 - DNA, 22 bp, Homo sapiens
atcttgaaatactttctagaat

SEQ ID NO: 9220102 - DNA, 22 bp, Homo sapiens
cttgtaatagataggatcaaat

SEQ ID NO: 9220103 - DNA, 22 bp, Homo sapiens
atcttcctttgccatgggatag

SEQ ID NO: 9220104 - DNA, 22 bp, Homo sapiens
cttgtaaatgcagattctgatt

SEQ ID NO: 9220105 - DNA, 22 bp, Homo sapiens
atgcatctgtagtgttatatga

SEQ ID NO: 9220106 - DNA, 20 bp, Homo sapiens
atgcatctggtatctttcct

SEQ ID NO: 9220107 - DNA, 22 bp, Homo sapiens
atgcatctatgacttagacatt

SEQ ID NO: 9220108 - DNA, 22 bp, Homo sapiens
atgcatcttatcaaaaattata

SEQ ID NO: 9220109 - DNA, 22 bp, Homo sapiens
atgcatcttttcaaggtatttc

SEQ ID NO: 9220110 - DNA, 22 bp, Homo sapiens
atgcatttatgtgtgtacattg

SEQ ID NO: 9220111 - DNA, 22 bp, Homo sapiens
atgcattctggaaagtagcaat

SEQ ID NO: 9220112 - DNA, 22 bp, Homo sapiens
atgcaaatgaacatgttgctag

SEQ ID NO: 9220113 - DNA, 22 bp, Homo sapiens
atgcaaataaagcaactataca

SEQ ID NO: 9220114 - DNA, 22 bp, Homo sapiens
atgcaaaataaggcagaaacat

SEQ ID NO: 9220115 - DNA, 20 bp, Homo sapiens
atgcaaactcacaaaatacc

SEQ ID NO: 9220116 - DNA, 22 bp, Homo sapiens
atgcagaatcttgagaaaaatt

SEQ ID NO: 9220117 - DNA, 22 bp, Homo sapiens
atgcagaattgctaagtatctg

SEQ ID NO: 9220118 - DNA, 22 bp, Homo sapiens
atgagtgtgaagttagctcagt

SEQ ID NO: 9220119 - DNA, 22 bp, Homo sapiens
atgagtgtcatgtatgagatat

SEQ ID NO: 9220120 - DNA, 22 bp, Homo sapiens
gaaagcagctaagtcttatgat

SEQ ID NO: 9220121 - DNA, 22 bp, Homo sapiens
gaaagcagatgaaattgcaaca

SEQ ID NO: 9220122 - DNA, 22 bp, Homo sapiens
atgaggccaccttctacatttc

SEQ ID NO: 9220123 - DNA, 22 bp, Homo sapiens
gaaagcagtaaatgggtcccat

SEQ ID NO: 9220124 - DNA, 22 bp, Homo sapiens
atgaggccacagttatagattt

SEQ ID NO: 9220125 - DNA, 22 bp, Homo sapiens
gaaagcagtaaatgggtcccat

SEQ ID NO: 9220126 - DNA, 22 bp, Homo sapiens
atgaggtgatggacatattaac

SEQ ID NO: 9220127 - DNA, 22 bp, Homo sapiens
gaaagcaagttgactgcagaat

SEQ ID NO: 9220128 - DNA, 22 bp, Homo sapiens
gaaagcaatttgtgtaatctgt

SEQ ID NO: 9220129 - DNA, 22 bp, Homo sapiens
gaaagcacccaagatttccttc

SEQ ID NO: 9220130 - DNA, 22 bp, Homo sapiens
atgaagatggttcaactggcct

SEQ ID NO: 9220131 - DNA, 22 bp, Homo sapiens
atgaagagttctgttttggaca

SEQ ID NO: 9220132 - DNA, 20 bp, Homo sapiens
atggaagctgctcttctcct

SEQ ID NO: 9220133 - DNA, 22 bp, Homo sapiens
atggacagtgtgaagcagatag

SEQ ID NO: 9220134 - DNA, 22 bp, Homo sapiens
atggagacattacactaagtga

SEQ ID NO: 9220135 - DNA, 20 bp, Homo sapiens
atggaggaagggcaagagaa

SEQ ID NO: 9220136 - DNA, 22 bp, Homo sapiens
atggagccattcctgaagactt

SEQ ID NO: 9220137 - DNA, 21 bp, Homo sapiens
atggagcctaagagtggaggt

SEQ ID NO: 9220138 - DNA, 22 bp, Homo sapiens
atggaaatgatggaacattaaa

SEQ ID NO: 9220139 - DNA, 22 bp, Homo sapiens
atggaaatgtaacttctgattc

SEQ ID NO: 9220140 - DNA, 22 bp, Homo sapiens
atggaaattaagatttgtctca

SEQ ID NO: 9220141 - DNA, 22 bp, Homo sapiens
atggaaatgttaagtcagtccg

SEQ ID NO: 9220142 - DNA, 22 bp, Homo sapiens
atggaaatgttccatatattga

SEQ ID NO: 9220143 - DNA, 22 bp, Homo sapiens
atgccactgcgctccagcctgg

SEQ ID NO: 9220144 - DNA, 22 bp, Homo sapiens
atggccagtctgttggacagca

SEQ ID NO: 9220145 - DNA, 22 bp, Homo sapiens
gagaggaaagaaccaatgaccc

SEQ ID NO: 9220146 - DNA, 22 bp, Homo sapiens
atggcagctggcttgggcacct

SEQ ID NO: 9220147 - DNA, 22 bp, Homo sapiens
atggcaggatacccagtccggc

SEQ ID NO: 9220148 - DNA, 22 bp, Homo sapiens
atggcagtatttgtatcacaga

SEQ ID NO: 9220149 - DNA, 22 bp, Homo sapiens
atggcagggcccttggctccca

SEQ ID NO: 9220150 - DNA, 22 bp, Homo sapiens
atggcagggaccaagctgtcat

SEQ ID NO: 9220151 - DNA, 22 bp, Homo sapiens
atggcagggactgtggcccttg

SEQ ID NO: 9220152 - DNA, 22 bp, Homo sapiens
gagccaggcccgtacttgctgt

SEQ ID NO: 9220153 - DNA, 22 bp, Homo sapiens
gagccagcgccttgcctctggg

SEQ ID NO: 9220154 - DNA, 22 bp, Homo sapiens
gagccagctatgtagcaagagg

SEQ ID NO: 9220155 - DNA, 22 bp, Homo sapiens
gagcagtgactggagcatgaga

SEQ ID NO: 9220156 - DNA, 22 bp, Homo sapiens
atggcccaaactgcaattactt

SEQ ID NO: 9220157 - DNA, 22 bp, Homo sapiens
atggtaaacatttaacaactag

SEQ ID NO: 9220158 - DNA, 22 bp, Homo sapiens
atgggttcaagtgattctcctg

SEQ ID NO: 9220159 - DNA, 22 bp, Homo sapiens
atgggttcaagtgattctcctg

SEQ ID NO: 9220160 - DNA, 22 bp, Homo sapiens
atggtaggtacaacagcaggca

SEQ ID NO: 9220161 - DNA, 22 bp, Homo sapiens
atggtagccccacactcaccag

SEQ ID NO: 9220162 - DNA, 22 bp, Homo sapiens
atggtatacaattatggactgt

SEQ ID NO: 9220163 - DNA, 22 bp, Homo sapiens
atggtacatagtttaaataagg

SEQ ID NO: 9220164 - DNA, 22 bp, Homo sapiens
atggtacagtgcactgaatgga

SEQ ID NO: 9220165 - DNA, 22 bp, Homo sapiens
atggtacagataatacatgctg

SEQ ID NO: 9220166 - DNA, 22 bp, Homo sapiens
atggtacaattttcatttgtgg

SEQ ID NO: 9220167 - DNA, 22 bp, Homo sapiens
atggtacaaaatgtataaagtc

SEQ ID NO: 9220168 - DNA, 22 bp, Homo sapiens
atggtacaatgatggatagtgg

SEQ ID NO: 9220169 - DNA, 22 bp, Homo sapiens
gagctggggcagcttaggagtg

SEQ ID NO: 9220170 - DNA, 22 bp, Homo sapiens
gagctggggcagcttaggagtg

SEQ ID NO: 9220171 - DNA, 21 bp, Homo sapiens
gagctgggcgaggctccgggg

SEQ ID NO: 9220172 - DNA, 22 bp, Homo sapiens
atggtccttatggccgtgatat

SEQ ID NO: 9220173 - DNA, 22 bp, Homo sapiens
gaggccagggtaccatcaacat

SEQ ID NO: 9220174 - DNA, 22 bp, Homo sapiens
gaggccagggatgcaatgagag

SEQ ID NO: 9220175 - DNA, 22 bp, Homo sapiens
gaggccagggatgcaatgagag

SEQ ID NO: 9220176 - DNA, 22 bp, Homo sapiens
gaggagctggctgtcgggaggc

SEQ ID NO: 9220177 - DNA, 22 bp, Homo sapiens
gaggagctggcagcgtctccgc

SEQ ID NO: 9220178 - DNA, 22 bp, Homo sapiens
gaggagctggcagcgtctccgc

SEQ ID NO: 9220179 - DNA, 22 bp, Homo sapiens
gaggagctgcagggggagtcta

SEQ ID NO: 9220180 - DNA, 22 bp, Homo sapiens
gaggagctgggaccctgtcatc

SEQ ID NO: 9220181 - DNA, 22 bp, Homo sapiens
gaggagctgggaccctgtcatc

SEQ ID NO: 9220182 - DNA, 22 bp, Homo sapiens
gaggagctggctgtcgggaggc

SEQ ID NO: 9220183 - DNA, 23 bp, Homo sapiens
gaggccacattcccctgcttgag

SEQ ID NO: 9220184 - DNA, 22 bp, Homo sapiens
gaggccaccctatgggtcccag

SEQ ID NO: 9220185 - DNA, 22 bp, Homo sapiens
gaggccaggagtgctgtaagtt

SEQ ID NO: 9220186 - DNA, 22 bp, Homo sapiens
atgtacattcttctcaccgaag

SEQ ID NO: 9220187 - DNA, 22 bp, Homo sapiens
atgtacattttcctaatgtttt

SEQ ID NO: 9220188 - DNA, 18 bp, Homo sapiens
atgtacatttgctaaagc

SEQ ID NO: 9220189 - DNA, 22 bp, Homo sapiens
gaggagctgaggctgaggcctc

SEQ ID NO: 9220190 - DNA, 22 bp, Homo sapiens
gaggagctgaggctgaggcctc

SEQ ID NO: 9220191 - DNA, 22 bp, Homo sapiens
gaggagctctgctccatccttc

SEQ ID NO: 9220192 - DNA, 22 bp, Homo sapiens
gaggagctctgctccatccttc

SEQ ID NO: 9220193 - DNA, 17 bp, Homo sapiens
gaggagctccagtaggt

SEQ ID NO: 9220194 - DNA, 17 bp, Homo sapiens
gaggagctccagtaggt

SEQ ID NO: 9220195 - DNA, 22 bp, Homo sapiens
gaggagctgagccacgtcctgg

SEQ ID NO: 9220196 - DNA, 22 bp, Homo sapiens
atgtgtgtatgtgcctatatct

SEQ ID NO: 9220197 - DNA, 22 bp, Homo sapiens
atgtgtgtatatatagtcattt

SEQ ID NO: 9220198 - DNA, 22 bp, Homo sapiens
atgtgtgtgcatttctctccct

SEQ ID NO: 9220199 - DNA, 22 bp, Homo sapiens
atgtgtgtgatgggcgccgcca

SEQ ID NO: 9220200 - DNA, 22 bp, Homo sapiens
gaggggagcatgatctagattg

SEQ ID NO: 9220201 - DNA, 16 bp, Homo sapiens
gaggggagcagtaggc

SEQ ID NO: 9220202 - DNA, 16 bp, Homo sapiens
gaggggagcagtaggc

SEQ ID NO: 9220203 - DNA, 22 bp, Homo sapiens
gaggggagcccccatcctccag

SEQ ID NO: 9220204 - DNA, 22 bp, Homo sapiens
atgtgaaaaatttcttattaca

SEQ ID NO: 9220205 - DNA, 22 bp, Homo sapiens
atgtcttttatgattacgggat

SEQ ID NO: 9220206 - DNA, 22 bp, Homo sapiens
gaggcctggctgtcagtcccca

SEQ ID NO: 9220207 - DNA, 22 bp, Homo sapiens
gaggcctggagccgcctaggcg

SEQ ID NO: 9220208 - DNA, 22 bp, Homo sapiens
gaggcctgggagcctgtcctcc

SEQ ID NO: 9220209 - DNA, 22 bp, Homo sapiens
atgtctgctttccttttaatca

SEQ ID NO: 9220210 - DNA, 17 bp, Homo sapiens
agcagaagtcagaggga

SEQ ID NO: 9220211 - DNA, 17 bp, Homo sapiens
agcagaagtcagaggga

SEQ ID NO: 9220212 - DNA, 22 bp, Homo sapiens
caaattaatgtgtctcaaaata

SEQ ID NO: 9220213 - DNA, 22 bp, Homo sapiens
caaattaatgtgtctcaaaata

SEQ ID NO: 9220214 - DNA, 22 bp, Homo sapiens
caaatgtttggtggcattttgt

SEQ ID NO: 9220215 - DNA, 22 bp, Homo sapiens
caaatgtttgcatcacagggca

SEQ ID NO: 9220216 - DNA, 22 bp, Homo sapiens
caaatgtttcttgaacaccaac

SEQ ID NO: 9220217 - DNA, 22 bp, Homo sapiens
caaatgtttggtggcattttgt

SEQ ID NO: 9220218 - DNA, 22 bp, Homo sapiens
caaatgtttttattctacaaca

SEQ ID NO: 9220219 - DNA, 22 bp, Homo sapiens
caaatgttttttagtataagta

SEQ ID NO: 9220220 - DNA, 22 bp, Homo sapiens
caaatgttgctgtaatgtttgt

SEQ ID NO: 9220221 - DNA, 22 bp, Homo sapiens
caaatgtttcttatctattgtt

SEQ ID NO: 9220222 - DNA, 22 bp, Homo sapiens
caaatgtttcttatctattgtt

SEQ ID NO: 9220223 - DNA, 22 bp, Homo sapiens
caaatgttgactaagagggttt

SEQ ID NO: 9220224 - DNA, 22 bp, Homo sapiens
caaatgttattcattcttgttt

SEQ ID NO: 9220225 - DNA, 22 bp, Homo sapiens
caaatgttattcattcttgttt

SEQ ID NO: 9220226 - DNA, 22 bp, Homo sapiens
caaatgttagtgcccatccctc

SEQ ID NO: 9220227 - DNA, 22 bp, Homo sapiens
caaatgttaagacaggatcaag

SEQ ID NO: 9220228 - DNA, 22 bp, Homo sapiens
caaatgcatagaaagatgaaac

SEQ ID NO: 9220229 - DNA, 22 bp, Homo sapiens
caaatgttaaatgtgttaagac

SEQ ID NO: 9220230 - DNA, 22 bp, Homo sapiens
caaatgcaggtcagcaggtgtc

SEQ ID NO: 9220231 - DNA, 22 bp, Homo sapiens
caaatgcaaaatataaccctgt

SEQ ID NO: 9220232 - DNA, 22 bp, Homo sapiens
agcacagctgttcaacaggaat

SEQ ID NO: 9220233 - DNA, 20 bp, Homo sapiens
agcacagcgcggtgttcctt

SEQ ID NO: 9220234 - DNA, 22 bp, Homo sapiens
agcacagccagctttattggcc

SEQ ID NO: 9220235 - DNA, 21 bp, Homo sapiens
agcacagcatatccaatgtca

SEQ ID NO: 9220236 - DNA, 22 bp, Homo sapiens
agcacagagttgcagagagcgt

SEQ ID NO: 9220237 - DNA, 22 bp, Homo sapiens
agcacagagaagatttcaatta

SEQ ID NO: 9220238 - DNA, 22 bp, Homo sapiens
agcacagagattatttacaaga

SEQ ID NO: 9220239 - DNA, 19 bp, Homo sapiens
agcacagagagtctatagc

SEQ ID NO: 9220240 - DNA, 22 bp, Homo sapiens
agcacagataacatggagtgga

SEQ ID NO: 9220241 - DNA, 22 bp, Homo sapiens
agcacagcaagtgggttattaa

SEQ ID NO: 9220242 - DNA, 22 bp, Homo sapiens
agcacagattctgaagagtcct

SEQ ID NO: 9220243 - DNA, 22 bp, Homo sapiens
agcacagatgtgagtggaggct

SEQ ID NO: 9220244 - DNA, 22 bp, Homo sapiens
attttctattctgctggtttag

SEQ ID NO: 9220245 - DNA, 22 bp, Homo sapiens
attttctatgttgtaattgtta

SEQ ID NO: 9220246 - DNA, 23 bp, Homo sapiens
agcacagactagaaaggtctttc

SEQ ID NO: 9220247 - DNA, 22 bp, Homo sapiens
caaggcagtccctactccctgc

SEQ ID NO: 9220248 - DNA, 22 bp, Homo sapiens
caaggcagttccccagagggct

SEQ ID NO: 9220249 - DNA, 22 bp, Homo sapiens
caaggcaggccagtttcaaggc

SEQ ID NO: 9220250 - DNA, 22 bp, Homo sapiens
agcagcatagaagctgggagga

SEQ ID NO: 9220251 - DNA, 22 bp, Homo sapiens
agcagcatcaaccctcccgtgt

SEQ ID NO: 9220252 - DNA, 22 bp, Homo sapiens
agcagcatctcttattgcagtg

SEQ ID NO: 9220253 - DNA, 22 bp, Homo sapiens
agcagcatctcttattgcagtg

SEQ ID NO: 9220254 - DNA, 22 bp, Homo sapiens
agcagcatccccggcctccacc

SEQ ID NO: 9220255 - DNA, 21 bp, Homo sapiens
agcagcatcagcctcacctga

SEQ ID NO: 9220256 - DNA, 22 bp, Homo sapiens
agcagcatattgtgtcttcata

SEQ ID NO: 9220257 - DNA, 22 bp, Homo sapiens
agcagcatagatgctatccgag

SEQ ID NO: 9220258 - DNA, 22 bp, Homo sapiens
agcagcatatcagagaaagtca

SEQ ID NO: 9220259 - DNA, 22 bp, Homo sapiens
agcagcatatcagagaaagtca

SEQ ID NO: 9220260 - DNA, 22 bp, Homo sapiens
agcagcatctggttctgatgtg

SEQ ID NO: 9220261 - DNA, 22 bp, Homo sapiens
agcagcatcttctaagtaaggc

SEQ ID NO: 9220262 - DNA, 22 bp, Homo sapiens
agcagcatcttctgttctccgc

SEQ ID NO: 9220263 - DNA, 22 bp, Homo sapiens
agcagcatgatgacagagtctc

SEQ ID NO: 9220264 - DNA, 22 bp, Homo sapiens
agcagcatggatgggcctcagc

SEQ ID NO: 9220265 - DNA, 22 bp, Homo sapiens
agcagcatggatgggcctcagc

SEQ ID NO: 9220266 - DNA, 22 bp, Homo sapiens
agcagcatggctgactaaagac

SEQ ID NO: 9220267 - DNA, 22 bp, Homo sapiens
agcagcatggagaaaccgttca

SEQ ID NO: 9220268 - DNA, 22 bp, Homo sapiens
agcagcattcctggcttctatc

SEQ ID NO: 9220269 - DNA, 22 bp, Homo sapiens
agcagcattatgatatatctta

SEQ ID NO: 9220270 - DNA, 22 bp, Homo sapiens
agcagcattaagggaactgcag

SEQ ID NO: 9220271 - DNA, 22 bp, Homo sapiens
agcagcatgttcattacattat

SEQ ID NO: 9220272 - DNA, 22 bp, Homo sapiens
agcagcatgtatgagggtgaac

SEQ ID NO: 9220273 - DNA, 22 bp, Homo sapiens
agcagcatgttgggatgtgaaa

SEQ ID NO: 9220274 - DNA, 22 bp, Homo sapiens
agcagcatgttgggatgtgaaa

SEQ ID NO: 9220275 - DNA, 22 bp, Homo sapiens
agcagcatttaagtttcttcta

SEQ ID NO: 9220276 - DNA, 22 bp, Homo sapiens
agcagcatttaaggatccaagt

SEQ ID NO: 9220277 - DNA, 20 bp, Homo sapiens
agcagcattgttctagagca

SEQ ID NO: 9220278 - DNA, 20 bp, Homo sapiens
agcagcattgttctagagca

SEQ ID NO: 9220279 - DNA, 22 bp, Homo sapiens
agcagcattctctggtatgggg

SEQ ID NO: 9220280 - DNA, 22 bp, Homo sapiens
agcagcaagcagtgcacgggtt

SEQ ID NO: 9220281 - DNA, 22 bp, Homo sapiens
agcagcaatggaaagcaacaca

SEQ ID NO: 9220282 - DNA, 22 bp, Homo sapiens
agcagcaatggaaagcaacaca

SEQ ID NO: 9220283 - DNA, 22 bp, Homo sapiens
agcagcaaggaagcgaggatgg

SEQ ID NO: 9220284 - DNA, 22 bp, Homo sapiens
agcagcaatggaaagcaacaca

SEQ ID NO: 9220285 - DNA, 22 bp, Homo sapiens
agcagaagtgccttagcaatca

SEQ ID NO: 9220286 - DNA, 18 bp, Homo sapiens
agcagaattctagggttc

SEQ ID NO: 9220287 - DNA, 22 bp, Homo sapiens
cacatctgaaaagatgcacaag

SEQ ID NO: 9220288 - DNA, 22 bp, Homo sapiens
agcaggtgatgtgagtctggaa

SEQ ID NO: 9220289 - DNA, 22 bp, Homo sapiens
cacatctgacttccagtgcagg

SEQ ID NO: 9220290 - DNA, 22 bp, Homo sapiens
cactctgcagctgaagggctgg

SEQ ID NO: 9220291 - DNA, 22 bp, Homo sapiens
cactctgattccacaaggctcc

SEQ ID NO: 9220292 - DNA, 22 bp, Homo sapiens
cactctgggggctgccgctgcc

SEQ ID NO: 9220293 - DNA, 22 bp, Homo sapiens
agcataagttggtacagccact

SEQ ID NO: 9220294 - DNA, 22 bp, Homo sapiens
cactctgagcccaagcaggctg

SEQ ID NO: 9220295 - DNA, 22 bp, Homo sapiens
cactctgagccaaaactaattc

SEQ ID NO: 9220296 - DNA, 20 bp, Homo sapiens
cactctgagggagtccatgt

SEQ ID NO: 9220297 - DNA, 22 bp, Homo sapiens
cactctgatggtttctgttcaa

SEQ ID NO: 9220298 - DNA, 22 bp, Homo sapiens
cactctgatggtttctgttcaa

SEQ ID NO: 9220299 - DNA, 22 bp, Homo sapiens
agcataaaggtcaacgttttag

SEQ ID NO: 9220300 - DNA, 22 bp, Homo sapiens
agcataaaggcactagaaagag

SEQ ID NO: 9220301 - DNA, 22 bp, Homo sapiens
agcagtttgaatcaatggccag

SEQ ID NO: 9220302 - DNA, 22 bp, Homo sapiens
caccaggctggagtgcagtggc

SEQ ID NO: 9220303 - DNA, 22 bp, Homo sapiens
agcagttgtagtcatggaaaat

SEQ ID NO: 9220304 - DNA, 22 bp, Homo sapiens
agcagtggcctggggctctgtg

SEQ ID NO: 9220305 - DNA, 22 bp, Homo sapiens
agcagtggcctggggctctgtg

SEQ ID NO: 9220306 - DNA, 22 bp, Homo sapiens
cacagggccttgtgtgactgca

SEQ ID NO: 9220307 - DNA, 22 bp, Homo sapiens
cacagggctaaatgaagggttg

SEQ ID NO: 9220308 - DNA, 22 bp, Homo sapiens
cacaggctgcccgcagctggga

SEQ ID NO: 9220309 - DNA, 22 bp, Homo sapiens
cacagggcctggggcagctgct

SEQ ID NO: 9220310 - DNA, 22 bp, Homo sapiens
cacagggcagtgctgcccactc

SEQ ID NO: 9220311 - DNA, 22 bp, Homo sapiens
cacaggagggagcgggcagcca

SEQ ID NO: 9220312 - DNA, 22 bp, Homo sapiens
cacaggagggagcgggcagcca

SEQ ID NO: 9220313 - DNA, 22 bp, Homo sapiens
cacaggaggaggccagagcgta

SEQ ID NO: 9220314 - DNA, 22 bp, Homo sapiens
cacaggaggcaatggtaagatt

SEQ ID NO: 9220315 - DNA, 22 bp, Homo sapiens
cacaggctgcccgcagctggga

SEQ ID NO: 9220316 - DNA, 22 bp, Homo sapiens
agcaggagaacactgtggctct

SEQ ID NO: 9220317 - DNA, 22 bp, Homo sapiens
cacaggaagctgactgctggca

SEQ ID NO: 9220318 - DNA, 22 bp, Homo sapiens
agcagcttctttcactcctgga

SEQ ID NO: 9220319 - DNA, 22 bp, Homo sapiens
agcagcttatcttggagaggca

SEQ ID NO: 9220320 - DNA, 22 bp, Homo sapiens
cacaggagctgtggggcagtgt

SEQ ID NO: 9220321 - DNA, 22 bp, Homo sapiens
cacaggagccctgaggcctccc

SEQ ID NO: 9220322 - DNA, 22 bp, Homo sapiens
cacaggagccctgaggcctccc

SEQ ID NO: 9220323 - DNA, 22 bp, Homo sapiens
agcagctgtggggacaagggta

SEQ ID NO: 9220324 - DNA, 22 bp, Homo sapiens
agcagctgtggggacaagggta

SEQ ID NO: 9220325 - DNA, 22 bp, Homo sapiens
agcagctgttagaaacaggaag

SEQ ID NO: 9220326 - DNA, 22 bp, Homo sapiens
agcagctgtactttcatctgtt

SEQ ID NO: 9220327 - DNA, 19 bp, Homo sapiens
agcagctgtagatagacac

SEQ ID NO: 9220328 - DNA, 18 bp, Homo sapiens
agcagctgtcagaatgcc

SEQ ID NO: 9220329 - DNA, 22 bp, Homo sapiens
agcagctgtcccttaacatcag

SEQ ID NO: 9220330 - DNA, 22 bp, Homo sapiens
agcagctgtcccttaacatcag

SEQ ID NO: 9220331 - DNA, 22 bp, Homo sapiens
agcagctgtggaaaagtaacta

SEQ ID NO: 9220332 - DNA, 18 bp, Homo sapiens
agcagctgtgccacactg

SEQ ID NO: 9220333 - DNA, 22 bp, Homo sapiens
cagcaggaccattgaggcatca

SEQ ID NO: 9220334 - DNA, 22 bp, Homo sapiens
cagcaggacgtccaagtgctat

SEQ ID NO: 9220335 - DNA, 22 bp, Homo sapiens
cagcaggacccaggaatcctgc

SEQ ID NO: 9220336 - DNA, 22 bp, Homo sapiens
cagcaggaggcatggcttccct

SEQ ID NO: 9220337 - DNA, 22 bp, Homo sapiens
cagcaggaggcatggcttccct

SEQ ID NO: 9220338 - DNA, 22 bp, Homo sapiens
cagcaggaggcatggcttccct

SEQ ID NO: 9220339 - DNA, 22 bp, Homo sapiens
cagcaggagcagtcagactcct

SEQ ID NO: 9220340 - DNA, 23 bp, Homo sapiens
agccttggaggttgaggctgcag

SEQ ID NO: 9220341 - DNA, 22 bp, Homo sapiens
agccttgaaccaattgtttagc

SEQ ID NO: 9220342 - DNA, 22 bp, Homo sapiens
agccttgagttcaagtgctggc

SEQ ID NO: 9220343 - DNA, 22 bp, Homo sapiens
agccttgagcagttcacttggt

SEQ ID NO: 9220344 - DNA, 22 bp, Homo sapiens
agccttgacactggggaaactg

SEQ ID NO: 9220345 - DNA, 22 bp, Homo sapiens
agccttgatcttggtaacagga

SEQ ID NO: 9220346 - DNA, 22 bp, Homo sapiens
agccttgaacactgactgaagg

SEQ ID NO: 9220347 - DNA, 22 bp, Homo sapiens
agccttctctgattctcctagt

SEQ ID NO: 9220348 - DNA, 22 bp, Homo sapiens
cagcaggaggtgagatgtgacc

SEQ ID NO: 9220349 - DNA, 23 bp, Homo sapiens
cagcaggagggtgcctgggctgc

SEQ ID NO: 9220350 - DNA, 23 bp, Homo sapiens
cagcaggagggtgcctgggctgc

SEQ ID NO: 9220351 - DNA, 22 bp, Homo sapiens
cagcaggaggtgagtagcaggt

SEQ ID NO: 9220352 - DNA, 22 bp, Homo sapiens
cagcaggataggtttctttgga

SEQ ID NO: 9220353 - DNA, 18 bp, Homo sapiens
agctcacagatctgtttt

SEQ ID NO: 9220354 - DNA, 22 bp, Homo sapiens
agctcagaagggaggaaatgag

SEQ ID NO: 9220355 - DNA, 22 bp, Homo sapiens
agctcagaagcctatgcatagt

SEQ ID NO: 9220356 - DNA, 22 bp, Homo sapiens
agctcagaactgcagacatgtg

SEQ ID NO: 9220357 - DNA, 22 bp, Homo sapiens
agctcagaactgcagacatgtg

SEQ ID NO: 9220358 - DNA, 22 bp, Homo sapiens
agctcagaaatgccagtaggta

SEQ ID NO: 9220359 - DNA, 22 bp, Homo sapiens
agctcagaaatgccagtaggta

SEQ ID NO: 9220360 - DNA, 22 bp, Homo sapiens
agctcagaacctcctcatccca

SEQ ID NO: 9220361 - DNA, 22 bp, Homo sapiens
agctcacattctcatcagatgt

SEQ ID NO: 9220362 - DNA, 22 bp, Homo sapiens
agctccagggaaagagtggatc

SEQ ID NO: 9220363 - DNA, 22 bp, Homo sapiens
cagccagctgaatgtaccatga

SEQ ID NO: 9220364 - DNA, 22 bp, Homo sapiens
cagccagaggctgcgaggggcc

SEQ ID NO: 9220365 - DNA, 22 bp, Homo sapiens
cagccagaggggccagagtcgg

SEQ ID NO: 9220366 - DNA, 22 bp, Homo sapiens
cagccagatcaaactcagatgt

SEQ ID NO: 9220367 - DNA, 22 bp, Homo sapiens
cagccagatcagggcaggggtt

SEQ ID NO: 9220368 - DNA, 22 bp, Homo sapiens
cagccagcctctcaaccatgca

SEQ ID NO: 9220369 - DNA, 22 bp, Homo sapiens
cagccagcctctcaaccatgca

SEQ ID NO: 9220370 - DNA, 22 bp, Homo sapiens
cagccagctgaatgtaccatga

SEQ ID NO: 9220371 - DNA, 22 bp, Homo sapiens
cagccagctcaggaaggatttt

SEQ ID NO: 9220372 - DNA, 22 bp, Homo sapiens
agctccctgcacgaccctgccc

SEQ ID NO: 9220373 - DNA, 21 bp, Homo sapiens
agctccctgtttcctcactct

SEQ ID NO: 9220374 - DNA, 19 bp, Homo sapiens
agctcctcacctctcgcgg

SEQ ID NO: 9220375 - DNA, 20 bp, Homo sapiens
agctcctcatcactggaggt

SEQ ID NO: 9220376 - DNA, 22 bp, Homo sapiens
agctcctctagatctgccactt

SEQ ID NO: 9220377 - DNA, 22 bp, Homo sapiens
cagccctgggagttggggccga

SEQ ID NO: 9220378 - DNA, 22 bp, Homo sapiens
cagccctgggtccctgccctgg

SEQ ID NO: 9220379 - DNA, 22 bp, Homo sapiens
cagccctggctagggcgagggc

SEQ ID NO: 9220380 - DNA, 22 bp, Homo sapiens
cagccctggcgcccccagatct

SEQ ID NO: 9220381 - DNA, 22 bp, Homo sapiens
agcctccatctcccatctgtga

SEQ ID NO: 9220382 - DNA, 22 bp, Homo sapiens
agcctccatctcccatctgtga

SEQ ID NO: 9220383 - DNA, 22 bp, Homo sapiens
cagcagagcttatgttgggtca

SEQ ID NO: 9220384 - DNA, 20 bp, Homo sapiens
cagcagaaatggggtgggaa

SEQ ID NO: 9220385 - DNA, 22 bp, Homo sapiens
agcctccaaatgtcaggtcccg

SEQ ID NO: 9220386 - DNA, 22 bp, Homo sapiens
agcctccaaatgtcaggtcccg

SEQ ID NO: 9220387 - DNA, 22 bp, Homo sapiens
cagcagcatgaattcgagccac

SEQ ID NO: 9220388 - DNA, 22 bp, Homo sapiens
cagcagcatcaggtctgtggtt

SEQ ID NO: 9220389 - DNA, 22 bp, Homo sapiens
agcctggtttaagcattttata

SEQ ID NO: 9220390 - DNA, 22 bp, Homo sapiens
cagcagcagtggctgcagaaca

SEQ ID NO: 9220391 - DNA, 22 bp, Homo sapiens
cagcagcaggcgcacggccgtc

SEQ ID NO: 9220392 - DNA, 22 bp, Homo sapiens
cagcagcagccccaggaaggtt

SEQ ID NO: 9220393 - DNA, 22 bp, Homo sapiens
cagcagcagccccaggaaggtt

SEQ ID NO: 9220394 - DNA, 22 bp, Homo sapiens
cagcagcagccccaggaaggtt

SEQ ID NO: 9220395 - DNA, 22 bp, Homo sapiens
cagcagcagccccaggaaggtt

SEQ ID NO: 9220396 - DNA, 22 bp, Homo sapiens
cagcagaggcacgtctgtgaat

SEQ ID NO: 9220397 - DNA, 22 bp, Homo sapiens
cagcacagggcttgagaggtgt

SEQ ID NO: 9220398 - DNA, 22 bp, Homo sapiens
cagcacaggtcagttttttaag

SEQ ID NO: 9220399 - DNA, 22 bp, Homo sapiens
agcctcagcacgcagctctgtg

SEQ ID NO: 9220400 - DNA, 21 bp, Homo sapiens
agcctcaggttgttggttctt

SEQ ID NO: 9220401 - DNA, 22 bp, Homo sapiens
cagcacaggaagtgggccttca

SEQ ID NO: 9220402 - DNA, 22 bp, Homo sapiens
cagcacaggaatatggtggaca

SEQ ID NO: 9220403 - DNA, 22 bp, Homo sapiens
cagcacagcacagcggtgactc

SEQ ID NO: 9220404 - DNA, 22 bp, Homo sapiens
cagcacaggcctgtctttgtct

SEQ ID NO: 9220405 - DNA, 22 bp, Homo sapiens
cagcacaggcaggggaactata

SEQ ID NO: 9220406 - DNA, 22 bp, Homo sapiens
cagcacagggacaatagcagat

SEQ ID NO: 9220407 - DNA, 22 bp, Homo sapiens
cagcacagggacaatagcagat

SEQ ID NO: 9220408 - DNA, 22 bp, Homo sapiens
cagcacagggcttgagaggtgt

SEQ ID NO: 9220409 - DNA, 20 bp, Homo sapiens
cagcacagagcttggctcta

SEQ ID NO: 9220410 - DNA, 22 bp, Homo sapiens
cagcacagagtattttattgat

SEQ ID NO: 9220411 - DNA, 22 bp, Homo sapiens
cagaggctaagatgagtgggtg

SEQ ID NO: 9220412 - DNA, 22 bp, Homo sapiens
cagaggcctttctacagtgata

SEQ ID NO: 9220413 - DNA, 22 bp, Homo sapiens
cagaggcctttctacagtgata

SEQ ID NO: 9220414 - DNA, 22 bp, Homo sapiens
agccctccatctgtgctcaggc

SEQ ID NO: 9220415 - DNA, 22 bp, Homo sapiens
agccctccatctgtgctcaggc

SEQ ID NO: 9220416 - DNA, 22 bp, Homo sapiens
cagagagggcggccctggcttc

SEQ ID NO: 9220417 - DNA, 22 bp, Homo sapiens
cagagatggggccagctgctcc

SEQ ID NO: 9220418 - DNA, 22 bp, Homo sapiens
cagagcaacaccctttacatcg

SEQ ID NO: 9220419 - DNA, 22 bp, Homo sapiens
cagagatgtgatccagctgtct

SEQ ID NO: 9220420 - DNA, 22 bp, Homo sapiens
cagagatgggtcgcagagatgg

SEQ ID NO: 9220421 - DNA, 22 bp, Homo sapiens
agccagtagatcgggaggatgt

SEQ ID NO: 9220422 - DNA, 22 bp, Homo sapiens
cagagaggatggattccatagc

SEQ ID NO: 9220423 - DNA, 22 bp, Homo sapiens
agccaggtcagctcaccctgct

SEQ ID NO: 9220424 - DNA, 17 bp, Homo sapiens
agccaggtacaagtcca

SEQ ID NO: 9220425 - DNA, 22 bp, Homo sapiens
agccagggtgggtgaatgctat

SEQ ID NO: 9220426 - DNA, 20 bp, Homo sapiens
agccagggttctggatgcac

SEQ ID NO: 9220427 - DNA, 22 bp, Homo sapiens
agcccaggagtttgaggctgtg

SEQ ID NO: 9220428 - DNA, 22 bp, Homo sapiens
agcccaggaggtggaggttgca

SEQ ID NO: 9220429 - DNA, 22 bp, Homo sapiens
agcccaggagtccttaaggacc

SEQ ID NO: 9220430 - DNA, 22 bp, Homo sapiens
agcccaggagtttgaggctgtg

SEQ ID NO: 9220431 - DNA, 22 bp, Homo sapiens
agcccaggaagttgaggcttgc

SEQ ID NO: 9220432 - DNA, 22 bp, Homo sapiens
agcccaggaagttgaggcttgc

SEQ ID NO: 9220433 - DNA, 22 bp, Homo sapiens
agcccaggagcctttggagggt

SEQ ID NO: 9220434 - DNA, 22 bp, Homo sapiens
agcccaggagcctttggagggt

SEQ ID NO: 9220435 - DNA, 22 bp, Homo sapiens
agccccttgcacttccccacgc

SEQ ID NO: 9220436 - DNA, 22 bp, Homo sapiens
agccccttgtgggcgcacagca

SEQ ID NO: 9220437 - DNA, 19 bp, Homo sapiens
agccccttggtactgtcct

SEQ ID NO: 9220438 - DNA, 19 bp, Homo sapiens
agcccccagacagcaggcc

SEQ ID NO: 9220439 - DNA, 22 bp, Homo sapiens
agccctagagctggaggtcagt

SEQ ID NO: 9220440 - DNA, 22 bp, Homo sapiens
cagagctggagggaaccctggc

SEQ ID NO: 9220441 - DNA, 23 bp, Homo sapiens
cagagctggctcagagctgcctg

SEQ ID NO: 9220442 - DNA, 17 bp, Homo sapiens
agcccccactcccaagt

SEQ ID NO: 9220443 - DNA, 22 bp, Homo sapiens
cagaagcagtgagagatgtgca

SEQ ID NO: 9220444 - DNA, 22 bp, Homo sapiens
cagaagcattccagcaaatagt

SEQ ID NO: 9220445 - DNA, 22 bp, Homo sapiens
cagaagcattccagcaaatagt

SEQ ID NO: 9220446 - DNA, 22 bp, Homo sapiens
cagaagcattgactccttgctc

SEQ ID NO: 9220447 - DNA, 22 bp, Homo sapiens
cagaagcattgactccttgctc

SEQ ID NO: 9220448 - DNA, 22 bp, Homo sapiens
cagaagctgaggagtgaggcaa

SEQ ID NO: 9220449 - DNA, 22 bp, Homo sapiens
cagaagctgcagtgatctggga

SEQ ID NO: 9220450 - DNA, 22 bp, Homo sapiens
cagaagctgcagtgatctggga

SEQ ID NO: 9220451 - DNA, 22 bp, Homo sapiens
cagaagcctgcctcagatgcac

SEQ ID NO: 9220452 - DNA, 22 bp, Homo sapiens
cagaagcctgcctcagatgcac

SEQ ID NO: 9220453 - DNA, 22 bp, Homo sapiens
cagaagcctgcctcagatgcac

SEQ ID NO: 9220454 - DNA, 22 bp, Homo sapiens
cagaactgttataacagctgtt

SEQ ID NO: 9220455 - DNA, 22 bp, Homo sapiens
cagaagaatggtgtctgagctc

SEQ ID NO: 9220456 - DNA, 22 bp, Homo sapiens
agccaggcagactctctttctt

SEQ ID NO: 9220457 - DNA, 21 bp, Homo sapiens
agccaggcaagcacccccact

SEQ ID NO: 9220458 - DNA, 21 bp, Homo sapiens
agccaggcaagcacccccact

SEQ ID NO: 9220459 - DNA, 22 bp, Homo sapiens
agccaggatcacccggggctgt

SEQ ID NO: 9220460 - DNA, 22 bp, Homo sapiens
cagacagacagccgtggccacc

SEQ ID NO: 9220461 - DNA, 22 bp, Homo sapiens
cagacagacagccgtggccacc

SEQ ID NO: 9220462 - DNA, 21 bp, Homo sapiens
agccagctatcacacagcatt

SEQ ID NO: 9220463 - DNA, 22 bp, Homo sapiens
agccagctccctcccctgcagg

SEQ ID NO: 9220464 - DNA, 22 bp, Homo sapiens
agccaggatggtctcgatcggc

SEQ ID NO: 9220465 - DNA, 22 bp, Homo sapiens
agccacaaaggcttgcctcgga

SEQ ID NO: 9220466 - DNA, 19 bp, Homo sapiens
agccacagaacttgcagga

SEQ ID NO: 9220467 - DNA, 19 bp, Homo sapiens
agccacagaacttgcagga

SEQ ID NO: 9220468 - DNA, 19 bp, Homo sapiens
agccacagaacttgcagga

SEQ ID NO: 9220469 - DNA, 22 bp, Homo sapiens
agccacagagcaggagaccttt

SEQ ID NO: 9220470 - DNA, 22 bp, Homo sapiens
agccacagagcaggagaccttt

SEQ ID NO: 9220471 - DNA, 22 bp, Homo sapiens
agccacagagcaggagaccttt

SEQ ID NO: 9220472 - DNA, 22 bp, Homo sapiens
agccacagagagggagctgcaa

SEQ ID NO: 9220473 - DNA, 22 bp, Homo sapiens
agccacagagagggagctgcaa

SEQ ID NO: 9220474 - DNA, 23 bp, Homo sapiens
agccacagccagagctatctcca

SEQ ID NO: 9220475 - DNA, 22 bp, Homo sapiens
agccacagcctgacttaactgt

SEQ ID NO: 9220476 - DNA, 22 bp, Homo sapiens
agccacagcacattgtaagaaa

SEQ ID NO: 9220477 - DNA, 22 bp, Homo sapiens
agccacagcaacaagtgcaatt

SEQ ID NO: 9220478 - DNA, 22 bp, Homo sapiens
cagaaatctccatgtcagacat

SEQ ID NO: 9220479 - DNA, 22 bp, Homo sapiens
agccacagctccttggtggaga

SEQ ID NO: 9220480 - DNA, 22 bp, Homo sapiens
agccacagcgaacctctcttcc

SEQ ID NO: 9220481 - DNA, 22 bp, Homo sapiens
cagaactggcctttcatcagtc

SEQ ID NO: 9220482 - DNA, 22 bp, Homo sapiens
cagaactgagtctcatggccat

SEQ ID NO: 9220483 - DNA, 23 bp, Homo sapiens
cagaaatgacagtaagcaccctg

SEQ ID NO: 9220484 - DNA, 22 bp, Homo sapiens
cagaaatgacaaagtaagagga

SEQ ID NO: 9220485 - DNA, 22 bp, Homo sapiens
agaatctttcctcattgctgtc

SEQ ID NO: 9220486 - DNA, 22 bp, Homo sapiens
agaatcttgtttcttgtgtgtt

SEQ ID NO: 9220487 - DNA, 22 bp, Homo sapiens
agaatctttctgaatgactgtg

SEQ ID NO: 9220488 - DNA, 22 bp, Homo sapiens
agaatcttgggcaaattcatct

SEQ ID NO: 9220489 - DNA, 22 bp, Homo sapiens
agaatgtgggggaaaagagtgt

SEQ ID NO: 9220490 - DNA, 22 bp, Homo sapiens
agaatgtgttattagagaagga

SEQ ID NO: 9220491 - DNA, 22 bp, Homo sapiens
agaatgtgttattagagaagga

SEQ ID NO: 9220492 - DNA, 22 bp, Homo sapiens
agaatgtaagaatgcaaagatt

SEQ ID NO: 9220493 - DNA, 22 bp, Homo sapiens
agacaatttttggttttgcaag

SEQ ID NO: 9220494 - DNA, 22 bp, Homo sapiens
agacaatttttggttttgcaag

SEQ ID NO: 9220495 - DNA, 22 bp, Homo sapiens
agacagtgagaatgagttgaaa

SEQ ID NO: 9220496 - DNA, 22 bp, Homo sapiens
agacagtgatggacaggcagac

SEQ ID NO: 9220497 - DNA, 22 bp, Homo sapiens
agacagtgcaagaagagcaggc

SEQ ID NO: 9220498 - DNA, 21 bp, Homo sapiens
atgcaggctgctcagaagcaa

SEQ ID NO: 9220499 - DNA, 22 bp, Homo sapiens
agacacagcagtgcctgcctca

SEQ ID NO: 9220500 - DNA, 22 bp, Homo sapiens
agacacagctaccataatacca

SEQ ID NO: 9220501 - DNA, 22 bp, Homo sapiens
agacacaggattctgcatttct

SEQ ID NO: 9220502 - DNA, 22 bp, Homo sapiens
agaaggcatcagaagtgtgtag

SEQ ID NO: 9220503 - DNA, 22 bp, Homo sapiens
agaaggctcatttgactgcatt

SEQ ID NO: 9220504 - DNA, 22 bp, Homo sapiens
agaatcactggaattgtttttt

SEQ ID NO: 9220505 - DNA, 22 bp, Homo sapiens
agaatacttgggaatgggttaa

SEQ ID NO: 9220506 - DNA, 22 bp, Homo sapiens
agaatacatctagtgctgcatg

SEQ ID NO: 9220507 - DNA, 22 bp, Homo sapiens
agaagagccctttaagggggaa

SEQ ID NO: 9220508 - DNA, 22 bp, Homo sapiens
agaagagcctggggaccatggc

SEQ ID NO: 9220509 - DNA, 20 bp, Homo sapiens
agaagaggatacaaccaggc

SEQ ID NO: 9220510 - DNA, 20 bp, Homo sapiens
agaagaggatacaaccaggc

SEQ ID NO: 9220511 - DNA, 20 bp, Homo sapiens
agaagaggatacaaccaggc

SEQ ID NO: 9220512 - DNA, 22 bp, Homo sapiens
agaagagaactgccaaacactt

SEQ ID NO: 9220513 - DNA, 22 bp, Homo sapiens
agaagcaaggtctgtcagtata

SEQ ID NO: 9220514 - DNA, 22 bp, Homo sapiens
atgtcaaatgctgcaaactcat

SEQ ID NO: 9220515 - DNA, 22 bp, Homo sapiens
atgtcaaatcagttttatcaga

SEQ ID NO: 9220516 - DNA, 22 bp, Homo sapiens
atgtcaaatcagttttatcaga

SEQ ID NO: 9220517 - DNA, 22 bp, Homo sapiens
atgtccaatttcagagtctcat

SEQ ID NO: 9220518 - DNA, 22 bp, Homo sapiens
atgtccagaggcttggtcccca

SEQ ID NO: 9220519 - DNA, 22 bp, Homo sapiens
atgtccagaggtgagtcagagc

SEQ ID NO: 9220520 - DNA, 22 bp, Homo sapiens
atgtacagtttctagactcaaa

SEQ ID NO: 9220521 - DNA, 22 bp, Homo sapiens
atgtccagggcacacagcagtg

SEQ ID NO: 9220522 - DNA, 22 bp, Homo sapiens
atggtttgtgtggcccagatga

SEQ ID NO: 9220523 - DNA, 22 bp, Homo sapiens
atggtttgtaacccaatactcc

SEQ ID NO: 9220524 - DNA, 22 bp, Homo sapiens
atgtaaaagattattttcctgt

SEQ ID NO: 9220525 - DNA, 22 bp, Homo sapiens
atgggaggatcacttgaggcca

SEQ ID NO: 9220526 - DNA, 22 bp, Homo sapiens
atgggaggaagagaagatgtct

SEQ ID NO: 9220527 - DNA, 22 bp, Homo sapiens
atgggaggaaggaggcccttga

SEQ ID NO: 9220528 - DNA, 22 bp, Homo sapiens
atgggaggcagcagagcccagc

SEQ ID NO: 9220529 - DNA, 22 bp, Homo sapiens
atgggaggcagcagagcccagc

SEQ ID NO: 9220530 - DNA, 22 bp, Homo sapiens
atgggaggcaggctcagaaccg

SEQ ID NO: 9220531 - DNA, 22 bp, Homo sapiens
atgggtggagggtgacacggat

SEQ ID NO: 9220532 - DNA, 22 bp, Homo sapiens
atgggaggcagcagagcccagc

SEQ ID NO: 9220533 - DNA, 22 bp, Homo sapiens
atgggaggcagacactaagttc

SEQ ID NO: 9220534 - DNA, 22 bp, Homo sapiens
atgggaggcaaagatcgcagaa

SEQ ID NO: 9220535 - DNA, 22 bp, Homo sapiens
atgggaggcaaagatcgcagaa

SEQ ID NO: 9220536 - DNA, 22 bp, Homo sapiens
atgggaggcaaagatcgcagaa

SEQ ID NO: 9220537 - DNA, 22 bp, Homo sapiens
atgggaggatgctcgggtgctc

SEQ ID NO: 9220538 - DNA, 22 bp, Homo sapiens
atggctgggtcaccatcagggt

SEQ ID NO: 9220539 - DNA, 22 bp, Homo sapiens
atggctgggcttttagtcagat

SEQ ID NO: 9220540 - DNA, 22 bp, Homo sapiens
atggcagcatagtggcaagtta

SEQ ID NO: 9220541 - DNA, 22 bp, Homo sapiens
atggagttctgccagcgctgct

SEQ ID NO: 9220542 - DNA, 22 bp, Homo sapiens
atggacagtactgagtggacta

SEQ ID NO: 9220543 - DNA, 22 bp, Homo sapiens
atggaaatcgatgtctaagtta

SEQ ID NO: 9220544 - DNA, 22 bp, Homo sapiens
atggaaatccaagtcaccgtag

SEQ ID NO: 9220545 - DNA, 22 bp, Homo sapiens
agactaaataatgatttactgg

SEQ ID NO: 9220546 - DNA, 22 bp, Homo sapiens
agactaaaagaaggaagctacc

SEQ ID NO: 9220547 - DNA, 20 bp, Homo sapiens
agactcagtttctatgctct

SEQ ID NO: 9220548 - DNA, 22 bp, Homo sapiens
agactattttgtgataactaat

SEQ ID NO: 9220549 - DNA, 22 bp, Homo sapiens
agactattacctaaaagataca

SEQ ID NO: 9220550 - DNA, 19 bp, Homo sapiens
atggaaaattgtactcaat

SEQ ID NO: 9220551 - DNA, 22 bp, Homo sapiens
atggaaatacacaagaggtttc

SEQ ID NO: 9220552 - DNA, 23 bp, Homo sapiens
atggaaatagcatgtgtcattta

SEQ ID NO: 9220553 - DNA, 22 bp, Homo sapiens
atggaaatacagccagagcaga

SEQ ID NO: 9220554 - DNA, 22 bp, Homo sapiens
atgcagggtctccgtgtgacga

SEQ ID NO: 9220555 - DNA, 22 bp, Homo sapiens
atttaaattttctgatggagag

SEQ ID NO: 9220556 - DNA, 22 bp, Homo sapiens
agagtggcccgttggcctgaac

SEQ ID NO: 9220557 - DNA, 23 bp, Homo sapiens
agagtggcctactcacactcatt

SEQ ID NO: 9220558 - DNA, 22 bp, Homo sapiens
atttaataccacttggtgcttt

SEQ ID NO: 9220559 - DNA, 22 bp, Homo sapiens
atttaagattgcgtattcatgt

SEQ ID NO: 9220560 - DNA, 23 bp, Homo sapiens
attcttcattatcttctagaaaa

SEQ ID NO: 9220561 - DNA, 22 bp, Homo sapiens
attcttcatgttgaagctgtca

SEQ ID NO: 9220562 - DNA, 22 bp, Homo sapiens
agagtgggacacgggcgctgtc

SEQ ID NO: 9220563 - DNA, 22 bp, Homo sapiens
agagtggcttgctcagctagca

SEQ ID NO: 9220564 - DNA, 22 bp, Homo sapiens
agagtggcttctttgacatgct

SEQ ID NO: 9220565 - DNA, 22 bp, Homo sapiens
agagtggggaaggtgttgagaa

SEQ ID NO: 9220566 - DNA, 22 bp, Homo sapiens
agagtggggaaggtgttgagaa

SEQ ID NO: 9220567 - DNA, 17 bp, Homo sapiens
agcaaaagtatcaaagc

SEQ ID NO: 9220568 - DNA, 22 bp, Homo sapiens
agcaaacagtgtgctaagaaat

SEQ ID NO: 9220569 - DNA, 19 bp, Homo sapiens
agatgtctatttgactatc

SEQ ID NO: 9220570 - DNA, 22 bp, Homo sapiens
agatgtggaacactagactgct

SEQ ID NO: 9220571 - DNA, 22 bp, Homo sapiens
agatgaaaagataagcagcaat

SEQ ID NO: 9220572 - DNA, 22 bp, Homo sapiens
agatgaaaagataagcagcaat

SEQ ID NO: 9220573 - DNA, 22 bp, Homo sapiens
agatgaaaagataagcagcaat

SEQ ID NO: 9220574 - DNA, 22 bp, Homo sapiens
agatgaagactcaggagcaggt

SEQ ID NO: 9220575 - DNA, 23 bp, Homo sapiens
agatgaaagcttcccatcacagt

SEQ ID NO: 9220576 - DNA, 22 bp, Homo sapiens
agatggtgagggcagaagtaac

SEQ ID NO: 9220577 - DNA, 22 bp, Homo sapiens
atttccaatctctgcatatggg

SEQ ID NO: 9220578 - DNA, 19 bp, Homo sapiens
atttccaagaattggagag

SEQ ID NO: 9220579 - DNA, 22 bp, Homo sapiens
atttccaagaaagctttaggat

SEQ ID NO: 9220580 - DNA, 21 bp, Homo sapiens
atttccaagggtacctaagat

SEQ ID NO: 9220581 - DNA, 22 bp, Homo sapiens
atttccaaaaccacttattgcc

SEQ ID NO: 9220582 - DNA, 22 bp, Homo sapiens
atgtcttctctgtaggtaaatt

SEQ ID NO: 9220583 - DNA, 23 bp, Homo sapiens
atgtgtgggaggtcagagagcca

SEQ ID NO: 9220584 - DNA, 22 bp, Homo sapiens
atgtgtgtaaacaagtataatt

SEQ ID NO: 9220585 - DNA, 22 bp, Homo sapiens
atgtgtgtacacacgtgactct

SEQ ID NO: 9220586 - DNA, 22 bp, Homo sapiens
atgtttgctattgttctagtgg

SEQ ID NO: 9220587 - DNA, 23 bp, Homo sapiens
atgtttgcagtaacccatcctgg

SEQ ID NO: 9220588 - DNA, 22 bp, Homo sapiens
atgtttctgaagtttacagata

SEQ ID NO: 9220589 - DNA, 22 bp, Homo sapiens
atgtttgtaggtaagtgacact

SEQ ID NO: 9220590 - DNA, 22 bp, Homo sapiens
atgtttgttgaacatctactgc

SEQ ID NO: 9220591 - DNA, 22 bp, Homo sapiens
atgtttgtgtttcccattcagg

SEQ ID NO: 9220592 - DNA, 22 bp, Homo sapiens
attaaagaaacccagcatgtga

SEQ ID NO: 9220593 - DNA, 22 bp, Homo sapiens
attaaagacagcagatggatgg

SEQ ID NO: 9220594 - DNA, 22 bp, Homo sapiens
attagcaaggcagcatcaggca

SEQ ID NO: 9220595 - DNA, 22 bp, Homo sapiens
attaaatactgcaggctaagca

SEQ ID NO: 9220596 - DNA, 22 bp, Homo sapiens
attcagctctgaatcagcagac

SEQ ID NO: 9220597 - DNA, 22 bp, Homo sapiens
attctctgtttccaagatgaaa

SEQ ID NO: 9220598 - DNA, 22 bp, Homo sapiens
attctctgtgtctgctttccca

SEQ ID NO: 9220599 - DNA, 22 bp, Homo sapiens
agaggggctcatatcctgtcat

SEQ ID NO: 9220600 - DNA, 19 bp, Homo sapiens
attcagcattctgcacttc

SEQ ID NO: 9220601 - DNA, 22 bp, Homo sapiens
attcagcataatcagtagcttg

SEQ ID NO: 9220602 - DNA, 22 bp, Homo sapiens
attcagcataatcagtagcttg

SEQ ID NO: 9220603 - DNA, 22 bp, Homo sapiens
attcagcagttcctgcttcagt

SEQ ID NO: 9220604 - DNA, 22 bp, Homo sapiens
attataaacctttgagggtggg

SEQ ID NO: 9220605 - DNA, 22 bp, Homo sapiens
attatacattttgtgtagagat

SEQ ID NO: 9220606 - DNA, 22 bp, Homo sapiens
actccaggggttgctatttaca

SEQ ID NO: 9220607 - DNA, 22 bp, Homo sapiens
actccagggctgaacgaggccc

SEQ ID NO: 9220608 - DNA, 22 bp, Homo sapiens
agtcgcagacatggtccccttt

SEQ ID NO: 9220609 - DNA, 22 bp, Homo sapiens
agtctctgaggttcagatgcct

SEQ ID NO: 9220610 - DNA, 22 bp, Homo sapiens
agtctctgcatgatgcagcaca

SEQ ID NO: 9220611 - DNA, 20 bp, Homo sapiens
agtctctgtagtgcctgaga

SEQ ID NO: 9220612 - DNA, 22 bp, Homo sapiens
actccaggcatctgcttctgct

SEQ ID NO: 9220613 - DNA, 19 bp, Homo sapiens
actccagggatgacagaag

SEQ ID NO: 9220614 - DNA, 19 bp, Homo sapiens
actccagggatgacagaag

SEQ ID NO: 9220615 - DNA, 22 bp, Homo sapiens
actccagggaggtgagtgtgcg

SEQ ID NO: 9220616 - DNA, 22 bp, Homo sapiens
actccaggatgtagaatcagag

SEQ ID NO: 9220617 - DNA, 22 bp, Homo sapiens
actccaggatgtagaatcagag

SEQ ID NO: 9220618 - DNA, 22 bp, Homo sapiens
actccagatgataagggacagt

SEQ ID NO: 9220619 - DNA, 22 bp, Homo sapiens
actccacaccacgggggccgcc

SEQ ID NO: 9220620 - DNA, 22 bp, Homo sapiens
actccagaatcctagggtcagc

SEQ ID NO: 9220621 - DNA, 22 bp, Homo sapiens
actgaaggaaacttttgtgttt

SEQ ID NO: 9220622 - DNA, 22 bp, Homo sapiens
actgaagagcgtgctatgctca

SEQ ID NO: 9220623 - DNA, 22 bp, Homo sapiens
actgaagagcgtgctatgctca

SEQ ID NO: 9220624 - DNA, 22 bp, Homo sapiens
actgaagaacgcatcagtggtt

SEQ ID NO: 9220625 - DNA, 23 bp, Homo sapiens
actgaaaggatcctagcagagac

SEQ ID NO: 9220626 - DNA, 22 bp, Homo sapiens
actgaaatactgctcttggatt

SEQ ID NO: 9220627 - DNA, 22 bp, Homo sapiens
actgaaaatgaattagaaacag

SEQ ID NO: 9220628 - DNA, 22 bp, Homo sapiens
actgaaatgaaatctatcatct

SEQ ID NO: 9220629 - DNA, 22 bp, Homo sapiens
agtctggccttgccttgtcgag

SEQ ID NO: 9220630 - DNA, 20 bp, Homo sapiens
agtctggcacctattcctgt

SEQ ID NO: 9220631 - DNA, 22 bp, Homo sapiens
agtctcttagatgtggacctgc

SEQ ID NO: 9220632 - DNA, 22 bp, Homo sapiens
agtctgggtgtgaatgaacttg

SEQ ID NO: 9220633 - DNA, 21 bp, Homo sapiens
agtctggggaagggatcccag

SEQ ID NO: 9220634 - DNA, 22 bp, Homo sapiens
actgcctgtagctcttcatctc

SEQ ID NO: 9220635 - DNA, 22 bp, Homo sapiens
actgcctgtgcactggtctttt

SEQ ID NO: 9220636 - DNA, 22 bp, Homo sapiens
actgcacacctccagggcacta

SEQ ID NO: 9220637 - DNA, 22 bp, Homo sapiens
actgcaaagggaagccctttct

SEQ ID NO: 9220638 - DNA, 21 bp, Homo sapiens
actgcaaacagcagagactga

SEQ ID NO: 9220639 - DNA, 22 bp, Homo sapiens
actgcaacacctcctgggttca

SEQ ID NO: 9220640 - DNA, 22 bp, Homo sapiens
actgcaacctccacctcctggg

SEQ ID NO: 9220641 - DNA, 22 bp, Homo sapiens
actgcaacctccacctcctggg

SEQ ID NO: 9220642 - DNA, 22 bp, Homo sapiens
agtggctgctggagtggagatg

SEQ ID NO: 9220643 - DNA, 22 bp, Homo sapiens
agtggctgcttctggttgctcc

SEQ ID NO: 9220644 - DNA, 22 bp, Homo sapiens
actgctcaaggatctggtaggg

SEQ ID NO: 9220645 - DNA, 20 bp, Homo sapiens
actgctgtagaccatctgca

SEQ ID NO: 9220646 - DNA, 22 bp, Homo sapiens
actgcttacaaaaggaaagaat

SEQ ID NO: 9220647 - DNA, 22 bp, Homo sapiens
actgcttcactgcgtcttatct

SEQ ID NO: 9220648 - DNA, 20 bp, Homo sapiens
actgcttctttctctgacct

SEQ ID NO: 9220649 - DNA, 20 bp, Homo sapiens
actgcttctttctctgacct

SEQ ID NO: 9220650 - DNA, 22 bp, Homo sapiens
agtggctgatgtaggcagtggg

SEQ ID NO: 9220651 - DNA, 19 bp, Homo sapiens
actcaagtctaatgaaatc

SEQ ID NO: 9220652 - DNA, 22 bp, Homo sapiens
actatgaatagccagatagtga

SEQ ID NO: 9220653 - DNA, 22 bp, Homo sapiens
actatagctcgggttataatgt

SEQ ID NO: 9220654 - DNA, 22 bp, Homo sapiens
actatataagattggcattttt

SEQ ID NO: 9220655 - DNA, 22 bp, Homo sapiens
acgggccttctcttcaggcgag

SEQ ID NO: 9220656 - DNA, 22 bp, Homo sapiens
acgggccttctcttcaggcgag

SEQ ID NO: 9220657 - DNA, 22 bp, Homo sapiens
actaaaaactactgccaatagc

SEQ ID NO: 9220658 - DNA, 22 bp, Homo sapiens
actaaagaacagttcgttcatg

SEQ ID NO: 9220659 - DNA, 22 bp, Homo sapiens
actaaagctcacagagttgaac

SEQ ID NO: 9220660 - DNA, 19 bp, Homo sapiens
actaaaaatgatgtttgag

SEQ ID NO: 9220661 - DNA, 19 bp, Homo sapiens
actaaaaatgatgtttgag

SEQ ID NO: 9220662 - DNA, 22 bp, Homo sapiens
accttcacctccacaccttggg

SEQ ID NO: 9220663 - DNA, 22 bp, Homo sapiens
accttcaactcaaagtgtccca

SEQ ID NO: 9220664 - DNA, 22 bp, Homo sapiens
accttcaagaaacatttccttg

SEQ ID NO: 9220665 - DNA, 21 bp, Homo sapiens
accttcaagccagaggtggtc

SEQ ID NO: 9220666 - DNA, 22 bp, Homo sapiens
accttaaaactgacacatggag

SEQ ID NO: 9220667 - DNA, 22 bp, Homo sapiens
acctgtggatcagattcttgta

SEQ ID NO: 9220668 - DNA, 22 bp, Homo sapiens
aggtacatgtgaccacttgggg

SEQ ID NO: 9220669 - DNA, 22 bp, Homo sapiens
aggtacataggaaagtggagct

SEQ ID NO: 9220670 - DNA, 23 bp, Homo sapiens
acctgctccatgtcaccttcact

SEQ ID NO: 9220671 - DNA, 22 bp, Homo sapiens
acctgctcaactggcttctcgc

SEQ ID NO: 9220672 - DNA, 22 bp, Homo sapiens
acctgccttctcaaggacatga

SEQ ID NO: 9220673 - DNA, 22 bp, Homo sapiens
acctggacacctgctgtcatct

SEQ ID NO: 9220674 - DNA, 22 bp, Homo sapiens
acctggaagtgggtgctatggc

SEQ ID NO: 9220675 - DNA, 22 bp, Homo sapiens
acctggacacctgctgtcatct

SEQ ID NO: 9220676 - DNA, 20 bp, Homo sapiens
agggtggggacgttctgact

SEQ ID NO: 9220677 - DNA, 20 bp, Homo sapiens
agggtggggacgttctgact

SEQ ID NO: 9220678 - DNA, 22 bp, Homo sapiens
agggtgggctagactcttcccc

SEQ ID NO: 9220679 - DNA, 22 bp, Homo sapiens
agggtgggctagactcttcccc

SEQ ID NO: 9220680 - DNA, 22 bp, Homo sapiens
agggtgggctagactcttcccc

SEQ ID NO: 9220681 - DNA, 22 bp, Homo sapiens
agggctttcggcactctgaggg

SEQ ID NO: 9220682 - DNA, 22 bp, Homo sapiens
agggctgtaccatcaggttcct

SEQ ID NO: 9220683 - DNA, 22 bp, Homo sapiens
agggctgtttttggcacctggg

SEQ ID NO: 9220684 - DNA, 22 bp, Homo sapiens
agggctggtatgtccatgaaag

SEQ ID NO: 9220685 - DNA, 22 bp, Homo sapiens
acctccccgggagcagcctcct

SEQ ID NO: 9220686 - DNA, 22 bp, Homo sapiens
acctccccgggagcagcctcct

SEQ ID NO: 9220687 - DNA, 22 bp, Homo sapiens
acctccccacatggtagtgagt

SEQ ID NO: 9220688 - DNA, 22 bp, Homo sapiens
acctccccattaggtcacccac

SEQ ID NO: 9220689 - DNA, 22 bp, Homo sapiens
acctccccattaggtcacccac

SEQ ID NO: 9220690 - DNA, 18 bp, Homo sapiens
acctccccattttctgaa

SEQ ID NO: 9220691 - DNA, 22 bp, Homo sapiens
acctcccctcaccaatctggtt

SEQ ID NO: 9220692 - DNA, 22 bp, Homo sapiens
acctcccctgactcgaaaccca

SEQ ID NO: 9220693 - DNA, 20 bp, Homo sapiens
acctccctctgtgggtggga

SEQ ID NO: 9220694 - DNA, 22 bp, Homo sapiens
agggtggggtgctacatcttta

SEQ ID NO: 9220695 - DNA, 20 bp, Homo sapiens
agggtggggacgttctgact

SEQ ID NO: 9220696 - DNA, 22 bp, Homo sapiens
agggtggggtgctacatcttta

SEQ ID NO: 9220697 - DNA, 22 bp, Homo sapiens
agggtggggtgctacatcttta

SEQ ID NO: 9220698 - DNA, 22 bp, Homo sapiens
acctcccagctctgagcttggg

SEQ ID NO: 9220699 - DNA, 22 bp, Homo sapiens
agtttacatcttcaatctcatt

SEQ ID NO: 9220700 - DNA, 22 bp, Homo sapiens
actggcagtagagggagcgcat

SEQ ID NO: 9220701 - DNA, 22 bp, Homo sapiens
actggcaggctgctggccggcg

SEQ ID NO: 9220702 - DNA, 20 bp, Homo sapiens
actggcagcctgcctgctgt

SEQ ID NO: 9220703 - DNA, 22 bp, Homo sapiens
actggcagtttgagaatgcatt

SEQ ID NO: 9220704 - DNA, 22 bp, Homo sapiens
agttgctacctctctgtgctcc

SEQ ID NO: 9220705 - DNA, 22 bp, Homo sapiens
agtttacacttttgattcttat

SEQ ID NO: 9220706 - DNA, 22 bp, Homo sapiens
actgtgaacggactgaagccca

SEQ ID NO: 9220707 - DNA, 22 bp, Homo sapiens
actgtgcctttcacttgcactt

SEQ ID NO: 9220708 - DNA, 22 bp, Homo sapiens
actgtgccacaattcaccaggg

SEQ ID NO: 9220709 - DNA, 22 bp, Homo sapiens
actgtgtaaatctgaaagtcta

SEQ ID NO: 9220710 - DNA, 21 bp, Homo sapiens
agtttcctcaactgcagaagg

SEQ ID NO: 9220711 - DNA, 22 bp, Homo sapiens
agtttccaaatattgttttagc

SEQ ID NO: 9220712 - DNA, 22 bp, Homo sapiens
acttcacttgtaaatgcagcct

SEQ ID NO: 9220713 - DNA, 22 bp, Homo sapiens
acttagaattaaatatttttgg

SEQ ID NO: 9220714 - DNA, 22 bp, Homo sapiens
actgtgttaaatacagagatgg

SEQ ID NO: 9220715 - DNA, 22 bp, Homo sapiens
actgttaaagtaattaattgtc

SEQ ID NO: 9220716 - DNA, 19 bp, Homo sapiens
actgtgtggaagtgtgatt

SEQ ID NO: 9220717 - DNA, 22 bp, Homo sapiens
actgtgtgaaacatcaatgtgt

SEQ ID NO: 9220718 - DNA, 22 bp, Homo sapiens
acttccaagtttattcatgtga

SEQ ID NO: 9220719 - DNA, 22 bp, Homo sapiens
acttccagaattagaatttaag

SEQ ID NO: 9220720 - DNA, 22 bp, Homo sapiens
acttccagagggtgtggaaata

SEQ ID NO: 9220721 - DNA, 22 bp, Homo sapiens
acttctttcacaatgtttctag

SEQ ID NO: 9220722 - DNA, 21 bp, Homo sapiens
acttggcagaacgcagaaggc

SEQ ID NO: 9220723 - DNA, 22 bp, Homo sapiens
acttggctgggagagttgaaga

SEQ ID NO: 9220724 - DNA, 22 bp, Homo sapiens
acttggctttagtagtaactga

SEQ ID NO: 9220725 - DNA, 22 bp, Homo sapiens
acttgggaaagaagtttcaccg

SEQ ID NO: 9220726 - DNA, 22 bp, Homo sapiens
acttgggaaaggaagaattgca

SEQ ID NO: 9220727 - DNA, 22 bp, Homo sapiens
acttgccccagaattgctgctg

SEQ ID NO: 9220728 - DNA, 22 bp, Homo sapiens
agaaaatttattcatgttagtt

SEQ ID NO: 9220729 - DNA, 22 bp, Homo sapiens
agaaaattagattttactgtgt

SEQ ID NO: 9220730 - DNA, 22 bp, Homo sapiens
agaaaattagattttactgtgt

SEQ ID NO: 9220731 - DNA, 22 bp, Homo sapiens
atatcttttagagcaagcttgt

SEQ ID NO: 9220732 - DNA, 22 bp, Homo sapiens
atatatttgagaatattcatga

SEQ ID NO: 9220733 - DNA, 22 bp, Homo sapiens
atatatttactctcctgttgca

SEQ ID NO: 9220734 - DNA, 22 bp, Homo sapiens
atatatttactctcctgttgca

SEQ ID NO: 9220735 - DNA, 22 bp, Homo sapiens
atatatttgagaatattcatga

SEQ ID NO: 9220736 - DNA, 22 bp, Homo sapiens
atatctgtgtttcccttttgct

SEQ ID NO: 9220737 - DNA, 22 bp, Homo sapiens
atataatttttggttagctcaa

SEQ ID NO: 9220738 - DNA, 22 bp, Homo sapiens
atataattctcaggtttgacta

SEQ ID NO: 9220739 - DNA, 22 bp, Homo sapiens
atataattctcaggtttgacta

SEQ ID NO: 9220740 - DNA, 22 bp, Homo sapiens
atataattgttctgaagtgttt

SEQ ID NO: 9220741 - DNA, 22 bp, Homo sapiens
atataatttttggttagctcaa

SEQ ID NO: 9220742 - DNA, 22 bp, Homo sapiens
atagttgtgtggggattctggt

SEQ ID NO: 9220743 - DNA, 22 bp, Homo sapiens
acttgggatttcagatgctgtg

SEQ ID NO: 9220744 - DNA, 22 bp, Homo sapiens
acttgggatggtggccagagcg

SEQ ID NO: 9220745 - DNA, 22 bp, Homo sapiens
acttgggagttctggaagcctg

SEQ ID NO: 9220746 - DNA, 22 bp, Homo sapiens
acttgggagggtgtgggcagct

SEQ ID NO: 9220747 - DNA, 18 bp, Homo sapiens
acttgggacttttgcatt

SEQ ID NO: 9220748 - DNA, 22 bp, Homo sapiens
acttgggaggctgaaggacatt

SEQ ID NO: 9220749 - DNA, 22 bp, Homo sapiens
atcaattttgaggatacaagaa

SEQ ID NO: 9220750 - DNA, 22 bp, Homo sapiens
agaaacatcttggcaactggaa

SEQ ID NO: 9220751 - DNA, 22 bp, Homo sapiens
agaaacatcattggaacacaag

SEQ ID NO: 9220752 - DNA, 22 bp, Homo sapiens
agaaacagcattagcatcaatt

SEQ ID NO: 9220753 - DNA, 22 bp, Homo sapiens
agaaacagcattagcatcaatt

SEQ ID NO: 9220754 - DNA, 22 bp, Homo sapiens
agaaacagcattagcatcaatt

SEQ ID NO: 9220755 - DNA, 22 bp, Homo sapiens
agaaacagaagggaaagctttt

SEQ ID NO: 9220756 - DNA, 22 bp, Homo sapiens
atcagagtgtaagttctttcct

SEQ ID NO: 9220757 - DNA, 22 bp, Homo sapiens
atccagaatgtcttgctggaga

SEQ ID NO: 9220758 - DNA, 22 bp, Homo sapiens
atccagagacccaaggacagaa

SEQ ID NO: 9220759 - DNA, 22 bp, Homo sapiens
atccagacagtctggtgccaga

SEQ ID NO: 9220760 - DNA, 22 bp, Homo sapiens
atccagacagtctggtgccaga

SEQ ID NO: 9220761 - DNA, 22 bp, Homo sapiens
agaaccttggtgagtctaacct

SEQ ID NO: 9220762 - DNA, 21 bp, Homo sapiens
agaaccttggatgccattgca

SEQ ID NO: 9220763 - DNA, 22 bp, Homo sapiens
agaaccttcagcttgcaacaag

SEQ ID NO: 9220764 - DNA, 22 bp, Homo sapiens
agaaccttccatcactccctac

SEQ ID NO: 9220765 - DNA, 22 bp, Homo sapiens
agaaccttgatcttggacttct

SEQ ID NO: 9220766 - DNA, 22 bp, Homo sapiens
atccagctttgtctggtcttcg

SEQ ID NO: 9220767 - DNA, 23 bp, Homo sapiens
atccagcctgggggtttaaccac

SEQ ID NO: 9220768 - DNA, 19 bp, Homo sapiens
atcagcaaggtaggatgtg

SEQ ID NO: 9220769 - DNA, 22 bp, Homo sapiens
atcatttatgccccaattagat

SEQ ID NO: 9220770 - DNA, 22 bp, Homo sapiens
agggcatctagttccctctctt

SEQ ID NO: 9220771 - DNA, 22 bp, Homo sapiens
agggcatctctaacagtctcct

SEQ ID NO: 9220772 - DNA, 22 bp, Homo sapiens
agggcagcttccatagtctggc

SEQ ID NO: 9220773 - DNA, 22 bp, Homo sapiens
accatttaaggaaaatgtatca

SEQ ID NO: 9220774 - DNA, 22 bp, Homo sapiens
accatgttggccaagctggtct

SEQ ID NO: 9220775 - DNA, 22 bp, Homo sapiens
acccaggctgcttctcagtggc

SEQ ID NO: 9220776 - DNA, 22 bp, Homo sapiens
acccaggctggagtgcagtagc

SEQ ID NO: 9220777 - DNA, 22 bp, Homo sapiens
agggcctgggccagcacccttt

SEQ ID NO: 9220778 - DNA, 22 bp, Homo sapiens
agggcctgggatgtcctcctag

SEQ ID NO: 9220779 - DNA, 22 bp, Homo sapiens
acccaggctagggtgcagtggc

SEQ ID NO: 9220780 - DNA, 22 bp, Homo sapiens
acccaggctagggtgcagtggc

SEQ ID NO: 9220781 - DNA, 22 bp, Homo sapiens
acccaggctagggtgcagtggc

SEQ ID NO: 9220782 - DNA, 22 bp, Homo sapiens
acccaggctagagtgcagtggt

SEQ ID NO: 9220783 - DNA, 22 bp, Homo sapiens
acccaggctagagtgcagtggt

SEQ ID NO: 9220784 - DNA, 22 bp, Homo sapiens
acccaggcgggagtgcagtgtc

SEQ ID NO: 9220785 - DNA, 22 bp, Homo sapiens
acccaggcgggagtgcagtgtc

SEQ ID NO: 9220786 - DNA, 22 bp, Homo sapiens
acccaggctagagtgcagtggt

SEQ ID NO: 9220787 - DNA, 22 bp, Homo sapiens
acccaggcctgagagacaggag

SEQ ID NO: 9220788 - DNA, 22 bp, Homo sapiens
acccaggcgggagtgcagtgtc

SEQ ID NO: 9220789 - DNA, 22 bp, Homo sapiens
acccgggaggcaggagtcatag

SEQ ID NO: 9220790 - DNA, 22 bp, Homo sapiens
accctcaacaaattcactctat

SEQ ID NO: 9220791 - DNA, 22 bp, Homo sapiens
acccgccctcagccttaccgtg

SEQ ID NO: 9220792 - DNA, 22 bp, Homo sapiens
accccaggaagtggaggtcatg

SEQ ID NO: 9220793 - DNA, 22 bp, Homo sapiens
agggcctggtgacctgggtcct

SEQ ID NO: 9220794 - DNA, 22 bp, Homo sapiens
accaggagttgggggtgggacc

SEQ ID NO: 9220795 - DNA, 22 bp, Homo sapiens
agggacagtatccatctcacag

SEQ ID NO: 9220796 - DNA, 22 bp, Homo sapiens
accaggcccaccgcatgctcct

SEQ ID NO: 9220797 - DNA, 20 bp, Homo sapiens
accaggccccgggccctgca

SEQ ID NO: 9220798 - DNA, 20 bp, Homo sapiens
accaggcccggtgtctcctc

SEQ ID NO: 9220799 - DNA, 22 bp, Homo sapiens
accaggcccgctgctatggtgg

SEQ ID NO: 9220800 - DNA, 22 bp, Homo sapiens
agggagctaggatcctgaaggt

SEQ ID NO: 9220801 - DNA, 22 bp, Homo sapiens
accaggcctagcaagtacatta

SEQ ID NO: 9220802 - DNA, 22 bp, Homo sapiens
accaggccctccagctgcgtgg

SEQ ID NO: 9220803 - DNA, 22 bp, Homo sapiens
agggaagaggaccagagtctct

SEQ ID NO: 9220804 - DNA, 22 bp, Homo sapiens
agggaattcactggaacgccct

SEQ ID NO: 9220805 - DNA, 21 bp, Homo sapiens
agggacacacaggatggggct

SEQ ID NO: 9220806 - DNA, 22 bp, Homo sapiens
agggacagatgaatgactgagt

SEQ ID NO: 9220807 - DNA, 22 bp, Homo sapiens
aggctggagtgtgcagtggcgc

SEQ ID NO: 9220808 - DNA, 22 bp, Homo sapiens
aggctggagtgtgcagtggcgc

SEQ ID NO: 9220809 - DNA, 22 bp, Homo sapiens
aggctggcaaggcagatgtgtg

SEQ ID NO: 9220810 - DNA, 22 bp, Homo sapiens
aggctggcagccacctcagcag

SEQ ID NO: 9220811 - DNA, 22 bp, Homo sapiens
agggaagagcttgcaagaaacc

SEQ ID NO: 9220812 - DNA, 22 bp, Homo sapiens
agggaagagcttgcaagaaacc

SEQ ID NO: 9220813 - DNA, 22 bp, Homo sapiens
acatttttactgggcatctgca

SEQ ID NO: 9220814 - DNA, 22 bp, Homo sapiens
acatttttatcctgagtgccag

SEQ ID NO: 9220815 - DNA, 22 bp, Homo sapiens
acatttttattcatcaaagcag

SEQ ID NO: 9220816 - DNA, 22 bp, Homo sapiens
acatttttctaggaggcaaggt

SEQ ID NO: 9220817 - DNA, 22 bp, Homo sapiens
acatttttcacatttgtagggt

SEQ ID NO: 9220818 - DNA, 22 bp, Homo sapiens
accaaaacctgctactaaagga

SEQ ID NO: 9220819 - DNA, 22 bp, Homo sapiens
acatttttgggttgatgtctga

SEQ ID NO: 9220820 - DNA, 22 bp, Homo sapiens
acattttttagagtcccacatt

SEQ ID NO: 9220821 - DNA, 22 bp, Homo sapiens
acatgaaagttattctgagttg

SEQ ID NO: 9220822 - DNA, 22 bp, Homo sapiens
aggcagggaccagttgttttct

SEQ ID NO: 9220823 - DNA, 22 bp, Homo sapiens
acatggcaaaagggactttaca

SEQ ID NO: 9220824 - DNA, 22 bp, Homo sapiens
acatggcattcactcccacagg

SEQ ID NO: 9220825 - DNA, 22 bp, Homo sapiens
acatggcacccagatctcaaaa

SEQ ID NO: 9220826 - DNA, 22 bp, Homo sapiens
acatggcaggaatcatgtgttt

SEQ ID NO: 9220827 - DNA, 22 bp, Homo sapiens
aggccctgttatgagccactgt

SEQ ID NO: 9220828 - DNA, 22 bp, Homo sapiens
aggccctgttatgagccactgt

SEQ ID NO: 9220829 - DNA, 22 bp, Homo sapiens
aggccctgtccatggtgctgaa

SEQ ID NO: 9220830 - DNA, 22 bp, Homo sapiens
aggccctgtccatggtgctgaa

SEQ ID NO: 9220831 - DNA, 22 bp, Homo sapiens
aggccctggtcaggtctggctg

SEQ ID NO: 9220832 - DNA, 22 bp, Homo sapiens
aggctgatgctggctgaggctg

SEQ ID NO: 9220833 - DNA, 22 bp, Homo sapiens
aggctgagtttctcattctcgc

SEQ ID NO: 9220834 - DNA, 22 bp, Homo sapiens
aggctgagggctcctgagggca

SEQ ID NO: 9220835 - DNA, 22 bp, Homo sapiens
aggctgaggctggcagctccag

SEQ ID NO: 9220836 - DNA, 22 bp, Homo sapiens
acatttaccctggaacattgga

SEQ ID NO: 9220837 - DNA, 22 bp, Homo sapiens
acatttacttatcaaaagtcag

SEQ ID NO: 9220838 - DNA, 22 bp, Homo sapiens
aggccttggaagccagggagcc

SEQ ID NO: 9220839 - DNA, 22 bp, Homo sapiens
aggccttgccaatgagagaact

SEQ ID NO: 9220840 - DNA, 22 bp, Homo sapiens
aggccttaccatagctgtagca

SEQ ID NO: 9220841 - DNA, 22 bp, Homo sapiens
acatttaaccaaactgtttaat

SEQ ID NO: 9220842 - DNA, 22 bp, Homo sapiens
aggctaggggcagtgccagcat

SEQ ID NO: 9220843 - DNA, 22 bp, Homo sapiens
aggctatttccactcttctcat

SEQ ID NO: 9220844 - DNA, 22 bp, Homo sapiens
aggctaggcatgtgctaccaca

SEQ ID NO: 9220845 - DNA, 22 bp, Homo sapiens
aggctaggaacagcccggccct

SEQ ID NO: 9220846 - DNA, 22 bp, Homo sapiens
aggctaggccttgccctggaac

SEQ ID NO: 9220847 - DNA, 22 bp, Homo sapiens
aggctaggccttgccctggaac

SEQ ID NO: 9220848 - DNA, 22 bp, Homo sapiens
aggctaggcatgtgctaccaca

SEQ ID NO: 9220849 - DNA, 22 bp, Homo sapiens
aggctagggccatggctggtga

SEQ ID NO: 9220850 - DNA, 22 bp, Homo sapiens
aggctaggctgatgcctcttcc

SEQ ID NO: 9220851 - DNA, 22 bp, Homo sapiens
acaggctgggcgcttcctgcgg

SEQ ID NO: 9220852 - DNA, 22 bp, Homo sapiens
acaggctgggcgcttcctgcgg

SEQ ID NO: 9220853 - DNA, 22 bp, Homo sapiens
acaggctgggcgcttcctgcgg

SEQ ID NO: 9220854 - DNA, 22 bp, Homo sapiens
acaggctggtggtcctggccat

SEQ ID NO: 9220855 - DNA, 22 bp, Homo sapiens
acaggctggaggaggaccaaga

SEQ ID NO: 9220856 - DNA, 22 bp, Homo sapiens
acaggctgctgggctccgtgct

SEQ ID NO: 9220857 - DNA, 22 bp, Homo sapiens
acaggctgctgggctccgtgct

SEQ ID NO: 9220858 - DNA, 22 bp, Homo sapiens
acaggctgctgggctccgtgct

SEQ ID NO: 9220859 - DNA, 22 bp, Homo sapiens
acaggctgcccgctccccacct

SEQ ID NO: 9220860 - DNA, 22 bp, Homo sapiens
acaggctgcctaccaagtatca

SEQ ID NO: 9220861 - DNA, 22 bp, Homo sapiens
acaggctgcccgctccccacct

SEQ ID NO: 9220862 - DNA, 22 bp, Homo sapiens
acaggctgctgagccatttgct

SEQ ID NO: 9220863 - DNA, 22 bp, Homo sapiens
acaggctgctgagccatttgct

SEQ ID NO: 9220864 - DNA, 22 bp, Homo sapiens
acaggctgcctaccaagtatca

SEQ ID NO: 9220865 - DNA, 22 bp, Homo sapiens
acaggctgccacttgcatccaa

SEQ ID NO: 9220866 - DNA, 22 bp, Homo sapiens
acaggctctggggcaggatggc

SEQ ID NO: 9220867 - DNA, 22 bp, Homo sapiens
acaggctggtttgtaaaagatg

SEQ ID NO: 9220868 - DNA, 22 bp, Homo sapiens
acaggctgtacttctaatcatc

SEQ ID NO: 9220869 - DNA, 18 bp, Homo sapiens
acaggctgtgggaatggt

SEQ ID NO: 9220870 - DNA, 18 bp, Homo sapiens
acaggctgtgggaatggt

SEQ ID NO: 9220871 - DNA, 22 bp, Homo sapiens
aggaatgacttgtagctctgag

SEQ ID NO: 9220872 - DNA, 22 bp, Homo sapiens
aggaagggctgtttctccaaga

SEQ ID NO: 9220873 - DNA, 22 bp, Homo sapiens
acaggccataaaggcaggccct

SEQ ID NO: 9220874 - DNA, 23 bp, Homo sapiens
acagcttcctactttgctgctgc

SEQ ID NO: 9220875 - DNA, 22 bp, Homo sapiens
acagctgtgttttataatcagc

SEQ ID NO: 9220876 - DNA, 22 bp, Homo sapiens
acagcacaggagttgaatgggc

SEQ ID NO: 9220877 - DNA, 22 bp, Homo sapiens
agctgccagatgacagtgctat

SEQ ID NO: 9220878 - DNA, 22 bp, Homo sapiens
agctgccatcctgttcagcacc

SEQ ID NO: 9220879 - DNA, 17 bp, Homo sapiens
agctgccttgcttgagc

SEQ ID NO: 9220880 - DNA, 17 bp, Homo sapiens
agctgccttgcttgagc

SEQ ID NO: 9220881 - DNA, 20 bp, Homo sapiens
agctgccttcattttctaga

SEQ ID NO: 9220882 - DNA, 22 bp, Homo sapiens
agctgccttccctctcattagg

SEQ ID NO: 9220883 - DNA, 22 bp, Homo sapiens
agctgcctttgcatcactttaa

SEQ ID NO: 9220884 - DNA, 21 bp, Homo sapiens
agctgcctttagagagaacca

SEQ ID NO: 9220885 - DNA, 22 bp, Homo sapiens
agctgctatgacaacaccagcc

SEQ ID NO: 9220886 - DNA, 22 bp, Homo sapiens
agctgccttttgagaaagctca

SEQ ID NO: 9220887 - DNA, 22 bp, Homo sapiens
acagcctgctgcctgcttcttg

SEQ ID NO: 9220888 - DNA, 22 bp, Homo sapiens
agctgcctgtaaaatgtgtgat

SEQ ID NO: 9220889 - DNA, 15 bp, Homo sapiens
agctgcctgggtgct

SEQ ID NO: 9220890 - DNA, 22 bp, Homo sapiens
agctgcctgggcttgtacacct

SEQ ID NO: 9220891 - DNA, 22 bp, Homo sapiens
agctgccttatggagtatgaaa

SEQ ID NO: 9220892 - DNA, 22 bp, Homo sapiens
agctgccttaaattactttgtg

SEQ ID NO: 9220893 - DNA, 22 bp, Homo sapiens
agctgccttatggagtatgaaa

SEQ ID NO: 9220894 - DNA, 22 bp, Homo sapiens
agctgcctgtgtagaaccatct

SEQ ID NO: 9220895 - DNA, 22 bp, Homo sapiens
agctgcctgtcctaggccatca

SEQ ID NO: 9220896 - DNA, 22 bp, Homo sapiens
agctgcctgtgctgggagccca

SEQ ID NO: 9220897 - DNA, 19 bp, Homo sapiens
agctgcctgtgcgcgcccg

SEQ ID NO: 9220898 - DNA, 22 bp, Homo sapiens
agctggggttgcacacattttg

SEQ ID NO: 9220899 - DNA, 22 bp, Homo sapiens
agctgggtacagcctgtgccta

SEQ ID NO: 9220900 - DNA, 22 bp, Homo sapiens
acagctcagacatcactgctct

SEQ ID NO: 9220901 - DNA, 22 bp, Homo sapiens
acagctcttcttcaagcctggc

SEQ ID NO: 9220902 - DNA, 22 bp, Homo sapiens
acagctcttaggcagaaccaac

SEQ ID NO: 9220903 - DNA, 22 bp, Homo sapiens
acagctctgggtgcaggaggtg

SEQ ID NO: 9220904 - DNA, 22 bp, Homo sapiens
acagctctgggtgcaggaggtg

SEQ ID NO: 9220905 - DNA, 22 bp, Homo sapiens
acagctctgagatattactatt

SEQ ID NO: 9220906 - DNA, 22 bp, Homo sapiens
acagctctccctcagagaaatg

SEQ ID NO: 9220907 - DNA, 22 bp, Homo sapiens
acagctctccctcagagaaatg

SEQ ID NO: 9220908 - DNA, 22 bp, Homo sapiens
aggaggaaaaaggccacagcaa

SEQ ID NO: 9220909 - DNA, 22 bp, Homo sapiens
aggaggaaagaaggcccccagc

SEQ ID NO: 9220910 - DNA, 22 bp, Homo sapiens
aggaggaaagaaggcccccagc

SEQ ID NO: 9220911 - DNA, 22 bp, Homo sapiens
aggaggaaagaaggcccccagc

SEQ ID NO: 9220912 - DNA, 22 bp, Homo sapiens
aggaggaactcagaaagaaggt

SEQ ID NO: 9220913 - DNA, 22 bp, Homo sapiens
acagtacaagcatgatacataa

SEQ ID NO: 9220914 - DNA, 22 bp, Homo sapiens
aggagtccatgagcagctagag

SEQ ID NO: 9220915 - DNA, 22 bp, Homo sapiens
aggagtccatgagcagctagag

SEQ ID NO: 9220916 - DNA, 22 bp, Homo sapiens
aggagtcccactgtcaatgcta

SEQ ID NO: 9220917 - DNA, 22 bp, Homo sapiens
aggagtcctcatgtctgtgcga

SEQ ID NO: 9220918 - DNA, 20 bp, Homo sapiens
aggagtccctgtgctctctc

SEQ ID NO: 9220919 - DNA, 22 bp, Homo sapiens
aggagtcctcatgtctgtgcga

SEQ ID NO: 9220920 - DNA, 22 bp, Homo sapiens
aggagtgcaaatagtccagaga

SEQ ID NO: 9220921 - DNA, 22 bp, Homo sapiens
acaggtggccccgagggagtgg

SEQ ID NO: 9220922 - DNA, 21 bp, Homo sapiens
aggagctgtgttagctggtcg

SEQ ID NO: 9220923 - DNA, 22 bp, Homo sapiens
aggagcttcagagagaacctgg

SEQ ID NO: 9220924 - DNA, 22 bp, Homo sapiens
aggagctgttttgttcagcaaa

SEQ ID NO: 9220925 - DNA, 22 bp, Homo sapiens
acagggtggggatggtgagctt

SEQ ID NO: 9220926 - DNA, 22 bp, Homo sapiens
acaggtggacacagcagcagtc

SEQ ID NO: 9220927 - DNA, 22 bp, Homo sapiens
acaggtggagtggttagcaggc

SEQ ID NO: 9220928 - DNA, 22 bp, Homo sapiens
acagggagtctgaggggatagt

SEQ ID NO: 9220929 - DNA, 18 bp, Homo sapiens
acagggagggcgctgggg

SEQ ID NO: 9220930 - DNA, 22 bp, Homo sapiens
acagggcaacctctgggagact

SEQ ID NO: 9220931 - DNA, 22 bp, Homo sapiens
aggcagctggaggcagagacta

SEQ ID NO: 9220932 - DNA, 22 bp, Homo sapiens
aggcagctggaggcagagacta

SEQ ID NO: 9220933 - DNA, 22 bp, Homo sapiens
aggcaggattgctgacaacaat

SEQ ID NO: 9220934 - DNA, 22 bp, Homo sapiens
aggcaggattgctgacaacaat

SEQ ID NO: 9220935 - DNA, 22 bp, Homo sapiens
acagttaggtcctaaaattctg

SEQ ID NO: 9220936 - DNA, 22 bp, Homo sapiens
acagttaatatgtgacagaact

SEQ ID NO: 9220937 - DNA, 22 bp, Homo sapiens
acagttaatcaaatggcatatg

SEQ ID NO: 9220938 - DNA, 22 bp, Homo sapiens
acagttaattaacattaagggg

SEQ ID NO: 9220939 - DNA, 22 bp, Homo sapiens
acagttaataagtagtaagtca

SEQ ID NO: 9220940 - DNA, 22 bp, Homo sapiens
acagtgcaaaccctcgggaaag

SEQ ID NO: 9220941 - DNA, 22 bp, Homo sapiens
acagtgttttcttaaggagaaa

SEQ ID NO: 9220942 - DNA, 22 bp, Homo sapiens
acagtgttttcttaaggagaaa

SEQ ID NO: 9220943 - DNA, 22 bp, Homo sapiens
acagtgttttgtctggcagggc

SEQ ID NO: 9220944 - DNA, 22 bp, Homo sapiens
acagtgttttatgagaattgtt

SEQ ID NO: 9220945 - DNA, 22 bp, Homo sapiens
acagttaagcagtatgatcaca

SEQ ID NO: 9220946 - DNA, 22 bp, Homo sapiens
acagttaaatatttctactggg

SEQ ID NO: 9220947 - DNA, 20 bp, Homo sapiens
acagtgtttttgagtagagc

SEQ ID NO: 9220948 - DNA, 22 bp, Homo sapiens
acagtgttttagaaaagcttga

SEQ ID NO: 9220949 - DNA, 22 bp, Homo sapiens
acagtgcacatcctgagtgatt

SEQ ID NO: 9220950 - DNA, 22 bp, Homo sapiens
acagtgttctgctttttaatcc

SEQ ID NO: 9220951 - DNA, 22 bp, Homo sapiens
acagtgcaaacttttgtctcct

SEQ ID NO: 9220952 - DNA, 22 bp, Homo sapiens
acagtgcacatcctgagtgatt

SEQ ID NO: 9220953 - DNA, 22 bp, Homo sapiens
acagtgcaaataggactgtctt

SEQ ID NO: 9220954 - DNA, 22 bp, Homo sapiens
accaggctgttgggcccagtgt

SEQ ID NO: 9220955 - DNA, 22 bp, Homo sapiens
accaggcttaatcctttgctat

SEQ ID NO: 9220956 - DNA, 19 bp, Homo sapiens
accaggcttatggtcagtg

SEQ ID NO: 9220957 - DNA, 19 bp, Homo sapiens
accaggcttatggtcagtg

SEQ ID NO: 9220958 - DNA, 22 bp, Homo sapiens
accaggcttgataccaagaaat

SEQ ID NO: 9220959 - DNA, 21 bp, Homo sapiens
acattttctgttttaggaagt

SEQ ID NO: 9220960 - DNA, 22 bp, Homo sapiens
accaggcttgatgatttgctta

SEQ ID NO: 9220961 - DNA, 21 bp, Homo sapiens
accaggcttgtgggagggagc

SEQ ID NO: 9220962 - DNA, 21 bp, Homo sapiens
accaggcttgtgggagggagc

SEQ ID NO: 9220963 - DNA, 22 bp, Homo sapiens
aagggctgtaagccaagtaaag

SEQ ID NO: 9220964 - DNA, 22 bp, Homo sapiens
accctgcctctgcttcctgtag

SEQ ID NO: 9220965 - DNA, 22 bp, Homo sapiens
accctgccgtgggctgcttgtg

SEQ ID NO: 9220966 - DNA, 22 bp, Homo sapiens
accctgaggggtatagcagaag

SEQ ID NO: 9220967 - DNA, 22 bp, Homo sapiens
accccgccgtgacgtcacgcct

SEQ ID NO: 9220968 - DNA, 22 bp, Homo sapiens
accctgagaaagtcacatgcat

SEQ ID NO: 9220969 - DNA, 22 bp, Homo sapiens
acccaggaggtggaggctgcag

SEQ ID NO: 9220970 - DNA, 22 bp, Homo sapiens
acatttcatttgcagtatggat

SEQ ID NO: 9220971 - DNA, 22 bp, Homo sapiens
acatttctcttgatgtctctat

SEQ ID NO: 9220972 - DNA, 21 bp, Homo sapiens
aaggctggagatgcaggtctg

SEQ ID NO: 9220973 - DNA, 19 bp, Homo sapiens
aaggctggagaaggcctct

SEQ ID NO: 9220974 - DNA, 22 bp, Homo sapiens
acatttaaatacctatgtttct

SEQ ID NO: 9220975 - DNA, 22 bp, Homo sapiens
aaggcctttgccccgatacagg

SEQ ID NO: 9220976 - DNA, 22 bp, Homo sapiens
aaggctaaattctgtactgcat

SEQ ID NO: 9220977 - DNA, 18 bp, Homo sapiens
aaggcctagtccctctct

SEQ ID NO: 9220978 - DNA, 22 bp, Homo sapiens
aaggcctcttctctctggagat

SEQ ID NO: 9220979 - DNA, 20 bp, Homo sapiens
aaggcagagtgggttggagc

SEQ ID NO: 9220980 - DNA, 21 bp, Homo sapiens
aaggcctgcttactgctagtt

SEQ ID NO: 9220981 - DNA, 22 bp, Homo sapiens
aaggcctgctcagctgtctgtg

SEQ ID NO: 9220982 - DNA, 22 bp, Homo sapiens
aaggcctgctcagctgtctgtg

SEQ ID NO: 9220983 - DNA, 22 bp, Homo sapiens
aaggccttggttctgagcaata

SEQ ID NO: 9220984 - DNA, 22 bp, Homo sapiens
aagctcaggaaagagtctggtt

SEQ ID NO: 9220985 - DNA, 22 bp, Homo sapiens
aagctccccgaaacccacctct

SEQ ID NO: 9220986 - DNA, 22 bp, Homo sapiens
aagctcagaggtagataatgtt

SEQ ID NO: 9220987 - DNA, 22 bp, Homo sapiens
aagctcagagtctcggagggaa

SEQ ID NO: 9220988 - DNA, 18 bp, Homo sapiens
aagctctggctaggaaaa

SEQ ID NO: 9220989 - DNA, 20 bp, Homo sapiens
aagctctgcttcatgtggtc

SEQ ID NO: 9220990 - DNA, 22 bp, Homo sapiens
aagctctgctcagcagactagg

SEQ ID NO: 9220991 - DNA, 17 bp, Homo sapiens
acagggcagaaacagct

SEQ ID NO: 9220992 - DNA, 17 bp, Homo sapiens
acagggcagaaacagct

SEQ ID NO: 9220993 - DNA, 22 bp, Homo sapiens
aagctctgtctcttgggagtta

SEQ ID NO: 9220994 - DNA, 19 bp, Homo sapiens
acagggcagcaataggata

SEQ ID NO: 9220995 - DNA, 18 bp, Homo sapiens
aagctgccctcaggcagg

SEQ ID NO: 9220996 - DNA, 22 bp, Homo sapiens
aagccaaggagaatggcctcag

SEQ ID NO: 9220997 - DNA, 22 bp, Homo sapiens
aagccaaggcctgtctggggct

SEQ ID NO: 9220998 - DNA, 22 bp, Homo sapiens
aagccttgctcttgaaaaagtt

SEQ ID NO: 9220999 - DNA, 22 bp, Homo sapiens
aagccttccctttttgagctca

SEQ ID NO: 9221000 - DNA, 22 bp, Homo sapiens
aagccaaggttttggtcacagc

SEQ ID NO: 9221001 - DNA, 22 bp, Homo sapiens
aagctaagggtgtttaagcagg

SEQ ID NO: 9221002 - DNA, 19 bp, Homo sapiens
acagcctgttggtggggct

SEQ ID NO: 9221003 - DNA, 22 bp, Homo sapiens
acagcctgtttgatctggtgct

SEQ ID NO: 9221004 - DNA, 22 bp, Homo sapiens
acagcctgtttgatctggtgct

SEQ ID NO: 9221005 - DNA, 22 bp, Homo sapiens
acagcctgtttgatctggtgct

SEQ ID NO: 9221006 - DNA, 19 bp, Homo sapiens
acagcctgttggtggggct

SEQ ID NO: 9221007 - DNA, 22 bp, Homo sapiens
acagcctgtgtaccagctggga

SEQ ID NO: 9221008 - DNA, 22 bp, Homo sapiens
acagcctgtgtaccagctggga

SEQ ID NO: 9221009 - DNA, 22 bp, Homo sapiens
acagcctggcctgagttaaggc

SEQ ID NO: 9221010 - DNA, 22 bp, Homo sapiens
acagcctggcctgagttaaggc

SEQ ID NO: 9221011 - DNA, 22 bp, Homo sapiens
acagcctggcctgagttaaggc

SEQ ID NO: 9221012 - DNA, 22 bp, Homo sapiens
acagcctggactggctctctgc

SEQ ID NO: 9221013 - DNA, 21 bp, Homo sapiens
acagcctgtcatctcatggtc

SEQ ID NO: 9221014 - DNA, 21 bp, Homo sapiens
acagcctgtcatctcatggtc

SEQ ID NO: 9221015 - DNA, 21 bp, Homo sapiens
acagcctgtcatctcatggtc

SEQ ID NO: 9221016 - DNA, 22 bp, Homo sapiens
aagcattttagtaatgaacttg

SEQ ID NO: 9221017 - DNA, 19 bp, Homo sapiens
acatatgtggatatacatg

SEQ ID NO: 9221018 - DNA, 22 bp, Homo sapiens
aaggcagagggctggatcagag

SEQ ID NO: 9221019 - DNA, 22 bp, Homo sapiens
acatatgtgttgtacatgcatg

SEQ ID NO: 9221020 - DNA, 23 bp, Homo sapiens
acatagaacagaatatatttgtg

SEQ ID NO: 9221021 - DNA, 22 bp, Homo sapiens
aaggaggaatgtagccagctcc

SEQ ID NO: 9221022 - DNA, 22 bp, Homo sapiens
aaggaggaatgtagccagctcc

SEQ ID NO: 9221023 - DNA, 22 bp, Homo sapiens
acagtgtttggcaatgcatgca

SEQ ID NO: 9221024 - DNA, 22 bp, Homo sapiens
acagtgtttaagagatggcatt

SEQ ID NO: 9221025 - DNA, 22 bp, Homo sapiens
acagtgtttatgtacagattgt

SEQ ID NO: 9221026 - DNA, 22 bp, Homo sapiens
acagtgtttcacttaaccgttt

SEQ ID NO: 9221027 - DNA, 22 bp, Homo sapiens
acagtgttcttgatattacagt

SEQ ID NO: 9221028 - DNA, 22 bp, Homo sapiens
acagtgttcttggcgctgagtg

SEQ ID NO: 9221029 - DNA, 22 bp, Homo sapiens
acagtgtttaaaaatcagatct

SEQ ID NO: 9221030 - DNA, 22 bp, Homo sapiens
acagtgtttaaaaatcagatct

SEQ ID NO: 9221031 - DNA, 22 bp, Homo sapiens
acagtgtttaaaataatatgct

SEQ ID NO: 9221032 - DNA, 22 bp, Homo sapiens
acagtgttgtggctcttaatag

SEQ ID NO: 9221033 - DNA, 22 bp, Homo sapiens
acagtgttgtatttagtttgat

SEQ ID NO: 9221034 - DNA, 22 bp, Homo sapiens
acagtgttgaggtgcttgtttc

SEQ ID NO: 9221035 - DNA, 22 bp, Homo sapiens
aaggagacatttgcagagcacc

SEQ ID NO: 9221036 - DNA, 22 bp, Homo sapiens
aaggagacttggcatcacttaa

SEQ ID NO: 9221037 - DNA, 20 bp, Homo sapiens
aaggagaatgacacggctgc

SEQ ID NO: 9221038 - DNA, 22 bp, Homo sapiens
aagctggactctgccatttact

SEQ ID NO: 9221039 - DNA, 22 bp, Homo sapiens
aaggacaggctaacctgacatt

SEQ ID NO: 9221040 - DNA, 22 bp, Homo sapiens
aagctggagagttaggtgaata

SEQ ID NO: 9221041 - DNA, 22 bp, Homo sapiens
aaggagctgggagggacacatg

SEQ ID NO: 9221042 - DNA, 22 bp, Homo sapiens
aaggagctcccggcagaccagg

SEQ ID NO: 9221043 - DNA, 22 bp, Homo sapiens
aaggagcacacaatctagaacc

SEQ ID NO: 9221044 - DNA, 22 bp, Homo sapiens
actcagagaatatctagaagga

SEQ ID NO: 9221045 - DNA, 22 bp, Homo sapiens
actccctccaaatctgcacagt

SEQ ID NO: 9221046 - DNA, 22 bp, Homo sapiens
actatacataaaacatttgggt

SEQ ID NO: 9221047 - DNA, 22 bp, Homo sapiens
actataacccatggaatataag

SEQ ID NO: 9221048 - DNA, 22 bp, Homo sapiens
aagtctctgactcacacaatgt

SEQ ID NO: 9221049 - DNA, 22 bp, Homo sapiens
aagtctctcatggctgacagca

SEQ ID NO: 9221050 - DNA, 20 bp, Homo sapiens
acgtggccaccagtggctta

SEQ ID NO: 9221051 - DNA, 22 bp, Homo sapiens
acctaagaaatccagagatttc

SEQ ID NO: 9221052 - DNA, 22 bp, Homo sapiens
acggggctagagaaggtttctt

SEQ ID NO: 9221053 - DNA, 22 bp, Homo sapiens
acggtgccggtggtgatgagcc

SEQ ID NO: 9221054 - DNA, 22 bp, Homo sapiens
aataccatgataattaattcat

SEQ ID NO: 9221055 - DNA, 22 bp, Homo sapiens
aataccagagacagtgtttacc

SEQ ID NO: 9221056 - DNA, 22 bp, Homo sapiens
aataccatgcagaaataacata

SEQ ID NO: 9221057 - DNA, 22 bp, Homo sapiens
aataccttccaacatcaagaca

SEQ ID NO: 9221058 - DNA, 22 bp, Homo sapiens
aatacgtctgaatgcattctca

SEQ ID NO: 9221059 - DNA, 22 bp, Homo sapiens
aatacgtcccatcatctttttc

SEQ ID NO: 9221060 - DNA, 22 bp, Homo sapiens
actggccaggcagcagtagctt

SEQ ID NO: 9221061 - DNA, 22 bp, Homo sapiens
actggccaggcgaaccacactg

SEQ ID NO: 9221062 - DNA, 22 bp, Homo sapiens
actggccagccaacaacaatag

SEQ ID NO: 9221063 - DNA, 22 bp, Homo sapiens
actggcccgggagcagaggcct

SEQ ID NO: 9221064 - DNA, 20 bp, Homo sapiens
actggagccatctcagccta

SEQ ID NO: 9221065 - DNA, 23 bp, Homo sapiens
actggacagagtggacgaggctg

SEQ ID NO: 9221066 - DNA, 22 bp, Homo sapiens
actggaggggaaaatggtagta

SEQ ID NO: 9221067 - DNA, 22 bp, Homo sapiens
actggaggcccctcccagtgaa

SEQ ID NO: 9221068 - DNA, 22 bp, Homo sapiens
actctggctattcactataata

SEQ ID NO: 9221069 - DNA, 22 bp, Homo sapiens
actctggcgggcgggcgagcca

SEQ ID NO: 9221070 - DNA, 22 bp, Homo sapiens
actctggccccaggatctgtgt

SEQ ID NO: 9221071 - DNA, 22 bp, Homo sapiens
actctggccctcctgctgccag

SEQ ID NO: 9221072 - DNA, 22 bp, Homo sapiens
actctggccaggtgcggtatgt

SEQ ID NO: 9221073 - DNA, 22 bp, Homo sapiens
actctggccatcttggaccttg

SEQ ID NO: 9221074 - DNA, 21 bp, Homo sapiens
actctgctgcgggcttggcct

SEQ ID NO: 9221075 - DNA, 22 bp, Homo sapiens
actctggcactgggtacctcag

SEQ ID NO: 9221076 - DNA, 22 bp, Homo sapiens
actctggcagcagaaccagtgt

SEQ ID NO: 9221077 - DNA, 22 bp, Homo sapiens
actctggcaagcttccacttcc

SEQ ID NO: 9221078 - DNA, 22 bp, Homo sapiens
actctgcttattgctgcaggca

SEQ ID NO: 9221079 - DNA, 22 bp, Homo sapiens
actgcactccagcctgggtaac

SEQ ID NO: 9221080 - DNA, 22 bp, Homo sapiens
actgcactccagcctgggtaac

SEQ ID NO: 9221081 - DNA, 22 bp, Homo sapiens
actgcactccagcctcggggtc

SEQ ID NO: 9221082 - DNA, 19 bp, Homo sapiens
actgcactccagcctgggt

SEQ ID NO: 9221083 - DNA, 22 bp, Homo sapiens
actgcactccagcccgagcaac

SEQ ID NO: 9221084 - DNA, 22 bp, Homo sapiens
actgcactccaacctgggtgac

SEQ ID NO: 9221085 - DNA, 22 bp, Homo sapiens
actgcactccaacctgggtgac

SEQ ID NO: 9221086 - DNA, 22 bp, Homo sapiens
actgcactccaacctgggtgac

SEQ ID NO: 9221087 - DNA, 22 bp, Homo sapiens
actgatacggttttagagtcca

SEQ ID NO: 9221088 - DNA, 22 bp, Homo sapiens
actgaggttgaaatagtgatgt

SEQ ID NO: 9221089 - DNA, 23 bp, Homo sapiens
actttattgaccccaggtcagtt

SEQ ID NO: 9221090 - DNA, 22 bp, Homo sapiens
actgttgaagtgccagcttgat

SEQ ID NO: 9221091 - DNA, 22 bp, Homo sapiens
actttgaaactaaaattcatta

SEQ ID NO: 9221092 - DNA, 22 bp, Homo sapiens
actttgaaatgtgtaagagaga

SEQ ID NO: 9221093 - DNA, 22 bp, Homo sapiens
aatatactatactactttctgg

SEQ ID NO: 9221094 - DNA, 22 bp, Homo sapiens
actgggcttcacttggcacatc

SEQ ID NO: 9221095 - DNA, 22 bp, Homo sapiens
actgggcttatgctgtggagta

SEQ ID NO: 9221096 - DNA, 22 bp, Homo sapiens
actgggcttcacttggcacatc

SEQ ID NO: 9221097 - DNA, 19 bp, Homo sapiens
actgggcttgtcctcgtgg

SEQ ID NO: 9221098 - DNA, 22 bp, Homo sapiens
aatagtacaatctacagacata

SEQ ID NO: 9221099 - DNA, 22 bp, Homo sapiens
aatataattttattcctagagt

SEQ ID NO: 9221100 - DNA, 22 bp, Homo sapiens
aatataattttattcctagagt

SEQ ID NO: 9221101 - DNA, 22 bp, Homo sapiens
aatatagctcactataccatgg

SEQ ID NO: 9221102 - DNA, 22 bp, Homo sapiens
aatatagttctagaaatatttt

SEQ ID NO: 9221103 - DNA, 22 bp, Homo sapiens
actgggcttatgctgtggagta

SEQ ID NO: 9221104 - DNA, 22 bp, Homo sapiens
actgggctgttttttgagtgga

SEQ ID NO: 9221105 - DNA, 22 bp, Homo sapiens
actgggcttatttcttgtgaac

SEQ ID NO: 9221106 - DNA, 23 bp, Homo sapiens
actgggcttatgaggaggcttgt

SEQ ID NO: 9221107 - DNA, 22 bp, Homo sapiens
actgggctgttttttgagtgga

SEQ ID NO: 9221108 - DNA, 22 bp, Homo sapiens
actgggctgttccttatttcta

SEQ ID NO: 9221109 - DNA, 22 bp, Homo sapiens
actgggctgttccttatttcta

SEQ ID NO: 9221110 - DNA, 22 bp, Homo sapiens
actgggctgtggacacccagcg

SEQ ID NO: 9221111 - DNA, 22 bp, Homo sapiens
actgggctgtaaagagaggcaa

SEQ ID NO: 9221112 - DNA, 22 bp, Homo sapiens
actgggctggttagttttacta

SEQ ID NO: 9221113 - DNA, 22 bp, Homo sapiens
actgggctggggctcattctcc

SEQ ID NO: 9221114 - DNA, 22 bp, Homo sapiens
actgggctggggctcattctcc

SEQ ID NO: 9221115 - DNA, 22 bp, Homo sapiens
actgggctgcttgagtgccttc

SEQ ID NO: 9221116 - DNA, 22 bp, Homo sapiens
aatactatgtagccaaaataat

SEQ ID NO: 9221117 - DNA, 22 bp, Homo sapiens
aatactatgttgtgacacatga

SEQ ID NO: 9221118 - DNA, 22 bp, Homo sapiens
actgggctgcctggttcttcta

SEQ ID NO: 9221119 - DNA, 22 bp, Homo sapiens
aatcaggatatgaacccaggta

SEQ ID NO: 9221120 - DNA, 22 bp, Homo sapiens
aatcaggacccactctacagtt

SEQ ID NO: 9221121 - DNA, 22 bp, Homo sapiens
aatcaggacccactctacagtt

SEQ ID NO: 9221122 - DNA, 22 bp, Homo sapiens
aatcataattcaaataagctta

SEQ ID NO: 9221123 - DNA, 22 bp, Homo sapiens
agaaatgaagcaggagttatta

SEQ ID NO: 9221124 - DNA, 22 bp, Homo sapiens
agaaatgacaagactgatcagg

SEQ ID NO: 9221125 - DNA, 22 bp, Homo sapiens
agaacaatgcgtattttactcc

SEQ ID NO: 9221126 - DNA, 22 bp, Homo sapiens
agaacaaatcgatggaagcctg

SEQ ID NO: 9221127 - DNA, 22 bp, Homo sapiens
agaacaaaattagaggagtgca

SEQ ID NO: 9221128 - DNA, 22 bp, Homo sapiens
agaaattattagtgaatagtct

SEQ ID NO: 9221129 - DNA, 22 bp, Homo sapiens
agaaattattagtgaatagtct

SEQ ID NO: 9221130 - DNA, 22 bp, Homo sapiens
agaaattcaattctaattagct

SEQ ID NO: 9221131 - DNA, 22 bp, Homo sapiens
agaaattcctaaggtacacaag

SEQ ID NO: 9221132 - DNA, 22 bp, Homo sapiens
agaaattcctaaggtacacaag

SEQ ID NO: 9221133 - DNA, 22 bp, Homo sapiens
agaaattatgcagtagttttat

SEQ ID NO: 9221134 - DNA, 22 bp, Homo sapiens
agaaattatgcagtagttttat

SEQ ID NO: 9221135 - DNA, 22 bp, Homo sapiens
aatgatgtcgaaaagtaagctc

SEQ ID NO: 9221136 - DNA, 22 bp, Homo sapiens
aatgatttggcaaaggaatcca

SEQ ID NO: 9221137 - DNA, 22 bp, Homo sapiens
agaagcagaaaagggcactttt

SEQ ID NO: 9221138 - DNA, 22 bp, Homo sapiens
agaagcagaaggaagcagggcc

SEQ ID NO: 9221139 - DNA, 22 bp, Homo sapiens
agaagcagaaggaagcagggcc

SEQ ID NO: 9221140 - DNA, 22 bp, Homo sapiens
acaacaaaatgaggaagtggtc

SEQ ID NO: 9221141 - DNA, 20 bp, Homo sapiens
acaacaaacttgcttaagga

SEQ ID NO: 9221142 - DNA, 22 bp, Homo sapiens
acaaattgccccattttgaact

SEQ ID NO: 9221143 - DNA, 22 bp, Homo sapiens
acaacacagctttcctcaagtt

SEQ ID NO: 9221144 - DNA, 22 bp, Homo sapiens
acaacacatgtgtatatgtgtg

SEQ ID NO: 9221145 - DNA, 22 bp, Homo sapiens
agataactggtttacattattg

SEQ ID NO: 9221146 - DNA, 22 bp, Homo sapiens
agataataagtctggtaataat

SEQ ID NO: 9221147 - DNA, 22 bp, Homo sapiens
agataataagtctggtaataat

SEQ ID NO: 9221148 - DNA, 22 bp, Homo sapiens
agataataaatgttttaggttt

SEQ ID NO: 9221149 - DNA, 22 bp, Homo sapiens
acaagaattatttctagttaac

SEQ ID NO: 9221150 - DNA, 22 bp, Homo sapiens
acaagagacaagaggttcttct

SEQ ID NO: 9221151 - DNA, 22 bp, Homo sapiens
acaagcagaaggtggggtctta

SEQ ID NO: 9221152 - DNA, 22 bp, Homo sapiens
acaatgaagggagacacttgct

SEQ ID NO: 9221153 - DNA, 22 bp, Homo sapiens
acaatgcaataggagctagaaa

SEQ ID NO: 9221154 - DNA, 22 bp, Homo sapiens
acaatgattttttagagtagtt

SEQ ID NO: 9221155 - DNA, 22 bp, Homo sapiens
acaatgattttttagagtagtt

SEQ ID NO: 9221156 - DNA, 21 bp, Homo sapiens
agaggccctcggactgggcgt

SEQ ID NO: 9221157 - DNA, 22 bp, Homo sapiens
agaggccctctctctcctgatg

SEQ ID NO: 9221158 - DNA, 22 bp, Homo sapiens
agaggccctctctctcctgatg

SEQ ID NO: 9221159 - DNA, 22 bp, Homo sapiens
agaggctgaatgatgtcatcat

SEQ ID NO: 9221160 - DNA, 22 bp, Homo sapiens
agaggctcttgcccttcccaca

SEQ ID NO: 9221161 - DNA, 19 bp, Homo sapiens
aattgcctgtctctgccag

SEQ ID NO: 9221162 - DNA, 22 bp, Homo sapiens
agagggggtgtcagcactgcag

SEQ ID NO: 9221163 - DNA, 22 bp, Homo sapiens
agagggggtgtcagcactgcag

SEQ ID NO: 9221164 - DNA, 22 bp, Homo sapiens
agaggcttgacaatatgattgg

SEQ ID NO: 9221165 - DNA, 20 bp, Homo sapiens
agaggcttccttgggaggag

SEQ ID NO: 9221166 - DNA, 22 bp, Homo sapiens
agaggctgttacactcccagat

SEQ ID NO: 9221167 - DNA, 22 bp, Homo sapiens
agaggcttctttctgatttgcg

SEQ ID NO: 9221168 - DNA, 19 bp, Homo sapiens
acaaagctgtgagcagctt

SEQ ID NO: 9221169 - DNA, 19 bp, Homo sapiens
acaaagctgtgagcagctt

SEQ ID NO: 9221170 - DNA, 22 bp, Homo sapiens
agaggctgttacactcccagat

SEQ ID NO: 9221171 - DNA, 22 bp, Homo sapiens
agaggctgtgcccaccaggcaa

SEQ ID NO: 9221172 - DNA, 22 bp, Homo sapiens
aatgtgaggccttggtagttat

SEQ ID NO: 9221173 - DNA, 22 bp, Homo sapiens
aatggtttttgcatattcaggt

SEQ ID NO: 9221174 - DNA, 22 bp, Homo sapiens
aatggtttttagtgagatcgat

SEQ ID NO: 9221175 - DNA, 22 bp, Homo sapiens
aatggttttgctttagtattct

SEQ ID NO: 9221176 - DNA, 22 bp, Homo sapiens
aatggttttgtctcatcaatgt

SEQ ID NO: 9221177 - DNA, 22 bp, Homo sapiens
aatggtttgtacctgtccttgg

SEQ ID NO: 9221178 - DNA, 22 bp, Homo sapiens
aatggttttctagaacatgaaa

SEQ ID NO: 9221179 - DNA, 22 bp, Homo sapiens
aatggttttgcaggtttgtgga

SEQ ID NO: 9221180 - DNA, 22 bp, Homo sapiens
aatggtttgatggacaaaatga

SEQ ID NO: 9221181 - DNA, 19 bp, Homo sapiens
aatggtttgatgaagtata

SEQ ID NO: 9221182 - DNA, 22 bp, Homo sapiens
aatggtttggactattcaatag

SEQ ID NO: 9221183 - DNA, 22 bp, Homo sapiens
aatggtttagttaagactgagt

SEQ ID NO: 9221184 - DNA, 22 bp, Homo sapiens
aatggtttaacatatgcttgag

SEQ ID NO: 9221185 - DNA, 22 bp, Homo sapiens
aatggtttctgaagttaggcag

SEQ ID NO: 9221186 - DNA, 22 bp, Homo sapiens
aatggtttcaaacacactaagt

SEQ ID NO: 9221187 - DNA, 22 bp, Homo sapiens
aatggtttatggggaccgcaaa

SEQ ID NO: 9221188 - DNA, 22 bp, Homo sapiens
agacaatgcaagcagggagtgg

SEQ ID NO: 9221189 - DNA, 20 bp, Homo sapiens
agacaatgagtgacagagtt

SEQ ID NO: 9221190 - DNA, 22 bp, Homo sapiens
agacaatatgtatattaagaat

SEQ ID NO: 9221191 - DNA, 22 bp, Homo sapiens
agacaatggagggaaatacttc

SEQ ID NO: 9221192 - DNA, 22 bp, Homo sapiens
agacaatggctaagtaacctgt

SEQ ID NO: 9221193 - DNA, 22 bp, Homo sapiens
agacaatggagagcagagtact

SEQ ID NO: 9221194 - DNA, 22 bp, Homo sapiens
agacaatgtcaaggtgatcatc

SEQ ID NO: 9221195 - DNA, 19 bp, Homo sapiens
agacaatggggttggcagt

SEQ ID NO: 9221196 - DNA, 22 bp, Homo sapiens
agacaatgtttggtctacactt

SEQ ID NO: 9221197 - DNA, 22 bp, Homo sapiens
agaagcagactctgaggcaagg

SEQ ID NO: 9221198 - DNA, 22 bp, Homo sapiens
agaagcagactctgaggcaagg

SEQ ID NO: 9221199 - DNA, 23 bp, Homo sapiens
agaagcagcttctggagtatcgg

SEQ ID NO: 9221200 - DNA, 22 bp, Homo sapiens
aatggcagtagttgcatgagag

SEQ ID NO: 9221201 - DNA, 22 bp, Homo sapiens
aatggagactgacacaaagata

SEQ ID NO: 9221202 - DNA, 22 bp, Homo sapiens
aatggagacttcaaaatggatt

SEQ ID NO: 9221203 - DNA, 22 bp, Homo sapiens
aatggagaggctgtgagtgaga

SEQ ID NO: 9221204 - DNA, 22 bp, Homo sapiens
agacaattaaaaaattatgctt

SEQ ID NO: 9221205 - DNA, 22 bp, Homo sapiens
aatggcactttataaatgttaa

SEQ ID NO: 9221206 - DNA, 22 bp, Homo sapiens
aatggcacccgtaataccaaag

SEQ ID NO: 9221207 - DNA, 22 bp, Homo sapiens
aatggagatgtctagagggtgc

SEQ ID NO: 9221208 - DNA, 22 bp, Homo sapiens
aatggagattccaagttccttt

SEQ ID NO: 9221209 - DNA, 22 bp, Homo sapiens
agaccccatacctcagcaggta

SEQ ID NO: 9221210 - DNA, 22 bp, Homo sapiens
agaccctgcacctctcgtgggc

SEQ ID NO: 9221211 - DNA, 22 bp, Homo sapiens
agaccctggggaaagtcacttc

SEQ ID NO: 9221212 - DNA, 22 bp, Homo sapiens
aattaaaaaaggagagcttgct

SEQ ID NO: 9221213 - DNA, 20 bp, Homo sapiens
agaccctgtgtcctgtggcc

SEQ ID NO: 9221214 - DNA, 22 bp, Homo sapiens
agaccctgtcagtgttaggaaa

SEQ ID NO: 9221215 - DNA, 22 bp, Homo sapiens
agacccttgcagtctggttgtc

SEQ ID NO: 9221216 - DNA, 18 bp, Homo sapiens
agagacagcagcaaaaga

SEQ ID NO: 9221217 - DNA, 22 bp, Homo sapiens
agagacaggaatggcattaaga

SEQ ID NO: 9221218 - DNA, 22 bp, Homo sapiens
agagacaggagttctgtttcca

SEQ ID NO: 9221219 - DNA, 22 bp, Homo sapiens
agagacagatctgagggacctc

SEQ ID NO: 9221220 - DNA, 22 bp, Homo sapiens
agagacagatctgagggacctc

SEQ ID NO: 9221221 - DNA, 22 bp, Homo sapiens
aattaacaaatgtagctgtgat

SEQ ID NO: 9221222 - DNA, 22 bp, Homo sapiens
aattaaattggtttagagagga

SEQ ID NO: 9221223 - DNA, 22 bp, Homo sapiens
aattaaattggtttagagagga

SEQ ID NO: 9221224 - DNA, 23 bp, Homo sapiens
aattaaattgctagatccagggc

SEQ ID NO: 9221225 - DNA, 23 bp, Homo sapiens
aattaaattgctagatccagggc

SEQ ID NO: 9221226 - DNA, 22 bp, Homo sapiens
aattaaatgacaggggaagatg

SEQ ID NO: 9221227 - DNA, 22 bp, Homo sapiens
aattaaatgacaggggaagatg

SEQ ID NO: 9221228 - DNA, 22 bp, Homo sapiens
aattaaatgacaggggaagatg

SEQ ID NO: 9221229 - DNA, 22 bp, Homo sapiens
agagcctggacctgagctacaa

SEQ ID NO: 9221230 - DNA, 22 bp, Homo sapiens
agagccagttacaactgtggag

SEQ ID NO: 9221231 - DNA, 22 bp, Homo sapiens
agagcctggaggttctgctgaa

SEQ ID NO: 9221232 - DNA, 22 bp, Homo sapiens
aattctgatgaataaatcatcc

SEQ ID NO: 9221233 - DNA, 22 bp, Homo sapiens
agagccaggctcccatggggca

SEQ ID NO: 9221234 - DNA, 22 bp, Homo sapiens
agagacagggttttgccatgtt

SEQ ID NO: 9221235 - DNA, 22 bp, Homo sapiens
agagacaggatatctgctcatg

SEQ ID NO: 9221236 - DNA, 22 bp, Homo sapiens
agagccaggcggctgggcacct

SEQ ID NO: 9221237 - DNA, 22 bp, Homo sapiens
acagacacaggcgtggagtcgc

SEQ ID NO: 9221238 - DNA, 22 bp, Homo sapiens
agccaggggattcatcagggac

SEQ ID NO: 9221239 - DNA, 22 bp, Homo sapiens
acagaaacccagaaaacctctc

SEQ ID NO: 9221240 - DNA, 22 bp, Homo sapiens
acagaaagaaggtgtatttgag

SEQ ID NO: 9221241 - DNA, 19 bp, Homo sapiens
agccagggtccagacatgt

SEQ ID NO: 9221242 - DNA, 22 bp, Homo sapiens
agccagggggacgctttctggc

SEQ ID NO: 9221243 - DNA, 22 bp, Homo sapiens
agccagggtctctcgctctgtt

SEQ ID NO: 9221244 - DNA, 22 bp, Homo sapiens
acagagaaagtgggctgaagat

SEQ ID NO: 9221245 - DNA, 22 bp, Homo sapiens
acagactgttggcctactgagc

SEQ ID NO: 9221246 - DNA, 22 bp, Homo sapiens
acagagaaagtgggctgaagat

SEQ ID NO: 9221247 - DNA, 22 bp, Homo sapiens
acagcacaatctgagtcccaga

SEQ ID NO: 9221248 - DNA, 22 bp, Homo sapiens
agctcctgcgcacggtgcacac

SEQ ID NO: 9221249 - DNA, 22 bp, Homo sapiens
agctcctgctctttgtccctaa

SEQ ID NO: 9221250 - DNA, 22 bp, Homo sapiens
agctcctgctctttgtccctaa

SEQ ID NO: 9221251 - DNA, 22 bp, Homo sapiens
agctcctgcttgacagaagagg

SEQ ID NO: 9221252 - DNA, 22 bp, Homo sapiens
agctcctgcttgacagaagagg

SEQ ID NO: 9221253 - DNA, 22 bp, Homo sapiens
agctcctgcacccagccttgag

SEQ ID NO: 9221254 - DNA, 22 bp, Homo sapiens
agctcctgcagactcctgctca

SEQ ID NO: 9221255 - DNA, 17 bp, Homo sapiens
agctcctgcccatggct

SEQ ID NO: 9221256 - DNA, 22 bp, Homo sapiens
agctcccagaaggccctgcgcc

SEQ ID NO: 9221257 - DNA, 19 bp, Homo sapiens
agctcctgattgtgcctcg

SEQ ID NO: 9221258 - DNA, 22 bp, Homo sapiens
acagatggtactaaacccatat

SEQ ID NO: 9221259 - DNA, 22 bp, Homo sapiens
agcctctgactgtcagcaaggt

SEQ ID NO: 9221260 - DNA, 22 bp, Homo sapiens
agcctctctttctggtggctaa

SEQ ID NO: 9221261 - DNA, 22 bp, Homo sapiens
agcctctgatgatcacaggggg

SEQ ID NO: 9221262 - DNA, 22 bp, Homo sapiens
agcctctgatgatcacaggggg

SEQ ID NO: 9221263 - DNA, 22 bp, Homo sapiens
acagagcccttccttgcaccat

SEQ ID NO: 9221264 - DNA, 20 bp, Homo sapiens
agccctgtttcctggagaga

SEQ ID NO: 9221265 - DNA, 22 bp, Homo sapiens
acagagctgggatctgaaccca

SEQ ID NO: 9221266 - DNA, 22 bp, Homo sapiens
acactgagtattgagtagggta

SEQ ID NO: 9221267 - DNA, 22 bp, Homo sapiens
acactagctaaatgctgattaa

SEQ ID NO: 9221268 - DNA, 22 bp, Homo sapiens
acactagctaaatgctgattaa

SEQ ID NO: 9221269 - DNA, 22 bp, Homo sapiens
acacccaggaataaggactggg

SEQ ID NO: 9221270 - DNA, 22 bp, Homo sapiens
acacccaggaataaggactggg

SEQ ID NO: 9221271 - DNA, 22 bp, Homo sapiens
acacagggcagagagctggctc

SEQ ID NO: 9221272 - DNA, 22 bp, Homo sapiens
acacaggcatagccatacatgt

SEQ ID NO: 9221273 - DNA, 18 bp, Homo sapiens
acacaggctgacagcacc

SEQ ID NO: 9221274 - DNA, 22 bp, Homo sapiens
acacagagcttctcaactggga

SEQ ID NO: 9221275 - DNA, 22 bp, Homo sapiens
acacagagggcagaagatacat

SEQ ID NO: 9221276 - DNA, 22 bp, Homo sapiens
acacagagtttgacacatggga

SEQ ID NO: 9221277 - DNA, 22 bp, Homo sapiens
agcagctggggcctgtgacgat

SEQ ID NO: 9221278 - DNA, 22 bp, Homo sapiens
agcagctggtaggagtggccac

SEQ ID NO: 9221279 - DNA, 17 bp, Homo sapiens
agcagctgggttgatct

SEQ ID NO: 9221280 - DNA, 22 bp, Homo sapiens
acaatgcacctattttaaaact

SEQ ID NO: 9221281 - DNA, 22 bp, Homo sapiens
agcagagcatggtgggaagggc

SEQ ID NO: 9221282 - DNA, 22 bp, Homo sapiens
agcagagcatgctaagtgactc

SEQ ID NO: 9221283 - DNA, 19 bp, Homo sapiens
agcagagcaaagtggctga

SEQ ID NO: 9221284 - DNA, 22 bp, Homo sapiens
agcagatgtttcagagcaggct

SEQ ID NO: 9221285 - DNA, 23 bp, Homo sapiens
agcagcaaaaatttatctttctg

SEQ ID NO: 9221286 - DNA, 20 bp, Homo sapiens
agcagatagcgggagagttt

SEQ ID NO: 9221287 - DNA, 22 bp, Homo sapiens
aagcagaatttcccactagttg

SEQ ID NO: 9221288 - DNA, 22 bp, Homo sapiens
aagcagacagagaatgggtttg

SEQ ID NO: 9221289 - DNA, 22 bp, Homo sapiens
aagcagaatttcccactagttg

SEQ ID NO: 9221290 - DNA, 22 bp, Homo sapiens
aagcagaatttaatagaaaggt

SEQ ID NO: 9221291 - DNA, 20 bp, Homo sapiens
aagcagaagctgctctcagc

SEQ ID NO: 9221292 - DNA, 22 bp, Homo sapiens
aagcagaactgggaagtagtgg

SEQ ID NO: 9221293 - DNA, 22 bp, Homo sapiens
aagcagaagttgatctaccata

SEQ ID NO: 9221294 - DNA, 22 bp, Homo sapiens
aagcagaaggggaataatattt

SEQ ID NO: 9221295 - DNA, 22 bp, Homo sapiens
aagcaatgtgttaatgaatgag

SEQ ID NO: 9221296 - DNA, 19 bp, Homo sapiens
aagcaatgttgtgaatcta

SEQ ID NO: 9221297 - DNA, 22 bp, Homo sapiens
aagcacaatgaacatcttagat

SEQ ID NO: 9221298 - DNA, 22 bp, Homo sapiens
aagcaattgagtgaaacctctt

SEQ ID NO: 9221299 - DNA, 22 bp, Homo sapiens
aagcaattggttttagtaaaat

SEQ ID NO: 9221300 - DNA, 22 bp, Homo sapiens
aagcacaatttaggactgaaat

SEQ ID NO: 9221301 - DNA, 22 bp, Homo sapiens
aagcacaatttaggactgaaat

SEQ ID NO: 9221302 - DNA, 22 bp, Homo sapiens
aagcaccaccctcccaacctgt

SEQ ID NO: 9221303 - DNA, 22 bp, Homo sapiens
aagcagaggtagggtgtgcagt

SEQ ID NO: 9221304 - DNA, 22 bp, Homo sapiens
aagcagaggccacagagtgggc

SEQ ID NO: 9221305 - DNA, 22 bp, Homo sapiens
acagcagagacactcaggaggc

SEQ ID NO: 9221306 - DNA, 22 bp, Homo sapiens
acagcagagacactcaggaggc

SEQ ID NO: 9221307 - DNA, 22 bp, Homo sapiens
aagcagcttccccaaagtgcct

SEQ ID NO: 9221308 - DNA, 22 bp, Homo sapiens
aagcagcttccccaaagtgcct

SEQ ID NO: 9221309 - DNA, 22 bp, Homo sapiens
aagcagcttccctggctcctgg

SEQ ID NO: 9221310 - DNA, 22 bp, Homo sapiens
aagcagcttccctggctcctgg

SEQ ID NO: 9221311 - DNA, 22 bp, Homo sapiens
aagcagcttttgaagagtgagg

SEQ ID NO: 9221312 - DNA, 22 bp, Homo sapiens
aagcagctttctttcctgtgaa

SEQ ID NO: 9221313 - DNA, 22 bp, Homo sapiens
acagcctggactggctctctgc

SEQ ID NO: 9221314 - DNA, 22 bp, Homo sapiens
acagccagggcattgtcgccga

SEQ ID NO: 9221315 - DNA, 22 bp, Homo sapiens
aagcagctgtgtgacataatct

SEQ ID NO: 9221316 - DNA, 22 bp, Homo sapiens
aagcagctgtgtgacataatct

SEQ ID NO: 9221317 - DNA, 22 bp, Homo sapiens
aagcagctggaagagtaagatg

SEQ ID NO: 9221318 - DNA, 22 bp, Homo sapiens
aagcagctgcaggttcaaagga

SEQ ID NO: 9221319 - DNA, 21 bp, Homo sapiens
aagcagcttaataaagtatgt

SEQ ID NO: 9221320 - DNA, 22 bp, Homo sapiens
aagcagcttaaattagagcctg

SEQ ID NO: 9221321 - DNA, 22 bp, Homo sapiens
aagcagcttaaattagagcctg

SEQ ID NO: 9221322 - DNA, 22 bp, Homo sapiens
aagatgtgcagttcatggcagg

SEQ ID NO: 9221323 - DNA, 22 bp, Homo sapiens
aagatgtgaacagaaccacagg

SEQ ID NO: 9221324 - DNA, 22 bp, Homo sapiens
aagatgtatcagttaagtcttc

SEQ ID NO: 9221325 - DNA, 22 bp, Homo sapiens
aagcaaggcccagagcatcagc

SEQ ID NO: 9221326 - DNA, 22 bp, Homo sapiens
aagcaaggcaacctatgtccag

SEQ ID NO: 9221327 - DNA, 22 bp, Homo sapiens
aagcaagagttggagtgatgtt

SEQ ID NO: 9221328 - DNA, 22 bp, Homo sapiens
aagcaataatcccaaagtgctg

SEQ ID NO: 9221329 - DNA, 22 bp, Homo sapiens
aagatgtgctgtcttgccactc

SEQ ID NO: 9221330 - DNA, 22 bp, Homo sapiens
aagatgttagaggtcatgcaga

SEQ ID NO: 9221331 - DNA, 22 bp, Homo sapiens
aagcaagagttggagtgatgtt

SEQ ID NO: 9221332 - DNA, 22 bp, Homo sapiens
aagcaaagagataaccttttgg

SEQ ID NO: 9221333 - DNA, 22 bp, Homo sapiens
aagagcaggacagaatcagaac

SEQ ID NO: 9221334 - DNA, 22 bp, Homo sapiens
aagagcaggctgctgtggagta

SEQ ID NO: 9221335 - DNA, 22 bp, Homo sapiens
aagatgaaaatttactgtgatg

SEQ ID NO: 9221336 - DNA, 22 bp, Homo sapiens
aagaaaacatgatctaatttaa

SEQ ID NO: 9221337 - DNA, 22 bp, Homo sapiens
aagaaaagatgtttggttttca

SEQ ID NO: 9221338 - DNA, 22 bp, Homo sapiens
aagaaaaggtaaccgcttatct

SEQ ID NO: 9221339 - DNA, 22 bp, Homo sapiens
aagaaaagaaacctgaggcttt

SEQ ID NO: 9221340 - DNA, 22 bp, Homo sapiens
aagaaaatcagttctggtcagt

SEQ ID NO: 9221341 - DNA, 22 bp, Homo sapiens
aagaaaatcagttctggtcagt

SEQ ID NO: 9221342 - DNA, 22 bp, Homo sapiens
aagaaaccaaccctgccagcac

SEQ ID NO: 9221343 - DNA, 22 bp, Homo sapiens
aagaaactggaatatagagagc

SEQ ID NO: 9221344 - DNA, 22 bp, Homo sapiens
aagaaacctagtctggagcagc

SEQ ID NO: 9221345 - DNA, 22 bp, Homo sapiens
aagaaacgtttgagctttgact

SEQ ID NO: 9221346 - DNA, 22 bp, Homo sapiens
aagaaactgaaagtggcttcat

SEQ ID NO: 9221347 - DNA, 22 bp, Homo sapiens
aatggcttttaaaaatagcatt

SEQ ID NO: 9221348 - DNA, 22 bp, Homo sapiens
aactggattaactggctcaaat

SEQ ID NO: 9221349 - DNA, 22 bp, Homo sapiens
aactggattattcagttgctgc

SEQ ID NO: 9221350 - DNA, 19 bp, Homo sapiens
aactggataatggccacat

SEQ ID NO: 9221351 - DNA, 22 bp, Homo sapiens
aactggattcttactgggctga

SEQ ID NO: 9221352 - DNA, 22 bp, Homo sapiens
aagaaaacaatgacttgccagc

SEQ ID NO: 9221353 - DNA, 22 bp, Homo sapiens
aatttacacttcatttggaggg

SEQ ID NO: 9221354 - DNA, 22 bp, Homo sapiens
aatttaaggaggccttcactct

SEQ ID NO: 9221355 - DNA, 22 bp, Homo sapiens
aatttaagaacatttcaggact

SEQ ID NO: 9221356 - DNA, 22 bp, Homo sapiens
aagaaatgtagagcctagtaaa

SEQ ID NO: 9221357 - DNA, 20 bp, Homo sapiens
aagaaacttgaaagtacaag

SEQ ID NO: 9221358 - DNA, 20 bp, Homo sapiens
aagaaacttgaaagtacaag

SEQ ID NO: 9221359 - DNA, 22 bp, Homo sapiens
aattttaagcatatgactggtt

SEQ ID NO: 9221360 - DNA, 22 bp, Homo sapiens
aagagaacagtcaccatgcaca

SEQ ID NO: 9221361 - DNA, 22 bp, Homo sapiens
aagagcagcctccaggggtgga

SEQ ID NO: 9221362 - DNA, 22 bp, Homo sapiens
aagagcaagtgggtagtgaagc

SEQ ID NO: 9221363 - DNA, 21 bp, Homo sapiens
acacaaacctcctcagcctgg

SEQ ID NO: 9221364 - DNA, 21 bp, Homo sapiens
acacaaacctcctcagcctgg

SEQ ID NO: 9221365 - DNA, 22 bp, Homo sapiens
acacaaaatcaaagtcctaggc

SEQ ID NO: 9221366 - DNA, 22 bp, Homo sapiens
acacaaaatcaaagtcctaggc

SEQ ID NO: 9221367 - DNA, 22 bp, Homo sapiens
acacaaacagtctatagcacca

SEQ ID NO: 9221368 - DNA, 22 bp, Homo sapiens
acacaaacagtctatagcacca

SEQ ID NO: 9221369 - DNA, 22 bp, Homo sapiens
acacaaagttggatgacaaaat

SEQ ID NO: 9221370 - DNA, 22 bp, Homo sapiens
acacaaactgctagaaaattgg

SEQ ID NO: 9221371 - DNA, 22 bp, Homo sapiens
acaatgttctgtctgacttgtc

SEQ ID NO: 9221372 - DNA, 22 bp, Homo sapiens
aagagacatgaatactcgaagg

SEQ ID NO: 9221373 - DNA, 22 bp, Homo sapiens
aagagaattctggttttcctat

SEQ ID NO: 9221374 - DNA, 22 bp, Homo sapiens
aaggctggtggattatgaggtc

SEQ ID NO: 9221375 - DNA, 22 bp, Homo sapiens
aaggctggtcagatgtggtgaa

SEQ ID NO: 9221376 - DNA, 22 bp, Homo sapiens
aaggctggtcagatgtggtgaa

SEQ ID NO: 9221377 - DNA, 22 bp, Homo sapiens
aaggctggttccatccctggtg

SEQ ID NO: 9221378 - DNA, 22 bp, Homo sapiens
aacaatgtaatctactctgctc

SEQ ID NO: 9221379 - DNA, 22 bp, Homo sapiens
aacaatgtgaagtgctgttcag

SEQ ID NO: 9221380 - DNA, 22 bp, Homo sapiens
aacacagaagtgccaagagcca

SEQ ID NO: 9221381 - DNA, 22 bp, Homo sapiens
aacacaggccagcctgtgcagt

SEQ ID NO: 9221382 - DNA, 22 bp, Homo sapiens
aacacaggggcgtggctcttac

SEQ ID NO: 9221383 - DNA, 22 bp, Homo sapiens
aacacagggcagctgctgggaa

SEQ ID NO: 9221384 - DNA, 20 bp, Homo sapiens
aacacagataccaaaggttg

SEQ ID NO: 9221385 - DNA, 22 bp, Homo sapiens
aacacagctaatttctgtcaat

SEQ ID NO: 9221386 - DNA, 22 bp, Homo sapiens
aacacaggttgctgggcctcac

SEQ ID NO: 9221387 - DNA, 22 bp, Homo sapiens
aacacaggttcattctgtgagg

SEQ ID NO: 9221388 - DNA, 20 bp, Homo sapiens
aacacagggttaccatcaga

SEQ ID NO: 9221389 - DNA, 22 bp, Homo sapiens
aacactttcttccttgctcagg

SEQ ID NO: 9221390 - DNA, 22 bp, Homo sapiens
aacagacaactcctgtggctca

SEQ ID NO: 9221391 - DNA, 22 bp, Homo sapiens
aacagacagaaaaatgtgatct

SEQ ID NO: 9221392 - DNA, 22 bp, Homo sapiens
aacagacatatttttaatatgc

SEQ ID NO: 9221393 - DNA, 22 bp, Homo sapiens
aacagacatatttttaatatgc

SEQ ID NO: 9221394 - DNA, 22 bp, Homo sapiens
aacagagcattctgcactacaa

SEQ ID NO: 9221395 - DNA, 22 bp, Homo sapiens
aaggctgggtttgggatgtgat

SEQ ID NO: 9221396 - DNA, 22 bp, Homo sapiens
aaggctgagccagggcccctat

SEQ ID NO: 9221397 - DNA, 21 bp, Homo sapiens
aaattcacctagtaaaacttc

SEQ ID NO: 9221398 - DNA, 22 bp, Homo sapiens
aaggctgagagtcacagtccta

SEQ ID NO: 9221399 - DNA, 22 bp, Homo sapiens
aaattattctcatgtgtttctt

SEQ ID NO: 9221400 - DNA, 18 bp, Homo sapiens
aaattattcttccttttc

SEQ ID NO: 9221401 - DNA, 22 bp, Homo sapiens
aaattcaattaactttcatgct

SEQ ID NO: 9221402 - DNA, 23 bp, Homo sapiens
aaattattgctcttcaattgcct

SEQ ID NO: 9221403 - DNA, 22 bp, Homo sapiens
aaggcagatataaagactagag

SEQ ID NO: 9221404 - DNA, 22 bp, Homo sapiens
aaggcagccctggctcagcctg

SEQ ID NO: 9221405 - DNA, 22 bp, Homo sapiens
aaggaaagacaggacggaattc

SEQ ID NO: 9221406 - DNA, 22 bp, Homo sapiens
aacatgtctttagagaaacatt

SEQ ID NO: 9221407 - DNA, 22 bp, Homo sapiens
aacatgtacctacaatcagaat

SEQ ID NO: 9221408 - DNA, 22 bp, Homo sapiens
aatagatactacttagatgtag

SEQ ID NO: 9221409 - DNA, 22 bp, Homo sapiens
aatagatactacttagatgtag

SEQ ID NO: 9221410 - DNA, 22 bp, Homo sapiens
aacatctagttcctatataata

SEQ ID NO: 9221411 - DNA, 22 bp, Homo sapiens
aacatctagttcctatataata

SEQ ID NO: 9221412 - DNA, 22 bp, Homo sapiens
aacatctaggttctcatcgata

SEQ ID NO: 9221413 - DNA, 22 bp, Homo sapiens
aacatctttttgtttgctgaaa

SEQ ID NO: 9221414 - DNA, 22 bp, Homo sapiens
aagtggtgtgttggaagaaatc

SEQ ID NO: 9221415 - DNA, 22 bp, Homo sapiens
aagtgtaaattcacagacttca

SEQ ID NO: 9221416 - DNA, 22 bp, Homo sapiens
aacagcgacgtcctccccaaca

SEQ ID NO: 9221417 - DNA, 22 bp, Homo sapiens
aagtgtcctcattcaacatgca

SEQ ID NO: 9221418 - DNA, 22 bp, Homo sapiens
aacagcttagaaatgttgctaa

SEQ ID NO: 9221419 - DNA, 22 bp, Homo sapiens
aaccctggggctgctctgcctg

SEQ ID NO: 9221420 - DNA, 22 bp, Homo sapiens
aaccctggggcagctgctaggg

SEQ ID NO: 9221421 - DNA, 22 bp, Homo sapiens
aaccctcagctgtttgaggaga

SEQ ID NO: 9221422 - DNA, 22 bp, Homo sapiens
aaccctggagaaggctttggat

SEQ ID NO: 9221423 - DNA, 22 bp, Homo sapiens
aaccctggccctggaataggca

SEQ ID NO: 9221424 - DNA, 22 bp, Homo sapiens
aaccttcttgtgcagaactgta

SEQ ID NO: 9221425 - DNA, 22 bp, Homo sapiens
aactagaaagaacatatttcca

SEQ ID NO: 9221426 - DNA, 22 bp, Homo sapiens
aatggccatatcattgcagagc

SEQ ID NO: 9221427 - DNA, 22 bp, Homo sapiens
aactataatggggttaggaaat

SEQ ID NO: 9221428 - DNA, 22 bp, Homo sapiens
aatgctttcaaaaatgtgcagt

SEQ ID NO: 9221429 - DNA, 22 bp, Homo sapiens
aatggcttctgaagcacacttt

SEQ ID NO: 9221430 - DNA, 22 bp, Homo sapiens
aagcaggcattccagagacaat

SEQ ID NO: 9221431 - DNA, 21 bp, Homo sapiens
aaatctcagctggcctctgtg

SEQ ID NO: 9221432 - DNA, 22 bp, Homo sapiens
aaatctgttgtaatgtttttta

SEQ ID NO: 9221433 - DNA, 22 bp, Homo sapiens
aagccttcagtccgttgcagag

SEQ ID NO: 9221434 - DNA, 22 bp, Homo sapiens
aagccctgtccggggggaagaa

SEQ ID NO: 9221435 - DNA, 22 bp, Homo sapiens
aagccctgttaggcactgggga

SEQ ID NO: 9221436 - DNA, 22 bp, Homo sapiens
aagcccttggcagagttcccca

SEQ ID NO: 9221437 - DNA, 22 bp, Homo sapiens
aagcctaaatgatgctattatg

SEQ ID NO: 9221438 - DNA, 22 bp, Homo sapiens
aagatcaagatttaggttgagg

SEQ ID NO: 9221439 - DNA, 22 bp, Homo sapiens
aagatgtttagatttatacaat

SEQ ID NO: 9221440 - DNA, 21 bp, Homo sapiens
aagatcccagagtgctcagta

SEQ ID NO: 9221441 - DNA, 22 bp, Homo sapiens
aagcaggatggatctagtgttc

SEQ ID NO: 9221442 - DNA, 22 bp, Homo sapiens
aagagggagggcaaaggcactg

SEQ ID NO: 9221443 - DNA, 22 bp, Homo sapiens
aagagggaaattgttggctgct

SEQ ID NO: 9221444 - DNA, 22 bp, Homo sapiens
aagagggctgcaatcttattgc

SEQ ID NO: 9221445 - DNA, 22 bp, Homo sapiens
aaagtttccaagttacaccatt

SEQ ID NO: 9221446 - DNA, 22 bp, Homo sapiens
aaatactagaattcagagttga

SEQ ID NO: 9221447 - DNA, 23 bp, Homo sapiens
aaatacctgaattagatattatc

SEQ ID NO: 9221448 - DNA, 23 bp, Homo sapiens
aaatacctgaattagatattatc

SEQ ID NO: 9221449 - DNA, 22 bp, Homo sapiens
aaatacatttacagtcgtggct

SEQ ID NO: 9221450 - DNA, 22 bp, Homo sapiens
aagaggggtggtctgtgaggat

SEQ ID NO: 9221451 - DNA, 22 bp, Homo sapiens
aagaggggtgtgtgtcaaccca

SEQ ID NO: 9221452 - DNA, 22 bp, Homo sapiens
aaatacattagacggagagtta

SEQ ID NO: 9221453 - DNA, 22 bp, Homo sapiens
aagaccctatactcagtgaccc

SEQ ID NO: 9221454 - DNA, 22 bp, Homo sapiens
aagaccctacccctggagagga

SEQ ID NO: 9221455 - DNA, 17 bp, Homo sapiens
aagaccctagtctaccc

SEQ ID NO: 9221456 - DNA, 22 bp, Homo sapiens
aagaccctatactcagtgaccc

SEQ ID NO: 9221457 - DNA, 22 bp, Homo sapiens
aagacctgggagagattgggtt

SEQ ID NO: 9221458 - DNA, 22 bp, Homo sapiens
aagacgcaccctttgagggcac

SEQ ID NO: 9221459 - DNA, 22 bp, Homo sapiens
aagactcaaggaacaacacagt

SEQ ID NO: 9221460 - DNA, 22 bp, Homo sapiens
aagactgagtggcttaagaaaa

SEQ ID NO: 9221461 - DNA, 22 bp, Homo sapiens
aagactctatctttagagatca

SEQ ID NO: 9221462 - DNA, 22 bp, Homo sapiens
aagaacatggtaggataacaaa

SEQ ID NO: 9221463 - DNA, 22 bp, Homo sapiens
aagaacatgctataattatctt

SEQ ID NO: 9221464 - DNA, 22 bp, Homo sapiens
aagaacatgagttatgatgatt

SEQ ID NO: 9221465 - DNA, 22 bp, Homo sapiens
aagacagagggaagcaatgatg

SEQ ID NO: 9221466 - DNA, 22 bp, Homo sapiens
aaagtgcagctgaaaacatcct

SEQ ID NO: 9221467 - DNA, 22 bp, Homo sapiens
aaagtgcacctgcttcttcttg

SEQ ID NO: 9221468 - DNA, 22 bp, Homo sapiens
aaaggcaggactgcagcatagg

SEQ ID NO: 9221469 - DNA, 22 bp, Homo sapiens
aaaggcagagtgctcagctggc

SEQ ID NO: 9221470 - DNA, 22 bp, Homo sapiens
aaccccaggctggaggagtctc

SEQ ID NO: 9221471 - DNA, 22 bp, Homo sapiens
aaccccaggctggaggagtctc

SEQ ID NO: 9221472 - DNA, 22 bp, Homo sapiens
aaccccagtaccccaggatatg

SEQ ID NO: 9221473 - DNA, 22 bp, Homo sapiens
aacccagaaacgcaggcggtca

SEQ ID NO: 9221474 - DNA, 22 bp, Homo sapiens
aacccagagctggaggagagta

SEQ ID NO: 9221475 - DNA, 22 bp, Homo sapiens
aacccaggaggcagaggctgca

SEQ ID NO: 9221476 - DNA, 22 bp, Homo sapiens
aacccagggtgaggggagtcta

SEQ ID NO: 9221477 - DNA, 22 bp, Homo sapiens
aacccaggagttggaggctgtg

SEQ ID NO: 9221478 - DNA, 22 bp, Homo sapiens
aaagcctgggttcctcactatc

SEQ ID NO: 9221479 - DNA, 22 bp, Homo sapiens
aaagccttctgtctagcagata

SEQ ID NO: 9221480 - DNA, 22 bp, Homo sapiens
aagaacatgagttatgatgatt

SEQ ID NO: 9221481 - DNA, 22 bp, Homo sapiens
aaagattatggcattgaaatac

SEQ ID NO: 9221482 - DNA, 22 bp, Homo sapiens
aaagatttgagttctgcttata

SEQ ID NO: 9221483 - DNA, 22 bp, Homo sapiens
aaagattaggcggcaactgggc

SEQ ID NO: 9221484 - DNA, 22 bp, Homo sapiens
aaagattagataagatagattt

SEQ ID NO: 9221485 - DNA, 22 bp, Homo sapiens
aaagattaaggtattgttagct

SEQ ID NO: 9221486 - DNA, 22 bp, Homo sapiens
aaagattaaatcaaattggtca

SEQ ID NO: 9221487 - DNA, 22 bp, Homo sapiens
aaagatgttttataagttatgg

SEQ ID NO: 9221488 - DNA, 22 bp, Homo sapiens
aaagatgttttataagttatgg

SEQ ID NO: 9221489 - DNA, 22 bp, Homo sapiens
aaagatgtttgttccaaaattc

SEQ ID NO: 9221490 - DNA, 22 bp, Homo sapiens
aaagatgttttacatagcacct

SEQ ID NO: 9221491 - DNA, 22 bp, Homo sapiens
aacacttatccacatttgaaag

SEQ ID NO: 9221492 - DNA, 22 bp, Homo sapiens
aacacttaaggagagatcaaat

SEQ ID NO: 9221493 - DNA, 22 bp, Homo sapiens
aacacattggaagccaagaatg

SEQ ID NO: 9221494 - DNA, 23 bp, Homo sapiens
aaagcaaggaattggcaacagag

SEQ ID NO: 9221495 - DNA, 22 bp, Homo sapiens
aaagcaagatgcatccgtcaag

SEQ ID NO: 9221496 - DNA, 22 bp, Homo sapiens
aacatataaactcttaagttca

SEQ ID NO: 9221497 - DNA, 22 bp, Homo sapiens
aacatagacccagttcaacaaa

SEQ ID NO: 9221498 - DNA, 22 bp, Homo sapiens
aaagcccatgtggaagtacagg

SEQ ID NO: 9221499 - DNA, 22 bp, Homo sapiens
aaagcctcccaggttatgagta

SEQ ID NO: 9221500 - DNA, 23 bp, Homo sapiens
aacatactgtttaatattcacag

SEQ ID NO: 9221501 - DNA, 22 bp, Homo sapiens
aacatacatatttcagtgtcca

SEQ ID NO: 9221502 - DNA, 22 bp, Homo sapiens
aacatacttgtactatgcatat

SEQ ID NO: 9221503 - DNA, 22 bp, Homo sapiens
aacataatgtggccaaagtcac

SEQ ID NO: 9221504 - DNA, 22 bp, Homo sapiens
aacatacagtgagcagtggact

SEQ ID NO: 9221505 - DNA, 22 bp, Homo sapiens
aaagcagagatcatggcttgta

SEQ ID NO: 9221506 - DNA, 22 bp, Homo sapiens
aaagcagagcagggcacttatg

SEQ ID NO: 9221507 - DNA, 22 bp, Homo sapiens
aaagcagactgatttgcatcac

SEQ ID NO: 9221508 - DNA, 22 bp, Homo sapiens
aaagcagaggttgcagtgagct

SEQ ID NO: 9221509 - DNA, 22 bp, Homo sapiens
aaagcagaggtgatatgactta

SEQ ID NO: 9221510 - DNA, 22 bp, Homo sapiens
aaagcagaggtgatatgactta

SEQ ID NO: 9221511 - DNA, 19 bp, Homo sapiens
aaagcagaggagcatctga

SEQ ID NO: 9221512 - DNA, 22 bp, Homo sapiens
aaagcagattctgatgcagtag

SEQ ID NO: 9221513 - DNA, 22 bp, Homo sapiens
aaaatattttagggccaggaga

SEQ ID NO: 9221514 - DNA, 22 bp, Homo sapiens
aaaatattttagggccaggaga

SEQ ID NO: 9221515 - DNA, 22 bp, Homo sapiens
aaacagtattatcaatatattt

SEQ ID NO: 9221516 - DNA, 17 bp, Homo sapiens
aaaattctgtaaagagg

SEQ ID NO: 9221517 - DNA, 22 bp, Homo sapiens
aaaattgaggccagtatgccat

SEQ ID NO: 9221518 - DNA, 22 bp, Homo sapiens
aaaattgaggctcatgttaaat

SEQ ID NO: 9221519 - DNA, 22 bp, Homo sapiens
aaaattgaggctcatgttaaat

SEQ ID NO: 9221520 - DNA, 22 bp, Homo sapiens
aaagagctggcatttatagtct

SEQ ID NO: 9221521 - DNA, 22 bp, Homo sapiens
aaagagctcttactctagtgta

SEQ ID NO: 9221522 - DNA, 22 bp, Homo sapiens
aaagagctcacagtccactgga

SEQ ID NO: 9221523 - DNA, 22 bp, Homo sapiens
aaagagcttgcttgctttatat

SEQ ID NO: 9221524 - DNA, 22 bp, Homo sapiens
aaacacaagaggcagggtacag

SEQ ID NO: 9221525 - DNA, 22 bp, Homo sapiens
aaacacaagatggcctcttctg

SEQ ID NO: 9221526 - DNA, 22 bp, Homo sapiens
aaaaagtattggccatggttga

SEQ ID NO: 9221527 - DNA, 22 bp, Homo sapiens
aaaactacatttgacattttgt

SEQ ID NO: 9221528 - DNA, 22 bp, Homo sapiens
aaaaggatgttttcatgaaaca

SEQ ID NO: 9221529 - DNA, 22 bp, Homo sapiens
aaaaggcattttgtcaaccata

SEQ ID NO: 9221530 - DNA, 22 bp, Homo sapiens
aaaattatggagtatcccaaag

SEQ ID NO: 9221531 - DNA, 22 bp, Homo sapiens
aaaattatagatctagtgcctg

SEQ ID NO: 9221532 - DNA, 21 bp, Homo sapiens
aaaatgtttccttgttggtta

SEQ ID NO: 9221533 - DNA, 22 bp, Homo sapiens
aaaattaagtgtctgggaagcc

SEQ ID NO: 9221534 - DNA, 18 bp, Homo sapiens
aaaatgttcccccattaa

SEQ ID NO: 9221535 - DNA, 22 bp, Homo sapiens
aaaactttcagggatacagaaa

SEQ ID NO: 9221536 - DNA, 22 bp, Homo sapiens
aaaaggtagttgccaaataagg

SEQ ID NO: 9221537 - DNA, 16 bp, Homo sapiens
aaagaaacaggtgtcc

SEQ ID NO: 9221538 - DNA, 22 bp, Homo sapiens
aaagaaacctatcagccacatg

SEQ ID NO: 9221539 - DNA, 22 bp, Homo sapiens
aaagaaatagatggcatttaaa

SEQ ID NO: 9221540 - DNA, 22 bp, Homo sapiens
aaactgtcctcccgaggtttcc

SEQ ID NO: 9221541 - DNA, 22 bp, Homo sapiens
aaagaacaatgtggaatctcct

SEQ ID NO: 9221542 - DNA, 22 bp, Homo sapiens
aaagactttcacctagcaaaga

SEQ ID NO: 9221543 - DNA, 22 bp, Homo sapiens
aaagagaaaatgatctgtacat

SEQ ID NO: 9221544 - DNA, 20 bp, Homo sapiens
aaagagaagcctcaccttgt

SEQ ID NO: 9221545 - DNA, 22 bp, Homo sapiens
aaagatgtgtaagaaataaaca

SEQ ID NO: 9221546 - DNA, 22 bp, Homo sapiens
aaagatgttatgaaataactat

SEQ ID NO: 9221547 - DNA, 22 bp, Homo sapiens
aaacattcaaagcaggatgtgt

SEQ ID NO: 9221548 - DNA, 22 bp, Homo sapiens
aaacattcacatttgctagtaa

SEQ ID NO: 9221549 - DNA, 22 bp, Homo sapiens
aaacatgttttctgaatatttt

SEQ ID NO: 9221550 - DNA, 22 bp, Homo sapiens
aaacattagacaccatatgctc

SEQ ID NO: 9221551 - DNA, 22 bp, Homo sapiens
aaacatgctggatttagaatat

SEQ ID NO: 9221552 - DNA, 22 bp, Homo sapiens
aaacatgtaagttcagatcacc

SEQ ID NO: 9221553 - DNA, 22 bp, Homo sapiens
aaactgtaagagaataaactac

SEQ ID NO: 9221554 - DNA, 22 bp, Homo sapiens
aaactgtatagggaaaagtaga

SEQ ID NO: 9221555 - DNA, 22 bp, Homo sapiens
aaacagcaatggagaagccagg

SEQ ID NO: 9221556 - DNA, 22 bp, Homo sapiens
aaacagcagctgtttaatttgc

SEQ ID NO: 9221557 - DNA, 22 bp, Homo sapiens
aaacagctaagtacattcaagg

SEQ ID NO: 9221558 - DNA, 22 bp, Homo sapiens
aaacagctgggaggtagaggcg

SEQ ID NO: 9221559 - DNA, 22 bp, Homo sapiens
aaacagctcaagaagttactct

SEQ ID NO: 9221560 - DNA, 22 bp, Homo sapiens
aaacagctacttctgtataatg

SEQ ID NO: 9221561 - DNA, 22 bp, Homo sapiens
aaacatgatgtcatatatgcca

SEQ ID NO: 9221562 - DNA, 22 bp, Homo sapiens
aaacatgatgcctgtactaaga

SEQ ID NO: 9221563 - DNA, 22 bp, Homo sapiens
aaacagctgtcattgttttaaa

SEQ ID NO: 9221564 - DNA, 22 bp, Homo sapiens
aaacagataagggacaatttca

SEQ ID NO: 9221565 - DNA, 22 bp, Homo sapiens
gtcaggagagatcaggacagca

SEQ ID NO: 9221566 - DNA, 22 bp, Homo sapiens
gtcaggacaggctctggactga

SEQ ID NO: 9221567 - DNA, 22 bp, Homo sapiens
gtcaggactctgacccgtcccg

SEQ ID NO: 9221568 - DNA, 22 bp, Homo sapiens
gtcaggaagtggcattggagaa

SEQ ID NO: 9221569 - DNA, 22 bp, Homo sapiens
gtcaggaagtggcattggagaa

SEQ ID NO: 9221570 - DNA, 22 bp, Homo sapiens
gtcaggaagcaaggttgggcat

SEQ ID NO: 9221571 - DNA, 22 bp, Homo sapiens
gtcaggaagcaaggttgggcat

SEQ ID NO: 9221572 - DNA, 22 bp, Homo sapiens
gtcaggccctggcagccgtgac

SEQ ID NO: 9221573 - DNA, 22 bp, Homo sapiens
gtcaggctgctggagcttgggt

SEQ ID NO: 9221574 - DNA, 22 bp, Homo sapiens
gtcaggattataatccccatgg

SEQ ID NO: 9221575 - DNA, 22 bp, Homo sapiens
gtcagctgcagtgggcacagcc

SEQ ID NO: 9221576 - DNA, 22 bp, Homo sapiens
gtcaggaaaaattgataatttt

SEQ ID NO: 9221577 - DNA, 22 bp, Homo sapiens
gtcaggaaaacccgggttgact

SEQ ID NO: 9221578 - DNA, 18 bp, Homo sapiens
gtccatggcctccaccca

SEQ ID NO: 9221579 - DNA, 22 bp, Homo sapiens
gtcccagggaagaaggcagcac

SEQ ID NO: 9221580 - DNA, 22 bp, Homo sapiens
gtcccagggaagaaggcagcac

SEQ ID NO: 9221581 - DNA, 22 bp, Homo sapiens
gtccatacaggcagtggctctg

SEQ ID NO: 9221582 - DNA, 22 bp, Homo sapiens
gtccatacagtggcacacatct

SEQ ID NO: 9221583 - DNA, 22 bp, Homo sapiens
gtcctgggtccccgcaggtcag

SEQ ID NO: 9221584 - DNA, 22 bp, Homo sapiens
gtcctgggtccccgcaggtcag

SEQ ID NO: 9221585 - DNA, 22 bp, Homo sapiens
gtcctggtagctggcttggtca

SEQ ID NO: 9221586 - DNA, 22 bp, Homo sapiens
gtcctggtagggctctgtgtct

SEQ ID NO: 9221587 - DNA, 22 bp, Homo sapiens
gtcctgtgtaagtacttgctca

SEQ ID NO: 9221588 - DNA, 22 bp, Homo sapiens
gtcccagggatgcagacatgag

SEQ ID NO: 9221589 - DNA, 22 bp, Homo sapiens
gtcccagggatgcagacatgag

SEQ ID NO: 9221590 - DNA, 22 bp, Homo sapiens
gtcccagggaggttcagggctt

SEQ ID NO: 9221591 - DNA, 22 bp, Homo sapiens
gtccttcaagtaacctgggacc

SEQ ID NO: 9221592 - DNA, 22 bp, Homo sapiens
gtccttcaaggtccttggtgtg

SEQ ID NO: 9221593 - DNA, 22 bp, Homo sapiens
gtccttcagcacctccctcggc

SEQ ID NO: 9221594 - DNA, 21 bp, Homo sapiens
gtccttcagcaagttagtggc

SEQ ID NO: 9221595 - DNA, 22 bp, Homo sapiens
gtccttcatttcctgatctcta

SEQ ID NO: 9221596 - DNA, 19 bp, Homo sapiens
gtctctggatttcaggtcc

SEQ ID NO: 9221597 - DNA, 22 bp, Homo sapiens
gtctcttttatggtgagttgat

SEQ ID NO: 9221598 - DNA, 22 bp, Homo sapiens
gtctgaggcctgaggccctggg

SEQ ID NO: 9221599 - DNA, 22 bp, Homo sapiens
gtctgagcaccctggcctgtca

SEQ ID NO: 9221600 - DNA, 22 bp, Homo sapiens
gtctgagggacagagtcctggc

SEQ ID NO: 9221601 - DNA, 22 bp, Homo sapiens
gtctgaggcgaggcctgagaac

SEQ ID NO: 9221602 - DNA, 22 bp, Homo sapiens
gtctgaggggtttcccaggaca

SEQ ID NO: 9221603 - DNA, 22 bp, Homo sapiens
gtctgaggggtttcccaggaca

SEQ ID NO: 9221604 - DNA, 22 bp, Homo sapiens
gtctggctttatatttgctatt

SEQ ID NO: 9221605 - DNA, 22 bp, Homo sapiens
gtctggctttgctcagatgctg

SEQ ID NO: 9221606 - DNA, 22 bp, Homo sapiens
gtctgggcacctggcctgggaa

SEQ ID NO: 9221607 - DNA, 22 bp, Homo sapiens
gtctgggcaagggagatggcgc

SEQ ID NO: 9221608 - DNA, 22 bp, Homo sapiens
gtctgggccaggcgagccgagg

SEQ ID NO: 9221609 - DNA, 22 bp, Homo sapiens
gtctgggcatcagactgcgggc

SEQ ID NO: 9221610 - DNA, 22 bp, Homo sapiens
gtctgggcagcagcatttctta

SEQ ID NO: 9221611 - DNA, 22 bp, Homo sapiens
gtctgggcaggaatctgcattc

SEQ ID NO: 9221612 - DNA, 22 bp, Homo sapiens
gtctggggcagcaaggcgcgcg

SEQ ID NO: 9221613 - DNA, 22 bp, Homo sapiens
gtctgggggtccgggtgcctgc

SEQ ID NO: 9221614 - DNA, 17 bp, Homo sapiens
gtctgggctttagagac

SEQ ID NO: 9221615 - DNA, 22 bp, Homo sapiens
gtctgggctcccagggtcggcg

SEQ ID NO: 9221616 - DNA, 22 bp, Homo sapiens
gtctgggcttagggacatggca

SEQ ID NO: 9221617 - DNA, 22 bp, Homo sapiens
gtctgggcttcagagttagaga

SEQ ID NO: 9221618 - DNA, 22 bp, Homo sapiens
gtctgggctcctggcaggcagc

SEQ ID NO: 9221619 - DNA, 22 bp, Homo sapiens
gtctggcattcttcctggagaa

SEQ ID NO: 9221620 - DNA, 22 bp, Homo sapiens
gtctggcatatgcaaagtgcat

SEQ ID NO: 9221621 - DNA, 22 bp, Homo sapiens
gtctggccatttgcccattgtg

SEQ ID NO: 9221622 - DNA, 22 bp, Homo sapiens
gtctggctcccactcttacaaa

SEQ ID NO: 9221623 - DNA, 22 bp, Homo sapiens
gtctgaggtcattagctctctt

SEQ ID NO: 9221624 - DNA, 22 bp, Homo sapiens
gtctgaggtcattagctctctt

SEQ ID NO: 9221625 - DNA, 22 bp, Homo sapiens
gtctgcagagggaaggcttcag

SEQ ID NO: 9221626 - DNA, 22 bp, Homo sapiens
gtctgcacggggaggatgggct

SEQ ID NO: 9221627 - DNA, 22 bp, Homo sapiens
gtctgcacgtgccagggagggg

SEQ ID NO: 9221628 - DNA, 22 bp, Homo sapiens
gtaaagaaggcaacctggttat

SEQ ID NO: 9221629 - DNA, 22 bp, Homo sapiens
gtaaagaaggcaacctggttat

SEQ ID NO: 9221630 - DNA, 22 bp, Homo sapiens
gtaaagaagtttttgaatgcat

SEQ ID NO: 9221631 - DNA, 22 bp, Homo sapiens
gtaaagaagtttttgaatgcat

SEQ ID NO: 9221632 - DNA, 22 bp, Homo sapiens
gtaaacattactgtgctgtata

SEQ ID NO: 9221633 - DNA, 22 bp, Homo sapiens
gtaaacatgctgtgtactcagc

SEQ ID NO: 9221634 - DNA, 22 bp, Homo sapiens
ggtgtcctcactatagcaagtc

SEQ ID NO: 9221635 - DNA, 22 bp, Homo sapiens
gtaaatattaaaggctgctaga

SEQ ID NO: 9221636 - DNA, 22 bp, Homo sapiens
gtaaatattccctcggttccta

SEQ ID NO: 9221637 - DNA, 22 bp, Homo sapiens
gtaaatataaatgctagctgcc

SEQ ID NO: 9221638 - DNA, 22 bp, Homo sapiens
gtaaataactggtaattggggt

SEQ ID NO: 9221639 - DNA, 22 bp, Homo sapiens
gtacatttaggattcattgaaa

SEQ ID NO: 9221640 - DNA, 22 bp, Homo sapiens
gtacattctgtggacttggaca

SEQ ID NO: 9221641 - DNA, 22 bp, Homo sapiens
gtacatatcctttacgttttgt

SEQ ID NO: 9221642 - DNA, 22 bp, Homo sapiens
gtatatatgtgtgaacatgtat

SEQ ID NO: 9221643 - DNA, 22 bp, Homo sapiens
gtatatatcggcactattttaa

SEQ ID NO: 9221644 - DNA, 22 bp, Homo sapiens
ggtggcagttacaggggcaaat

SEQ ID NO: 9221645 - DNA, 22 bp, Homo sapiens
ggtggcaggctggcattggcaa

SEQ ID NO: 9221646 - DNA, 22 bp, Homo sapiens
ggtggccataggaccagcctgg

SEQ ID NO: 9221647 - DNA, 22 bp, Homo sapiens
ggtggccaggccagctctggcc

SEQ ID NO: 9221648 - DNA, 22 bp, Homo sapiens
ggtggcattcagaagagctggc

SEQ ID NO: 9221649 - DNA, 23 bp, Homo sapiens
ggtggcaggagtggatgctgagc

SEQ ID NO: 9221650 - DNA, 22 bp, Homo sapiens
ggtggcagcatggtcccagtgt

SEQ ID NO: 9221651 - DNA, 22 bp, Homo sapiens
ggtggcagcgtctatctgacat

SEQ ID NO: 9221652 - DNA, 22 bp, Homo sapiens
ggtggcaggccctgagcatccc

SEQ ID NO: 9221653 - DNA, 22 bp, Homo sapiens
ggtggcaggccctgagcatccc

SEQ ID NO: 9221654 - DNA, 22 bp, Homo sapiens
ggtggttcacgcctataatccc

SEQ ID NO: 9221655 - DNA, 22 bp, Homo sapiens
ggtggtgggagagctttctgga

SEQ ID NO: 9221656 - DNA, 22 bp, Homo sapiens
ggtggtgggagagctttctgga

SEQ ID NO: 9221657 - DNA, 23 bp, Homo sapiens
ggtggtggtgagtcacgggctca

SEQ ID NO: 9221658 - DNA, 23 bp, Homo sapiens
ggtggtggtgagtcacgggctca

SEQ ID NO: 9221659 - DNA, 23 bp, Homo sapiens
ggtggtggtgagtcacgggctca

SEQ ID NO: 9221660 - DNA, 22 bp, Homo sapiens
ggtggtggtcccgacttgggag

SEQ ID NO: 9221661 - DNA, 22 bp, Homo sapiens
ggtggtggtcccgacttgggag

SEQ ID NO: 9221662 - DNA, 22 bp, Homo sapiens
ggtgaggggcgcctctgcccag

SEQ ID NO: 9221663 - DNA, 22 bp, Homo sapiens
ggtgaggggcacctctgcccgg

SEQ ID NO: 9221664 - DNA, 22 bp, Homo sapiens
ggtgaggggctcctctgcccgg

SEQ ID NO: 9221665 - DNA, 22 bp, Homo sapiens
ggtgaggggcgcctctgcccgg

SEQ ID NO: 9221666 - DNA, 22 bp, Homo sapiens
ggtgagggtaaatataggcaaa

SEQ ID NO: 9221667 - DNA, 22 bp, Homo sapiens
gggtggggttcaggaatcttca

SEQ ID NO: 9221668 - DNA, 22 bp, Homo sapiens
gggtggggtgtatcggatccta

SEQ ID NO: 9221669 - DNA, 22 bp, Homo sapiens
gggtggggcccaggaaatctat

SEQ ID NO: 9221670 - DNA, 22 bp, Homo sapiens
gggtgggcctgtctggccatgt

SEQ ID NO: 9221671 - DNA, 22 bp, Homo sapiens
gggtggggccaggcaatttgca

SEQ ID NO: 9221672 - DNA, 22 bp, Homo sapiens
ggtgcaggcggtggggcaagta

SEQ ID NO: 9221673 - DNA, 22 bp, Homo sapiens
ggtggcagagaggaggtagttt

SEQ ID NO: 9221674 - DNA, 22 bp, Homo sapiens
ggtggcagaggtgcatcagccc

SEQ ID NO: 9221675 - DNA, 22 bp, Homo sapiens
ggtggcagaggtgcatcagccc

SEQ ID NO: 9221676 - DNA, 22 bp, Homo sapiens
ggtgatgaaaagtgcctttatc

SEQ ID NO: 9221677 - DNA, 22 bp, Homo sapiens
ggtgcaggaatctgcaattgaa

SEQ ID NO: 9221678 - DNA, 22 bp, Homo sapiens
gtggaggacaaaagaagccttt

SEQ ID NO: 9221679 - DNA, 22 bp, Homo sapiens
gtggagggtgattgccggctgt

SEQ ID NO: 9221680 - DNA, 22 bp, Homo sapiens
gtggagtggcctggccctgaga

SEQ ID NO: 9221681 - DNA, 22 bp, Homo sapiens
gtggagggtttgcaatgtgcag

SEQ ID NO: 9221682 - DNA, 22 bp, Homo sapiens
gtggacatgcatacatatgttt

SEQ ID NO: 9221683 - DNA, 22 bp, Homo sapiens
gtggacagcttctaggtgccag

SEQ ID NO: 9221684 - DNA, 22 bp, Homo sapiens
gtggacaggcaggctgtcgggg

SEQ ID NO: 9221685 - DNA, 22 bp, Homo sapiens
gtggacagacataatcctaatt

SEQ ID NO: 9221686 - DNA, 22 bp, Homo sapiens
gtggcagagggtgagctggact

SEQ ID NO: 9221687 - DNA, 22 bp, Homo sapiens
gtggcagagggtgagctggact

SEQ ID NO: 9221688 - DNA, 22 bp, Homo sapiens
gtggcagagccgtgcaggtagg

SEQ ID NO: 9221689 - DNA, 22 bp, Homo sapiens
gtggcagattgctcaccatggt

SEQ ID NO: 9221690 - DNA, 22 bp, Homo sapiens
gtggcagagttcaggcgtttgg

SEQ ID NO: 9221691 - DNA, 22 bp, Homo sapiens
gtggatggccctgcacacaggt

SEQ ID NO: 9221692 - DNA, 22 bp, Homo sapiens
gtggcacagaagtttagagaac

SEQ ID NO: 9221693 - DNA, 22 bp, Homo sapiens
gtggcacaaggcttacacagca

SEQ ID NO: 9221694 - DNA, 22 bp, Homo sapiens
gtggcacagccaagcctcactc

SEQ ID NO: 9221695 - DNA, 22 bp, Homo sapiens
gtggcacagggtgtggcacaca

SEQ ID NO: 9221696 - DNA, 22 bp, Homo sapiens
gtggcacagagatggggcatga

SEQ ID NO: 9221697 - DNA, 22 bp, Homo sapiens
gtggcacagtgggagagcccca

SEQ ID NO: 9221698 - DNA, 22 bp, Homo sapiens
gtggcacagtctgaaattttga

SEQ ID NO: 9221699 - DNA, 22 bp, Homo sapiens
gtggcacacaggagagagctca

SEQ ID NO: 9221700 - DNA, 22 bp, Homo sapiens
gtggcacagggttgttggtcat

SEQ ID NO: 9221701 - DNA, 22 bp, Homo sapiens
gtggcacataggatcctgtggc

SEQ ID NO: 9221702 - DNA, 22 bp, Homo sapiens
gtggcacattggtagggtctgt

SEQ ID NO: 9221703 - DNA, 22 bp, Homo sapiens
gtggcacatgctgctgcttctg

SEQ ID NO: 9221704 - DNA, 22 bp, Homo sapiens
gtggcactaaatacagcatttc

SEQ ID NO: 9221705 - DNA, 22 bp, Homo sapiens
gtggcactcacctgtagtttca

SEQ ID NO: 9221706 - DNA, 22 bp, Homo sapiens
gtggcagagccgtgcaggtagg

SEQ ID NO: 9221707 - DNA, 22 bp, Homo sapiens
gtgcctggaactgggtaggctg

SEQ ID NO: 9221708 - DNA, 22 bp, Homo sapiens
gtgcctgagccagctgcagctc

SEQ ID NO: 9221709 - DNA, 22 bp, Homo sapiens
gtgcctgcagcaatccatggca

SEQ ID NO: 9221710 - DNA, 22 bp, Homo sapiens
gtgcctgctacctgacttgttt

SEQ ID NO: 9221711 - DNA, 22 bp, Homo sapiens
gtgcctgctgcagagtcgctgt

SEQ ID NO: 9221712 - DNA, 22 bp, Homo sapiens
gtgaccagtgatgctgaggagt

SEQ ID NO: 9221713 - DNA, 22 bp, Homo sapiens
gtgacaatattagctcaggggc

SEQ ID NO: 9221714 - DNA, 22 bp, Homo sapiens
gtgctttttataaggcagactg

SEQ ID NO: 9221715 - DNA, 22 bp, Homo sapiens
gtgctttttcaatcagaaggga

SEQ ID NO: 9221716 - DNA, 22 bp, Homo sapiens
gtggaagggactgcctagagga

SEQ ID NO: 9221717 - DNA, 22 bp, Homo sapiens
gtgcctttgtgtctaaaacagc

SEQ ID NO: 9221718 - DNA, 22 bp, Homo sapiens
gtgcctttgagaagtttctctg

SEQ ID NO: 9221719 - DNA, 22 bp, Homo sapiens
gtgccttttcttcatagttact

SEQ ID NO: 9221720 - DNA, 22 bp, Homo sapiens
gtgcgcaccctcccggcatccc

SEQ ID NO: 9221721 - DNA, 20 bp, Homo sapiens
gtgcctggagaagaggctgt

SEQ ID NO: 9221722 - DNA, 22 bp, Homo sapiens
gtgcctgtttcttttgaattca

SEQ ID NO: 9221723 - DNA, 22 bp, Homo sapiens
gtggcctggcgagctggcgcgg

SEQ ID NO: 9221724 - DNA, 22 bp, Homo sapiens
gtgggagaaattagctctagtt

SEQ ID NO: 9221725 - DNA, 22 bp, Homo sapiens
gtggcttccaagactaagtcac

SEQ ID NO: 9221726 - DNA, 22 bp, Homo sapiens
gtgggagcatggtcccagtgcc

SEQ ID NO: 9221727 - DNA, 22 bp, Homo sapiens
gtgggagcatggtcccagtgcc

SEQ ID NO: 9221728 - DNA, 22 bp, Homo sapiens
gtgggagccctcagggaggtgc

SEQ ID NO: 9221729 - DNA, 22 bp, Homo sapiens
gtgggagccctcagggaggtgc

SEQ ID NO: 9221730 - DNA, 22 bp, Homo sapiens
gtgggagctttggcatcaggct

SEQ ID NO: 9221731 - DNA, 22 bp, Homo sapiens
gtgggatgcagtggtgagtggc

SEQ ID NO: 9221732 - DNA, 22 bp, Homo sapiens
gtgggagcttcatcaagcagtt

SEQ ID NO: 9221733 - DNA, 22 bp, Homo sapiens
gtgggagctgcggaggcctggg

SEQ ID NO: 9221734 - DNA, 22 bp, Homo sapiens
gtgggagctgcggaggcctggg

SEQ ID NO: 9221735 - DNA, 22 bp, Homo sapiens
gtggcagggcaatgctccctct

SEQ ID NO: 9221736 - DNA, 22 bp, Homo sapiens
gtggcaggagtgggccttgaag

SEQ ID NO: 9221737 - DNA, 22 bp, Homo sapiens
gtggcaggagagacacagccat

SEQ ID NO: 9221738 - DNA, 22 bp, Homo sapiens
gtggcatctcagaggccaagaa

SEQ ID NO: 9221739 - DNA, 22 bp, Homo sapiens
gtggcattgacatgtaaacagt

SEQ ID NO: 9221740 - DNA, 22 bp, Homo sapiens
gtggcattgacatgtaaacagt

SEQ ID NO: 9221741 - DNA, 22 bp, Homo sapiens
gtggcatttgaacaatcacata

SEQ ID NO: 9221742 - DNA, 22 bp, Homo sapiens
gtggcagttctgtgtctcttgt

SEQ ID NO: 9221743 - DNA, 22 bp, Homo sapiens
gtggcccaggcttggcgctggc

SEQ ID NO: 9221744 - DNA, 22 bp, Homo sapiens
gtggccccagggccctgtctgg

SEQ ID NO: 9221745 - DNA, 22 bp, Homo sapiens
gtggcccaggcaccctgatgac

SEQ ID NO: 9221746 - DNA, 22 bp, Homo sapiens
gtggcccaggcttggcgctggc

SEQ ID NO: 9221747 - DNA, 22 bp, Homo sapiens
gtggccctctgatagggtcagg

SEQ ID NO: 9221748 - DNA, 22 bp, Homo sapiens
gtggccctcagcagttgccaag

SEQ ID NO: 9221749 - DNA, 22 bp, Homo sapiens
gtggccaggacattgccaggca

SEQ ID NO: 9221750 - DNA, 22 bp, Homo sapiens
gtggccagctgtcagcaccctt

SEQ ID NO: 9221751 - DNA, 22 bp, Homo sapiens
gtggccagaaccaggagaatga

SEQ ID NO: 9221752 - DNA, 22 bp, Homo sapiens
gtggccagaatcttgaggcctt

SEQ ID NO: 9221753 - DNA, 22 bp, Homo sapiens
gtggccagaatcttgaggcctt

SEQ ID NO: 9221754 - DNA, 22 bp, Homo sapiens
gtggccagagattaaatagagt

SEQ ID NO: 9221755 - DNA, 22 bp, Homo sapiens
gtggccagaggtcccatgtgtc

SEQ ID NO: 9221756 - DNA, 18 bp, Homo sapiens
gtggccagcctggtcttg

SEQ ID NO: 9221757 - DNA, 22 bp, Homo sapiens
gtggccagccccatggacagtt

SEQ ID NO: 9221758 - DNA, 22 bp, Homo sapiens
gtggccagccagggtgctgatg

SEQ ID NO: 9221759 - DNA, 22 bp, Homo sapiens
gtggccagaggtcccatgtgtc

SEQ ID NO: 9221760 - DNA, 22 bp, Homo sapiens
gtggccagccagggtgctgatg

SEQ ID NO: 9221761 - DNA, 22 bp, Homo sapiens
gtggccagcaagtgctgcctct

SEQ ID NO: 9221762 - DNA, 18 bp, Homo sapiens
gtgtcctggctgcggcgc

SEQ ID NO: 9221763 - DNA, 22 bp, Homo sapiens
gtgtcctgccaccctgggcttt

SEQ ID NO: 9221764 - DNA, 22 bp, Homo sapiens
gtgtcctgagtgaggcctggcc

SEQ ID NO: 9221765 - DNA, 22 bp, Homo sapiens
gtgtggggtcttctcttggcct

SEQ ID NO: 9221766 - DNA, 22 bp, Homo sapiens
gtgtggggctcagtgggaatgt

SEQ ID NO: 9221767 - DNA, 22 bp, Homo sapiens
gtgtgggggcagctctgatatg

SEQ ID NO: 9221768 - DNA, 22 bp, Homo sapiens
gtgtggggccaggatcagggct

SEQ ID NO: 9221769 - DNA, 22 bp, Homo sapiens
gtgtggggagctgcagccacat

SEQ ID NO: 9221770 - DNA, 22 bp, Homo sapiens
gtgtggggaggagagagccctt

SEQ ID NO: 9221771 - DNA, 22 bp, Homo sapiens
gtgtgcagaggcaggaggtgct

SEQ ID NO: 9221772 - DNA, 22 bp, Homo sapiens
gtgtgcagaagacacaagacat

SEQ ID NO: 9221773 - DNA, 22 bp, Homo sapiens
gtgtgcagaacagggagtgggt

SEQ ID NO: 9221774 - DNA, 22 bp, Homo sapiens
gtgtgcaggtgtcagtgcagct

SEQ ID NO: 9221775 - DNA, 22 bp, Homo sapiens
gtgtgcagtagagaaagagcag

SEQ ID NO: 9221776 - DNA, 22 bp, Homo sapiens
gtgtgcagggatgagtgcaggt

SEQ ID NO: 9221777 - DNA, 21 bp, Homo sapiens
gttattttaagtgagctttgc

SEQ ID NO: 9221778 - DNA, 22 bp, Homo sapiens
gttattttatctctgagaggtt

SEQ ID NO: 9221779 - DNA, 22 bp, Homo sapiens
gttcaaaattcaaatggtatac

SEQ ID NO: 9221780 - DNA, 22 bp, Homo sapiens
gttattttcattggctcagact

SEQ ID NO: 9221781 - DNA, 22 bp, Homo sapiens
gttattttaacttctcagtaat

SEQ ID NO: 9221782 - DNA, 22 bp, Homo sapiens
gttcgcatcttgatcatggact

SEQ ID NO: 9221783 - DNA, 22 bp, Homo sapiens
gttcaagaccagcctggccaac

SEQ ID NO: 9221784 - DNA, 22 bp, Homo sapiens
gttcaagaccagcctggccaac

SEQ ID NO: 9221785 - DNA, 22 bp, Homo sapiens
gttctccctgtcccctgagctt

SEQ ID NO: 9221786 - DNA, 22 bp, Homo sapiens
gttctcatagtggaaaataggt

SEQ ID NO: 9221787 - DNA, 22 bp, Homo sapiens
gttctcagggataacttccccc

SEQ ID NO: 9221788 - DNA, 22 bp, Homo sapiens
gttctcagtgatctgtgattcg

SEQ ID NO: 9221789 - DNA, 22 bp, Homo sapiens
gttgttttataggctcatgcct

SEQ ID NO: 9221790 - DNA, 22 bp, Homo sapiens
gttgttttattgtgagtcccat

SEQ ID NO: 9221791 - DNA, 22 bp, Homo sapiens
gttgttttcacaaacccatgat

SEQ ID NO: 9221792 - DNA, 22 bp, Homo sapiens
gttgttttaaaatactccagaa

SEQ ID NO: 9221793 - DNA, 22 bp, Homo sapiens
gttgttttataattgattgcaa

SEQ ID NO: 9221794 - DNA, 22 bp, Homo sapiens
gttctgagtcctcctttgaagg

SEQ ID NO: 9221795 - DNA, 22 bp, Homo sapiens
gtggggtagatctttctcagga

SEQ ID NO: 9221796 - DNA, 22 bp, Homo sapiens
gtgggggtttcattaagacaat

SEQ ID NO: 9221797 - DNA, 22 bp, Homo sapiens
gtgggggtggaaaggcaagttg

SEQ ID NO: 9221798 - DNA, 22 bp, Homo sapiens
gtggggggagctgcaagctgga

SEQ ID NO: 9221799 - DNA, 22 bp, Homo sapiens
gtgggggctggctcgtcctgtg

SEQ ID NO: 9221800 - DNA, 18 bp, Homo sapiens
gtggggtgttgtgaggat

SEQ ID NO: 9221801 - DNA, 22 bp, Homo sapiens
gtggggtgtccagcagcgagct

SEQ ID NO: 9221802 - DNA, 22 bp, Homo sapiens
gtggggtgtccagcagcgagct

SEQ ID NO: 9221803 - DNA, 22 bp, Homo sapiens
gtggggtgggctgagttaggcc

SEQ ID NO: 9221804 - DNA, 22 bp, Homo sapiens
gtggtcagaaatctcagtggca

SEQ ID NO: 9221805 - DNA, 22 bp, Homo sapiens
gtgggtggaggcgtcgagggca

SEQ ID NO: 9221806 - DNA, 22 bp, Homo sapiens
gtggtcagcagcagtgggagtg

SEQ ID NO: 9221807 - DNA, 22 bp, Homo sapiens
gtggtcagagatgacagtgggt

SEQ ID NO: 9221808 - DNA, 22 bp, Homo sapiens
gtggtcagagatgacagtgggt

SEQ ID NO: 9221809 - DNA, 22 bp, Homo sapiens
gtggtcagaatggagcccagga

SEQ ID NO: 9221810 - DNA, 22 bp, Homo sapiens
gtggtcagagatgacagtgggt

SEQ ID NO: 9221811 - DNA, 22 bp, Homo sapiens
gtggtcagaatggagcccagga

SEQ ID NO: 9221812 - DNA, 22 bp, Homo sapiens
gtggtcaggggctgaggtgccc

SEQ ID NO: 9221813 - DNA, 22 bp, Homo sapiens
gtggtcaggttatcagatcata

SEQ ID NO: 9221814 - DNA, 22 bp, Homo sapiens
gtggtcaggggctgtggctatg

SEQ ID NO: 9221815 - DNA, 22 bp, Homo sapiens
gtggtcaggcagtgggagagaa

SEQ ID NO: 9221816 - DNA, 22 bp, Homo sapiens
gtgggtggagactgggtgcaag

SEQ ID NO: 9221817 - DNA, 22 bp, Homo sapiens
gtgggtgcggggagccgaggcg

SEQ ID NO: 9221818 - DNA, 22 bp, Homo sapiens
gtggtttttagatttctacagt

SEQ ID NO: 9221819 - DNA, 22 bp, Homo sapiens
gtggtttgttttattcctggaa

SEQ ID NO: 9221820 - DNA, 22 bp, Homo sapiens
gtgtaagtggaatcatatagta

SEQ ID NO: 9221821 - DNA, 21 bp, Homo sapiens
gtggttctagagaaacagaat

SEQ ID NO: 9221822 - DNA, 21 bp, Homo sapiens
gtggttctagagaaacagaat

SEQ ID NO: 9221823 - DNA, 22 bp, Homo sapiens
gtggtttgtgcatagctcctat

SEQ ID NO: 9221824 - DNA, 22 bp, Homo sapiens
gtggtgtaggtcacagttagga

SEQ ID NO: 9221825 - DNA, 22 bp, Homo sapiens
gtggtgcaggccagcaggggcg

SEQ ID NO: 9221826 - DNA, 22 bp, Homo sapiens
gtggtcctgcacccgcttggcc

SEQ ID NO: 9221827 - DNA, 22 bp, Homo sapiens
gtggtcctgccagccaggtcca

SEQ ID NO: 9221828 - DNA, 22 bp, Homo sapiens
gtggtcctcataattcagtgag

SEQ ID NO: 9221829 - DNA, 22 bp, Homo sapiens
gtggtcctggcaaccatggtga

SEQ ID NO: 9221830 - DNA, 22 bp, Homo sapiens
gtggtcctggcaaccatggtga

SEQ ID NO: 9221831 - DNA, 22 bp, Homo sapiens
gtggtctggggtcaggcctgag

SEQ ID NO: 9221832 - DNA, 22 bp, Homo sapiens
gtgggcttctgttagggaggct

SEQ ID NO: 9221833 - DNA, 22 bp, Homo sapiens
gtgggccagttcctcacaggta

SEQ ID NO: 9221834 - DNA, 22 bp, Homo sapiens
gtggggcttcctggggcaagtt

SEQ ID NO: 9221835 - DNA, 22 bp, Homo sapiens
gtgggggatgctgagttggaaa

SEQ ID NO: 9221836 - DNA, 22 bp, Homo sapiens
gtgggggcaggcagtgctagga

SEQ ID NO: 9221837 - DNA, 22 bp, Homo sapiens
gtgggggcaggcagtgctagga

SEQ ID NO: 9221838 - DNA, 22 bp, Homo sapiens
gtgggggcagtgggcttcgagc

SEQ ID NO: 9221839 - DNA, 22 bp, Homo sapiens
gtgggggctggaaatcttgcca

SEQ ID NO: 9221840 - DNA, 22 bp, Homo sapiens
gtggggaaaggagtggggctca

SEQ ID NO: 9221841 - DNA, 22 bp, Homo sapiens
gtggggaggcctaagcaagttg

SEQ ID NO: 9221842 - DNA, 22 bp, Homo sapiens
gtgggccacatcccagggctct

SEQ ID NO: 9221843 - DNA, 22 bp, Homo sapiens
gtgggccaggccggagtgcaga

SEQ ID NO: 9221844 - DNA, 19 bp, Homo sapiens
gtgggccaggcagaaggct

SEQ ID NO: 9221845 - DNA, 22 bp, Homo sapiens
gtgggccagcttttctcctggg

SEQ ID NO: 9221846 - DNA, 22 bp, Homo sapiens
gtgggcagccccttcaaggcca

SEQ ID NO: 9221847 - DNA, 22 bp, Homo sapiens
gtgggcagcctgtccggagacc

SEQ ID NO: 9221848 - DNA, 22 bp, Homo sapiens
gtgggcagagcaagggaactca

SEQ ID NO: 9221849 - DNA, 22 bp, Homo sapiens
gtgggcagacatgatagaagga

SEQ ID NO: 9221850 - DNA, 20 bp, Homo sapiens
gtgggcagcaggcatactgg

SEQ ID NO: 9221851 - DNA, 22 bp, Homo sapiens
gtgggcagcaccagggaagtgt

SEQ ID NO: 9221852 - DNA, 22 bp, Homo sapiens
gtgggcagcaccagggaagtgt

SEQ ID NO: 9221853 - DNA, 22 bp, Homo sapiens
gtgggcagcaccagggaagtgt

SEQ ID NO: 9221854 - DNA, 22 bp, Homo sapiens
gtgggcagaggagagaacatta

SEQ ID NO: 9221855 - DNA, 22 bp, Homo sapiens
gtttaaataattaggggcctgt

SEQ ID NO: 9221856 - DNA, 22 bp, Homo sapiens
gttgtttttgttctctatagct

SEQ ID NO: 9221857 - DNA, 22 bp, Homo sapiens
gttgttttgcaggatccttaca

SEQ ID NO: 9221858 - DNA, 22 bp, Homo sapiens
gttgttttcagcagtttatgac

SEQ ID NO: 9221859 - DNA, 22 bp, Homo sapiens
gttgttttgctgtctgtcttag

SEQ ID NO: 9221860 - DNA, 19 bp, Homo sapiens
gttgtttttcttattatgg

SEQ ID NO: 9221861 - DNA, 22 bp, Homo sapiens
gttgtttttgaacggtggtggc

SEQ ID NO: 9221862 - DNA, 22 bp, Homo sapiens
gtttaaccaagagcattgtgca

SEQ ID NO: 9221863 - DNA, 22 bp, Homo sapiens
gttttttgggtgtatatcttct

SEQ ID NO: 9221864 - DNA, 22 bp, Homo sapiens
gtttttctttgtgtgaagacaa

SEQ ID NO: 9221865 - DNA, 22 bp, Homo sapiens
gtttttctttgtgtgaagacaa

SEQ ID NO: 9221866 - DNA, 20 bp, Homo sapiens
gtttttctctcttgccacta

SEQ ID NO: 9221867 - DNA, 22 bp, Homo sapiens
taaaggcagccactgagctcaa

SEQ ID NO: 9221868 - DNA, 22 bp, Homo sapiens
taaaggcagttctgattaggtc

SEQ ID NO: 9221869 - DNA, 22 bp, Homo sapiens
taaaggcagttggagttgagga

SEQ ID NO: 9221870 - DNA, 22 bp, Homo sapiens
taaaggcctagtaagttgagac

SEQ ID NO: 9221871 - DNA, 22 bp, Homo sapiens
taaaggccagggcctgagtgct

SEQ ID NO: 9221872 - DNA, 22 bp, Homo sapiens
taaaggccatgatggaggatca

SEQ ID NO: 9221873 - DNA, 22 bp, Homo sapiens
taaatacttttactccactgat

SEQ ID NO: 9221874 - DNA, 22 bp, Homo sapiens
taaaactagaccgtgagtctaa

SEQ ID NO: 9221875 - DNA, 19 bp, Homo sapiens
taaaacgtgcatggcagca

SEQ ID NO: 9221876 - DNA, 22 bp, Homo sapiens
taaaacagcagggcagagaagt

SEQ ID NO: 9221877 - DNA, 22 bp, Homo sapiens
taaaggaactgctgctatggaa

SEQ ID NO: 9221878 - DNA, 22 bp, Homo sapiens
taacagaatagcagaaacagaa

SEQ ID NO: 9221879 - DNA, 22 bp, Homo sapiens
taacagcactggcaggcactgt

SEQ ID NO: 9221880 - DNA, 22 bp, Homo sapiens
taagaaatttagttatagaatg

SEQ ID NO: 9221881 - DNA, 22 bp, Homo sapiens
taagaaatttagttatagaatg

SEQ ID NO: 9221882 - DNA, 22 bp, Homo sapiens
ggaaagagggacccagcttggt

SEQ ID NO: 9221883 - DNA, 22 bp, Homo sapiens
ggaaccttgctagatgctgagg

SEQ ID NO: 9221884 - DNA, 19 bp, Homo sapiens
ggaaccttggagcttcggc

SEQ ID NO: 9221885 - DNA, 22 bp, Homo sapiens
ggaacctttctccaggttgtag

SEQ ID NO: 9221886 - DNA, 22 bp, Homo sapiens
ggaacctttgtgaagggagagg

SEQ ID NO: 9221887 - DNA, 22 bp, Homo sapiens
ggaacctttgtgctccactggg

SEQ ID NO: 9221888 - DNA, 22 bp, Homo sapiens
ggaaagccaggtgctctggtgt

SEQ ID NO: 9221889 - DNA, 22 bp, Homo sapiens
ggaactcctgctccaagcagct

SEQ ID NO: 9221890 - DNA, 22 bp, Homo sapiens
ggaactcctgctccaagcagct

SEQ ID NO: 9221891 - DNA, 23 bp, Homo sapiens
ggaaagagaggagttgtgcatag

SEQ ID NO: 9221892 - DNA, 22 bp, Homo sapiens
ggaaagagcccagcagtgcttg

SEQ ID NO: 9221893 - DNA, 22 bp, Homo sapiens
ggaaactgcttacactagaggg

SEQ ID NO: 9221894 - DNA, 22 bp, Homo sapiens
ggaaactagaagaatactagtc

SEQ ID NO: 9221895 - DNA, 22 bp, Homo sapiens
ggaaacacatgatcagacatct

SEQ ID NO: 9221896 - DNA, 22 bp, Homo sapiens
ggaaacatgcctgctggacagt

SEQ ID NO: 9221897 - DNA, 22 bp, Homo sapiens
ggaaaactgaggctctcagcag

SEQ ID NO: 9221898 - DNA, 17 bp, Homo sapiens
ggaagaaaaggatcatc

SEQ ID NO: 9221899 - DNA, 22 bp, Homo sapiens
ggaaggggttaggggtccctga

SEQ ID NO: 9221900 - DNA, 22 bp, Homo sapiens
ggaagggtttaagcaggagagt

SEQ ID NO: 9221901 - DNA, 22 bp, Homo sapiens
ggaaggggtgtcgcccatggat

SEQ ID NO: 9221902 - DNA, 22 bp, Homo sapiens
ggaaggggtgtcgcccatggat

SEQ ID NO: 9221903 - DNA, 21 bp, Homo sapiens
ggaaggggtcctcccaacagt

SEQ ID NO: 9221904 - DNA, 22 bp, Homo sapiens
ggaaggggtgggtgagcctcag

SEQ ID NO: 9221905 - DNA, 22 bp, Homo sapiens
ggaagggagtagttggaatgca

SEQ ID NO: 9221906 - DNA, 22 bp, Homo sapiens
gcttcctggagggagagagctg

SEQ ID NO: 9221907 - DNA, 22 bp, Homo sapiens
gcttcctggagggagagagctg

SEQ ID NO: 9221908 - DNA, 22 bp, Homo sapiens
gcttcaggctgaattcctccta

SEQ ID NO: 9221909 - DNA, 22 bp, Homo sapiens
gcttcattactgacagtctgtg

SEQ ID NO: 9221910 - DNA, 22 bp, Homo sapiens
gcttcagaagttgggctctgac

SEQ ID NO: 9221911 - DNA, 22 bp, Homo sapiens
gcttcacagaatcaatagttgg

SEQ ID NO: 9221912 - DNA, 22 bp, Homo sapiens
gcttcgctgctagctagttggt

SEQ ID NO: 9221913 - DNA, 20 bp, Homo sapiens
gcttctcagggcttctctga

SEQ ID NO: 9221914 - DNA, 22 bp, Homo sapiens
gcttctgagttcttgcttaata

SEQ ID NO: 9221915 - DNA, 22 bp, Homo sapiens
gcttccttccttacattggtgg

SEQ ID NO: 9221916 - DNA, 22 bp, Homo sapiens
gcttccttctaccacatcatgc

SEQ ID NO: 9221917 - DNA, 22 bp, Homo sapiens
gcttccttattgttgccatagt

SEQ ID NO: 9221918 - DNA, 22 bp, Homo sapiens
gcttccttattgttgccatagt

SEQ ID NO: 9221919 - DNA, 22 bp, Homo sapiens
gcttcctgtatcctcctgtacc

SEQ ID NO: 9221920 - DNA, 22 bp, Homo sapiens
gcttcctgtatcctcctgtacc

SEQ ID NO: 9221921 - DNA, 22 bp, Homo sapiens
gcttcctgtaggcaggtccaag

SEQ ID NO: 9221922 - DNA, 17 bp, Homo sapiens
gcttcctgtgctgggga

SEQ ID NO: 9221923 - DNA, 22 bp, Homo sapiens
gcttcctgtccctcagccatga

SEQ ID NO: 9221924 - DNA, 22 bp, Homo sapiens
gcttcctgtccaggccccacat

SEQ ID NO: 9221925 - DNA, 22 bp, Homo sapiens
gcttcctgtccctcagccatga

SEQ ID NO: 9221926 - DNA, 22 bp, Homo sapiens
gctgggctgagctagacttggc

SEQ ID NO: 9221927 - DNA, 22 bp, Homo sapiens
gctgggctgagctagacttggc

SEQ ID NO: 9221928 - DNA, 22 bp, Homo sapiens
gctgggctgagctagacttggc

SEQ ID NO: 9221929 - DNA, 22 bp, Homo sapiens
gctgggctgcgtcggggaagcc

SEQ ID NO: 9221930 - DNA, 22 bp, Homo sapiens
gctgggctgcccaacctctgac

SEQ ID NO: 9221931 - DNA, 22 bp, Homo sapiens
gctgggctgcccaacctctgac

SEQ ID NO: 9221932 - DNA, 22 bp, Homo sapiens
gctgggctgcccaacctctgac

SEQ ID NO: 9221933 - DNA, 22 bp, Homo sapiens
gcttagtgtaggacctggaata

SEQ ID NO: 9221934 - DNA, 22 bp, Homo sapiens
gcttagtggtgtgcaaaggggt

SEQ ID NO: 9221935 - DNA, 16 bp, Homo sapiens
gcttagtgagagcaac

SEQ ID NO: 9221936 - DNA, 22 bp, Homo sapiens
gctgggctctgtcatgccttcc

SEQ ID NO: 9221937 - DNA, 22 bp, Homo sapiens
gctgggctctgtcatgccttcc

SEQ ID NO: 9221938 - DNA, 22 bp, Homo sapiens
gctgggctctgtcatgccttcc

SEQ ID NO: 9221939 - DNA, 22 bp, Homo sapiens
gctgggctcgttcccacacgcg

SEQ ID NO: 9221940 - DNA, 21 bp, Homo sapiens
gctgggctccagtctgccgct

SEQ ID NO: 9221941 - DNA, 22 bp, Homo sapiens
gctgggctcgttcccacacgcg

SEQ ID NO: 9221942 - DNA, 21 bp, Homo sapiens
gctgggctccagtctgccgct

SEQ ID NO: 9221943 - DNA, 22 bp, Homo sapiens
gctgggctctttacccctgtac

SEQ ID NO: 9221944 - DNA, 22 bp, Homo sapiens
gctgggctcttatcacctgtac

SEQ ID NO: 9221945 - DNA, 22 bp, Homo sapiens
gctgggctcttatcacctgtac

SEQ ID NO: 9221946 - DNA, 22 bp, Homo sapiens
gctgggctcttatcacctgtac

SEQ ID NO: 9221947 - DNA, 22 bp, Homo sapiens
gctgggctgagaagttaagcaa

SEQ ID NO: 9221948 - DNA, 22 bp, Homo sapiens
gctgggctgagctagacttggc

SEQ ID NO: 9221949 - DNA, 22 bp, Homo sapiens
gctgggctcagacctagtgaac

SEQ ID NO: 9221950 - DNA, 22 bp, Homo sapiens
gctgggctcagacctagtgaac

SEQ ID NO: 9221951 - DNA, 22 bp, Homo sapiens
gctgggctcagacctagtgaac

SEQ ID NO: 9221952 - DNA, 22 bp, Homo sapiens
gctgggcatgtgaccaacagaa

SEQ ID NO: 9221953 - DNA, 22 bp, Homo sapiens
gctgggctccaccctcaactgt

SEQ ID NO: 9221954 - DNA, 22 bp, Homo sapiens
gctgggctccaggccagggtga

SEQ ID NO: 9221955 - DNA, 22 bp, Homo sapiens
gctgggctccaggccagggtga

SEQ ID NO: 9221956 - DNA, 22 bp, Homo sapiens
gctgggctcatttgtgtgtctg

SEQ ID NO: 9221957 - DNA, 22 bp, Homo sapiens
gctgggctccaccctcaactgt

SEQ ID NO: 9221958 - DNA, 22 bp, Homo sapiens
gctgggctcatttgtgtgtctg

SEQ ID NO: 9221959 - DNA, 23 bp, Homo sapiens
ggagaggggtgtgggcatcttta

SEQ ID NO: 9221960 - DNA, 22 bp, Homo sapiens
ggagccttccagactgcccaca

SEQ ID NO: 9221961 - DNA, 18 bp, Homo sapiens
ggaaggtgctggagtgca

SEQ ID NO: 9221962 - DNA, 22 bp, Homo sapiens
ggaagtggtagagccatgagtg

SEQ ID NO: 9221963 - DNA, 22 bp, Homo sapiens
ggaatatagccagtaacagtca

SEQ ID NO: 9221964 - DNA, 22 bp, Homo sapiens
ggaatactaaaggaagcaattg

SEQ ID NO: 9221965 - DNA, 22 bp, Homo sapiens
ggaataaaaattgtttactgta

SEQ ID NO: 9221966 - DNA, 21 bp, Homo sapiens
ggagaaggacaatgttgagta

SEQ ID NO: 9221967 - DNA, 22 bp, Homo sapiens
ggagaaggaagaaagctactat

SEQ ID NO: 9221968 - DNA, 17 bp, Homo sapiens
ggagacagggtctttaa

SEQ ID NO: 9221969 - DNA, 22 bp, Homo sapiens
ggagaaggtggctcagcaaagg

SEQ ID NO: 9221970 - DNA, 22 bp, Homo sapiens
ggagctgaaccccatcgtgctg

SEQ ID NO: 9221971 - DNA, 22 bp, Homo sapiens
ggagctcctggcagtgacagag

SEQ ID NO: 9221972 - DNA, 22 bp, Homo sapiens
ggaggagcccactcaaagggga

SEQ ID NO: 9221973 - DNA, 22 bp, Homo sapiens
ggaggaagcacacggcttgtat

SEQ ID NO: 9221974 - DNA, 22 bp, Homo sapiens
ggaggaagccctcggtgcccca

SEQ ID NO: 9221975 - DNA, 22 bp, Homo sapiens
ggaggccaaggtgggcggatca

SEQ ID NO: 9221976 - DNA, 22 bp, Homo sapiens
ggaggccaagtcactgacctgg

SEQ ID NO: 9221977 - DNA, 22 bp, Homo sapiens
ggaggccaccatggagtcactt

SEQ ID NO: 9221978 - DNA, 22 bp, Homo sapiens
ggaggccaattttctaactgca

SEQ ID NO: 9221979 - DNA, 22 bp, Homo sapiens
ggaggccacctgacctgctgtt

SEQ ID NO: 9221980 - DNA, 22 bp, Homo sapiens
ggaggccagaatctgtgttgga

SEQ ID NO: 9221981 - DNA, 22 bp, Homo sapiens
ggaggccacggtttagcaccga

SEQ ID NO: 9221982 - DNA, 22 bp, Homo sapiens
ggaggccaaggcgggcggatca

SEQ ID NO: 9221983 - DNA, 22 bp, Homo sapiens
ggaggcagaatagagtgtgggt

SEQ ID NO: 9221984 - DNA, 22 bp, Homo sapiens
ggaggagctgctgtgggggccc

SEQ ID NO: 9221985 - DNA, 22 bp, Homo sapiens
ggaggaggcaagtaccagatgc

SEQ ID NO: 9221986 - DNA, 22 bp, Homo sapiens
ggaggccatagtttgggagtca

SEQ ID NO: 9221987 - DNA, 22 bp, Homo sapiens
ggaggccagtcctggccgggct

SEQ ID NO: 9221988 - DNA, 22 bp, Homo sapiens
ggaggccatcagggagggcatt

SEQ ID NO: 9221989 - DNA, 22 bp, Homo sapiens
ggaggccatcagggagggcatt

SEQ ID NO: 9221990 - DNA, 22 bp, Homo sapiens
ggaggccatctggctggaggct

SEQ ID NO: 9221991 - DNA, 22 bp, Homo sapiens
ggaggccatctggctggaggct

SEQ ID NO: 9221992 - DNA, 22 bp, Homo sapiens
ggaggccatgaggctctaggtg

SEQ ID NO: 9221993 - DNA, 22 bp, Homo sapiens
ggaggccagcctgaggctgagg

SEQ ID NO: 9221994 - DNA, 22 bp, Homo sapiens
ggaggccagcctgaggctgagg

SEQ ID NO: 9221995 - DNA, 22 bp, Homo sapiens
ggaggccaggaaggctcggaga

SEQ ID NO: 9221996 - DNA, 22 bp, Homo sapiens
ggaggccaggatgggaactcaa

SEQ ID NO: 9221997 - DNA, 22 bp, Homo sapiens
ggaggccaggaagagccgccct

SEQ ID NO: 9221998 - DNA, 15 bp, Homo sapiens
ggaggccaggctgtg

SEQ ID NO: 9221999 - DNA, 22 bp, Homo sapiens
ggaggccagggacccagtcagc

SEQ ID NO: 9222000 - DNA, 22 bp, Homo sapiens
ggaggccagggacccagtcagc

SEQ ID NO: 9222001 - DNA, 22 bp, Homo sapiens
ggaggccaggtgggagtcatct

SEQ ID NO: 9222002 - DNA, 22 bp, Homo sapiens
ggaggccaggtgggagtcatct

SEQ ID NO: 9222003 - DNA, 22 bp, Homo sapiens
ggaggccagggtgggtggatcg

SEQ ID NO: 9222004 - DNA, 22 bp, Homo sapiens
ggaggcggaggttgcagtgagc

SEQ ID NO: 9222005 - DNA, 22 bp, Homo sapiens
ggaggcggaggttgcagtgagt

SEQ ID NO: 9222006 - DNA, 22 bp, Homo sapiens
ggaggctccatgagctcctgca

SEQ ID NO: 9222007 - DNA, 22 bp, Homo sapiens
ggaggcctcagtaccttgcttt

SEQ ID NO: 9222008 - DNA, 22 bp, Homo sapiens
ggaggccatgggcagaatcttt

SEQ ID NO: 9222009 - DNA, 22 bp, Homo sapiens
ggaggcctagaaaagtggttct

SEQ ID NO: 9222010 - DNA, 22 bp, Homo sapiens
ggaggcctagaaaagtggttct

SEQ ID NO: 9222011 - DNA, 22 bp, Homo sapiens
ggaggcccagagaggtgaagtg

SEQ ID NO: 9222012 - DNA, 22 bp, Homo sapiens
ggaggctctcctggccttgtct

SEQ ID NO: 9222013 - DNA, 22 bp, Homo sapiens
ggaggctctaaactttccttgg

SEQ ID NO: 9222014 - DNA, 22 bp, Homo sapiens
ggaggctcctaagctgacttga

SEQ ID NO: 9222015 - DNA, 22 bp, Homo sapiens
ggagggacccactctagaggtg

SEQ ID NO: 9222016 - DNA, 22 bp, Homo sapiens
ggagggagagtgaccctaccaa

SEQ ID NO: 9222017 - DNA, 22 bp, Homo sapiens
ggagggagagtgaccctaccaa

SEQ ID NO: 9222018 - DNA, 22 bp, Homo sapiens
ggagggcccctccagtgggcag

SEQ ID NO: 9222019 - DNA, 22 bp, Homo sapiens
ggagggcatcaatcaggcctgg

SEQ ID NO: 9222020 - DNA, 22 bp, Homo sapiens
ggagggcccctccagtgggcag

SEQ ID NO: 9222021 - DNA, 22 bp, Homo sapiens
ggagggccatcttgggtgtgat

SEQ ID NO: 9222022 - DNA, 22 bp, Homo sapiens
ggagggctcgtcatccaccact

SEQ ID NO: 9222023 - DNA, 22 bp, Homo sapiens
ggagggccctgggtgcagctct

SEQ ID NO: 9222024 - DNA, 22 bp, Homo sapiens
ggagggctgtagaggagacctg

SEQ ID NO: 9222025 - DNA, 23 bp, Homo sapiens
ggagggcttcatcagacccccag

SEQ ID NO: 9222026 - DNA, 22 bp, Homo sapiens
ggaggggaactaatcccgtgac

SEQ ID NO: 9222027 - DNA, 22 bp, Homo sapiens
ggaggtggaggttgcagtgagc

SEQ ID NO: 9222028 - DNA, 22 bp, Homo sapiens
ggaggtggaggttgcagtgagc

SEQ ID NO: 9222029 - DNA, 22 bp, Homo sapiens
ggaggtcccaggcctggcagca

SEQ ID NO: 9222030 - DNA, 22 bp, Homo sapiens
ggaggtagtctgagtcataggc

SEQ ID NO: 9222031 - DNA, 22 bp, Homo sapiens
ggagggttagcaaaggcacaga

SEQ ID NO: 9222032 - DNA, 22 bp, Homo sapiens
ggagtagctgcattccgagcac

SEQ ID NO: 9222033 - DNA, 22 bp, Homo sapiens
ggagtagctgcattccgagcac

SEQ ID NO: 9222034 - DNA, 22 bp, Homo sapiens
ggaggtggtttgatttctatat

SEQ ID NO: 9222035 - DNA, 22 bp, Homo sapiens
ggaggtgggctaaggactctct

SEQ ID NO: 9222036 - DNA, 22 bp, Homo sapiens
ggaggtgggctaaggactctct

SEQ ID NO: 9222037 - DNA, 22 bp, Homo sapiens
ggaggtgggctaaggactctct

SEQ ID NO: 9222038 - DNA, 22 bp, Homo sapiens
ggaggtgggagacataggcggc

SEQ ID NO: 9222039 - DNA, 22 bp, Homo sapiens
ggaggtgggagcctccagtggt

SEQ ID NO: 9222040 - DNA, 22 bp, Homo sapiens
ggaggtgggagcctccagtggt

SEQ ID NO: 9222041 - DNA, 22 bp, Homo sapiens
ggaggtgggagcctccagtggt

SEQ ID NO: 9222042 - DNA, 22 bp, Homo sapiens
ggaggtgggattaggacctaaa

SEQ ID NO: 9222043 - DNA, 22 bp, Homo sapiens
ggaggtgggattaggacctaaa

SEQ ID NO: 9222044 - DNA, 22 bp, Homo sapiens
ggaggtgggagtttagttcttg

SEQ ID NO: 9222045 - DNA, 22 bp, Homo sapiens
ggagggtccccagcagcatgaa

SEQ ID NO: 9222046 - DNA, 22 bp, Homo sapiens
ggaggggagatgtttgggctca

SEQ ID NO: 9222047 - DNA, 22 bp, Homo sapiens
ggaggggaggattaatgacaaa

SEQ ID NO: 9222048 - DNA, 22 bp, Homo sapiens
ggaggggaggtccagctgatct

SEQ ID NO: 9222049 - DNA, 22 bp, Homo sapiens
ggaggggagtctcccaaagccg

SEQ ID NO: 9222050 - DNA, 22 bp, Homo sapiens
ggagggggaaactttggctgcc

SEQ ID NO: 9222051 - DNA, 22 bp, Homo sapiens
ggagggggaattcagccccagc

SEQ ID NO: 9222052 - DNA, 22 bp, Homo sapiens
ggagggggaattcagccccagc

SEQ ID NO: 9222053 - DNA, 22 bp, Homo sapiens
ggcacacagatggagcactagc

SEQ ID NO: 9222054 - DNA, 22 bp, Homo sapiens
ggcaagggacggccgtgagaca

SEQ ID NO: 9222055 - DNA, 22 bp, Homo sapiens
ggcaaggccttgcccagcattc

SEQ ID NO: 9222056 - DNA, 22 bp, Homo sapiens
ggcacagagaggccctggaagg

SEQ ID NO: 9222057 - DNA, 21 bp, Homo sapiens
ggagttctgcgtttaaagggg

SEQ ID NO: 9222058 - DNA, 22 bp, Homo sapiens
ggagtggtgtcactgagaggaa

SEQ ID NO: 9222059 - DNA, 22 bp, Homo sapiens
ggagttcactgtgcaggctctg

SEQ ID NO: 9222060 - DNA, 22 bp, Homo sapiens
ggagtgggaacaatgacatggt

SEQ ID NO: 9222061 - DNA, 22 bp, Homo sapiens
ggagtgggaacaatgacatggt

SEQ ID NO: 9222062 - DNA, 22 bp, Homo sapiens
ggagtgggcagcactgccctgt

SEQ ID NO: 9222063 - DNA, 22 bp, Homo sapiens
ggagtggcctctcctgtgcagg

SEQ ID NO: 9222064 - DNA, 22 bp, Homo sapiens
ggagtggcactctgaggcgggg

SEQ ID NO: 9222065 - DNA, 22 bp, Homo sapiens
ggcacagcaagaagggaaatga

SEQ ID NO: 9222066 - DNA, 22 bp, Homo sapiens
ggcacagcacagagcacatgta

SEQ ID NO: 9222067 - DNA, 22 bp, Homo sapiens
ggcacagcacagtggacccagg

SEQ ID NO: 9222068 - DNA, 22 bp, Homo sapiens
ggcacagcaccttttcacattg

SEQ ID NO: 9222069 - DNA, 22 bp, Homo sapiens
ggcacagcaccttttcacattg

SEQ ID NO: 9222070 - DNA, 22 bp, Homo sapiens
ggcacagatagatcaagtgtct

SEQ ID NO: 9222071 - DNA, 23 bp, Homo sapiens
ggcacagatgctgagcatgtgca

SEQ ID NO: 9222072 - DNA, 22 bp, Homo sapiens
ggcacagagttggcagagctgc

SEQ ID NO: 9222073 - DNA, 22 bp, Homo sapiens
ggcacagagctccagccttggc

SEQ ID NO: 9222074 - DNA, 23 bp, Homo sapiens
ggcagagagcatggctggggccc

SEQ ID NO: 9222075 - DNA, 22 bp, Homo sapiens
ggcagagacaccgaatgactct

SEQ ID NO: 9222076 - DNA, 22 bp, Homo sapiens
ggcagagactgggttggcagag

SEQ ID NO: 9222077 - DNA, 22 bp, Homo sapiens
ggcagagactgggttggcagag

SEQ ID NO: 9222078 - DNA, 22 bp, Homo sapiens
ggcagacctctccagccccaca

SEQ ID NO: 9222079 - DNA, 22 bp, Homo sapiens
ggcagagaatctggctgtttac

SEQ ID NO: 9222080 - DNA, 22 bp, Homo sapiens
ggcagactgtaataggagaatt

SEQ ID NO: 9222081 - DNA, 22 bp, Homo sapiens
ggcaggctgcttgggtcatgtc

SEQ ID NO: 9222082 - DNA, 22 bp, Homo sapiens
ggcaggctgcttgggtcatgtc

SEQ ID NO: 9222083 - DNA, 22 bp, Homo sapiens
ggcaggctggctttgttccagg

SEQ ID NO: 9222084 - DNA, 22 bp, Homo sapiens
ggcaggctggctttgttccagg

SEQ ID NO: 9222085 - DNA, 22 bp, Homo sapiens
ggcaggctgggagtcatcagag

SEQ ID NO: 9222086 - DNA, 22 bp, Homo sapiens
ggcaggctccaagcatcctatg

SEQ ID NO: 9222087 - DNA, 22 bp, Homo sapiens
ggcaggctcagcagccaaggag

SEQ ID NO: 9222088 - DNA, 22 bp, Homo sapiens
ggcaggcattgcaacatgtaca

SEQ ID NO: 9222089 - DNA, 22 bp, Homo sapiens
ggcaggcagcctccatccacag

SEQ ID NO: 9222090 - DNA, 22 bp, Homo sapiens
ggcagctctgctaattgagcct

SEQ ID NO: 9222091 - DNA, 22 bp, Homo sapiens
ggcagctctgatgatgctctgg

SEQ ID NO: 9222092 - DNA, 22 bp, Homo sapiens
ggcagctctgctccacatgagt

SEQ ID NO: 9222093 - DNA, 22 bp, Homo sapiens
ggcagctggcctcctcgcccac

SEQ ID NO: 9222094 - DNA, 22 bp, Homo sapiens
ggcagctggcctcctcgcccac

SEQ ID NO: 9222095 - DNA, 22 bp, Homo sapiens
ggcagctgctgcattacgttgt

SEQ ID NO: 9222096 - DNA, 22 bp, Homo sapiens
ggcagaggaagctggaagtggg

SEQ ID NO: 9222097 - DNA, 22 bp, Homo sapiens
ggcagaggaagctggaagtggg

SEQ ID NO: 9222098 - DNA, 22 bp, Homo sapiens
ggcagaggaagctggaagtggg

SEQ ID NO: 9222099 - DNA, 20 bp, Homo sapiens
ggcagctctagtcgaggccc

SEQ ID NO: 9222100 - DNA, 23 bp, Homo sapiens
ggcagctctcatctgatgactga

SEQ ID NO: 9222101 - DNA, 22 bp, Homo sapiens
ggcagctgggttggccagaaac

SEQ ID NO: 9222102 - DNA, 22 bp, Homo sapiens
ggcagctgggttggccagaaac

SEQ ID NO: 9222103 - DNA, 23 bp, Homo sapiens
ggcagctgggcagcactcatggg

SEQ ID NO: 9222104 - DNA, 23 bp, Homo sapiens
ggcagctgggcagcactcatggg

SEQ ID NO: 9222105 - DNA, 22 bp, Homo sapiens
ggcagctggggcagtgccctgt

SEQ ID NO: 9222106 - DNA, 22 bp, Homo sapiens
ggcagctggggcagtgccctgt

SEQ ID NO: 9222107 - DNA, 22 bp, Homo sapiens
ggcagctggggcagtgccctgt

SEQ ID NO: 9222108 - DNA, 22 bp, Homo sapiens
ggcagctggttctttccattaa

SEQ ID NO: 9222109 - DNA, 22 bp, Homo sapiens
ggcagctgtaagatgagtgaat

SEQ ID NO: 9222110 - DNA, 22 bp, Homo sapiens
ggcagctgtctctgagttagca

SEQ ID NO: 9222111 - DNA, 22 bp, Homo sapiens
ggcagctgtctctgagttagca

SEQ ID NO: 9222112 - DNA, 22 bp, Homo sapiens
ggcaggcagatggctgcaccaa

SEQ ID NO: 9222113 - DNA, 22 bp, Homo sapiens
ggcagctgtgaagtgcctcaca

SEQ ID NO: 9222114 - DNA, 22 bp, Homo sapiens
ggcagctgtgaagtgcctcaca

SEQ ID NO: 9222115 - DNA, 22 bp, Homo sapiens
gggctctgtggttgtgctttgt

SEQ ID NO: 9222116 - DNA, 22 bp, Homo sapiens
gggctctgtgttctagctctcg

SEQ ID NO: 9222117 - DNA, 22 bp, Homo sapiens
gggctgagaattcagctttcct

SEQ ID NO: 9222118 - DNA, 22 bp, Homo sapiens
gggctaggcttggccagcactg

SEQ ID NO: 9222119 - DNA, 22 bp, Homo sapiens
gggctagcagattctacctaat

SEQ ID NO: 9222120 - DNA, 22 bp, Homo sapiens
gggctctgtgcaccccagcacc

SEQ ID NO: 9222121 - DNA, 20 bp, Homo sapiens
gggctctgtaaggttgaaag

SEQ ID NO: 9222122 - DNA, 22 bp, Homo sapiens
gggctggatctcctgcaggcag

SEQ ID NO: 9222123 - DNA, 22 bp, Homo sapiens
ggggaaggattgagttgaccca

SEQ ID NO: 9222124 - DNA, 22 bp, Homo sapiens
ggggacagttaaagaccaagac

SEQ ID NO: 9222125 - DNA, 22 bp, Homo sapiens
gggtctggcatgctgagatgga

SEQ ID NO: 9222126 - DNA, 22 bp, Homo sapiens
gggtctggagggcagcccttct

SEQ ID NO: 9222127 - DNA, 22 bp, Homo sapiens
gggtcttcgccgccgccataac

SEQ ID NO: 9222128 - DNA, 22 bp, Homo sapiens
gggtcttcatttattctacact

SEQ ID NO: 9222129 - DNA, 22 bp, Homo sapiens
gggtctgggcaggcgcttcctc

SEQ ID NO: 9222130 - DNA, 22 bp, Homo sapiens
gggtctggcatgctgagatgga

SEQ ID NO: 9222131 - DNA, 22 bp, Homo sapiens
gggtctggagatccgggtgaag

SEQ ID NO: 9222132 - DNA, 22 bp, Homo sapiens
gggtctggacggctgcaggaag

SEQ ID NO: 9222133 - DNA, 22 bp, Homo sapiens
gggtctctcatgcagttgctgt

SEQ ID NO: 9222134 - DNA, 22 bp, Homo sapiens
gggtctccatgttaacatcact

SEQ ID NO: 9222135 - DNA, 17 bp, Homo sapiens
gggtgggcactgctggc

SEQ ID NO: 9222136 - DNA, 22 bp, Homo sapiens
gggtgggatggcaggagccgct

SEQ ID NO: 9222137 - DNA, 23 bp, Homo sapiens
gggtgggccaaattaggtagcct

SEQ ID NO: 9222138 - DNA, 23 bp, Homo sapiens
gggtgggccaaattaggtagcct

SEQ ID NO: 9222139 - DNA, 17 bp, Homo sapiens
gggtgggcactgctggc

SEQ ID NO: 9222140 - DNA, 22 bp, Homo sapiens
gggtgggcccagcccagagaag

SEQ ID NO: 9222141 - DNA, 22 bp, Homo sapiens
gggtgggccactgagcagcgtg

SEQ ID NO: 9222142 - DNA, 22 bp, Homo sapiens
gggtgggccactgagcagcgtg

SEQ ID NO: 9222143 - DNA, 22 bp, Homo sapiens
gggtgggccccaggtatctgta

SEQ ID NO: 9222144 - DNA, 22 bp, Homo sapiens
gggtgggcccagcccagagaag

SEQ ID NO: 9222145 - DNA, 22 bp, Homo sapiens
gggtgggcccagcccagagaag

SEQ ID NO: 9222146 - DNA, 22 bp, Homo sapiens
gggtgggaacaggatgccagga

SEQ ID NO: 9222147 - DNA, 22 bp, Homo sapiens
gggtgggatgccgctgtctcca

SEQ ID NO: 9222148 - DNA, 22 bp, Homo sapiens
gggtgaggagctgccagtcatg

SEQ ID NO: 9222149 - DNA, 22 bp, Homo sapiens
gggtgaggagctgccagtcatg

SEQ ID NO: 9222150 - DNA, 22 bp, Homo sapiens
gggtccagggacgtttctgcag

SEQ ID NO: 9222151 - DNA, 22 bp, Homo sapiens
ggggtaggaagagaaaatagtg

SEQ ID NO: 9222152 - DNA, 22 bp, Homo sapiens
ggggacgggacttagcatgagt

SEQ ID NO: 9222153 - DNA, 22 bp, Homo sapiens
gggatgaggatcaatcagggag

SEQ ID NO: 9222154 - DNA, 21 bp, Homo sapiens
gggatctgaggcaagtctcct

SEQ ID NO: 9222155 - DNA, 22 bp, Homo sapiens
gggatctgacttgctggtgggt

SEQ ID NO: 9222156 - DNA, 22 bp, Homo sapiens
gggagggaaggtacctgtgtga

SEQ ID NO: 9222157 - DNA, 22 bp, Homo sapiens
gggatctgatgcactgctgaaa

SEQ ID NO: 9222158 - DNA, 22 bp, Homo sapiens
gggatctgagtaggcagaagct

SEQ ID NO: 9222159 - DNA, 22 bp, Homo sapiens
gggatctgagttgtcaggaagg

SEQ ID NO: 9222160 - DNA, 22 bp, Homo sapiens
gggagggaaagcttgatctgtc

SEQ ID NO: 9222161 - DNA, 22 bp, Homo sapiens
gggagggaaggaggcgccgtgt

SEQ ID NO: 9222162 - DNA, 22 bp, Homo sapiens
gggagggaaggtacctgtgtga

SEQ ID NO: 9222163 - DNA, 22 bp, Homo sapiens
gggagggaaggaccttatgaat

SEQ ID NO: 9222164 - DNA, 22 bp, Homo sapiens
gggatggagggtagagcaagtg

SEQ ID NO: 9222165 - DNA, 19 bp, Homo sapiens
gggatgggccctcaccctc

SEQ ID NO: 9222166 - DNA, 19 bp, Homo sapiens
gggatgggccctcaccctc

SEQ ID NO: 9222167 - DNA, 22 bp, Homo sapiens
gggcagaggggcgcttccctct

SEQ ID NO: 9222168 - DNA, 22 bp, Homo sapiens
gggcagaggggcgcttccctct

SEQ ID NO: 9222169 - DNA, 22 bp, Homo sapiens
gggatggggagctggaaagggg

SEQ ID NO: 9222170 - DNA, 22 bp, Homo sapiens
gggacccacgaaaggctttgga

SEQ ID NO: 9222171 - DNA, 22 bp, Homo sapiens
gggacgagatcttggcagtgtg

SEQ ID NO: 9222172 - DNA, 22 bp, Homo sapiens
gggagaaatgtctggcctgctg

SEQ ID NO: 9222173 - DNA, 22 bp, Homo sapiens
gggagaactgggtggagcatct

SEQ ID NO: 9222174 - DNA, 20 bp, Homo sapiens
gggaggccccagagtccagg

SEQ ID NO: 9222175 - DNA, 18 bp, Homo sapiens
gggaggccccagcaggag

SEQ ID NO: 9222176 - DNA, 22 bp, Homo sapiens
gggaggcgccgagggtagctaa

SEQ ID NO: 9222177 - DNA, 22 bp, Homo sapiens
gggcccactggctgtctgaccc

SEQ ID NO: 9222178 - DNA, 22 bp, Homo sapiens
gggcccagcactggctgggatc

SEQ ID NO: 9222179 - DNA, 19 bp, Homo sapiens
gggcccagcatggagggtt

SEQ ID NO: 9222180 - DNA, 22 bp, Homo sapiens
gggcctggtgcttctgactcct

SEQ ID NO: 9222181 - DNA, 22 bp, Homo sapiens
gggccacaggagaggctgtcag

SEQ ID NO: 9222182 - DNA, 22 bp, Homo sapiens
gggccacaggccttgcccgcag

SEQ ID NO: 9222183 - DNA, 22 bp, Homo sapiens
gggccaggagtggagatatggg

SEQ ID NO: 9222184 - DNA, 22 bp, Homo sapiens
gggccaggtcggtgaatggtca

SEQ ID NO: 9222185 - DNA, 22 bp, Homo sapiens
gggcagctagccctctagccca

SEQ ID NO: 9222186 - DNA, 22 bp, Homo sapiens
gggcagctcagccaccatgcag

SEQ ID NO: 9222187 - DNA, 21 bp, Homo sapiens
gggccacaccttctgcagacc

SEQ ID NO: 9222188 - DNA, 22 bp, Homo sapiens
gggcagcacgtttcaggaggat

SEQ ID NO: 9222189 - DNA, 22 bp, Homo sapiens
ggctgcaggaacgacggagggg

SEQ ID NO: 9222190 - DNA, 20 bp, Homo sapiens
ggctgcaggactcattggct

SEQ ID NO: 9222191 - DNA, 22 bp, Homo sapiens
ggctgcaggatgcccagccgtg

SEQ ID NO: 9222192 - DNA, 22 bp, Homo sapiens
ggctgcaggcagaggctgtctg

SEQ ID NO: 9222193 - DNA, 19 bp, Homo sapiens
ggctgcctggagcgagggc

SEQ ID NO: 9222194 - DNA, 18 bp, Homo sapiens
ggctgcctgttcctgaag

SEQ ID NO: 9222195 - DNA, 22 bp, Homo sapiens
ggctgcctgtgcccaggcacac

SEQ ID NO: 9222196 - DNA, 22 bp, Homo sapiens
ggctgcctggtttcttgtaagg

SEQ ID NO: 9222197 - DNA, 22 bp, Homo sapiens
ggctgcctgttgagtatgtccc

SEQ ID NO: 9222198 - DNA, 22 bp, Homo sapiens
ggctgccttcagactccagctt

SEQ ID NO: 9222199 - DNA, 22 bp, Homo sapiens
ggctgcctgggagccctcctct

SEQ ID NO: 9222200 - DNA, 21 bp, Homo sapiens
ggctgcctgggaagaagaaga

SEQ ID NO: 9222201 - DNA, 22 bp, Homo sapiens
ggctgcctggtttagtgctgac

SEQ ID NO: 9222202 - DNA, 22 bp, Homo sapiens
ggctgccttccctgagccccgg

SEQ ID NO: 9222203 - DNA, 22 bp, Homo sapiens
ggctgccttcatagaccatggg

SEQ ID NO: 9222204 - DNA, 19 bp, Homo sapiens
ggctgccttctgctcatct

SEQ ID NO: 9222205 - DNA, 23 bp, Homo sapiens
ggctggcccggggctgctcctga

SEQ ID NO: 9222206 - DNA, 23 bp, Homo sapiens
ggctggcccggggctgctcctga

SEQ ID NO: 9222207 - DNA, 22 bp, Homo sapiens
ggctggcctgtgtggccgccac

SEQ ID NO: 9222208 - DNA, 22 bp, Homo sapiens
ggctggctatctgtggttgcct

SEQ ID NO: 9222209 - DNA, 22 bp, Homo sapiens
ggctggctacattggaggaagg

SEQ ID NO: 9222210 - DNA, 19 bp, Homo sapiens
ggctgcagagccccggcgc

SEQ ID NO: 9222211 - DNA, 22 bp, Homo sapiens
ggctgcagagctggtgccctgg

SEQ ID NO: 9222212 - DNA, 22 bp, Homo sapiens
ggctgcagaggcccccagtggg

SEQ ID NO: 9222213 - DNA, 19 bp, Homo sapiens
ggctctcccttgagagagc

SEQ ID NO: 9222214 - DNA, 22 bp, Homo sapiens
ggctctccactatggatgagaa

SEQ ID NO: 9222215 - DNA, 22 bp, Homo sapiens
ggctctagagactctagagaaa

SEQ ID NO: 9222216 - DNA, 20 bp, Homo sapiens
ggctccttctttcatggccc

SEQ ID NO: 9222217 - DNA, 22 bp, Homo sapiens
ggctccttcaaagcacctggct

SEQ ID NO: 9222218 - DNA, 22 bp, Homo sapiens
ggctccttatctctcctatgcc

SEQ ID NO: 9222219 - DNA, 22 bp, Homo sapiens
ggctcctgttatttaatgagga

SEQ ID NO: 9222220 - DNA, 22 bp, Homo sapiens
ggctcctgggagatagaggtca

SEQ ID NO: 9222221 - DNA, 22 bp, Homo sapiens
ggctcctgggatgggactgagc

SEQ ID NO: 9222222 - DNA, 22 bp, Homo sapiens
ggctcctgggcagctgctccct

SEQ ID NO: 9222223 - DNA, 22 bp, Homo sapiens
ggctcctggaaagccctcgctc

SEQ ID NO: 9222224 - DNA, 22 bp, Homo sapiens
ggcttcctccttcctgctgtca

SEQ ID NO: 9222225 - DNA, 22 bp, Homo sapiens
ggcttcctatcccatctgagtg

SEQ ID NO: 9222226 - DNA, 22 bp, Homo sapiens
ggcttcctaatactccctacac

SEQ ID NO: 9222227 - DNA, 22 bp, Homo sapiens
ggcttccctttccgagaggaga

SEQ ID NO: 9222228 - DNA, 22 bp, Homo sapiens
ggcttcctgggcatgtgttcta

SEQ ID NO: 9222229 - DNA, 22 bp, Homo sapiens
ggcttcctggagaaggtctgag

SEQ ID NO: 9222230 - DNA, 22 bp, Homo sapiens
ggcttcctttcactaccctcag

SEQ ID NO: 9222231 - DNA, 22 bp, Homo sapiens
ggcttcctggggcctcctgcaa

SEQ ID NO: 9222232 - DNA, 22 bp, Homo sapiens
ggcttctccaggtactgagcat

SEQ ID NO: 9222233 - DNA, 22 bp, Homo sapiens
gggaagagaccgtaccctggcc

SEQ ID NO: 9222234 - DNA, 22 bp, Homo sapiens
gggaagagaggaggtggtttcg

SEQ ID NO: 9222235 - DNA, 22 bp, Homo sapiens
gggaagagaccgtaccctggcc

SEQ ID NO: 9222236 - DNA, 18 bp, Homo sapiens
gggaagaggatctggccc

SEQ ID NO: 9222237 - DNA, 18 bp, Homo sapiens
gggaagaggatctggccc

SEQ ID NO: 9222238 - DNA, 22 bp, Homo sapiens
gggaagagatttccacatcatt

SEQ ID NO: 9222239 - DNA, 22 bp, Homo sapiens
gggaacagagtgccagactgac

SEQ ID NO: 9222240 - DNA, 22 bp, Homo sapiens
gggaacctgccccaggcctctg

SEQ ID NO: 9222241 - DNA, 22 bp, Homo sapiens
ggctggctggctggtagacaag

SEQ ID NO: 9222242 - DNA, 22 bp, Homo sapiens
ggctggctggctggtagacaag

SEQ ID NO: 9222243 - DNA, 22 bp, Homo sapiens
ggctggctggctggtagacaag

SEQ ID NO: 9222244 - DNA, 22 bp, Homo sapiens
ggctggctggcttagcagagga

SEQ ID NO: 9222245 - DNA, 22 bp, Homo sapiens
ggctggctgtgccctgtactct

SEQ ID NO: 9222246 - DNA, 22 bp, Homo sapiens
ggctggctggcttagcagagga

SEQ ID NO: 9222247 - DNA, 22 bp, Homo sapiens
ggctggctgtgccctgtactct

SEQ ID NO: 9222248 - DNA, 22 bp, Homo sapiens
ggctggctggcttagcagagga

SEQ ID NO: 9222249 - DNA, 22 bp, Homo sapiens
ggctggctggcttagcagagga

SEQ ID NO: 9222250 - DNA, 22 bp, Homo sapiens
ggctggcttgccaagctcaggg

SEQ ID NO: 9222251 - DNA, 22 bp, Homo sapiens
ggctggcttgccaagctcaggg

SEQ ID NO: 9222252 - DNA, 22 bp, Homo sapiens
ggctgtggtggcatccctgagc

SEQ ID NO: 9222253 - DNA, 19 bp, Homo sapiens
ggctgtggtggtgccttgc

SEQ ID NO: 9222254 - DNA, 22 bp, Homo sapiens
ggctggctcttaccgacagcgt

SEQ ID NO: 9222255 - DNA, 22 bp, Homo sapiens
ggctggctcttaccgacagcgt

SEQ ID NO: 9222256 - DNA, 22 bp, Homo sapiens
ggctggctgataaagggttgag

SEQ ID NO: 9222257 - DNA, 22 bp, Homo sapiens
ggctggctgataaagggttgag

SEQ ID NO: 9222258 - DNA, 22 bp, Homo sapiens
ggctggctggatgaatggatta

SEQ ID NO: 9222259 - DNA, 22 bp, Homo sapiens
ggctggctgcatgccccctcct

SEQ ID NO: 9222260 - DNA, 22 bp, Homo sapiens
ggctggctgataaagggttgag

SEQ ID NO: 9222261 - DNA, 22 bp, Homo sapiens
ggctggctccacctaggtagct

SEQ ID NO: 9222262 - DNA, 22 bp, Homo sapiens
ggctggctccacctaggtagct

SEQ ID NO: 9222263 - DNA, 22 bp, Homo sapiens
ggctggctccacctaggtagct

SEQ ID NO: 9222264 - DNA, 22 bp, Homo sapiens
ggctggctcatgcaaagggtga

SEQ ID NO: 9222265 - DNA, 22 bp, Homo sapiens
ggctggctcagggcttgagaga

SEQ ID NO: 9222266 - DNA, 22 bp, Homo sapiens
ggctggctcagggcttgagaga

SEQ ID NO: 9222267 - DNA, 22 bp, Homo sapiens
ggctggctatctgtggttgcct

SEQ ID NO: 9222268 - DNA, 17 bp, Homo sapiens
ggcttccaggtggctct

SEQ ID NO: 9222269 - DNA, 22 bp, Homo sapiens
ggcttccagctgggccttggag

SEQ ID NO: 9222270 - DNA, 22 bp, Homo sapiens
ggcttcccagtccctgctctca

SEQ ID NO: 9222271 - DNA, 22 bp, Homo sapiens
ggcttcccaggcggtccccaca

SEQ ID NO: 9222272 - DNA, 22 bp, Homo sapiens
ggcttcccagcagagggcgcac

SEQ ID NO: 9222273 - DNA, 22 bp, Homo sapiens
ggcttcccaaggagccaggatg

SEQ ID NO: 9222274 - DNA, 22 bp, Homo sapiens
ggcttccccacaaagcacacaa

SEQ ID NO: 9222275 - DNA, 22 bp, Homo sapiens
ggcttccccacagtcctgagct

SEQ ID NO: 9222276 - DNA, 22 bp, Homo sapiens
ggcttcccctccagtgctctgt

SEQ ID NO: 9222277 - DNA, 20 bp, Homo sapiens
ggcttccccgccatcttccg

SEQ ID NO: 9222278 - DNA, 22 bp, Homo sapiens
ggcttccctaaacctttccact

SEQ ID NO: 9222279 - DNA, 18 bp, Homo sapiens
ggcttccctactcacttc

SEQ ID NO: 9222280 - DNA, 22 bp, Homo sapiens
ggcttccctgcctcacttattc

SEQ ID NO: 9222281 - DNA, 22 bp, Homo sapiens
ggcttccctgtttgctgtgcct

SEQ ID NO: 9222282 - DNA, 22 bp, Homo sapiens
ggcttcagtggccagagatgat

SEQ ID NO: 9222283 - DNA, 22 bp, Homo sapiens
ggcccctcttgtggcacatacg

SEQ ID NO: 9222284 - DNA, 22 bp, Homo sapiens
ggcccctcagcatctgagtcag

SEQ ID NO: 9222285 - DNA, 19 bp, Homo sapiens
ggcccctctcacaggagtt

SEQ ID NO: 9222286 - DNA, 19 bp, Homo sapiens
ggcccctctcacaggagtt

SEQ ID NO: 9222287 - DNA, 22 bp, Homo sapiens
ggccccagttcactcctggccg

SEQ ID NO: 9222288 - DNA, 22 bp, Homo sapiens
ggcccccagggtgggtgtagac

SEQ ID NO: 9222289 - DNA, 22 bp, Homo sapiens
ggccccagttcactcctggccg

SEQ ID NO: 9222290 - DNA, 22 bp, Homo sapiens
ggcccagcctcagacatgccct

SEQ ID NO: 9222291 - DNA, 22 bp, Homo sapiens
ggccccagattctgggctgggt

SEQ ID NO: 9222292 - DNA, 22 bp, Homo sapiens
ggccccagattctgggctgggt

SEQ ID NO: 9222293 - DNA, 22 bp, Homo sapiens
ggcccatgcatcctgtgcagcc

SEQ ID NO: 9222294 - DNA, 22 bp, Homo sapiens
ggccatggtgaggtcttctcag

SEQ ID NO: 9222295 - DNA, 22 bp, Homo sapiens
ggccatgtttggcagaaggatt

SEQ ID NO: 9222296 - DNA, 22 bp, Homo sapiens
ggcccaaggcccaggtcgagct

SEQ ID NO: 9222297 - DNA, 22 bp, Homo sapiens
ggcccacactgacagctgagct

SEQ ID NO: 9222298 - DNA, 19 bp, Homo sapiens
ggcccaagtactgagtgcc

SEQ ID NO: 9222299 - DNA, 22 bp, Homo sapiens
ggcccacttgaaatggagctca

SEQ ID NO: 9222300 - DNA, 22 bp, Homo sapiens
ggcccacttgaaatggagctca

SEQ ID NO: 9222301 - DNA, 20 bp, Homo sapiens
ggcccacatcctttgctatg

SEQ ID NO: 9222302 - DNA, 22 bp, Homo sapiens
ggcccagcccgagtcagccttc

SEQ ID NO: 9222303 - DNA, 22 bp, Homo sapiens
ggccagagagcagccaggattc

SEQ ID NO: 9222304 - DNA, 22 bp, Homo sapiens
ggccagaggccacagctgtgtc

SEQ ID NO: 9222305 - DNA, 18 bp, Homo sapiens
ggccagagggagggtccc

SEQ ID NO: 9222306 - DNA, 22 bp, Homo sapiens
ggccacctgggatctcatcctg

SEQ ID NO: 9222307 - DNA, 22 bp, Homo sapiens
ggccacctggctgtgggggcag

SEQ ID NO: 9222308 - DNA, 22 bp, Homo sapiens
ggccacctctgccctactgagt

SEQ ID NO: 9222309 - DNA, 22 bp, Homo sapiens
ggccaccttccagttgcctgca

SEQ ID NO: 9222310 - DNA, 22 bp, Homo sapiens
ggccagagaagtcagacccttg

SEQ ID NO: 9222311 - DNA, 22 bp, Homo sapiens
ggccctctgagtagctgcaaac

SEQ ID NO: 9222312 - DNA, 22 bp, Homo sapiens
ggccctctgcctgtgctggcga

SEQ ID NO: 9222313 - DNA, 22 bp, Homo sapiens
ggccctctgctcacttcctatt

SEQ ID NO: 9222314 - DNA, 22 bp, Homo sapiens
ggccctctgcctgtgctggcga

SEQ ID NO: 9222315 - DNA, 22 bp, Homo sapiens
ggccctcttttatccatcataa

SEQ ID NO: 9222316 - DNA, 22 bp, Homo sapiens
ggccctctgtggctgccatgga

SEQ ID NO: 9222317 - DNA, 22 bp, Homo sapiens
ggccctctggtgagtatcacat

SEQ ID NO: 9222318 - DNA, 22 bp, Homo sapiens
ggccctctggcttccgcatggg

SEQ ID NO: 9222319 - DNA, 22 bp, Homo sapiens
ggccctgagctgaagtactgtg

SEQ ID NO: 9222320 - DNA, 22 bp, Homo sapiens
ggccttcctggcggctcagggt

SEQ ID NO: 9222321 - DNA, 22 bp, Homo sapiens
ggccttcctggcggctcagggt

SEQ ID NO: 9222322 - DNA, 21 bp, Homo sapiens
ggccttcccctgcagtctccg

SEQ ID NO: 9222323 - DNA, 22 bp, Homo sapiens
ggccttcctgctgctccgggcc

SEQ ID NO: 9222324 - DNA, 22 bp, Homo sapiens
ggccttcacgtgacctggcgtg

SEQ ID NO: 9222325 - DNA, 22 bp, Homo sapiens
ggccttgcggaacgctcaggcg

SEQ ID NO: 9222326 - DNA, 19 bp, Homo sapiens
ggccttgatgagtggggag

SEQ ID NO: 9222327 - DNA, 22 bp, Homo sapiens
ggccttgatgttcttgggagat

SEQ ID NO: 9222328 - DNA, 22 bp, Homo sapiens
ggccttgatctctctaactgct

SEQ ID NO: 9222329 - DNA, 22 bp, Homo sapiens
ggccttgatcctccagagcact

SEQ ID NO: 9222330 - DNA, 22 bp, Homo sapiens
ggccttgacagttaagagacct

SEQ ID NO: 9222331 - DNA, 22 bp, Homo sapiens
ggccttgagagccagtgcaggc

SEQ ID NO: 9222332 - DNA, 22 bp, Homo sapiens
ggccttgatcctccagagcact

SEQ ID NO: 9222333 - DNA, 22 bp, Homo sapiens
ggccttgagagccagtgcaggc

SEQ ID NO: 9222334 - DNA, 22 bp, Homo sapiens
ggccttgagcagggagaaacca

SEQ ID NO: 9222335 - DNA, 22 bp, Homo sapiens
ggccttggagtcctccactgga

SEQ ID NO: 9222336 - DNA, 22 bp, Homo sapiens
ggccttggaaagatacccagct

SEQ ID NO: 9222337 - DNA, 20 bp, Homo sapiens
ggccttggaatagcacagct

SEQ ID NO: 9222338 - DNA, 22 bp, Homo sapiens
ggctcaggccagaccacgactc

SEQ ID NO: 9222339 - DNA, 21 bp, Homo sapiens
ggctcctgctttgtgaggggc

SEQ ID NO: 9222340 - DNA, 22 bp, Homo sapiens
ggctcctgctgtcctttgaagc

SEQ ID NO: 9222341 - DNA, 22 bp, Homo sapiens
ggctcagcgcgctgggagggag

SEQ ID NO: 9222342 - DNA, 22 bp, Homo sapiens
ggctcagccccgtaacacagca

SEQ ID NO: 9222343 - DNA, 22 bp, Homo sapiens
ggctcagcccccacgcttcttc

SEQ ID NO: 9222344 - DNA, 22 bp, Homo sapiens
ggccttggcctagccctccagg

SEQ ID NO: 9222345 - DNA, 22 bp, Homo sapiens
ggccttggatccaagctgcggc

SEQ ID NO: 9222346 - DNA, 21 bp, Homo sapiens
ggccttggcgggggccgaatt

SEQ ID NO: 9222347 - DNA, 22 bp, Homo sapiens
ggccttggctcctgcagggagt

SEQ ID NO: 9222348 - DNA, 22 bp, Homo sapiens
ggccttgggaggagggtcagaa

SEQ ID NO: 9222349 - DNA, 22 bp, Homo sapiens
ggctcaggatgagccttctcat

SEQ ID NO: 9222350 - DNA, 22 bp, Homo sapiens
ggctcagcttatctgggcaggc

SEQ ID NO: 9222351 - DNA, 22 bp, Homo sapiens
ggctcagcttggtgcgcagaaa

SEQ ID NO: 9222352 - DNA, 22 bp, Homo sapiens
gcagaagctgggagaagggatt

SEQ ID NO: 9222353 - DNA, 22 bp, Homo sapiens
gcagaagctgggagaagggatt

SEQ ID NO: 9222354 - DNA, 22 bp, Homo sapiens
gcagaagctgggagaagggatt

SEQ ID NO: 9222355 - DNA, 22 bp, Homo sapiens
gcagaagcagggcaggggcaaa

SEQ ID NO: 9222356 - DNA, 22 bp, Homo sapiens
gcagaagcccggtcagcgcacg

SEQ ID NO: 9222357 - DNA, 22 bp, Homo sapiens
gcagaagcacaggtgacgggcc

SEQ ID NO: 9222358 - DNA, 22 bp, Homo sapiens
gcagaaatatgatgcataaagg

SEQ ID NO: 9222359 - DNA, 22 bp, Homo sapiens
gcagaaaccacagtgtctttta

SEQ ID NO: 9222360 - DNA, 22 bp, Homo sapiens
gcagaaacttggagaagccagg

SEQ ID NO: 9222361 - DNA, 22 bp, Homo sapiens
gcagaaacttggagaagccagg

SEQ ID NO: 9222362 - DNA, 22 bp, Homo sapiens
gcactttgtggattgtatttcc

SEQ ID NO: 9222363 - DNA, 22 bp, Homo sapiens
gcactttgcccctcctttggca

SEQ ID NO: 9222364 - DNA, 22 bp, Homo sapiens
gcactttcagcaggcagacaga

SEQ ID NO: 9222365 - DNA, 22 bp, Homo sapiens
gcagaaacaggagaaagggatc

SEQ ID NO: 9222366 - DNA, 22 bp, Homo sapiens
gcagaagctgggcagcgaggtg

SEQ ID NO: 9222367 - DNA, 22 bp, Homo sapiens
gcagaagctgggcagcgaggtg

SEQ ID NO: 9222368 - DNA, 22 bp, Homo sapiens
gcagaagctgggcagcgaggtg

SEQ ID NO: 9222369 - DNA, 22 bp, Homo sapiens
gcagagcagtgcttgcccagcg

SEQ ID NO: 9222370 - DNA, 22 bp, Homo sapiens
gcagagccaggctggggcaggt

SEQ ID NO: 9222371 - DNA, 22 bp, Homo sapiens
gcagagcccctcaagccagcct

SEQ ID NO: 9222372 - DNA, 22 bp, Homo sapiens
gcagagccagaatggccaggac

SEQ ID NO: 9222373 - DNA, 22 bp, Homo sapiens
gcagagccaggagcccaggatc

SEQ ID NO: 9222374 - DNA, 22 bp, Homo sapiens
gcacttgtggatttgatataca

SEQ ID NO: 9222375 - DNA, 22 bp, Homo sapiens
gcaccctgtttatcctgagttc

SEQ ID NO: 9222376 - DNA, 22 bp, Homo sapiens
gcaccctgctctatccttgcta

SEQ ID NO: 9222377 - DNA, 19 bp, Homo sapiens
gcaccctggccactcccac

SEQ ID NO: 9222378 - DNA, 19 bp, Homo sapiens
gcaccctgaggtcatggcc

SEQ ID NO: 9222379 - DNA, 22 bp, Homo sapiens
gcaccctgagtgttcagctcca

SEQ ID NO: 9222380 - DNA, 22 bp, Homo sapiens
gcacaagggtggtctctggagc

SEQ ID NO: 9222381 - DNA, 22 bp, Homo sapiens
gcacacacatgtgagtacatgc

SEQ ID NO: 9222382 - DNA, 22 bp, Homo sapiens
gcacacactgttttcctcacat

SEQ ID NO: 9222383 - DNA, 22 bp, Homo sapiens
gcacccagggacttggctggcc

SEQ ID NO: 9222384 - DNA, 22 bp, Homo sapiens
gcacccagggacttggctggcc

SEQ ID NO: 9222385 - DNA, 22 bp, Homo sapiens
gcacccagggacttggctggcc

SEQ ID NO: 9222386 - DNA, 22 bp, Homo sapiens
gcacccaggcttgggcagcaac

SEQ ID NO: 9222387 - DNA, 22 bp, Homo sapiens
gcacccaggccggcgactgcag

SEQ ID NO: 9222388 - DNA, 22 bp, Homo sapiens
gcacccagtttgtctcagggtt

SEQ ID NO: 9222389 - DNA, 22 bp, Homo sapiens
gcacccagggcaggaagtgagg

SEQ ID NO: 9222390 - DNA, 22 bp, Homo sapiens
gcacccagggcaggaagtgagg

SEQ ID NO: 9222391 - DNA, 22 bp, Homo sapiens
gattttcatttgcactctagaa

SEQ ID NO: 9222392 - DNA, 22 bp, Homo sapiens
gattttcattatagctagtttc

SEQ ID NO: 9222393 - DNA, 22 bp, Homo sapiens
gattttcatgataaacttgtga

SEQ ID NO: 9222394 - DNA, 22 bp, Homo sapiens
gattttcatgataaacttgtga

SEQ ID NO: 9222395 - DNA, 22 bp, Homo sapiens
gatttcttggcccactctcaga

SEQ ID NO: 9222396 - DNA, 22 bp, Homo sapiens
gatttctttagctcatcagatc

SEQ ID NO: 9222397 - DNA, 22 bp, Homo sapiens
gatttctttgtacccacaatcc

SEQ ID NO: 9222398 - DNA, 22 bp, Homo sapiens
gatttcttcattcattagatgg

SEQ ID NO: 9222399 - DNA, 22 bp, Homo sapiens
gcacaaactgcaattacttttg

SEQ ID NO: 9222400 - DNA, 22 bp, Homo sapiens
gcacaagaaatcatggactgaa

SEQ ID NO: 9222401 - DNA, 22 bp, Homo sapiens
gcacaacaccaagggaggtatc

SEQ ID NO: 9222402 - DNA, 19 bp, Homo sapiens
gcaatccacccacctcagc

SEQ ID NO: 9222403 - DNA, 17 bp, Homo sapiens
gcaatctcagtctcctt

SEQ ID NO: 9222404 - DNA, 22 bp, Homo sapiens
gcaaacatgctgagaaataaga

SEQ ID NO: 9222405 - DNA, 22 bp, Homo sapiens
gatgtttggctcaaacgagtgt

SEQ ID NO: 9222406 - DNA, 22 bp, Homo sapiens
gatgtgtttccaggatttgttt

SEQ ID NO: 9222407 - DNA, 21 bp, Homo sapiens
gattaaatttaagctacatgc

SEQ ID NO: 9222408 - DNA, 21 bp, Homo sapiens
gattaaatttaagctacatgc

SEQ ID NO: 9222409 - DNA, 22 bp, Homo sapiens
gatttacagctatacccaatgg

SEQ ID NO: 9222410 - DNA, 22 bp, Homo sapiens
gatttacagctatacccaatgg

SEQ ID NO: 9222411 - DNA, 22 bp, Homo sapiens
gatttacaggttaggtcctgta

SEQ ID NO: 9222412 - DNA, 22 bp, Homo sapiens
gatttacaggttaggtcctgta

SEQ ID NO: 9222413 - DNA, 22 bp, Homo sapiens
gatttattggtctttcattggt

SEQ ID NO: 9222414 - DNA, 22 bp, Homo sapiens
gattgtggaagtcagtggttct

SEQ ID NO: 9222415 - DNA, 19 bp, Homo sapiens
gatttaaacgtggctctat

SEQ ID NO: 9222416 - DNA, 22 bp, Homo sapiens
gatttacaaagctctctagtgt

SEQ ID NO: 9222417 - DNA, 22 bp, Homo sapiens
gatttacagatctaagggtcac

SEQ ID NO: 9222418 - DNA, 22 bp, Homo sapiens
gatttacaaagctctctagtgt

SEQ ID NO: 9222419 - DNA, 22 bp, Homo sapiens
gatttacagatctaagggtcac

SEQ ID NO: 9222420 - DNA, 22 bp, Homo sapiens
gattgcttctggaaagcagttt

SEQ ID NO: 9222421 - DNA, 22 bp, Homo sapiens
gatgggtgggttctgtgagagg

SEQ ID NO: 9222422 - DNA, 22 bp, Homo sapiens
gatggggatgagaagtgagcag

SEQ ID NO: 9222423 - DNA, 22 bp, Homo sapiens
gatgggggccagggcctgcttt

SEQ ID NO: 9222424 - DNA, 22 bp, Homo sapiens
gatgtaaaacctatggagctga

SEQ ID NO: 9222425 - DNA, 18 bp, Homo sapiens
gatgtaaaatagtagctt

SEQ ID NO: 9222426 - DNA, 22 bp, Homo sapiens
gatggaggagatggcagggtgc

SEQ ID NO: 9222427 - DNA, 22 bp, Homo sapiens
gatgggaggaacctgggtccct

SEQ ID NO: 9222428 - DNA, 22 bp, Homo sapiens
gatgctggcctggccatctggg

SEQ ID NO: 9222429 - DNA, 22 bp, Homo sapiens
gatgcgggcccgctccactgcc

SEQ ID NO: 9222430 - DNA, 22 bp, Homo sapiens
gatgcctgcatttcaggagagt

SEQ ID NO: 9222431 - DNA, 22 bp, Homo sapiens
gatgcctgtggtgagcacacat

SEQ ID NO: 9222432 - DNA, 22 bp, Homo sapiens
gatgcctgtggtgagcacacat

SEQ ID NO: 9222433 - DNA, 22 bp, Homo sapiens
gatgcctggcacccagcaagga

SEQ ID NO: 9222434 - DNA, 22 bp, Homo sapiens
gatgcctgtggtgagcacacat

SEQ ID NO: 9222435 - DNA, 22 bp, Homo sapiens
gcaggactttgtggatgatgga

SEQ ID NO: 9222436 - DNA, 22 bp, Homo sapiens
gcaggagagccagcaggcttcc

SEQ ID NO: 9222437 - DNA, 22 bp, Homo sapiens
gcaggacaggcgttggtccagt

SEQ ID NO: 9222438 - DNA, 22 bp, Homo sapiens
gcaggactcaaatctgaaggca

SEQ ID NO: 9222439 - DNA, 22 bp, Homo sapiens
gcagctgacatctggctgggcc

SEQ ID NO: 9222440 - DNA, 22 bp, Homo sapiens
gcagctgagagaagaacagggc

SEQ ID NO: 9222441 - DNA, 22 bp, Homo sapiens
gcagctgagagaagaacagggc

SEQ ID NO: 9222442 - DNA, 22 bp, Homo sapiens
gcagctgagcgtgaggaagagt

SEQ ID NO: 9222443 - DNA, 22 bp, Homo sapiens
gcagctgagcgtgaggaagagt

SEQ ID NO: 9222444 - DNA, 22 bp, Homo sapiens
gcaggagctcgtttccaggctg

SEQ ID NO: 9222445 - DNA, 22 bp, Homo sapiens
gcaggagctcgtttccaggctg

SEQ ID NO: 9222446 - DNA, 22 bp, Homo sapiens
gcaggagccacttcagggatgc

SEQ ID NO: 9222447 - DNA, 22 bp, Homo sapiens
gcaggagccacttcagggatgc

SEQ ID NO: 9222448 - DNA, 22 bp, Homo sapiens
gcaggagccaggccgagctggt

SEQ ID NO: 9222449 - DNA, 22 bp, Homo sapiens
gcaggagccaggccgagctggt

SEQ ID NO: 9222450 - DNA, 22 bp, Homo sapiens
gcaggagccctggcatgttctt

SEQ ID NO: 9222451 - DNA, 22 bp, Homo sapiens
gcaggagccagggattccagga

SEQ ID NO: 9222452 - DNA, 22 bp, Homo sapiens
gcagagctcatgcctgcacctc

SEQ ID NO: 9222453 - DNA, 22 bp, Homo sapiens
gcagcctctgcagttcaggagg

SEQ ID NO: 9222454 - DNA, 22 bp, Homo sapiens
gcagcgtggggctgagtcagct

SEQ ID NO: 9222455 - DNA, 22 bp, Homo sapiens
gcagagccttgcgtcatgtgcc

SEQ ID NO: 9222456 - DNA, 22 bp, Homo sapiens
gcagctcaagagaggtgctatg

SEQ ID NO: 9222457 - DNA, 22 bp, Homo sapiens
gcagctcacagtctccgccatc

SEQ ID NO: 9222458 - DNA, 22 bp, Homo sapiens
gcagctcagtaaaagaggagca

SEQ ID NO: 9222459 - DNA, 22 bp, Homo sapiens
gcagctcagggagagggcacca

SEQ ID NO: 9222460 - DNA, 22 bp, Homo sapiens
gcagctcagtaaaagaggagca

SEQ ID NO: 9222461 - DNA, 22 bp, Homo sapiens
gcagctcccatcagggcacaga

SEQ ID NO: 9222462 - DNA, 22 bp, Homo sapiens
gcagctctgacaatgcctggaa

SEQ ID NO: 9222463 - DNA, 18 bp, Homo sapiens
gcagctgacactggagtt

SEQ ID NO: 9222464 - DNA, 18 bp, Homo sapiens
gcagctgacactggagtt

SEQ ID NO: 9222465 - DNA, 22 bp, Homo sapiens
gcagctgaatgtccattgctgc

SEQ ID NO: 9222466 - DNA, 22 bp, Homo sapiens
gcagctgaaagggatctctaca

SEQ ID NO: 9222467 - DNA, 22 bp, Homo sapiens
gcagctgaagctgcagttccag

SEQ ID NO: 9222468 - DNA, 20 bp, Homo sapiens
gcagctgaaagtatgacacc

SEQ ID NO: 9222469 - DNA, 21 bp, Homo sapiens
gcaggctggtcaaacctcagt

SEQ ID NO: 9222470 - DNA, 21 bp, Homo sapiens
gcaggctggtcaaacctcagt

SEQ ID NO: 9222471 - DNA, 21 bp, Homo sapiens
gcaggctggtcaaacctcagt

SEQ ID NO: 9222472 - DNA, 21 bp, Homo sapiens
gcaggctggtcaaacctcagt

SEQ ID NO: 9222473 - DNA, 22 bp, Homo sapiens
gcaggctggggtagccccactt

SEQ ID NO: 9222474 - DNA, 22 bp, Homo sapiens
gcaggctggggtagccccactt

SEQ ID NO: 9222475 - DNA, 22 bp, Homo sapiens
gcaggctggtctgaccatccct

SEQ ID NO: 9222476 - DNA, 22 bp, Homo sapiens
gcagggacgccagggacagcaa

SEQ ID NO: 9222477 - DNA, 22 bp, Homo sapiens
gcaggctggaggctgttctggg

SEQ ID NO: 9222478 - DNA, 22 bp, Homo sapiens
gcaggctgctgagatccttagg

SEQ ID NO: 9222479 - DNA, 22 bp, Homo sapiens
gcaggctgccctcttgtgttga

SEQ ID NO: 9222480 - DNA, 22 bp, Homo sapiens
gcaggctgctgagatccttagg

SEQ ID NO: 9222481 - DNA, 22 bp, Homo sapiens
gcaggcagagaaggaacattta

SEQ ID NO: 9222482 - DNA, 22 bp, Homo sapiens
gcaggggcaggagatctcaggc

SEQ ID NO: 9222483 - DNA, 22 bp, Homo sapiens
gcaggggctactctgagcttcc

SEQ ID NO: 9222484 - DNA, 22 bp, Homo sapiens
gcaggggcggctgggtttccag

SEQ ID NO: 9222485 - DNA, 22 bp, Homo sapiens
gcaggggctaaggacacagaga

SEQ ID NO: 9222486 - DNA, 22 bp, Homo sapiens
gcaggggctgagcaccagcggg

SEQ ID NO: 9222487 - DNA, 22 bp, Homo sapiens
gcaggggctgagcaccagcggg

SEQ ID NO: 9222488 - DNA, 22 bp, Homo sapiens
gcaggggctgctgggaactcgg

SEQ ID NO: 9222489 - DNA, 22 bp, Homo sapiens
gcaggggctgctgggaactcgg

SEQ ID NO: 9222490 - DNA, 22 bp, Homo sapiens
gcaggtgggggtcggtgcatct

SEQ ID NO: 9222491 - DNA, 22 bp, Homo sapiens
gcaggtggtcactcatccccag

SEQ ID NO: 9222492 - DNA, 22 bp, Homo sapiens
gcaggtgggagccgctgcctga

SEQ ID NO: 9222493 - DNA, 22 bp, Homo sapiens
gcagggtggatggcagggccag

SEQ ID NO: 9222494 - DNA, 22 bp, Homo sapiens
gcagggtgccgacttcagggat

SEQ ID NO: 9222495 - DNA, 22 bp, Homo sapiens
gcagggtgccgacttcagggat

SEQ ID NO: 9222496 - DNA, 22 bp, Homo sapiens
gcagggtgatagtgaggctcag

SEQ ID NO: 9222497 - DNA, 22 bp, Homo sapiens
gcagtagaactgtcatgatgtt

SEQ ID NO: 9222498 - DNA, 22 bp, Homo sapiens
gcagtaagatgtttcccagagc

SEQ ID NO: 9222499 - DNA, 22 bp, Homo sapiens
gcagtagcagtatccagaagca

SEQ ID NO: 9222500 - DNA, 22 bp, Homo sapiens
gcagtgggcctgaggaagggtg

SEQ ID NO: 9222501 - DNA, 22 bp, Homo sapiens
gcagtgggcaacaagagctgga

SEQ ID NO: 9222502 - DNA, 22 bp, Homo sapiens
gcagtgggcaacaagagctgga

SEQ ID NO: 9222503 - DNA, 22 bp, Homo sapiens
gcagtggggcgctgggagttgg

SEQ ID NO: 9222504 - DNA, 22 bp, Homo sapiens
gcagtggggcaatcatagctca

SEQ ID NO: 9222505 - DNA, 22 bp, Homo sapiens
gcagtggggaatgctggggaga

SEQ ID NO: 9222506 - DNA, 22 bp, Homo sapiens
gcagtgttaggaataaaaatga

SEQ ID NO: 9222507 - DNA, 22 bp, Homo sapiens
gcagtgttatgttttctataat

SEQ ID NO: 9222508 - DNA, 22 bp, Homo sapiens
gcagtgttccttctactggggc

SEQ ID NO: 9222509 - DNA, 22 bp, Homo sapiens
gcagtgttcagtgaagcaggag

SEQ ID NO: 9222510 - DNA, 22 bp, Homo sapiens
gcagtgttgagccagctggggg

SEQ ID NO: 9222511 - DNA, 22 bp, Homo sapiens
gcagtgttgagtggtggctgaa

SEQ ID NO: 9222512 - DNA, 22 bp, Homo sapiens
gcagtgttgactatggtatgag

SEQ ID NO: 9222513 - DNA, 22 bp, Homo sapiens
gcagtgttcttgttgcttttat

SEQ ID NO: 9222514 - DNA, 22 bp, Homo sapiens
gcagtgttctaaattgggtgtg

SEQ ID NO: 9222515 - DNA, 22 bp, Homo sapiens
gcagtgttcagtgaagcaggag

SEQ ID NO: 9222516 - DNA, 22 bp, Homo sapiens
gcatgggaggacagtctgggct

SEQ ID NO: 9222517 - DNA, 22 bp, Homo sapiens
gcatggcttctgccaggcacct

SEQ ID NO: 9222518 - DNA, 22 bp, Homo sapiens
gcatgggcaagaggactggggg

SEQ ID NO: 9222519 - DNA, 22 bp, Homo sapiens
gcatgtctgtaattacagagcc

SEQ ID NO: 9222520 - DNA, 22 bp, Homo sapiens
gcatgttttgcaacaagtgacc

SEQ ID NO: 9222521 - DNA, 22 bp, Homo sapiens
gccaatagcaatttctaggccc

SEQ ID NO: 9222522 - DNA, 22 bp, Homo sapiens
gccacacttattctcatgcaca

SEQ ID NO: 9222523 - DNA, 22 bp, Homo sapiens
gccacagacagagagtctagtg

SEQ ID NO: 9222524 - DNA, 22 bp, Homo sapiens
gccacactgcttctttgagcct

SEQ ID NO: 9222525 - DNA, 22 bp, Homo sapiens
gccacacttattctcatgcaca

SEQ ID NO: 9222526 - DNA, 22 bp, Homo sapiens
gccacaggctccagcatcagta

SEQ ID NO: 9222527 - DNA, 20 bp, Homo sapiens
gccagaggccggcaggggct

SEQ ID NO: 9222528 - DNA, 22 bp, Homo sapiens
gccacaggctccagcatcagta

SEQ ID NO: 9222529 - DNA, 22 bp, Homo sapiens
gccagaggctcaggttgccatg

SEQ ID NO: 9222530 - DNA, 22 bp, Homo sapiens
gccagatctgacatagtggaag

SEQ ID NO: 9222531 - DNA, 22 bp, Homo sapiens
gccacaggaaagcaccctggag

SEQ ID NO: 9222532 - DNA, 22 bp, Homo sapiens
gccacagctccagtcaggtgac

SEQ ID NO: 9222533 - DNA, 22 bp, Homo sapiens
gccacagcctctgggaaaactc

SEQ ID NO: 9222534 - DNA, 22 bp, Homo sapiens
gccacagcggggccgctagagc

SEQ ID NO: 9222535 - DNA, 19 bp, Homo sapiens
gccagcagaatgatgaggc

SEQ ID NO: 9222536 - DNA, 19 bp, Homo sapiens
gccagcacccagctgtgtc

SEQ ID NO: 9222537 - DNA, 22 bp, Homo sapiens
gccagcaaagcaagttgtcagc

SEQ ID NO: 9222538 - DNA, 22 bp, Homo sapiens
gccagcagctgtggggtggcca

SEQ ID NO: 9222539 - DNA, 22 bp, Homo sapiens
gccagcagccacagaagtcact

SEQ ID NO: 9222540 - DNA, 22 bp, Homo sapiens
gcccaggctggagtgcagtggc

SEQ ID NO: 9222541 - DNA, 22 bp, Homo sapiens
gcccaggctggagtgcagtggc

SEQ ID NO: 9222542 - DNA, 22 bp, Homo sapiens
gccctcagcaggaaagatcaac

SEQ ID NO: 9222543 - DNA, 22 bp, Homo sapiens
gccctcagagttccccacagtg

SEQ ID NO: 9222544 - DNA, 22 bp, Homo sapiens
gccctcagctcctggacacatg

SEQ ID NO: 9222545 - DNA, 22 bp, Homo sapiens
gccctcagcatcctcagggcca

SEQ ID NO: 9222546 - DNA, 22 bp, Homo sapiens
gccctctcttctgcagcctcca

SEQ ID NO: 9222547 - DNA, 22 bp, Homo sapiens
gccctctcttctgcagcctcca

SEQ ID NO: 9222548 - DNA, 22 bp, Homo sapiens
gccctcgggctgccctaggctg

SEQ ID NO: 9222549 - DNA, 22 bp, Homo sapiens
gccctcaggcagggagtctttc

SEQ ID NO: 9222550 - DNA, 22 bp, Homo sapiens
gccctctgatgctcaccgagga

SEQ ID NO: 9222551 - DNA, 22 bp, Homo sapiens
gcccttacagggtggtcagcca

SEQ ID NO: 9222552 - DNA, 22 bp, Homo sapiens
gcccttcagttactccttgatg

SEQ ID NO: 9222553 - DNA, 22 bp, Homo sapiens
gcccttcagttactccttgatg

SEQ ID NO: 9222554 - DNA, 22 bp, Homo sapiens
gcccttcatttatagttggaat

SEQ ID NO: 9222555 - DNA, 22 bp, Homo sapiens
gcccttcacgatggtatcttag

SEQ ID NO: 9222556 - DNA, 22 bp, Homo sapiens
gcctctgcccatccaccatcag

SEQ ID NO: 9222557 - DNA, 22 bp, Homo sapiens
gcctctgccctcctgggactgc

SEQ ID NO: 9222558 - DNA, 22 bp, Homo sapiens
gcctctgcgcctcagccgacct

SEQ ID NO: 9222559 - DNA, 22 bp, Homo sapiens
gcctctgcggagctgtacatca

SEQ ID NO: 9222560 - DNA, 22 bp, Homo sapiens
gcctctgcggggcccgagcccg

SEQ ID NO: 9222561 - DNA, 22 bp, Homo sapiens
gcctctgctcggactttgcctc

SEQ ID NO: 9222562 - DNA, 22 bp, Homo sapiens
gcctctgctgcaagcctggttg

SEQ ID NO: 9222563 - DNA, 21 bp, Homo sapiens
gcctctgctgtcttattgtga

SEQ ID NO: 9222564 - DNA, 19 bp, Homo sapiens
gcctctgctggggacaggc

SEQ ID NO: 9222565 - DNA, 19 bp, Homo sapiens
gcctctgctggggacaggc

SEQ ID NO: 9222566 - DNA, 23 bp, Homo sapiens
gcctctgctctgcgttggggact

SEQ ID NO: 9222567 - DNA, 22 bp, Homo sapiens
gcctctgctctcaggtagcctc

SEQ ID NO: 9222568 - DNA, 22 bp, Homo sapiens
gcctctgctgacaagatggaca

SEQ ID NO: 9222569 - DNA, 22 bp, Homo sapiens
gcctctgctgacaagatggaca

SEQ ID NO: 9222570 - DNA, 23 bp, Homo sapiens
gcctctgcagcctagttagtgtc

SEQ ID NO: 9222571 - DNA, 22 bp, Homo sapiens
gcctctgcaggtgcggttatcc

SEQ ID NO: 9222572 - DNA, 22 bp, Homo sapiens
gcctctgcactgtggcacacca

SEQ ID NO: 9222573 - DNA, 22 bp, Homo sapiens
gcctctgcaccagtactgtgcc

SEQ ID NO: 9222574 - DNA, 22 bp, Homo sapiens
gcctctgcaactccgccttggt

SEQ ID NO: 9222575 - DNA, 22 bp, Homo sapiens
gcctctgcaattacattgtgcc

SEQ ID NO: 9222576 - DNA, 22 bp, Homo sapiens
gcctctgccaagggggctgcgg

SEQ ID NO: 9222577 - DNA, 22 bp, Homo sapiens
gcctctgcatgctcagcaccca

SEQ ID NO: 9222578 - DNA, 22 bp, Homo sapiens
gcctctgcatcttcgccgcact

SEQ ID NO: 9222579 - DNA, 22 bp, Homo sapiens
gcctctgcatcatcactccagc

SEQ ID NO: 9222580 - DNA, 22 bp, Homo sapiens
gcctcctggttgcttctccaac

SEQ ID NO: 9222581 - DNA, 22 bp, Homo sapiens
gccgtccacgtgacccaagaag

SEQ ID NO: 9222582 - DNA, 22 bp, Homo sapiens
gccgtccacctcgatggccact

SEQ ID NO: 9222583 - DNA, 22 bp, Homo sapiens
gccgggttcaagccattctcct

SEQ ID NO: 9222584 - DNA, 22 bp, Homo sapiens
gccgaagacgctgggcgtgggc

SEQ ID NO: 9222585 - DNA, 22 bp, Homo sapiens
gccaggctctcagtgactgccc

SEQ ID NO: 9222586 - DNA, 22 bp, Homo sapiens
gccagcagctgtggggtggcca

SEQ ID NO: 9222587 - DNA, 22 bp, Homo sapiens
gccaggctctcagtgactgccc

SEQ ID NO: 9222588 - DNA, 19 bp, Homo sapiens
gccaggctcttattctgtg

SEQ ID NO: 9222589 - DNA, 22 bp, Homo sapiens
gccaggctcttccatttgggtc

SEQ ID NO: 9222590 - DNA, 22 bp, Homo sapiens
gccaggctcttggttatgtttt

SEQ ID NO: 9222591 - DNA, 22 bp, Homo sapiens
gccaggctcttggttatgtttt

SEQ ID NO: 9222592 - DNA, 22 bp, Homo sapiens
gccaggctgactcccccggcct

SEQ ID NO: 9222593 - DNA, 22 bp, Homo sapiens
gccaggctgaggctctggaaga

SEQ ID NO: 9222594 - DNA, 22 bp, Homo sapiens
gccaggctgaggctctggaaga

SEQ ID NO: 9222595 - DNA, 22 bp, Homo sapiens
gccaggctgccttatctctagc

SEQ ID NO: 9222596 - DNA, 22 bp, Homo sapiens
gccaggctgctccagggaggcc

SEQ ID NO: 9222597 - DNA, 22 bp, Homo sapiens
gccaggctgctccagggaggcc

SEQ ID NO: 9222598 - DNA, 22 bp, Homo sapiens
gccaggctgctggctgctgtcc

SEQ ID NO: 9222599 - DNA, 22 bp, Homo sapiens
gccaggctggtgtcacaactct

SEQ ID NO: 9222600 - DNA, 22 bp, Homo sapiens
gccaggctggtgtcacaactct

SEQ ID NO: 9222601 - DNA, 22 bp, Homo sapiens
gccaggctggttatttaatgag

SEQ ID NO: 9222602 - DNA, 22 bp, Homo sapiens
gccaggctggttatttaatgag

SEQ ID NO: 9222603 - DNA, 22 bp, Homo sapiens
gccaggctgtggggaacttgaa

SEQ ID NO: 9222604 - DNA, 22 bp, Homo sapiens
gccaggctggtgcaaggatatt

SEQ ID NO: 9222605 - DNA, 22 bp, Homo sapiens
gccaggctggtgtcacaactct

SEQ ID NO: 9222606 - DNA, 22 bp, Homo sapiens
gccaggctgtggggaacttgaa

SEQ ID NO: 9222607 - DNA, 22 bp, Homo sapiens
gccaggctgtggggaacttgaa

SEQ ID NO: 9222608 - DNA, 22 bp, Homo sapiens
gccaggctgtttttattactgt

SEQ ID NO: 9222609 - DNA, 22 bp, Homo sapiens
gccaggctgtttttattactgt

SEQ ID NO: 9222610 - DNA, 22 bp, Homo sapiens
gccagtgggtagttggagctgg

SEQ ID NO: 9222611 - DNA, 22 bp, Homo sapiens
gccatatacccactgtctccat

SEQ ID NO: 9222612 - DNA, 22 bp, Homo sapiens
gccagtggtgagattccctggg

SEQ ID NO: 9222613 - DNA, 22 bp, Homo sapiens
gccattgagattgaagtaagca

SEQ ID NO: 9222614 - DNA, 22 bp, Homo sapiens
gccattgatgtgaaagtaagac

SEQ ID NO: 9222615 - DNA, 22 bp, Homo sapiens
gccattgagattgaagtaagca

SEQ ID NO: 9222616 - DNA, 22 bp, Homo sapiens
gccattgggctgtagttttttg

SEQ ID NO: 9222617 - DNA, 22 bp, Homo sapiens
gccattgatgtgaaagtaagac

SEQ ID NO: 9222618 - DNA, 22 bp, Homo sapiens
gccatgtcctgggcatctgcca

SEQ ID NO: 9222619 - DNA, 22 bp, Homo sapiens
gccatggggctcagctgcacta

SEQ ID NO: 9222620 - DNA, 22 bp, Homo sapiens
gccatcacatccaggctacctc

SEQ ID NO: 9222621 - DNA, 22 bp, Homo sapiens
gcccaggctagcgtagagtgca

SEQ ID NO: 9222622 - DNA, 22 bp, Homo sapiens
gcccaggctagcgtagagtgca

SEQ ID NO: 9222623 - DNA, 22 bp, Homo sapiens
gcccaggctggagtgcagtagc

SEQ ID NO: 9222624 - DNA, 23 bp, Homo sapiens
gcctgcctgacctgtgcaaagtc

SEQ ID NO: 9222625 - DNA, 21 bp, Homo sapiens
gcctgcctgcgtgaccctctt

SEQ ID NO: 9222626 - DNA, 22 bp, Homo sapiens
gcctgcctgaaggctgtaccag

SEQ ID NO: 9222627 - DNA, 20 bp, Homo sapiens
gcctgcctcagctagctgag

SEQ ID NO: 9222628 - DNA, 22 bp, Homo sapiens
gcctgcctcaaaatcccagttc

SEQ ID NO: 9222629 - DNA, 18 bp, Homo sapiens
gcctgcctagagcttgcc

SEQ ID NO: 9222630 - DNA, 20 bp, Homo sapiens
gcctgcctcagctagctgag

SEQ ID NO: 9222631 - DNA, 17 bp, Homo sapiens
gcctctgcttgtgtcat

SEQ ID NO: 9222632 - DNA, 22 bp, Homo sapiens
gcctgccaaaagaagctgctgg

SEQ ID NO: 9222633 - DNA, 18 bp, Homo sapiens
gcctgccaactcctgatc

SEQ ID NO: 9222634 - DNA, 18 bp, Homo sapiens
gcctgccaactcctgatc

SEQ ID NO: 9222635 - DNA, 19 bp, Homo sapiens
gcctgccagatagtaatga

SEQ ID NO: 9222636 - DNA, 19 bp, Homo sapiens
gcctgccagcctgaatctg

SEQ ID NO: 9222637 - DNA, 22 bp, Homo sapiens
gcctgccagtgtttgaggattg

SEQ ID NO: 9222638 - DNA, 22 bp, Homo sapiens
gcctgcctgctgtcatctgcct

SEQ ID NO: 9222639 - DNA, 22 bp, Homo sapiens
gcctgcctgctgtcatctgcct

SEQ ID NO: 9222640 - DNA, 22 bp, Homo sapiens
gcctgcctggagcttgaggtga

SEQ ID NO: 9222641 - DNA, 19 bp, Homo sapiens
gcctgcctgggtttctgag

SEQ ID NO: 9222642 - DNA, 22 bp, Homo sapiens
gcctgcctggagcttgaggtga

SEQ ID NO: 9222643 - DNA, 22 bp, Homo sapiens
gcctgcctgctgtgtgcaagtt

SEQ ID NO: 9222644 - DNA, 22 bp, Homo sapiens
gcctgcctgctgtgtgcaagtt

SEQ ID NO: 9222645 - DNA, 22 bp, Homo sapiens
gcctgccttcggtgcgcagcgg

SEQ ID NO: 9222646 - DNA, 22 bp, Homo sapiens
gcctgcctttgtatgaccctga

SEQ ID NO: 9222647 - DNA, 22 bp, Homo sapiens
gcctgcctgttggctgaggtgc

SEQ ID NO: 9222648 - DNA, 22 bp, Homo sapiens
gcctgccttcggtgcgcagcgg

SEQ ID NO: 9222649 - DNA, 22 bp, Homo sapiens
gcctgcctgttggctgaggtgc

SEQ ID NO: 9222650 - DNA, 22 bp, Homo sapiens
gcctgcctgttggctgaggtgc

SEQ ID NO: 9222651 - DNA, 19 bp, Homo sapiens
gcctgcctgggtttctgag

SEQ ID NO: 9222652 - DNA, 19 bp, Homo sapiens
gcctgcctgggtttctgag

SEQ ID NO: 9222653 - DNA, 22 bp, Homo sapiens
gcctgcctggagcttgaggtga

SEQ ID NO: 9222654 - DNA, 22 bp, Homo sapiens
gcctgctttgtgcctgatcttt

SEQ ID NO: 9222655 - DNA, 22 bp, Homo sapiens
gcctgctttaagtctgttgcct

SEQ ID NO: 9222656 - DNA, 22 bp, Homo sapiens
gcctgcttctcagtcagcttgg

SEQ ID NO: 9222657 - DNA, 22 bp, Homo sapiens
gcctgcctttgtgaggaagcgg

SEQ ID NO: 9222658 - DNA, 22 bp, Homo sapiens
gcctgccttttggaggcacatt

SEQ ID NO: 9222659 - DNA, 22 bp, Homo sapiens
gcctgccttttggaggcacatt

SEQ ID NO: 9222660 - DNA, 22 bp, Homo sapiens
gcctgctcagacctagcaggcc

SEQ ID NO: 9222661 - DNA, 22 bp, Homo sapiens
gcctgctctccggatccctgat

SEQ ID NO: 9222662 - DNA, 22 bp, Homo sapiens
gcctgccttttggaggcacatt

SEQ ID NO: 9222663 - DNA, 22 bp, Homo sapiens
gcctggagcctcagcaaggagg

SEQ ID NO: 9222664 - DNA, 22 bp, Homo sapiens
gcctggagcctcagcaaggagg

SEQ ID NO: 9222665 - DNA, 22 bp, Homo sapiens
gcctgtggccgactgagagcct

SEQ ID NO: 9222666 - DNA, 22 bp, Homo sapiens
gcctgggattcccagaggggca

SEQ ID NO: 9222667 - DNA, 23 bp, Homo sapiens
gcctgggactcaggaggagctca

SEQ ID NO: 9222668 - DNA, 22 bp, Homo sapiens
gcctggcagtgatgtcttttgg

SEQ ID NO: 9222669 - DNA, 23 bp, Homo sapiens
gcctggccaccccagggctgctt

SEQ ID NO: 9222670 - DNA, 17 bp, Homo sapiens
gcctggcccagcctggc

SEQ ID NO: 9222671 - DNA, 22 bp, Homo sapiens
gcctggccgctccgagctccgc

SEQ ID NO: 9222672 - DNA, 22 bp, Homo sapiens
gcctggcctgaactaggaggtg

SEQ ID NO: 9222673 - DNA, 22 bp, Homo sapiens
gcctggcttttgcctcatgttc

SEQ ID NO: 9222674 - DNA, 22 bp, Homo sapiens
gcctgggaaatggtggggtcag

SEQ ID NO: 9222675 - DNA, 19 bp, Homo sapiens
gctcctgggcctcactcat

SEQ ID NO: 9222676 - DNA, 16 bp, Homo sapiens
gctcctgggccctcga

SEQ ID NO: 9222677 - DNA, 22 bp, Homo sapiens
gctcctggctctggccaaggga

SEQ ID NO: 9222678 - DNA, 22 bp, Homo sapiens
gctcctggcttcactgacatca

SEQ ID NO: 9222679 - DNA, 22 bp, Homo sapiens
gctcctggctctggccaaggga

SEQ ID NO: 9222680 - DNA, 22 bp, Homo sapiens
gctcctggctctggccaaggga

SEQ ID NO: 9222681 - DNA, 22 bp, Homo sapiens
gctcctgggtgtggctgcccct

SEQ ID NO: 9222682 - DNA, 22 bp, Homo sapiens
gctgagattacgggcatgagcc

SEQ ID NO: 9222683 - DNA, 22 bp, Homo sapiens
gctgagagtgtgagatcagatt

SEQ ID NO: 9222684 - DNA, 17 bp, Homo sapiens
gctctgccaggaaagag

SEQ ID NO: 9222685 - DNA, 22 bp, Homo sapiens
gctcttctcagattgtacactc

SEQ ID NO: 9222686 - DNA, 22 bp, Homo sapiens
gctcttctcagattgtacactc

SEQ ID NO: 9222687 - DNA, 22 bp, Homo sapiens
gctcttctaaagaatgtacagg

SEQ ID NO: 9222688 - DNA, 22 bp, Homo sapiens
gctcttccatttctcttgaact

SEQ ID NO: 9222689 - DNA, 22 bp, Homo sapiens
gctctgtttatccctgacaatt

SEQ ID NO: 9222690 - DNA, 22 bp, Homo sapiens
gctccaggagagggaagcagat

SEQ ID NO: 9222691 - DNA, 22 bp, Homo sapiens
gctccaggagctcacagctcgc

SEQ ID NO: 9222692 - DNA, 22 bp, Homo sapiens
gctccaggaggatgaccttcct

SEQ ID NO: 9222693 - DNA, 22 bp, Homo sapiens
gctcctcttatttcatcagggc

SEQ ID NO: 9222694 - DNA, 22 bp, Homo sapiens
gctcctctgtcaaatgagagtg

SEQ ID NO: 9222695 - DNA, 22 bp, Homo sapiens
gctcctggcaggcagtgtgtgt

SEQ ID NO: 9222696 - DNA, 22 bp, Homo sapiens
gctcctctcccagagctgcagg

SEQ ID NO: 9222697 - DNA, 22 bp, Homo sapiens
gctcctggccagcacagggccc

SEQ ID NO: 9222698 - DNA, 22 bp, Homo sapiens
gctcctggctctctgagggctg

SEQ ID NO: 9222699 - DNA, 22 bp, Homo sapiens
gctcctggctccaggcagccaa

SEQ ID NO: 9222700 - DNA, 22 bp, Homo sapiens
gctccagcacctagagcaggtc

SEQ ID NO: 9222701 - DNA, 22 bp, Homo sapiens
gctccaggaagggaaatctcca

SEQ ID NO: 9222702 - DNA, 22 bp, Homo sapiens
gctccacaaataatggaacctg

SEQ ID NO: 9222703 - DNA, 22 bp, Homo sapiens
gctcatgactgtaatcccagca

SEQ ID NO: 9222704 - DNA, 22 bp, Homo sapiens
gctcagagcatcccagtgaatg

SEQ ID NO: 9222705 - DNA, 22 bp, Homo sapiens
gctcagagatggggaatgaaaa

SEQ ID NO: 9222706 - DNA, 22 bp, Homo sapiens
gctcagagatgttcagtagctt

SEQ ID NO: 9222707 - DNA, 22 bp, Homo sapiens
gctcagaccccaccctggcaga

SEQ ID NO: 9222708 - DNA, 22 bp, Homo sapiens
gctcagacctgtaatcttagca

SEQ ID NO: 9222709 - DNA, 19 bp, Homo sapiens
gctcagacattaagcagct

SEQ ID NO: 9222710 - DNA, 22 bp, Homo sapiens
gctcagacagatatttcgagat

SEQ ID NO: 9222711 - DNA, 22 bp, Homo sapiens
gctcactggcctgaagaggacg

SEQ ID NO: 9222712 - DNA, 22 bp, Homo sapiens
gctggcctgggcagcctgtcgg

SEQ ID NO: 9222713 - DNA, 22 bp, Homo sapiens
gctggcctgcgagggcaggctg

SEQ ID NO: 9222714 - DNA, 22 bp, Homo sapiens
gctgggatgcgtcttcccaggc

SEQ ID NO: 9222715 - DNA, 22 bp, Homo sapiens
gctgggatggagactgcagtga

SEQ ID NO: 9222716 - DNA, 22 bp, Homo sapiens
gctgggagttactgtctccttt

SEQ ID NO: 9222717 - DNA, 22 bp, Homo sapiens
gctggcctttgaggaagctgcg

SEQ ID NO: 9222718 - DNA, 22 bp, Homo sapiens
gctgggcaatgccagagaggag

SEQ ID NO: 9222719 - DNA, 22 bp, Homo sapiens
gctgggcaacggaagagagaaa

SEQ ID NO: 9222720 - DNA, 22 bp, Homo sapiens
gctgggcaggcctcgtgagggc

SEQ ID NO: 9222721 - DNA, 22 bp, Homo sapiens
gctgggcagcctggccgctgcc

SEQ ID NO: 9222722 - DNA, 22 bp, Homo sapiens
gctgggcagcccctacagagag

SEQ ID NO: 9222723 - DNA, 22 bp, Homo sapiens
gctggagctgagttccctgggc

SEQ ID NO: 9222724 - DNA, 22 bp, Homo sapiens
gctggccccgagtgctacgctc

SEQ ID NO: 9222725 - DNA, 22 bp, Homo sapiens
gctggcccagggtcacctagga

SEQ ID NO: 9222726 - DNA, 22 bp, Homo sapiens
gctggcccagtgacccacagtg

SEQ ID NO: 9222727 - DNA, 22 bp, Homo sapiens
gctggagctgcagcctgggcct

SEQ ID NO: 9222728 - DNA, 22 bp, Homo sapiens
gctggccagtgtcccagggatc

SEQ ID NO: 9222729 - DNA, 22 bp, Homo sapiens
gctggcccagggtcacctagga

SEQ ID NO: 9222730 - DNA, 22 bp, Homo sapiens
gctggcctgacctgaggctggg

SEQ ID NO: 9222731 - DNA, 22 bp, Homo sapiens
gctggcctcgcaggcaggatgt

SEQ ID NO: 9222732 - DNA, 22 bp, Homo sapiens
gctgcctgtcccaggatgagga

SEQ ID NO: 9222733 - DNA, 22 bp, Homo sapiens
gctgcctggtttctcagctgca

SEQ ID NO: 9222734 - DNA, 22 bp, Homo sapiens
gctgcctgggcaggaggcgctg

SEQ ID NO: 9222735 - DNA, 22 bp, Homo sapiens
gctgcctgggctggcattccca

SEQ ID NO: 9222736 - DNA, 22 bp, Homo sapiens
gctgcctgggctggcattccca

SEQ ID NO: 9222737 - DNA, 22 bp, Homo sapiens
gctgctctgctgtgtaagcagg

SEQ ID NO: 9222738 - DNA, 22 bp, Homo sapiens
gctgaggattgaagagttgcca

SEQ ID NO: 9222739 - DNA, 22 bp, Homo sapiens
gctgcctgaagtgtctacactg

SEQ ID NO: 9222740 - DNA, 22 bp, Homo sapiens
gctgcctgatcatacaccaggg

SEQ ID NO: 9222741 - DNA, 22 bp, Homo sapiens
gctgagctagctatctcagtct

SEQ ID NO: 9222742 - DNA, 22 bp, Homo sapiens
gctgcctggagctcagcctgcc

SEQ ID NO: 9222743 - DNA, 22 bp, Homo sapiens
gctgcctggatttgcaatcctc

SEQ ID NO: 9222744 - DNA, 22 bp, Homo sapiens
gctgcctggatttgcaatcctc

SEQ ID NO: 9222745 - DNA, 22 bp, Homo sapiens
gctgcctggctttagtccactt

SEQ ID NO: 9222746 - DNA, 22 bp, Homo sapiens
gctgcctggagctcagcctgcc

SEQ ID NO: 9222747 - DNA, 22 bp, Homo sapiens
gctgcctggagaggcagggatg

SEQ ID NO: 9222748 - DNA, 22 bp, Homo sapiens
gctgcctggaataacggctggc

SEQ ID NO: 9222749 - DNA, 22 bp, Homo sapiens
gctgcctgcttcatgtgggaga

SEQ ID NO: 9222750 - DNA, 22 bp, Homo sapiens
gctgcctgctcacccggcctgg

SEQ ID NO: 9222751 - DNA, 22 bp, Homo sapiens
gctgcctgatcatacaccaggg

SEQ ID NO: 9222752 - DNA, 22 bp, Homo sapiens
gaggaggctgaacaatgccctg

SEQ ID NO: 9222753 - DNA, 22 bp, Homo sapiens
gaggaggctgaacaatgccctg

SEQ ID NO: 9222754 - DNA, 19 bp, Homo sapiens
gaggaggcttcagctttct

SEQ ID NO: 9222755 - DNA, 22 bp, Homo sapiens
gaggcagaggttgcagtgagct

SEQ ID NO: 9222756 - DNA, 22 bp, Homo sapiens
gaggcagagtgcaccccaggag

SEQ ID NO: 9222757 - DNA, 22 bp, Homo sapiens
gaggaggtcgctgctgagcccc

SEQ ID NO: 9222758 - DNA, 22 bp, Homo sapiens
gaggaggtcccccgacatgcct

SEQ ID NO: 9222759 - DNA, 22 bp, Homo sapiens
gaggcagaggttgcagtgagct

SEQ ID NO: 9222760 - DNA, 22 bp, Homo sapiens
gaggcagaggttgcagtgagct

SEQ ID NO: 9222761 - DNA, 22 bp, Homo sapiens
gaggcctagtctgcctgctcac

SEQ ID NO: 9222762 - DNA, 22 bp, Homo sapiens
gaggcctaggagccaggcatca

SEQ ID NO: 9222763 - DNA, 19 bp, Homo sapiens
gaggcccatgagggtgctc

SEQ ID NO: 9222764 - DNA, 22 bp, Homo sapiens
gaggcctctgtcccaccaggga

SEQ ID NO: 9222765 - DNA, 22 bp, Homo sapiens
gaggcctcctctgagacatctg

SEQ ID NO: 9222766 - DNA, 18 bp, Homo sapiens
gaggcctgagaaccaggt

SEQ ID NO: 9222767 - DNA, 22 bp, Homo sapiens
gaggcctctgtcccgccaggga

SEQ ID NO: 9222768 - DNA, 22 bp, Homo sapiens
gaggcagctcttctgaatgggg

SEQ ID NO: 9222769 - DNA, 22 bp, Homo sapiens
gaggcagcaggctgaggaggat

SEQ ID NO: 9222770 - DNA, 22 bp, Homo sapiens
gaggcagcagaacatggaagag

SEQ ID NO: 9222771 - DNA, 22 bp, Homo sapiens
gagagtctagtgcacctagttt

SEQ ID NO: 9222772 - DNA, 22 bp, Homo sapiens
gagagttcttgcctgggtatta

SEQ ID NO: 9222773 - DNA, 22 bp, Homo sapiens
gagctggaggaccaggactggg

SEQ ID NO: 9222774 - DNA, 22 bp, Homo sapiens
gagctggaggcagtgctgaggt

SEQ ID NO: 9222775 - DNA, 22 bp, Homo sapiens
gagctggcacagaaggatctta

SEQ ID NO: 9222776 - DNA, 22 bp, Homo sapiens
gagctggcaggaggctccccga

SEQ ID NO: 9222777 - DNA, 22 bp, Homo sapiens
gagctggctccgccatgctgct

SEQ ID NO: 9222778 - DNA, 22 bp, Homo sapiens
gagctggctaatactgacttat

SEQ ID NO: 9222779 - DNA, 22 bp, Homo sapiens
gaggaatgggtgtctcgtgatt

SEQ ID NO: 9222780 - DNA, 22 bp, Homo sapiens
gaggacagagccgcctggcaag

SEQ ID NO: 9222781 - DNA, 22 bp, Homo sapiens
gaggacagagccgcctggcaag

SEQ ID NO: 9222782 - DNA, 22 bp, Homo sapiens
gagctgggaggactgggaactt

SEQ ID NO: 9222783 - DNA, 22 bp, Homo sapiens
gagctgggagttatagcatgtt

SEQ ID NO: 9222784 - DNA, 22 bp, Homo sapiens
gagctgggacttggaatccaca

SEQ ID NO: 9222785 - DNA, 22 bp, Homo sapiens
gagggccaaagagcaagagcct

SEQ ID NO: 9222786 - DNA, 22 bp, Homo sapiens
gaggggagtgtcctccgggccc

SEQ ID NO: 9222787 - DNA, 22 bp, Homo sapiens
gaggggagtgtcctccgggccc

SEQ ID NO: 9222788 - DNA, 22 bp, Homo sapiens
gaggggagtaaagtcatgttac

SEQ ID NO: 9222789 - DNA, 22 bp, Homo sapiens
gaggggcaagaagttggcctct

SEQ ID NO: 9222790 - DNA, 21 bp, Homo sapiens
gaggggcagctcttagcatta

SEQ ID NO: 9222791 - DNA, 22 bp, Homo sapiens
gaggggcagttgattgtgctat

SEQ ID NO: 9222792 - DNA, 22 bp, Homo sapiens
gagggatgcagaaacagaggcc

SEQ ID NO: 9222793 - DNA, 22 bp, Homo sapiens
gaggctgggggctgccttcctc

SEQ ID NO: 9222794 - DNA, 22 bp, Homo sapiens
gaggcctgcagcgtggtccctg

SEQ ID NO: 9222795 - DNA, 22 bp, Homo sapiens
gaggcctgaggctgcctggagc

SEQ ID NO: 9222796 - DNA, 22 bp, Homo sapiens
gagtcagaaagtagtgtgccta

SEQ ID NO: 9222797 - DNA, 22 bp, Homo sapiens
gagtcagaaactcactctatag

SEQ ID NO: 9222798 - DNA, 19 bp, Homo sapiens
gaggtgggtccccgcagcc

SEQ ID NO: 9222799 - DNA, 22 bp, Homo sapiens
gaggtgggtgtatcacaggtca

SEQ ID NO: 9222800 - DNA, 22 bp, Homo sapiens
gagtcagaccgactgggctcat

SEQ ID NO: 9222801 - DNA, 22 bp, Homo sapiens
gagtcagatgaagataaaaggg

SEQ ID NO: 9222802 - DNA, 22 bp, Homo sapiens
gagtcagattgcagacagggct

SEQ ID NO: 9222803 - DNA, 22 bp, Homo sapiens
gagtcagattgcagacagggct

SEQ ID NO: 9222804 - DNA, 22 bp, Homo sapiens
gagtcagacagggtcacccaga

SEQ ID NO: 9222805 - DNA, 22 bp, Homo sapiens
gagtcagaatgtcctcctgcgg

SEQ ID NO: 9222806 - DNA, 22 bp, Homo sapiens
gagtcagaattgtattttaaac

SEQ ID NO: 9222807 - DNA, 22 bp, Homo sapiens
gagtcagaagaaactatttaca

SEQ ID NO: 9222808 - DNA, 22 bp, Homo sapiens
gagtcccatgatgatagccaca

SEQ ID NO: 9222809 - DNA, 22 bp, Homo sapiens
gagtcccatgatgatagccaca

SEQ ID NO: 9222810 - DNA, 22 bp, Homo sapiens
gagtccagttgttcacagaggc

SEQ ID NO: 9222811 - DNA, 22 bp, Homo sapiens
gagtcccaggaatgagcatagt

SEQ ID NO: 9222812 - DNA, 22 bp, Homo sapiens
gagtcccaggatatgtgctgtt

SEQ ID NO: 9222813 - DNA, 22 bp, Homo sapiens
gagtcaggctagggtgacaggc

SEQ ID NO: 9222814 - DNA, 22 bp, Homo sapiens
gaggtgggcggatcacaaggtc

SEQ ID NO: 9222815 - DNA, 22 bp, Homo sapiens
gaggtgggatgtgtgtgctact

SEQ ID NO: 9222816 - DNA, 22 bp, Homo sapiens
gaggtccagggtggggcctgag

SEQ ID NO: 9222817 - DNA, 22 bp, Homo sapiens
gaggggcctggcgaggacatgt

SEQ ID NO: 9222818 - DNA, 22 bp, Homo sapiens
gaggggcctggcactgagctgg

SEQ ID NO: 9222819 - DNA, 22 bp, Homo sapiens
gaggggcctggcactgagctgg

SEQ ID NO: 9222820 - DNA, 22 bp, Homo sapiens
gaggtaggtgtaggaggcctgc

SEQ ID NO: 9222821 - DNA, 22 bp, Homo sapiens
gaggtaggtgtaggaggcctgc

SEQ ID NO: 9222822 - DNA, 22 bp, Homo sapiens
gaggtaacactgttcagtgggc

SEQ ID NO: 9222823 - DNA, 22 bp, Homo sapiens
gagtggcatatgtgcctgtgaa

SEQ ID NO: 9222824 - DNA, 22 bp, Homo sapiens
gagtggagatcgtgccactgca

SEQ ID NO: 9222825 - DNA, 22 bp, Homo sapiens
gagtggagcaaaagaggtagat

SEQ ID NO: 9222826 - DNA, 22 bp, Homo sapiens
gagtgctcctggatggatttcc

SEQ ID NO: 9222827 - DNA, 22 bp, Homo sapiens
gagtgcatggactactggcttg

SEQ ID NO: 9222828 - DNA, 22 bp, Homo sapiens
gagtgccaagagaagaggctgg

SEQ ID NO: 9222829 - DNA, 22 bp, Homo sapiens
gagtgccaagagaagaggctgg

SEQ ID NO: 9222830 - DNA, 22 bp, Homo sapiens
gagtgagggccaacatccagct

SEQ ID NO: 9222831 - DNA, 22 bp, Homo sapiens
gagtgaggctggaatcatggct

SEQ ID NO: 9222832 - DNA, 22 bp, Homo sapiens
gagtgagtggccaggaggcaga

SEQ ID NO: 9222833 - DNA, 22 bp, Homo sapiens
gagtctggactattctggtctt

SEQ ID NO: 9222834 - DNA, 22 bp, Homo sapiens
gagtctccaatccatgcctgtc

SEQ ID NO: 9222835 - DNA, 22 bp, Homo sapiens
gagtcctgctttcaattctttt

SEQ ID NO: 9222836 - DNA, 22 bp, Homo sapiens
gagtcctggagaaacgcaggtg

SEQ ID NO: 9222837 - DNA, 22 bp, Homo sapiens
gagtcctggcgtccaatttcct

SEQ ID NO: 9222838 - DNA, 22 bp, Homo sapiens
gagtcccaggaatgagcatagt

SEQ ID NO: 9222839 - DNA, 19 bp, Homo sapiens
gagtcctgtgctccttgtt

SEQ ID NO: 9222840 - DNA, 22 bp, Homo sapiens
gagttgatcattatttggtttc

SEQ ID NO: 9222841 - DNA, 22 bp, Homo sapiens
gataacaatatgaagtagatat

SEQ ID NO: 9222842 - DNA, 20 bp, Homo sapiens
gataaattgtctcttaagtg

SEQ ID NO: 9222843 - DNA, 22 bp, Homo sapiens
gagtggggtctgggcatcagtc

SEQ ID NO: 9222844 - DNA, 22 bp, Homo sapiens
gagtgggtaccggagcaggtgc

SEQ ID NO: 9222845 - DNA, 22 bp, Homo sapiens
gagtggggggtccgtctcagtg

SEQ ID NO: 9222846 - DNA, 22 bp, Homo sapiens
gagtggggggtccgtctcagtg

SEQ ID NO: 9222847 - DNA, 22 bp, Homo sapiens
gagtggttagaagtagtgtggc

SEQ ID NO: 9222848 - DNA, 22 bp, Homo sapiens
gagtgtgggcacgggggccttg

SEQ ID NO: 9222849 - DNA, 22 bp, Homo sapiens
gagtgtgggcacgggggccttg

SEQ ID NO: 9222850 - DNA, 22 bp, Homo sapiens
gagtgtggatcccagaagcaga

SEQ ID NO: 9222851 - DNA, 22 bp, Homo sapiens
gagtgtggtgaacaggagcacc

SEQ ID NO: 9222852 - DNA, 22 bp, Homo sapiens
gagtgtggtgaacaggagcacc

SEQ ID NO: 9222853 - DNA, 22 bp, Homo sapiens
gagtgtggtgaacaggagcacc

SEQ ID NO: 9222854 - DNA, 22 bp, Homo sapiens
gagtgtgggtctcagctttaag

SEQ ID NO: 9222855 - DNA, 22 bp, Homo sapiens
gatgaaaaattgctgtgtcata

SEQ ID NO: 9222856 - DNA, 22 bp, Homo sapiens
gatcttttcagaatttatcagt

SEQ ID NO: 9222857 - DNA, 22 bp, Homo sapiens
gatctggtttcatcatggactt

SEQ ID NO: 9222858 - DNA, 22 bp, Homo sapiens
gatcccttgggccaaggagttg

SEQ ID NO: 9222859 - DNA, 22 bp, Homo sapiens
gatctggtacaggcctgcagcc

SEQ ID NO: 9222860 - DNA, 22 bp, Homo sapiens
gatccagcttctacacagagct

SEQ ID NO: 9222861 - DNA, 22 bp, Homo sapiens
gatgaggaaaccaaggctcagg

SEQ ID NO: 9222862 - DNA, 22 bp, Homo sapiens
gatgaggaaaccaaggctcagg

SEQ ID NO: 9222863 - DNA, 22 bp, Homo sapiens
gatgcaggtgtgccacagagct

SEQ ID NO: 9222864 - DNA, 22 bp, Homo sapiens
gatgcagggctggcaggagctt

SEQ ID NO: 9222865 - DNA, 22 bp, Homo sapiens
gatgcagggctggcaggagctt

SEQ ID NO: 9222866 - DNA, 22 bp, Homo sapiens
gatgcagggaacttagtgggct

SEQ ID NO: 9222867 - DNA, 22 bp, Homo sapiens
gatgcacggtcatgtcttttca

SEQ ID NO: 9222868 - DNA, 22 bp, Homo sapiens
gatacataaaaatgtgctctat

SEQ ID NO: 9222869 - DNA, 22 bp, Homo sapiens
gataatatctggtttattcacc

SEQ ID NO: 9222870 - DNA, 22 bp, Homo sapiens
gataataagcacagcaggatgt

SEQ ID NO: 9222871 - DNA, 22 bp, Homo sapiens
gataggagatgatccaatggga

SEQ ID NO: 9222872 - DNA, 22 bp, Homo sapiens
gatagtcacctcccttaacttt

SEQ ID NO: 9222873 - DNA, 22 bp, Homo sapiens
gatatacaatccacagttgatt

SEQ ID NO: 9222874 - DNA, 22 bp, Homo sapiens
gatagaaagaatatagattcca

SEQ ID NO: 9222875 - DNA, 22 bp, Homo sapiens
gatagcagctctggggtcagac

SEQ ID NO: 9222876 - DNA, 22 bp, Homo sapiens
gatagaaagagtggttcttttt

SEQ ID NO: 9222877 - DNA, 22 bp, Homo sapiens
gatagaaaggtgttgaaatcca

SEQ ID NO: 9222878 - DNA, 18 bp, Homo sapiens
gatatataggaggaaagt

SEQ ID NO: 9222879 - DNA, 22 bp, Homo sapiens
gatataggttcatagtgttaca

SEQ ID NO: 9222880 - DNA, 22 bp, Homo sapiens
gatatacataggtttctatgca

SEQ ID NO: 9222881 - DNA, 22 bp, Homo sapiens
gatatacagagcattctttgat

SEQ ID NO: 9222882 - DNA, 22 bp, Homo sapiens
gatattttgagaaatcctatga

SEQ ID NO: 9222883 - DNA, 22 bp, Homo sapiens
gatatttttaggtgatgcaggc

SEQ ID NO: 9222884 - DNA, 22 bp, Homo sapiens
gatattttcattcggatgctca

SEQ ID NO: 9222885 - DNA, 22 bp, Homo sapiens
gatattttcagtctcctttcaa

SEQ ID NO: 9222886 - DNA, 22 bp, Homo sapiens
gatattttcgcagggagaattc

SEQ ID NO: 9222887 - DNA, 22 bp, Homo sapiens
gatcaatggtgtaacttgtcct

SEQ ID NO: 9222888 - DNA, 22 bp, Homo sapiens
gatatttttgcagacacctggg

SEQ ID NO: 9222889 - DNA, 22 bp, Homo sapiens
gatatttttagtatttctgcct

SEQ ID NO: 9222890 - DNA, 21 bp, Homo sapiens
ctttagtgaaaaggggctaac

SEQ ID NO: 9222891 - DNA, 22 bp, Homo sapiens
ctttagcaacgatgatgatatt

SEQ ID NO: 9222892 - DNA, 22 bp, Homo sapiens
ctttagtgttgttgtgaggatt

SEQ ID NO: 9222893 - DNA, 22 bp, Homo sapiens
ctttacaattcaagggaactct

SEQ ID NO: 9222894 - DNA, 22 bp, Homo sapiens
ctttacaattcaagggaactct

SEQ ID NO: 9222895 - DNA, 22 bp, Homo sapiens
ctttacaacctaagttgaagct

SEQ ID NO: 9222896 - DNA, 22 bp, Homo sapiens
ctttggcagcctctgctattga

SEQ ID NO: 9222897 - DNA, 20 bp, Homo sapiens
ctttggcaggccttgccacg

SEQ ID NO: 9222898 - DNA, 22 bp, Homo sapiens
ctttggcatggtcctcactata

SEQ ID NO: 9222899 - DNA, 17 bp, Homo sapiens
ctttggcaggagggagg

SEQ ID NO: 9222900 - DNA, 19 bp, Homo sapiens
ctttgtcagaacatgcttc

SEQ ID NO: 9222901 - DNA, 22 bp, Homo sapiens
ctttggcagcctcagctgcagg

SEQ ID NO: 9222902 - DNA, 22 bp, Homo sapiens
cttgggagacacaagaagacat

SEQ ID NO: 9222903 - DNA, 22 bp, Homo sapiens
cttgggagacacaagaagacat

SEQ ID NO: 9222904 - DNA, 22 bp, Homo sapiens
cttgggagtagaggcaggagca

SEQ ID NO: 9222905 - DNA, 22 bp, Homo sapiens
cttgggatttgagatctggata

SEQ ID NO: 9222906 - DNA, 22 bp, Homo sapiens
cttgggcaagcagcattcagaa

SEQ ID NO: 9222907 - DNA, 22 bp, Homo sapiens
ctttacaacctaagttgaagct

SEQ ID NO: 9222908 - DNA, 22 bp, Homo sapiens
ctttacaaattagctctcggga

SEQ ID NO: 9222909 - DNA, 22 bp, Homo sapiens
cttggggaagccactgatccct

SEQ ID NO: 9222910 - DNA, 22 bp, Homo sapiens
cttggatttgggcccttaaatt

SEQ ID NO: 9222911 - DNA, 22 bp, Homo sapiens
cttggctgtctataggaaagag

SEQ ID NO: 9222912 - DNA, 22 bp, Homo sapiens
cttggctgttgggcattgagaa

SEQ ID NO: 9222913 - DNA, 22 bp, Homo sapiens
cttggctgcttttgtgcacatt

SEQ ID NO: 9222914 - DNA, 22 bp, Homo sapiens
cttggctggaactcctgagaaa

SEQ ID NO: 9222915 - DNA, 22 bp, Homo sapiens
cttggctgtcataaggtcctgg

SEQ ID NO: 9222916 - DNA, 22 bp, Homo sapiens
cttctttactttctagaaataa

SEQ ID NO: 9222917 - DNA, 22 bp, Homo sapiens
cttctttgaaaaaggcagtcag

SEQ ID NO: 9222918 - DNA, 22 bp, Homo sapiens
cttctctgtgtagagattcaga

SEQ ID NO: 9222919 - DNA, 22 bp, Homo sapiens
cttctctctgcataggcatggg

SEQ ID NO: 9222920 - DNA, 22 bp, Homo sapiens
cttctctggcatagcaagcagg

SEQ ID NO: 9222921 - DNA, 22 bp, Homo sapiens
cttctctgcccataggaaatgc

SEQ ID NO: 9222922 - DNA, 17 bp, Homo sapiens
cttctctggcagaagat

SEQ ID NO: 9222923 - DNA, 22 bp, Homo sapiens
ctggctggtctgagcagtcgca

SEQ ID NO: 9222924 - DNA, 22 bp, Homo sapiens
ctggctggttccctgctccagg

SEQ ID NO: 9222925 - DNA, 22 bp, Homo sapiens
cttctctccctggcactcagac

SEQ ID NO: 9222926 - DNA, 22 bp, Homo sapiens
cttctctatgatgttctaaggt

SEQ ID NO: 9222927 - DNA, 22 bp, Homo sapiens
ctggctgggttccaggattcca

SEQ ID NO: 9222928 - DNA, 22 bp, Homo sapiens
ctggctgggttccaggattcca

SEQ ID NO: 9222929 - DNA, 22 bp, Homo sapiens
ctggctggtaatggaacgacag

SEQ ID NO: 9222930 - DNA, 22 bp, Homo sapiens
ctggctggtagaattgtgacct

SEQ ID NO: 9222931 - DNA, 22 bp, Homo sapiens
ctggctggtcatgtcatgagcc

SEQ ID NO: 9222932 - DNA, 22 bp, Homo sapiens
ctggctggtcatgtcatgagcc

SEQ ID NO: 9222933 - DNA, 22 bp, Homo sapiens
ctggctggtcatgtcatgagcc

SEQ ID NO: 9222934 - DNA, 22 bp, Homo sapiens
ctggctggtcatgtcatgagcc

SEQ ID NO: 9222935 - DNA, 22 bp, Homo sapiens
ctggctgggcagacagaatgct

SEQ ID NO: 9222936 - DNA, 22 bp, Homo sapiens
ctggctggggtaccagttgaac

SEQ ID NO: 9222937 - DNA, 22 bp, Homo sapiens
ctggctggaggtgagtcactga

SEQ ID NO: 9222938 - DNA, 22 bp, Homo sapiens
gaaagggagtggacaacaggca

SEQ ID NO: 9222939 - DNA, 22 bp, Homo sapiens
gaaaggtgccccataggcagga

SEQ ID NO: 9222940 - DNA, 22 bp, Homo sapiens
gaaagttattgaaccttattta

SEQ ID NO: 9222941 - DNA, 21 bp, Homo sapiens
gaaaatacaatgagcttgacc

SEQ ID NO: 9222942 - DNA, 22 bp, Homo sapiens
gaaaagtatgtttattttgact

SEQ ID NO: 9222943 - DNA, 22 bp, Homo sapiens
gaaaggcatcttcagtctctga

SEQ ID NO: 9222944 - DNA, 22 bp, Homo sapiens
gaaaggccaccatgccagggac

SEQ ID NO: 9222945 - DNA, 22 bp, Homo sapiens
gaaaggccacgtgccaagatta

SEQ ID NO: 9222946 - DNA, 22 bp, Homo sapiens
gaaaggccagctcacagatgag

SEQ ID NO: 9222947 - DNA, 22 bp, Homo sapiens
gaaaggccatttctgagggttt

SEQ ID NO: 9222948 - DNA, 22 bp, Homo sapiens
gaaagggagtgaagatggtata

SEQ ID NO: 9222949 - DNA, 22 bp, Homo sapiens
ctttgttcatgacatctgcttc

SEQ ID NO: 9222950 - DNA, 22 bp, Homo sapiens
ctttgtcattttgtctctcagt

SEQ ID NO: 9222951 - DNA, 22 bp, Homo sapiens
ctttgtggctcctgcaggccat

SEQ ID NO: 9222952 - DNA, 22 bp, Homo sapiens
gaaaagctaggccagttcagct

SEQ ID NO: 9222953 - DNA, 21 bp, Homo sapiens
gaaaagcaagggagtagaaca

SEQ ID NO: 9222954 - DNA, 21 bp, Homo sapiens
gaaaagcaagggagtagaaca

SEQ ID NO: 9222955 - DNA, 21 bp, Homo sapiens
gaaaagcaagggagtagaaca

SEQ ID NO: 9222956 - DNA, 22 bp, Homo sapiens
gaaaacatccagagatagacct

SEQ ID NO: 9222957 - DNA, 22 bp, Homo sapiens
gaaatacaaatgcctagatcct

SEQ ID NO: 9222958 - DNA, 22 bp, Homo sapiens
gaaatacaaagccagccatttt

SEQ ID NO: 9222959 - DNA, 22 bp, Homo sapiens
gaaatacaaagccagccatttt

SEQ ID NO: 9222960 - DNA, 22 bp, Homo sapiens
gaaataatacagtgctcttctc

SEQ ID NO: 9222961 - DNA, 22 bp, Homo sapiens
gaacacagtgtgatcgtatgtc

SEQ ID NO: 9222962 - DNA, 22 bp, Homo sapiens
gaacacagtcaagggctgctgt

SEQ ID NO: 9222963 - DNA, 22 bp, Homo sapiens
gaacacagtacttttcctgatg

SEQ ID NO: 9222964 - DNA, 22 bp, Homo sapiens
gaaatttacaactttctcatgg

SEQ ID NO: 9222965 - DNA, 22 bp, Homo sapiens
gaaatttattatctacatcatt

SEQ ID NO: 9222966 - DNA, 22 bp, Homo sapiens
gaacacagcagggataaccact

SEQ ID NO: 9222967 - DNA, 22 bp, Homo sapiens
gaaatacagaaagggctgaatg

SEQ ID NO: 9222968 - DNA, 22 bp, Homo sapiens
gaaatttacaactttctcatgg

SEQ ID NO: 9222969 - DNA, 22 bp, Homo sapiens
gaaatacaattttgtcccagct

SEQ ID NO: 9222970 - DNA, 22 bp, Homo sapiens
gaacagaattaccgaagatctg

SEQ ID NO: 9222971 - DNA, 22 bp, Homo sapiens
gaacagatgggctcagatcctg

SEQ ID NO: 9222972 - DNA, 22 bp, Homo sapiens
gaagtgtgcacatcttacaagt

SEQ ID NO: 9222973 - DNA, 22 bp, Homo sapiens
gaaggctctgatttcttgcaaa

SEQ ID NO: 9222974 - DNA, 22 bp, Homo sapiens
gaaggagagggtcaaggataat

SEQ ID NO: 9222975 - DNA, 22 bp, Homo sapiens
gaaggcccgccctgagcaaggg

SEQ ID NO: 9222976 - DNA, 22 bp, Homo sapiens
gaaggcccagtcaaggggctag

SEQ ID NO: 9222977 - DNA, 22 bp, Homo sapiens
gaaggccctgttttccctattt

SEQ ID NO: 9222978 - DNA, 22 bp, Homo sapiens
gaaggcctagggatgctctgcg

SEQ ID NO: 9222979 - DNA, 22 bp, Homo sapiens
gaaggccctggtattcttgagg

SEQ ID NO: 9222980 - DNA, 22 bp, Homo sapiens
gaaggcccgccctgagcaaggg

SEQ ID NO: 9222981 - DNA, 22 bp, Homo sapiens
gaaggagagaaaggcaattctg

SEQ ID NO: 9222982 - DNA, 22 bp, Homo sapiens
gaaggaccctctggggtctcag

SEQ ID NO: 9222983 - DNA, 22 bp, Homo sapiens
gaagttcaactgccatgcttgg

SEQ ID NO: 9222984 - DNA, 22 bp, Homo sapiens
gaattctagggtaaatatccta

SEQ ID NO: 9222985 - DNA, 22 bp, Homo sapiens
gaatttaagaggatgaatctgt

SEQ ID NO: 9222986 - DNA, 22 bp, Homo sapiens
gaatttaaatttaaatctacca

SEQ ID NO: 9222987 - DNA, 22 bp, Homo sapiens
gaatttaaaggccagacctgag

SEQ ID NO: 9222988 - DNA, 23 bp, Homo sapiens
gacacaggagcacccagctgagc

SEQ ID NO: 9222989 - DNA, 20 bp, Homo sapiens
gacacaggcagtcctcagag

SEQ ID NO: 9222990 - DNA, 22 bp, Homo sapiens
gacacaggattcctggctctgc

SEQ ID NO: 9222991 - DNA, 18 bp, Homo sapiens
gacacaggagagagtccc

SEQ ID NO: 9222992 - DNA, 22 bp, Homo sapiens
gacacaggaatcaccttggatg

SEQ ID NO: 9222993 - DNA, 22 bp, Homo sapiens
gacacaggaaaagctccagccc

SEQ ID NO: 9222994 - DNA, 22 bp, Homo sapiens
gacacagcttgatgagggcttt

SEQ ID NO: 9222995 - DNA, 22 bp, Homo sapiens
gacacagctttctgaagagcat

SEQ ID NO: 9222996 - DNA, 20 bp, Homo sapiens
gacaggagagttaggtaggt

SEQ ID NO: 9222997 - DNA, 22 bp, Homo sapiens
gacacagggggatgtgtggacg

SEQ ID NO: 9222998 - DNA, 22 bp, Homo sapiens
gacacagggacgtgctctgcct

SEQ ID NO: 9222999 - DNA, 22 bp, Homo sapiens
gacacaggggggcgctagaaga

SEQ ID NO: 9223000 - DNA, 22 bp, Homo sapiens
gacacagggggatgtgtggacg

SEQ ID NO: 9223001 - DNA, 22 bp, Homo sapiens
gacagctgtggagaggcatgtg

SEQ ID NO: 9223002 - DNA, 22 bp, Homo sapiens
gagacacaggtggttcctgtca

SEQ ID NO: 9223003 - DNA, 22 bp, Homo sapiens
gagacacagagaggctgtgtga

SEQ ID NO: 9223004 - DNA, 22 bp, Homo sapiens
gagaaacaacacttgatgcctt

SEQ ID NO: 9223005 - DNA, 22 bp, Homo sapiens
gagaaaatagcatgtgtagtat

SEQ ID NO: 9223006 - DNA, 22 bp, Homo sapiens
gacttgggtgtcggggcagtct

SEQ ID NO: 9223007 - DNA, 22 bp, Homo sapiens
gagagtctaggaacctcatata

SEQ ID NO: 9223008 - DNA, 22 bp, Homo sapiens
gagagctggccagcttcagtat

SEQ ID NO: 9223009 - DNA, 22 bp, Homo sapiens
gagagccctgctcctatcccag

SEQ ID NO: 9223010 - DNA, 22 bp, Homo sapiens
gagacagagtttcactcttgtt

SEQ ID NO: 9223011 - DNA, 22 bp, Homo sapiens
gacttcctaagattcaggaatg

SEQ ID NO: 9223012 - DNA, 22 bp, Homo sapiens
gacttgaaagggtgaacaactt

SEQ ID NO: 9223013 - DNA, 22 bp, Homo sapiens
gacttgaatcccaactcctctc

SEQ ID NO: 9223014 - DNA, 22 bp, Homo sapiens
gacttgggctgagggccagcag

SEQ ID NO: 9223015 - DNA, 22 bp, Homo sapiens
gacttgggggaagatgtggctg

SEQ ID NO: 9223016 - DNA, 22 bp, Homo sapiens
gacccagggtttctgcacaggg

SEQ ID NO: 9223017 - DNA, 22 bp, Homo sapiens
gacccagggtttctgcacaggg

SEQ ID NO: 9223018 - DNA, 22 bp, Homo sapiens
gactgtccagaattcctaggtg

SEQ ID NO: 9223019 - DNA, 18 bp, Homo sapiens
gacccagcagatgggctt

SEQ ID NO: 9223020 - DNA, 22 bp, Homo sapiens
gacccagctaaccaggtgggga

SEQ ID NO: 9223021 - DNA, 22 bp, Homo sapiens
gacccagcttaagtcacatgtt

SEQ ID NO: 9223022 - DNA, 22 bp, Homo sapiens
gacccaggcccaaggctgccag

SEQ ID NO: 9223023 - DNA, 22 bp, Homo sapiens
gacccaggggcagggagaaagt

SEQ ID NO: 9223024 - DNA, 22 bp, Homo sapiens
gacccaggggcagggagaaagt

SEQ ID NO: 9223025 - DNA, 22 bp, Homo sapiens
gacaggcaccttgtctgtcttg

SEQ ID NO: 9223026 - DNA, 22 bp, Homo sapiens
gacaggaggcagagctcaggtg

SEQ ID NO: 9223027 - DNA, 22 bp, Homo sapiens
gacaggaggcagagctcaggtg

SEQ ID NO: 9223028 - DNA, 22 bp, Homo sapiens
gaccaggcttccccagacctca

SEQ ID NO: 9223029 - DNA, 22 bp, Homo sapiens
gaccaggctgttccagtctaac

SEQ ID NO: 9223030 - DNA, 22 bp, Homo sapiens
tgtatgtctgtgaattcatatt

SEQ ID NO: 9223031 - DNA, 22 bp, Homo sapiens
tgtatgtatgtatgtatttggg

SEQ ID NO: 9223032 - DNA, 22 bp, Homo sapiens
cctggcaccttcacagactact

SEQ ID NO: 9223033 - DNA, 22 bp, Homo sapiens
tgtcatggtagctgaaggatgt

SEQ ID NO: 9223034 - DNA, 22 bp, Homo sapiens
tgtcatgggtctaaacattgat

SEQ ID NO: 9223035 - DNA, 22 bp, Homo sapiens
tgtcatgggcatttattgaggg

SEQ ID NO: 9223036 - DNA, 22 bp, Homo sapiens
tgtcagctggagatggcatggg

SEQ ID NO: 9223037 - DNA, 22 bp, Homo sapiens
tgtaaacatatgtatgtatgta

SEQ ID NO: 9223038 - DNA, 22 bp, Homo sapiens
cctggaggtggaggttgcagtg

SEQ ID NO: 9223039 - DNA, 22 bp, Homo sapiens
cctggaggtggaggttgcagtg

SEQ ID NO: 9223040 - DNA, 22 bp, Homo sapiens
cctggagcacagcccagtccca

SEQ ID NO: 9223041 - DNA, 22 bp, Homo sapiens
cctggagaggagaaagggccca

SEQ ID NO: 9223042 - DNA, 22 bp, Homo sapiens
cctggagattatttggtccaat

SEQ ID NO: 9223043 - DNA, 22 bp, Homo sapiens
cctggagaggcgctgcagagga

SEQ ID NO: 9223044 - DNA, 22 bp, Homo sapiens
cctggagacctgatggcagcgg

SEQ ID NO: 9223045 - DNA, 22 bp, Homo sapiens
cctggagacgaggctggaccat

SEQ ID NO: 9223046 - DNA, 22 bp, Homo sapiens
cctggagagctcgggccaggca

SEQ ID NO: 9223047 - DNA, 21 bp, Homo sapiens
cctggagacaaagacagggtg

SEQ ID NO: 9223048 - DNA, 22 bp, Homo sapiens
tggtgctgcaggtgggcacagt

SEQ ID NO: 9223049 - DNA, 22 bp, Homo sapiens
tggtgctgccacctcctctgct

SEQ ID NO: 9223050 - DNA, 22 bp, Homo sapiens
tggtgctgccaggctcctgcca

SEQ ID NO: 9223051 - DNA, 23 bp, Homo sapiens
tggtggcttgtggtggccaccag

SEQ ID NO: 9223052 - DNA, 22 bp, Homo sapiens
tggtggctgttgcagaactgag

SEQ ID NO: 9223053 - DNA, 17 bp, Homo sapiens
tggtggctggagtcagg

SEQ ID NO: 9223054 - DNA, 22 bp, Homo sapiens
tggtggctgtaagggagagaag

SEQ ID NO: 9223055 - DNA, 22 bp, Homo sapiens
tggtggctcacgtctgtaatct

SEQ ID NO: 9223056 - DNA, 22 bp, Homo sapiens
tggtggctaccaggtcctgggg

SEQ ID NO: 9223057 - DNA, 22 bp, Homo sapiens
tggtggctaccaggtcctgggg

SEQ ID NO: 9223058 - DNA, 22 bp, Homo sapiens
tggtggctcacacctgtaatcc

SEQ ID NO: 9223059 - DNA, 18 bp, Homo sapiens
cctgccattgattctgag

SEQ ID NO: 9223060 - DNA, 22 bp, Homo sapiens
cctgccatgccagcatgcccgt

SEQ ID NO: 9223061 - DNA, 22 bp, Homo sapiens
cctgcccacagagagggtgcat

SEQ ID NO: 9223062 - DNA, 22 bp, Homo sapiens
cctgcccactccaggagcaact

SEQ ID NO: 9223063 - DNA, 22 bp, Homo sapiens
cctgcccactccaggagcaact

SEQ ID NO: 9223064 - DNA, 22 bp, Homo sapiens
cctgccagtgcctcccactggt

SEQ ID NO: 9223065 - DNA, 17 bp, Homo sapiens
cctgcccagagacagat

SEQ ID NO: 9223066 - DNA, 17 bp, Homo sapiens
cctgcccagagacagat

SEQ ID NO: 9223067 - DNA, 17 bp, Homo sapiens
cctgcccagagacagat

SEQ ID NO: 9223068 - DNA, 22 bp, Homo sapiens
cctgcccactgcccggtcagcc

SEQ ID NO: 9223069 - DNA, 21 bp, Homo sapiens
tggtgccttcagctgtctttt

SEQ ID NO: 9223070 - DNA, 19 bp, Homo sapiens
tggtcccatactgctggcc

SEQ ID NO: 9223071 - DNA, 22 bp, Homo sapiens
tggtccctagcacagctgtcct

SEQ ID NO: 9223072 - DNA, 22 bp, Homo sapiens
tggtaggatagtgacttatatg

SEQ ID NO: 9223073 - DNA, 22 bp, Homo sapiens
tggtaggagggaaatgcgggtt

SEQ ID NO: 9223074 - DNA, 22 bp, Homo sapiens
tggtccagtcgttcctttcctt

SEQ ID NO: 9223075 - DNA, 22 bp, Homo sapiens
tggtccagtaagggtggagaga

SEQ ID NO: 9223076 - DNA, 22 bp, Homo sapiens
cctctgtgcctcagtttcatgt

SEQ ID NO: 9223077 - DNA, 22 bp, Homo sapiens
cctggctcccggaacagggtct

SEQ ID NO: 9223078 - DNA, 22 bp, Homo sapiens
cctggctccctggacctcatta

SEQ ID NO: 9223079 - DNA, 22 bp, Homo sapiens
cctggctcctgcctctgcaggg

SEQ ID NO: 9223080 - DNA, 22 bp, Homo sapiens
cctggctccgtgtcacgtgccc

SEQ ID NO: 9223081 - DNA, 22 bp, Homo sapiens
cctggctcctgcacagatcttt

SEQ ID NO: 9223082 - DNA, 22 bp, Homo sapiens
cctggctcgctgacctcagggg

SEQ ID NO: 9223083 - DNA, 22 bp, Homo sapiens
cctggctctagaggccactcct

SEQ ID NO: 9223084 - DNA, 22 bp, Homo sapiens
cctggctctctgcagatcctgg

SEQ ID NO: 9223085 - DNA, 22 bp, Homo sapiens
cctggctctgaagtccacatca

SEQ ID NO: 9223086 - DNA, 19 bp, Homo sapiens
cctggccctgctgcgcggg

SEQ ID NO: 9223087 - DNA, 22 bp, Homo sapiens
cctggccctggaatagggcagg

SEQ ID NO: 9223088 - DNA, 22 bp, Homo sapiens
cctggcctcctggccttctcat

SEQ ID NO: 9223089 - DNA, 22 bp, Homo sapiens
cctggctcccccatcatagctg

SEQ ID NO: 9223090 - DNA, 22 bp, Homo sapiens
cctggctccagctgcctgtcct

SEQ ID NO: 9223091 - DNA, 22 bp, Homo sapiens
cctggctccagctgcctgtcct

SEQ ID NO: 9223092 - DNA, 21 bp, Homo sapiens
cctggctccagaacttccggt

SEQ ID NO: 9223093 - DNA, 22 bp, Homo sapiens
cctggcctgtgaatctgagagc

SEQ ID NO: 9223094 - DNA, 22 bp, Homo sapiens
tgtctcatctcttaaccccact

SEQ ID NO: 9223095 - DNA, 22 bp, Homo sapiens
tgtctctggcccatgagcagag

SEQ ID NO: 9223096 - DNA, 22 bp, Homo sapiens
tgtctctggctgcagcctgttc

SEQ ID NO: 9223097 - DNA, 22 bp, Homo sapiens
tgtctctggctgcagcctgttc

SEQ ID NO: 9223098 - DNA, 22 bp, Homo sapiens
tgtctctgtctcccaggttgtg

SEQ ID NO: 9223099 - DNA, 22 bp, Homo sapiens
tgtcctggaaaaatggagagtt

SEQ ID NO: 9223100 - DNA, 22 bp, Homo sapiens
cctggccagcgccggctgctcg

SEQ ID NO: 9223101 - DNA, 22 bp, Homo sapiens
cctggccagccagggctggggt

SEQ ID NO: 9223102 - DNA, 22 bp, Homo sapiens
cctggcattctctccagagaga

SEQ ID NO: 9223103 - DNA, 22 bp, Homo sapiens
cctggccatagggcccaggaaa

SEQ ID NO: 9223104 - DNA, 22 bp, Homo sapiens
cctggccagtttccaggccctg

SEQ ID NO: 9223105 - DNA, 22 bp, Homo sapiens
cctggccagtttccaggccctg

SEQ ID NO: 9223106 - DNA, 22 bp, Homo sapiens
cctggccagggtctgggctgct

SEQ ID NO: 9223107 - DNA, 22 bp, Homo sapiens
cctggccagggtctgggctgct

SEQ ID NO: 9223108 - DNA, 22 bp, Homo sapiens
cctggccagggtctgggctgct

SEQ ID NO: 9223109 - DNA, 22 bp, Homo sapiens
cctggccaggcatggagtcaca

SEQ ID NO: 9223110 - DNA, 22 bp, Homo sapiens
cctggccaggcatggagtcaca

SEQ ID NO: 9223111 - DNA, 22 bp, Homo sapiens
cctggccagctaattgcccatc

SEQ ID NO: 9223112 - DNA, 22 bp, Homo sapiens
cctggccagctaattgcccatc

SEQ ID NO: 9223113 - DNA, 22 bp, Homo sapiens
cctggccagcgccggctgctcg

SEQ ID NO: 9223114 - DNA, 22 bp, Homo sapiens
cctggccaggctccaagtactg

SEQ ID NO: 9223115 - DNA, 22 bp, Homo sapiens
cctggccaggcatggagtcaca

SEQ ID NO: 9223116 - DNA, 22 bp, Homo sapiens
cctggccaggctctcagcactg

SEQ ID NO: 9223117 - DNA, 22 bp, Homo sapiens
tgtcctccagcagcatggtatg

SEQ ID NO: 9223118 - DNA, 22 bp, Homo sapiens
tgtcctccaggacctgcagggc

SEQ ID NO: 9223119 - DNA, 19 bp, Homo sapiens
tgtcccagactccgtgtct

SEQ ID NO: 9223120 - DNA, 22 bp, Homo sapiens
tgtccatggagaagctcagggc

SEQ ID NO: 9223121 - DNA, 22 bp, Homo sapiens
cctggccatagggcccaggaaa

SEQ ID NO: 9223122 - DNA, 22 bp, Homo sapiens
cctggccatttgaacttcagac

SEQ ID NO: 9223123 - DNA, 22 bp, Homo sapiens
cctggccatttgaacttcagac

SEQ ID NO: 9223124 - DNA, 22 bp, Homo sapiens
tgtccagtgattctcatgagcc

SEQ ID NO: 9223125 - DNA, 22 bp, Homo sapiens
cctggcagtcaggggagtcctt

SEQ ID NO: 9223126 - DNA, 22 bp, Homo sapiens
cctggcaggcccctcctggatt

SEQ ID NO: 9223127 - DNA, 21 bp, Homo sapiens
cctggcttcagggtgcactgg

SEQ ID NO: 9223128 - DNA, 20 bp, Homo sapiens
cctggctgcattcaggacgg

SEQ ID NO: 9223129 - DNA, 22 bp, Homo sapiens
cctggctgcattttgctggatg

SEQ ID NO: 9223130 - DNA, 22 bp, Homo sapiens
cctggctgctatagcagcatgt

SEQ ID NO: 9223131 - DNA, 22 bp, Homo sapiens
cctggctgctatagcagcatgt

SEQ ID NO: 9223132 - DNA, 22 bp, Homo sapiens
cctggctgctgtcactgaccat

SEQ ID NO: 9223133 - DNA, 22 bp, Homo sapiens
cctggctgtgcattgccggccc

SEQ ID NO: 9223134 - DNA, 22 bp, Homo sapiens
tgtgctgtcagtatcaagggat

SEQ ID NO: 9223135 - DNA, 22 bp, Homo sapiens
tgtgcttcttgcagctcctgta

SEQ ID NO: 9223136 - DNA, 22 bp, Homo sapiens
tgtgcccagactgcctcagtga

SEQ ID NO: 9223137 - DNA, 22 bp, Homo sapiens
tgtgcccatccctctggagtgt

SEQ ID NO: 9223138 - DNA, 21 bp, Homo sapiens
tgtgccagggatggggagccc

SEQ ID NO: 9223139 - DNA, 22 bp, Homo sapiens
tgtgccaggccctggggaccaa

SEQ ID NO: 9223140 - DNA, 22 bp, Homo sapiens
cctgggagagtctgtggtctcc

SEQ ID NO: 9223141 - DNA, 22 bp, Homo sapiens
cctgggagagtctgtggtctcc

SEQ ID NO: 9223142 - DNA, 22 bp, Homo sapiens
cctgggaagcccatagcagctt

SEQ ID NO: 9223143 - DNA, 22 bp, Homo sapiens
cctgggagagccatctgtggcc

SEQ ID NO: 9223144 - DNA, 22 bp, Homo sapiens
cctgggagccaagcctctgtgt

SEQ ID NO: 9223145 - DNA, 21 bp, Homo sapiens
cctgggagatcagctgccttc

SEQ ID NO: 9223146 - DNA, 21 bp, Homo sapiens
cctgggagatcagctgccttc

SEQ ID NO: 9223147 - DNA, 22 bp, Homo sapiens
cctgggagccgactgactgtgc

SEQ ID NO: 9223148 - DNA, 22 bp, Homo sapiens
tgtgaaggagcatgcagagggg

SEQ ID NO: 9223149 - DNA, 22 bp, Homo sapiens
tgtgaagctggatcctggagct

SEQ ID NO: 9223150 - DNA, 22 bp, Homo sapiens
tgtctttatatatttggaaaat

SEQ ID NO: 9223151 - DNA, 23 bp, Homo sapiens
tgtctttgaatgggctgtagaca

SEQ ID NO: 9223152 - DNA, 22 bp, Homo sapiens
tgtgaggaacaggactagagca

SEQ ID NO: 9223153 - DNA, 22 bp, Homo sapiens
tgtgaggacattggaggactca

SEQ ID NO: 9223154 - DNA, 22 bp, Homo sapiens
cctggctcttcgggagtttgtt

SEQ ID NO: 9223155 - DNA, 19 bp, Homo sapiens
cctggctctgagcccagcc

SEQ ID NO: 9223156 - DNA, 22 bp, Homo sapiens
cctggctcttctgtgtcagccc

SEQ ID NO: 9223157 - DNA, 22 bp, Homo sapiens
cctggctgaacaaagtccctcc

SEQ ID NO: 9223158 - DNA, 22 bp, Homo sapiens
cctggctgaggggccaaggacc

SEQ ID NO: 9223159 - DNA, 23 bp, Homo sapiens
tgtctggggcgccagaagagaga

SEQ ID NO: 9223160 - DNA, 21 bp, Homo sapiens
cctggctgcacagttgctggt

SEQ ID NO: 9223161 - DNA, 21 bp, Homo sapiens
cctggctgcacagttgctggt

SEQ ID NO: 9223162 - DNA, 22 bp, Homo sapiens
tgtctgtattagtcagcattct

SEQ ID NO: 9223163 - DNA, 22 bp, Homo sapiens
tgtctggtgggttgacaggcag

SEQ ID NO: 9223164 - DNA, 21 bp, Homo sapiens
tgtctttaggacctgttaaat

SEQ ID NO: 9223165 - DNA, 22 bp, Homo sapiens
tgtctgtctgtccttctcatta

SEQ ID NO: 9223166 - DNA, 22 bp, Homo sapiens
tgtgtgtcagtcttgtttaggg

SEQ ID NO: 9223167 - DNA, 22 bp, Homo sapiens
tgtgtgtataataatgtctgca

SEQ ID NO: 9223168 - DNA, 22 bp, Homo sapiens
tgtgtgtcagtcttgtttaggg

SEQ ID NO: 9223169 - DNA, 22 bp, Homo sapiens
cctgggcctcacccagctcttg

SEQ ID NO: 9223170 - DNA, 22 bp, Homo sapiens
cctgggcctggcgggtcggctc

SEQ ID NO: 9223171 - DNA, 22 bp, Homo sapiens
cctggggaatagagtcaagggg

SEQ ID NO: 9223172 - DNA, 22 bp, Homo sapiens
cctgggctttggaacagtactt

SEQ ID NO: 9223173 - DNA, 22 bp, Homo sapiens
cctgggctttggaacagtactt

SEQ ID NO: 9223174 - DNA, 22 bp, Homo sapiens
cctgggctttggaacagtactt

SEQ ID NO: 9223175 - DNA, 22 bp, Homo sapiens
cctggggaagtcacttctcttt

SEQ ID NO: 9223176 - DNA, 22 bp, Homo sapiens
cctgggctcaagcgatcttgtc

SEQ ID NO: 9223177 - DNA, 22 bp, Homo sapiens
cctgggctcaagcgatcttgtc

SEQ ID NO: 9223178 - DNA, 22 bp, Homo sapiens
cctgggcttccacgagcagagg

SEQ ID NO: 9223179 - DNA, 22 bp, Homo sapiens
cctgggcttccacgagcagagg

SEQ ID NO: 9223180 - DNA, 22 bp, Homo sapiens
cctgggctttgctggcaaggcc

SEQ ID NO: 9223181 - DNA, 20 bp, Homo sapiens
cctgggctcaaagcatcctc

SEQ ID NO: 9223182 - DNA, 20 bp, Homo sapiens
cctgggctcaaagcatcctc

SEQ ID NO: 9223183 - DNA, 22 bp, Homo sapiens
cctgggccttgacctcgtgggc

SEQ ID NO: 9223184 - DNA, 22 bp, Homo sapiens
cctgggccttgacctcgtgggc

SEQ ID NO: 9223185 - DNA, 22 bp, Homo sapiens
cctggggctcaagatggcgccg

SEQ ID NO: 9223186 - DNA, 22 bp, Homo sapiens
cctgggtccaccctgtgaagta

SEQ ID NO: 9223187 - DNA, 22 bp, Homo sapiens
cctgggtcccagccaggctttg

SEQ ID NO: 9223188 - DNA, 22 bp, Homo sapiens
cctggggacctgcctcagccct

SEQ ID NO: 9223189 - DNA, 22 bp, Homo sapiens
cctggggaatcttgcaggggaa

SEQ ID NO: 9223190 - DNA, 22 bp, Homo sapiens
cctgggtgacccgtgagcgtcc

SEQ ID NO: 9223191 - DNA, 22 bp, Homo sapiens
cctgggtcttggttcatgctct

SEQ ID NO: 9223192 - DNA, 22 bp, Homo sapiens
cctgggtcttcagtctgctggt

SEQ ID NO: 9223193 - DNA, 19 bp, Homo sapiens
cctgggtctgcagcattca

SEQ ID NO: 9223194 - DNA, 22 bp, Homo sapiens
cctgggtctggtcactaagtca

SEQ ID NO: 9223195 - DNA, 22 bp, Homo sapiens
cctgggtctgtattggtaggta

SEQ ID NO: 9223196 - DNA, 22 bp, Homo sapiens
cctgggtcccatcccagagtga

SEQ ID NO: 9223197 - DNA, 22 bp, Homo sapiens
cctgggtccctgagagatgatt

SEQ ID NO: 9223198 - DNA, 22 bp, Homo sapiens
cctgggtcctggcagcctcctg

SEQ ID NO: 9223199 - DNA, 22 bp, Homo sapiens
cctgggtctcctcctgctggct

SEQ ID NO: 9223200 - DNA, 22 bp, Homo sapiens
cctgggtctatagacttcaaga

SEQ ID NO: 9223201 - DNA, 22 bp, Homo sapiens
tgtgctttggttttacaggatg

SEQ ID NO: 9223202 - DNA, 22 bp, Homo sapiens
tgtgcttgtcgtggagccaggc

SEQ ID NO: 9223203 - DNA, 22 bp, Homo sapiens
tgtgctttcaaagttaagtaaa

SEQ ID NO: 9223204 - DNA, 22 bp, Homo sapiens
tgtgctttggttttacaggatg

SEQ ID NO: 9223205 - DNA, 22 bp, Homo sapiens
tgtggcaggaagagcttctgag

SEQ ID NO: 9223206 - DNA, 22 bp, Homo sapiens
tgtggcaggcattctgaggctg

SEQ ID NO: 9223207 - DNA, 22 bp, Homo sapiens
tgtggcagggatactgaggcag

SEQ ID NO: 9223208 - DNA, 17 bp, Homo sapiens
cctgggaggagttatga

SEQ ID NO: 9223209 - DNA, 22 bp, Homo sapiens
cctgggcctcacccagctcttg

SEQ ID NO: 9223210 - DNA, 22 bp, Homo sapiens
cctgggcctcacccagctcttg

SEQ ID NO: 9223211 - DNA, 22 bp, Homo sapiens
cctgggcctatcctagaaccaa

SEQ ID NO: 9223212 - DNA, 22 bp, Homo sapiens
tgtggggctgtggtgttcttct

SEQ ID NO: 9223213 - DNA, 22 bp, Homo sapiens
tgtggggtgtggtccaggcatc

SEQ ID NO: 9223214 - DNA, 22 bp, Homo sapiens
tgtgggggtacacgtacacatg

SEQ ID NO: 9223215 - DNA, 22 bp, Homo sapiens
tgtgtgggtggtaaggaaggcc

SEQ ID NO: 9223216 - DNA, 22 bp, Homo sapiens
cctgggccaggcttgggaatgc

SEQ ID NO: 9223217 - DNA, 21 bp, Homo sapiens
cctgggccaaattccctggac

SEQ ID NO: 9223218 - DNA, 22 bp, Homo sapiens
cctgggcataaatcactccaag

SEQ ID NO: 9223219 - DNA, 18 bp, Homo sapiens
cctctgggttttgttccc

SEQ ID NO: 9223220 - DNA, 22 bp, Homo sapiens
cctctgggttagtttagggagc

SEQ ID NO: 9223221 - DNA, 22 bp, Homo sapiens
cctctggggtgagtgggccact

SEQ ID NO: 9223222 - DNA, 22 bp, Homo sapiens
cctctgggggtcctcagagtct

SEQ ID NO: 9223223 - DNA, 22 bp, Homo sapiens
cctctggggtctagcaatagca

SEQ ID NO: 9223224 - DNA, 22 bp, Homo sapiens
cctctgggtatctgtggaagta

SEQ ID NO: 9223225 - DNA, 22 bp, Homo sapiens
cctctgggtgacagactcttgg

SEQ ID NO: 9223226 - DNA, 22 bp, Homo sapiens
cctctgggtgggaggccgggcg

SEQ ID NO: 9223227 - DNA, 22 bp, Homo sapiens
cctctgggtgggaggccgggcg

SEQ ID NO: 9223228 - DNA, 22 bp, Homo sapiens
cctctggggcatcagacaaagg

SEQ ID NO: 9223229 - DNA, 22 bp, Homo sapiens
cctctgggggcttccttaccct

SEQ ID NO: 9223230 - DNA, 22 bp, Homo sapiens
cctctgggggcttccttaccct

SEQ ID NO: 9223231 - DNA, 22 bp, Homo sapiens
cctctgggctgcctgcacgggt

SEQ ID NO: 9223232 - DNA, 22 bp, Homo sapiens
cctctgggctggaaaattaatg

SEQ ID NO: 9223233 - DNA, 22 bp, Homo sapiens
cctctggctgtaccactggcac

SEQ ID NO: 9223234 - DNA, 22 bp, Homo sapiens
cctctggctcacagcaccaact

SEQ ID NO: 9223235 - DNA, 22 bp, Homo sapiens
cctctgagaccagctctgcacc

SEQ ID NO: 9223236 - DNA, 22 bp, Homo sapiens
cctctctgtgtggcctctccat

SEQ ID NO: 9223237 - DNA, 22 bp, Homo sapiens
cctctcttggatgtggatgggt

SEQ ID NO: 9223238 - DNA, 22 bp, Homo sapiens
cctctctcttgtagtccctgcc

SEQ ID NO: 9223239 - DNA, 22 bp, Homo sapiens
tggctgccgactggctcttggc

SEQ ID NO: 9223240 - DNA, 22 bp, Homo sapiens
tggctgcctgatcgagcaggtg

SEQ ID NO: 9223241 - DNA, 22 bp, Homo sapiens
cctctaggatgtggctggagga

SEQ ID NO: 9223242 - DNA, 22 bp, Homo sapiens
tggcccctgaggagcatcagcc

SEQ ID NO: 9223243 - DNA, 22 bp, Homo sapiens
tggcccctgaggagcgtcagcc

SEQ ID NO: 9223244 - DNA, 22 bp, Homo sapiens
tggcccctgaggagcgtcagcc

SEQ ID NO: 9223245 - DNA, 22 bp, Homo sapiens
tggcccctgaggagcatcagcc

SEQ ID NO: 9223246 - DNA, 22 bp, Homo sapiens
tggcccctggcacacggaggat

SEQ ID NO: 9223247 - DNA, 22 bp, Homo sapiens
tggcccctggcacacggaggat

SEQ ID NO: 9223248 - DNA, 18 bp, Homo sapiens
tggccccttatcagtcct

SEQ ID NO: 9223249 - DNA, 18 bp, Homo sapiens
tggccccttatcagtcct

SEQ ID NO: 9223250 - DNA, 22 bp, Homo sapiens
tggccctgctatgatcctgcaa

SEQ ID NO: 9223251 - DNA, 22 bp, Homo sapiens
tggccctgctatgatcctgcaa

SEQ ID NO: 9223252 - DNA, 22 bp, Homo sapiens
tggccctgccgccacgacgtct

SEQ ID NO: 9223253 - DNA, 22 bp, Homo sapiens
tggccctgctggacacgcctgc

SEQ ID NO: 9223254 - DNA, 22 bp, Homo sapiens
tggccctgctggacacgcctgc

SEQ ID NO: 9223255 - DNA, 22 bp, Homo sapiens
tggcccagcagttctgccccag

SEQ ID NO: 9223256 - DNA, 22 bp, Homo sapiens
tggcccagtgcttatgctctga

SEQ ID NO: 9223257 - DNA, 20 bp, Homo sapiens
tggcccagtggggcagggtg

SEQ ID NO: 9223258 - DNA, 20 bp, Homo sapiens
tggcccagtggggcagggtg

SEQ ID NO: 9223259 - DNA, 22 bp, Homo sapiens
tggctcagtttagcagctcagt

SEQ ID NO: 9223260 - DNA, 22 bp, Homo sapiens
tggctcagtttctgcccagctg

SEQ ID NO: 9223261 - DNA, 22 bp, Homo sapiens
tggctcagtttgggggattgaa

SEQ ID NO: 9223262 - DNA, 21 bp, Homo sapiens
tggctcagttgctgggcacag

SEQ ID NO: 9223263 - DNA, 22 bp, Homo sapiens
tggccctgctgggtcagagctg

SEQ ID NO: 9223264 - DNA, 22 bp, Homo sapiens
tggccctgctggccaaaggcta

SEQ ID NO: 9223265 - DNA, 22 bp, Homo sapiens
tggccctgctgtatcatctgct

SEQ ID NO: 9223266 - DNA, 22 bp, Homo sapiens
cctcctctgggaagattcagag

SEQ ID NO: 9223267 - DNA, 22 bp, Homo sapiens
cctcctggtccagcatctcttt

SEQ ID NO: 9223268 - DNA, 22 bp, Homo sapiens
cctcggctgggccttggccact

SEQ ID NO: 9223269 - DNA, 22 bp, Homo sapiens
cctccctgctcctcaactggca

SEQ ID NO: 9223270 - DNA, 22 bp, Homo sapiens
cctccctggccagagcagcagc

SEQ ID NO: 9223271 - DNA, 22 bp, Homo sapiens
cctccctgtctacctgttgtgg

SEQ ID NO: 9223272 - DNA, 22 bp, Homo sapiens
cctccctggtggctctggtcta

SEQ ID NO: 9223273 - DNA, 22 bp, Homo sapiens
cctccagccttcctgaagagcc

SEQ ID NO: 9223274 - DNA, 22 bp, Homo sapiens
cctccaagtttgactcaggaca

SEQ ID NO: 9223275 - DNA, 22 bp, Homo sapiens
cctccaagtttgactcaggaca

SEQ ID NO: 9223276 - DNA, 22 bp, Homo sapiens
cctccactctggcctctcaggt

SEQ ID NO: 9223277 - DNA, 22 bp, Homo sapiens
cctccagcattactggcccatg

SEQ ID NO: 9223278 - DNA, 22 bp, Homo sapiens
cctccagcattactggcccatg

SEQ ID NO: 9223279 - DNA, 22 bp, Homo sapiens
ccctccagctcaaagcaaccgg

SEQ ID NO: 9223280 - DNA, 22 bp, Homo sapiens
ccctccagccatggacccaggt

SEQ ID NO: 9223281 - DNA, 22 bp, Homo sapiens
ccctccagccatggacccaggt

SEQ ID NO: 9223282 - DNA, 22 bp, Homo sapiens
ccctggactgttcagggcctga

SEQ ID NO: 9223283 - DNA, 22 bp, Homo sapiens
ccctccagagcctggacattct

SEQ ID NO: 9223284 - DNA, 22 bp, Homo sapiens
ccctcaggtgaaaggaaaaatt

SEQ ID NO: 9223285 - DNA, 22 bp, Homo sapiens
ccctccagagcttgacctgctg

SEQ ID NO: 9223286 - DNA, 22 bp, Homo sapiens
ccctccagagcttgacctgctg

SEQ ID NO: 9223287 - DNA, 22 bp, Homo sapiens
ccctccagagcttgacctgctg

SEQ ID NO: 9223288 - DNA, 23 bp, Homo sapiens
tggagctgacagtcagagggagg

SEQ ID NO: 9223289 - DNA, 22 bp, Homo sapiens
tggagctgactcacaccagcta

SEQ ID NO: 9223290 - DNA, 22 bp, Homo sapiens
tggagctgagaagtggagctct

SEQ ID NO: 9223291 - DNA, 22 bp, Homo sapiens
tggagctgagagccaggctggc

SEQ ID NO: 9223292 - DNA, 19 bp, Homo sapiens
ccctggagaataccctgga

SEQ ID NO: 9223293 - DNA, 22 bp, Homo sapiens
ccctggagaggactcacccctg

SEQ ID NO: 9223294 - DNA, 20 bp, Homo sapiens
ccctggagagaagctccacg

SEQ ID NO: 9223295 - DNA, 22 bp, Homo sapiens
ccctggagatcgggagaggaag

SEQ ID NO: 9223296 - DNA, 18 bp, Homo sapiens
tggatctttatgaggctg

SEQ ID NO: 9223297 - DNA, 21 bp, Homo sapiens
tggatctgtgatctggggcac

SEQ ID NO: 9223298 - DNA, 22 bp, Homo sapiens
tggatctggttccctgagcctt

SEQ ID NO: 9223299 - DNA, 22 bp, Homo sapiens
tggatctgactggcttttcttc

SEQ ID NO: 9223300 - DNA, 22 bp, Homo sapiens
tggcaactcctgactctactca

SEQ ID NO: 9223301 - DNA, 22 bp, Homo sapiens
tggcaaggaagagcctggtgca

SEQ ID NO: 9223302 - DNA, 22 bp, Homo sapiens
ccctggcctccaggcagtcctg

SEQ ID NO: 9223303 - DNA, 20 bp, Homo sapiens
ccctggcctgtttcatgccc

SEQ ID NO: 9223304 - DNA, 22 bp, Homo sapiens
tggagctgagcacctccagggc

SEQ ID NO: 9223305 - DNA, 22 bp, Homo sapiens
tggagctgagcacctccagggc

SEQ ID NO: 9223306 - DNA, 17 bp, Homo sapiens
ccctggctctaggtgga

SEQ ID NO: 9223307 - DNA, 23 bp, Homo sapiens
ccctggccttggggcacaggctg

SEQ ID NO: 9223308 - DNA, 23 bp, Homo sapiens
ccctggccttggggcacaggctg

SEQ ID NO: 9223309 - DNA, 22 bp, Homo sapiens
tggcagctggagggcaatggcc

SEQ ID NO: 9223310 - DNA, 22 bp, Homo sapiens
tggcacagtatgggattaaaga

SEQ ID NO: 9223311 - DNA, 22 bp, Homo sapiens
tggcacagggcttggtcgctca

SEQ ID NO: 9223312 - DNA, 22 bp, Homo sapiens
tggcacagggcttggtcgctca

SEQ ID NO: 9223313 - DNA, 22 bp, Homo sapiens
tggcacagtcctgggtgcctgc

SEQ ID NO: 9223314 - DNA, 22 bp, Homo sapiens
tggcacagtcctgggtgcctgc

SEQ ID NO: 9223315 - DNA, 22 bp, Homo sapiens
tggcacaggcggtaagggtgtg

SEQ ID NO: 9223316 - DNA, 22 bp, Homo sapiens
tggcacaggcggtaagggtgtg

SEQ ID NO: 9223317 - DNA, 22 bp, Homo sapiens
tggcacaggatctcagcggcca

SEQ ID NO: 9223318 - DNA, 22 bp, Homo sapiens
tggcacaggatctcagcggcca

SEQ ID NO: 9223319 - DNA, 22 bp, Homo sapiens
tggcacaggagcactgccctgg

SEQ ID NO: 9223320 - DNA, 22 bp, Homo sapiens
tggcacaggagcactgccctgg

SEQ ID NO: 9223321 - DNA, 22 bp, Homo sapiens
tggcacaggaatttagatgcag

SEQ ID NO: 9223322 - DNA, 22 bp, Homo sapiens
tggcaaggccacaggtgcagtt

SEQ ID NO: 9223323 - DNA, 22 bp, Homo sapiens
tggcaaggccacaggtgcagtt

SEQ ID NO: 9223324 - DNA, 22 bp, Homo sapiens
tggcaaggctgtgggggcagag

SEQ ID NO: 9223325 - DNA, 22 bp, Homo sapiens
tggcacagcttgtcataaactc

SEQ ID NO: 9223326 - DNA, 22 bp, Homo sapiens
cctaggccttactttcctgtgc

SEQ ID NO: 9223327 - DNA, 22 bp, Homo sapiens
cctaggctaattcagtccagta

SEQ ID NO: 9223328 - DNA, 22 bp, Homo sapiens
cctaggcttgttttcatcagct

SEQ ID NO: 9223329 - DNA, 22 bp, Homo sapiens
cctagtcttccgcgtccccacc

SEQ ID NO: 9223330 - DNA, 22 bp, Homo sapiens
tggccaggcaggtagaacggcc

SEQ ID NO: 9223331 - DNA, 22 bp, Homo sapiens
tggccaggcaggtagaacggcc

SEQ ID NO: 9223332 - DNA, 22 bp, Homo sapiens
tggccaggcaggtagaacggcc

SEQ ID NO: 9223333 - DNA, 22 bp, Homo sapiens
cctaggcccattaattcccctt

SEQ ID NO: 9223334 - DNA, 22 bp, Homo sapiens
cctaggccctcaaagagcataa

SEQ ID NO: 9223335 - DNA, 23 bp, Homo sapiens
tggccaggcataaaggtgggtgg

SEQ ID NO: 9223336 - DNA, 23 bp, Homo sapiens
tggccaggcataaaggtgggtgg

SEQ ID NO: 9223337 - DNA, 22 bp, Homo sapiens
tggcagcttcctgctcatagga

SEQ ID NO: 9223338 - DNA, 22 bp, Homo sapiens
tggcagctgtgtccaggtagaa

SEQ ID NO: 9223339 - DNA, 22 bp, Homo sapiens
tggcagctggtacagtgggtct

SEQ ID NO: 9223340 - DNA, 23 bp, Homo sapiens
tggcagctgtgtaagagaaagca

SEQ ID NO: 9223341 - DNA, 22 bp, Homo sapiens
tggcagctgtctgtggggtctc

SEQ ID NO: 9223342 - DNA, 22 bp, Homo sapiens
tggccaggaggctgcttctgac

SEQ ID NO: 9223343 - DNA, 21 bp, Homo sapiens
tggccagctggagtctccaca

SEQ ID NO: 9223344 - DNA, 21 bp, Homo sapiens
tggccagctggagtctccaca

SEQ ID NO: 9223345 - DNA, 22 bp, Homo sapiens
cccaggctcttatgtgacttgc

SEQ ID NO: 9223346 - DNA, 21 bp, Homo sapiens
cccaggctgaattaaaaatat

SEQ ID NO: 9223347 - DNA, 22 bp, Homo sapiens
cccaggctcctgactcattcta

SEQ ID NO: 9223348 - DNA, 22 bp, Homo sapiens
cccaggctcctgactcattcta

SEQ ID NO: 9223349 - DNA, 22 bp, Homo sapiens
cccaggctcctgctgtgttgac

SEQ ID NO: 9223350 - DNA, 22 bp, Homo sapiens
cccaggctcctgctgtgttgac

SEQ ID NO: 9223351 - DNA, 22 bp, Homo sapiens
tgctccaggtgtgcctctcatg

SEQ ID NO: 9223352 - DNA, 22 bp, Homo sapiens
tgctccatctagagctctgcag

SEQ ID NO: 9223353 - DNA, 22 bp, Homo sapiens
cccaggctcctagaggcccaga

SEQ ID NO: 9223354 - DNA, 22 bp, Homo sapiens
cccaggctcctagaggcccaga

SEQ ID NO: 9223355 - DNA, 22 bp, Homo sapiens
cccaggctcctactgtattctg

SEQ ID NO: 9223356 - DNA, 22 bp, Homo sapiens
tgcctgggccttcccacctctg

SEQ ID NO: 9223357 - DNA, 22 bp, Homo sapiens
tgcctgggatctgtgccctttg

SEQ ID NO: 9223358 - DNA, 22 bp, Homo sapiens
tgcctgggagtgaccaagactc

SEQ ID NO: 9223359 - DNA, 22 bp, Homo sapiens
tgcctgggcctctgaggaaggc

SEQ ID NO: 9223360 - DNA, 22 bp, Homo sapiens
tgcctgggccttcccacctctg

SEQ ID NO: 9223361 - DNA, 22 bp, Homo sapiens
tgcctgggacatgctgtggact

SEQ ID NO: 9223362 - DNA, 22 bp, Homo sapiens
tgcctgggacatgctgtggact

SEQ ID NO: 9223363 - DNA, 22 bp, Homo sapiens
tgcctgggagtgaccaagactc

SEQ ID NO: 9223364 - DNA, 22 bp, Homo sapiens
tgcctgggactgtactaaattt

SEQ ID NO: 9223365 - DNA, 22 bp, Homo sapiens
tgcctgctcttgagacttacaa

SEQ ID NO: 9223366 - DNA, 22 bp, Homo sapiens
tgctgcagaaattctgtgagga

SEQ ID NO: 9223367 - DNA, 20 bp, Homo sapiens
tgctgcagacagggccattg

SEQ ID NO: 9223368 - DNA, 22 bp, Homo sapiens
cccagggaggtagcaggagaaa

SEQ ID NO: 9223369 - DNA, 22 bp, Homo sapiens
cccagggaggtagcaggagaaa

SEQ ID NO: 9223370 - DNA, 22 bp, Homo sapiens
cccagggatgtggcagatgtta

SEQ ID NO: 9223371 - DNA, 20 bp, Homo sapiens
cccagggacctgagctccat

SEQ ID NO: 9223372 - DNA, 22 bp, Homo sapiens
cccctctccctcacttatcaat

SEQ ID NO: 9223373 - DNA, 22 bp, Homo sapiens
cccctcctggccacactgtcag

SEQ ID NO: 9223374 - DNA, 22 bp, Homo sapiens
cccctccctgacctggttgggc

SEQ ID NO: 9223375 - DNA, 22 bp, Homo sapiens
cccctccctgacctggttgggc

SEQ ID NO: 9223376 - DNA, 21 bp, Homo sapiens
ccctcaggaaacagaatgcac

SEQ ID NO: 9223377 - DNA, 21 bp, Homo sapiens
ccctcaggaaacagaatgcac

SEQ ID NO: 9223378 - DNA, 21 bp, Homo sapiens
ccctcaggaaacagaatgcac

SEQ ID NO: 9223379 - DNA, 22 bp, Homo sapiens
ccctcaggagatgtcagctgga

SEQ ID NO: 9223380 - DNA, 22 bp, Homo sapiens
ccctcagcttctccctgcagct

SEQ ID NO: 9223381 - DNA, 22 bp, Homo sapiens
ccctcagcttctccctgcagct

SEQ ID NO: 9223382 - DNA, 22 bp, Homo sapiens
ccctcaggatgcagtggaagtg

SEQ ID NO: 9223383 - DNA, 22 bp, Homo sapiens
ccctcagggaccactgacttca

SEQ ID NO: 9223384 - DNA, 19 bp, Homo sapiens
ccctcaggtctgagcagtc

SEQ ID NO: 9223385 - DNA, 22 bp, Homo sapiens
ccccagggaagctttgcttact

SEQ ID NO: 9223386 - DNA, 22 bp, Homo sapiens
ccccaggcctgttggatggcgc

SEQ ID NO: 9223387 - DNA, 22 bp, Homo sapiens
cccccacctgaggacagtctta

SEQ ID NO: 9223388 - DNA, 22 bp, Homo sapiens
cccccacctgaggacagtctta

SEQ ID NO: 9223389 - DNA, 22 bp, Homo sapiens
cccccaccgtgttcctgctcgg

SEQ ID NO: 9223390 - DNA, 22 bp, Homo sapiens
cccccaccgtgttcctgctcgg

SEQ ID NO: 9223391 - DNA, 21 bp, Homo sapiens
cccctcatacactctccttgc

SEQ ID NO: 9223392 - DNA, 22 bp, Homo sapiens
ccccgccctgcgcggggataac

SEQ ID NO: 9223393 - DNA, 22 bp, Homo sapiens
cccccaggctctgacacaggag

SEQ ID NO: 9223394 - DNA, 22 bp, Homo sapiens
cccccaggctctgacacaggag

SEQ ID NO: 9223395 - DNA, 22 bp, Homo sapiens
cccccaggggctccgcctcgtg

SEQ ID NO: 9223396 - DNA, 22 bp, Homo sapiens
tgctggagatcattaatgttca

SEQ ID NO: 9223397 - DNA, 22 bp, Homo sapiens
ccccagccttccatgggaattg

SEQ ID NO: 9223398 - DNA, 22 bp, Homo sapiens
tgctgcaggaacttaagaagct

SEQ ID NO: 9223399 - DNA, 22 bp, Homo sapiens
tgctgcagctaaggtgaggtgc

SEQ ID NO: 9223400 - DNA, 22 bp, Homo sapiens
ccccacctgtgcgtctgccgca

SEQ ID NO: 9223401 - DNA, 22 bp, Homo sapiens
ccccacctgtgcgtctgccgca

SEQ ID NO: 9223402 - DNA, 22 bp, Homo sapiens
tgctgcagagaatgttttggcc

SEQ ID NO: 9223403 - DNA, 22 bp, Homo sapiens
ccccagcatatcatggtttcgt

SEQ ID NO: 9223404 - DNA, 22 bp, Homo sapiens
ccccagccagcaggacctctga

SEQ ID NO: 9223405 - DNA, 22 bp, Homo sapiens
ccccagccagcaggacctctga

SEQ ID NO: 9223406 - DNA, 22 bp, Homo sapiens
ccccagccagcttgtagtagaa

SEQ ID NO: 9223407 - DNA, 22 bp, Homo sapiens
ccccagcagactcagggcaggt

SEQ ID NO: 9223408 - DNA, 22 bp, Homo sapiens
ccccagcagcacctggggcagt

SEQ ID NO: 9223409 - DNA, 22 bp, Homo sapiens
cccagctcttcctgggagctaa

SEQ ID NO: 9223410 - DNA, 22 bp, Homo sapiens
cccagctcttcaagtcaccccc

SEQ ID NO: 9223411 - DNA, 22 bp, Homo sapiens
cccagctgatttttgcagagat

SEQ ID NO: 9223412 - DNA, 22 bp, Homo sapiens
cccagctgatttttgcagagat

SEQ ID NO: 9223413 - DNA, 23 bp, Homo sapiens
cccagctgcagacaagggagggt

SEQ ID NO: 9223414 - DNA, 17 bp, Homo sapiens
cccagctggcagtgccg

SEQ ID NO: 9223415 - DNA, 23 bp, Homo sapiens
cccagctggaagttagaggacca

SEQ ID NO: 9223416 - DNA, 17 bp, Homo sapiens
cccagctgcgtctgagg

SEQ ID NO: 9223417 - DNA, 22 bp, Homo sapiens
cccagctggccaggtggctttg

SEQ ID NO: 9223418 - DNA, 18 bp, Homo sapiens
cccagctggtgggtcagt

SEQ ID NO: 9223419 - DNA, 18 bp, Homo sapiens
cccagctggtgggtcagt

SEQ ID NO: 9223420 - DNA, 22 bp, Homo sapiens
cccagctgtaacgggtctgcac

SEQ ID NO: 9223421 - DNA, 22 bp, Homo sapiens
cccaggaaagtgaatctaattg

SEQ ID NO: 9223422 - DNA, 22 bp, Homo sapiens
cccaggaaacccgaaggcgacc

SEQ ID NO: 9223423 - DNA, 22 bp, Homo sapiens
cccagctgtggcagaggccggg

SEQ ID NO: 9223424 - DNA, 22 bp, Homo sapiens
tgcatgtttgtgtctgagaact

SEQ ID NO: 9223425 - DNA, 22 bp, Homo sapiens
cccagcctgtgacagccgtcct

SEQ ID NO: 9223426 - DNA, 22 bp, Homo sapiens
cccagcctggtgcactgtgggg

SEQ ID NO: 9223427 - DNA, 22 bp, Homo sapiens
cccagcctttgcttcctggttc

SEQ ID NO: 9223428 - DNA, 22 bp, Homo sapiens
cccagccttccaccctggacta

SEQ ID NO: 9223429 - DNA, 22 bp, Homo sapiens
cccagcctactctgccatagca

SEQ ID NO: 9223430 - DNA, 22 bp, Homo sapiens
cccagcgagtttgccggtgaac

SEQ ID NO: 9223431 - DNA, 22 bp, Homo sapiens
cccagctcaagcagagagctaa

SEQ ID NO: 9223432 - DNA, 22 bp, Homo sapiens
tgcagggagggcccagcaatct

SEQ ID NO: 9223433 - DNA, 22 bp, Homo sapiens
tgccaggcctcaggagtctcca

SEQ ID NO: 9223434 - DNA, 22 bp, Homo sapiens
tgccaggcctcaggagtctcca

SEQ ID NO: 9223435 - DNA, 22 bp, Homo sapiens
tgccaggcctcaggagtctcca

SEQ ID NO: 9223436 - DNA, 22 bp, Homo sapiens
tgccaggcctcaggagtctcca

SEQ ID NO: 9223437 - DNA, 22 bp, Homo sapiens
cccaggaggtgtagctgcgtgg

SEQ ID NO: 9223438 - DNA, 22 bp, Homo sapiens
cccaggaggtggaggttgcagt

SEQ ID NO: 9223439 - DNA, 22 bp, Homo sapiens
cccaggaggtggaggttgcagc

SEQ ID NO: 9223440 - DNA, 22 bp, Homo sapiens
cccaggaggtggaggctgcagt

SEQ ID NO: 9223441 - DNA, 22 bp, Homo sapiens
tgccacagagcaattctgctga

SEQ ID NO: 9223442 - DNA, 22 bp, Homo sapiens
cccaggagggtggcctctgccc

SEQ ID NO: 9223443 - DNA, 22 bp, Homo sapiens
tgccacacagctgtatgaggga

SEQ ID NO: 9223444 - DNA, 22 bp, Homo sapiens
tgccacacattgtcaggttagt

SEQ ID NO: 9223445 - DNA, 22 bp, Homo sapiens
tgccacacagtctggtagaata

SEQ ID NO: 9223446 - DNA, 22 bp, Homo sapiens
tgccacactcacttctgtggac

SEQ ID NO: 9223447 - DNA, 22 bp, Homo sapiens
tgccacaccaacatctttcagc

SEQ ID NO: 9223448 - DNA, 22 bp, Homo sapiens
tgccacactcccctgctgcagt

SEQ ID NO: 9223449 - DNA, 22 bp, Homo sapiens
tgccacagacaggacagaacag

SEQ ID NO: 9223450 - DNA, 22 bp, Homo sapiens
tgccacagagactttcattgta

SEQ ID NO: 9223451 - DNA, 22 bp, Homo sapiens
tgccaagggtatgggcaagata

SEQ ID NO: 9223452 - DNA, 22 bp, Homo sapiens
tgccaagtggagctcaggaatc

SEQ ID NO: 9223453 - DNA, 22 bp, Homo sapiens
tgccaagggtatgggcaagata

SEQ ID NO: 9223454 - DNA, 22 bp, Homo sapiens
tgccaagtttctctcagggact

SEQ ID NO: 9223455 - DNA, 22 bp, Homo sapiens
tgccaagaggtccaggtgggaa

SEQ ID NO: 9223456 - DNA, 22 bp, Homo sapiens
tgccaggcgtggtggtgcgcac

SEQ ID NO: 9223457 - DNA, 22 bp, Homo sapiens
cccaggatgtcgaggctgcagt

SEQ ID NO: 9223458 - DNA, 22 bp, Homo sapiens
cccaggatgtcgaggctgcagt

SEQ ID NO: 9223459 - DNA, 22 bp, Homo sapiens
tgccaggcgattgctatcagca

SEQ ID NO: 9223460 - DNA, 22 bp, Homo sapiens
tgccaggcgattgctatcagca

SEQ ID NO: 9223461 - DNA, 21 bp, Homo sapiens
tgccaggcctgagctggggtc

SEQ ID NO: 9223462 - DNA, 21 bp, Homo sapiens
tgccaggcctgagctggggtc

SEQ ID NO: 9223463 - DNA, 21 bp, Homo sapiens
tgccaggcctgagctggggtc

SEQ ID NO: 9223464 - DNA, 22 bp, Homo sapiens
cccaggcacaccccgaacggaa

SEQ ID NO: 9223465 - DNA, 22 bp, Homo sapiens
cccaggatgtcgaggctgcagt

SEQ ID NO: 9223466 - DNA, 22 bp, Homo sapiens
cccaggcacactgaagtgacat

SEQ ID NO: 9223467 - DNA, 22 bp, Homo sapiens
cccaggcacatccactctgtga

SEQ ID NO: 9223468 - DNA, 22 bp, Homo sapiens
cccaggcacatccactctgtga

SEQ ID NO: 9223469 - DNA, 22 bp, Homo sapiens
cccaggcagagagctggtgagc

SEQ ID NO: 9223470 - DNA, 22 bp, Homo sapiens
cccaggcactcttggtcatttt

SEQ ID NO: 9223471 - DNA, 22 bp, Homo sapiens
cccaggcagtgctgatccctca

SEQ ID NO: 9223472 - DNA, 22 bp, Homo sapiens
cccaggcagtagaaagaagagg

SEQ ID NO: 9223473 - DNA, 22 bp, Homo sapiens
cccaggcagtgctgatccctca

SEQ ID NO: 9223474 - DNA, 22 bp, Homo sapiens
cccaggcagggacgtgctctgg

SEQ ID NO: 9223475 - DNA, 22 bp, Homo sapiens
cccaggcagggacgtgctctgg

SEQ ID NO: 9223476 - DNA, 22 bp, Homo sapiens
cccaggcagccccagaagcttg

SEQ ID NO: 9223477 - DNA, 22 bp, Homo sapiens
cccaggcagcggggtctccttg

SEQ ID NO: 9223478 - DNA, 22 bp, Homo sapiens
cccaggcagcggggtctccttg

SEQ ID NO: 9223479 - DNA, 22 bp, Homo sapiens
cccaggcagccccagaagcttg

SEQ ID NO: 9223480 - DNA, 22 bp, Homo sapiens
ctggccaggcggcccctgcatg

SEQ ID NO: 9223481 - DNA, 22 bp, Homo sapiens
ctggccagtgcctgtgggcccc

SEQ ID NO: 9223482 - DNA, 22 bp, Homo sapiens
ctggccaggcggcccctgcatg

SEQ ID NO: 9223483 - DNA, 22 bp, Homo sapiens
ctggccaccaagagcttgctca

SEQ ID NO: 9223484 - DNA, 23 bp, Homo sapiens
ctggccaccatctttctggcttc

SEQ ID NO: 9223485 - DNA, 22 bp, Homo sapiens
ctggccacaactagcccaggac

SEQ ID NO: 9223486 - DNA, 22 bp, Homo sapiens
ctggccacatgtgtgctgagca

SEQ ID NO: 9223487 - DNA, 22 bp, Homo sapiens
ctggccacatgtgtgctgagca

SEQ ID NO: 9223488 - DNA, 21 bp, Homo sapiens
ctggcattatgatagcgtcct

SEQ ID NO: 9223489 - DNA, 18 bp, Homo sapiens
ctggcattcttccctgga

SEQ ID NO: 9223490 - DNA, 22 bp, Homo sapiens
ctggcagggctggtattcaaaa

SEQ ID NO: 9223491 - DNA, 22 bp, Homo sapiens
ctggcagggctctttgggtgct

SEQ ID NO: 9223492 - DNA, 22 bp, Homo sapiens
ctggcagggctctttgggtgct

SEQ ID NO: 9223493 - DNA, 22 bp, Homo sapiens
ctggcagcattaacagagagca

SEQ ID NO: 9223494 - DNA, 22 bp, Homo sapiens
ctggcagcaggtcacacgcaga

SEQ ID NO: 9223495 - DNA, 22 bp, Homo sapiens
ctggcagcatggagcctgtgct

SEQ ID NO: 9223496 - DNA, 22 bp, Homo sapiens
ctggcagcattaacagagagca

SEQ ID NO: 9223497 - DNA, 22 bp, Homo sapiens
ctggcagtgagctggccactca

SEQ ID NO: 9223498 - DNA, 22 bp, Homo sapiens
ctggcagtgacattgcaggtgc

SEQ ID NO: 9223499 - DNA, 22 bp, Homo sapiens
ctggcagtctgcctcttcactg

SEQ ID NO: 9223500 - DNA, 22 bp, Homo sapiens
ctggcagtttgccaggagctcg

SEQ ID NO: 9223501 - DNA, 22 bp, Homo sapiens
ctggcatgaaatggcatctcat

SEQ ID NO: 9223502 - DNA, 22 bp, Homo sapiens
ctggcacattgtaatatataca

SEQ ID NO: 9223503 - DNA, 22 bp, Homo sapiens
ctggcacatcactcctagttta

SEQ ID NO: 9223504 - DNA, 22 bp, Homo sapiens
ctggcacatgtgagccacatca

SEQ ID NO: 9223505 - DNA, 22 bp, Homo sapiens
ctggcactgtgtctgcggaggg

SEQ ID NO: 9223506 - DNA, 22 bp, Homo sapiens
ctggcacttggcacccatgaaa

SEQ ID NO: 9223507 - DNA, 22 bp, Homo sapiens
ctggcactggatcgtgcatatc

SEQ ID NO: 9223508 - DNA, 22 bp, Homo sapiens
ctggcactcataggccagttca

SEQ ID NO: 9223509 - DNA, 22 bp, Homo sapiens
ctggcactgagtggcttatgac

SEQ ID NO: 9223510 - DNA, 22 bp, Homo sapiens
ctggcacatgctccctgagtgg

SEQ ID NO: 9223511 - DNA, 22 bp, Homo sapiens
ctggcacatgtgagccacatca

SEQ ID NO: 9223512 - DNA, 22 bp, Homo sapiens
ctggcacatagtcagcactcaa

SEQ ID NO: 9223513 - DNA, 22 bp, Homo sapiens
ctggcacatagtcagcactcaa

SEQ ID NO: 9223514 - DNA, 22 bp, Homo sapiens
ctggcacatagtaggtgcacag

SEQ ID NO: 9223515 - DNA, 22 bp, Homo sapiens
ctggcacatagtaggtgcacag

SEQ ID NO: 9223516 - DNA, 22 bp, Homo sapiens
ctggcagattggggtcagcagt

SEQ ID NO: 9223517 - DNA, 22 bp, Homo sapiens
ctggcagcagcttctggatcga

SEQ ID NO: 9223518 - DNA, 22 bp, Homo sapiens
ctggcagatatttgcagacatg

SEQ ID NO: 9223519 - DNA, 22 bp, Homo sapiens
ctggcagatagtaagtgatcaa

SEQ ID NO: 9223520 - DNA, 22 bp, Homo sapiens
ctggcagatagccacgcctgtc

SEQ ID NO: 9223521 - DNA, 22 bp, Homo sapiens
ctggcaagaaatatatatctta

SEQ ID NO: 9223522 - DNA, 22 bp, Homo sapiens
ctggatctgaacatcggtatca

SEQ ID NO: 9223523 - DNA, 22 bp, Homo sapiens
ctggatctaaaggtggatgtag

SEQ ID NO: 9223524 - DNA, 22 bp, Homo sapiens
ctggatctgtcttttggatccc

SEQ ID NO: 9223525 - DNA, 22 bp, Homo sapiens
ctggatctgtttgtgcttgtgg

SEQ ID NO: 9223526 - DNA, 22 bp, Homo sapiens
ctggatctgtcccctttttgtt

SEQ ID NO: 9223527 - DNA, 21 bp, Homo sapiens
ctggatctgtcatcgagtttt

SEQ ID NO: 9223528 - DNA, 22 bp, Homo sapiens
ctggatccatcgggtcccgagt

SEQ ID NO: 9223529 - DNA, 22 bp, Homo sapiens
ctggatctgtttgtgcttgtgg

SEQ ID NO: 9223530 - DNA, 22 bp, Homo sapiens
ctggatcttgctgcattgagaa

SEQ ID NO: 9223531 - DNA, 22 bp, Homo sapiens
ctggatcttcagagatcaccag

SEQ ID NO: 9223532 - DNA, 22 bp, Homo sapiens
ctggatgctgagaggtaccaag

SEQ ID NO: 9223533 - DNA, 22 bp, Homo sapiens
ctggctccctctccctgagtca

SEQ ID NO: 9223534 - DNA, 22 bp, Homo sapiens
ctggctccaggtcatgcactca

SEQ ID NO: 9223535 - DNA, 22 bp, Homo sapiens
ctggctccaggtcatgcactca

SEQ ID NO: 9223536 - DNA, 22 bp, Homo sapiens
ctggctccctggacatggggcc

SEQ ID NO: 9223537 - DNA, 22 bp, Homo sapiens
ctggcctggcgcagtggctcac

SEQ ID NO: 9223538 - DNA, 22 bp, Homo sapiens
ctggcctggcaggggacctcta

SEQ ID NO: 9223539 - DNA, 22 bp, Homo sapiens
ctggcctggcaggggacctcta

SEQ ID NO: 9223540 - DNA, 22 bp, Homo sapiens
ctggcctggggcctcagctgct

SEQ ID NO: 9223541 - DNA, 22 bp, Homo sapiens
ctggctctgtggcttccttcat

SEQ ID NO: 9223542 - DNA, 23 bp, Homo sapiens
ctggctctgtaggtggcatcctt

SEQ ID NO: 9223543 - DNA, 22 bp, Homo sapiens
ctggctctgtcaccctttctcc

SEQ ID NO: 9223544 - DNA, 22 bp, Homo sapiens
ctggctctgagcccacctccag

SEQ ID NO: 9223545 - DNA, 22 bp, Homo sapiens
ctggctctgggctaagctccca

SEQ ID NO: 9223546 - DNA, 22 bp, Homo sapiens
ctggctctaagtgtcagctccc

SEQ ID NO: 9223547 - DNA, 22 bp, Homo sapiens
ctggcctgagaatgctaccctt

SEQ ID NO: 9223548 - DNA, 22 bp, Homo sapiens
ctggcctgagcacagcggctgc

SEQ ID NO: 9223549 - DNA, 22 bp, Homo sapiens
ctggcctgaggccgccttcaga

SEQ ID NO: 9223550 - DNA, 22 bp, Homo sapiens
ctggcctgaggccgccttcaga

SEQ ID NO: 9223551 - DNA, 22 bp, Homo sapiens
ctggcctgaggccgccttcaga

SEQ ID NO: 9223552 - DNA, 22 bp, Homo sapiens
ctggcctgcagatcccagggtc

SEQ ID NO: 9223553 - DNA, 22 bp, Homo sapiens
ctggcccagagctctggccttt

SEQ ID NO: 9223554 - DNA, 22 bp, Homo sapiens
ctggcccagagctctggccttt

SEQ ID NO: 9223555 - DNA, 22 bp, Homo sapiens
ctggcccagagctctggccttt

SEQ ID NO: 9223556 - DNA, 22 bp, Homo sapiens
ctggcccaggagagcaggcatt

SEQ ID NO: 9223557 - DNA, 21 bp, Homo sapiens
ctggcccagggatctgcattt

SEQ ID NO: 9223558 - DNA, 22 bp, Homo sapiens
ctggcccaggctcctggggcac

SEQ ID NO: 9223559 - DNA, 22 bp, Homo sapiens
ctggcccagagagcagagctta

SEQ ID NO: 9223560 - DNA, 22 bp, Homo sapiens
ctggcccagagagcagagctta

SEQ ID NO: 9223561 - DNA, 22 bp, Homo sapiens
ctggccatgttgcctctgagac

SEQ ID NO: 9223562 - DNA, 22 bp, Homo sapiens
ctggccagttgtcctggcttgg

SEQ ID NO: 9223563 - DNA, 22 bp, Homo sapiens
ctggccagttgtcctggcttgg

SEQ ID NO: 9223564 - DNA, 22 bp, Homo sapiens
ctggccagttgccttcctgggt

SEQ ID NO: 9223565 - DNA, 22 bp, Homo sapiens
ctggccagttgtcctggcttgg

SEQ ID NO: 9223566 - DNA, 17 bp, Homo sapiens
ctggccagtgtacttgg

SEQ ID NO: 9223567 - DNA, 22 bp, Homo sapiens
ctggactcatccatagaggtga

SEQ ID NO: 9223568 - DNA, 20 bp, Homo sapiens
ctggacttgctgctcacctg

SEQ ID NO: 9223569 - DNA, 22 bp, Homo sapiens
ctggactttggcccatctgcca

SEQ ID NO: 9223570 - DNA, 21 bp, Homo sapiens
ctggactgaggagacagtcgc

SEQ ID NO: 9223571 - DNA, 22 bp, Homo sapiens
ctggaccagaaaggacatggct

SEQ ID NO: 9223572 - DNA, 22 bp, Homo sapiens
ctggacatttcgcacccttcca

SEQ ID NO: 9223573 - DNA, 19 bp, Homo sapiens
ctggacctggaggcccgga

SEQ ID NO: 9223574 - DNA, 22 bp, Homo sapiens
ctggaggaccacagaagctggt

SEQ ID NO: 9223575 - DNA, 22 bp, Homo sapiens
ctggaggaataatggcatcttg

SEQ ID NO: 9223576 - DNA, 22 bp, Homo sapiens
ctggagctctgtgtgttcctga

SEQ ID NO: 9223577 - DNA, 22 bp, Homo sapiens
ctggagctctccagagccccgt

SEQ ID NO: 9223578 - DNA, 22 bp, Homo sapiens
ctggaggcaaagcagaggcatg

SEQ ID NO: 9223579 - DNA, 22 bp, Homo sapiens
ctggaggacccctgcctggaag

SEQ ID NO: 9223580 - DNA, 21 bp, Homo sapiens
ctggaggcaggtggtgccagg

SEQ ID NO: 9223581 - DNA, 21 bp, Homo sapiens
ctggagtcattttctgagtag

SEQ ID NO: 9223582 - DNA, 22 bp, Homo sapiens
ctggagggactttctcacggat

SEQ ID NO: 9223583 - DNA, 22 bp, Homo sapiens
ctggagggggaaatgttcattg

SEQ ID NO: 9223584 - DNA, 22 bp, Homo sapiens
ctggagggggaaatgttcattg

SEQ ID NO: 9223585 - DNA, 22 bp, Homo sapiens
ctggagggtgagcctcatctct

SEQ ID NO: 9223586 - DNA, 22 bp, Homo sapiens
ctggacacactggagtctggca

SEQ ID NO: 9223587 - DNA, 22 bp, Homo sapiens
ctggacacaaacatctcctctg

SEQ ID NO: 9223588 - DNA, 23 bp, Homo sapiens
ctggaagtgcttttatagctttg

SEQ ID NO: 9223589 - DNA, 22 bp, Homo sapiens
ctggaaggttctttgtgtgcct

SEQ ID NO: 9223590 - DNA, 22 bp, Homo sapiens
ctggacagaaagggctgctgtg

SEQ ID NO: 9223591 - DNA, 22 bp, Homo sapiens
ctggacagaaaccagtcctggg

SEQ ID NO: 9223592 - DNA, 22 bp, Homo sapiens
ctggacagtgctgcttgagatg

SEQ ID NO: 9223593 - DNA, 22 bp, Homo sapiens
ctggaaagacagagggcatggg

SEQ ID NO: 9223594 - DNA, 22 bp, Homo sapiens
ctggaaagatttctttggagtc

SEQ ID NO: 9223595 - DNA, 22 bp, Homo sapiens
ctgctttctgcaccccaggtcg

SEQ ID NO: 9223596 - DNA, 23 bp, Homo sapiens
ctgcttccttgcttcattgctgg

SEQ ID NO: 9223597 - DNA, 23 bp, Homo sapiens
ctgcttccttgcttcattgctgg

SEQ ID NO: 9223598 - DNA, 19 bp, Homo sapiens
ctgcttccttccctcactg

SEQ ID NO: 9223599 - DNA, 22 bp, Homo sapiens
ctgcttctaagaacctgcagct

SEQ ID NO: 9223600 - DNA, 22 bp, Homo sapiens
ctgcctgggccggccaccctct

SEQ ID NO: 9223601 - DNA, 22 bp, Homo sapiens
ctgcctgggccggccaccctct

SEQ ID NO: 9223602 - DNA, 22 bp, Homo sapiens
ctgcctggcctgatctccacgc

SEQ ID NO: 9223603 - DNA, 22 bp, Homo sapiens
ctgcctggctaaactcaagtcg

SEQ ID NO: 9223604 - DNA, 22 bp, Homo sapiens
ctgcctggagcattctgaaggt

SEQ ID NO: 9223605 - DNA, 22 bp, Homo sapiens
ctgcctggagcattctgaaggt

SEQ ID NO: 9223606 - DNA, 22 bp, Homo sapiens
ctgcctggaatgccagcttctc

SEQ ID NO: 9223607 - DNA, 22 bp, Homo sapiens
ctgcctggaccggcagccctcc

SEQ ID NO: 9223608 - DNA, 22 bp, Homo sapiens
ctgcctggaatgccagcttctc

SEQ ID NO: 9223609 - DNA, 22 bp, Homo sapiens
ctgcctgctctatccaggcctg

SEQ ID NO: 9223610 - DNA, 22 bp, Homo sapiens
ctgcctgctacctgaaatgcca

SEQ ID NO: 9223611 - DNA, 22 bp, Homo sapiens
ctgcctgctcaccagggctctg

SEQ ID NO: 9223612 - DNA, 22 bp, Homo sapiens
ctgcctgctcaccagggctctg

SEQ ID NO: 9223613 - DNA, 22 bp, Homo sapiens
ctgcctggccacaacccagggt

SEQ ID NO: 9223614 - DNA, 22 bp, Homo sapiens
ctgcctggcatggagaagagaa

SEQ ID NO: 9223615 - DNA, 22 bp, Homo sapiens
ctgcctggcatggagaagagaa

SEQ ID NO: 9223616 - DNA, 22 bp, Homo sapiens
ctgcctggcatagtctggtcga

SEQ ID NO: 9223617 - DNA, 20 bp, Homo sapiens
ctgcctggaggcctctacct

SEQ ID NO: 9223618 - DNA, 17 bp, Homo sapiens
ctgatttattagcagac

SEQ ID NO: 9223619 - DNA, 22 bp, Homo sapiens
ctgatttagatttcacacgtga

SEQ ID NO: 9223620 - DNA, 22 bp, Homo sapiens
ctgatttacatatacaaaagat

SEQ ID NO: 9223621 - DNA, 22 bp, Homo sapiens
ctgatctcaagtgatccaccca

SEQ ID NO: 9223622 - DNA, 22 bp, Homo sapiens
ctgatcctcctttaagtagctg

SEQ ID NO: 9223623 - DNA, 22 bp, Homo sapiens
ctgagtccagggacagaggcgt

SEQ ID NO: 9223624 - DNA, 22 bp, Homo sapiens
ctgagtccagggacagaggcgt

SEQ ID NO: 9223625 - DNA, 22 bp, Homo sapiens
ctgagacatggtttgactggca

SEQ ID NO: 9223626 - DNA, 22 bp, Homo sapiens
ctgagactgtaccacttcctcc

SEQ ID NO: 9223627 - DNA, 22 bp, Homo sapiens
ctgagagaatcatgctgcaggt

SEQ ID NO: 9223628 - DNA, 22 bp, Homo sapiens
ctgaggatctaattattgggtc

SEQ ID NO: 9223629 - DNA, 17 bp, Homo sapiens
ctgaggattatggttgt

SEQ ID NO: 9223630 - DNA, 22 bp, Homo sapiens
ctgaggcactaacaaggacaag

SEQ ID NO: 9223631 - DNA, 22 bp, Homo sapiens
ctgaggcactaacaaggacaag

SEQ ID NO: 9223632 - DNA, 22 bp, Homo sapiens
ctgaggcactgtcagctgaggc

SEQ ID NO: 9223633 - DNA, 22 bp, Homo sapiens
ctgaggcactggtaatgggcat

SEQ ID NO: 9223634 - DNA, 22 bp, Homo sapiens
ctgccatctgagggtccagcct

SEQ ID NO: 9223635 - DNA, 22 bp, Homo sapiens
ctgccatcctcaccagagcagc

SEQ ID NO: 9223636 - DNA, 22 bp, Homo sapiens
ctgccaggtaaactgcaggaat

SEQ ID NO: 9223637 - DNA, 22 bp, Homo sapiens
ctgccaggtgagctccaggcct

SEQ ID NO: 9223638 - DNA, 22 bp, Homo sapiens
ctgccaggttggcgctcgctct

SEQ ID NO: 9223639 - DNA, 22 bp, Homo sapiens
ctgccaggttggcgctcgctct

SEQ ID NO: 9223640 - DNA, 22 bp, Homo sapiens
ctgcctcctcacgtccacagtg

SEQ ID NO: 9223641 - DNA, 22 bp, Homo sapiens
ctgcctgcgttgcctcgtgcct

SEQ ID NO: 9223642 - DNA, 22 bp, Homo sapiens
ctgcctcatgctgcctgcagcc

SEQ ID NO: 9223643 - DNA, 22 bp, Homo sapiens
ctgcagagctaggctgagtgaa

SEQ ID NO: 9223644 - DNA, 22 bp, Homo sapiens
ctgcagagcttgtctggatgtg

SEQ ID NO: 9223645 - DNA, 22 bp, Homo sapiens
ctgcagcaagagaagtgctgac

SEQ ID NO: 9223646 - DNA, 22 bp, Homo sapiens
ctgccaggcctggggtgctgtc

SEQ ID NO: 9223647 - DNA, 22 bp, Homo sapiens
ctgccaggctgtcccaggtccg

SEQ ID NO: 9223648 - DNA, 22 bp, Homo sapiens
ctgccagggccctactcagttt

SEQ ID NO: 9223649 - DNA, 22 bp, Homo sapiens
ctgccaggggcctcacaggcca

SEQ ID NO: 9223650 - DNA, 22 bp, Homo sapiens
ctgccagggcatcctgtggtgg

SEQ ID NO: 9223651 - DNA, 22 bp, Homo sapiens
ctgccaggcctccgctgtcccc

SEQ ID NO: 9223652 - DNA, 22 bp, Homo sapiens
ctgccaggcctccgctgtcccc

SEQ ID NO: 9223653 - DNA, 22 bp, Homo sapiens
ctgccaggcctccgctgtcccc

SEQ ID NO: 9223654 - DNA, 22 bp, Homo sapiens
ctgccagctggagaccaaggaa

SEQ ID NO: 9223655 - DNA, 22 bp, Homo sapiens
ctgccagctggagaccaaggaa

SEQ ID NO: 9223656 - DNA, 17 bp, Homo sapiens
ctcttttgtcttcttcc

SEQ ID NO: 9223657 - DNA, 22 bp, Homo sapiens
tttttaagagattctccagtct

SEQ ID NO: 9223658 - DNA, 22 bp, Homo sapiens
tttttaagctcctttgatgtca

SEQ ID NO: 9223659 - DNA, 22 bp, Homo sapiens
ctctgggttcactgaggctctg

SEQ ID NO: 9223660 - DNA, 22 bp, Homo sapiens
ctctggtcatttggaagagcat

SEQ ID NO: 9223661 - DNA, 22 bp, Homo sapiens
ctctggtcaagcaaagaggttt

SEQ ID NO: 9223662 - DNA, 21 bp, Homo sapiens
ctctttgtggcaatgtatttt

SEQ ID NO: 9223663 - DNA, 22 bp, Homo sapiens
ctctttgtgctattatgatcct

SEQ ID NO: 9223664 - DNA, 22 bp, Homo sapiens
ctctttgtaaagaagtggtagg

SEQ ID NO: 9223665 - DNA, 22 bp, Homo sapiens
ctctttgtagcctttgcatatt

SEQ ID NO: 9223666 - DNA, 22 bp, Homo sapiens
ctgaagaggacgcagcagcaag

SEQ ID NO: 9223667 - DNA, 22 bp, Homo sapiens
ctgaagaggacgcagcagcaag

SEQ ID NO: 9223668 - DNA, 22 bp, Homo sapiens
ctgaagatgtctgagatgctca

SEQ ID NO: 9223669 - DNA, 22 bp, Homo sapiens
ctgactgttgctgttgatgagg

SEQ ID NO: 9223670 - DNA, 22 bp, Homo sapiens
ctgaactgacagactgcctgct

SEQ ID NO: 9223671 - DNA, 18 bp, Homo sapiens
ctgaagacaaaatgtcca

SEQ ID NO: 9223672 - DNA, 20 bp, Homo sapiens
ctgaagagactggaggggca

SEQ ID NO: 9223673 - DNA, 22 bp, Homo sapiens
ctctcctggggagcacacacac

SEQ ID NO: 9223674 - DNA, 22 bp, Homo sapiens
ctctggctgcctctcaggcctg

SEQ ID NO: 9223675 - DNA, 22 bp, Homo sapiens
tttgtgaataggttggcttcca

SEQ ID NO: 9223676 - DNA, 22 bp, Homo sapiens
tttgtgaataggttggcttcca

SEQ ID NO: 9223677 - DNA, 22 bp, Homo sapiens
ctctggctgtcccgatgagcag

SEQ ID NO: 9223678 - DNA, 22 bp, Homo sapiens
ctctggctgtcccgatgagcag

SEQ ID NO: 9223679 - DNA, 22 bp, Homo sapiens
ctctggctggctgggcctcagt

SEQ ID NO: 9223680 - DNA, 22 bp, Homo sapiens
ctctgggctccttcagcccttt

SEQ ID NO: 9223681 - DNA, 22 bp, Homo sapiens
ctctgggctccttcagcccttt

SEQ ID NO: 9223682 - DNA, 22 bp, Homo sapiens
ctctgggctgaatggctgaacc

SEQ ID NO: 9223683 - DNA, 22 bp, Homo sapiens
ctctgggctgaatggctgaacc

SEQ ID NO: 9223684 - DNA, 22 bp, Homo sapiens
ctctgggccatgctactgctct

SEQ ID NO: 9223685 - DNA, 21 bp, Homo sapiens
ctctgggccattttcttccac

SEQ ID NO: 9223686 - DNA, 22 bp, Homo sapiens
ctctgggcccacttaaatctgg

SEQ ID NO: 9223687 - DNA, 22 bp, Homo sapiens
ctctgggcggcccaggccaacc

SEQ ID NO: 9223688 - DNA, 23 bp, Homo sapiens
ctctgggcgggcaggtcagcctc

SEQ ID NO: 9223689 - DNA, 23 bp, Homo sapiens
ctctgggcgggcaggtcagcctc

SEQ ID NO: 9223690 - DNA, 22 bp, Homo sapiens
ttttattcatagggatggagag

SEQ ID NO: 9223691 - DNA, 17 bp, Homo sapiens
ctctgggcagcctgggg

SEQ ID NO: 9223692 - DNA, 17 bp, Homo sapiens
ctctgggcagcctgggg

SEQ ID NO: 9223693 - DNA, 17 bp, Homo sapiens
ctctgggcagcctgggg

SEQ ID NO: 9223694 - DNA, 22 bp, Homo sapiens
ctctgggcactgtatgggttct

SEQ ID NO: 9223695 - DNA, 22 bp, Homo sapiens
ctctgggcaccaaagagcagct

SEQ ID NO: 9223696 - DNA, 22 bp, Homo sapiens
ctctgggcacattttccaggac

SEQ ID NO: 9223697 - DNA, 22 bp, Homo sapiens
ctctgggcaggaccagtggacc

SEQ ID NO: 9223698 - DNA, 22 bp, Homo sapiens
ctctgggccaccgctggtgtat

SEQ ID NO: 9223699 - DNA, 22 bp, Homo sapiens
ctctgggcaggacgccaggcct

SEQ ID NO: 9223700 - DNA, 22 bp, Homo sapiens
ctctgggcaagtttcttcatga

SEQ ID NO: 9223701 - DNA, 19 bp, Homo sapiens
ctctgggcaagtcacttaa

SEQ ID NO: 9223702 - DNA, 22 bp, Homo sapiens
ctctgggcaaagatgcctcatc

SEQ ID NO: 9223703 - DNA, 22 bp, Homo sapiens
ctctgggcaagtatgatagaaa

SEQ ID NO: 9223704 - DNA, 22 bp, Homo sapiens
ctctgggcaaagatgcctcatc

SEQ ID NO: 9223705 - DNA, 22 bp, Homo sapiens
ctccaggcccctggccttctgc

SEQ ID NO: 9223706 - DNA, 22 bp, Homo sapiens
ttggtacatgttaaggaagagt

SEQ ID NO: 9223707 - DNA, 22 bp, Homo sapiens
ttggtacattacagtttgattg

SEQ ID NO: 9223708 - DNA, 21 bp, Homo sapiens
ttggtagatgcagcaccagta

SEQ ID NO: 9223709 - DNA, 22 bp, Homo sapiens
ttgggtcatgggatcccagcat

SEQ ID NO: 9223710 - DNA, 22 bp, Homo sapiens
ttgggtcttatggctggagtag

SEQ ID NO: 9223711 - DNA, 22 bp, Homo sapiens
ttgggtctgtttagctgagaag

SEQ ID NO: 9223712 - DNA, 22 bp, Homo sapiens
ttggggtgttggatggagcaag

SEQ ID NO: 9223713 - DNA, 22 bp, Homo sapiens
ttggtacatgcagatatttagt

SEQ ID NO: 9223714 - DNA, 22 bp, Homo sapiens
ttggtacaatgtgctaggtagg

SEQ ID NO: 9223715 - DNA, 22 bp, Homo sapiens
ttggtacagatgaggtattctc

SEQ ID NO: 9223716 - DNA, 22 bp, Homo sapiens
ttggtacaaaagtaactgtggt

SEQ ID NO: 9223717 - DNA, 22 bp, Homo sapiens
ttggtacaaaaccatgaaagaa

SEQ ID NO: 9223718 - DNA, 22 bp, Homo sapiens
ctccagggggcatccacacagc

SEQ ID NO: 9223719 - DNA, 22 bp, Homo sapiens
ttgtatttgattgtcatatcgt

SEQ ID NO: 9223720 - DNA, 22 bp, Homo sapiens
ttgttaaaaatagatttccagg

SEQ ID NO: 9223721 - DNA, 22 bp, Homo sapiens
ttgttaaaatgaggtcattctg

SEQ ID NO: 9223722 - DNA, 22 bp, Homo sapiens
ctccagggttccccgatccact

SEQ ID NO: 9223723 - DNA, 22 bp, Homo sapiens
ttgttacagcagcaatagaaaa

SEQ ID NO: 9223724 - DNA, 22 bp, Homo sapiens
ctccaggttttacaaggtctat

SEQ ID NO: 9223725 - DNA, 22 bp, Homo sapiens
ctccaggtgcagaaggactcag

SEQ ID NO: 9223726 - DNA, 22 bp, Homo sapiens
ctccaggtgcagaaggactcag

SEQ ID NO: 9223727 - DNA, 22 bp, Homo sapiens
tttaaaaaactagtctgagtct

SEQ ID NO: 9223728 - DNA, 22 bp, Homo sapiens
tttaaaaaactagtctgagtct

SEQ ID NO: 9223729 - DNA, 22 bp, Homo sapiens
ttgggaggtaatggagccaagt

SEQ ID NO: 9223730 - DNA, 22 bp, Homo sapiens
ttgggaggtcataaatctgttc

SEQ ID NO: 9223731 - DNA, 22 bp, Homo sapiens
ttgggcagaggccaggaggatg

SEQ ID NO: 9223732 - DNA, 22 bp, Homo sapiens
ttgggcagatgtttcctgtgga

SEQ ID NO: 9223733 - DNA, 22 bp, Homo sapiens
ttgggcagcattgcagttccct

SEQ ID NO: 9223734 - DNA, 22 bp, Homo sapiens
ttggccagacactacccccctt

SEQ ID NO: 9223735 - DNA, 22 bp, Homo sapiens
ttggccacaatccaagccttgg

SEQ ID NO: 9223736 - DNA, 22 bp, Homo sapiens
ttggccacactcactagagccc

SEQ ID NO: 9223737 - DNA, 22 bp, Homo sapiens
ttggccagaggtttctctcatg

SEQ ID NO: 9223738 - DNA, 22 bp, Homo sapiens
ttggccaagggctctttaggct

SEQ ID NO: 9223739 - DNA, 22 bp, Homo sapiens
ttggcattcatgggacaacaaa

SEQ ID NO: 9223740 - DNA, 22 bp, Homo sapiens
ttggcattggagatgcaagaac

SEQ ID NO: 9223741 - DNA, 22 bp, Homo sapiens
ttggcattgaagtttcattggt

SEQ ID NO: 9223742 - DNA, 22 bp, Homo sapiens
ttggatcttatgaaggtggcat

SEQ ID NO: 9223743 - DNA, 22 bp, Homo sapiens
ttgctttttaattaggaggcag

SEQ ID NO: 9223744 - DNA, 22 bp, Homo sapiens
ttgcttttaattaatcattgct

SEQ ID NO: 9223745 - DNA, 22 bp, Homo sapiens
ttgcttttaatctttgtacatc

SEQ ID NO: 9223746 - DNA, 18 bp, Homo sapiens
ctcctgggctgcagatgc

SEQ ID NO: 9223747 - DNA, 18 bp, Homo sapiens
ctcctgggctgcagatgc

SEQ ID NO: 9223748 - DNA, 22 bp, Homo sapiens
ctcctgggctgggaactcagcc

SEQ ID NO: 9223749 - DNA, 22 bp, Homo sapiens
ctctccagccaggggcttcctg

SEQ ID NO: 9223750 - DNA, 22 bp, Homo sapiens
ctcctgggaggatgcggacccg

SEQ ID NO: 9223751 - DNA, 22 bp, Homo sapiens
ctcctgggagctgtggcagagc

SEQ ID NO: 9223752 - DNA, 22 bp, Homo sapiens
ctcctgggagctgtggcagagc

SEQ ID NO: 9223753 - DNA, 22 bp, Homo sapiens
ctcctgggagcagggatggatg

SEQ ID NO: 9223754 - DNA, 22 bp, Homo sapiens
ctcctgggagcagggatggatg

SEQ ID NO: 9223755 - DNA, 22 bp, Homo sapiens
ctcctggctcgcccccagctga

SEQ ID NO: 9223756 - DNA, 21 bp, Homo sapiens
ctcctgggctaagatatagtg

SEQ ID NO: 9223757 - DNA, 22 bp, Homo sapiens
ctcctgggctcaagtgatcctc

SEQ ID NO: 9223758 - DNA, 22 bp, Homo sapiens
ctctccccggtacgagcggccg

SEQ ID NO: 9223759 - DNA, 22 bp, Homo sapiens
ctctcccccacagcagccttct

SEQ ID NO: 9223760 - DNA, 22 bp, Homo sapiens
ctctcccccacagcagccttct

SEQ ID NO: 9223761 - DNA, 22 bp, Homo sapiens
ctctcctcagaacaggccctct

SEQ ID NO: 9223762 - DNA, 22 bp, Homo sapiens
ctctccagttacctaggtctga

SEQ ID NO: 9223763 - DNA, 22 bp, Homo sapiens
tttagacatagctgaaatcatt

SEQ ID NO: 9223764 - DNA, 22 bp, Homo sapiens
tttagacaggggcaaaataagg

SEQ ID NO: 9223765 - DNA, 22 bp, Homo sapiens
ctcctctgggtcctggtggcca

SEQ ID NO: 9223766 - DNA, 22 bp, Homo sapiens
ctcctctggcttcctggaggca

SEQ ID NO: 9223767 - DNA, 22 bp, Homo sapiens
ctcctctgtctggccctgagcc

SEQ ID NO: 9223768 - DNA, 22 bp, Homo sapiens
ctcctctgtctaccacgagggt

SEQ ID NO: 9223769 - DNA, 22 bp, Homo sapiens
tttaaaaggggtattaagtcca

SEQ ID NO: 9223770 - DNA, 22 bp, Homo sapiens
tttaaaaaactagtctgagtct

SEQ ID NO: 9223771 - DNA, 22 bp, Homo sapiens
tttacatggaatattgtcttgt

SEQ ID NO: 9223772 - DNA, 22 bp, Homo sapiens
tttacacatacctctttaaagt

SEQ ID NO: 9223773 - DNA, 22 bp, Homo sapiens
tttaacagatgctatgtctacc

SEQ ID NO: 9223774 - DNA, 22 bp, Homo sapiens
ctaggctgttcatgctcagacc

SEQ ID NO: 9223775 - DNA, 22 bp, Homo sapiens
ctaggctgtaaagagctaggag

SEQ ID NO: 9223776 - DNA, 22 bp, Homo sapiens
ctaggctggagtgcattggcgt

SEQ ID NO: 9223777 - DNA, 22 bp, Homo sapiens
ctaggctggagtgcagtggcat

SEQ ID NO: 9223778 - DNA, 22 bp, Homo sapiens
ctaggctggagtgcagtggcac

SEQ ID NO: 9223779 - DNA, 22 bp, Homo sapiens
ctaggctgcacctaggatggct

SEQ ID NO: 9223780 - DNA, 22 bp, Homo sapiens
ctaggccagagagacctcatga

SEQ ID NO: 9223781 - DNA, 22 bp, Homo sapiens
ctaggccacagggcaaaaagga

SEQ ID NO: 9223782 - DNA, 22 bp, Homo sapiens
ctaggccagagagacctcatga

SEQ ID NO: 9223783 - DNA, 22 bp, Homo sapiens
ctaggcccatgaggtttgctgg

SEQ ID NO: 9223784 - DNA, 22 bp, Homo sapiens
ctaggccagttaggaagagaag

SEQ ID NO: 9223785 - DNA, 22 bp, Homo sapiens
ctaggccagttaggaagagaag

SEQ ID NO: 9223786 - DNA, 22 bp, Homo sapiens
ctaggccatattttgagaactg

SEQ ID NO: 9223787 - DNA, 22 bp, Homo sapiens
ctaggctgagctgggctgagct

SEQ ID NO: 9223788 - DNA, 22 bp, Homo sapiens
ttcctttcccttgcttctgtgc

SEQ ID NO: 9223789 - DNA, 22 bp, Homo sapiens
ttcctttccctcacagcctcgg

SEQ ID NO: 9223790 - DNA, 22 bp, Homo sapiens
ttcctttgggaaatcactaagg

SEQ ID NO: 9223791 - DNA, 22 bp, Homo sapiens
ttccttttagaatcatgaagac

SEQ ID NO: 9223792 - DNA, 22 bp, Homo sapiens
ttccttttcttaaacatatgtg

SEQ ID NO: 9223793 - DNA, 22 bp, Homo sapiens
ctaggcagactgagctctaggg

SEQ ID NO: 9223794 - DNA, 22 bp, Homo sapiens
ctagggccaaaggctgtgatgc

SEQ ID NO: 9223795 - DNA, 22 bp, Homo sapiens
ctagggccaaaggctgtgatgc

SEQ ID NO: 9223796 - DNA, 22 bp, Homo sapiens
ctagggagggatgttggcatga

SEQ ID NO: 9223797 - DNA, 22 bp, Homo sapiens
ctagggagtggcagagctggga

SEQ ID NO: 9223798 - DNA, 22 bp, Homo sapiens
ttctgtcatgctcatgtaattg

SEQ ID NO: 9223799 - DNA, 22 bp, Homo sapiens
ttctgtccactgctggggcctc

SEQ ID NO: 9223800 - DNA, 22 bp, Homo sapiens
ttctgtcatgctcatgtaattg

SEQ ID NO: 9223801 - DNA, 22 bp, Homo sapiens
ttctgtcatcctttctagatgt

SEQ ID NO: 9223802 - DNA, 22 bp, Homo sapiens
ttctgtcacagtgctggtatca

SEQ ID NO: 9223803 - DNA, 22 bp, Homo sapiens
ttctgtcaaatgccagtagaga

SEQ ID NO: 9223804 - DNA, 22 bp, Homo sapiens
ttctgtatgtacatatgtgtat

SEQ ID NO: 9223805 - DNA, 22 bp, Homo sapiens
ttctgtatttagtttgaggaca

SEQ ID NO: 9223806 - DNA, 22 bp, Homo sapiens
ttctgtatctttcttcaagatt

SEQ ID NO: 9223807 - DNA, 18 bp, Homo sapiens
ttgataaacaatttcatt

SEQ ID NO: 9223808 - DNA, 22 bp, Homo sapiens
ttgaggagcaggatgggaggct

SEQ ID NO: 9223809 - DNA, 22 bp, Homo sapiens
ttgagaaaagctgtgtaaggat

SEQ ID NO: 9223810 - DNA, 22 bp, Homo sapiens
ttgagctgtaaggtgggatgtg

SEQ ID NO: 9223811 - DNA, 17 bp, Homo sapiens
ctcagcagggctcactt

SEQ ID NO: 9223812 - DNA, 22 bp, Homo sapiens
ctcagcaggtcttgggtagggg

SEQ ID NO: 9223813 - DNA, 22 bp, Homo sapiens
ctcagcagagaccagggaggaa

SEQ ID NO: 9223814 - DNA, 22 bp, Homo sapiens
ctcagcagcagggaagaggtca

SEQ ID NO: 9223815 - DNA, 22 bp, Homo sapiens
ctatttttctgtaccctaattt

SEQ ID NO: 9223816 - DNA, 22 bp, Homo sapiens
ctatttttctgtaccctaattt

SEQ ID NO: 9223817 - DNA, 22 bp, Homo sapiens
ctattttgtccttagtgcaggg

SEQ ID NO: 9223818 - DNA, 17 bp, Homo sapiens
ctattttggagattaaa

SEQ ID NO: 9223819 - DNA, 22 bp, Homo sapiens
ctcagcacccgggcctttcctc

SEQ ID NO: 9223820 - DNA, 22 bp, Homo sapiens
ctattttgcctgcctagaaatc

SEQ ID NO: 9223821 - DNA, 22 bp, Homo sapiens
ttcttgtactggagatacatga

SEQ ID NO: 9223822 - DNA, 22 bp, Homo sapiens
ttcttggccaccagatctcact

SEQ ID NO: 9223823 - DNA, 22 bp, Homo sapiens
ttcttggctgttcatggtcagg

SEQ ID NO: 9223824 - DNA, 22 bp, Homo sapiens
ttcttgttctggttctgttagc

SEQ ID NO: 9223825 - DNA, 20 bp, Homo sapiens
ttcattcattccacaacttc

SEQ ID NO: 9223826 - DNA, 22 bp, Homo sapiens
cggctctgtcctcagcactgct

SEQ ID NO: 9223827 - DNA, 22 bp, Homo sapiens
cggctcaggccacaggacggca

SEQ ID NO: 9223828 - DNA, 22 bp, Homo sapiens
ttcactgtttcatcctacttct

SEQ ID NO: 9223829 - DNA, 22 bp, Homo sapiens
ttcactgttggctttgcttgtc

SEQ ID NO: 9223830 - DNA, 22 bp, Homo sapiens
ttcactgttgttagcagaggcg

SEQ ID NO: 9223831 - DNA, 22 bp, Homo sapiens
ttcagaaaaaacttcaataagt

SEQ ID NO: 9223832 - DNA, 22 bp, Homo sapiens
ttcagaaacatcagtggatgga

SEQ ID NO: 9223833 - DNA, 22 bp, Homo sapiens
cctgggtggcagaggttgcagt

SEQ ID NO: 9223834 - DNA, 22 bp, Homo sapiens
cctgggtggttccggcaaggag

SEQ ID NO: 9223835 - DNA, 22 bp, Homo sapiens
ttcacagtgtgatctatgggca

SEQ ID NO: 9223836 - DNA, 22 bp, Homo sapiens
ttcacagtggcttaggctatgg

SEQ ID NO: 9223837 - DNA, 22 bp, Homo sapiens
ttcacagtttaatggcaaggat

SEQ ID NO: 9223838 - DNA, 22 bp, Homo sapiens
ttcacagtttgctgggacagga

SEQ ID NO: 9223839 - DNA, 22 bp, Homo sapiens
ttcacagtttaatggcaaggat

SEQ ID NO: 9223840 - DNA, 22 bp, Homo sapiens
ttcacagtttgctgggacagga

SEQ ID NO: 9223841 - DNA, 22 bp, Homo sapiens
cggcatccccacttcctcctgc

SEQ ID NO: 9223842 - DNA, 22 bp, Homo sapiens
ctacaaaagtaattgtggtttt

SEQ ID NO: 9223843 - DNA, 22 bp, Homo sapiens
ctaataatagaggtggcatttg

SEQ ID NO: 9223844 - DNA, 22 bp, Homo sapiens
ctaagggttgaaacagcaagaa

SEQ ID NO: 9223845 - DNA, 22 bp, Homo sapiens
ctaataacatgaactactttct

SEQ ID NO: 9223846 - DNA, 22 bp, Homo sapiens
ttccttcccctagctgagaaac

SEQ ID NO: 9223847 - DNA, 22 bp, Homo sapiens
ctacaaatataaaacacagata

SEQ ID NO: 9223848 - DNA, 22 bp, Homo sapiens
ttccaggatgggctgtcctact

SEQ ID NO: 9223849 - DNA, 22 bp, Homo sapiens
ttccaggatgggctgtcctact

SEQ ID NO: 9223850 - DNA, 21 bp, Homo sapiens
ttccaggattgcttattttta

SEQ ID NO: 9223851 - DNA, 22 bp, Homo sapiens
ttccatttggcacttcactgag

SEQ ID NO: 9223852 - DNA, 22 bp, Homo sapiens
ttccaggatgggctgtcctact

SEQ ID NO: 9223853 - DNA, 22 bp, Homo sapiens
ttcccaaaatataacagttaac

SEQ ID NO: 9223854 - DNA, 22 bp, Homo sapiens
ttccatttttctaactctcaga

SEQ ID NO: 9223855 - DNA, 22 bp, Homo sapiens
ttcccaaagctttgtctgtgaa

SEQ ID NO: 9223856 - DNA, 22 bp, Homo sapiens
ttccgagggctcggcggccgcc

SEQ ID NO: 9223857 - DNA, 22 bp, Homo sapiens
ttccctttggcagccttctcct

SEQ ID NO: 9223858 - DNA, 22 bp, Homo sapiens
ctaactttttgattcttgggga

SEQ ID NO: 9223859 - DNA, 22 bp, Homo sapiens
ctaacttttacagtcatgttgc

SEQ ID NO: 9223860 - DNA, 22 bp, Homo sapiens
caggaagcatctggctagctaa

SEQ ID NO: 9223861 - DNA, 22 bp, Homo sapiens
gtttgtatgaatgttttatgct

SEQ ID NO: 9223862 - DNA, 23 bp, Homo sapiens
caggaagcagatggggtagaaga

SEQ ID NO: 9223863 - DNA, 22 bp, Homo sapiens
gtttggcaatatttgtggaaca

SEQ ID NO: 9223864 - DNA, 22 bp, Homo sapiens
gtttggcactatgatgaggcta

SEQ ID NO: 9223865 - DNA, 22 bp, Homo sapiens
gtttggcagagcatggggatga

SEQ ID NO: 9223866 - DNA, 22 bp, Homo sapiens
gtttggcacatgaacctatttt

SEQ ID NO: 9223867 - DNA, 18 bp, Homo sapiens
gtttggcataactgatgc

SEQ ID NO: 9223868 - DNA, 22 bp, Homo sapiens
gtttggcatctcacttaaaccg

SEQ ID NO: 9223869 - DNA, 22 bp, Homo sapiens
gtttggcataggatgtgggtta

SEQ ID NO: 9223870 - DNA, 19 bp, Homo sapiens
gtttggcagcaaatcagac

SEQ ID NO: 9223871 - DNA, 22 bp, Homo sapiens
gtttggcagtgttatgtaggtt

SEQ ID NO: 9223872 - DNA, 22 bp, Homo sapiens
gtttggcataaatattttcacc

SEQ ID NO: 9223873 - DNA, 22 bp, Homo sapiens
caggaagggggatccttggaag

SEQ ID NO: 9223874 - DNA, 22 bp, Homo sapiens
caggaagctgtgaaggagacgg

SEQ ID NO: 9223875 - DNA, 22 bp, Homo sapiens
caggaagctgagctgcactgca

SEQ ID NO: 9223876 - DNA, 22 bp, Homo sapiens
caggaagctgagctgcactgca

SEQ ID NO: 9223877 - DNA, 22 bp, Homo sapiens
caggaagctgccggtgagcgag

SEQ ID NO: 9223878 - DNA, 22 bp, Homo sapiens
caggaagctggtcagatcctgt

SEQ ID NO: 9223879 - DNA, 22 bp, Homo sapiens
caggaagggggatccttggaag

SEQ ID NO: 9223880 - DNA, 22 bp, Homo sapiens
gttttccactggattgtttgga

SEQ ID NO: 9223881 - DNA, 22 bp, Homo sapiens
gttttccactggattgtttgga

SEQ ID NO: 9223882 - DNA, 22 bp, Homo sapiens
gttttccaggtaccttggtatt

SEQ ID NO: 9223883 - DNA, 18 bp, Homo sapiens
gttttccatttgttcctc

SEQ ID NO: 9223884 - DNA, 22 bp, Homo sapiens
gttttccatggaggtctgacct

SEQ ID NO: 9223885 - DNA, 22 bp, Homo sapiens
gttttccatggaggtctgacct

SEQ ID NO: 9223886 - DNA, 22 bp, Homo sapiens
caggacagtataggctttagga

SEQ ID NO: 9223887 - DNA, 22 bp, Homo sapiens
caggacaggagtggggtcaaag

SEQ ID NO: 9223888 - DNA, 22 bp, Homo sapiens
caggacaggccctgtggggtct

SEQ ID NO: 9223889 - DNA, 22 bp, Homo sapiens
caggacagctcaacacctcctc

SEQ ID NO: 9223890 - DNA, 22 bp, Homo sapiens
caggacagctgggccaccacca

SEQ ID NO: 9223891 - DNA, 22 bp, Homo sapiens
gttttcctgagcccagagatgc

SEQ ID NO: 9223892 - DNA, 22 bp, Homo sapiens
taaaatcaccaaaagcaggtgg

SEQ ID NO: 9223893 - DNA, 22 bp, Homo sapiens
taaaatcatgacagattgacat

SEQ ID NO: 9223894 - DNA, 22 bp, Homo sapiens
taaaatcagccgaccatggtgg

SEQ ID NO: 9223895 - DNA, 22 bp, Homo sapiens
taaaatgacttcctccaacatc

SEQ ID NO: 9223896 - DNA, 22 bp, Homo sapiens
taaaaatcttatgaatggcaag

SEQ ID NO: 9223897 - DNA, 22 bp, Homo sapiens
taaacatttgttattcttgttt

SEQ ID NO: 9223898 - DNA, 22 bp, Homo sapiens
taaacatttgttattcttgttt

SEQ ID NO: 9223899 - DNA, 22 bp, Homo sapiens
taaacatttgttattcttgttt

SEQ ID NO: 9223900 - DNA, 22 bp, Homo sapiens
caggacagtgcaggtccatcct

SEQ ID NO: 9223901 - DNA, 22 bp, Homo sapiens
taaactatctgtgtttgaagtt

SEQ ID NO: 9223902 - DNA, 18 bp, Homo sapiens
taaacctttcttgtggca

SEQ ID NO: 9223903 - DNA, 22 bp, Homo sapiens
taaaccttcatgatggtcatta

SEQ ID NO: 9223904 - DNA, 22 bp, Homo sapiens
taaactactaggatgaattttt

SEQ ID NO: 9223905 - DNA, 22 bp, Homo sapiens
taaactacccatgacagtttca

SEQ ID NO: 9223906 - DNA, 22 bp, Homo sapiens
caggacccaacctccctgctct

SEQ ID NO: 9223907 - DNA, 22 bp, Homo sapiens
caggaccaggcgttctgggctg

SEQ ID NO: 9223908 - DNA, 22 bp, Homo sapiens
caggacagttggcatctgctgc

SEQ ID NO: 9223909 - DNA, 19 bp, Homo sapiens
caggacagtttgccaagaa

SEQ ID NO: 9223910 - DNA, 19 bp, Homo sapiens
caggacagtttgccaagaa

SEQ ID NO: 9223911 - DNA, 22 bp, Homo sapiens
caggacagtttgctttgccctg

SEQ ID NO: 9223912 - DNA, 22 bp, Homo sapiens
caggagaaggtttggagtgcag

SEQ ID NO: 9223913 - DNA, 22 bp, Homo sapiens
caggagacaatggctgtggggc

SEQ ID NO: 9223914 - DNA, 22 bp, Homo sapiens
caggagataaaagagatgcttt

SEQ ID NO: 9223915 - DNA, 23 bp, Homo sapiens
caggagatggctgctgtgtcagc

SEQ ID NO: 9223916 - DNA, 22 bp, Homo sapiens
caggagatgacagggaagaacc

SEQ ID NO: 9223917 - DNA, 22 bp, Homo sapiens
caggagatgtaagacttctgtt

SEQ ID NO: 9223918 - DNA, 22 bp, Homo sapiens
caggagatgcggtgtttgctct

SEQ ID NO: 9223919 - DNA, 23 bp, Homo sapiens
caggagatggctgctgtgtcagc

SEQ ID NO: 9223920 - DNA, 22 bp, Homo sapiens
caggagagcccgggtccgggct

SEQ ID NO: 9223921 - DNA, 22 bp, Homo sapiens
caggagctggataggaccacaa

SEQ ID NO: 9223922 - DNA, 22 bp, Homo sapiens
caggagctggataggaccacaa

SEQ ID NO: 9223923 - DNA, 22 bp, Homo sapiens
caggagctggataggaccacaa

SEQ ID NO: 9223924 - DNA, 22 bp, Homo sapiens
caggagctcttaaggatgtgat

SEQ ID NO: 9223925 - DNA, 22 bp, Homo sapiens
caggagctctcatcgtcagggc

SEQ ID NO: 9223926 - DNA, 22 bp, Homo sapiens
taaagcagtgtggttgtgtccc

SEQ ID NO: 9223927 - DNA, 22 bp, Homo sapiens
caggagctcaagaccaccctgg

SEQ ID NO: 9223928 - DNA, 22 bp, Homo sapiens
caggagctcacagtctttgggt

SEQ ID NO: 9223929 - DNA, 22 bp, Homo sapiens
caggagccttaggaaatacatc

SEQ ID NO: 9223930 - DNA, 22 bp, Homo sapiens
caggagctactcaggttgggtt

SEQ ID NO: 9223931 - DNA, 22 bp, Homo sapiens
caggagctcaagaccaccctgg

SEQ ID NO: 9223932 - DNA, 22 bp, Homo sapiens
caggagcccgttgctccggcgg

SEQ ID NO: 9223933 - DNA, 22 bp, Homo sapiens
caggagcccgttgctccggcgg

SEQ ID NO: 9223934 - DNA, 22 bp, Homo sapiens
caggagccctggtgggtggaca

SEQ ID NO: 9223935 - DNA, 22 bp, Homo sapiens
caggagccctggtgggtggaca

SEQ ID NO: 9223936 - DNA, 22 bp, Homo sapiens
caggagccgccaggcacgttgg

SEQ ID NO: 9223937 - DNA, 22 bp, Homo sapiens
caggagccgccaggcacgttgg

SEQ ID NO: 9223938 - DNA, 22 bp, Homo sapiens
taaatgcttagattcatagaaa

SEQ ID NO: 9223939 - DNA, 22 bp, Homo sapiens
taaatatgcatgtatccttatc

SEQ ID NO: 9223940 - DNA, 18 bp, Homo sapiens
taaatatatttccccctt

SEQ ID NO: 9223941 - DNA, 22 bp, Homo sapiens
taaagtcatctttacatctttg

SEQ ID NO: 9223942 - DNA, 22 bp, Homo sapiens
taaagccatactgaaagccact

SEQ ID NO: 9223943 - DNA, 17 bp, Homo sapiens
taaagccagtcaagtca

SEQ ID NO: 9223944 - DNA, 22 bp, Homo sapiens
taaagccacttcattctagtct

SEQ ID NO: 9223945 - DNA, 22 bp, Homo sapiens
taacaaagtaccatagattggg

SEQ ID NO: 9223946 - DNA, 22 bp, Homo sapiens
taacaaaggttgccaaactaag

SEQ ID NO: 9223947 - DNA, 22 bp, Homo sapiens
taacaaaggttgccaaactaag

SEQ ID NO: 9223948 - DNA, 22 bp, Homo sapiens
caggagtgtctccacacagcaa

SEQ ID NO: 9223949 - DNA, 22 bp, Homo sapiens
caggagtgtcgggtcactaggt

SEQ ID NO: 9223950 - DNA, 22 bp, Homo sapiens
caggagtggtgtgagggactcc

SEQ ID NO: 9223951 - DNA, 22 bp, Homo sapiens
caggaggcccggccacagccca

SEQ ID NO: 9223952 - DNA, 22 bp, Homo sapiens
caggaggcccggccacagccca

SEQ ID NO: 9223953 - DNA, 22 bp, Homo sapiens
caggagctgggtctggaagcag

SEQ ID NO: 9223954 - DNA, 22 bp, Homo sapiens
caggagctggatctccttgcgg

SEQ ID NO: 9223955 - DNA, 22 bp, Homo sapiens
caggagctggatctccttgcgg

SEQ ID NO: 9223956 - DNA, 22 bp, Homo sapiens
caggagcttctgcccatggcca

SEQ ID NO: 9223957 - DNA, 22 bp, Homo sapiens
caggagcttctgcccatggcca

SEQ ID NO: 9223958 - DNA, 22 bp, Homo sapiens
caggagcttctgcccatggcca

SEQ ID NO: 9223959 - DNA, 22 bp, Homo sapiens
caggaggaaactggattcactt

SEQ ID NO: 9223960 - DNA, 22 bp, Homo sapiens
caggagctgggtctggaagcag

SEQ ID NO: 9223961 - DNA, 22 bp, Homo sapiens
caggaggaaatgtgaccctgct

SEQ ID NO: 9223962 - DNA, 22 bp, Homo sapiens
caggaggaaatgtgaccctgct

SEQ ID NO: 9223963 - DNA, 22 bp, Homo sapiens
caggaggaaagttccactcaac

SEQ ID NO: 9223964 - DNA, 22 bp, Homo sapiens
caggaggaaatgtgaccctgct

SEQ ID NO: 9223965 - DNA, 22 bp, Homo sapiens
caggaggattgcttgaggccag

SEQ ID NO: 9223966 - DNA, 22 bp, Homo sapiens
caggaggcagaggttgcagtga

SEQ ID NO: 9223967 - DNA, 22 bp, Homo sapiens
caggaggcagaggttgcagcga

SEQ ID NO: 9223968 - DNA, 22 bp, Homo sapiens
caggaggcagaggatgcccagt

SEQ ID NO: 9223969 - DNA, 23 bp, Homo sapiens
caggcaggatgaggactacactc

SEQ ID NO: 9223970 - DNA, 23 bp, Homo sapiens
caggcaggatgaggactacactc

SEQ ID NO: 9223971 - DNA, 22 bp, Homo sapiens
caggcaggagaggaggatttct

SEQ ID NO: 9223972 - DNA, 22 bp, Homo sapiens
caggcagctgcgacaagagagc

SEQ ID NO: 9223973 - DNA, 22 bp, Homo sapiens
caggcagctgaggactttgcta

SEQ ID NO: 9223974 - DNA, 22 bp, Homo sapiens
caggcagctgggtcaccgtccc

SEQ ID NO: 9223975 - DNA, 22 bp, Homo sapiens
caggcagccctgcaccaagtgt

SEQ ID NO: 9223976 - DNA, 22 bp, Homo sapiens
caggcagccaggggacctgtcc

SEQ ID NO: 9223977 - DNA, 22 bp, Homo sapiens
caggcagctcgatgccttgttg

SEQ ID NO: 9223978 - DNA, 22 bp, Homo sapiens
caggcagctctaatggaaagtg

SEQ ID NO: 9223979 - DNA, 22 bp, Homo sapiens
caggcagcagccactctggtat

SEQ ID NO: 9223980 - DNA, 22 bp, Homo sapiens
caggcagcagccactctggtat

SEQ ID NO: 9223981 - DNA, 22 bp, Homo sapiens
caggcagcaggagccctgctcg

SEQ ID NO: 9223982 - DNA, 22 bp, Homo sapiens
caggcagcaggagccctgctcg

SEQ ID NO: 9223983 - DNA, 22 bp, Homo sapiens
caggcagcatcagtctgctgta

SEQ ID NO: 9223984 - DNA, 22 bp, Homo sapiens
caggcagcatcagtctgctgta

SEQ ID NO: 9223985 - DNA, 22 bp, Homo sapiens
caggcagcatttactctgatga

SEQ ID NO: 9223986 - DNA, 22 bp, Homo sapiens
taatttaatccaagtgttacat

SEQ ID NO: 9223987 - DNA, 22 bp, Homo sapiens
taatttacagttcgccatgtct

SEQ ID NO: 9223988 - DNA, 22 bp, Homo sapiens
taatttactcagatgttcaatc

SEQ ID NO: 9223989 - DNA, 22 bp, Homo sapiens
taatttacttgcaaataacaat

SEQ ID NO: 9223990 - DNA, 22 bp, Homo sapiens
taatttaatttcatgccagcct

SEQ ID NO: 9223991 - DNA, 22 bp, Homo sapiens
taatttaattccatggattcta

SEQ ID NO: 9223992 - DNA, 22 bp, Homo sapiens
taatttacagagatacagtcag

SEQ ID NO: 9223993 - DNA, 22 bp, Homo sapiens
caggcagagcaactggtccaga

SEQ ID NO: 9223994 - DNA, 22 bp, Homo sapiens
caggcagagcaactggtccaga

SEQ ID NO: 9223995 - DNA, 22 bp, Homo sapiens
caggcagagaactcatccgtga

SEQ ID NO: 9223996 - DNA, 22 bp, Homo sapiens
caggcagagaactcatccgtga

SEQ ID NO: 9223997 - DNA, 22 bp, Homo sapiens
caggcagagacgtcagtgtagg

SEQ ID NO: 9223998 - DNA, 22 bp, Homo sapiens
caggcagagaccctctcctaaa

SEQ ID NO: 9223999 - DNA, 22 bp, Homo sapiens
caggcagagacgtcagtgtagg

SEQ ID NO: 9224000 - DNA, 22 bp, Homo sapiens
caggcagaaggaagtaccaggc

SEQ ID NO: 9224001 - DNA, 22 bp, Homo sapiens
caggcagaaggaagtaccaggc

SEQ ID NO: 9224002 - DNA, 22 bp, Homo sapiens
caggcagaaggaagtaccaggc

SEQ ID NO: 9224003 - DNA, 22 bp, Homo sapiens
caggcagaatgaccgacctcgc

SEQ ID NO: 9224004 - DNA, 22 bp, Homo sapiens
caggcagaagaagtggaaggac

SEQ ID NO: 9224005 - DNA, 22 bp, Homo sapiens
caggcagaaattttgtttcatt

SEQ ID NO: 9224006 - DNA, 22 bp, Homo sapiens
tacaaatgaccatagccactta

SEQ ID NO: 9224007 - DNA, 20 bp, Homo sapiens
tacaaattttccatgtttcc

SEQ ID NO: 9224008 - DNA, 22 bp, Homo sapiens
tacaagtcacttcctttctaaa

SEQ ID NO: 9224009 - DNA, 22 bp, Homo sapiens
tacatatttgtctttgtactgt

SEQ ID NO: 9224010 - DNA, 22 bp, Homo sapiens
caggcacagtgttgctgttcaa

SEQ ID NO: 9224011 - DNA, 17 bp, Homo sapiens
caggcacatgaagccag

SEQ ID NO: 9224012 - DNA, 22 bp, Homo sapiens
caggcacatgggagctcatcat

SEQ ID NO: 9224013 - DNA, 22 bp, Homo sapiens
caggcacaaatttctagataag

SEQ ID NO: 9224014 - DNA, 22 bp, Homo sapiens
caggcacaagatcggctagata

SEQ ID NO: 9224015 - DNA, 22 bp, Homo sapiens
caggcacagctaagactggcca

SEQ ID NO: 9224016 - DNA, 22 bp, Homo sapiens
caggcacagctgggcaattgcg

SEQ ID NO: 9224017 - DNA, 22 bp, Homo sapiens
caggcacagctaagactggcca

SEQ ID NO: 9224018 - DNA, 22 bp, Homo sapiens
caggcaagcaaggggtcttgaa

SEQ ID NO: 9224019 - DNA, 22 bp, Homo sapiens
caggcaagttcatttccaggca

SEQ ID NO: 9224020 - DNA, 22 bp, Homo sapiens
caggcaaggaggcactgaggga

SEQ ID NO: 9224021 - DNA, 22 bp, Homo sapiens
caggatggtggcatgatcagaa

SEQ ID NO: 9224022 - DNA, 22 bp, Homo sapiens
caggatggtggcatgatcagaa

SEQ ID NO: 9224023 - DNA, 22 bp, Homo sapiens
caggcaagatccagaggctgct

SEQ ID NO: 9224024 - DNA, 22 bp, Homo sapiens
taaggcacccttctgagtagag

SEQ ID NO: 9224025 - DNA, 22 bp, Homo sapiens
taagatgtcatccacatagagt

SEQ ID NO: 9224026 - DNA, 22 bp, Homo sapiens
caggatgagaagggctcttacg

SEQ ID NO: 9224027 - DNA, 22 bp, Homo sapiens
taagaaacatttttatgacagt

SEQ ID NO: 9224028 - DNA, 22 bp, Homo sapiens
caggatcctggctgcatggacg

SEQ ID NO: 9224029 - DNA, 22 bp, Homo sapiens
caggatccctggcctccgccca

SEQ ID NO: 9224030 - DNA, 22 bp, Homo sapiens
caggatgctgaaaacacgagga

SEQ ID NO: 9224031 - DNA, 22 bp, Homo sapiens
caggatggtggcatgatcagaa

SEQ ID NO: 9224032 - DNA, 19 bp, Homo sapiens
caggatgatcccatgacac

SEQ ID NO: 9224033 - DNA, 22 bp, Homo sapiens
caggatgccatctgctgctgct

SEQ ID NO: 9224034 - DNA, 22 bp, Homo sapiens
taacatttcggtgacagtggga

SEQ ID NO: 9224035 - DNA, 22 bp, Homo sapiens
taacatttaaatttttcacata

SEQ ID NO: 9224036 - DNA, 22 bp, Homo sapiens
taacatttagaaagtgtccatt

SEQ ID NO: 9224037 - DNA, 16 bp, Homo sapiens
taacatttttaaaagg

SEQ ID NO: 9224038 - DNA, 22 bp, Homo sapiens
taacttctttggtttaaagaga

SEQ ID NO: 9224039 - DNA, 22 bp, Homo sapiens
taagaaacatgatacttttcct

SEQ ID NO: 9224040 - DNA, 22 bp, Homo sapiens
taagaaacatgattaatggcag

SEQ ID NO: 9224041 - DNA, 22 bp, Homo sapiens
taactttgaagggaattttact

SEQ ID NO: 9224042 - DNA, 22 bp, Homo sapiens
taactttaggaataggtaatct

SEQ ID NO: 9224043 - DNA, 22 bp, Homo sapiens
taacattcttaacttagaaaca

SEQ ID NO: 9224044 - DNA, 22 bp, Homo sapiens
taacattcttaacttagaaaca

SEQ ID NO: 9224045 - DNA, 22 bp, Homo sapiens
taacattaggtagacataagcc

SEQ ID NO: 9224046 - DNA, 22 bp, Homo sapiens
taacattatacagagaggacag

SEQ ID NO: 9224047 - DNA, 22 bp, Homo sapiens
taacagaaaggggacagaaata

SEQ ID NO: 9224048 - DNA, 22 bp, Homo sapiens
taacagaaatagaaatgagagt

SEQ ID NO: 9224049 - DNA, 19 bp, Homo sapiens
taacaaagtctgaagtcag

SEQ ID NO: 9224050 - DNA, 22 bp, Homo sapiens
gttcacaaagtactgtatgcat

SEQ ID NO: 9224051 - DNA, 22 bp, Homo sapiens
caggaaagagctgccaggcagg

SEQ ID NO: 9224052 - DNA, 22 bp, Homo sapiens
caggaaagagagctattcactt

SEQ ID NO: 9224053 - DNA, 21 bp, Homo sapiens
caggaaagaaaacgtacatat

SEQ ID NO: 9224054 - DNA, 22 bp, Homo sapiens
caggaaaatggaatcacctgta

SEQ ID NO: 9224055 - DNA, 22 bp, Homo sapiens
caggaaaatggaatcacctgta

SEQ ID NO: 9224056 - DNA, 22 bp, Homo sapiens
caggaaaatctgcccacacaag

SEQ ID NO: 9224057 - DNA, 22 bp, Homo sapiens
cagctttgattcactgcctagt

SEQ ID NO: 9224058 - DNA, 22 bp, Homo sapiens
cagctttgattcactgcctagt

SEQ ID NO: 9224059 - DNA, 22 bp, Homo sapiens
cagctttgagcagccagtggca

SEQ ID NO: 9224060 - DNA, 22 bp, Homo sapiens
cagctttgagagttgcatttta

SEQ ID NO: 9224061 - DNA, 22 bp, Homo sapiens
cagctttgaaacatggctctag

SEQ ID NO: 9224062 - DNA, 22 bp, Homo sapiens
cagctttgacctaaagtaggaa

SEQ ID NO: 9224063 - DNA, 22 bp, Homo sapiens
cagctttctgtctcatgactga

SEQ ID NO: 9224064 - DNA, 22 bp, Homo sapiens
cagctttcttccttctgtctgt

SEQ ID NO: 9224065 - DNA, 22 bp, Homo sapiens
cagctttcatcagtgacactca

SEQ ID NO: 9224066 - DNA, 22 bp, Homo sapiens
cagctttccccgtgcctcagcc

SEQ ID NO: 9224067 - DNA, 22 bp, Homo sapiens
cagctttaggactcataataaa

SEQ ID NO: 9224068 - DNA, 22 bp, Homo sapiens
cagctttagagaaaacatattt

SEQ ID NO: 9224069 - DNA, 22 bp, Homo sapiens
cagcttctaccatcaggaaatt

SEQ ID NO: 9224070 - DNA, 22 bp, Homo sapiens
gttattcttggtggccctgctg

SEQ ID NO: 9224071 - DNA, 22 bp, Homo sapiens
gttattctgccaaacttccaca

SEQ ID NO: 9224072 - DNA, 22 bp, Homo sapiens
cagcttctccagatgaccctca

SEQ ID NO: 9224073 - DNA, 22 bp, Homo sapiens
cagcttctcagaaagctgaggt

SEQ ID NO: 9224074 - DNA, 22 bp, Homo sapiens
cagcttctatttatctttgtgt

SEQ ID NO: 9224075 - DNA, 22 bp, Homo sapiens
cagcttctcagaaagctgaggt

SEQ ID NO: 9224076 - DNA, 22 bp, Homo sapiens
cagcttctagcatcggctttga

SEQ ID NO: 9224077 - DNA, 22 bp, Homo sapiens
cagcttctaccatcaggaaatt

SEQ ID NO: 9224078 - DNA, 22 bp, Homo sapiens
cagcttctccggcctggtgcgg

SEQ ID NO: 9224079 - DNA, 22 bp, Homo sapiens
cagcttctccattcttctggct

SEQ ID NO: 9224080 - DNA, 21 bp, Homo sapiens
cagcttctgaaggtgtaggaa

SEQ ID NO: 9224081 - DNA, 22 bp, Homo sapiens
cagcttctgagcaagccagggg

SEQ ID NO: 9224082 - DNA, 22 bp, Homo sapiens
cagcttggattttggcacgtgt

SEQ ID NO: 9224083 - DNA, 20 bp, Homo sapiens
cagcttggatgagaggctga

SEQ ID NO: 9224084 - DNA, 20 bp, Homo sapiens
cagcttggatgagaggctga

SEQ ID NO: 9224085 - DNA, 22 bp, Homo sapiens
cagcttggaggaggatctaaga

SEQ ID NO: 9224086 - DNA, 22 bp, Homo sapiens
cagcttggaggaggatctaaga

SEQ ID NO: 9224087 - DNA, 22 bp, Homo sapiens
cagcttgggggcgctggcctca

SEQ ID NO: 9224088 - DNA, 22 bp, Homo sapiens
cagcttgggtcaggtgcctgct

SEQ ID NO: 9224089 - DNA, 22 bp, Homo sapiens
cagcttgggtcaggtgcctgct

SEQ ID NO: 9224090 - DNA, 22 bp, Homo sapiens
cagcttggcttcacattctgta

SEQ ID NO: 9224091 - DNA, 22 bp, Homo sapiens
cagcttggcgaatgtaggtatg

SEQ ID NO: 9224092 - DNA, 22 bp, Homo sapiens
cagcttggcttccgctttactg

SEQ ID NO: 9224093 - DNA, 22 bp, Homo sapiens
cagcttggcttccgctttactg

SEQ ID NO: 9224094 - DNA, 22 bp, Homo sapiens
cagcttgggagtttggttttat

SEQ ID NO: 9224095 - DNA, 22 bp, Homo sapiens
cagcttgggagtttggttttat

SEQ ID NO: 9224096 - DNA, 22 bp, Homo sapiens
gtgtgtgtatatatacacacac

SEQ ID NO: 9224097 - DNA, 22 bp, Homo sapiens
gtgtgtgtactctgtatataaa

SEQ ID NO: 9224098 - DNA, 22 bp, Homo sapiens
gtgtgtggggccttcgggtcct

SEQ ID NO: 9224099 - DNA, 23 bp, Homo sapiens
gtgtgtggaaagtgcatgggcct

SEQ ID NO: 9224100 - DNA, 22 bp, Homo sapiens
gttacaaatgtaaattctgggg

SEQ ID NO: 9224101 - DNA, 22 bp, Homo sapiens
gttacaatgtccttacatgaaa

SEQ ID NO: 9224102 - DNA, 22 bp, Homo sapiens
gttacagtcaggagatattttg

SEQ ID NO: 9224103 - DNA, 22 bp, Homo sapiens
gttacaatgttcttcagttctg

SEQ ID NO: 9224104 - DNA, 22 bp, Homo sapiens
gttaaataacctcatgtccgtt

SEQ ID NO: 9224105 - DNA, 22 bp, Homo sapiens
cagctgtggagggaggaaatgc

SEQ ID NO: 9224106 - DNA, 22 bp, Homo sapiens
cagctgtgctgattgctcagta

SEQ ID NO: 9224107 - DNA, 22 bp, Homo sapiens
cagctgtgctgattgctcagta

SEQ ID NO: 9224108 - DNA, 18 bp, Homo sapiens
cagctgtgccctgtttgg

SEQ ID NO: 9224109 - DNA, 22 bp, Homo sapiens
cagctgtgatatgcctgcctga

SEQ ID NO: 9224110 - DNA, 22 bp, Homo sapiens
cagctgtgatatgcctgcctga

SEQ ID NO: 9224111 - DNA, 22 bp, Homo sapiens
cagctgtgggcctgacgtggca

SEQ ID NO: 9224112 - DNA, 22 bp, Homo sapiens
cagctgtggctgccactgctcc

SEQ ID NO: 9224113 - DNA, 22 bp, Homo sapiens
cagctgtgtaaacacatgtgta

SEQ ID NO: 9224114 - DNA, 22 bp, Homo sapiens
cagcttccataagagatggaga

SEQ ID NO: 9224115 - DNA, 22 bp, Homo sapiens
cagcttccacagacttggctcg

SEQ ID NO: 9224116 - DNA, 22 bp, Homo sapiens
cagcttccccccgggcttgaga

SEQ ID NO: 9224117 - DNA, 22 bp, Homo sapiens
cagcttcccttggctgagcaga

SEQ ID NO: 9224118 - DNA, 22 bp, Homo sapiens
cagcttcccagctcactcataa

SEQ ID NO: 9224119 - DNA, 22 bp, Homo sapiens
cagcttccatctccactgccct

SEQ ID NO: 9224120 - DNA, 22 bp, Homo sapiens
cagcttccgaccgggggctgca

SEQ ID NO: 9224121 - DNA, 20 bp, Homo sapiens
cagcttcaatgtcagcttga

SEQ ID NO: 9224122 - DNA, 22 bp, Homo sapiens
caggaaaggtagtcacaatgta

SEQ ID NO: 9224123 - DNA, 22 bp, Homo sapiens
caggaaaggtagtcacaatgta

SEQ ID NO: 9224124 - DNA, 22 bp, Homo sapiens
caggaaaggtagtcacaatgta

SEQ ID NO: 9224125 - DNA, 22 bp, Homo sapiens
caggaaagccgagtgccatagg

SEQ ID NO: 9224126 - DNA, 22 bp, Homo sapiens
caggaaagccgagtgccatagg

SEQ ID NO: 9224127 - DNA, 22 bp, Homo sapiens
gttggcagagagaagcctagca

SEQ ID NO: 9224128 - DNA, 22 bp, Homo sapiens
gttggccattaattggaggaca

SEQ ID NO: 9224129 - DNA, 22 bp, Homo sapiens
gttcacagtgttttctttgcat

SEQ ID NO: 9224130 - DNA, 22 bp, Homo sapiens
gttcctaagctgtggccctgga

SEQ ID NO: 9224131 - DNA, 22 bp, Homo sapiens
gttcctgaagggactggtgcag

SEQ ID NO: 9224132 - DNA, 22 bp, Homo sapiens
gttctgggaaggtggacctgtt

SEQ ID NO: 9224133 - DNA, 22 bp, Homo sapiens
gttccggaagtgactgatccgc

SEQ ID NO: 9224134 - DNA, 22 bp, Homo sapiens
gttctgtagtcatagagcaatt

SEQ ID NO: 9224135 - DNA, 22 bp, Homo sapiens
gttctgtctgagcaccacagga

SEQ ID NO: 9224136 - DNA, 22 bp, Homo sapiens
caggaagattgtggaggtggtt

SEQ ID NO: 9224137 - DNA, 22 bp, Homo sapiens
caggaagcaagtgattttcttg

SEQ ID NO: 9224138 - DNA, 22 bp, Homo sapiens
caggaagattagaccaagagct

SEQ ID NO: 9224139 - DNA, 22 bp, Homo sapiens
gtttacaacatcttgtccttca

SEQ ID NO: 9224140 - DNA, 22 bp, Homo sapiens
gtttacaacatgccaactgggc

SEQ ID NO: 9224141 - DNA, 21 bp, Homo sapiens
gtttacaaggctttgctcctg

SEQ ID NO: 9224142 - DNA, 22 bp, Homo sapiens
caggaacatgttggaaagaaat

SEQ ID NO: 9224143 - DNA, 22 bp, Homo sapiens
caggaagagaacatggaggctg

SEQ ID NO: 9224144 - DNA, 22 bp, Homo sapiens
caggaagaggacaggcttcccc

SEQ ID NO: 9224145 - DNA, 22 bp, Homo sapiens
caggaacagagtggcattgtct

SEQ ID NO: 9224146 - DNA, 22 bp, Homo sapiens
caggaacagcaccaggagctag

SEQ ID NO: 9224147 - DNA, 22 bp, Homo sapiens
cagctgggtgatcttgggcagg

SEQ ID NO: 9224148 - DNA, 22 bp, Homo sapiens
cagctggggagagacatggcag

SEQ ID NO: 9224149 - DNA, 22 bp, Homo sapiens
cagctgggagctccattagata

SEQ ID NO: 9224150 - DNA, 22 bp, Homo sapiens
gtgtgctgcccaactcgcagat

SEQ ID NO: 9224151 - DNA, 22 bp, Homo sapiens
gtgtggccgtgtatccatggct

SEQ ID NO: 9224152 - DNA, 22 bp, Homo sapiens
cagctggcttgtttgttcttga

SEQ ID NO: 9224153 - DNA, 22 bp, Homo sapiens
cagctggctggtcagtgcacaa

SEQ ID NO: 9224154 - DNA, 22 bp, Homo sapiens
cagctggctggtcagtgcacaa

SEQ ID NO: 9224155 - DNA, 20 bp, Homo sapiens
gtgtggccaggagctgcgct

SEQ ID NO: 9224156 - DNA, 22 bp, Homo sapiens
gtgtggccctgcgtcctgagtc

SEQ ID NO: 9224157 - DNA, 21 bp, Homo sapiens
gtgtggatatgtgacaggtgg

SEQ ID NO: 9224158 - DNA, 22 bp, Homo sapiens
gtgtggcaaggtgagaagtggg

SEQ ID NO: 9224159 - DNA, 22 bp, Homo sapiens
gtggtacagctgaaaggcttgc

SEQ ID NO: 9224160 - DNA, 22 bp, Homo sapiens
gtgtgaaagttcctaagactat

SEQ ID NO: 9224161 - DNA, 22 bp, Homo sapiens
cagctgctgttcagttttgttt

SEQ ID NO: 9224162 - DNA, 22 bp, Homo sapiens
cagctgcttactagctgtgtga

SEQ ID NO: 9224163 - DNA, 22 bp, Homo sapiens
cagctgctgcccttggctgcag

SEQ ID NO: 9224164 - DNA, 22 bp, Homo sapiens
cagctgctgatggcctgacaga

SEQ ID NO: 9224165 - DNA, 22 bp, Homo sapiens
gtgggtggatcatgaggtcagg

SEQ ID NO: 9224166 - DNA, 22 bp, Homo sapiens
gtgggtggatcacctgaggtca

SEQ ID NO: 9224167 - DNA, 22 bp, Homo sapiens
cagctggccccacagtagaggc

SEQ ID NO: 9224168 - DNA, 22 bp, Homo sapiens
cagctggcgtggagtgattgca

SEQ ID NO: 9224169 - DNA, 22 bp, Homo sapiens
cagctggcgtggagtgattgca

SEQ ID NO: 9224170 - DNA, 22 bp, Homo sapiens
gtggggagtgttctgtgattgg

SEQ ID NO: 9224171 - DNA, 22 bp, Homo sapiens
gtggggcatgcacgctgctcct

SEQ ID NO: 9224172 - DNA, 22 bp, Homo sapiens
gtggggctgagtggagccagaa

SEQ ID NO: 9224173 - DNA, 22 bp, Homo sapiens
cagctgcactgaagcaggtttg

SEQ ID NO: 9224174 - DNA, 22 bp, Homo sapiens
cagctgcagaaagcaagcaggt

SEQ ID NO: 9224175 - DNA, 22 bp, Homo sapiens
cagctgcagaaagcaagcaggt

SEQ ID NO: 9224176 - DNA, 22 bp, Homo sapiens
cagctgcaggagaaacagaggc

SEQ ID NO: 9224177 - DNA, 18 bp, Homo sapiens
cagctgcaggctcaggac

SEQ ID NO: 9224178 - DNA, 22 bp, Homo sapiens
cagctgcagtcatcttctagaa

SEQ ID NO: 9224179 - DNA, 22 bp, Homo sapiens
cagctgcaggctgtgcaggaag

SEQ ID NO: 9224180 - DNA, 22 bp, Homo sapiens
gtgggcaggccctaggcgattt

SEQ ID NO: 9224181 - DNA, 22 bp, Homo sapiens
gtgggcaggccccaaagcaggg

SEQ ID NO: 9224182 - DNA, 22 bp, Homo sapiens
gtggggaggcctaagcaagttg

SEQ ID NO: 9224183 - DNA, 22 bp, Homo sapiens
gtgggcagtgcctgacggatga

SEQ ID NO: 9224184 - DNA, 22 bp, Homo sapiens
gtggcttggaccagtcacagtg

SEQ ID NO: 9224185 - DNA, 22 bp, Homo sapiens
gtggctttggaattgtagactc

SEQ ID NO: 9224186 - DNA, 22 bp, Homo sapiens
gtggcgaggggaggtcctggcg

SEQ ID NO: 9224187 - DNA, 22 bp, Homo sapiens
cagctgagtgttggcatgttca

SEQ ID NO: 9224188 - DNA, 23 bp, Homo sapiens
cagctgaagcagcctgggctgga

SEQ ID NO: 9224189 - DNA, 22 bp, Homo sapiens
cagctgagctcccaggccatca

SEQ ID NO: 9224190 - DNA, 22 bp, Homo sapiens
cagctgaggtcaaagaagcagg

SEQ ID NO: 9224191 - DNA, 22 bp, Homo sapiens
cagctgagtctgaggttctttg

SEQ ID NO: 9224192 - DNA, 22 bp, Homo sapiens
cagctgaacatgtagagcatct

SEQ ID NO: 9224193 - DNA, 22 bp, Homo sapiens
cagctctgttcaaactatccag

SEQ ID NO: 9224194 - DNA, 22 bp, Homo sapiens
cagctctgttcatagatggtgc

SEQ ID NO: 9224195 - DNA, 22 bp, Homo sapiens
gtggcagagccaaggctggagc

SEQ ID NO: 9224196 - DNA, 22 bp, Homo sapiens
gtggcagaaactggcagaggag

SEQ ID NO: 9224197 - DNA, 22 bp, Homo sapiens
gtggcagaaactggcagaggag

SEQ ID NO: 9224198 - DNA, 22 bp, Homo sapiens
gtggcagaaatattcttgctct

SEQ ID NO: 9224199 - DNA, 22 bp, Homo sapiens
gtggcagaccttcccttctcct

SEQ ID NO: 9224200 - DNA, 22 bp, Homo sapiens
gtggcagaagagtaggatgggc

SEQ ID NO: 9224201 - DNA, 22 bp, Homo sapiens
gtggcagagaacaaggagaggt

SEQ ID NO: 9224202 - DNA, 22 bp, Homo sapiens
cagcccagctgggatcacactc

SEQ ID NO: 9224203 - DNA, 22 bp, Homo sapiens
cagcccaggactgcaggtgttt

SEQ ID NO: 9224204 - DNA, 22 bp, Homo sapiens
gtggagccctgccttgctcatg

SEQ ID NO: 9224205 - DNA, 22 bp, Homo sapiens
gtggcactggggtctagctggc

SEQ ID NO: 9224206 - DNA, 22 bp, Homo sapiens
gtggcactgatagtttcactct

SEQ ID NO: 9224207 - DNA, 22 bp, Homo sapiens
gtggcactgtttcccacggaag

SEQ ID NO: 9224208 - DNA, 22 bp, Homo sapiens
gtggcactggtagttttaagat

SEQ ID NO: 9224209 - DNA, 22 bp, Homo sapiens
gtggcactgggtgagtgagtga

SEQ ID NO: 9224210 - DNA, 22 bp, Homo sapiens
gtggccaggtcagggacttgtg

SEQ ID NO: 9224211 - DNA, 22 bp, Homo sapiens
gtggccaggtcagggacttgtg

SEQ ID NO: 9224212 - DNA, 22 bp, Homo sapiens
gtggccagtcccgatgcttgtt

SEQ ID NO: 9224213 - DNA, 22 bp, Homo sapiens
gtggccagggcccacaggatga

SEQ ID NO: 9224214 - DNA, 22 bp, Homo sapiens
gtggccagtgggaatgggctca

SEQ ID NO: 9224215 - DNA, 22 bp, Homo sapiens
gtggccagtggtgggcgccctg

SEQ ID NO: 9224216 - DNA, 19 bp, Homo sapiens
gtggccagggcaggggctg

SEQ ID NO: 9224217 - DNA, 22 bp, Homo sapiens
cagctctggctattgaggacca

SEQ ID NO: 9224218 - DNA, 22 bp, Homo sapiens
cagctctggctattgaggacca

SEQ ID NO: 9224219 - DNA, 22 bp, Homo sapiens
cagctctggctttggggagctt

SEQ ID NO: 9224220 - DNA, 20 bp, Homo sapiens
cagctctgggaaagaggcca

SEQ ID NO: 9224221 - DNA, 22 bp, Homo sapiens
cagctctgtgggagcgtatgtg

SEQ ID NO: 9224222 - DNA, 22 bp, Homo sapiens
cagctctgtgcaggcctgggga

SEQ ID NO: 9224223 - DNA, 22 bp, Homo sapiens
cagctctgtgcaggcctgggga

SEQ ID NO: 9224224 - DNA, 22 bp, Homo sapiens
cagctctggcgtcagggagcga

SEQ ID NO: 9224225 - DNA, 22 bp, Homo sapiens
cagctctggcgtcagggagcga

SEQ ID NO: 9224226 - DNA, 22 bp, Homo sapiens
cagctctggcagagcccaaccc

SEQ ID NO: 9224227 - DNA, 22 bp, Homo sapiens
cagctctggccagatctatcct

SEQ ID NO: 9224228 - DNA, 22 bp, Homo sapiens
cagctctgctggtggtgccagg

SEQ ID NO: 9224229 - DNA, 22 bp, Homo sapiens
cagctctgctggtggtgccagg

SEQ ID NO: 9224230 - DNA, 22 bp, Homo sapiens
cagctctgctggtggtgccagg

SEQ ID NO: 9224231 - DNA, 22 bp, Homo sapiens
cagctctgctgggaggatgcag

SEQ ID NO: 9224232 - DNA, 22 bp, Homo sapiens
cagctctgctgggaggatgcag

SEQ ID NO: 9224233 - DNA, 22 bp, Homo sapiens
tctcccacagccgtgcttcaag

SEQ ID NO: 9224234 - DNA, 22 bp, Homo sapiens
tctcccaagggcacattcaagg

SEQ ID NO: 9224235 - DNA, 22 bp, Homo sapiens
tctccagtgaatctcctcctgg

SEQ ID NO: 9224236 - DNA, 22 bp, Homo sapiens
ccagagcttgacgtgcaacgga

SEQ ID NO: 9224237 - DNA, 22 bp, Homo sapiens
ccagagcctgctgagccccatt

SEQ ID NO: 9224238 - DNA, 20 bp, Homo sapiens
ccagagctgatggctgcccg

SEQ ID NO: 9224239 - DNA, 18 bp, Homo sapiens
ccagagctggctcctcgc

SEQ ID NO: 9224240 - DNA, 18 bp, Homo sapiens
ccagagctggctcctcgc

SEQ ID NO: 9224241 - DNA, 22 bp, Homo sapiens
ccagagcttcggggcggctgta

SEQ ID NO: 9224242 - DNA, 22 bp, Homo sapiens
ccagagctgatgggcccagggt

SEQ ID NO: 9224243 - DNA, 22 bp, Homo sapiens
ccagagctgcatccagcaggtt

SEQ ID NO: 9224244 - DNA, 22 bp, Homo sapiens
ccagatctaagtccaaagtact

SEQ ID NO: 9224245 - DNA, 21 bp, Homo sapiens
ccagatcctgcttcctcaccc

SEQ ID NO: 9224246 - DNA, 17 bp, Homo sapiens
ccagatcccagtcctta

SEQ ID NO: 9224247 - DNA, 22 bp, Homo sapiens
ccagatggtttgcatgggaggg

SEQ ID NO: 9224248 - DNA, 22 bp, Homo sapiens
ccagatggtatagtagggagag

SEQ ID NO: 9224249 - DNA, 22 bp, Homo sapiens
ccagatgggaagaagcatgact

SEQ ID NO: 9224250 - DNA, 22 bp, Homo sapiens
ccagatgggccaggggtttgtt

SEQ ID NO: 9224251 - DNA, 22 bp, Homo sapiens
ccagaggtgagggggattcttg

SEQ ID NO: 9224252 - DNA, 22 bp, Homo sapiens
ccagaggagggctctgatgagg

SEQ ID NO: 9224253 - DNA, 21 bp, Homo sapiens
tctctacactttcactaggct

SEQ ID NO: 9224254 - DNA, 22 bp, Homo sapiens
tctctagtataatatagcaaaa

SEQ ID NO: 9224255 - DNA, 22 bp, Homo sapiens
ccagaagtggctttctcaggga

SEQ ID NO: 9224256 - DNA, 22 bp, Homo sapiens
ccagaagtcaggaatgagtctt

SEQ ID NO: 9224257 - DNA, 20 bp, Homo sapiens
ccagaaggtaggatggaaca

SEQ ID NO: 9224258 - DNA, 22 bp, Homo sapiens
ccagaagtcaatgcagatgtga

SEQ ID NO: 9224259 - DNA, 22 bp, Homo sapiens
ccagaagtcaatgcagatgtga

SEQ ID NO: 9224260 - DNA, 22 bp, Homo sapiens
ccagaagggctattgcagtgac

SEQ ID NO: 9224261 - DNA, 22 bp, Homo sapiens
ccagaagggctattgcagtgac

SEQ ID NO: 9224262 - DNA, 22 bp, Homo sapiens
ccagaagcaaaacagacagttt

SEQ ID NO: 9224263 - DNA, 22 bp, Homo sapiens
ccagaagcaaaacagacagttt

SEQ ID NO: 9224264 - DNA, 22 bp, Homo sapiens
ccagaaaagcatctggttcttt

SEQ ID NO: 9224265 - DNA, 22 bp, Homo sapiens
ccagaaaactctacatgcttgt

SEQ ID NO: 9224266 - DNA, 22 bp, Homo sapiens
ccactgaggaggtgaggacaga

SEQ ID NO: 9224267 - DNA, 22 bp, Homo sapiens
ccactgaggcaggcagtatcta

SEQ ID NO: 9224268 - DNA, 22 bp, Homo sapiens
ccactgaggcctgggcccaggg

SEQ ID NO: 9224269 - DNA, 22 bp, Homo sapiens
ccactgaggaacatgggctcca

SEQ ID NO: 9224270 - DNA, 22 bp, Homo sapiens
ccactgcacttcagcctgggtg

SEQ ID NO: 9224271 - DNA, 22 bp, Homo sapiens
ccacagtgagttagattgacca

SEQ ID NO: 9224272 - DNA, 16 bp, Homo sapiens
ccacctgcagctctca

SEQ ID NO: 9224273 - DNA, 22 bp, Homo sapiens
ccacagtgaaatcttgatggag

SEQ ID NO: 9224274 - DNA, 22 bp, Homo sapiens
ccactgagaagcacagcttgtc

SEQ ID NO: 9224275 - DNA, 22 bp, Homo sapiens
ccactgagaaggggttggggtc

SEQ ID NO: 9224276 - DNA, 22 bp, Homo sapiens
ccactctgattttggctccact

SEQ ID NO: 9224277 - DNA, 22 bp, Homo sapiens
ccactctgctgtgctccatgat

SEQ ID NO: 9224278 - DNA, 22 bp, Homo sapiens
ccactctgattggtcacctctg

SEQ ID NO: 9224279 - DNA, 23 bp, Homo sapiens
tcctggtgacatgcctgagcatc

SEQ ID NO: 9224280 - DNA, 22 bp, Homo sapiens
tcctggggagggttctggctcc

SEQ ID NO: 9224281 - DNA, 22 bp, Homo sapiens
ccacagggtcagccactctgca

SEQ ID NO: 9224282 - DNA, 22 bp, Homo sapiens
ccacagggtcagccactctgca

SEQ ID NO: 9224283 - DNA, 22 bp, Homo sapiens
ccacagggtcagccactctgca

SEQ ID NO: 9224284 - DNA, 22 bp, Homo sapiens
ccacaggggtctctgtagctga

SEQ ID NO: 9224285 - DNA, 22 bp, Homo sapiens
ccacagcaggactggagccgcc

SEQ ID NO: 9224286 - DNA, 22 bp, Homo sapiens
ccacagcatgcaggcctgacac

SEQ ID NO: 9224287 - DNA, 22 bp, Homo sapiens
ccacagcacctgcagccagttg

SEQ ID NO: 9224288 - DNA, 22 bp, Homo sapiens
ccacagctctagctccctccca

SEQ ID NO: 9224289 - DNA, 22 bp, Homo sapiens
ccacagctagggcaatctgatt

SEQ ID NO: 9224290 - DNA, 17 bp, Homo sapiens
ccacagcctggcacttg

SEQ ID NO: 9224291 - DNA, 17 bp, Homo sapiens
ccacagcctggcacttg

SEQ ID NO: 9224292 - DNA, 22 bp, Homo sapiens
ccacagagtcttccttctcttc

SEQ ID NO: 9224293 - DNA, 22 bp, Homo sapiens
ccacagaggacaactgcctggc

SEQ ID NO: 9224294 - DNA, 22 bp, Homo sapiens
tcctgccaggagtgctggccct

SEQ ID NO: 9224295 - DNA, 22 bp, Homo sapiens
tcctgccactgcacatatactt

SEQ ID NO: 9224296 - DNA, 23 bp, Homo sapiens
tcctcccaaatttcagcctcatt

SEQ ID NO: 9224297 - DNA, 23 bp, Homo sapiens
tcctcccaaatttcagcctcatt

SEQ ID NO: 9224298 - DNA, 22 bp, Homo sapiens
ccaaagtgctggggttacaggc

SEQ ID NO: 9224299 - DNA, 22 bp, Homo sapiens
tcctcccacataggacaatggg

SEQ ID NO: 9224300 - DNA, 22 bp, Homo sapiens
tcctcccacataggacaatggg

SEQ ID NO: 9224301 - DNA, 22 bp, Homo sapiens
tcctcccaacttttccatctca

SEQ ID NO: 9224302 - DNA, 20 bp, Homo sapiens
tcctcccccacctttgcagc

SEQ ID NO: 9224303 - DNA, 22 bp, Homo sapiens
ccaagggaaggatgtatatgat

SEQ ID NO: 9224304 - DNA, 22 bp, Homo sapiens
tcctccccaaagcccagcctgg

SEQ ID NO: 9224305 - DNA, 22 bp, Homo sapiens
tcctccccaaagcccagcctgg

SEQ ID NO: 9224306 - DNA, 22 bp, Homo sapiens
tcctccccaaagcccagcctgg

SEQ ID NO: 9224307 - DNA, 22 bp, Homo sapiens
ccacaagtgaagtacacctgcc

SEQ ID NO: 9224308 - DNA, 22 bp, Homo sapiens
catttagagagtaaaaattagc

SEQ ID NO: 9224309 - DNA, 23 bp, Homo sapiens
tccaggcacgcatttcttctagc

SEQ ID NO: 9224310 - DNA, 22 bp, Homo sapiens
catttacagcagactgatgaaa

SEQ ID NO: 9224311 - DNA, 22 bp, Homo sapiens
catttacacttctaaccacaag

SEQ ID NO: 9224312 - DNA, 22 bp, Homo sapiens
tcccagggcagctgtccagaag

SEQ ID NO: 9224313 - DNA, 22 bp, Homo sapiens
tcccagggcactcaccctccct

SEQ ID NO: 9224314 - DNA, 21 bp, Homo sapiens
tcccagggccaggtgccatca

SEQ ID NO: 9224315 - DNA, 21 bp, Homo sapiens
tcccagggccaggtgccatca

SEQ ID NO: 9224316 - DNA, 22 bp, Homo sapiens
tcccagggcttttctcatgctt

SEQ ID NO: 9224317 - DNA, 22 bp, Homo sapiens
tcccagggcttttctcatgctt

SEQ ID NO: 9224318 - DNA, 22 bp, Homo sapiens
tcccagggccgcaaacgagttt

SEQ ID NO: 9224319 - DNA, 22 bp, Homo sapiens
tcccagggctctagagtgctgg

SEQ ID NO: 9224320 - DNA, 22 bp, Homo sapiens
tcccagggctctagagtgctgg

SEQ ID NO: 9224321 - DNA, 22 bp, Homo sapiens
tcccagggtatcctgtagtaaa

SEQ ID NO: 9224322 - DNA, 22 bp, Homo sapiens
tcccagggggatgaacactgcc

SEQ ID NO: 9224323 - DNA, 22 bp, Homo sapiens
tcccagggtcagtggtgaggcc

SEQ ID NO: 9224324 - DNA, 22 bp, Homo sapiens
catttgaagacttagaagagga

SEQ ID NO: 9224325 - DNA, 22 bp, Homo sapiens
catttgaactaataactgtgct

SEQ ID NO: 9224326 - DNA, 22 bp, Homo sapiens
ccaaagtgctaggattacaggc

SEQ ID NO: 9224327 - DNA, 22 bp, Homo sapiens
ccaaagtgctgggattacaggt

SEQ ID NO: 9224328 - DNA, 22 bp, Homo sapiens
ccaaagtgctgggattacaggc

SEQ ID NO: 9224329 - DNA, 22 bp, Homo sapiens
ccaaagtgctgagattacaggt

SEQ ID NO: 9224330 - DNA, 22 bp, Homo sapiens
ccaaagtgctaggattacaggt

SEQ ID NO: 9224331 - DNA, 22 bp, Homo sapiens
tccctgctcagctcacctggca

SEQ ID NO: 9224332 - DNA, 22 bp, Homo sapiens
tccctgctcagctcacctggca

SEQ ID NO: 9224333 - DNA, 22 bp, Homo sapiens
tccctgcttgctctcagccctt

SEQ ID NO: 9224334 - DNA, 21 bp, Homo sapiens
tccctgctttctggcccagtc

SEQ ID NO: 9224335 - DNA, 22 bp, Homo sapiens
tccctgcttggaatgaccctta

SEQ ID NO: 9224336 - DNA, 22 bp, Homo sapiens
tccctgcttggaatgaccctta

SEQ ID NO: 9224337 - DNA, 22 bp, Homo sapiens
ccaggaggcagaagttgcagtg

SEQ ID NO: 9224338 - DNA, 22 bp, Homo sapiens
ccaggaggcaatatcaagtcca

SEQ ID NO: 9224339 - DNA, 22 bp, Homo sapiens
ccaggagcctgggccaggctgg

SEQ ID NO: 9224340 - DNA, 22 bp, Homo sapiens
ccaggagcctgggccaggctgg

SEQ ID NO: 9224341 - DNA, 22 bp, Homo sapiens
ccaggaagcggtgagggctgcc

SEQ ID NO: 9224342 - DNA, 22 bp, Homo sapiens
ccaggaagcggtgagggctgcc

SEQ ID NO: 9224343 - DNA, 22 bp, Homo sapiens
ccaggaagcctgtgtctctgga

SEQ ID NO: 9224344 - DNA, 22 bp, Homo sapiens
ccaggaagctctgctccacggg

SEQ ID NO: 9224345 - DNA, 23 bp, Homo sapiens
ccaggaagaggccatccacagtc

SEQ ID NO: 9224346 - DNA, 23 bp, Homo sapiens
ccaggaagaggccatccacagtc

SEQ ID NO: 9224347 - DNA, 22 bp, Homo sapiens
ccagcttcatgggcatgcacca

SEQ ID NO: 9224348 - DNA, 22 bp, Homo sapiens
ccaggaaatagtgctgtgatct

SEQ ID NO: 9224349 - DNA, 22 bp, Homo sapiens
ccaggaaatggcttgcttcttt

SEQ ID NO: 9224350 - DNA, 22 bp, Homo sapiens
ccaggaagacacatgctcatcc

SEQ ID NO: 9224351 - DNA, 17 bp, Homo sapiens
tctgtctgtggtccact

SEQ ID NO: 9224352 - DNA, 23 bp, Homo sapiens
tctgtctgtgtatgtgcagaaag

SEQ ID NO: 9224353 - DNA, 22 bp, Homo sapiens
tctgtcttagccatctcaggct

SEQ ID NO: 9224354 - DNA, 18 bp, Homo sapiens
tctgtctgtacaagtatc

SEQ ID NO: 9224355 - DNA, 22 bp, Homo sapiens
ccaggaggcggaaggtacagtg

SEQ ID NO: 9224356 - DNA, 22 bp, Homo sapiens
ccaggaggcggaggttgcagcg

SEQ ID NO: 9224357 - DNA, 22 bp, Homo sapiens
ccaggaggcagaggttgtagtg

SEQ ID NO: 9224358 - DNA, 22 bp, Homo sapiens
tctgccttgtttgagctttgac

SEQ ID NO: 9224359 - DNA, 22 bp, Homo sapiens
tctgccttggcaaccacagctt

SEQ ID NO: 9224360 - DNA, 22 bp, Homo sapiens
tctgcctgagaagtggggtgcc

SEQ ID NO: 9224361 - DNA, 22 bp, Homo sapiens
tctgcctgaaccactcttggag

SEQ ID NO: 9224362 - DNA, 22 bp, Homo sapiens
tctgcctgaaattcacatgtaa

SEQ ID NO: 9224363 - DNA, 22 bp, Homo sapiens
tctgctaaggcatttgcttgga

SEQ ID NO: 9224364 - DNA, 22 bp, Homo sapiens
ccagctgctttttgtcacatgg

SEQ ID NO: 9224365 - DNA, 22 bp, Homo sapiens
ccagctggtaagtgatggagcc

SEQ ID NO: 9224366 - DNA, 22 bp, Homo sapiens
ccagctggtaagtgatggagcc

SEQ ID NO: 9224367 - DNA, 22 bp, Homo sapiens
ccagctgggtccctgctggggc

SEQ ID NO: 9224368 - DNA, 22 bp, Homo sapiens
ccagctgggtccctgctggggc

SEQ ID NO: 9224369 - DNA, 22 bp, Homo sapiens
ccagctggggaagtggggcata

SEQ ID NO: 9224370 - DNA, 22 bp, Homo sapiens
ccagctggtctgtgctcatgtt

SEQ ID NO: 9224371 - DNA, 22 bp, Homo sapiens
ccagctggtgggtctttctctg

SEQ ID NO: 9224372 - DNA, 22 bp, Homo sapiens
ccagctggtgacatccccaacc

SEQ ID NO: 9224373 - DNA, 22 bp, Homo sapiens
tctggagccttggatgggaaag

SEQ ID NO: 9224374 - DNA, 22 bp, Homo sapiens
ccagctggttaaaatagagaaa

SEQ ID NO: 9224375 - DNA, 22 bp, Homo sapiens
ccagctggtgttccttaggacc

SEQ ID NO: 9224376 - DNA, 22 bp, Homo sapiens
ccagcttcatgggcatgcacca

SEQ ID NO: 9224377 - DNA, 22 bp, Homo sapiens
ccagctgtgccgtgtggatagc

SEQ ID NO: 9224378 - DNA, 22 bp, Homo sapiens
tctggcttgagcttcgaccagt

SEQ ID NO: 9224379 - DNA, 22 bp, Homo sapiens
tctggcttgctggcttggtccc

SEQ ID NO: 9224380 - DNA, 22 bp, Homo sapiens
tctggcttggctggcatctctg

SEQ ID NO: 9224381 - DNA, 22 bp, Homo sapiens
tctggcttggcgctgccctctg

SEQ ID NO: 9224382 - DNA, 22 bp, Homo sapiens
tctggctttattccttcactga

SEQ ID NO: 9224383 - DNA, 22 bp, Homo sapiens
tctggagctggagggcaaggca

SEQ ID NO: 9224384 - DNA, 22 bp, Homo sapiens
tctggagcttgaagctttggtt

SEQ ID NO: 9224385 - DNA, 22 bp, Homo sapiens
tctggcttccctctgttctggg

SEQ ID NO: 9224386 - DNA, 22 bp, Homo sapiens
tctggcttcagtagggttcact

SEQ ID NO: 9224387 - DNA, 23 bp, Homo sapiens
tctggcttccagtgggttcaacc

SEQ ID NO: 9224388 - DNA, 22 bp, Homo sapiens
tctggcttcaagtcccagctct

SEQ ID NO: 9224389 - DNA, 22 bp, Homo sapiens
tctggctgttaggcctgacctt

SEQ ID NO: 9224390 - DNA, 22 bp, Homo sapiens
ccagcctggactgggtcttgtg

SEQ ID NO: 9224391 - DNA, 22 bp, Homo sapiens
ccagcctggactgggtcttgtg

SEQ ID NO: 9224392 - DNA, 22 bp, Homo sapiens
ccagcctggactgggtcttgtg

SEQ ID NO: 9224393 - DNA, 22 bp, Homo sapiens
ccagcctggagggcagtggtgg

SEQ ID NO: 9224394 - DNA, 22 bp, Homo sapiens
ccagcctggagggcagtggtgg

SEQ ID NO: 9224395 - DNA, 22 bp, Homo sapiens
ccagcctggagggcagtggtgg

SEQ ID NO: 9224396 - DNA, 22 bp, Homo sapiens
ccagcctggggaggcagcttct

SEQ ID NO: 9224397 - DNA, 22 bp, Homo sapiens
ccagcctggggaggcagcttct

SEQ ID NO: 9224398 - DNA, 22 bp, Homo sapiens
ccagcctggggaggcagcttct

SEQ ID NO: 9224399 - DNA, 22 bp, Homo sapiens
ccagccttcacctgctctggtc

SEQ ID NO: 9224400 - DNA, 22 bp, Homo sapiens
ccagccttctgagctgcctgga

SEQ ID NO: 9224401 - DNA, 22 bp, Homo sapiens
ccagcctggttcagaattggct

SEQ ID NO: 9224402 - DNA, 22 bp, Homo sapiens
ccagcctggttcagaattggct

SEQ ID NO: 9224403 - DNA, 22 bp, Homo sapiens
ccagcctgggtgttagaagaca

SEQ ID NO: 9224404 - DNA, 22 bp, Homo sapiens
ccagcctggggaggcagcttct

SEQ ID NO: 9224405 - DNA, 22 bp, Homo sapiens
ccagctccaagtttgggcatca

SEQ ID NO: 9224406 - DNA, 22 bp, Homo sapiens
ccagctaggcttgcactcttgt

SEQ ID NO: 9224407 - DNA, 22 bp, Homo sapiens
ccagctagtaagcacctgcatc

SEQ ID NO: 9224408 - DNA, 22 bp, Homo sapiens
ccagctcaagcactgtgtgaag

SEQ ID NO: 9224409 - DNA, 22 bp, Homo sapiens
ccagctagtaagcacctgcatc

SEQ ID NO: 9224410 - DNA, 22 bp, Homo sapiens
ccagctcagggtcacatggcac

SEQ ID NO: 9224411 - DNA, 23 bp, Homo sapiens
ccagctcatccattacctctctt

SEQ ID NO: 9224412 - DNA, 22 bp, Homo sapiens
ccagctctagccccatgtggct

SEQ ID NO: 9224413 - DNA, 22 bp, Homo sapiens
ccagctctagccccatgtggct

SEQ ID NO: 9224414 - DNA, 22 bp, Homo sapiens
ccagctctaaacggctctgtgg

SEQ ID NO: 9224415 - DNA, 22 bp, Homo sapiens
ccagctccttctgtctgtggag

SEQ ID NO: 9224416 - DNA, 22 bp, Homo sapiens
ccagctcctgggtcttagtcag

SEQ ID NO: 9224417 - DNA, 22 bp, Homo sapiens
ccagctcctgggtcttagtcag

SEQ ID NO: 9224418 - DNA, 22 bp, Homo sapiens
ccagctcctcttgtctctagca

SEQ ID NO: 9224419 - DNA, 21 bp, Homo sapiens
ccagctccaggaccttggatc

SEQ ID NO: 9224420 - DNA, 22 bp, Homo sapiens
ccagctcatattttatgtgcag

SEQ ID NO: 9224421 - DNA, 22 bp, Homo sapiens
ccagctccaggactgggagctg

SEQ ID NO: 9224422 - DNA, 22 bp, Homo sapiens
ccagctccaggactgggagctg

SEQ ID NO: 9224423 - DNA, 23 bp, Homo sapiens
ccagctccgtgagcctcgggctc

SEQ ID NO: 9224424 - DNA, 22 bp, Homo sapiens
tctgcctcgctaacagcagcca

SEQ ID NO: 9224425 - DNA, 21 bp, Homo sapiens
tctgccagctgaagaggtgga

SEQ ID NO: 9224426 - DNA, 22 bp, Homo sapiens
tctgccaggagccatgagcaag

SEQ ID NO: 9224427 - DNA, 22 bp, Homo sapiens
tctgccagaagccagggtctgg

SEQ ID NO: 9224428 - DNA, 22 bp, Homo sapiens
tctgccagacctgactcagtag

SEQ ID NO: 9224429 - DNA, 22 bp, Homo sapiens
tctgccagaagttctgagagta

SEQ ID NO: 9224430 - DNA, 18 bp, Homo sapiens
tctcttgcatcttctgta

SEQ ID NO: 9224431 - DNA, 18 bp, Homo sapiens
tctcttgcatcttctgta

SEQ ID NO: 9224432 - DNA, 22 bp, Homo sapiens
tctcttgggaggaaagagagaa

SEQ ID NO: 9224433 - DNA, 22 bp, Homo sapiens
tctctcttgaagtattagctag

SEQ ID NO: 9224434 - DNA, 17 bp, Homo sapiens
tctcttgttcactgctg

SEQ ID NO: 9224435 - DNA, 22 bp, Homo sapiens
ccagccagtccagcattggtgt

SEQ ID NO: 9224436 - DNA, 22 bp, Homo sapiens
ccagccagtcccgcatgaccgc

SEQ ID NO: 9224437 - DNA, 22 bp, Homo sapiens
ccagccagtcccgcatgaccgc

SEQ ID NO: 9224438 - DNA, 22 bp, Homo sapiens
ccagccctacagtatcacctgt

SEQ ID NO: 9224439 - DNA, 21 bp, Homo sapiens
ccagcccagctgtgtcccagc

SEQ ID NO: 9224440 - DNA, 22 bp, Homo sapiens
ccagcccatgcccttatagcat

SEQ ID NO: 9224441 - DNA, 19 bp, Homo sapiens
ccagcccatagtccatcac

SEQ ID NO: 9224442 - DNA, 22 bp, Homo sapiens
ccagcccaaacaagccgccttc

SEQ ID NO: 9224443 - DNA, 22 bp, Homo sapiens
tctgaggcaaacagaggagtgt

SEQ ID NO: 9224444 - DNA, 22 bp, Homo sapiens
tctgaggcccctgggcaggatg

SEQ ID NO: 9224445 - DNA, 22 bp, Homo sapiens
tctgaggccccagccctgcaca

SEQ ID NO: 9224446 - DNA, 22 bp, Homo sapiens
tctgaggcccagttcaactctt

SEQ ID NO: 9224447 - DNA, 22 bp, Homo sapiens
tctgaggcatacccaggccccc

SEQ ID NO: 9224448 - DNA, 22 bp, Homo sapiens
tctgaggcataacctgttctgc

SEQ ID NO: 9224449 - DNA, 22 bp, Homo sapiens
cagtgaggaagctgtctggacc

SEQ ID NO: 9224450 - DNA, 22 bp, Homo sapiens
cagtctcaccctggaggcccca

SEQ ID NO: 9224451 - DNA, 22 bp, Homo sapiens
cagtctaacttcacagcctgga

SEQ ID NO: 9224452 - DNA, 22 bp, Homo sapiens
cagtgaggtgcccagcctgccc

SEQ ID NO: 9224453 - DNA, 21 bp, Homo sapiens
cagtgaggtccccagcctagg

SEQ ID NO: 9224454 - DNA, 22 bp, Homo sapiens
cagtgagggcccccttccaggt

SEQ ID NO: 9224455 - DNA, 22 bp, Homo sapiens
cagtgagggcccccttccaggt

SEQ ID NO: 9224456 - DNA, 20 bp, Homo sapiens
cagtgaggaggtgctggggg

SEQ ID NO: 9224457 - DNA, 22 bp, Homo sapiens
cagtgagtaagtagacagctta

SEQ ID NO: 9224458 - DNA, 22 bp, Homo sapiens
cagtgcacgggccagtcctgcc

SEQ ID NO: 9224459 - DNA, 22 bp, Homo sapiens
cagtgcagacgtggagggggca

SEQ ID NO: 9224460 - DNA, 20 bp, Homo sapiens
tatttagattcaagtatgga

SEQ ID NO: 9224461 - DNA, 20 bp, Homo sapiens
tatttacaacttagagcctc

SEQ ID NO: 9224462 - DNA, 22 bp, Homo sapiens
cagtcctggggaccaggctgag

SEQ ID NO: 9224463 - DNA, 22 bp, Homo sapiens
cagtcctggggaccaggctgag

SEQ ID NO: 9224464 - DNA, 22 bp, Homo sapiens
cagtcctggggaccaggctgag

SEQ ID NO: 9224465 - DNA, 22 bp, Homo sapiens
tcagaaatttaggctggacttg

SEQ ID NO: 9224466 - DNA, 22 bp, Homo sapiens
tcagaaattttctcagtagttc

SEQ ID NO: 9224467 - DNA, 22 bp, Homo sapiens
tcagaagctggtgtcctttgaa

SEQ ID NO: 9224468 - DNA, 22 bp, Homo sapiens
tcagaaggaaacgatgccagct

SEQ ID NO: 9224469 - DNA, 22 bp, Homo sapiens
tcagaaggaaacgatgccagct

SEQ ID NO: 9224470 - DNA, 22 bp, Homo sapiens
tcagaaggcccgttgctaagag

SEQ ID NO: 9224471 - DNA, 22 bp, Homo sapiens
tcagaaatactatcagcttttg

SEQ ID NO: 9224472 - DNA, 22 bp, Homo sapiens
tcagaaatagctctaagctcct

SEQ ID NO: 9224473 - DNA, 22 bp, Homo sapiens
tcagaaatcttgtcaaggcatc

SEQ ID NO: 9224474 - DNA, 22 bp, Homo sapiens
tcactcagtttttggcctctgc

SEQ ID NO: 9224475 - DNA, 22 bp, Homo sapiens
tcactcaggttcatgtctttgt

SEQ ID NO: 9224476 - DNA, 22 bp, Homo sapiens
tcactcagcctgcctggttcct

SEQ ID NO: 9224477 - DNA, 22 bp, Homo sapiens
tcactcaggctggagtgcagtg

SEQ ID NO: 9224478 - DNA, 22 bp, Homo sapiens
tcactcagctagcttcaggagc

SEQ ID NO: 9224479 - DNA, 22 bp, Homo sapiens
tcactcagcattcactgggcct

SEQ ID NO: 9224480 - DNA, 22 bp, Homo sapiens
tcactcagaaatagaatgaacc

SEQ ID NO: 9224481 - DNA, 22 bp, Homo sapiens
tcactcagatgttaaagggctt

SEQ ID NO: 9224482 - DNA, 22 bp, Homo sapiens
tcactcagagatagcctcattt

SEQ ID NO: 9224483 - DNA, 22 bp, Homo sapiens
tcacccagacagcttgcactga

SEQ ID NO: 9224484 - DNA, 22 bp, Homo sapiens
cagtgctgtgctggaagctgtt

SEQ ID NO: 9224485 - DNA, 22 bp, Homo sapiens
cagtgctgtgtttgctgcctgg

SEQ ID NO: 9224486 - DNA, 22 bp, Homo sapiens
cagtgctgggcagaggagagcg

SEQ ID NO: 9224487 - DNA, 22 bp, Homo sapiens
cagtgctgcatctccatgccag

SEQ ID NO: 9224488 - DNA, 19 bp, Homo sapiens
cagtgcccaccctagcaca

SEQ ID NO: 9224489 - DNA, 22 bp, Homo sapiens
tataagaagtgaagaagagtta

SEQ ID NO: 9224490 - DNA, 22 bp, Homo sapiens
tacatgtgttctgtttcaagtt

SEQ ID NO: 9224491 - DNA, 22 bp, Homo sapiens
tataatatgaggcaggagtgat

SEQ ID NO: 9224492 - DNA, 22 bp, Homo sapiens
tataagcacatccttgactgat

SEQ ID NO: 9224493 - DNA, 22 bp, Homo sapiens
caggggccaggctgtctgctgt

SEQ ID NO: 9224494 - DNA, 22 bp, Homo sapiens
caggggccaagggtccagacct

SEQ ID NO: 9224495 - DNA, 22 bp, Homo sapiens
caggggcaggtgtgagatcatc

SEQ ID NO: 9224496 - DNA, 22 bp, Homo sapiens
caggggcagtctgtgtgcgtgg

SEQ ID NO: 9224497 - DNA, 22 bp, Homo sapiens
cagggtcttataaggccaattt

SEQ ID NO: 9224498 - DNA, 22 bp, Homo sapiens
caggggcctggctgtctaggaa

SEQ ID NO: 9224499 - DNA, 22 bp, Homo sapiens
caggggccggctgtccgtgccc

SEQ ID NO: 9224500 - DNA, 22 bp, Homo sapiens
cagggtggaacaggcaatactt

SEQ ID NO: 9224501 - DNA, 22 bp, Homo sapiens
cagggtggaacaggcaatactt

SEQ ID NO: 9224502 - DNA, 22 bp, Homo sapiens
cagggtggaaaagctagttgga

SEQ ID NO: 9224503 - DNA, 22 bp, Homo sapiens
caggtctgggttgatggcctgg

SEQ ID NO: 9224504 - DNA, 22 bp, Homo sapiens
caggtctggcatcagctgtgtg

SEQ ID NO: 9224505 - DNA, 22 bp, Homo sapiens
caggtctgagtcacatgttcat

SEQ ID NO: 9224506 - DNA, 22 bp, Homo sapiens
caggtctgaagagtcacatgcc

SEQ ID NO: 9224507 - DNA, 22 bp, Homo sapiens
caggtctgcagacagggccatg

SEQ ID NO: 9224508 - DNA, 22 bp, Homo sapiens
caggtctgaagagtcacatgcc

SEQ ID NO: 9224509 - DNA, 17 bp, Homo sapiens
caggtctgaggccaggc

SEQ ID NO: 9224510 - DNA, 22 bp, Homo sapiens
cagggtggaatggaatgctggc

SEQ ID NO: 9224511 - DNA, 22 bp, Homo sapiens
cagggtggaagctgtagagtgg

SEQ ID NO: 9224512 - DNA, 22 bp, Homo sapiens
cagggtggaagctgtagagtgg

SEQ ID NO: 9224513 - DNA, 22 bp, Homo sapiens
cagggtggaatggaatgctggc

SEQ ID NO: 9224514 - DNA, 22 bp, Homo sapiens
cagggtggcacatcacagcatt

SEQ ID NO: 9224515 - DNA, 22 bp, Homo sapiens
cagggtggcacatcacagcatt

SEQ ID NO: 9224516 - DNA, 22 bp, Homo sapiens
tatacagatggaaagatacaca

SEQ ID NO: 9224517 - DNA, 22 bp, Homo sapiens
tatgtttgttatcacaactagg

SEQ ID NO: 9224518 - DNA, 22 bp, Homo sapiens
tattaaatatatctgttagttg

SEQ ID NO: 9224519 - DNA, 22 bp, Homo sapiens
tattgcctgagtgtttcataat

SEQ ID NO: 9224520 - DNA, 22 bp, Homo sapiens
tatctctagcgcacagaagaaa

SEQ ID NO: 9224521 - DNA, 22 bp, Homo sapiens
tatgcacagttacaagaatatc

SEQ ID NO: 9224522 - DNA, 22 bp, Homo sapiens
tatggcagttacccttgatgat

SEQ ID NO: 9224523 - DNA, 22 bp, Homo sapiens
caggtcttttctactggtggag

SEQ ID NO: 9224524 - DNA, 22 bp, Homo sapiens
caggtctttgttgcagcatgga

SEQ ID NO: 9224525 - DNA, 20 bp, Homo sapiens
caggtcttcatgtggctgtc

SEQ ID NO: 9224526 - DNA, 18 bp, Homo sapiens
caggtctgtctgcctccc

SEQ ID NO: 9224527 - DNA, 18 bp, Homo sapiens
caggtctgtctgcctccc

SEQ ID NO: 9224528 - DNA, 22 bp, Homo sapiens
caggtctgtgtgccatttccaa

SEQ ID NO: 9224529 - DNA, 22 bp, Homo sapiens
caggtctgtttccatcagtgct

SEQ ID NO: 9224530 - DNA, 22 bp, Homo sapiens
caggtctgttttcaaggtcagt

SEQ ID NO: 9224531 - DNA, 22 bp, Homo sapiens
caggtctggtgagagaacagtt

SEQ ID NO: 9224532 - DNA, 21 bp, Homo sapiens
caggtctggtgaacactctca

SEQ ID NO: 9224533 - DNA, 21 bp, Homo sapiens
caggtctggtgaacactctca

SEQ ID NO: 9224534 - DNA, 22 bp, Homo sapiens
catccaggctgaagtgcagtgg

SEQ ID NO: 9224535 - DNA, 22 bp, Homo sapiens
catccagaccgtgccatgctgc

SEQ ID NO: 9224536 - DNA, 22 bp, Homo sapiens
catccagagtccaaggctgggc

SEQ ID NO: 9224537 - DNA, 22 bp, Homo sapiens
catcatgaagatgagaaagcat

SEQ ID NO: 9224538 - DNA, 22 bp, Homo sapiens
catcacatgcctatcatgagct

SEQ ID NO: 9224539 - DNA, 22 bp, Homo sapiens
catcacatgtaggcagcatcac

SEQ ID NO: 9224540 - DNA, 21 bp, Homo sapiens
catcacattactcaaagtcct

SEQ ID NO: 9224541 - DNA, 22 bp, Homo sapiens
tcaggaagtgcctaggctggcc

SEQ ID NO: 9224542 - DNA, 22 bp, Homo sapiens
tcaggaagtggtaaaggatgtt

SEQ ID NO: 9224543 - DNA, 22 bp, Homo sapiens
tcaggaagtggtaaaggatgtt

SEQ ID NO: 9224544 - DNA, 22 bp, Homo sapiens
tcaggaagtggtaaaggatgtt

SEQ ID NO: 9224545 - DNA, 22 bp, Homo sapiens
tcaggaagttgaggcgtagaga

SEQ ID NO: 9224546 - DNA, 22 bp, Homo sapiens
tcaggaagtgcctaggctggcc

SEQ ID NO: 9224547 - DNA, 22 bp, Homo sapiens
tcaggaagtgcctaggctggcc

SEQ ID NO: 9224548 - DNA, 22 bp, Homo sapiens
tcaggaagtgctgaggctgctt

SEQ ID NO: 9224549 - DNA, 22 bp, Homo sapiens
tcaggaagttgaggcgtagaga

SEQ ID NO: 9224550 - DNA, 19 bp, Homo sapiens
tcaggaagttgatgaggtg

SEQ ID NO: 9224551 - DNA, 22 bp, Homo sapiens
catatcataggtcttggataat

SEQ ID NO: 9224552 - DNA, 22 bp, Homo sapiens
catatacacttccacctctgtg

SEQ ID NO: 9224553 - DNA, 20 bp, Homo sapiens
catatatacctagaagtgga

SEQ ID NO: 9224554 - DNA, 22 bp, Homo sapiens
tcagaagtccccagtcaaggag

SEQ ID NO: 9224555 - DNA, 22 bp, Homo sapiens
tcagaagtccaataccatggga

SEQ ID NO: 9224556 - DNA, 22 bp, Homo sapiens
tcagaagtcacttaggaaaggg

SEQ ID NO: 9224557 - DNA, 22 bp, Homo sapiens
tcagaagtattatgctaaagga

SEQ ID NO: 9224558 - DNA, 22 bp, Homo sapiens
cagtttctgagccctgtcattt

SEQ ID NO: 9224559 - DNA, 22 bp, Homo sapiens
cagtttggcagcaacatggcga

SEQ ID NO: 9224560 - DNA, 22 bp, Homo sapiens
cataatttttttaagtcagaac

SEQ ID NO: 9224561 - DNA, 22 bp, Homo sapiens
tcaggaagtataatcagattca

SEQ ID NO: 9224562 - DNA, 22 bp, Homo sapiens
tcagccctgggcttcctcatgg

SEQ ID NO: 9224563 - DNA, 22 bp, Homo sapiens
tcagctctgttttgagtggaac

SEQ ID NO: 9224564 - DNA, 22 bp, Homo sapiens
tcagctctgttttgagtggaac

SEQ ID NO: 9224565 - DNA, 20 bp, Homo sapiens
tcagctctgtgcctgggatg

SEQ ID NO: 9224566 - DNA, 22 bp, Homo sapiens
tcagctgagctccagctcatag

SEQ ID NO: 9224567 - DNA, 22 bp, Homo sapiens
tcagctgaagtggagaagcaga

SEQ ID NO: 9224568 - DNA, 22 bp, Homo sapiens
tcagctgagttctagagcactc

SEQ ID NO: 9224569 - DNA, 22 bp, Homo sapiens
tcagctcttaaccctctggcct

SEQ ID NO: 9224570 - DNA, 20 bp, Homo sapiens
tcagctcttagaggtcgctt

SEQ ID NO: 9224571 - DNA, 22 bp, Homo sapiens
tcagccctagcctcagtccagg

SEQ ID NO: 9224572 - DNA, 22 bp, Homo sapiens
tcagccctggcactgtctccca

SEQ ID NO: 9224573 - DNA, 22 bp, Homo sapiens
catggctgcgagaagagtgggt

SEQ ID NO: 9224574 - DNA, 20 bp, Homo sapiens
catggctgtgagcccacagg

SEQ ID NO: 9224575 - DNA, 23 bp, Homo sapiens
catggctgatttcaagctaccac

SEQ ID NO: 9224576 - DNA, 22 bp, Homo sapiens
tcatttttagcgcgcaaaagtt

SEQ ID NO: 9224577 - DNA, 20 bp, Homo sapiens
tccagcccagcagcctgaca

SEQ ID NO: 9224578 - DNA, 18 bp, Homo sapiens
catgtctgcgccacaagg

SEQ ID NO: 9224579 - DNA, 22 bp, Homo sapiens
tccagccaggatggcccaggga

SEQ ID NO: 9224580 - DNA, 22 bp, Homo sapiens
tccagccaggatggcccaggga

SEQ ID NO: 9224581 - DNA, 22 bp, Homo sapiens
catggcttttagccctacatga

SEQ ID NO: 9224582 - DNA, 22 bp, Homo sapiens
tccagccacttgcacagttaaa

SEQ ID NO: 9224583 - DNA, 22 bp, Homo sapiens
tccagccatgcatgacaatcac

SEQ ID NO: 9224584 - DNA, 22 bp, Homo sapiens
catgtgcatccttaatctccct

SEQ ID NO: 9224585 - DNA, 22 bp, Homo sapiens
catgtgcagacggtgggctgga

SEQ ID NO: 9224586 - DNA, 19 bp, Homo sapiens
catgtgcatgagcacagga

SEQ ID NO: 9224587 - DNA, 22 bp, Homo sapiens
tccaggcaagggaggagcatgg

SEQ ID NO: 9224588 - DNA, 22 bp, Homo sapiens
tccaggcaaagtgctgggctgc

SEQ ID NO: 9224589 - DNA, 22 bp, Homo sapiens
catgatctggtcctactgtggg

SEQ ID NO: 9224590 - DNA, 22 bp, Homo sapiens
tcatggggtttggctggatgtc

SEQ ID NO: 9224591 - DNA, 22 bp, Homo sapiens
tcatggctttttcactgttcgc

SEQ ID NO: 9224592 - DNA, 22 bp, Homo sapiens
tcatggggctcttcaagtggag

SEQ ID NO: 9224593 - DNA, 22 bp, Homo sapiens
tcatggggccacagctgccagc

SEQ ID NO: 9224594 - DNA, 22 bp, Homo sapiens
catccattaactcatttgtttc

SEQ ID NO: 9224595 - DNA, 22 bp, Homo sapiens
catccatagcctcaataaatag

SEQ ID NO: 9224596 - DNA, 22 bp, Homo sapiens
catctttagggaccattattct

SEQ ID NO: 9224597 - DNA, 22 bp, Homo sapiens
tctggagaggggcctagaattt

SEQ ID NO: 9224598 - DNA, 22 bp, Homo sapiens
tctggagataagacagacagat

SEQ ID NO: 9224599 - DNA, 22 bp, Homo sapiens
tctggagagtcacagtgccaga

SEQ ID NO: 9224600 - DNA, 22 bp, Homo sapiens
tctggagaagcccagggagctg

SEQ ID NO: 9224601 - DNA, 22 bp, Homo sapiens
tctggagaatctgtcagtgtgg

SEQ ID NO: 9224602 - DNA, 22 bp, Homo sapiens
tctggaagacagtgagcccgct

SEQ ID NO: 9224603 - DNA, 22 bp, Homo sapiens
tctggaaggaacccttagagga

SEQ ID NO: 9224604 - DNA, 22 bp, Homo sapiens
tctggactaacagcagcctcag

SEQ ID NO: 9224605 - DNA, 22 bp, Homo sapiens
tctggaagaacggggcatgctg

SEQ ID NO: 9224606 - DNA, 22 bp, Homo sapiens
tctgctgtgaaaggtgaatatt

SEQ ID NO: 9224607 - DNA, 22 bp, Homo sapiens
tctgctctagttgcttcctgcc

SEQ ID NO: 9224608 - DNA, 22 bp, Homo sapiens
tctgctctccatacttccgcac

SEQ ID NO: 9224609 - DNA, 22 bp, Homo sapiens
tctgctgctacagactctctag

SEQ ID NO: 9224610 - DNA, 22 bp, Homo sapiens
tctggcagaggaaggaggcctg

SEQ ID NO: 9224611 - DNA, 22 bp, Homo sapiens
tctggcagaggaaggaggcctg

SEQ ID NO: 9224612 - DNA, 22 bp, Homo sapiens
tctggcagaagtgctgtcagta

SEQ ID NO: 9224613 - DNA, 22 bp, Homo sapiens
tctggcaccactgagtctgcag

SEQ ID NO: 9224614 - DNA, 22 bp, Homo sapiens
tctggcagtgaagtcatgaggt

SEQ ID NO: 9224615 - DNA, 22 bp, Homo sapiens
tctggcagggtgtgtatttaca

SEQ ID NO: 9224616 - DNA, 22 bp, Homo sapiens
tctggcatcactcgcaagagca

SEQ ID NO: 9224617 - DNA, 22 bp, Homo sapiens
tctggccacccgaggcccctgc

SEQ ID NO: 9224618 - DNA, 22 bp, Homo sapiens
tctggcagtgatttctgtgatc

SEQ ID NO: 9224619 - DNA, 22 bp, Homo sapiens
tctggcagttgccgcttcagtc

SEQ ID NO: 9224620 - DNA, 22 bp, Homo sapiens
tctggcccagcccctgatccca

SEQ ID NO: 9224621 - DNA, 22 bp, Homo sapiens
tctggcccagcccctgaggtca

SEQ ID NO: 9224622 - DNA, 22 bp, Homo sapiens
tctggcccagcccctgaggtca

SEQ ID NO: 9224623 - DNA, 22 bp, Homo sapiens
tctggatctccctcatcctggg

SEQ ID NO: 9224624 - DNA, 22 bp, Homo sapiens
tctggagcaacagagcaggaca

SEQ ID NO: 9224625 - DNA, 21 bp, Homo sapiens
tctggagccctaagctgagaa

SEQ ID NO: 9224626 - DNA, 22 bp, Homo sapiens
tctggaggggtttagagggaca

SEQ ID NO: 9224627 - DNA, 22 bp, Homo sapiens
tctggcttttattcagttggca

SEQ ID NO: 9224628 - DNA, 21 bp, Homo sapiens
tctggctttcattccccttct

SEQ ID NO: 9224629 - DNA, 22 bp, Homo sapiens
tctggctttctcagcatggcat

SEQ ID NO: 9224630 - DNA, 22 bp, Homo sapiens
tctggctttcatttgtttaaag

SEQ ID NO: 9224631 - DNA, 22 bp, Homo sapiens
tctggctttcctggagcaagaa

SEQ ID NO: 9224632 - DNA, 22 bp, Homo sapiens
tctggctgggtgagagcttctc

SEQ ID NO: 9224633 - DNA, 22 bp, Homo sapiens
tctggctccactctgtgcatgc

SEQ ID NO: 9224634 - DNA, 23 bp, Homo sapiens
tctggctccatccttggggatcc

SEQ ID NO: 9224635 - DNA, 22 bp, Homo sapiens
tctggcccctggtctctggtgt

SEQ ID NO: 9224636 - DNA, 22 bp, Homo sapiens
tctggcccctggtctctggtgt

SEQ ID NO: 9224637 - DNA, 22 bp, Homo sapiens
tctggccctatggcatgtacct

SEQ ID NO: 9224638 - DNA, 22 bp, Homo sapiens
tctggccccgcatgcactttat

SEQ ID NO: 9224639 - DNA, 22 bp, Homo sapiens
tctggcccatgatcctgctaac

SEQ ID NO: 9224640 - DNA, 22 bp, Homo sapiens
tctggccccggtcttcacagct

SEQ ID NO: 9224641 - DNA, 22 bp, Homo sapiens
tctggctctttgggtgattgta

SEQ ID NO: 9224642 - DNA, 22 bp, Homo sapiens
tctggctgaaaggggctgtgcc

SEQ ID NO: 9224643 - DNA, 22 bp, Homo sapiens
tctggctctgacactactgtta

SEQ ID NO: 9224644 - DNA, 22 bp, Homo sapiens
tctggctcctggctccactgcc

SEQ ID NO: 9224645 - DNA, 22 bp, Homo sapiens
tctggctcggatttgtctagca

SEQ ID NO: 9224646 - DNA, 22 bp, Homo sapiens
tctggctctaactaggcatcag

SEQ ID NO: 9224647 - DNA, 22 bp, Homo sapiens
tctgggaggtcacattggtctt

SEQ ID NO: 9224648 - DNA, 22 bp, Homo sapiens
tctgggaggtactgggaggtgt

SEQ ID NO: 9224649 - DNA, 22 bp, Homo sapiens
tctgggagggagcctcagaatc

SEQ ID NO: 9224650 - DNA, 22 bp, Homo sapiens
tctgggaggtggcagggtgcat

SEQ ID NO: 9224651 - DNA, 22 bp, Homo sapiens
tctgggagttgtagtccggtgg

SEQ ID NO: 9224652 - DNA, 22 bp, Homo sapiens
tctgggagaagctgatgtgaag

SEQ ID NO: 9224653 - DNA, 22 bp, Homo sapiens
tctgggctcttagtgtaccctc

SEQ ID NO: 9224654 - DNA, 21 bp, Homo sapiens
tctgggcccatgctgcctcac

SEQ ID NO: 9224655 - DNA, 23 bp, Homo sapiens
tctgggccacttgtctgcacttc

SEQ ID NO: 9224656 - DNA, 21 bp, Homo sapiens
tctgggctgctgctgcccatc

SEQ ID NO: 9224657 - DNA, 21 bp, Homo sapiens
tctgggctgctgctgcccatc

SEQ ID NO: 9224658 - DNA, 22 bp, Homo sapiens
tctgggctgctgtgcagtgacc

SEQ ID NO: 9224659 - DNA, 22 bp, Homo sapiens
tctgggctgctatgaggcagag

SEQ ID NO: 9224660 - DNA, 22 bp, Homo sapiens
tctgggctgctatgaggcagag

SEQ ID NO: 9224661 - DNA, 22 bp, Homo sapiens
tctgggctgctatgaggcagag

SEQ ID NO: 9224662 - DNA, 22 bp, Homo sapiens
tctgggctgaaatgaaggcctt

SEQ ID NO: 9224663 - DNA, 23 bp, Homo sapiens
tctgggctgagacttggaaggtc

SEQ ID NO: 9224664 - DNA, 23 bp, Homo sapiens
tctgggctgagctcgagtgtaga

SEQ ID NO: 9224665 - DNA, 22 bp, Homo sapiens
tctgggatgagatcagagacac

SEQ ID NO: 9224666 - DNA, 22 bp, Homo sapiens
tctgggattttatagacatgct

SEQ ID NO: 9224667 - DNA, 22 bp, Homo sapiens
tctgggatgcaaacagaatctg

SEQ ID NO: 9224668 - DNA, 22 bp, Homo sapiens
tctgggagtttctgtgggagct

SEQ ID NO: 9224669 - DNA, 22 bp, Homo sapiens
tctgggatagggccagaacatg

SEQ ID NO: 9224670 - DNA, 22 bp, Homo sapiens
tctgggcactgctgagcctgta

SEQ ID NO: 9224671 - DNA, 22 bp, Homo sapiens
tctgggatgaagccagaaactt

SEQ ID NO: 9224672 - DNA, 19 bp, Homo sapiens
tctgggcagggccagcacc

SEQ ID NO: 9224673 - DNA, 22 bp, Homo sapiens
tctgggcagcctcaggccaggg

SEQ ID NO: 9224674 - DNA, 22 bp, Homo sapiens
tctgggcagcagcagctagtag

SEQ ID NO: 9224675 - DNA, 22 bp, Homo sapiens
tctgggcagccatgtgcctggc

SEQ ID NO: 9224676 - DNA, 18 bp, Homo sapiens
tctgcactcctgagagag

SEQ ID NO: 9224677 - DNA, 20 bp, Homo sapiens
tctgcactcctgcatgtgcc

SEQ ID NO: 9224678 - DNA, 22 bp, Homo sapiens
tctgcaccctgtggtcctctag

SEQ ID NO: 9224679 - DNA, 22 bp, Homo sapiens
tctgcacccttctgggttggaa

SEQ ID NO: 9224680 - DNA, 22 bp, Homo sapiens
tctgcaccccgcagggtcaggt

SEQ ID NO: 9224681 - DNA, 22 bp, Homo sapiens
tctgcagatttatcagcagctg

SEQ ID NO: 9224682 - DNA, 22 bp, Homo sapiens
tctgcacataggtaggctggaa

SEQ ID NO: 9224683 - DNA, 22 bp, Homo sapiens
tctgcacaggagggccgtggtg

SEQ ID NO: 9224684 - DNA, 21 bp, Homo sapiens
tctgcacagccccgcaggagg

SEQ ID NO: 9224685 - DNA, 22 bp, Homo sapiens
tctgcacaccgccaggctgact

SEQ ID NO: 9224686 - DNA, 22 bp, Homo sapiens
tctgcaggaaaaaagtgcctgg

SEQ ID NO: 9224687 - DNA, 22 bp, Homo sapiens
tctgcaggatgcaaagtgtaca

SEQ ID NO: 9224688 - DNA, 22 bp, Homo sapiens
tctgcaggcatttttggttgtc

SEQ ID NO: 9224689 - DNA, 22 bp, Homo sapiens
tctgcaggagagtgccctagag

SEQ ID NO: 9224690 - DNA, 22 bp, Homo sapiens
tctgcaggagcagggcgtggag

SEQ ID NO: 9224691 - DNA, 22 bp, Homo sapiens
tctgcaggatcagagccagagg

SEQ ID NO: 9224692 - DNA, 22 bp, Homo sapiens
tctgcaggaggctggctgcagg

SEQ ID NO: 9224693 - DNA, 22 bp, Homo sapiens
tctgcaggcttggagtggcagc

SEQ ID NO: 9224694 - DNA, 22 bp, Homo sapiens
tctgcaggcttggagtggcagc

SEQ ID NO: 9224695 - DNA, 22 bp, Homo sapiens
tctgcaggctctagatgaggtt

SEQ ID NO: 9224696 - DNA, 22 bp, Homo sapiens
tctgcaggcttataggatgggt

SEQ ID NO: 9224697 - DNA, 22 bp, Homo sapiens
tctgcagggtcccagcctcagc

SEQ ID NO: 9224698 - DNA, 22 bp, Homo sapiens
tctgcaggtagagctcaggaat

SEQ ID NO: 9224699 - DNA, 17 bp, Homo sapiens
tctgcagggggccgtgt

SEQ ID NO: 9224700 - DNA, 22 bp, Homo sapiens
tctgcagggatgtgaggggtga

SEQ ID NO: 9224701 - DNA, 22 bp, Homo sapiens
tctgcagggcccttggctcctg

SEQ ID NO: 9224702 - DNA, 22 bp, Homo sapiens
tctgcaggtagagctcaggaat

SEQ ID NO: 9224703 - DNA, 22 bp, Homo sapiens
tctgcaggtcacgctccagcct

SEQ ID NO: 9224704 - DNA, 22 bp, Homo sapiens
tctgcaggtgggcccctagaat

SEQ ID NO: 9224705 - DNA, 22 bp, Homo sapiens
tctgcaggtgttggaagggtca

SEQ ID NO: 9224706 - DNA, 22 bp, Homo sapiens
tctgcatattgttaatggaatg

SEQ ID NO: 9224707 - DNA, 22 bp, Homo sapiens
tctgccagtttatagacaagcc

SEQ ID NO: 9224708 - DNA, 23 bp, Homo sapiens
tctgccagtgtgtgccaggagcc

SEQ ID NO: 9224709 - DNA, 23 bp, Homo sapiens
tctgccagtgtgtgccaggagcc

SEQ ID NO: 9224710 - DNA, 22 bp, Homo sapiens
tctgccaggccacacagggcac

SEQ ID NO: 9224711 - DNA, 22 bp, Homo sapiens
tctgccaggcctgcttccgggg

SEQ ID NO: 9224712 - DNA, 22 bp, Homo sapiens
tctgccaggtggggagaggcca

SEQ ID NO: 9224713 - DNA, 22 bp, Homo sapiens
tctgccagtggtttggccctga

SEQ ID NO: 9224714 - DNA, 22 bp, Homo sapiens
tctgccaggtggggagaggcca

SEQ ID NO: 9224715 - DNA, 22 bp, Homo sapiens
tctgcctgctgcctgggggctc

SEQ ID NO: 9224716 - DNA, 22 bp, Homo sapiens
tctgcctgcttcttcatagtct

SEQ ID NO: 9224717 - DNA, 19 bp, Homo sapiens
tctgcctgcttgtaggggc

SEQ ID NO: 9224718 - DNA, 22 bp, Homo sapiens
tctgcctggagagttcttctct

SEQ ID NO: 9224719 - DNA, 22 bp, Homo sapiens
tctgcctgcggctgcaggtggc

SEQ ID NO: 9224720 - DNA, 22 bp, Homo sapiens
tctgcctgcggctgcaggtggc

SEQ ID NO: 9224721 - DNA, 22 bp, Homo sapiens
tctgcctgcggctgcaggtggc

SEQ ID NO: 9224722 - DNA, 22 bp, Homo sapiens
tctgcctgcgctcacggggccg

SEQ ID NO: 9224723 - DNA, 22 bp, Homo sapiens
tctgcctgcgctcacggggccg

SEQ ID NO: 9224724 - DNA, 22 bp, Homo sapiens
tctgcctggatgatggcagggc

SEQ ID NO: 9224725 - DNA, 22 bp, Homo sapiens
tctgcctggatgatggcagggc

SEQ ID NO: 9224726 - DNA, 22 bp, Homo sapiens
tctgcctggatgatggcagggc

SEQ ID NO: 9224727 - DNA, 22 bp, Homo sapiens
tctgcctggattccattctcca

SEQ ID NO: 9224728 - DNA, 22 bp, Homo sapiens
tctgcctggattttggaaagct

SEQ ID NO: 9224729 - DNA, 22 bp, Homo sapiens
tctgcctggcctggagggcaca

SEQ ID NO: 9224730 - DNA, 22 bp, Homo sapiens
tctgcctggcctggagggcaca

SEQ ID NO: 9224731 - DNA, 22 bp, Homo sapiens
tctgcctggcctggagggcaca

SEQ ID NO: 9224732 - DNA, 22 bp, Homo sapiens
tctgcctgtacctcttttttgc

SEQ ID NO: 9224733 - DNA, 22 bp, Homo sapiens
tctgcctgggtgtggagcagag

SEQ ID NO: 9224734 - DNA, 22 bp, Homo sapiens
tctgcctggctcatggcagtga

SEQ ID NO: 9224735 - DNA, 22 bp, Homo sapiens
tctgcctggctcatggcagtga

SEQ ID NO: 9224736 - DNA, 22 bp, Homo sapiens
tctgcctgtggtggaggaagtt

SEQ ID NO: 9224737 - DNA, 22 bp, Homo sapiens
tctgcctgtggtggaggaagtt

SEQ ID NO: 9224738 - DNA, 22 bp, Homo sapiens
tctgcctgttcaagtcttctag

SEQ ID NO: 9224739 - DNA, 22 bp, Homo sapiens
tctgcctgtggtggaggaagtt

SEQ ID NO: 9224740 - DNA, 22 bp, Homo sapiens
tctgcctgtggatacatgctct

SEQ ID NO: 9224741 - DNA, 22 bp, Homo sapiens
tctgcctgtgctgtgttttcat

SEQ ID NO: 9224742 - DNA, 22 bp, Homo sapiens
tctgcctgttgagcctaaggcc

SEQ ID NO: 9224743 - DNA, 22 bp, Homo sapiens
tctgcctgttgagcctaaggcc

SEQ ID NO: 9224744 - DNA, 22 bp, Homo sapiens
tctgcctgttgctagaatgtca

SEQ ID NO: 9224745 - DNA, 22 bp, Homo sapiens
tctgcctgttgctagaatgtca

SEQ ID NO: 9224746 - DNA, 22 bp, Homo sapiens
tctgcctgttgagcctaaggcc

SEQ ID NO: 9224747 - DNA, 22 bp, Homo sapiens
tctgctcactattacatggaca

SEQ ID NO: 9224748 - DNA, 22 bp, Homo sapiens
tctgctcaccctcagctgatgc

SEQ ID NO: 9224749 - DNA, 22 bp, Homo sapiens
tctgctcagggagggtcactac

SEQ ID NO: 9224750 - DNA, 22 bp, Homo sapiens
tctgcctgagcagagggaggcc

SEQ ID NO: 9224751 - DNA, 22 bp, Homo sapiens
tctgcctgagcagagggaggcc

SEQ ID NO: 9224752 - DNA, 22 bp, Homo sapiens
tctgcctgagcagagggaggcc

SEQ ID NO: 9224753 - DNA, 22 bp, Homo sapiens
tctgcccttggctctcttgttg

SEQ ID NO: 9224754 - DNA, 22 bp, Homo sapiens
tctgccctggggtcagcctcca

SEQ ID NO: 9224755 - DNA, 22 bp, Homo sapiens
tctgcctgcagtgtggcagggc

SEQ ID NO: 9224756 - DNA, 22 bp, Homo sapiens
tctgcctgcagtgtggcagggc

SEQ ID NO: 9224757 - DNA, 22 bp, Homo sapiens
tctgcctgcagtgtggcagggc

SEQ ID NO: 9224758 - DNA, 22 bp, Homo sapiens
tctgcctgccgagaacacctac

SEQ ID NO: 9224759 - DNA, 22 bp, Homo sapiens
tctgcctgccagtctggtcctc

SEQ ID NO: 9224760 - DNA, 22 bp, Homo sapiens
tctgcctgagggagctgaggaa

SEQ ID NO: 9224761 - DNA, 18 bp, Homo sapiens
tctgcctgcagggcatct

SEQ ID NO: 9224762 - DNA, 18 bp, Homo sapiens
tctgcctgcagggcatct

SEQ ID NO: 9224763 - DNA, 22 bp, Homo sapiens
tctgcctgagggagctgaggaa

SEQ ID NO: 9224764 - DNA, 22 bp, Homo sapiens
tctgcctgagggagctgaggaa

SEQ ID NO: 9224765 - DNA, 22 bp, Homo sapiens
tctgcctgagcagagggaggcc

SEQ ID NO: 9224766 - DNA, 22 bp, Homo sapiens
tctgccctcattgctgcctgga

SEQ ID NO: 9224767 - DNA, 22 bp, Homo sapiens
tctgcccaggacacctgccact

SEQ ID NO: 9224768 - DNA, 22 bp, Homo sapiens
tctgcccaggaggtcccatggg

SEQ ID NO: 9224769 - DNA, 21 bp, Homo sapiens
tctgatggtagatgagatgtg

SEQ ID NO: 9224770 - DNA, 21 bp, Homo sapiens
tctgatggtagatgagatgtg

SEQ ID NO: 9224771 - DNA, 22 bp, Homo sapiens
tctgatatttgaagaccattag

SEQ ID NO: 9224772 - DNA, 22 bp, Homo sapiens
tctgcaacagtgccctgtaaat

SEQ ID NO: 9224773 - DNA, 22 bp, Homo sapiens
tctgcaaactggctcttactgc

SEQ ID NO: 9224774 - DNA, 22 bp, Homo sapiens
tctgcaagatcattaaagcaga

SEQ ID NO: 9224775 - DNA, 22 bp, Homo sapiens
tctgcaagcgtcacatgattct

SEQ ID NO: 9224776 - DNA, 23 bp, Homo sapiens
tctgcaagataatgaagatgata

SEQ ID NO: 9224777 - DNA, 22 bp, Homo sapiens
tctgcaacattcctctccccac

SEQ ID NO: 9224778 - DNA, 22 bp, Homo sapiens
tctgaggctaagagacagaggc

SEQ ID NO: 9224779 - DNA, 22 bp, Homo sapiens
tctgaggccttgggacagaagt

SEQ ID NO: 9224780 - DNA, 22 bp, Homo sapiens
tctgaggccttgggacagaagt

SEQ ID NO: 9224781 - DNA, 22 bp, Homo sapiens
tctgaggccttcagcatgaatc

SEQ ID NO: 9224782 - DNA, 22 bp, Homo sapiens
tctgaggcctgaagcagcagag

SEQ ID NO: 9224783 - DNA, 22 bp, Homo sapiens
tctgaggccctgcaggcagtgt

SEQ ID NO: 9224784 - DNA, 22 bp, Homo sapiens
tctgagctttagctgggatttt

SEQ ID NO: 9224785 - DNA, 22 bp, Homo sapiens
tctgaggccctaccctgagcct

SEQ ID NO: 9224786 - DNA, 22 bp, Homo sapiens
tctgaggctgcatctatgtgac

SEQ ID NO: 9224787 - DNA, 22 bp, Homo sapiens
tctgaggcttcagactgtactg

SEQ ID NO: 9224788 - DNA, 22 bp, Homo sapiens
tctgaggctgtctctgggctcc

SEQ ID NO: 9224789 - DNA, 19 bp, Homo sapiens
tctgaggcttctccccttg

SEQ ID NO: 9224790 - DNA, 22 bp, Homo sapiens
tctgagcagagcatcatttcag

SEQ ID NO: 9224791 - DNA, 22 bp, Homo sapiens
tctgagcaccttatattcttga

SEQ ID NO: 9224792 - DNA, 22 bp, Homo sapiens
tctgagccaatttctgtgtcca

SEQ ID NO: 9224793 - DNA, 22 bp, Homo sapiens
tctgagccacctgagcccatgg

SEQ ID NO: 9224794 - DNA, 22 bp, Homo sapiens
tctgagcccagtgagtctcgca

SEQ ID NO: 9224795 - DNA, 22 bp, Homo sapiens
tctgagccagacaagacagcca

SEQ ID NO: 9224796 - DNA, 22 bp, Homo sapiens
tctgagctggagcccatcacct

SEQ ID NO: 9224797 - DNA, 22 bp, Homo sapiens
tctgagctggagcccatcacct

SEQ ID NO: 9224798 - DNA, 22 bp, Homo sapiens
tctgagctgggcacagaaggcg

SEQ ID NO: 9224799 - DNA, 22 bp, Homo sapiens
tctgagctgggcacagaaggcg

SEQ ID NO: 9224800 - DNA, 22 bp, Homo sapiens
tctgagctgtggccattcttcc

SEQ ID NO: 9224801 - DNA, 23 bp, Homo sapiens
tctgagctgtcttttcagcagaa

SEQ ID NO: 9224802 - DNA, 22 bp, Homo sapiens
tctgagcttctgcatttccaac

SEQ ID NO: 9224803 - DNA, 21 bp, Homo sapiens
tctgagctgagtcctctaggt

SEQ ID NO: 9224804 - DNA, 22 bp, Homo sapiens
tctgagctgcagagtggggtgg

SEQ ID NO: 9224805 - DNA, 22 bp, Homo sapiens
tctgagctctatctgtgggaat

SEQ ID NO: 9224806 - DNA, 22 bp, Homo sapiens
tctgagctccatgcaggaggct

SEQ ID NO: 9224807 - DNA, 22 bp, Homo sapiens
tctgagctacgatgcctgtcac

SEQ ID NO: 9224808 - DNA, 22 bp, Homo sapiens
tctgagctaatcctgttgccga

SEQ ID NO: 9224809 - DNA, 23 bp, Homo sapiens
tctgaccatttgacaacatcctg

SEQ ID NO: 9224810 - DNA, 23 bp, Homo sapiens
tctgaccaagttttgcatgccac

SEQ ID NO: 9224811 - DNA, 22 bp, Homo sapiens
tctgaccacagacaacctgcta

SEQ ID NO: 9224812 - DNA, 22 bp, Homo sapiens
tctgagaaatcagtggtgaata

SEQ ID NO: 9224813 - DNA, 22 bp, Homo sapiens
tctgacttttctcactgttgtg

SEQ ID NO: 9224814 - DNA, 21 bp, Homo sapiens
tctgagaacttctgctgcagc

SEQ ID NO: 9224815 - DNA, 17 bp, Homo sapiens
tctgagaatgctggagg

SEQ ID NO: 9224816 - DNA, 22 bp, Homo sapiens
tctgtgtctggttgggccagta

SEQ ID NO: 9224817 - DNA, 22 bp, Homo sapiens
tctgtgggcatttataatctgg

SEQ ID NO: 9224818 - DNA, 19 bp, Homo sapiens
tctgtgctgggaggcagca

SEQ ID NO: 9224819 - DNA, 22 bp, Homo sapiens
tctgtggagtgacctgggcttt

SEQ ID NO: 9224820 - DNA, 22 bp, Homo sapiens
tctgtggagttgaggaaggttg

SEQ ID NO: 9224821 - DNA, 22 bp, Homo sapiens
tctgtctgccttgtgagggcac

SEQ ID NO: 9224822 - DNA, 22 bp, Homo sapiens
tctgtctttgtcaggaccagag

SEQ ID NO: 9224823 - DNA, 17 bp, Homo sapiens
tctgtgatagtgtagat

SEQ ID NO: 9224824 - DNA, 22 bp, Homo sapiens
tctgtgacttacaagaagggac

SEQ ID NO: 9224825 - DNA, 22 bp, Homo sapiens
tctgtgacttgcgggaggagaa

SEQ ID NO: 9224826 - DNA, 22 bp, Homo sapiens
tctgtgaatgtgaccttatttg

SEQ ID NO: 9224827 - DNA, 22 bp, Homo sapiens
tctgtgaacatcacattgacag

SEQ ID NO: 9224828 - DNA, 22 bp, Homo sapiens
tctgtgcctttaagaagctcat

SEQ ID NO: 9224829 - DNA, 23 bp, Homo sapiens
tctgtgccagtttccatgtctgt

SEQ ID NO: 9224830 - DNA, 23 bp, Homo sapiens
tctgtgccagtttccatgtctgt

SEQ ID NO: 9224831 - DNA, 22 bp, Homo sapiens
tctgtgccaagcttatatctgt

SEQ ID NO: 9224832 - DNA, 22 bp, Homo sapiens
tcttaagcagagaagaagttga

SEQ ID NO: 9224833 - DNA, 22 bp, Homo sapiens
tcttaagcagagaagaagttga

SEQ ID NO: 9224834 - DNA, 20 bp, Homo sapiens
tctgtgtgccatcacctaac

SEQ ID NO: 9224835 - DNA, 22 bp, Homo sapiens
tctgtgtgaccataagccagct

SEQ ID NO: 9224836 - DNA, 22 bp, Homo sapiens
tctgtgtgggatagtttgagga

SEQ ID NO: 9224837 - DNA, 22 bp, Homo sapiens
tctgtgtgttgtcaggaggatt

SEQ ID NO: 9224838 - DNA, 22 bp, Homo sapiens
tctgtgttgataattttggaga

SEQ ID NO: 9224839 - DNA, 22 bp, Homo sapiens
tctgttgcaatgtgcatggtga

SEQ ID NO: 9224840 - DNA, 22 bp, Homo sapiens
tctgttgactcctagcagccat

SEQ ID NO: 9224841 - DNA, 22 bp, Homo sapiens
tctgtctgactaccatgaggca

SEQ ID NO: 9224842 - DNA, 22 bp, Homo sapiens
tctgtcatgtttccattacatg

SEQ ID NO: 9224843 - DNA, 22 bp, Homo sapiens
tctgtcatctgttcagtgctca

SEQ ID NO: 9224844 - DNA, 22 bp, Homo sapiens
tctgtcatctgtaacaggaggg

SEQ ID NO: 9224845 - DNA, 22 bp, Homo sapiens
tctgtcattttgtatctacatg

SEQ ID NO: 9224846 - DNA, 22 bp, Homo sapiens
tctgtccagaacgtacatcttg

SEQ ID NO: 9224847 - DNA, 22 bp, Homo sapiens
tctgtagtaggttgtagttctt

SEQ ID NO: 9224848 - DNA, 23 bp, Homo sapiens
tctgtaggcagcatgccactctc

SEQ ID NO: 9224849 - DNA, 22 bp, Homo sapiens
tctgtataaggacaaacattta

SEQ ID NO: 9224850 - DNA, 22 bp, Homo sapiens
tctgtattctatggcagttggt

SEQ ID NO: 9224851 - DNA, 22 bp, Homo sapiens
tctgtattctatggcagttggt

SEQ ID NO: 9224852 - DNA, 22 bp, Homo sapiens
tctgtcaaggcaactgcatttt

SEQ ID NO: 9224853 - DNA, 22 bp, Homo sapiens
tctgtattttaagatgctgttt

SEQ ID NO: 9224854 - DNA, 22 bp, Homo sapiens
tctgtattgattctgttaggca

SEQ ID NO: 9224855 - DNA, 22 bp, Homo sapiens
tctgtcacccaggctggagtgc

SEQ ID NO: 9224856 - DNA, 22 bp, Homo sapiens
tctgtaaagactccaaaagcca

SEQ ID NO: 9224857 - DNA, 22 bp, Homo sapiens
tctgtacatgagttgagaatca

SEQ ID NO: 9224858 - DNA, 23 bp, Homo sapiens
tctgtacaattgagaagagaaca

SEQ ID NO: 9224859 - DNA, 22 bp, Homo sapiens
tctgtaaaacttctttgtaaat

SEQ ID NO: 9224860 - DNA, 22 bp, Homo sapiens
tctgggggttaagtgaggacaa

SEQ ID NO: 9224861 - DNA, 22 bp, Homo sapiens
tctgggggttaagtgaggacaa

SEQ ID NO: 9224862 - DNA, 22 bp, Homo sapiens
tctgggtaataggaagtgcagt

SEQ ID NO: 9224863 - DNA, 22 bp, Homo sapiens
tctgggtcactgtgggagggca

SEQ ID NO: 9224864 - DNA, 19 bp, Homo sapiens
tctgggtatttggaagatg

SEQ ID NO: 9224865 - DNA, 22 bp, Homo sapiens
tctgggtccccgaggaaggaga

SEQ ID NO: 9224866 - DNA, 22 bp, Homo sapiens
tctgggtcatgactcagcgtga

SEQ ID NO: 9224867 - DNA, 22 bp, Homo sapiens
tctgggtctcagagtgaccatg

SEQ ID NO: 9224868 - DNA, 22 bp, Homo sapiens
tctgggtctggctgctggtgca

SEQ ID NO: 9224869 - DNA, 22 bp, Homo sapiens
tctgggtctttacccatggaat

SEQ ID NO: 9224870 - DNA, 22 bp, Homo sapiens
tctgggtctatgatctcacttc

SEQ ID NO: 9224871 - DNA, 22 bp, Homo sapiens
tctgggtccgggactgtggatg

SEQ ID NO: 9224872 - DNA, 22 bp, Homo sapiens
tctgggtctatcccatgccttt

SEQ ID NO: 9224873 - DNA, 17 bp, Homo sapiens
tctgggcttcagtggtc

SEQ ID NO: 9224874 - DNA, 22 bp, Homo sapiens
tctgggctgtgggaattcaaca

SEQ ID NO: 9224875 - DNA, 22 bp, Homo sapiens
tctgggctgtgccaaagctctt

SEQ ID NO: 9224876 - DNA, 22 bp, Homo sapiens
tctgggctgtgccaaagctctt

SEQ ID NO: 9224877 - DNA, 22 bp, Homo sapiens
tctgggctgtggttccactccg

SEQ ID NO: 9224878 - DNA, 22 bp, Homo sapiens
tctgggcttggattggctctgc

SEQ ID NO: 9224879 - DNA, 22 bp, Homo sapiens
tctgggcttgcctggttgtgca

SEQ ID NO: 9224880 - DNA, 20 bp, Homo sapiens
tctgggcttcccccagctcc

SEQ ID NO: 9224881 - DNA, 20 bp, Homo sapiens
tctgggcttcccccagctcc

SEQ ID NO: 9224882 - DNA, 18 bp, Homo sapiens
tctgggcttcccgaggct

SEQ ID NO: 9224883 - DNA, 18 bp, Homo sapiens
tctgggcttcccgaggct

SEQ ID NO: 9224884 - DNA, 22 bp, Homo sapiens
tctgggctgtctacaggttggc

SEQ ID NO: 9224885 - DNA, 22 bp, Homo sapiens
tctgggctgtctacaggttggc

SEQ ID NO: 9224886 - DNA, 15 bp, Homo sapiens
tctgggctgtgagca

SEQ ID NO: 9224887 - DNA, 22 bp, Homo sapiens
tctgggctgtctacaggttggc

SEQ ID NO: 9224888 - DNA, 22 bp, Homo sapiens
tctgggctggttgtgcttgctt

SEQ ID NO: 9224889 - DNA, 22 bp, Homo sapiens
tctgggctggttgtgcttgctt

SEQ ID NO: 9224890 - DNA, 22 bp, Homo sapiens
tctgggctggtgctcatgaatt

SEQ ID NO: 9224891 - DNA, 22 bp, Homo sapiens
tctgggctggctttatgctgac

SEQ ID NO: 9224892 - DNA, 22 bp, Homo sapiens
tctgggctggctttatgctgac

SEQ ID NO: 9224893 - DNA, 22 bp, Homo sapiens
tctgggctgcttcagccttcgc

SEQ ID NO: 9224894 - DNA, 22 bp, Homo sapiens
tctgggctgcttcagccttcgc

SEQ ID NO: 9224895 - DNA, 23 bp, Homo sapiens
tctgggctgcttaaggatcaagg

SEQ ID NO: 9224896 - DNA, 22 bp, Homo sapiens
tctgggctgggagcgtgtggac

SEQ ID NO: 9224897 - DNA, 22 bp, Homo sapiens
tctgggctgggcttaggaaccc

SEQ ID NO: 9224898 - DNA, 22 bp, Homo sapiens
tctgggcttggattggctctgc

SEQ ID NO: 9224899 - DNA, 22 bp, Homo sapiens
tctgggcttgggtagaaatcac

SEQ ID NO: 9224900 - DNA, 22 bp, Homo sapiens
tctgggctttaagaactctgtt

SEQ ID NO: 9224901 - DNA, 22 bp, Homo sapiens
tctgggcttggttagggctgtt

SEQ ID NO: 9224902 - DNA, 22 bp, Homo sapiens
tctgggcttggttagggctgtt

SEQ ID NO: 9224903 - DNA, 22 bp, Homo sapiens
tctgggctttacactgtgctta

SEQ ID NO: 9224904 - DNA, 22 bp, Homo sapiens
tctgggctttacactgtgctta

SEQ ID NO: 9224905 - DNA, 22 bp, Homo sapiens
tctgggctttagtttgttatct

SEQ ID NO: 9224906 - DNA, 22 bp, Homo sapiens
tctgggctttaagaactctgtt

SEQ ID NO: 9224907 - DNA, 22 bp, Homo sapiens
tctgggctttgtaatgggaggt

SEQ ID NO: 9224908 - DNA, 22 bp, Homo sapiens
tctgggcttgggtagaaatcac

SEQ ID NO: 9224909 - DNA, 21 bp, Homo sapiens
tctgggctttcttataaggca

SEQ ID NO: 9224910 - DNA, 22 bp, Homo sapiens
tctggggcagttactggggcct

SEQ ID NO: 9224911 - DNA, 22 bp, Homo sapiens
tctgggggcgaccagggactgc

SEQ ID NO: 9224912 - DNA, 20 bp, Homo sapiens
tctggggatgaggtctagga

SEQ ID NO: 9224913 - DNA, 22 bp, Homo sapiens
tctgggcttttccatgcctgtg

SEQ ID NO: 9224914 - DNA, 22 bp, Homo sapiens
tcttccagctcatattctatca

SEQ ID NO: 9224915 - DNA, 22 bp, Homo sapiens
tcttccagctccccacggtgtc

SEQ ID NO: 9224916 - DNA, 22 bp, Homo sapiens
tcttccagcccttctaatggta

SEQ ID NO: 9224917 - DNA, 22 bp, Homo sapiens
tcttccagccaatagcgtcctt

SEQ ID NO: 9224918 - DNA, 22 bp, Homo sapiens
tcttccagccaatagcgtcctt

SEQ ID NO: 9224919 - DNA, 19 bp, Homo sapiens
tcttccagcatctgggggc

SEQ ID NO: 9224920 - DNA, 22 bp, Homo sapiens
tcttccagcaatgtgaaatcac

SEQ ID NO: 9224921 - DNA, 22 bp, Homo sapiens
tcttccagcaatgtgaaatcac

SEQ ID NO: 9224922 - DNA, 20 bp, Homo sapiens
tcttccagagacattttccc

SEQ ID NO: 9224923 - DNA, 22 bp, Homo sapiens
tcttccagagcctccatcccta

SEQ ID NO: 9224924 - DNA, 22 bp, Homo sapiens
tcttccagagcctccatcccta

SEQ ID NO: 9224925 - DNA, 22 bp, Homo sapiens
tcttccagatacttcctgactt

SEQ ID NO: 9224926 - DNA, 22 bp, Homo sapiens
tcttccagatgcagatgcttct

SEQ ID NO: 9224927 - DNA, 22 bp, Homo sapiens
tcttccagaagtgttttcagaa

SEQ ID NO: 9224928 - DNA, 22 bp, Homo sapiens
tcttccagaatctcagagggct

SEQ ID NO: 9224929 - DNA, 22 bp, Homo sapiens
tcttccagaatgcattctcttt

SEQ ID NO: 9224930 - DNA, 22 bp, Homo sapiens
tcttccagaatgcattctcttt

SEQ ID NO: 9224931 - DNA, 22 bp, Homo sapiens
tcttccagaatgcattctcttt

SEQ ID NO: 9224932 - DNA, 22 bp, Homo sapiens
tcttccaattagaatatttggg

SEQ ID NO: 9224933 - DNA, 22 bp, Homo sapiens
tcttccaatggtttctagattt

SEQ ID NO: 9224934 - DNA, 18 bp, Homo sapiens
tcttccaacactgacacc

SEQ ID NO: 9224935 - DNA, 18 bp, Homo sapiens
tcttccaacactgacacc

SEQ ID NO: 9224936 - DNA, 21 bp, Homo sapiens
tcttccaagggctgctgagac

SEQ ID NO: 9224937 - DNA, 22 bp, Homo sapiens
tcttccaaatgcagctaaagct

SEQ ID NO: 9224938 - DNA, 22 bp, Homo sapiens
tcttccaaaattagtctcagtt

SEQ ID NO: 9224939 - DNA, 22 bp, Homo sapiens
tcttcaggctctggctgccttt

SEQ ID NO: 9224940 - DNA, 22 bp, Homo sapiens
tcttcaggaagggaaatcatcc

SEQ ID NO: 9224941 - DNA, 22 bp, Homo sapiens
tcttcaggagctgaaagcctgc

SEQ ID NO: 9224942 - DNA, 22 bp, Homo sapiens
tcttcatacaatttcagacatc

SEQ ID NO: 9224943 - DNA, 22 bp, Homo sapiens
tcttcacaccgggcagcaggaa

SEQ ID NO: 9224944 - DNA, 22 bp, Homo sapiens
tcttcacagatgcatatacttc

SEQ ID NO: 9224945 - DNA, 22 bp, Homo sapiens
tcttattattgttgtaaaagca

SEQ ID NO: 9224946 - DNA, 22 bp, Homo sapiens
tcttctgtgagaattcaagcaa

SEQ ID NO: 9224947 - DNA, 22 bp, Homo sapiens
tcttctgtgagaattcaagcaa

SEQ ID NO: 9224948 - DNA, 22 bp, Homo sapiens
tcttctggatgagagcggaggc

SEQ ID NO: 9224949 - DNA, 22 bp, Homo sapiens
tcttctccagtgcttctgcaca

SEQ ID NO: 9224950 - DNA, 22 bp, Homo sapiens
tcttctcagtttctctaggatg

SEQ ID NO: 9224951 - DNA, 22 bp, Homo sapiens
tcttctcccatctccaggcagg

SEQ ID NO: 9224952 - DNA, 22 bp, Homo sapiens
tcttcttcctcatttatacata

SEQ ID NO: 9224953 - DNA, 22 bp, Homo sapiens
tcttcttcctcatttatacata

SEQ ID NO: 9224954 - DNA, 22 bp, Homo sapiens
tcttcttcctcatttatacata

SEQ ID NO: 9224955 - DNA, 22 bp, Homo sapiens
tcttcttcctccacagggccca

SEQ ID NO: 9224956 - DNA, 22 bp, Homo sapiens
tcttcttcctcatttatacata

SEQ ID NO: 9224957 - DNA, 22 bp, Homo sapiens
tcttctgttaccacagcgatga

SEQ ID NO: 9224958 - DNA, 22 bp, Homo sapiens
tcttctgttttagattgcatac

SEQ ID NO: 9224959 - DNA, 22 bp, Homo sapiens
tcttctttttgtcccacagaat

SEQ ID NO: 9224960 - DNA, 22 bp, Homo sapiens
tcttcttttatttcaagggtgt

SEQ ID NO: 9224961 - DNA, 22 bp, Homo sapiens
tcttctttggatgaaagaatat

SEQ ID NO: 9224962 - DNA, 22 bp, Homo sapiens
tcttcctgtcaatgagaattaa

SEQ ID NO: 9224963 - DNA, 22 bp, Homo sapiens
tcttccttctttgatgacaagg

SEQ ID NO: 9224964 - DNA, 22 bp, Homo sapiens
tcttcctgctttggtgaggctt

SEQ ID NO: 9224965 - DNA, 22 bp, Homo sapiens
tcttcctggcattgatgctgca

SEQ ID NO: 9224966 - DNA, 22 bp, Homo sapiens
tcttcctggcattgatgctgca

SEQ ID NO: 9224967 - DNA, 22 bp, Homo sapiens
tcttcctgcttggtgtgtctgg

SEQ ID NO: 9224968 - DNA, 22 bp, Homo sapiens
tcttcctgcttggtgtgtctgg

SEQ ID NO: 9224969 - DNA, 22 bp, Homo sapiens
tcttctcaaaaaatgtaggtgg

SEQ ID NO: 9224970 - DNA, 22 bp, Homo sapiens
tcttccttgtaagggctttaga

SEQ ID NO: 9224971 - DNA, 22 bp, Homo sapiens
tcttccttgccttgcttcatca

SEQ ID NO: 9224972 - DNA, 20 bp, Homo sapiens
tcttccagcttctggtagaa

SEQ ID NO: 9224973 - DNA, 22 bp, Homo sapiens
tcttccaggagggcatttcttt

SEQ ID NO: 9224974 - DNA, 22 bp, Homo sapiens
tcttccaggagggcatttcttt

SEQ ID NO: 9224975 - DNA, 22 bp, Homo sapiens
tcttccaggagggtgggcaaac

SEQ ID NO: 9224976 - DNA, 20 bp, Homo sapiens
tcttccagcttctggtagaa

SEQ ID NO: 9224977 - DNA, 22 bp, Homo sapiens
tcttcctccctacagagctcag

SEQ ID NO: 9224978 - DNA, 22 bp, Homo sapiens
tcttcctcttctgctgagaagt

SEQ ID NO: 9224979 - DNA, 22 bp, Homo sapiens
tcttcctgaaaccctgttccag

SEQ ID NO: 9224980 - DNA, 17 bp, Homo sapiens
tctttcctgccatgctc

SEQ ID NO: 9224981 - DNA, 22 bp, Homo sapiens
tctttcctaggtgatatgcaat

SEQ ID NO: 9224982 - DNA, 22 bp, Homo sapiens
tctttccatggccacacagtct

SEQ ID NO: 9224983 - DNA, 19 bp, Homo sapiens
tctttagccagagctctgg

SEQ ID NO: 9224984 - DNA, 20 bp, Homo sapiens
tctttagatttatcttatgt

SEQ ID NO: 9224985 - DNA, 22 bp, Homo sapiens
tcttgaggtcatcatctgaaac

SEQ ID NO: 9224986 - DNA, 22 bp, Homo sapiens
tcttgctagaatcatttggaga

SEQ ID NO: 9224987 - DNA, 22 bp, Homo sapiens
tcttgctaggagctatggaaga

SEQ ID NO: 9224988 - DNA, 19 bp, Homo sapiens
tcttgcttcttcatccctc

SEQ ID NO: 9224989 - DNA, 22 bp, Homo sapiens
tcttgcttctgctcaaggggag

SEQ ID NO: 9224990 - DNA, 22 bp, Homo sapiens
tcttgaaggggggcagtgttga

SEQ ID NO: 9224991 - DNA, 22 bp, Homo sapiens
tcttgacattcaatcatgtata

SEQ ID NO: 9224992 - DNA, 22 bp, Homo sapiens
tcttggccactaccacctggag

SEQ ID NO: 9224993 - DNA, 20 bp, Homo sapiens
tcttggcaaatgggagtgtc

SEQ ID NO: 9224994 - DNA, 18 bp, Homo sapiens
tcttggcagcatctggca

SEQ ID NO: 9224995 - DNA, 22 bp, Homo sapiens
tcttggccaggtgtggtgcctc

SEQ ID NO: 9224996 - DNA, 22 bp, Homo sapiens
tcttggattttaatggatcaaa

SEQ ID NO: 9224997 - DNA, 22 bp, Homo sapiens
tcttggaacttattattgtaga

SEQ ID NO: 9224998 - DNA, 22 bp, Homo sapiens
tcttggaatctccatagagtga

SEQ ID NO: 9224999 - DNA, 22 bp, Homo sapiens
tctttacacaagacaagaataa

SEQ ID NO: 9225000 - DNA, 22 bp, Homo sapiens
tcttgggaaataaacagattga

SEQ ID NO: 9225001 - DNA, 22 bp, Homo sapiens
tcttgggaaatgtttgcgagct

SEQ ID NO: 9225002 - DNA, 22 bp, Homo sapiens
tcttgggagtcccaggacatag

SEQ ID NO: 9225003 - DNA, 22 bp, Homo sapiens
tcttgggaagcccatttccacc

SEQ ID NO: 9225004 - DNA, 22 bp, Homo sapiens
tcttgggaccatttacacatac

SEQ ID NO: 9225005 - DNA, 22 bp, Homo sapiens
tcttgggagctcctttaacctt

SEQ ID NO: 9225006 - DNA, 22 bp, Homo sapiens
tcttgggaggagcacctgcctg

SEQ ID NO: 9225007 - DNA, 22 bp, Homo sapiens
tcttgggcaatttctctagagg

SEQ ID NO: 9225008 - DNA, 22 bp, Homo sapiens
tcttgggattgccctgcagttc

SEQ ID NO: 9225009 - DNA, 22 bp, Homo sapiens
tcttgggatctcttcaccacct

SEQ ID NO: 9225010 - DNA, 22 bp, Homo sapiens
tcttgggatcacctcctggctt

SEQ ID NO: 9225011 - DNA, 21 bp, Homo sapiens
tcttgggataaacttcaagaa

SEQ ID NO: 9225012 - DNA, 22 bp, Homo sapiens
tcttgggatagtgtctcatggc

SEQ ID NO: 9225013 - DNA, 22 bp, Homo sapiens
tcttgggcatgtgtttgatttc

SEQ ID NO: 9225014 - DNA, 22 bp, Homo sapiens
tctctgtggtgggaggctgagt

SEQ ID NO: 9225015 - DNA, 22 bp, Homo sapiens
tctctgggtttttgtcctgtac

SEQ ID NO: 9225016 - DNA, 22 bp, Homo sapiens
tctctgggtttttgtcctgtac

SEQ ID NO: 9225017 - DNA, 22 bp, Homo sapiens
tctctgtctcccgtgtgtccgg

SEQ ID NO: 9225018 - DNA, 22 bp, Homo sapiens
tctctgtctgagcctggcagac

SEQ ID NO: 9225019 - DNA, 22 bp, Homo sapiens
tctctgtccctaggagccttgc

SEQ ID NO: 9225020 - DNA, 22 bp, Homo sapiens
tctctgtctgagcctggcagac

SEQ ID NO: 9225021 - DNA, 18 bp, Homo sapiens
tctcttcttggcagtcaa

SEQ ID NO: 9225022 - DNA, 22 bp, Homo sapiens
tctcttcttgtgttttcctgcc

SEQ ID NO: 9225023 - DNA, 18 bp, Homo sapiens
tctcttcttggcagtcaa

SEQ ID NO: 9225024 - DNA, 22 bp, Homo sapiens
tctcttcttgattttcactgga

SEQ ID NO: 9225025 - DNA, 22 bp, Homo sapiens
tctcttctgacctagccttgga

SEQ ID NO: 9225026 - DNA, 22 bp, Homo sapiens
tctcttctgaaacctgtcttta

SEQ ID NO: 9225027 - DNA, 22 bp, Homo sapiens
tctcttctaattagggtccatg

SEQ ID NO: 9225028 - DNA, 22 bp, Homo sapiens
tctcttctatttgagactattt

SEQ ID NO: 9225029 - DNA, 22 bp, Homo sapiens
tctcttctagcttcttgtggtt

SEQ ID NO: 9225030 - DNA, 22 bp, Homo sapiens
tctcttctagcttcttgtggtt

SEQ ID NO: 9225031 - DNA, 19 bp, Homo sapiens
tctcttctccctggtttta

SEQ ID NO: 9225032 - DNA, 22 bp, Homo sapiens
tctcttctatttgagactattt

SEQ ID NO: 9225033 - DNA, 22 bp, Homo sapiens
tctcttctaacactagaaattc

SEQ ID NO: 9225034 - DNA, 22 bp, Homo sapiens
tctcttccagtaagagtcttta

SEQ ID NO: 9225035 - DNA, 22 bp, Homo sapiens
tctgaagacatatgatatggtg

SEQ ID NO: 9225036 - DNA, 22 bp, Homo sapiens
tctgaagaactgagtaaacatg

SEQ ID NO: 9225037 - DNA, 22 bp, Homo sapiens
tctgaagaataggatgttgtgt

SEQ ID NO: 9225038 - DNA, 22 bp, Homo sapiens
tctgaagaataggatgttgtgt

SEQ ID NO: 9225039 - DNA, 22 bp, Homo sapiens
tctgaaatgttctcttgttttg

SEQ ID NO: 9225040 - DNA, 17 bp, Homo sapiens
tctctttccctttctgc

SEQ ID NO: 9225041 - DNA, 17 bp, Homo sapiens
tctctttccctttctgc

SEQ ID NO: 9225042 - DNA, 22 bp, Homo sapiens
tctctttctattgcaccatgct

SEQ ID NO: 9225043 - DNA, 22 bp, Homo sapiens
tctctttaagtataatcttata

SEQ ID NO: 9225044 - DNA, 23 bp, Homo sapiens
tctctttcaagagcttaatgtgc

SEQ ID NO: 9225045 - DNA, 22 bp, Homo sapiens
tctcttctttggggtgggctca

SEQ ID NO: 9225046 - DNA, 22 bp, Homo sapiens
tctctttaaagactcagagatt

SEQ ID NO: 9225047 - DNA, 22 bp, Homo sapiens
tctgaaaatgttgactttgttt

SEQ ID NO: 9225048 - DNA, 22 bp, Homo sapiens
tctgaaaactccatgagctcgt

SEQ ID NO: 9225049 - DNA, 22 bp, Homo sapiens
tctgaaagaagggcagtctttt

SEQ ID NO: 9225050 - DNA, 22 bp, Homo sapiens
tctgaaaatgttgactttgttt

SEQ ID NO: 9225051 - DNA, 22 bp, Homo sapiens
tctctttgtggccaggagagga

SEQ ID NO: 9225052 - DNA, 20 bp, Homo sapiens
tctcttttagcttacagctg

SEQ ID NO: 9225053 - DNA, 22 bp, Homo sapiens
tctgaaagatgagtggtccatt

SEQ ID NO: 9225054 - DNA, 22 bp, Homo sapiens
tctgaaatagaagtgtctttct

SEQ ID NO: 9225055 - DNA, 22 bp, Homo sapiens
tctctagtgccatgaaagtcct

SEQ ID NO: 9225056 - DNA, 22 bp, Homo sapiens
tctctcagcattactcttacta

SEQ ID NO: 9225057 - DNA, 22 bp, Homo sapiens
tctctcagaggccagggtcctg

SEQ ID NO: 9225058 - DNA, 22 bp, Homo sapiens
tctctctcagccattacagaac

SEQ ID NO: 9225059 - DNA, 22 bp, Homo sapiens
tctctctactggggcactagga

SEQ ID NO: 9225060 - DNA, 22 bp, Homo sapiens
tctctccttatcattgtgttta

SEQ ID NO: 9225061 - DNA, 22 bp, Homo sapiens
tctctgagctcaggagctgcag

SEQ ID NO: 9225062 - DNA, 22 bp, Homo sapiens
tctctgagggagatggcctgcc

SEQ ID NO: 9225063 - DNA, 22 bp, Homo sapiens
tctctgaaagcagctgctcatc

SEQ ID NO: 9225064 - DNA, 22 bp, Homo sapiens
tctctgaagagctcagactagt

SEQ ID NO: 9225065 - DNA, 22 bp, Homo sapiens
tctctgaagagtcagacataac

SEQ ID NO: 9225066 - DNA, 23 bp, Homo sapiens
tctctctggcaaatttcacatat

SEQ ID NO: 9225067 - DNA, 22 bp, Homo sapiens
tctctctttttaatcatgtaat

SEQ ID NO: 9225068 - DNA, 22 bp, Homo sapiens
tctctctgccaactcacagcca

SEQ ID NO: 9225069 - DNA, 22 bp, Homo sapiens
tctctctgccaactcacagcca

SEQ ID NO: 9225070 - DNA, 22 bp, Homo sapiens
tctctgaattctgatgcaagtg

SEQ ID NO: 9225071 - DNA, 22 bp, Homo sapiens
tctctgaccactgagggattta

SEQ ID NO: 9225072 - DNA, 22 bp, Homo sapiens
tctctggcttaggttgagtgca

SEQ ID NO: 9225073 - DNA, 19 bp, Homo sapiens
tctctggcttgtctgcctg

SEQ ID NO: 9225074 - DNA, 22 bp, Homo sapiens
tctctgggatcaggtggcccag

SEQ ID NO: 9225075 - DNA, 22 bp, Homo sapiens
tctctgggatcaggtggcccag

SEQ ID NO: 9225076 - DNA, 22 bp, Homo sapiens
tctctgggatcgttttgggctc

SEQ ID NO: 9225077 - DNA, 21 bp, Homo sapiens
tctctgggccctcctgtgggg

SEQ ID NO: 9225078 - DNA, 22 bp, Homo sapiens
tctctgggcccagaccttcctt

SEQ ID NO: 9225079 - DNA, 21 bp, Homo sapiens
tctctgggccctcctgtgggg

SEQ ID NO: 9225080 - DNA, 22 bp, Homo sapiens
tctctgggcctcagttttctca

SEQ ID NO: 9225081 - DNA, 22 bp, Homo sapiens
tctctgggcccagaccttcctt

SEQ ID NO: 9225082 - DNA, 22 bp, Homo sapiens
tctctgggatcgttttgggctc

SEQ ID NO: 9225083 - DNA, 22 bp, Homo sapiens
tctctggggatgcttattcttg

SEQ ID NO: 9225084 - DNA, 19 bp, Homo sapiens
tctctggggacactttcac

SEQ ID NO: 9225085 - DNA, 19 bp, Homo sapiens
tctctggggacactttcac

SEQ ID NO: 9225086 - DNA, 22 bp, Homo sapiens
tctctgggctcaggagcccggc

SEQ ID NO: 9225087 - DNA, 22 bp, Homo sapiens
tctctgggctcaggagcccggc

SEQ ID NO: 9225088 - DNA, 22 bp, Homo sapiens
tctctggggaaaaggctgatac

SEQ ID NO: 9225089 - DNA, 22 bp, Homo sapiens
tctctgggcctgttttctcatc

SEQ ID NO: 9225090 - DNA, 22 bp, Homo sapiens
tctctgggcctccctttccaag

SEQ ID NO: 9225091 - DNA, 22 bp, Homo sapiens
tctctgggctaaaatcaaggtg

SEQ ID NO: 9225092 - DNA, 22 bp, Homo sapiens
tctctgggttgagaactaggac

SEQ ID NO: 9225093 - DNA, 16 bp, Homo sapiens
tctctgggttgcacag

SEQ ID NO: 9225094 - DNA, 22 bp, Homo sapiens
tctctgggttctcactcagcac

SEQ ID NO: 9225095 - DNA, 20 bp, Homo sapiens
tctctgggttctcactcagc

SEQ ID NO: 9225096 - DNA, 22 bp, Homo sapiens
tctctgggtcctggcaagctca

SEQ ID NO: 9225097 - DNA, 22 bp, Homo sapiens
tctctgggtctcagtttgtaca

SEQ ID NO: 9225098 - DNA, 22 bp, Homo sapiens
tctctgggtattcactgccttc

SEQ ID NO: 9225099 - DNA, 22 bp, Homo sapiens
tctctgggtgatggcagggcac

SEQ ID NO: 9225100 - DNA, 22 bp, Homo sapiens
tctctgggtgatggcagggcac

SEQ ID NO: 9225101 - DNA, 23 bp, Homo sapiens
tctctgggtgggctgtgtctata

SEQ ID NO: 9225102 - DNA, 22 bp, Homo sapiens
tctctgggggtagaactcaggc

SEQ ID NO: 9225103 - DNA, 22 bp, Homo sapiens
tctctggggcctttctacatca

SEQ ID NO: 9225104 - DNA, 22 bp, Homo sapiens
tctctggggatggacctgggag

SEQ ID NO: 9225105 - DNA, 22 bp, Homo sapiens
tctctggggatggacctgggag

SEQ ID NO: 9225106 - DNA, 22 bp, Homo sapiens
tctctgggtatggtaacgttgg

SEQ ID NO: 9225107 - DNA, 22 bp, Homo sapiens
tctctgggtattcactgccttc

SEQ ID NO: 9225108 - DNA, 22 bp, Homo sapiens
tctctgggtaaagttctctcat

SEQ ID NO: 9225109 - DNA, 22 bp, Homo sapiens
tctctggggtagggcccaggac

SEQ ID NO: 9225110 - DNA, 22 bp, Homo sapiens
tctctggggtagggcccaggac

SEQ ID NO: 9225111 - DNA, 22 bp, Homo sapiens
tctctgctctgtgcctcagttt

SEQ ID NO: 9225112 - DNA, 22 bp, Homo sapiens
tctctgctaagattgtgtctag

SEQ ID NO: 9225113 - DNA, 19 bp, Homo sapiens
tctctgccgatcagggccc

SEQ ID NO: 9225114 - DNA, 19 bp, Homo sapiens
tctctgcttctcttggcat

SEQ ID NO: 9225115 - DNA, 19 bp, Homo sapiens
tctctgcttctcttggcat

SEQ ID NO: 9225116 - DNA, 22 bp, Homo sapiens
tctctggaattggctgaggcaa

SEQ ID NO: 9225117 - DNA, 21 bp, Homo sapiens
tctctggagttagcagagaga

SEQ ID NO: 9225118 - DNA, 22 bp, Homo sapiens
tctctggcagactggctgggct

SEQ ID NO: 9225119 - DNA, 22 bp, Homo sapiens
tctctggcagaggccctatccc

SEQ ID NO: 9225120 - DNA, 22 bp, Homo sapiens
tctctggcagggatatctggct

SEQ ID NO: 9225121 - DNA, 22 bp, Homo sapiens
tctctggcagggatatctggct

SEQ ID NO: 9225122 - DNA, 22 bp, Homo sapiens
tctctggcagcttgtgctgttg

SEQ ID NO: 9225123 - DNA, 20 bp, Homo sapiens
tctctggcaagaagctgcag

SEQ ID NO: 9225124 - DNA, 22 bp, Homo sapiens
tctctggcacataataaggtct

SEQ ID NO: 9225125 - DNA, 22 bp, Homo sapiens
tctctggcactcccttatggct

SEQ ID NO: 9225126 - DNA, 22 bp, Homo sapiens
tctctggcagacacctccctga

SEQ ID NO: 9225127 - DNA, 22 bp, Homo sapiens
tctctggccctgttttctatct

SEQ ID NO: 9225128 - DNA, 22 bp, Homo sapiens
tctctggccccatggctgagct

SEQ ID NO: 9225129 - DNA, 19 bp, Homo sapiens
tctctggcatagactcaat

SEQ ID NO: 9225130 - DNA, 19 bp, Homo sapiens
tctctggcagttcagagca

SEQ ID NO: 9225131 - DNA, 20 bp, Homo sapiens
tctctggccagaaacaacag

SEQ ID NO: 9225132 - DNA, 21 bp, Homo sapiens
tctctggcggtgtttggctcc

SEQ ID NO: 9225133 - DNA, 23 bp, Homo sapiens
tctctggcctttgatcaggttga

SEQ ID NO: 9225134 - DNA, 22 bp, Homo sapiens
tctctggccgagagtccctggg

SEQ ID NO: 9225135 - DNA, 22 bp, Homo sapiens
tctctggctcctgccgggtcca

SEQ ID NO: 9225136 - DNA, 22 bp, Homo sapiens
tctctggctgatattcctctgc

SEQ ID NO: 9225137 - DNA, 22 bp, Homo sapiens
tctctggctggcaccccaggga

SEQ ID NO: 9225138 - DNA, 22 bp, Homo sapiens
tctccttgctacccagtatgtc

SEQ ID NO: 9225139 - DNA, 22 bp, Homo sapiens
tctcctttgaaagttaggactg

SEQ ID NO: 9225140 - DNA, 22 bp, Homo sapiens
tctcgacagcctggcacagtgg

SEQ ID NO: 9225141 - DNA, 22 bp, Homo sapiens
tctctaaacttatatgaactat

SEQ ID NO: 9225142 - DNA, 22 bp, Homo sapiens
tctctagtgaagggctttccaa

SEQ ID NO: 9225143 - DNA, 22 bp, Homo sapiens
tctcgctctgtcgcccaggctg

SEQ ID NO: 9225144 - DNA, 22 bp, Homo sapiens
tctcgctctgtcgcccaggctg

SEQ ID NO: 9225145 - DNA, 22 bp, Homo sapiens
tctcctgcttcaactgatggac

SEQ ID NO: 9225146 - DNA, 22 bp, Homo sapiens
tctcctgcttcaactgatggac

SEQ ID NO: 9225147 - DNA, 22 bp, Homo sapiens
tctcctgctcccaactgctgca

SEQ ID NO: 9225148 - DNA, 22 bp, Homo sapiens
tctcctgctcccaactgctgca

SEQ ID NO: 9225149 - DNA, 22 bp, Homo sapiens
tctcctggagcaggaaggtggg

SEQ ID NO: 9225150 - DNA, 22 bp, Homo sapiens
tctcctctactgggtctgcaga

SEQ ID NO: 9225151 - DNA, 22 bp, Homo sapiens
tctcctctatttctgtatgtat

SEQ ID NO: 9225152 - DNA, 22 bp, Homo sapiens
tctcctctcttacctggtacaa

SEQ ID NO: 9225153 - DNA, 22 bp, Homo sapiens
tctcctctcctttcatgttgtt

SEQ ID NO: 9225154 - DNA, 22 bp, Homo sapiens
tctcctctgtgccacagcttgg

SEQ ID NO: 9225155 - DNA, 22 bp, Homo sapiens
tctcctctgcgcggcagtgccc

SEQ ID NO: 9225156 - DNA, 22 bp, Homo sapiens
tctccaggtgactctgatgtat

SEQ ID NO: 9225157 - DNA, 22 bp, Homo sapiens
tctccaggtagatatgtcagga

SEQ ID NO: 9225158 - DNA, 22 bp, Homo sapiens
tctccaggtgctaagtgtgcct

SEQ ID NO: 9225159 - DNA, 22 bp, Homo sapiens
tctcccactgcaagcccaggct

SEQ ID NO: 9225160 - DNA, 22 bp, Homo sapiens
tctcccactggccttgtatgat

SEQ ID NO: 9225161 - DNA, 22 bp, Homo sapiens
tctccagggactgaggctggag

SEQ ID NO: 9225162 - DNA, 22 bp, Homo sapiens
tctccagggcagagaatagcaa

SEQ ID NO: 9225163 - DNA, 22 bp, Homo sapiens
tctccagggaggtagcccagtg

SEQ ID NO: 9225164 - DNA, 22 bp, Homo sapiens
tctccccagctgagctgccctt

SEQ ID NO: 9225165 - DNA, 22 bp, Homo sapiens
tctccccaggggtatgggtatt

SEQ ID NO: 9225166 - DNA, 19 bp, Homo sapiens
tctcccagctgagaagggc

SEQ ID NO: 9225167 - DNA, 22 bp, Homo sapiens
tctcccaggctgccctgtggac

SEQ ID NO: 9225168 - DNA, 22 bp, Homo sapiens
tctcccaggtgggtgcctggag

SEQ ID NO: 9225169 - DNA, 22 bp, Homo sapiens
tctccaggagaaatatgaagga

SEQ ID NO: 9225170 - DNA, 22 bp, Homo sapiens
tctccaggactgagctccagcc

SEQ ID NO: 9225171 - DNA, 17 bp, Homo sapiens
tctccaggacgagctca

SEQ ID NO: 9225172 - DNA, 22 bp, Homo sapiens
tctccaggaagccctccctgac

SEQ ID NO: 9225173 - DNA, 22 bp, Homo sapiens
tctccaagaaaagatctcagct

SEQ ID NO: 9225174 - DNA, 22 bp, Homo sapiens
tctcattcataccctacatgct

SEQ ID NO: 9225175 - DNA, 23 bp, Homo sapiens
tctcatgtctttcctacaagcat

SEQ ID NO: 9225176 - DNA, 22 bp, Homo sapiens
tctcatggagtcaggagcagaa

SEQ ID NO: 9225177 - DNA, 22 bp, Homo sapiens
tctcagggctcagagctcaggc

SEQ ID NO: 9225178 - DNA, 22 bp, Homo sapiens
tctcagcagccagatccagagc

SEQ ID NO: 9225179 - DNA, 22 bp, Homo sapiens
tctcagagtttagagctgagcc

SEQ ID NO: 9225180 - DNA, 22 bp, Homo sapiens
tctcagagttcctctggagtcc

SEQ ID NO: 9225181 - DNA, 22 bp, Homo sapiens
tctcagggagttgaggctgcct

SEQ ID NO: 9225182 - DNA, 22 bp, Homo sapiens
tctcagggccccaaaggctagt

SEQ ID NO: 9225183 - DNA, 20 bp, Homo sapiens
tctcaggccccctccttgct

SEQ ID NO: 9225184 - DNA, 22 bp, Homo sapiens
tctcaggcccctgagtttctct

SEQ ID NO: 9225185 - DNA, 21 bp, Homo sapiens
tctcaggcgagaattctttta

SEQ ID NO: 9225186 - DNA, 22 bp, Homo sapiens
tctcaggctaccttgcacaagg

SEQ ID NO: 9225187 - DNA, 21 bp, Homo sapiens
tctcaggcgagaattctttta

SEQ ID NO: 9225188 - DNA, 22 bp, Homo sapiens
tctcagctgcctgccctgctcc

SEQ ID NO: 9225189 - DNA, 22 bp, Homo sapiens
tctcagctgactgctttcctcg

SEQ ID NO: 9225190 - DNA, 22 bp, Homo sapiens
tctcagctcttttttcacagaa

SEQ ID NO: 9225191 - DNA, 22 bp, Homo sapiens
tctcacagttgtccactgaaaa

SEQ ID NO: 9225192 - DNA, 23 bp, Homo sapiens
tctcagaaaggagaagtaatttg

SEQ ID NO: 9225193 - DNA, 22 bp, Homo sapiens
tctcagaaatgacaggaggtac

SEQ ID NO: 9225194 - DNA, 22 bp, Homo sapiens
tctcagaaatactatgttgtca

SEQ ID NO: 9225195 - DNA, 22 bp, Homo sapiens
tctcagagcttcagttattttc

SEQ ID NO: 9225196 - DNA, 23 bp, Homo sapiens
tctcagaggattcctgggccttg

SEQ ID NO: 9225197 - DNA, 18 bp, Homo sapiens
tctcagaggccatcctag

SEQ ID NO: 9225198 - DNA, 22 bp, Homo sapiens
taagaacagtgtctgtctcaca

SEQ ID NO: 9225199 - DNA, 22 bp, Homo sapiens
tcctggctcctgatctgtcact

SEQ ID NO: 9225200 - DNA, 22 bp, Homo sapiens
tcctggctcctggagacctgct

SEQ ID NO: 9225201 - DNA, 22 bp, Homo sapiens
tcctggcctccgttctctgcat

SEQ ID NO: 9225202 - DNA, 22 bp, Homo sapiens
tcctggctctaagtcctgagtg

SEQ ID NO: 9225203 - DNA, 22 bp, Homo sapiens
tcctggctcgattgctaccaat

SEQ ID NO: 9225204 - DNA, 17 bp, Homo sapiens
tcctggctctgccactg

SEQ ID NO: 9225205 - DNA, 17 bp, Homo sapiens
tcctggctctgccactg

SEQ ID NO: 9225206 - DNA, 22 bp, Homo sapiens
tcctggctctctacaaaccaga

SEQ ID NO: 9225207 - DNA, 22 bp, Homo sapiens
tcctggcctagctcaccctgga

SEQ ID NO: 9225208 - DNA, 22 bp, Homo sapiens
tcctggccctgtggcctgcagt

SEQ ID NO: 9225209 - DNA, 22 bp, Homo sapiens
tcctggccctgtggcctgcagt

SEQ ID NO: 9225210 - DNA, 22 bp, Homo sapiens
tcctggccctgtggcctgcagt

SEQ ID NO: 9225211 - DNA, 22 bp, Homo sapiens
tcctggccctctgcaaacgcca

SEQ ID NO: 9225212 - DNA, 22 bp, Homo sapiens
tcctggcccactatgccagcat

SEQ ID NO: 9225213 - DNA, 22 bp, Homo sapiens
tcctggcccactatgccagcat

SEQ ID NO: 9225214 - DNA, 22 bp, Homo sapiens
tcctggcccactatgccagcat

SEQ ID NO: 9225215 - DNA, 22 bp, Homo sapiens
tcctggcccactcctagcttct

SEQ ID NO: 9225216 - DNA, 22 bp, Homo sapiens
tcctggccacccgacagaagtc

SEQ ID NO: 9225217 - DNA, 18 bp, Homo sapiens
tcctggccacactacctt

SEQ ID NO: 9225218 - DNA, 22 bp, Homo sapiens
tcctggccaggatgacctaaca

SEQ ID NO: 9225219 - DNA, 22 bp, Homo sapiens
tcctggccagaggacaaagctg

SEQ ID NO: 9225220 - DNA, 21 bp, Homo sapiens
tcctggccagggcactaggca

SEQ ID NO: 9225221 - DNA, 22 bp, Homo sapiens
tcctggccaagttactctctgc

SEQ ID NO: 9225222 - DNA, 22 bp, Homo sapiens
tcctggccaagtagatgtggcg

SEQ ID NO: 9225223 - DNA, 22 bp, Homo sapiens
tcctggcagttcagccccctaa

SEQ ID NO: 9225224 - DNA, 22 bp, Homo sapiens
tcctggcaatggcaggttcagg

SEQ ID NO: 9225225 - DNA, 22 bp, Homo sapiens
tcctggattaatagggagctgt

SEQ ID NO: 9225226 - DNA, 22 bp, Homo sapiens
tcctggatcagcgggggcaggc

SEQ ID NO: 9225227 - DNA, 22 bp, Homo sapiens
tcctgtgccatctctagagact

SEQ ID NO: 9225228 - DNA, 22 bp, Homo sapiens
tcctgtctgctcacagagctgg

SEQ ID NO: 9225229 - DNA, 22 bp, Homo sapiens
tcctgtgggctctcggcctcca

SEQ ID NO: 9225230 - DNA, 22 bp, Homo sapiens
tcctgtccacagccctgacctc

SEQ ID NO: 9225231 - DNA, 22 bp, Homo sapiens
tcctggtggtctgtgcttcttc

SEQ ID NO: 9225232 - DNA, 22 bp, Homo sapiens
tcctggtggtctgtgcttcttc

SEQ ID NO: 9225233 - DNA, 22 bp, Homo sapiens
tcctggggtcctgactgcttcc

SEQ ID NO: 9225234 - DNA, 22 bp, Homo sapiens
tcctggggtgtgttttgctgct

SEQ ID NO: 9225235 - DNA, 22 bp, Homo sapiens
tcctggggtgtgttttgctgct

SEQ ID NO: 9225236 - DNA, 22 bp, Homo sapiens
tcctggggtttagagggaagtg

SEQ ID NO: 9225237 - DNA, 22 bp, Homo sapiens
tcctggggttttggccgcagct

SEQ ID NO: 9225238 - DNA, 22 bp, Homo sapiens
tcctggggttttggccgcagct

SEQ ID NO: 9225239 - DNA, 22 bp, Homo sapiens
tcctggggccagcactggtgga

SEQ ID NO: 9225240 - DNA, 22 bp, Homo sapiens
tcctggggccagcactggtgga

SEQ ID NO: 9225241 - DNA, 22 bp, Homo sapiens
tcctggggccaggcacctctgg

SEQ ID NO: 9225242 - DNA, 22 bp, Homo sapiens
tcctggggctcatgggatttgt

SEQ ID NO: 9225243 - DNA, 16 bp, Homo sapiens
tcctggggatactgga

SEQ ID NO: 9225244 - DNA, 22 bp, Homo sapiens
tcctggggaggtcgaggctgag

SEQ ID NO: 9225245 - DNA, 19 bp, Homo sapiens
tcctggggatgtggtcacc

SEQ ID NO: 9225246 - DNA, 20 bp, Homo sapiens
tcctggggtaagccatggtc

SEQ ID NO: 9225247 - DNA, 20 bp, Homo sapiens
tcctggggtaagccatggtc

SEQ ID NO: 9225248 - DNA, 22 bp, Homo sapiens
tcctggggctgcaaggcctgtc

SEQ ID NO: 9225249 - DNA, 21 bp, Homo sapiens
tcctggggggtaggtgagttt

SEQ ID NO: 9225250 - DNA, 22 bp, Homo sapiens
tcctggggctgcaaggcctgtc

SEQ ID NO: 9225251 - DNA, 22 bp, Homo sapiens
tcctggggctctgagcgagaca

SEQ ID NO: 9225252 - DNA, 22 bp, Homo sapiens
tcctggggctctttgatgtgat

SEQ ID NO: 9225253 - DNA, 22 bp, Homo sapiens
tcctggcttgtcacatctacgt

SEQ ID NO: 9225254 - DNA, 22 bp, Homo sapiens
tcctggcttttcttggctcatc

SEQ ID NO: 9225255 - DNA, 21 bp, Homo sapiens
tcctggctttatgctacctct

SEQ ID NO: 9225256 - DNA, 22 bp, Homo sapiens
tcctggctgccgtcgtcctgcg

SEQ ID NO: 9225257 - DNA, 22 bp, Homo sapiens
tcctggctggaatttctcactc

SEQ ID NO: 9225258 - DNA, 22 bp, Homo sapiens
tcctggctgtcactcgggttga

SEQ ID NO: 9225259 - DNA, 22 bp, Homo sapiens
tcctggcttaggtttccagaac

SEQ ID NO: 9225260 - DNA, 22 bp, Homo sapiens
tcctggcttccactcctctgtt

SEQ ID NO: 9225261 - DNA, 22 bp, Homo sapiens
tcctgggccctccggatcaggt

SEQ ID NO: 9225262 - DNA, 22 bp, Homo sapiens
tcctgggccctccggatcaggt

SEQ ID NO: 9225263 - DNA, 22 bp, Homo sapiens
tcctgggcctgtactccatccg

SEQ ID NO: 9225264 - DNA, 22 bp, Homo sapiens
tcctgggcctgtactccatccg

SEQ ID NO: 9225265 - DNA, 22 bp, Homo sapiens
tcctgggcgagtggtggtacac

SEQ ID NO: 9225266 - DNA, 22 bp, Homo sapiens
tcctgggcgaggtactggggct

SEQ ID NO: 9225267 - DNA, 22 bp, Homo sapiens
tcctgggcccaggctgccaggg

SEQ ID NO: 9225268 - DNA, 22 bp, Homo sapiens
tcctgggcagaatgggatggct

SEQ ID NO: 9225269 - DNA, 22 bp, Homo sapiens
tcctgggctgcagggaagagca

SEQ ID NO: 9225270 - DNA, 22 bp, Homo sapiens
tcctgggctgcagggaagagca

SEQ ID NO: 9225271 - DNA, 19 bp, Homo sapiens
tcctgggctgcgtcttgcc

SEQ ID NO: 9225272 - DNA, 22 bp, Homo sapiens
tcctgggcggttatgtgatctg

SEQ ID NO: 9225273 - DNA, 19 bp, Homo sapiens
tcctgggctgggccaggtc

SEQ ID NO: 9225274 - DNA, 22 bp, Homo sapiens
tcctggggagggttctggctcc

SEQ ID NO: 9225275 - DNA, 22 bp, Homo sapiens
tcctggggaggtcgaggctgag

SEQ ID NO: 9225276 - DNA, 22 bp, Homo sapiens
tcctgggcacaagtgagtctcc

SEQ ID NO: 9225277 - DNA, 22 bp, Homo sapiens
tcctgggcaaagaggggcagtg

SEQ ID NO: 9225278 - DNA, 23 bp, Homo sapiens
tcgttgaatagcaatagcacaac

SEQ ID NO: 9225279 - DNA, 19 bp, Homo sapiens
tcgtggggaggtgggcagc

SEQ ID NO: 9225280 - DNA, 22 bp, Homo sapiens
tcgtgatctgtccacctcggcc

SEQ ID NO: 9225281 - DNA, 17 bp, Homo sapiens
tcggtttgccaggcttc

SEQ ID NO: 9225282 - DNA, 22 bp, Homo sapiens
tctaaaaaagtctgttcacttg

SEQ ID NO: 9225283 - DNA, 22 bp, Homo sapiens
tctaaagatgtttattgacata

SEQ ID NO: 9225284 - DNA, 22 bp, Homo sapiens
tctaaagatttggattcatttg

SEQ ID NO: 9225285 - DNA, 22 bp, Homo sapiens
tcctttccctttccatcctggc

SEQ ID NO: 9225286 - DNA, 22 bp, Homo sapiens
tccttgggaaacatcatgtaat

SEQ ID NO: 9225287 - DNA, 22 bp, Homo sapiens
tccttgggaaatcactagcact

SEQ ID NO: 9225288 - DNA, 22 bp, Homo sapiens
tcctttggttgtagacaggaat

SEQ ID NO: 9225289 - DNA, 22 bp, Homo sapiens
tcgaactcatagtcgtagctgt

SEQ ID NO: 9225290 - DNA, 22 bp, Homo sapiens
tcgaactcatagtcgtagctgt

SEQ ID NO: 9225291 - DNA, 22 bp, Homo sapiens
tcgaaataatttagaatataga

SEQ ID NO: 9225292 - DNA, 22 bp, Homo sapiens
tcctttttaagtcgttgtggta

SEQ ID NO: 9225293 - DNA, 22 bp, Homo sapiens
tcctttttatagttagagaaac

SEQ ID NO: 9225294 - DNA, 22 bp, Homo sapiens
tcctttttggtccaaggtgacc

SEQ ID NO: 9225295 - DNA, 22 bp, Homo sapiens
tccttcaaagctcctagtgagc

SEQ ID NO: 9225296 - DNA, 22 bp, Homo sapiens
tccttcaaaagttgagagagcc

SEQ ID NO: 9225297 - DNA, 22 bp, Homo sapiens
tccttcaagtgcagtacctgag

SEQ ID NO: 9225298 - DNA, 23 bp, Homo sapiens
tccttcaagttaggaagtgaaca

SEQ ID NO: 9225299 - DNA, 22 bp, Homo sapiens
tccttcaatcacccagtgggga

SEQ ID NO: 9225300 - DNA, 22 bp, Homo sapiens
tccttcagaacctgtgatggaa

SEQ ID NO: 9225301 - DNA, 22 bp, Homo sapiens
tccttcagaaaacctcagtctt

SEQ ID NO: 9225302 - DNA, 22 bp, Homo sapiens
tccttcaccttagccctcctag

SEQ ID NO: 9225303 - DNA, 22 bp, Homo sapiens
tccttcagaggacggcagccag

SEQ ID NO: 9225304 - DNA, 23 bp, Homo sapiens
tccttcagagcctccctccaagc

SEQ ID NO: 9225305 - DNA, 22 bp, Homo sapiens
tccttcagcctcccagctcaaa

SEQ ID NO: 9225306 - DNA, 22 bp, Homo sapiens
tccttcagccatgggctctcca

SEQ ID NO: 9225307 - DNA, 22 bp, Homo sapiens
tccttcagggggccgcctgcac

SEQ ID NO: 9225308 - DNA, 22 bp, Homo sapiens
tccttctttccccctagtcatt

SEQ ID NO: 9225309 - DNA, 22 bp, Homo sapiens
tccttctttccccctagtcatt

SEQ ID NO: 9225310 - DNA, 22 bp, Homo sapiens
tccttctttgacaagtggcaga

SEQ ID NO: 9225311 - DNA, 21 bp, Homo sapiens
tccttgctattttcctcagct

SEQ ID NO: 9225312 - DNA, 22 bp, Homo sapiens
tccttggaggtgttcatctgcc

SEQ ID NO: 9225313 - DNA, 22 bp, Homo sapiens
tctaaattcagtttattttgat

SEQ ID NO: 9225314 - DNA, 22 bp, Homo sapiens
tctaaattactttgggcagtat

SEQ ID NO: 9225315 - DNA, 22 bp, Homo sapiens
tctaaattctttcctgggttga

SEQ ID NO: 9225316 - DNA, 22 bp, Homo sapiens
tctaacattgtttttcacagat

SEQ ID NO: 9225317 - DNA, 22 bp, Homo sapiens
tctaacatttatggccactgga

SEQ ID NO: 9225318 - DNA, 22 bp, Homo sapiens
tctaagaaagattaagaaattt

SEQ ID NO: 9225319 - DNA, 22 bp, Homo sapiens
tctaagaaagattaagaaattt

SEQ ID NO: 9225320 - DNA, 22 bp, Homo sapiens
tctacagggtcagagtttcatg

SEQ ID NO: 9225321 - DNA, 22 bp, Homo sapiens
tctacagactcctatgtaacac

SEQ ID NO: 9225322 - DNA, 22 bp, Homo sapiens
tctacagaaactggctactctc

SEQ ID NO: 9225323 - DNA, 22 bp, Homo sapiens
tctactttcactcatacttatt

SEQ ID NO: 9225324 - DNA, 22 bp, Homo sapiens
tctacttttccctatacagttt

SEQ ID NO: 9225325 - DNA, 22 bp, Homo sapiens
tctaccctgcggtcttggggca

SEQ ID NO: 9225326 - DNA, 22 bp, Homo sapiens
tctactgtagtgatgctgcagt

SEQ ID NO: 9225327 - DNA, 22 bp, Homo sapiens
tctagctctgcttatcatggct

SEQ ID NO: 9225328 - DNA, 22 bp, Homo sapiens
tctagcttggcgtttgccttct

SEQ ID NO: 9225329 - DNA, 20 bp, Homo sapiens
tctagcttagtgcctgcctc

SEQ ID NO: 9225330 - DNA, 22 bp, Homo sapiens
tctaggaaagcctttcacaact

SEQ ID NO: 9225331 - DNA, 22 bp, Homo sapiens
tctaggaaataatgactcatcc

SEQ ID NO: 9225332 - DNA, 20 bp, Homo sapiens
tctaggcaggcaggctcgtg

SEQ ID NO: 9225333 - DNA, 22 bp, Homo sapiens
tctcacagccatttctccctct

SEQ ID NO: 9225334 - DNA, 22 bp, Homo sapiens
tctcacaccgtccctaaaccat

SEQ ID NO: 9225335 - DNA, 22 bp, Homo sapiens
tctcacactatttattctgctt

SEQ ID NO: 9225336 - DNA, 22 bp, Homo sapiens
tctcacacttctgtgttgcaca

SEQ ID NO: 9225337 - DNA, 22 bp, Homo sapiens
tctatttttatagttgaagtgc

SEQ ID NO: 9225338 - DNA, 22 bp, Homo sapiens
tctcaaactaacaatgattata

SEQ ID NO: 9225339 - DNA, 22 bp, Homo sapiens
tctattttatactcaaatcttc

SEQ ID NO: 9225340 - DNA, 22 bp, Homo sapiens
tctatgtagtgccagctagtat

SEQ ID NO: 9225341 - DNA, 22 bp, Homo sapiens
tctataaagggccagatagtag

SEQ ID NO: 9225342 - DNA, 22 bp, Homo sapiens
tctaggccgtaggatacagagc

SEQ ID NO: 9225343 - DNA, 22 bp, Homo sapiens
tctaggcattgttattacaact

SEQ ID NO: 9225344 - DNA, 22 bp, Homo sapiens
tctaggcattgttattacaact

SEQ ID NO: 9225345 - DNA, 22 bp, Homo sapiens
tctataaaactcaagagcaatt

SEQ ID NO: 9225346 - DNA, 19 bp, Homo sapiens
tgcaggaggactgagcaga

SEQ ID NO: 9225347 - DNA, 22 bp, Homo sapiens
tgcaggagggagggttacagtt

SEQ ID NO: 9225348 - DNA, 22 bp, Homo sapiens
tgcaggagctgctgtcctgctc

SEQ ID NO: 9225349 - DNA, 21 bp, Homo sapiens
tgcaggagtgtaatgtgaccc

SEQ ID NO: 9225350 - DNA, 22 bp, Homo sapiens
tgcaggagttaagtgctctcct

SEQ ID NO: 9225351 - DNA, 22 bp, Homo sapiens
tgcaggctcacctgccagggcc

SEQ ID NO: 9225352 - DNA, 22 bp, Homo sapiens
tgcaggctccaggtgcacatat

SEQ ID NO: 9225353 - DNA, 22 bp, Homo sapiens
tgcaggctcaccctggagctga

SEQ ID NO: 9225354 - DNA, 23 bp, Homo sapiens
tgcaggctaggaagagagccttc

SEQ ID NO: 9225355 - DNA, 20 bp, Homo sapiens
tgcagctggtttcacaggga

SEQ ID NO: 9225356 - DNA, 20 bp, Homo sapiens
tgcagctggtttcacaggga

SEQ ID NO: 9225357 - DNA, 22 bp, Homo sapiens
tgcagctgtaacagaggcctca

SEQ ID NO: 9225358 - DNA, 22 bp, Homo sapiens
tgcagctgtaacagaggcctca

SEQ ID NO: 9225359 - DNA, 22 bp, Homo sapiens
tgcagctgtgaaagggaaccaa

SEQ ID NO: 9225360 - DNA, 22 bp, Homo sapiens
tgcagctgttacggaccctgtc

SEQ ID NO: 9225361 - DNA, 22 bp, Homo sapiens
tgcaggagcagagatggctgga

SEQ ID NO: 9225362 - DNA, 22 bp, Homo sapiens
tgcaggagcaccagctcaccct

SEQ ID NO: 9225363 - DNA, 22 bp, Homo sapiens
tgcagccttggcaaccagggac

SEQ ID NO: 9225364 - DNA, 22 bp, Homo sapiens
tgcagccttgcctcctcccagc

SEQ ID NO: 9225365 - DNA, 18 bp, Homo sapiens
tgcagcctgtagtcttgt

SEQ ID NO: 9225366 - DNA, 22 bp, Homo sapiens
tgcagctcaagctggtgaggtg

SEQ ID NO: 9225367 - DNA, 23 bp, Homo sapiens
tgcagctcaaagatgggtaaatg

SEQ ID NO: 9225368 - DNA, 22 bp, Homo sapiens
tgcagccttggcaaccagggac

SEQ ID NO: 9225369 - DNA, 22 bp, Homo sapiens
tgcagcctttagaagttcagat

SEQ ID NO: 9225370 - DNA, 22 bp, Homo sapiens
tgcagctcgggcttagggtggg

SEQ ID NO: 9225371 - DNA, 22 bp, Homo sapiens
tgcagctcctctggctgcctga

SEQ ID NO: 9225372 - DNA, 22 bp, Homo sapiens
tgcagctcctgtgctgagtgtg

SEQ ID NO: 9225373 - DNA, 22 bp, Homo sapiens
tgcagctcatattagagagaag

SEQ ID NO: 9225374 - DNA, 22 bp, Homo sapiens
tgcagctcattggtgtcctggt

SEQ ID NO: 9225375 - DNA, 22 bp, Homo sapiens
tgcagctcaggattctcagggc

SEQ ID NO: 9225376 - DNA, 19 bp, Homo sapiens
tgcagctcagggcaggggc

SEQ ID NO: 9225377 - DNA, 22 bp, Homo sapiens
tgcagctcaggattctcagggc

SEQ ID NO: 9225378 - DNA, 21 bp, Homo sapiens
tgcagctgacaccctttggga

SEQ ID NO: 9225379 - DNA, 22 bp, Homo sapiens
tgcagctctgggcaagtgcctt

SEQ ID NO: 9225380 - DNA, 22 bp, Homo sapiens
tgcagctctgaacagtcatgaa

SEQ ID NO: 9225381 - DNA, 22 bp, Homo sapiens
tgcagctctgaacagtcatgaa

SEQ ID NO: 9225382 - DNA, 22 bp, Homo sapiens
tgcagctctgcatggctggttc

SEQ ID NO: 9225383 - DNA, 22 bp, Homo sapiens
tgcagctcttacggagggcggg

SEQ ID NO: 9225384 - DNA, 22 bp, Homo sapiens
tgcagctgaccagcaagtcctg

SEQ ID NO: 9225385 - DNA, 21 bp, Homo sapiens
tgcagctgacactggtatgcc

SEQ ID NO: 9225386 - DNA, 22 bp, Homo sapiens
tgcagctggtatcccatggatt

SEQ ID NO: 9225387 - DNA, 20 bp, Homo sapiens
tgcagctggtttcacaggga

SEQ ID NO: 9225388 - DNA, 22 bp, Homo sapiens
tgcagctgggtctgccctggct

SEQ ID NO: 9225389 - DNA, 22 bp, Homo sapiens
tgcagctgcttgattcatcttg

SEQ ID NO: 9225390 - DNA, 22 bp, Homo sapiens
tgcagctgctggcccaggtgct

SEQ ID NO: 9225391 - DNA, 22 bp, Homo sapiens
tgcagctgcttgattcatcttg

SEQ ID NO: 9225392 - DNA, 22 bp, Homo sapiens
tgcagctgctggtggctgaaag

SEQ ID NO: 9225393 - DNA, 22 bp, Homo sapiens
tgcagctgataattacatgttc

SEQ ID NO: 9225394 - DNA, 22 bp, Homo sapiens
tgcagcctagacattctggtca

SEQ ID NO: 9225395 - DNA, 22 bp, Homo sapiens
tgcagcccttccttcctctggg

SEQ ID NO: 9225396 - DNA, 22 bp, Homo sapiens
tgcagcccaggcgtcaggtggt

SEQ ID NO: 9225397 - DNA, 22 bp, Homo sapiens
tgcagcctggtggtcactggag

SEQ ID NO: 9225398 - DNA, 21 bp, Homo sapiens
tgcagcctctgcccagcagtg

SEQ ID NO: 9225399 - DNA, 21 bp, Homo sapiens
tgcagcagagtaagcagggga

SEQ ID NO: 9225400 - DNA, 22 bp, Homo sapiens
tgcagcagcagggaggaggctc

SEQ ID NO: 9225401 - DNA, 22 bp, Homo sapiens
tgcagagatctgggcgtcggct

SEQ ID NO: 9225402 - DNA, 22 bp, Homo sapiens
tgcagagatttggctcttaaag

SEQ ID NO: 9225403 - DNA, 22 bp, Homo sapiens
tgcagagatcctggactgagcg

SEQ ID NO: 9225404 - DNA, 22 bp, Homo sapiens
tgcagagaaaccagtggaggac

SEQ ID NO: 9225405 - DNA, 22 bp, Homo sapiens
tgcagagaaaactcctgggtac

SEQ ID NO: 9225406 - DNA, 22 bp, Homo sapiens
tgcagaggagctggaaggctgg

SEQ ID NO: 9225407 - DNA, 22 bp, Homo sapiens
tgcagaggagctggaaggctgg

SEQ ID NO: 9225408 - DNA, 23 bp, Homo sapiens
tgcagaggcatgatcactgctca

SEQ ID NO: 9225409 - DNA, 20 bp, Homo sapiens
tgcagcacgggccctttcca

SEQ ID NO: 9225410 - DNA, 23 bp, Homo sapiens
tgcagagggactgaagccagctt

SEQ ID NO: 9225411 - DNA, 22 bp, Homo sapiens
tgcagaaataactcatattgca

SEQ ID NO: 9225412 - DNA, 22 bp, Homo sapiens
tgcagaaacagtcattaatgta

SEQ ID NO: 9225413 - DNA, 20 bp, Homo sapiens
tgcagaagaacgttctggtt

SEQ ID NO: 9225414 - DNA, 22 bp, Homo sapiens
tgcagaagacacaaggtaacgt

SEQ ID NO: 9225415 - DNA, 22 bp, Homo sapiens
tgcagaagaccttccagggctg

SEQ ID NO: 9225416 - DNA, 22 bp, Homo sapiens
tgcagaagcagagccggtggcc

SEQ ID NO: 9225417 - DNA, 22 bp, Homo sapiens
tgcagaagcagagagttgccaa

SEQ ID NO: 9225418 - DNA, 22 bp, Homo sapiens
tgcagaagtgagtcatgaggaa

SEQ ID NO: 9225419 - DNA, 22 bp, Homo sapiens
tgcagaagtgagtcatgaggaa

SEQ ID NO: 9225420 - DNA, 22 bp, Homo sapiens
tgcagaagtattccaggcccca

SEQ ID NO: 9225421 - DNA, 22 bp, Homo sapiens
tgcagaagctgcaggtcagtgg

SEQ ID NO: 9225422 - DNA, 22 bp, Homo sapiens
tgcaccacccgtgggaggactg

SEQ ID NO: 9225423 - DNA, 22 bp, Homo sapiens
tgcacccatagcacacactcct

SEQ ID NO: 9225424 - DNA, 22 bp, Homo sapiens
tgcacatggcaatgctgctccc

SEQ ID NO: 9225425 - DNA, 22 bp, Homo sapiens
tgcacaggtgagactcaggaag

SEQ ID NO: 9225426 - DNA, 22 bp, Homo sapiens
tgcacagttggctacatcgtgg

SEQ ID NO: 9225427 - DNA, 22 bp, Homo sapiens
tgcacacagtggacaagtcttg

SEQ ID NO: 9225428 - DNA, 22 bp, Homo sapiens
tgcacacagttctcaggaaaga

SEQ ID NO: 9225429 - DNA, 21 bp, Homo sapiens
tgcacagccataccctccttg

SEQ ID NO: 9225430 - DNA, 22 bp, Homo sapiens
tgcacagcgcttgtcgggtgtg

SEQ ID NO: 9225431 - DNA, 22 bp, Homo sapiens
tgcacagcgggtgtctgtcagg

SEQ ID NO: 9225432 - DNA, 18 bp, Homo sapiens
tgcacagctgtgggctgg

SEQ ID NO: 9225433 - DNA, 22 bp, Homo sapiens
tgcacagctggctctccttttc

SEQ ID NO: 9225434 - DNA, 22 bp, Homo sapiens
tgcacagctgcctcctctctgc

SEQ ID NO: 9225435 - DNA, 22 bp, Homo sapiens
tgcacagctggctctccttttc

SEQ ID NO: 9225436 - DNA, 22 bp, Homo sapiens
tgcacagggagggggccagctc

SEQ ID NO: 9225437 - DNA, 20 bp, Homo sapiens
tgcacagggtgggaagcaac

SEQ ID NO: 9225438 - DNA, 22 bp, Homo sapiens
tgcacacacggagataggcttt

SEQ ID NO: 9225439 - DNA, 22 bp, Homo sapiens
tgcacacacatgaagtagcatg

SEQ ID NO: 9225440 - DNA, 22 bp, Homo sapiens
tgcacacacatgcagagggaga

SEQ ID NO: 9225441 - DNA, 22 bp, Homo sapiens
tgcacacacacgtagagaaaag

SEQ ID NO: 9225442 - DNA, 22 bp, Homo sapiens
tgcacacacatgaagtagcatg

SEQ ID NO: 9225443 - DNA, 22 bp, Homo sapiens
tgcacacagctgggcctggctg

SEQ ID NO: 9225444 - DNA, 19 bp, Homo sapiens
tgcacacagataagtatct

SEQ ID NO: 9225445 - DNA, 22 bp, Homo sapiens
tgcaatgtgttagatggtttta

SEQ ID NO: 9225446 - DNA, 22 bp, Homo sapiens
tgcaaggtcttctctctggagg

SEQ ID NO: 9225447 - DNA, 21 bp, Homo sapiens
tgcaatccagcctgggcgaca

SEQ ID NO: 9225448 - DNA, 22 bp, Homo sapiens
tgcaagggtagaagtgatggca

SEQ ID NO: 9225449 - DNA, 22 bp, Homo sapiens
tgcaaggatatttagtctagtg

SEQ ID NO: 9225450 - DNA, 22 bp, Homo sapiens
tgcaagcaagtttttgaagtgg

SEQ ID NO: 9225451 - DNA, 22 bp, Homo sapiens
tgcaacctgcactctgtcttta

SEQ ID NO: 9225452 - DNA, 22 bp, Homo sapiens
tgcaaatttctttagtacataa

SEQ ID NO: 9225453 - DNA, 22 bp, Homo sapiens
tgatttacttctggataaatcc

SEQ ID NO: 9225454 - DNA, 22 bp, Homo sapiens
tgatttaccagttactatcttg

SEQ ID NO: 9225455 - DNA, 22 bp, Homo sapiens
tgatttacagtagtgtctaaac

SEQ ID NO: 9225456 - DNA, 22 bp, Homo sapiens
tgatttacacatcaaagcagca

SEQ ID NO: 9225457 - DNA, 22 bp, Homo sapiens
tgatttacacacctatgattta

SEQ ID NO: 9225458 - DNA, 22 bp, Homo sapiens
tgatttacaattgtaaaagttt

SEQ ID NO: 9225459 - DNA, 22 bp, Homo sapiens
tgatttttagctattctgaaga

SEQ ID NO: 9225460 - DNA, 22 bp, Homo sapiens
tgatttttaaaattctccttgc

SEQ ID NO: 9225461 - DNA, 22 bp, Homo sapiens
tgcaaaaattgctggaatcttt

SEQ ID NO: 9225462 - DNA, 19 bp, Homo sapiens
tgcaaattctaaaaactga

SEQ ID NO: 9225463 - DNA, 22 bp, Homo sapiens
tgcaaatatttccttatagcca

SEQ ID NO: 9225464 - DNA, 22 bp, Homo sapiens
tgcaaacaatttcctataaagt

SEQ ID NO: 9225465 - DNA, 20 bp, Homo sapiens
tgcaaacacagagtgtatga

SEQ ID NO: 9225466 - DNA, 22 bp, Homo sapiens
tgatagagcactaagtagtgta

SEQ ID NO: 9225467 - DNA, 22 bp, Homo sapiens
tgatcccaatctttcctgctcc

SEQ ID NO: 9225468 - DNA, 22 bp, Homo sapiens
tgatcccaatctttcctgctcc

SEQ ID NO: 9225469 - DNA, 22 bp, Homo sapiens
tgatcccagatctgagagggtt

SEQ ID NO: 9225470 - DNA, 19 bp, Homo sapiens
tgatctggaaggaaccagg

SEQ ID NO: 9225471 - DNA, 22 bp, Homo sapiens
tgatctggaattccctgtggta

SEQ ID NO: 9225472 - DNA, 22 bp, Homo sapiens
tgatctggtcctactgtgggca

SEQ ID NO: 9225473 - DNA, 22 bp, Homo sapiens
tgatcaaattcaggagtctgga

SEQ ID NO: 9225474 - DNA, 22 bp, Homo sapiens
tgagtggagaacagaggctctc

SEQ ID NO: 9225475 - DNA, 22 bp, Homo sapiens
tgagtggacgtgaggctgagta

SEQ ID NO: 9225476 - DNA, 17 bp, Homo sapiens
tgagtggccgggggaca

SEQ ID NO: 9225477 - DNA, 19 bp, Homo sapiens
tgagtggagtgcaatgaag

SEQ ID NO: 9225478 - DNA, 20 bp, Homo sapiens
tgagtggccactgggtcgca

SEQ ID NO: 9225479 - DNA, 22 bp, Homo sapiens
tgagtggagactgtgtgtagag

SEQ ID NO: 9225480 - DNA, 21 bp, Homo sapiens
tgagtgccacctgctggccaa

SEQ ID NO: 9225481 - DNA, 22 bp, Homo sapiens
tgagtgagctggggagccggtg

SEQ ID NO: 9225482 - DNA, 22 bp, Homo sapiens
tgattaagttcaaaatatagaa

SEQ ID NO: 9225483 - DNA, 23 bp, Homo sapiens
tgattcagcaagtccacttctgg

SEQ ID NO: 9225484 - DNA, 22 bp, Homo sapiens
tgatttaaaagaaacattgtct

SEQ ID NO: 9225485 - DNA, 22 bp, Homo sapiens
tgatgggaggtgctgcaggacc

SEQ ID NO: 9225486 - DNA, 23 bp, Homo sapiens
tgatggccgccctttgccctgtc

SEQ ID NO: 9225487 - DNA, 22 bp, Homo sapiens
tgccaggccctcccacagatta

SEQ ID NO: 9225488 - DNA, 22 bp, Homo sapiens
tgccaggccctcccacagatta

SEQ ID NO: 9225489 - DNA, 22 bp, Homo sapiens
tgccaggccctgcggggtccca

SEQ ID NO: 9225490 - DNA, 22 bp, Homo sapiens
tgccaggcccagctccagagct

SEQ ID NO: 9225491 - DNA, 22 bp, Homo sapiens
tgccaggcccagctccagagct

SEQ ID NO: 9225492 - DNA, 22 bp, Homo sapiens
tgccaggcccagctccagagct

SEQ ID NO: 9225493 - DNA, 22 bp, Homo sapiens
tgccaggctaagtggaggactt

SEQ ID NO: 9225494 - DNA, 22 bp, Homo sapiens
tgccaggccctgtgctggatgc

SEQ ID NO: 9225495 - DNA, 22 bp, Homo sapiens
tgccaggctaagtggaggactt

SEQ ID NO: 9225496 - DNA, 22 bp, Homo sapiens
tgccaggccctgtgctggatgc

SEQ ID NO: 9225497 - DNA, 22 bp, Homo sapiens
tgccaggccctgtgctggatgc

SEQ ID NO: 9225498 - DNA, 22 bp, Homo sapiens
tgccaggcatttgacagacact

SEQ ID NO: 9225499 - DNA, 22 bp, Homo sapiens
tgccaggccaatgaaggcaggg

SEQ ID NO: 9225500 - DNA, 22 bp, Homo sapiens
tgccaggccacgtagcttcaag

SEQ ID NO: 9225501 - DNA, 22 bp, Homo sapiens
tgccaggcccagcagggcggcc

SEQ ID NO: 9225502 - DNA, 22 bp, Homo sapiens
tgccaggcccagctccagagct

SEQ ID NO: 9225503 - DNA, 19 bp, Homo sapiens
tgccagctcacaggagctc

SEQ ID NO: 9225504 - DNA, 22 bp, Homo sapiens
tgccagctcccttttctcctcc

SEQ ID NO: 9225505 - DNA, 22 bp, Homo sapiens
tgccagcctggcctgagtcttt

SEQ ID NO: 9225506 - DNA, 18 bp, Homo sapiens
tgccagccgactggcctg

SEQ ID NO: 9225507 - DNA, 22 bp, Homo sapiens
tgccagctactctgtaggctga

SEQ ID NO: 9225508 - DNA, 22 bp, Homo sapiens
tgccagcgtgaagctgggcccc

SEQ ID NO: 9225509 - DNA, 22 bp, Homo sapiens
tgccagcccaccttggggcctc

SEQ ID NO: 9225510 - DNA, 22 bp, Homo sapiens
tgccagctagagaagctagaaa

SEQ ID NO: 9225511 - DNA, 17 bp, Homo sapiens
tgccagcctgtcccagg

SEQ ID NO: 9225512 - DNA, 22 bp, Homo sapiens
tgccaggcatatggcctctttg

SEQ ID NO: 9225513 - DNA, 22 bp, Homo sapiens
tgccaggcatgtagtagacttg

SEQ ID NO: 9225514 - DNA, 22 bp, Homo sapiens
tgccaggcagtgtcagattgag

SEQ ID NO: 9225515 - DNA, 22 bp, Homo sapiens
tgccaggcagtgtcagattgag

SEQ ID NO: 9225516 - DNA, 22 bp, Homo sapiens
tgccaggcacgtgagagtggcc

SEQ ID NO: 9225517 - DNA, 22 bp, Homo sapiens
tgccaggcacgtgagagtggcc

SEQ ID NO: 9225518 - DNA, 22 bp, Homo sapiens
tgccaggcacgtgagagtggcc

SEQ ID NO: 9225519 - DNA, 22 bp, Homo sapiens
tgccaggcaggaccctagaacc

SEQ ID NO: 9225520 - DNA, 20 bp, Homo sapiens
tgccaggcacggagtgcatg

SEQ ID NO: 9225521 - DNA, 22 bp, Homo sapiens
tgccatctgcacccacctgccc

SEQ ID NO: 9225522 - DNA, 22 bp, Homo sapiens
tgccatcttccttcctctgcac

SEQ ID NO: 9225523 - DNA, 22 bp, Homo sapiens
tgccatggaagtggccagacct

SEQ ID NO: 9225524 - DNA, 17 bp, Homo sapiens
tgccatcccccttgggc

SEQ ID NO: 9225525 - DNA, 22 bp, Homo sapiens
tgccatccaacagttccatctt

SEQ ID NO: 9225526 - DNA, 22 bp, Homo sapiens
tgccagtccattgcctgcgttc

SEQ ID NO: 9225527 - DNA, 22 bp, Homo sapiens
tgccagggtgtcaggagagcta

SEQ ID NO: 9225528 - DNA, 23 bp, Homo sapiens
tgccagggtttgtttgtggttca

SEQ ID NO: 9225529 - DNA, 22 bp, Homo sapiens
tgccaggggacctagggatgtc

SEQ ID NO: 9225530 - DNA, 22 bp, Homo sapiens
tgccaggggacctagggatgtc

SEQ ID NO: 9225531 - DNA, 22 bp, Homo sapiens
tgccagggtcagctgcagctct

SEQ ID NO: 9225532 - DNA, 22 bp, Homo sapiens
tgccagggctgctactggctga

SEQ ID NO: 9225533 - DNA, 22 bp, Homo sapiens
tgccagggccatagggagtcta

SEQ ID NO: 9225534 - DNA, 20 bp, Homo sapiens
tgccagggccagcagaggct

SEQ ID NO: 9225535 - DNA, 22 bp, Homo sapiens
tgccagggagccctgctgacca

SEQ ID NO: 9225536 - DNA, 22 bp, Homo sapiens
tgccagggagccctgctgacca

SEQ ID NO: 9225537 - DNA, 21 bp, Homo sapiens
tgccagggatttacagagcct

SEQ ID NO: 9225538 - DNA, 22 bp, Homo sapiens
tgccaggctttggtcaaaggct

SEQ ID NO: 9225539 - DNA, 22 bp, Homo sapiens
tgccaggcttagagcaggggct

SEQ ID NO: 9225540 - DNA, 20 bp, Homo sapiens
tgccaggctgcacgcctgcc

SEQ ID NO: 9225541 - DNA, 20 bp, Homo sapiens
tgccaggctgcacgcctgcc

SEQ ID NO: 9225542 - DNA, 22 bp, Homo sapiens
tgccaggctgccctccagtctg

SEQ ID NO: 9225543 - DNA, 22 bp, Homo sapiens
tgccaggctgtcctgggcctgg

SEQ ID NO: 9225544 - DNA, 22 bp, Homo sapiens
tgccaggctgaacagggtctta

SEQ ID NO: 9225545 - DNA, 22 bp, Homo sapiens
tgccaggctgaacagggtctta

SEQ ID NO: 9225546 - DNA, 22 bp, Homo sapiens
tgccaggctccggaacgacagt

SEQ ID NO: 9225547 - DNA, 22 bp, Homo sapiens
tgccatgtttaaagttgaaggg

SEQ ID NO: 9225548 - DNA, 20 bp, Homo sapiens
tgccatggtaacagagtgtg

SEQ ID NO: 9225549 - DNA, 22 bp, Homo sapiens
tgccatttctttcaatattctt

SEQ ID NO: 9225550 - DNA, 20 bp, Homo sapiens
tgcccacatcactcaggagt

SEQ ID NO: 9225551 - DNA, 22 bp, Homo sapiens
tgcccacagctcagggctgctc

SEQ ID NO: 9225552 - DNA, 21 bp, Homo sapiens
tgcccacagcaaatgcagagg

SEQ ID NO: 9225553 - DNA, 21 bp, Homo sapiens
tgcccaccaagctccacactg

SEQ ID NO: 9225554 - DNA, 20 bp, Homo sapiens
tgcccagcaagagtgcagtt

SEQ ID NO: 9225555 - DNA, 22 bp, Homo sapiens
tgcccagcacccagcatgatgc

SEQ ID NO: 9225556 - DNA, 19 bp, Homo sapiens
tgcccaggcctcccaaaag

SEQ ID NO: 9225557 - DNA, 22 bp, Homo sapiens
tgcccaggattgtgaggtcagg

SEQ ID NO: 9225558 - DNA, 19 bp, Homo sapiens
tgcccaggccaggttgggc

SEQ ID NO: 9225559 - DNA, 22 bp, Homo sapiens
tgcccaggctggagtgcagagg

SEQ ID NO: 9225560 - DNA, 21 bp, Homo sapiens
tgcccaggggccaaccgctgc

SEQ ID NO: 9225561 - DNA, 22 bp, Homo sapiens
tgcccaggtttgagtgcccaag

SEQ ID NO: 9225562 - DNA, 22 bp, Homo sapiens
tgcccaggtttgagtgcccaag

SEQ ID NO: 9225563 - DNA, 22 bp, Homo sapiens
tgcccagggtggagtgcagcgg

SEQ ID NO: 9225564 - DNA, 22 bp, Homo sapiens
tgcccagggtttctaagagcag

SEQ ID NO: 9225565 - DNA, 22 bp, Homo sapiens
tgcccctcgacgcaatgaaggg

SEQ ID NO: 9225566 - DNA, 22 bp, Homo sapiens
tgcccctctcctgtgatccaag

SEQ ID NO: 9225567 - DNA, 22 bp, Homo sapiens
tgcccctcagggaacgggtatc

SEQ ID NO: 9225568 - DNA, 19 bp, Homo sapiens
tgcccccagcacctccctg

SEQ ID NO: 9225569 - DNA, 22 bp, Homo sapiens
tgcccccaggccctgtggttag

SEQ ID NO: 9225570 - DNA, 22 bp, Homo sapiens
tgcccccagacagaatccagtt

SEQ ID NO: 9225571 - DNA, 22 bp, Homo sapiens
tgcctggcaccccagtctgcac

SEQ ID NO: 9225572 - DNA, 22 bp, Homo sapiens
tgcctggcaccccagtctgcac

SEQ ID NO: 9225573 - DNA, 22 bp, Homo sapiens
tgcctggcaatgccagaagcca

SEQ ID NO: 9225574 - DNA, 22 bp, Homo sapiens
tgcctggcaagaggggctggct

SEQ ID NO: 9225575 - DNA, 22 bp, Homo sapiens
tgcctgccaggtgcttcttcat

SEQ ID NO: 9225576 - DNA, 22 bp, Homo sapiens
tgcctgccatgcagaaagctga

SEQ ID NO: 9225577 - DNA, 22 bp, Homo sapiens
tgcctgctgattggagttgaat

SEQ ID NO: 9225578 - DNA, 22 bp, Homo sapiens
tgcctgccccacaaggggttgc

SEQ ID NO: 9225579 - DNA, 22 bp, Homo sapiens
tgcctgctgccactgctgttac

SEQ ID NO: 9225580 - DNA, 22 bp, Homo sapiens
tgcctgcttgtgtacctggtga

SEQ ID NO: 9225581 - DNA, 22 bp, Homo sapiens
tgcctgcttgtttacctactcc

SEQ ID NO: 9225582 - DNA, 22 bp, Homo sapiens
tgcctcagctgaggccgctcca

SEQ ID NO: 9225583 - DNA, 22 bp, Homo sapiens
tgcctcgtgtctgagtctgttc

SEQ ID NO: 9225584 - DNA, 22 bp, Homo sapiens
tgcctccctggcaagtctctcc

SEQ ID NO: 9225585 - DNA, 22 bp, Homo sapiens
tgcctctgaggaagattgtgtt

SEQ ID NO: 9225586 - DNA, 22 bp, Homo sapiens
tgcctctgtgggcagagctgcc

SEQ ID NO: 9225587 - DNA, 22 bp, Homo sapiens
tgcctctgtgtgcaggtgagca

SEQ ID NO: 9225588 - DNA, 22 bp, Homo sapiens
tgcctgaatgatcagtcagatt

SEQ ID NO: 9225589 - DNA, 22 bp, Homo sapiens
tgcctgaattcaattcctggct

SEQ ID NO: 9225590 - DNA, 22 bp, Homo sapiens
tgcctgaacatgaatagtttat

SEQ ID NO: 9225591 - DNA, 22 bp, Homo sapiens
tgcctcttggagcctttcctct

SEQ ID NO: 9225592 - DNA, 22 bp, Homo sapiens
tgcctctgtggaaatggtggtc

SEQ ID NO: 9225593 - DNA, 22 bp, Homo sapiens
tgcctctgtgggccttcctggc

SEQ ID NO: 9225594 - DNA, 22 bp, Homo sapiens
tgccctggaaccatctacagtc

SEQ ID NO: 9225595 - DNA, 22 bp, Homo sapiens
tgccctggaaatgagaggtgtg

SEQ ID NO: 9225596 - DNA, 22 bp, Homo sapiens
tgccctggctcctcccacgctg

SEQ ID NO: 9225597 - DNA, 22 bp, Homo sapiens
tgccctggctctccactagttt

SEQ ID NO: 9225598 - DNA, 19 bp, Homo sapiens
tgccctgcccgcagccttg

SEQ ID NO: 9225599 - DNA, 22 bp, Homo sapiens
tgccctgccaagactcagtggt

SEQ ID NO: 9225600 - DNA, 22 bp, Homo sapiens
tgccctgccaagaccaagtggt

SEQ ID NO: 9225601 - DNA, 22 bp, Homo sapiens
tgccctcaagcaacagagagga

SEQ ID NO: 9225602 - DNA, 22 bp, Homo sapiens
tgcccctgacctcaggcgaagg

SEQ ID NO: 9225603 - DNA, 22 bp, Homo sapiens
tgcccctcttgagaagctcagc

SEQ ID NO: 9225604 - DNA, 22 bp, Homo sapiens
tgcccctcttgctggccctgtc

SEQ ID NO: 9225605 - DNA, 22 bp, Homo sapiens
tgccctgggaacacagatgcca

SEQ ID NO: 9225606 - DNA, 22 bp, Homo sapiens
tgccgcagtgcggggagggccc

SEQ ID NO: 9225607 - DNA, 22 bp, Homo sapiens
tgccggctggacctgagccagc

SEQ ID NO: 9225608 - DNA, 22 bp, Homo sapiens
tgcctaaaccattccccttcct

SEQ ID NO: 9225609 - DNA, 22 bp, Homo sapiens
tgcctaggctggaatgcagtgg

SEQ ID NO: 9225610 - DNA, 22 bp, Homo sapiens
tgcctaggaaacctcatgcttc

SEQ ID NO: 9225611 - DNA, 22 bp, Homo sapiens
tgcctagggcctaaccagagcc

SEQ ID NO: 9225612 - DNA, 23 bp, Homo sapiens
tgccaaagtttacctaacactgg

SEQ ID NO: 9225613 - DNA, 22 bp, Homo sapiens
tgccaaaatggccaaaagctag

SEQ ID NO: 9225614 - DNA, 22 bp, Homo sapiens
tgcatttttgaggttaactcaa

SEQ ID NO: 9225615 - DNA, 22 bp, Homo sapiens
tgcatttttaacaaggctaatt

SEQ ID NO: 9225616 - DNA, 22 bp, Homo sapiens
tgcattcctttgtctgttaaag

SEQ ID NO: 9225617 - DNA, 22 bp, Homo sapiens
tgccagaacagctcatctggcc

SEQ ID NO: 9225618 - DNA, 22 bp, Homo sapiens
tgccaccatctggctgtgttga

SEQ ID NO: 9225619 - DNA, 22 bp, Homo sapiens
tgccaccaggagaaccagtgca

SEQ ID NO: 9225620 - DNA, 22 bp, Homo sapiens
tgccaccaggagaaccagtgca

SEQ ID NO: 9225621 - DNA, 22 bp, Homo sapiens
tgccacagttgtttgtgctcta

SEQ ID NO: 9225622 - DNA, 22 bp, Homo sapiens
tgccacagtttcatggattctg

SEQ ID NO: 9225623 - DNA, 22 bp, Homo sapiens
tgccacagtttcatggattctg

SEQ ID NO: 9225624 - DNA, 22 bp, Homo sapiens
tgccaagaccacaattgctttt

SEQ ID NO: 9225625 - DNA, 22 bp, Homo sapiens
tgccacaggcaatccctgcacg

SEQ ID NO: 9225626 - DNA, 22 bp, Homo sapiens
tgccacagggtcctcaggccag

SEQ ID NO: 9225627 - DNA, 22 bp, Homo sapiens
tgccagcagtagcagtaggcca

SEQ ID NO: 9225628 - DNA, 23 bp, Homo sapiens
tgccagcagggaatgggaaggac

SEQ ID NO: 9225629 - DNA, 22 bp, Homo sapiens
tgccagcagaaataaatacttg

SEQ ID NO: 9225630 - DNA, 21 bp, Homo sapiens
tgccagcattaaacagtcatt

SEQ ID NO: 9225631 - DNA, 21 bp, Homo sapiens
tgccagcatgtaggctagttg

SEQ ID NO: 9225632 - DNA, 19 bp, Homo sapiens
tgccagcattaggctgaag

SEQ ID NO: 9225633 - DNA, 19 bp, Homo sapiens
tgccagcattaggctgaag

SEQ ID NO: 9225634 - DNA, 22 bp, Homo sapiens
tgccagccaggttctgaggcta

SEQ ID NO: 9225635 - DNA, 22 bp, Homo sapiens
tgccagcccaccttggggcctc

SEQ ID NO: 9225636 - DNA, 23 bp, Homo sapiens
tgccagaggcagtcacagtggtg

SEQ ID NO: 9225637 - DNA, 22 bp, Homo sapiens
tgccagcacaagttaagagatc

SEQ ID NO: 9225638 - DNA, 22 bp, Homo sapiens
tgccagcacttctggctgtctg

SEQ ID NO: 9225639 - DNA, 22 bp, Homo sapiens
tgccagcaagaatagacagtaa

SEQ ID NO: 9225640 - DNA, 18 bp, Homo sapiens
tgcatatactgcctatct

SEQ ID NO: 9225641 - DNA, 22 bp, Homo sapiens
tgcatctgattctcaggcagaa

SEQ ID NO: 9225642 - DNA, 20 bp, Homo sapiens
tgcatctagtaagagtgtca

SEQ ID NO: 9225643 - DNA, 22 bp, Homo sapiens
tgcatagggaacctcatgcatt

SEQ ID NO: 9225644 - DNA, 22 bp, Homo sapiens
tgcatagaggatccagtgtggt

SEQ ID NO: 9225645 - DNA, 22 bp, Homo sapiens
tgcataaaacatgatttctgct

SEQ ID NO: 9225646 - DNA, 19 bp, Homo sapiens
tgcataaattatatacttt

SEQ ID NO: 9225647 - DNA, 22 bp, Homo sapiens
tgcatgttaagaaaatattgag

SEQ ID NO: 9225648 - DNA, 22 bp, Homo sapiens
tgcatctgttcagagctgtcga

SEQ ID NO: 9225649 - DNA, 22 bp, Homo sapiens
tgcatgcatgtgagcatgcata

SEQ ID NO: 9225650 - DNA, 23 bp, Homo sapiens
tgcatgctaacacagtgcacagg

SEQ ID NO: 9225651 - DNA, 18 bp, Homo sapiens
tgcatgccaggttctgtg

SEQ ID NO: 9225652 - DNA, 22 bp, Homo sapiens
tgcatggaacggtctcctggtc

SEQ ID NO: 9225653 - DNA, 22 bp, Homo sapiens
tgcatgctaagaaatagcagct

SEQ ID NO: 9225654 - DNA, 22 bp, Homo sapiens
tgcaggctctctgctgccagat

SEQ ID NO: 9225655 - DNA, 22 bp, Homo sapiens
tgcaggctggggaggcagactt

SEQ ID NO: 9225656 - DNA, 22 bp, Homo sapiens
tgcaggctgtaatctgaggcta

SEQ ID NO: 9225657 - DNA, 22 bp, Homo sapiens
tgcaggctgctcaagacttagt

SEQ ID NO: 9225658 - DNA, 22 bp, Homo sapiens
tgcaggctgccttcacagagcc

SEQ ID NO: 9225659 - DNA, 22 bp, Homo sapiens
tgcaggctgctggcagtagctt

SEQ ID NO: 9225660 - DNA, 22 bp, Homo sapiens
tgcagggaaaacccaggatgct

SEQ ID NO: 9225661 - DNA, 22 bp, Homo sapiens
tgcaggctttagccccatggct

SEQ ID NO: 9225662 - DNA, 22 bp, Homo sapiens
tgcaggctttagccccatggct

SEQ ID NO: 9225663 - DNA, 20 bp, Homo sapiens
tgcaggcttcgctctaggag

SEQ ID NO: 9225664 - DNA, 21 bp, Homo sapiens
tgcaggctgtttaagaggcaa

SEQ ID NO: 9225665 - DNA, 22 bp, Homo sapiens
tgcagggaacttggacagctag

SEQ ID NO: 9225666 - DNA, 22 bp, Homo sapiens
tgcagggaagcaagggtggctc

SEQ ID NO: 9225667 - DNA, 22 bp, Homo sapiens
tgcagggcagtttgtttcggca

SEQ ID NO: 9225668 - DNA, 22 bp, Homo sapiens
tgcagggccagactgggttgga

SEQ ID NO: 9225669 - DNA, 22 bp, Homo sapiens
tgcagggccatggtggcggctg

SEQ ID NO: 9225670 - DNA, 22 bp, Homo sapiens
tgcagggctacaggactacaac

SEQ ID NO: 9225671 - DNA, 22 bp, Homo sapiens
tgcagggcccttggggttgaac

SEQ ID NO: 9225672 - DNA, 22 bp, Homo sapiens
tgcagggcacacgcacgggtgt

SEQ ID NO: 9225673 - DNA, 22 bp, Homo sapiens
tgcagggcagtggaggttgagt

SEQ ID NO: 9225674 - DNA, 22 bp, Homo sapiens
tgcaggggcttgtctgggcctg

SEQ ID NO: 9225675 - DNA, 22 bp, Homo sapiens
tgcagggcttcctcttggagtt

SEQ ID NO: 9225676 - DNA, 22 bp, Homo sapiens
tgcaggtaggcctgacttccag

SEQ ID NO: 9225677 - DNA, 22 bp, Homo sapiens
tgcagtccctggcccactttaa

SEQ ID NO: 9225678 - DNA, 22 bp, Homo sapiens
tgcagtggtggtaaagatgctc

SEQ ID NO: 9225679 - DNA, 22 bp, Homo sapiens
tgcagtgggccggaggccaggg

SEQ ID NO: 9225680 - DNA, 22 bp, Homo sapiens
tgcagtgttcctgtagcctgcc

SEQ ID NO: 9225681 - DNA, 23 bp, Homo sapiens
tgagaagccgccgggcagcctgg

SEQ ID NO: 9225682 - DNA, 22 bp, Homo sapiens
tgagaaccatgaaaagctgtca

SEQ ID NO: 9225683 - DNA, 23 bp, Homo sapiens
tgagaaattttgattcagtagga

SEQ ID NO: 9225684 - DNA, 22 bp, Homo sapiens
tgagaaagcctttagtcccagg

SEQ ID NO: 9225685 - DNA, 19 bp, Homo sapiens
tgagaaattccacaggatg

SEQ ID NO: 9225686 - DNA, 22 bp, Homo sapiens
tgagaaatgggtctgctgaaga

SEQ ID NO: 9225687 - DNA, 22 bp, Homo sapiens
tgagaaagtgggtgcctagcaa

SEQ ID NO: 9225688 - DNA, 22 bp, Homo sapiens
tgagaaatattgcacagtgagg

SEQ ID NO: 9225689 - DNA, 22 bp, Homo sapiens
tgagacaaaattgacagacaaa

SEQ ID NO: 9225690 - DNA, 22 bp, Homo sapiens
tgagacagcagtcagggaaata

SEQ ID NO: 9225691 - DNA, 22 bp, Homo sapiens
tgagacagcctctgcactcatg

SEQ ID NO: 9225692 - DNA, 17 bp, Homo sapiens
tgagacagggcaggccc

SEQ ID NO: 9225693 - DNA, 17 bp, Homo sapiens
tgagacagggcaggccc

SEQ ID NO: 9225694 - DNA, 22 bp, Homo sapiens
tgagaggctagatcagctctgt

SEQ ID NO: 9225695 - DNA, 22 bp, Homo sapiens
tgagaggcgctcactctcaggt

SEQ ID NO: 9225696 - DNA, 22 bp, Homo sapiens
tgagaggcgctcactctcaggt

SEQ ID NO: 9225697 - DNA, 22 bp, Homo sapiens
tgagagagcgcctgggatcatt

SEQ ID NO: 9225698 - DNA, 22 bp, Homo sapiens
tgagagagtaattgagtggtaa

SEQ ID NO: 9225699 - DNA, 22 bp, Homo sapiens
tgagagagcctgaatctcttac

SEQ ID NO: 9225700 - DNA, 22 bp, Homo sapiens
tgagatgggtggggagctcagg

SEQ ID NO: 9225701 - DNA, 22 bp, Homo sapiens
tgagatggggagggctgcagaa

SEQ ID NO: 9225702 - DNA, 22 bp, Homo sapiens
tgagatctgctaattgactgac

SEQ ID NO: 9225703 - DNA, 22 bp, Homo sapiens
tgagatgcaggagatgggactg

SEQ ID NO: 9225704 - DNA, 22 bp, Homo sapiens
tgagatgaataactcctgctaa

SEQ ID NO: 9225705 - DNA, 22 bp, Homo sapiens
tgagcagaggagtgacgtaggt

SEQ ID NO: 9225706 - DNA, 22 bp, Homo sapiens
tgagcagaggccagcacctggg

SEQ ID NO: 9225707 - DNA, 22 bp, Homo sapiens
tgagcagagcagtaacaggagc

SEQ ID NO: 9225708 - DNA, 22 bp, Homo sapiens
tgagcagaggaggctgccaact

SEQ ID NO: 9225709 - DNA, 22 bp, Homo sapiens
tgagcagatgtctaacttttac

SEQ ID NO: 9225710 - DNA, 22 bp, Homo sapiens
tgagcagatggaggcttctgca

SEQ ID NO: 9225711 - DNA, 22 bp, Homo sapiens
tgagcagatggaggcttctgca

SEQ ID NO: 9225712 - DNA, 22 bp, Homo sapiens
tgagcagagtcgctccagagtg

SEQ ID NO: 9225713 - DNA, 22 bp, Homo sapiens
tgagcagagttgtttctcctga

SEQ ID NO: 9225714 - DNA, 18 bp, Homo sapiens
tgagcagagtaaggcttt

SEQ ID NO: 9225715 - DNA, 22 bp, Homo sapiens
tgagcagagtcgctccagagtg

SEQ ID NO: 9225716 - DNA, 23 bp, Homo sapiens
tgagcaagtgaccaactgtctgt

SEQ ID NO: 9225717 - DNA, 22 bp, Homo sapiens
tgagcaaggagcagtctttctt

SEQ ID NO: 9225718 - DNA, 22 bp, Homo sapiens
tgagcagagacttcaagggcag

SEQ ID NO: 9225719 - DNA, 22 bp, Homo sapiens
tgagcagagcaataggactctc

SEQ ID NO: 9225720 - DNA, 22 bp, Homo sapiens
tgagcagagcaggctgcgccct

SEQ ID NO: 9225721 - DNA, 22 bp, Homo sapiens
tgagcagagatgactgggcatt

SEQ ID NO: 9225722 - DNA, 22 bp, Homo sapiens
tgagcaggactcactgcagcct

SEQ ID NO: 9225723 - DNA, 22 bp, Homo sapiens
tgagcagcaactgtccatggca

SEQ ID NO: 9225724 - DNA, 22 bp, Homo sapiens
tgagcagatttgttctaggggt

SEQ ID NO: 9225725 - DNA, 22 bp, Homo sapiens
tgagcagatgtgccaaactgta

SEQ ID NO: 9225726 - DNA, 22 bp, Homo sapiens
tgagcagcaggatcttctggta

SEQ ID NO: 9225727 - DNA, 22 bp, Homo sapiens
tgagcagcccttcctccggcca

SEQ ID NO: 9225728 - DNA, 23 bp, Homo sapiens
tgagcagctaaaggtgatgcggg

SEQ ID NO: 9225729 - DNA, 22 bp, Homo sapiens
tgagccagccttgcagctgtgc

SEQ ID NO: 9225730 - DNA, 22 bp, Homo sapiens
tgagccagccttgcagctgtgc

SEQ ID NO: 9225731 - DNA, 22 bp, Homo sapiens
tgagccagcctcagaagtcacg

SEQ ID NO: 9225732 - DNA, 22 bp, Homo sapiens
tgagccagataagggctcacgc

SEQ ID NO: 9225733 - DNA, 22 bp, Homo sapiens
tgagccagataagggctcacgc

SEQ ID NO: 9225734 - DNA, 22 bp, Homo sapiens
tgagccaggagtttgaggctgt

SEQ ID NO: 9225735 - DNA, 20 bp, Homo sapiens
tgagccaggctaggaagggc

SEQ ID NO: 9225736 - DNA, 22 bp, Homo sapiens
tgagccaggctcaagtgatcct

SEQ ID NO: 9225737 - DNA, 22 bp, Homo sapiens
tgagccaggcccagtggggtca

SEQ ID NO: 9225738 - DNA, 22 bp, Homo sapiens
tgagccaggctccatgccacct

SEQ ID NO: 9225739 - DNA, 19 bp, Homo sapiens
tgagccagggaggccatgc

SEQ ID NO: 9225740 - DNA, 19 bp, Homo sapiens
tgagccagggaggccatgc

SEQ ID NO: 9225741 - DNA, 22 bp, Homo sapiens
tgagccaaggcctcaagaattt

SEQ ID NO: 9225742 - DNA, 22 bp, Homo sapiens
tgagccacagtgagagctcctg

SEQ ID NO: 9225743 - DNA, 22 bp, Homo sapiens
tgagccagagaggttgaggcta

SEQ ID NO: 9225744 - DNA, 22 bp, Homo sapiens
tgagccagagtggagtgtgcct

SEQ ID NO: 9225745 - DNA, 22 bp, Homo sapiens
tgagccagagtggagtgtgcct

SEQ ID NO: 9225746 - DNA, 22 bp, Homo sapiens
tgagcagtggcaccaggtcacc

SEQ ID NO: 9225747 - DNA, 22 bp, Homo sapiens
tgagcagggactttggagtctg

SEQ ID NO: 9225748 - DNA, 22 bp, Homo sapiens
tgagcttgctacatagatcaga

SEQ ID NO: 9225749 - DNA, 22 bp, Homo sapiens
tgagcttcctccctgcatccat

SEQ ID NO: 9225750 - DNA, 22 bp, Homo sapiens
tgagcttctttatttggccaga

SEQ ID NO: 9225751 - DNA, 22 bp, Homo sapiens
tgagcttccctcctgcactaca

SEQ ID NO: 9225752 - DNA, 22 bp, Homo sapiens
tgagcttttaatatacaggtgt

SEQ ID NO: 9225753 - DNA, 22 bp, Homo sapiens
tgaggaaacttacaaggcagaa

SEQ ID NO: 9225754 - DNA, 22 bp, Homo sapiens
tgaggaaacttacaaggcagaa

SEQ ID NO: 9225755 - DNA, 22 bp, Homo sapiens
tgagcttcaaagttggatctga

SEQ ID NO: 9225756 - DNA, 17 bp, Homo sapiens
tgagcttcaatcaggtg

SEQ ID NO: 9225757 - DNA, 22 bp, Homo sapiens
tgagctggaggacaggagggta

SEQ ID NO: 9225758 - DNA, 22 bp, Homo sapiens
tgagctggaggacaggagggta

SEQ ID NO: 9225759 - DNA, 22 bp, Homo sapiens
tgagctggttcttgaggcatga

SEQ ID NO: 9225760 - DNA, 22 bp, Homo sapiens
tgagctggttcttgaggcatga

SEQ ID NO: 9225761 - DNA, 22 bp, Homo sapiens
tgagctggttcttgaggcatga

SEQ ID NO: 9225762 - DNA, 22 bp, Homo sapiens
tgagctggtcactccttctgaa

SEQ ID NO: 9225763 - DNA, 22 bp, Homo sapiens
tgagctaggtgtgcagatatga

SEQ ID NO: 9225764 - DNA, 22 bp, Homo sapiens
tgagcctgagttcaaggctgca

SEQ ID NO: 9225765 - DNA, 22 bp, Homo sapiens
tgagcctgcctgcaggtgtgct

SEQ ID NO: 9225766 - DNA, 22 bp, Homo sapiens
tgagccgtggtctctgagggtg

SEQ ID NO: 9225767 - DNA, 22 bp, Homo sapiens
tgagccccggagtttcaggctg

SEQ ID NO: 9225768 - DNA, 22 bp, Homo sapiens
tgagccagtctgtctgggtgaa

SEQ ID NO: 9225769 - DNA, 22 bp, Homo sapiens
tgagccagtctgtctgggtgaa

SEQ ID NO: 9225770 - DNA, 22 bp, Homo sapiens
tgagccagtctctcagaaccct

SEQ ID NO: 9225771 - DNA, 22 bp, Homo sapiens
tgagccaggttttccatcattc

SEQ ID NO: 9225772 - DNA, 20 bp, Homo sapiens
tgagccagtcaagctacatt

SEQ ID NO: 9225773 - DNA, 22 bp, Homo sapiens
tgagccaggttaagacaggagc

SEQ ID NO: 9225774 - DNA, 22 bp, Homo sapiens
tgagggactcagaattcagcct

SEQ ID NO: 9225775 - DNA, 22 bp, Homo sapiens
tgagggactgcatacccagctt

SEQ ID NO: 9225776 - DNA, 19 bp, Homo sapiens
tgagggacattgggagcag

SEQ ID NO: 9225777 - DNA, 23 bp, Homo sapiens
tgagggacatggtggcttctgag

SEQ ID NO: 9225778 - DNA, 22 bp, Homo sapiens
tgagggacaccagggctggagc

SEQ ID NO: 9225779 - DNA, 22 bp, Homo sapiens
tgagggagctgacctttctgtg

SEQ ID NO: 9225780 - DNA, 22 bp, Homo sapiens
tgaggggagacagagtggactc

SEQ ID NO: 9225781 - DNA, 22 bp, Homo sapiens
tgaggggaactgatgcccattg

SEQ ID NO: 9225782 - DNA, 19 bp, Homo sapiens
tgaggggaggagaggcctg

SEQ ID NO: 9225783 - DNA, 22 bp, Homo sapiens
tgaggggaggttggggcacatc

SEQ ID NO: 9225784 - DNA, 22 bp, Homo sapiens
tgaggctcagagaagtgctgtt

SEQ ID NO: 9225785 - DNA, 22 bp, Homo sapiens
tgaggcctgcttggaattgaat

SEQ ID NO: 9225786 - DNA, 22 bp, Homo sapiens
tgaggcctggactctgcatgga

SEQ ID NO: 9225787 - DNA, 22 bp, Homo sapiens
tgaggcctggagggaggagttt

SEQ ID NO: 9225788 - DNA, 22 bp, Homo sapiens
tgaggcctgggcacataacctc

SEQ ID NO: 9225789 - DNA, 22 bp, Homo sapiens
tgaggctaaaggtgaccagatt

SEQ ID NO: 9225790 - DNA, 22 bp, Homo sapiens
tgaggttcagttcttggccaca

SEQ ID NO: 9225791 - DNA, 22 bp, Homo sapiens
tgagtctgggcatgttcacttt

SEQ ID NO: 9225792 - DNA, 22 bp, Homo sapiens
tgagtctgtatgtccagattta

SEQ ID NO: 9225793 - DNA, 22 bp, Homo sapiens
tgaggtgggtgtcaggtcagag

SEQ ID NO: 9225794 - DNA, 22 bp, Homo sapiens
tgaggtggttactgtggtgctc

SEQ ID NO: 9225795 - DNA, 22 bp, Homo sapiens
tgaggtggttactgtggtgctc

SEQ ID NO: 9225796 - DNA, 22 bp, Homo sapiens
tgaggtgtgtccccagggaggt

SEQ ID NO: 9225797 - DNA, 22 bp, Homo sapiens
tgaggtggctagggaggcactc

SEQ ID NO: 9225798 - DNA, 22 bp, Homo sapiens
tgaggggcgctggcaggttcct

SEQ ID NO: 9225799 - DNA, 22 bp, Homo sapiens
tgaggggcagagaggtgtccag

SEQ ID NO: 9225800 - DNA, 22 bp, Homo sapiens
tgaggggcgctggcaggttcct

SEQ ID NO: 9225801 - DNA, 22 bp, Homo sapiens
tgagggtctggaatctgggctt

SEQ ID NO: 9225802 - DNA, 22 bp, Homo sapiens
tgaggccaagcctcctctgcca

SEQ ID NO: 9225803 - DNA, 19 bp, Homo sapiens
tgaggccaaggtcacagat

SEQ ID NO: 9225804 - DNA, 19 bp, Homo sapiens
tgaggccaaggtcacagat

SEQ ID NO: 9225805 - DNA, 22 bp, Homo sapiens
tgaggccaagaaaagctgggtg

SEQ ID NO: 9225806 - DNA, 22 bp, Homo sapiens
tgaggccaagcctcctctgcca

SEQ ID NO: 9225807 - DNA, 22 bp, Homo sapiens
tgaggcagttgagcttcctgag

SEQ ID NO: 9225808 - DNA, 22 bp, Homo sapiens
tgaggccaaaatgactcaaatg

SEQ ID NO: 9225809 - DNA, 22 bp, Homo sapiens
tgaggccaactagggagatgga

SEQ ID NO: 9225810 - DNA, 22 bp, Homo sapiens
tgaggccaactagggagatgga

SEQ ID NO: 9225811 - DNA, 23 bp, Homo sapiens
tgaggcaggcggatcacgaggtc

SEQ ID NO: 9225812 - DNA, 23 bp, Homo sapiens
tgaggcaggcggatcacgaggtc

SEQ ID NO: 9225813 - DNA, 22 bp, Homo sapiens
tgaggcagggagagtggatatg

SEQ ID NO: 9225814 - DNA, 22 bp, Homo sapiens
tgaggcagggagagtggatatg

SEQ ID NO: 9225815 - DNA, 22 bp, Homo sapiens
tgaggcagggagagtggatatg

SEQ ID NO: 9225816 - DNA, 22 bp, Homo sapiens
tgaggcagtgtgagataataaa

SEQ ID NO: 9225817 - DNA, 22 bp, Homo sapiens
tgaggcaggagttcaggctgcg

SEQ ID NO: 9225818 - DNA, 22 bp, Homo sapiens
tgaggcaggagttaatgtgctc

SEQ ID NO: 9225819 - DNA, 22 bp, Homo sapiens
tgaggcaggagttaatgtgctc

SEQ ID NO: 9225820 - DNA, 22 bp, Homo sapiens
tgaggcaggagttcaggctgcg

SEQ ID NO: 9225821 - DNA, 20 bp, Homo sapiens
tgaggcaggagaatggcatg

SEQ ID NO: 9225822 - DNA, 20 bp, Homo sapiens
tgaggcaggagaatggcatg

SEQ ID NO: 9225823 - DNA, 22 bp, Homo sapiens
tgaggcaggagaatggcgggaa

SEQ ID NO: 9225824 - DNA, 22 bp, Homo sapiens
tgaggcaggagaatggcgggaa

SEQ ID NO: 9225825 - DNA, 22 bp, Homo sapiens
tgaggcaggagaatggcgggaa

SEQ ID NO: 9225826 - DNA, 22 bp, Homo sapiens
tgaggcaggaggattgcaggat

SEQ ID NO: 9225827 - DNA, 22 bp, Homo sapiens
tgaggcaggaggattgcaggat

SEQ ID NO: 9225828 - DNA, 22 bp, Homo sapiens
tgaggcaggaggttgagaactg

SEQ ID NO: 9225829 - DNA, 22 bp, Homo sapiens
tgaggccaggacccccagcagg

SEQ ID NO: 9225830 - DNA, 22 bp, Homo sapiens
tgaggccagcttcagcagtgga

SEQ ID NO: 9225831 - DNA, 22 bp, Homo sapiens
tgaggccagcttcagcagtgga

SEQ ID NO: 9225832 - DNA, 19 bp, Homo sapiens
tgaggccagctggcatttt

SEQ ID NO: 9225833 - DNA, 19 bp, Homo sapiens
tgaggccagctggcatttt

SEQ ID NO: 9225834 - DNA, 18 bp, Homo sapiens
tgaggccagagtgggcat

SEQ ID NO: 9225835 - DNA, 18 bp, Homo sapiens
tgaggccagagtgggcat

SEQ ID NO: 9225836 - DNA, 16 bp, Homo sapiens
tgaggccagccatttc

SEQ ID NO: 9225837 - DNA, 22 bp, Homo sapiens
tgaggccagccacagccaccct

SEQ ID NO: 9225838 - DNA, 22 bp, Homo sapiens
tgaggccagagtttttaattcc

SEQ ID NO: 9225839 - DNA, 22 bp, Homo sapiens
tgaggccacaggaaagggcccg

SEQ ID NO: 9225840 - DNA, 22 bp, Homo sapiens
tgaggccacagtatcagaacag

SEQ ID NO: 9225841 - DNA, 22 bp, Homo sapiens
tgaggccagactgaaaccaaca

SEQ ID NO: 9225842 - DNA, 22 bp, Homo sapiens
tgaggccagagagtttgcattt

SEQ ID NO: 9225843 - DNA, 22 bp, Homo sapiens
tgaggccacttccccacagccc

SEQ ID NO: 9225844 - DNA, 22 bp, Homo sapiens
tgaggccacttccccacagccc

SEQ ID NO: 9225845 - DNA, 21 bp, Homo sapiens
tgaggccaatagcccctggac

SEQ ID NO: 9225846 - DNA, 22 bp, Homo sapiens
tgaggccacaggaaagggcccg

SEQ ID NO: 9225847 - DNA, 22 bp, Homo sapiens
tgaggccacaggaaagggcccg

SEQ ID NO: 9225848 - DNA, 22 bp, Homo sapiens
tgaggccaatgaccctgggcag

SEQ ID NO: 9225849 - DNA, 22 bp, Homo sapiens
tgaggcctcatttagggagagg

SEQ ID NO: 9225850 - DNA, 22 bp, Homo sapiens
tgaggccctagggcatgggaga

SEQ ID NO: 9225851 - DNA, 22 bp, Homo sapiens
tgaggccaggatcccaggctct

SEQ ID NO: 9225852 - DNA, 22 bp, Homo sapiens
tgaggccccgaagctgaggttt

SEQ ID NO: 9225853 - DNA, 22 bp, Homo sapiens
tgaggccaggatcccaggctct

SEQ ID NO: 9225854 - DNA, 22 bp, Homo sapiens
tgaggccaggacccccagcagg

SEQ ID NO: 9225855 - DNA, 17 bp, Homo sapiens
tgaggcctgcatcagtg

SEQ ID NO: 9225856 - DNA, 22 bp, Homo sapiens
tgaggcctgcattgaactagaa

SEQ ID NO: 9225857 - DNA, 22 bp, Homo sapiens
tgaggcctgaagcctggagcct

SEQ ID NO: 9225858 - DNA, 21 bp, Homo sapiens
tgaggcctctcctgggctggc

SEQ ID NO: 9225859 - DNA, 22 bp, Homo sapiens
tgaggcctgaagcctgaagtga

SEQ ID NO: 9225860 - DNA, 22 bp, Homo sapiens
tgaggcctctgtgccatccagg

SEQ ID NO: 9225861 - DNA, 22 bp, Homo sapiens
tgaggaaagaaaggcatgcatg

SEQ ID NO: 9225862 - DNA, 22 bp, Homo sapiens
tgaggagaaatgctcagagcca

SEQ ID NO: 9225863 - DNA, 22 bp, Homo sapiens
tgaggagcttctggaaagtgca

SEQ ID NO: 9225864 - DNA, 22 bp, Homo sapiens
tgaggagcgggcagggatgcag

SEQ ID NO: 9225865 - DNA, 23 bp, Homo sapiens
tgaggagcatagctgactgacag

SEQ ID NO: 9225866 - DNA, 22 bp, Homo sapiens
tgaggagcagggtggcttactc

SEQ ID NO: 9225867 - DNA, 22 bp, Homo sapiens
tgaggaggcccaggttggggct

SEQ ID NO: 9225868 - DNA, 22 bp, Homo sapiens
tgaggatggggagatggtgtct

SEQ ID NO: 9225869 - DNA, 22 bp, Homo sapiens
tgaggcacatccaggccagctc

SEQ ID NO: 9225870 - DNA, 22 bp, Homo sapiens
tgaggcactccaggatgctgtt

SEQ ID NO: 9225871 - DNA, 22 bp, Homo sapiens
tgaggattaaatgagctaataa

SEQ ID NO: 9225872 - DNA, 19 bp, Homo sapiens
tgaggattgaggtccagta

SEQ ID NO: 9225873 - DNA, 22 bp, Homo sapiens
tgaggatggttaaagaacattg

SEQ ID NO: 9225874 - DNA, 22 bp, Homo sapiens
tgaggcaggacatggacaactg

SEQ ID NO: 9225875 - DNA, 22 bp, Homo sapiens
tgaggcaggacatggacaactg

SEQ ID NO: 9225876 - DNA, 22 bp, Homo sapiens
tgaggcaggaatggggaaaagt

SEQ ID NO: 9225877 - DNA, 22 bp, Homo sapiens
tgaggcaggaatggggaaaagt

SEQ ID NO: 9225878 - DNA, 22 bp, Homo sapiens
tgaggcagcctgcattaaagag

SEQ ID NO: 9225879 - DNA, 22 bp, Homo sapiens
tgaggcactgggagagcacact

SEQ ID NO: 9225880 - DNA, 22 bp, Homo sapiens
tgaggcaggacttgcataaagt

SEQ ID NO: 9225881 - DNA, 22 bp, Homo sapiens
tgaggcaggactgagcgggatg

SEQ ID NO: 9225882 - DNA, 22 bp, Homo sapiens
tgaggcaggactgagcgggatg

SEQ ID NO: 9225883 - DNA, 19 bp, Homo sapiens
tgaagcaggcagagaagat

SEQ ID NO: 9225884 - DNA, 22 bp, Homo sapiens
tgaagaataagatagatggagc

SEQ ID NO: 9225885 - DNA, 22 bp, Homo sapiens
tgaagaataagatagatggagc

SEQ ID NO: 9225886 - DNA, 22 bp, Homo sapiens
tgaagaataaatggttgagact

SEQ ID NO: 9225887 - DNA, 22 bp, Homo sapiens
tgaagaataaatggttgagact

SEQ ID NO: 9225888 - DNA, 22 bp, Homo sapiens
tgaagactcagaagctaagata

SEQ ID NO: 9225889 - DNA, 22 bp, Homo sapiens
tgaagaatgtgaattggtagct

SEQ ID NO: 9225890 - DNA, 22 bp, Homo sapiens
tgaagaatgttgcagtgagcat

SEQ ID NO: 9225891 - DNA, 22 bp, Homo sapiens
tgaagaatcagattggcctgcg

SEQ ID NO: 9225892 - DNA, 22 bp, Homo sapiens
tgaagaatcccagggaatttgg

SEQ ID NO: 9225893 - DNA, 22 bp, Homo sapiens
tgaacaaatggaaataaccagt

SEQ ID NO: 9225894 - DNA, 22 bp, Homo sapiens
tgaacctttgtgttggacctgg

SEQ ID NO: 9225895 - DNA, 22 bp, Homo sapiens
tgaaccttttgaataaggacca

SEQ ID NO: 9225896 - DNA, 22 bp, Homo sapiens
tgaaccttcataaaattaagtg

SEQ ID NO: 9225897 - DNA, 22 bp, Homo sapiens
tgaaccttgttcctgccctcct

SEQ ID NO: 9225898 - DNA, 22 bp, Homo sapiens
tgaacatacaattattaagaac

SEQ ID NO: 9225899 - DNA, 22 bp, Homo sapiens
tgaactcctgacctcatgatcc

SEQ ID NO: 9225900 - DNA, 22 bp, Homo sapiens
tgaacgcaggtccacatggctc

SEQ ID NO: 9225901 - DNA, 22 bp, Homo sapiens
tgaaccttttgctaagaagtta

SEQ ID NO: 9225902 - DNA, 22 bp, Homo sapiens
tgaaagagtttgacatgattct

SEQ ID NO: 9225903 - DNA, 22 bp, Homo sapiens
tgaaagcaacctgtaacagtga

SEQ ID NO: 9225904 - DNA, 22 bp, Homo sapiens
tgaaagatgctcaatgaatggt

SEQ ID NO: 9225905 - DNA, 23 bp, Homo sapiens
tgaaagcaatgggtctatagtat

SEQ ID NO: 9225906 - DNA, 22 bp, Homo sapiens
tgaaagcactcacttctgctct

SEQ ID NO: 9225907 - DNA, 22 bp, Homo sapiens
tgaaagcacaagttctaacagg

SEQ ID NO: 9225908 - DNA, 22 bp, Homo sapiens
tgaaagcactcacttctgctct

SEQ ID NO: 9225909 - DNA, 22 bp, Homo sapiens
tgaaagtgaatgtcactgttga

SEQ ID NO: 9225910 - DNA, 22 bp, Homo sapiens
tgaaatacacaaatttagtaag

SEQ ID NO: 9225911 - DNA, 20 bp, Homo sapiens
tgaaataaggagttgtcctt

SEQ ID NO: 9225912 - DNA, 22 bp, Homo sapiens
tgaaataggaaacagatgtttc

SEQ ID NO: 9225913 - DNA, 22 bp, Homo sapiens
tgaaatatccagcccagcagga

SEQ ID NO: 9225914 - DNA, 22 bp, Homo sapiens
tgaaatatccagcccagcagga

SEQ ID NO: 9225915 - DNA, 22 bp, Homo sapiens
tgaaatagtctaaaaaaccaga

SEQ ID NO: 9225916 - DNA, 22 bp, Homo sapiens
tgaaatatttagagagtaagtt

SEQ ID NO: 9225917 - DNA, 23 bp, Homo sapiens
tgaaatattcttttgcatgagct

SEQ ID NO: 9225918 - DNA, 22 bp, Homo sapiens
tgaaatatttagagagtaagtt

SEQ ID NO: 9225919 - DNA, 22 bp, Homo sapiens
tgaaatctgtcccactttagct

SEQ ID NO: 9225920 - DNA, 22 bp, Homo sapiens
tgaaatcattgccaagtattga

SEQ ID NO: 9225921 - DNA, 22 bp, Homo sapiens
tgaaatgtaagcatagaggttg

SEQ ID NO: 9225922 - DNA, 22 bp, Homo sapiens
tgaaatgtagtgaagcatggaa

SEQ ID NO: 9225923 - DNA, 22 bp, Homo sapiens
tgaaatgtagattaggcattct

SEQ ID NO: 9225924 - DNA, 22 bp, Homo sapiens
tgaaatgtcagtgttttataag

SEQ ID NO: 9225925 - DNA, 22 bp, Homo sapiens
tgaaatgtctcacttagacttt

SEQ ID NO: 9225926 - DNA, 22 bp, Homo sapiens
tgaaatgtgtccatgttatttc

SEQ ID NO: 9225927 - DNA, 22 bp, Homo sapiens
tgaaatgtggagatggtaagta

SEQ ID NO: 9225928 - DNA, 22 bp, Homo sapiens
tgaaatgtgatctgagcttggc

SEQ ID NO: 9225929 - DNA, 22 bp, Homo sapiens
tgaaatgtctttgcaattgaaa

SEQ ID NO: 9225930 - DNA, 22 bp, Homo sapiens
tgaaatgtttaggaccactaga

SEQ ID NO: 9225931 - DNA, 22 bp, Homo sapiens
tgaaatgttggtaattttatat

SEQ ID NO: 9225932 - DNA, 22 bp, Homo sapiens
tgaaatgtttgaagaccactga

SEQ ID NO: 9225933 - DNA, 22 bp, Homo sapiens
tgaaatgtttgggtccagaagt

SEQ ID NO: 9225934 - DNA, 22 bp, Homo sapiens
tgaaatgtgttctagtgttttg

SEQ ID NO: 9225935 - DNA, 22 bp, Homo sapiens
tgaaatgttaatcacacaaagg

SEQ ID NO: 9225936 - DNA, 22 bp, Homo sapiens
tgaaatgttctggagtttctgt

SEQ ID NO: 9225937 - DNA, 22 bp, Homo sapiens
tctttgcatcccttccatagtt

SEQ ID NO: 9225938 - DNA, 22 bp, Homo sapiens
tctttgctccacactctagaga

SEQ ID NO: 9225939 - DNA, 22 bp, Homo sapiens
tctttgcagaacgatgaagatg

SEQ ID NO: 9225940 - DNA, 22 bp, Homo sapiens
tctttgcagtctgggcttgttt

SEQ ID NO: 9225941 - DNA, 22 bp, Homo sapiens
tctttgcactgtgcaagcagaa

SEQ ID NO: 9225942 - DNA, 22 bp, Homo sapiens
tctttgcaaaatacaacaatgg

SEQ ID NO: 9225943 - DNA, 22 bp, Homo sapiens
tctttgcaaactatggagtgtg

SEQ ID NO: 9225944 - DNA, 22 bp, Homo sapiens
tctttgtggcgggcttaaatac

SEQ ID NO: 9225945 - DNA, 19 bp, Homo sapiens
tctttgtacaagtctctgc

SEQ ID NO: 9225946 - DNA, 22 bp, Homo sapiens
tgaaaaaacaagttggcccatt

SEQ ID NO: 9225947 - DNA, 22 bp, Homo sapiens
tgaaaagtcttatattgtctga

SEQ ID NO: 9225948 - DNA, 22 bp, Homo sapiens
tgaaaacttgacaagtgaggta

SEQ ID NO: 9225949 - DNA, 22 bp, Homo sapiens
tgaaaactccaagtttcatcag

SEQ ID NO: 9225950 - DNA, 22 bp, Homo sapiens
tgaaaagtgatcatggattagg

SEQ ID NO: 9225951 - DNA, 22 bp, Homo sapiens
tgaaaatttccatcagttatat

SEQ ID NO: 9225952 - DNA, 22 bp, Homo sapiens
tgaaaattgttgtacttgataa

SEQ ID NO: 9225953 - DNA, 22 bp, Homo sapiens
tgaaaattgttgtacttgataa

SEQ ID NO: 9225954 - DNA, 22 bp, Homo sapiens
tgaaaatgccctctatgtctca

SEQ ID NO: 9225955 - DNA, 22 bp, Homo sapiens
tgaaaattcatctcatagcaga

SEQ ID NO: 9225956 - DNA, 22 bp, Homo sapiens
tgaaaattaagcagatgaatga

SEQ ID NO: 9225957 - DNA, 22 bp, Homo sapiens
tgaaacattgcactgtatgaat

SEQ ID NO: 9225958 - DNA, 19 bp, Homo sapiens
tgaaacaaacttaaaagga

SEQ ID NO: 9225959 - DNA, 22 bp, Homo sapiens
tgaaacagtctccagacttgga

SEQ ID NO: 9225960 - DNA, 22 bp, Homo sapiens
tgaaacaaaattaagattctcg

SEQ ID NO: 9225961 - DNA, 19 bp, Homo sapiens
tgaaacaaacttaaaagga

SEQ ID NO: 9225962 - DNA, 22 bp, Homo sapiens
tgaaagaagtgtcacattgcca

SEQ ID NO: 9225963 - DNA, 22 bp, Homo sapiens
tgaatgagtcaatcatttagct

SEQ ID NO: 9225964 - DNA, 22 bp, Homo sapiens
tgaatgcttggagtcataaaat

SEQ ID NO: 9225965 - DNA, 22 bp, Homo sapiens
tgaatactatttcataatgtgg

SEQ ID NO: 9225966 - DNA, 22 bp, Homo sapiens
tgaatacaggaaaatatactga

SEQ ID NO: 9225967 - DNA, 22 bp, Homo sapiens
tgacaaaccctgcaaatagctc

SEQ ID NO: 9225968 - DNA, 22 bp, Homo sapiens
tgaaggctttctcccctctggt

SEQ ID NO: 9225969 - DNA, 22 bp, Homo sapiens
tgaaggcttggattggtcattt

SEQ ID NO: 9225970 - DNA, 22 bp, Homo sapiens
tgaagggggagatatatgtgtg

SEQ ID NO: 9225971 - DNA, 21 bp, Homo sapiens
tgaaggggccatcacaaaggc

SEQ ID NO: 9225972 - DNA, 21 bp, Homo sapiens
tgaagggcagcctcaggctcc

SEQ ID NO: 9225973 - DNA, 22 bp, Homo sapiens
tgaaggggttcagcatgggggt

SEQ ID NO: 9225974 - DNA, 21 bp, Homo sapiens
tgaaggggtggcagtgtgctt

SEQ ID NO: 9225975 - DNA, 22 bp, Homo sapiens
tgaaggcatttgagttggtgag

SEQ ID NO: 9225976 - DNA, 22 bp, Homo sapiens
tgaaggccagggatttgcagcc

SEQ ID NO: 9225977 - DNA, 22 bp, Homo sapiens
tgaagcccctaagtcccaggca

SEQ ID NO: 9225978 - DNA, 22 bp, Homo sapiens
tgaagccctgtcttatggaaga

SEQ ID NO: 9225979 - DNA, 22 bp, Homo sapiens
tgaagcccaggtgttagtgggg

SEQ ID NO: 9225980 - DNA, 22 bp, Homo sapiens
tgaagcccaggaatctacattt

SEQ ID NO: 9225981 - DNA, 22 bp, Homo sapiens
tgaagcccaatcctgtgttcct

SEQ ID NO: 9225982 - DNA, 22 bp, Homo sapiens
tgaagcccaaggcactgtctga

SEQ ID NO: 9225983 - DNA, 21 bp, Homo sapiens
tgaagcctgaggcatagcccc

SEQ ID NO: 9225984 - DNA, 22 bp, Homo sapiens
tgaagcccttcatgcacagtca

SEQ ID NO: 9225985 - DNA, 22 bp, Homo sapiens
tgaagccctgtgataggtccag

SEQ ID NO: 9225986 - DNA, 22 bp, Homo sapiens
tgaagccactttccagaatcac

SEQ ID NO: 9225987 - DNA, 22 bp, Homo sapiens
tgaagccactttccagaatcac

SEQ ID NO: 9225988 - DNA, 22 bp, Homo sapiens
tgaagccataggacagaggata

SEQ ID NO: 9225989 - DNA, 22 bp, Homo sapiens
tgacacagattagagacatacc

SEQ ID NO: 9225990 - DNA, 18 bp, Homo sapiens
tgacagaacctggagcct

SEQ ID NO: 9225991 - DNA, 23 bp, Homo sapiens
tgacaggccagaagagcagctgg

SEQ ID NO: 9225992 - DNA, 22 bp, Homo sapiens
tgacagcctcactttgttaatt

SEQ ID NO: 9225993 - DNA, 22 bp, Homo sapiens
tgacagcccacctcacaggatt

SEQ ID NO: 9225994 - DNA, 22 bp, Homo sapiens
tgacagccatgatccttactgt

SEQ ID NO: 9225995 - DNA, 22 bp, Homo sapiens
tgacctttctctgggtgcttgg

SEQ ID NO: 9225996 - DNA, 22 bp, Homo sapiens
tgacttcctgcactcaggtgat

SEQ ID NO: 9225997 - DNA, 22 bp, Homo sapiens
tgactgccccttccattcctgc

SEQ ID NO: 9225998 - DNA, 22 bp, Homo sapiens
tgacctattagatttccttgcc

SEQ ID NO: 9225999 - DNA, 22 bp, Homo sapiens
tgacatttttaaaaccactagt

SEQ ID NO: 9226000 - DNA, 22 bp, Homo sapiens
tgacatttgagcatacatgtaa

SEQ ID NO: 9226001 - DNA, 22 bp, Homo sapiens
tgacatttgagagagatataca

SEQ ID NO: 9226002 - DNA, 22 bp, Homo sapiens
tgacatttcttgttgatataaa

SEQ ID NO: 9226003 - DNA, 22 bp, Homo sapiens
tgacatttaatccctaaatatt

SEQ ID NO: 9226004 - DNA, 22 bp, Homo sapiens
tgacatgtcctgagaagatggc

SEQ ID NO: 9226005 - DNA, 22 bp, Homo sapiens
tgacatttatcttctacaatga

SEQ ID NO: 9226006 - DNA, 22 bp, Homo sapiens
tgacatttatcaaagaaatggt

SEQ ID NO: 9226007 - DNA, 21 bp, Homo sapiens
tgacatttccaatataaagcc

SEQ ID NO: 9226008 - DNA, 22 bp, Homo sapiens
tggccctgtcctcatttcatct

SEQ ID NO: 9226009 - DNA, 22 bp, Homo sapiens
tggccctgtccctggagcctgg

SEQ ID NO: 9226010 - DNA, 22 bp, Homo sapiens
tggccctgtctgcacacaggat

SEQ ID NO: 9226011 - DNA, 22 bp, Homo sapiens
tggccctgtctgcacacaggat

SEQ ID NO: 9226012 - DNA, 22 bp, Homo sapiens
tggccctgtgactgagttctag

SEQ ID NO: 9226013 - DNA, 22 bp, Homo sapiens
tggccctggtggcacagcctgc

SEQ ID NO: 9226014 - DNA, 22 bp, Homo sapiens
tggccctggtggcacagcctgc

SEQ ID NO: 9226015 - DNA, 22 bp, Homo sapiens
tggccctgggcatctttcgtga

SEQ ID NO: 9226016 - DNA, 22 bp, Homo sapiens
tggccctgggtggaatgtccca

SEQ ID NO: 9226017 - DNA, 22 bp, Homo sapiens
tggccctgggcagaggcaacat

SEQ ID NO: 9226018 - DNA, 22 bp, Homo sapiens
tggccctgggcagaggcaacat

SEQ ID NO: 9226019 - DNA, 21 bp, Homo sapiens
tggccctggccacggctgcca

SEQ ID NO: 9226020 - DNA, 22 bp, Homo sapiens
tggccctggctgagttagattt

SEQ ID NO: 9226021 - DNA, 22 bp, Homo sapiens
tggccctgccactcactgctga

SEQ ID NO: 9226022 - DNA, 22 bp, Homo sapiens
tggccctgccactcactgctga

SEQ ID NO: 9226023 - DNA, 22 bp, Homo sapiens
tggccctgccctcttcatcttt

SEQ ID NO: 9226024 - DNA, 22 bp, Homo sapiens
tggccctgccgcactatcctca

SEQ ID NO: 9226025 - DNA, 22 bp, Homo sapiens
tggccctgtgtgcaggctgcac

SEQ ID NO: 9226026 - DNA, 22 bp, Homo sapiens
tggccctgtgtcctgctgccag

SEQ ID NO: 9226027 - DNA, 22 bp, Homo sapiens
tggccctgtggcttcagaacag

SEQ ID NO: 9226028 - DNA, 23 bp, Homo sapiens
tggccctgtgcatgctgcttccc

SEQ ID NO: 9226029 - DNA, 22 bp, Homo sapiens
tggccctgtggaggtcagtgag

SEQ ID NO: 9226030 - DNA, 20 bp, Homo sapiens
tggccctgttttctccaggc

SEQ ID NO: 9226031 - DNA, 22 bp, Homo sapiens
tggccctgttctgtacctcata

SEQ ID NO: 9226032 - DNA, 22 bp, Homo sapiens
tggccctttggtttatgactga

SEQ ID NO: 9226033 - DNA, 22 bp, Homo sapiens
tggcccttgttcaaatatgtca

SEQ ID NO: 9226034 - DNA, 22 bp, Homo sapiens
tggcctctgtgggagctgagca

SEQ ID NO: 9226035 - DNA, 22 bp, Homo sapiens
tggcctctgcactgggctcccc

SEQ ID NO: 9226036 - DNA, 22 bp, Homo sapiens
tggcctctgaggcacctttgcc

SEQ ID NO: 9226037 - DNA, 18 bp, Homo sapiens
tggcctggagacaactct

SEQ ID NO: 9226038 - DNA, 23 bp, Homo sapiens
tggcctggagagaaaagatgagt

SEQ ID NO: 9226039 - DNA, 22 bp, Homo sapiens
tggcctggaagagaggtcgagg

SEQ ID NO: 9226040 - DNA, 22 bp, Homo sapiens
tggcctggccacatccagcagg

SEQ ID NO: 9226041 - DNA, 22 bp, Homo sapiens
tggcctggccacatccagcagg

SEQ ID NO: 9226042 - DNA, 22 bp, Homo sapiens
tggcctggaaaaatgcagatgg

SEQ ID NO: 9226043 - DNA, 22 bp, Homo sapiens
tggcctggaaaaatgcagatgg

SEQ ID NO: 9226044 - DNA, 22 bp, Homo sapiens
tggccctgacaggtcctgggca

SEQ ID NO: 9226045 - DNA, 22 bp, Homo sapiens
tggccctgacaggtcctgggca

SEQ ID NO: 9226046 - DNA, 22 bp, Homo sapiens
tggccctgacacgtggtactgg

SEQ ID NO: 9226047 - DNA, 22 bp, Homo sapiens
tggccctgactgatgtggaggg

SEQ ID NO: 9226048 - DNA, 22 bp, Homo sapiens
tggccctgacttggaggcctga

SEQ ID NO: 9226049 - DNA, 22 bp, Homo sapiens
tggccctgaggggctgtgcccc

SEQ ID NO: 9226050 - DNA, 22 bp, Homo sapiens
tggccctgaggacccagtgtgg

SEQ ID NO: 9226051 - DNA, 22 bp, Homo sapiens
tggccctgagggctcggagcca

SEQ ID NO: 9226052 - DNA, 22 bp, Homo sapiens
tggccctgcacccagagcagtt

SEQ ID NO: 9226053 - DNA, 22 bp, Homo sapiens
tggccctgcacccagagcagtt

SEQ ID NO: 9226054 - DNA, 22 bp, Homo sapiens
tggccctgcagaactagcctgg

SEQ ID NO: 9226055 - DNA, 23 bp, Homo sapiens
tggccctgaatctgtcctggagg

SEQ ID NO: 9226056 - DNA, 23 bp, Homo sapiens
tggccctgaatctgtcctggagg

SEQ ID NO: 9226057 - DNA, 22 bp, Homo sapiens
tggccctgaatcaaggccagca

SEQ ID NO: 9226058 - DNA, 22 bp, Homo sapiens
tggccctgaaggccttgagcat

SEQ ID NO: 9226059 - DNA, 22 bp, Homo sapiens
tggcccaggtgcacccagaggc

SEQ ID NO: 9226060 - DNA, 22 bp, Homo sapiens
tggcccaggtgcaagagacaga

SEQ ID NO: 9226061 - DNA, 22 bp, Homo sapiens
tggcccagtcagcaggagaggg

SEQ ID NO: 9226062 - DNA, 22 bp, Homo sapiens
tggcccaggcgaggtgggcaga

SEQ ID NO: 9226063 - DNA, 22 bp, Homo sapiens
tggcccaggaggccagagggca

SEQ ID NO: 9226064 - DNA, 22 bp, Homo sapiens
tggcccaggaggccagagggca

SEQ ID NO: 9226065 - DNA, 22 bp, Homo sapiens
tggcccagctgcagatggtgga

SEQ ID NO: 9226066 - DNA, 22 bp, Homo sapiens
tggcccaggtctctctgagccc

SEQ ID NO: 9226067 - DNA, 22 bp, Homo sapiens
tggcccaggtctctctgagccc

SEQ ID NO: 9226068 - DNA, 22 bp, Homo sapiens
tggcccaggggctcttggtgtt

SEQ ID NO: 9226069 - DNA, 22 bp, Homo sapiens
tggcccagggcacagcagggag

SEQ ID NO: 9226070 - DNA, 15 bp, Homo sapiens
tggcccacccgttga

SEQ ID NO: 9226071 - DNA, 15 bp, Homo sapiens
tggcccacccgttga

SEQ ID NO: 9226072 - DNA, 22 bp, Homo sapiens
tggcccagctcagggtgggcgg

SEQ ID NO: 9226073 - DNA, 22 bp, Homo sapiens
tggcccagccctgctctagggc

SEQ ID NO: 9226074 - DNA, 22 bp, Homo sapiens
tggcccagccctgctctagggc

SEQ ID NO: 9226075 - DNA, 22 bp, Homo sapiens
tggccagtttgctcaggcagtc

SEQ ID NO: 9226076 - DNA, 22 bp, Homo sapiens
tggccatgacatggaggctttg

SEQ ID NO: 9226077 - DNA, 22 bp, Homo sapiens
tggccatgaaggaggcagcaga

SEQ ID NO: 9226078 - DNA, 22 bp, Homo sapiens
tggccatgggatagtgcagggg

SEQ ID NO: 9226079 - DNA, 22 bp, Homo sapiens
tggccagtgtgtgctgccggct

SEQ ID NO: 9226080 - DNA, 22 bp, Homo sapiens
tggccagcccttcagccatgcc

SEQ ID NO: 9226081 - DNA, 22 bp, Homo sapiens
tggccagattcatgcatgtatc

SEQ ID NO: 9226082 - DNA, 22 bp, Homo sapiens
tggccaggcattcagataagac

SEQ ID NO: 9226083 - DNA, 22 bp, Homo sapiens
tggccaggccggggacagaact

SEQ ID NO: 9226084 - DNA, 22 bp, Homo sapiens
tggccaggccggggacagaact

SEQ ID NO: 9226085 - DNA, 22 bp, Homo sapiens
tggccaggccggggacagaact

SEQ ID NO: 9226086 - DNA, 22 bp, Homo sapiens
tggccaggcattcagataagac

SEQ ID NO: 9226087 - DNA, 22 bp, Homo sapiens
tggccaggggagttcccctcca

SEQ ID NO: 9226088 - DNA, 23 bp, Homo sapiens
tggccagggtactacacccaccc

SEQ ID NO: 9226089 - DNA, 22 bp, Homo sapiens
tggccaggctggtctggaacgc

SEQ ID NO: 9226090 - DNA, 22 bp, Homo sapiens
tggccaggctggtctggaacgc

SEQ ID NO: 9226091 - DNA, 19 bp, Homo sapiens
tggccaggtactgtctgct

SEQ ID NO: 9226092 - DNA, 19 bp, Homo sapiens
tggccaggtactgtctgct

SEQ ID NO: 9226093 - DNA, 22 bp, Homo sapiens
tggccaggttgggctttgcagc

SEQ ID NO: 9226094 - DNA, 22 bp, Homo sapiens
tggccagtaatagcttctggtg

SEQ ID NO: 9226095 - DNA, 22 bp, Homo sapiens
tggccaggtgtgggttctcaga

SEQ ID NO: 9226096 - DNA, 22 bp, Homo sapiens
tggccagagtccagtgagcctt

SEQ ID NO: 9226097 - DNA, 22 bp, Homo sapiens
tggccagaacctgcagtaggcc

SEQ ID NO: 9226098 - DNA, 22 bp, Homo sapiens
tggccagaactcagacatgtgg

SEQ ID NO: 9226099 - DNA, 22 bp, Homo sapiens
tggccactcctccctgcaggct

SEQ ID NO: 9226100 - DNA, 22 bp, Homo sapiens
tggccactcagggatgcaggaa

SEQ ID NO: 9226101 - DNA, 22 bp, Homo sapiens
tggccacttggcatgtgtgcca

SEQ ID NO: 9226102 - DNA, 22 bp, Homo sapiens
tggccactggcttccactgagt

SEQ ID NO: 9226103 - DNA, 22 bp, Homo sapiens
tggccaccttcccacttctgcc

SEQ ID NO: 9226104 - DNA, 22 bp, Homo sapiens
tggccaccttatggctattgga

SEQ ID NO: 9226105 - DNA, 19 bp, Homo sapiens
tggccacctctgctgttct

SEQ ID NO: 9226106 - DNA, 20 bp, Homo sapiens
tggccacctgcgtcccagcc

SEQ ID NO: 9226107 - DNA, 22 bp, Homo sapiens
tggccacatcctttccttgtca

SEQ ID NO: 9226108 - DNA, 22 bp, Homo sapiens
tggccacagtgtccagcagcag

SEQ ID NO: 9226109 - DNA, 22 bp, Homo sapiens
tggccacatgcgtctgtgaggc

SEQ ID NO: 9226110 - DNA, 22 bp, Homo sapiens
tggccacccccaatgtcagtag

SEQ ID NO: 9226111 - DNA, 22 bp, Homo sapiens
tggccacccagctgacgccttc

SEQ ID NO: 9226112 - DNA, 22 bp, Homo sapiens
tggccacccctttctctgcact

SEQ ID NO: 9226113 - DNA, 22 bp, Homo sapiens
tggccacccctttctctgcact

SEQ ID NO: 9226114 - DNA, 22 bp, Homo sapiens
tggccacccctttctctgcact

SEQ ID NO: 9226115 - DNA, 22 bp, Homo sapiens
tggcatttctggccatttgtgt

SEQ ID NO: 9226116 - DNA, 22 bp, Homo sapiens
tggccacacccacctagaggag

SEQ ID NO: 9226117 - DNA, 22 bp, Homo sapiens
tggccacactgcccccactggg

SEQ ID NO: 9226118 - DNA, 22 bp, Homo sapiens
tggcatttcacctttcatttcc

SEQ ID NO: 9226119 - DNA, 22 bp, Homo sapiens
tggcatttagttgcgtattgca

SEQ ID NO: 9226120 - DNA, 22 bp, Homo sapiens
tggcatttatatcccagtttat

SEQ ID NO: 9226121 - DNA, 22 bp, Homo sapiens
tggcatggtcaaggctatgtta

SEQ ID NO: 9226122 - DNA, 22 bp, Homo sapiens
tggcatggtggagtgacgggca

SEQ ID NO: 9226123 - DNA, 22 bp, Homo sapiens
tggcatgtatacttgagtagga

SEQ ID NO: 9226124 - DNA, 22 bp, Homo sapiens
tggcattgcttctgaagtggag

SEQ ID NO: 9226125 - DNA, 23 bp, Homo sapiens
tggcatagtgaggggcacagaga

SEQ ID NO: 9226126 - DNA, 23 bp, Homo sapiens
tggcatagtgaggggcacagaga

SEQ ID NO: 9226127 - DNA, 22 bp, Homo sapiens
tggcagtgccccttgaccagtg

SEQ ID NO: 9226128 - DNA, 19 bp, Homo sapiens
tggcagtgtggggtatgaa

SEQ ID NO: 9226129 - DNA, 22 bp, Homo sapiens
tggcagtgtttctaaggggctc

SEQ ID NO: 9226130 - DNA, 22 bp, Homo sapiens
tggcagtggctcagagtgcaga

SEQ ID NO: 9226131 - DNA, 22 bp, Homo sapiens
tggcagtggctcagagtgcaga

SEQ ID NO: 9226132 - DNA, 22 bp, Homo sapiens
tggcatggaccttggaagaatt

SEQ ID NO: 9226133 - DNA, 22 bp, Homo sapiens
tggcatctcaaacaggcagatt

SEQ ID NO: 9226134 - DNA, 22 bp, Homo sapiens
tggcatctccgacagtcttgat

SEQ ID NO: 9226135 - DNA, 23 bp, Homo sapiens
tggcatcttggcatcttgctgct

SEQ ID NO: 9226136 - DNA, 22 bp, Homo sapiens
tggcatctttgtcccagaagct

SEQ ID NO: 9226137 - DNA, 22 bp, Homo sapiens
tggcatgggtggagagagcaca

SEQ ID NO: 9226138 - DNA, 22 bp, Homo sapiens
tggcatgggcaaaccagggaaa

SEQ ID NO: 9226139 - DNA, 22 bp, Homo sapiens
tggcatgggccagggagagctg

SEQ ID NO: 9226140 - DNA, 22 bp, Homo sapiens
tggcatggctactggaatggcg

SEQ ID NO: 9226141 - DNA, 22 bp, Homo sapiens
tggcatggcgtggcatcgtgtg

SEQ ID NO: 9226142 - DNA, 22 bp, Homo sapiens
tggcatggccagtgctgggagt

SEQ ID NO: 9226143 - DNA, 22 bp, Homo sapiens
tggcatggccagtgctgggagt

SEQ ID NO: 9226144 - DNA, 22 bp, Homo sapiens
tggcatggcaaccctgcaggga

SEQ ID NO: 9226145 - DNA, 22 bp, Homo sapiens
tggcatggcatttagagaatta

SEQ ID NO: 9226146 - DNA, 21 bp, Homo sapiens
tggcatggaggtagcagtgtg

SEQ ID NO: 9226147 - DNA, 22 bp, Homo sapiens
tggcagtccctctggtagcacc

SEQ ID NO: 9226148 - DNA, 22 bp, Homo sapiens
tggcagtagatccagtctctct

SEQ ID NO: 9226149 - DNA, 18 bp, Homo sapiens
tggcagtgaggtaggcat

SEQ ID NO: 9226150 - DNA, 22 bp, Homo sapiens
tggcagtgatgcggcaggacat

SEQ ID NO: 9226151 - DNA, 22 bp, Homo sapiens
tggcagggtgccagttgcgagt

SEQ ID NO: 9226152 - DNA, 22 bp, Homo sapiens
tggcagggtgccagttgcgagt

SEQ ID NO: 9226153 - DNA, 22 bp, Homo sapiens
tggcagggtcttgctgtgttgc

SEQ ID NO: 9226154 - DNA, 22 bp, Homo sapiens
tggcagggtcttgctgtgttgc

SEQ ID NO: 9226155 - DNA, 22 bp, Homo sapiens
tggcaatgtaggcaagaacatt

SEQ ID NO: 9226156 - DNA, 22 bp, Homo sapiens
tggcacacagagaagacacttg

SEQ ID NO: 9226157 - DNA, 22 bp, Homo sapiens
tggcacacagagaagacacttg

SEQ ID NO: 9226158 - DNA, 22 bp, Homo sapiens
tggcacagaccttatcttctct

SEQ ID NO: 9226159 - DNA, 22 bp, Homo sapiens
tggcacagaccttatcttctct

SEQ ID NO: 9226160 - DNA, 22 bp, Homo sapiens
tggcacagacatttaatagcct

SEQ ID NO: 9226161 - DNA, 22 bp, Homo sapiens
tggcacagacagcacagcaatg

SEQ ID NO: 9226162 - DNA, 22 bp, Homo sapiens
tggcacagacagatcaggagtc

SEQ ID NO: 9226163 - DNA, 22 bp, Homo sapiens
tggcacagaaaaatgctccatt

SEQ ID NO: 9226164 - DNA, 22 bp, Homo sapiens
tggcacagaaaaatgctccatt

SEQ ID NO: 9226165 - DNA, 21 bp, Homo sapiens
tggcacagaaaggaaagttca

SEQ ID NO: 9226166 - DNA, 21 bp, Homo sapiens
tggcacagaaaggaaagttca

SEQ ID NO: 9226167 - DNA, 20 bp, Homo sapiens
tggcacagaacccttgccta

SEQ ID NO: 9226168 - DNA, 20 bp, Homo sapiens
tggcacagaacccttgccta

SEQ ID NO: 9226169 - DNA, 22 bp, Homo sapiens
tggcacagccactgaatcggga

SEQ ID NO: 9226170 - DNA, 22 bp, Homo sapiens
tggcacagccatcttctcctgc

SEQ ID NO: 9226171 - DNA, 23 bp, Homo sapiens
tggcacagcaggtgtgctttgtt

SEQ ID NO: 9226172 - DNA, 22 bp, Homo sapiens
tggcacagccactgaatcggga

SEQ ID NO: 9226173 - DNA, 23 bp, Homo sapiens
tggcacagcaggtgtgctttgtt

SEQ ID NO: 9226174 - DNA, 21 bp, Homo sapiens
tggcacagcaagtgggctcat

SEQ ID NO: 9226175 - DNA, 21 bp, Homo sapiens
tggcacagcaagtgggctcat

SEQ ID NO: 9226176 - DNA, 22 bp, Homo sapiens
tggcacagcctttaaagtacca

SEQ ID NO: 9226177 - DNA, 22 bp, Homo sapiens
tggcacagtgctggatggtgct

SEQ ID NO: 9226178 - DNA, 22 bp, Homo sapiens
tggcacagcccagagctcttga

SEQ ID NO: 9226179 - DNA, 22 bp, Homo sapiens
tggcacagcccagagctcttga

SEQ ID NO: 9226180 - DNA, 22 bp, Homo sapiens
tggcacagcccagagctcttga

SEQ ID NO: 9226181 - DNA, 22 bp, Homo sapiens
tggcacagcccattcagagaag

SEQ ID NO: 9226182 - DNA, 22 bp, Homo sapiens
tggcacagcccggattctatga

SEQ ID NO: 9226183 - DNA, 22 bp, Homo sapiens
tggcacagcccattcagagaag

SEQ ID NO: 9226184 - DNA, 22 bp, Homo sapiens
tggcacagcctccatgtcgtcc

SEQ ID NO: 9226185 - DNA, 22 bp, Homo sapiens
tggcacagactgggccaaggaa

SEQ ID NO: 9226186 - DNA, 22 bp, Homo sapiens
tggcacagactgggccaaggaa

SEQ ID NO: 9226187 - DNA, 22 bp, Homo sapiens
tggcacagactgggccaaggaa

SEQ ID NO: 9226188 - DNA, 23 bp, Homo sapiens
tggcacagaggaccatgctttgc

SEQ ID NO: 9226189 - DNA, 16 bp, Homo sapiens
tggcacagagcagata

SEQ ID NO: 9226190 - DNA, 23 bp, Homo sapiens
tggcacagaggaccatgctttgc

SEQ ID NO: 9226191 - DNA, 22 bp, Homo sapiens
tggcacagagggacccagcagc

SEQ ID NO: 9226192 - DNA, 17 bp, Homo sapiens
tggcacagaggtgctat

SEQ ID NO: 9226193 - DNA, 19 bp, Homo sapiens
tggcacagatttcctccct

SEQ ID NO: 9226194 - DNA, 22 bp, Homo sapiens
tggcacagcaagagtttgggaa

SEQ ID NO: 9226195 - DNA, 22 bp, Homo sapiens
tggcacagagggacccagcagc

SEQ ID NO: 9226196 - DNA, 22 bp, Homo sapiens
tggcaacaagaaaggcagaggg

SEQ ID NO: 9226197 - DNA, 23 bp, Homo sapiens
tggcaactagtggtgaagagcct

SEQ ID NO: 9226198 - DNA, 22 bp, Homo sapiens
tggcaaagattaccacatctac

SEQ ID NO: 9226199 - DNA, 22 bp, Homo sapiens
tggatttctccagctctccatt

SEQ ID NO: 9226200 - DNA, 22 bp, Homo sapiens
tggattcacaccattctcctgc

SEQ ID NO: 9226201 - DNA, 22 bp, Homo sapiens
tggatgggttgaaatgtgagcc

SEQ ID NO: 9226202 - DNA, 22 bp, Homo sapiens
tggatgggttgaaatgtgagcc

SEQ ID NO: 9226203 - DNA, 22 bp, Homo sapiens
tggattaaagattaaaatgaca

SEQ ID NO: 9226204 - DNA, 22 bp, Homo sapiens
tggcacagttaaagttgtagaa

SEQ ID NO: 9226205 - DNA, 22 bp, Homo sapiens
tggcacagttaaagttgtagaa

SEQ ID NO: 9226206 - DNA, 22 bp, Homo sapiens
tggcactgaagctggaaagcct

SEQ ID NO: 9226207 - DNA, 22 bp, Homo sapiens
tggcactgaaaaaggagaggtt

SEQ ID NO: 9226208 - DNA, 22 bp, Homo sapiens
tggcactgaaaaaggagaggtt

SEQ ID NO: 9226209 - DNA, 22 bp, Homo sapiens
tggcacttccgtctgccttgtg

SEQ ID NO: 9226210 - DNA, 22 bp, Homo sapiens
tggcacttaggtacaagggaat

SEQ ID NO: 9226211 - DNA, 22 bp, Homo sapiens
tggcacttccactgtggctgct

SEQ ID NO: 9226212 - DNA, 22 bp, Homo sapiens
tggcacttattcatatcatgga

SEQ ID NO: 9226213 - DNA, 22 bp, Homo sapiens
tggcacttaaaaattattcttc

SEQ ID NO: 9226214 - DNA, 22 bp, Homo sapiens
tggcacttagcagggaaggtgt

SEQ ID NO: 9226215 - DNA, 22 bp, Homo sapiens
tggcacttagatcaggttgggt

SEQ ID NO: 9226216 - DNA, 22 bp, Homo sapiens
tggcacttaatgcatgtgctat

SEQ ID NO: 9226217 - DNA, 22 bp, Homo sapiens
tggcactgaccccaggcctgtg

SEQ ID NO: 9226218 - DNA, 21 bp, Homo sapiens
tggcactgcttagcaggttcc

SEQ ID NO: 9226219 - DNA, 23 bp, Homo sapiens
tggcagagacccagaatctacat

SEQ ID NO: 9226220 - DNA, 23 bp, Homo sapiens
tggcagagacccagaatctacat

SEQ ID NO: 9226221 - DNA, 22 bp, Homo sapiens
tggcagagaacacggctgatct

SEQ ID NO: 9226222 - DNA, 22 bp, Homo sapiens
tggcagagagactctccttgat

SEQ ID NO: 9226223 - DNA, 22 bp, Homo sapiens
tggcagaggaaaaagtcactgg

SEQ ID NO: 9226224 - DNA, 22 bp, Homo sapiens
tggcagctacagacagaggtga

SEQ ID NO: 9226225 - DNA, 22 bp, Homo sapiens
tggcagcctcagacaaggacct

SEQ ID NO: 9226226 - DNA, 22 bp, Homo sapiens
tggcagcattttttccagaaca

SEQ ID NO: 9226227 - DNA, 22 bp, Homo sapiens
tggcagcagtggaggtagaaag

SEQ ID NO: 9226228 - DNA, 22 bp, Homo sapiens
tggcagcagggaggccagtgtt

SEQ ID NO: 9226229 - DNA, 22 bp, Homo sapiens
tggcagcagccatggaaggccc

SEQ ID NO: 9226230 - DNA, 18 bp, Homo sapiens
tggcagcaggaagccatt

SEQ ID NO: 9226231 - DNA, 22 bp, Homo sapiens
tggcagcagacatctgaggtct

SEQ ID NO: 9226232 - DNA, 22 bp, Homo sapiens
tggcagagtaggatggccctgt

SEQ ID NO: 9226233 - DNA, 21 bp, Homo sapiens
tggcagagtgcagtctataca

SEQ ID NO: 9226234 - DNA, 22 bp, Homo sapiens
tggcagagtgcagaagaggcat

SEQ ID NO: 9226235 - DNA, 22 bp, Homo sapiens
tggcagagtgcggcatcccctg

SEQ ID NO: 9226236 - DNA, 22 bp, Homo sapiens
tggcagagtggaccatactcaa

SEQ ID NO: 9226237 - DNA, 20 bp, Homo sapiens
tggcagagttgtcccaccca

SEQ ID NO: 9226238 - DNA, 22 bp, Homo sapiens
tggcagctctgttcaacatgag

SEQ ID NO: 9226239 - DNA, 22 bp, Homo sapiens
tggcagctgattagatggtgcc

SEQ ID NO: 9226240 - DNA, 22 bp, Homo sapiens
tggcagctgaggggaggctttg

SEQ ID NO: 9226241 - DNA, 22 bp, Homo sapiens
tggcaggaaaaagggccagagg

SEQ ID NO: 9226242 - DNA, 22 bp, Homo sapiens
tggcagctgcaggcctcctgag

SEQ ID NO: 9226243 - DNA, 18 bp, Homo sapiens
tggcaggaaatgcacttt

SEQ ID NO: 9226244 - DNA, 22 bp, Homo sapiens
tggcaggaaataccctgcctag

SEQ ID NO: 9226245 - DNA, 22 bp, Homo sapiens
tggcaggaaagtaacagagcac

SEQ ID NO: 9226246 - DNA, 20 bp, Homo sapiens
tggcaggaatagggccagag

SEQ ID NO: 9226247 - DNA, 22 bp, Homo sapiens
tggcaggaaggagactcagccc

SEQ ID NO: 9226248 - DNA, 22 bp, Homo sapiens
tggcaggaggatgaggcggcta

SEQ ID NO: 9226249 - DNA, 22 bp, Homo sapiens
tggcaggagcctgcggggaggt

SEQ ID NO: 9226250 - DNA, 22 bp, Homo sapiens
tggcaggagcctgcggggaggt

SEQ ID NO: 9226251 - DNA, 20 bp, Homo sapiens
tggcaggagccactggaagc

SEQ ID NO: 9226252 - DNA, 20 bp, Homo sapiens
tggcaggaggcagcagtgga

SEQ ID NO: 9226253 - DNA, 20 bp, Homo sapiens
tggcaggaggcagcagtgga

SEQ ID NO: 9226254 - DNA, 20 bp, Homo sapiens
tggcaggaggcagcagtgga

SEQ ID NO: 9226255 - DNA, 18 bp, Homo sapiens
tggcaggggcagtacgcc

SEQ ID NO: 9226256 - DNA, 21 bp, Homo sapiens
tggcaggcagctggaagcttg

SEQ ID NO: 9226257 - DNA, 22 bp, Homo sapiens
tggcagggagttcgttcacaac

SEQ ID NO: 9226258 - DNA, 22 bp, Homo sapiens
tggcagggagccaccggtcatg

SEQ ID NO: 9226259 - DNA, 22 bp, Homo sapiens
tggcagggagccaccggtcatg

SEQ ID NO: 9226260 - DNA, 23 bp, Homo sapiens
tggctctgagaggttcagatgct

SEQ ID NO: 9226261 - DNA, 21 bp, Homo sapiens
tggctctgagcctcatggctg

SEQ ID NO: 9226262 - DNA, 22 bp, Homo sapiens
tggctctgagctgcaaagctgc

SEQ ID NO: 9226263 - DNA, 21 bp, Homo sapiens
tggctctgagcctcatggctg

SEQ ID NO: 9226264 - DNA, 22 bp, Homo sapiens
tggctctgagacacaggctctc

SEQ ID NO: 9226265 - DNA, 20 bp, Homo sapiens
tggctctcaccctgtgcgat

SEQ ID NO: 9226266 - DNA, 18 bp, Homo sapiens
tggctctgccactcaccg

SEQ ID NO: 9226267 - DNA, 22 bp, Homo sapiens
tggctctgccccatacccctgc

SEQ ID NO: 9226268 - DNA, 22 bp, Homo sapiens
tggctctgccactaacttggta

SEQ ID NO: 9226269 - DNA, 18 bp, Homo sapiens
tggctctgcagccagatg

SEQ ID NO: 9226270 - DNA, 22 bp, Homo sapiens
tggctctgatgggaggtattgg

SEQ ID NO: 9226271 - DNA, 22 bp, Homo sapiens
tggctctgctgaacctagtgca

SEQ ID NO: 9226272 - DNA, 22 bp, Homo sapiens
tggctctggagctcctgggccc

SEQ ID NO: 9226273 - DNA, 22 bp, Homo sapiens
tggctctgcgtctgttcgtggg

SEQ ID NO: 9226274 - DNA, 21 bp, Homo sapiens
tggctctgctcagagcagtcc

SEQ ID NO: 9226275 - DNA, 22 bp, Homo sapiens
tggctctggattaatctaggaa

SEQ ID NO: 9226276 - DNA, 22 bp, Homo sapiens
tggctctggattaatctaggaa

SEQ ID NO: 9226277 - DNA, 22 bp, Homo sapiens
tggctctgggaatgggaagatg

SEQ ID NO: 9226278 - DNA, 22 bp, Homo sapiens
tggctctgggaatctgttgctt

SEQ ID NO: 9226279 - DNA, 22 bp, Homo sapiens
tggctctgggaatgggaagatg

SEQ ID NO: 9226280 - DNA, 23 bp, Homo sapiens
tggctctgtggatccctcaggag

SEQ ID NO: 9226281 - DNA, 22 bp, Homo sapiens
tggctctgtggtcttagcatgc

SEQ ID NO: 9226282 - DNA, 22 bp, Homo sapiens
tggctctgtggtcttagcatgc

SEQ ID NO: 9226283 - DNA, 22 bp, Homo sapiens
tggctctgtggatgttctgacc

SEQ ID NO: 9226284 - DNA, 22 bp, Homo sapiens
tggctctgtcgccgtttggaat

SEQ ID NO: 9226285 - DNA, 22 bp, Homo sapiens
tggctctgtcgccgtttggaat

SEQ ID NO: 9226286 - DNA, 22 bp, Homo sapiens
tggctctggggacagtaagtcc

SEQ ID NO: 9226287 - DNA, 22 bp, Homo sapiens
tggctctgtgcttctagtatct

SEQ ID NO: 9226288 - DNA, 22 bp, Homo sapiens
tggctctgttcgccatcaggag

SEQ ID NO: 9226289 - DNA, 21 bp, Homo sapiens
tggctctgttcaatatatgga

SEQ ID NO: 9226290 - DNA, 19 bp, Homo sapiens
tggctctgtttctctggag

SEQ ID NO: 9226291 - DNA, 19 bp, Homo sapiens
tggctctgtttctctggag

SEQ ID NO: 9226292 - DNA, 22 bp, Homo sapiens
tggctctgttgtgctgagccag

SEQ ID NO: 9226293 - DNA, 22 bp, Homo sapiens
tggctgaggagagggcggaagt

SEQ ID NO: 9226294 - DNA, 22 bp, Homo sapiens
tggctgagcctttggggctttc

SEQ ID NO: 9226295 - DNA, 22 bp, Homo sapiens
tggctgagctgcagcgtggctt

SEQ ID NO: 9226296 - DNA, 22 bp, Homo sapiens
tggctgaggtctggggcttctg

SEQ ID NO: 9226297 - DNA, 22 bp, Homo sapiens
tggctgaggctggagtgcagtg

SEQ ID NO: 9226298 - DNA, 21 bp, Homo sapiens
tggctgagccaggtgtgtgga

SEQ ID NO: 9226299 - DNA, 22 bp, Homo sapiens
tggctgcttaaaattgctgcaa

SEQ ID NO: 9226300 - DNA, 22 bp, Homo sapiens
tggctggaaacaggagattcag

SEQ ID NO: 9226301 - DNA, 22 bp, Homo sapiens
tggctgctgcttggtcttcttc

SEQ ID NO: 9226302 - DNA, 21 bp, Homo sapiens
tggctgctggccctctctcca

SEQ ID NO: 9226303 - DNA, 22 bp, Homo sapiens
tggctgagttcctggcacacgg

SEQ ID NO: 9226304 - DNA, 22 bp, Homo sapiens
tggctgagttacgaacagagca

SEQ ID NO: 9226305 - DNA, 20 bp, Homo sapiens
tggctgcacaccaggacagg

SEQ ID NO: 9226306 - DNA, 22 bp, Homo sapiens
tggctcagagagggagtgtgga

SEQ ID NO: 9226307 - DNA, 22 bp, Homo sapiens
tggctcagagcagggactctgg

SEQ ID NO: 9226308 - DNA, 22 bp, Homo sapiens
tggctcagagccttgagagctg

SEQ ID NO: 9226309 - DNA, 22 bp, Homo sapiens
tggctcagatgctcttccagtg

SEQ ID NO: 9226310 - DNA, 21 bp, Homo sapiens
tggcggggacttgtggctgcc

SEQ ID NO: 9226311 - DNA, 21 bp, Homo sapiens
tggcggggacttgtggctgcc

SEQ ID NO: 9226312 - DNA, 20 bp, Homo sapiens
tggcggggatgagggagtta

SEQ ID NO: 9226313 - DNA, 22 bp, Homo sapiens
tggctattgtgccaaatgaaca

SEQ ID NO: 9226314 - DNA, 22 bp, Homo sapiens
tggctattgagtgatctctaga

SEQ ID NO: 9226315 - DNA, 22 bp, Homo sapiens
tggctcagaactacttctagtt

SEQ ID NO: 9226316 - DNA, 22 bp, Homo sapiens
tggcctggtaccacatagattt

SEQ ID NO: 9226317 - DNA, 22 bp, Homo sapiens
tggcctggccctgaggccctgt

SEQ ID NO: 9226318 - DNA, 22 bp, Homo sapiens
tggcgaggccaggccagggcct

SEQ ID NO: 9226319 - DNA, 22 bp, Homo sapiens
tggcgcagtttctctgctgcct

SEQ ID NO: 9226320 - DNA, 22 bp, Homo sapiens
tggctcaggatctaagcagaat

SEQ ID NO: 9226321 - DNA, 22 bp, Homo sapiens
tggctcagctttccccatctgg

SEQ ID NO: 9226322 - DNA, 22 bp, Homo sapiens
tggctcagctgtcacagcctgg

SEQ ID NO: 9226323 - DNA, 22 bp, Homo sapiens
tggctcagccagccctaggaac

SEQ ID NO: 9226324 - DNA, 22 bp, Homo sapiens
tggctcagcaagacattgacct

SEQ ID NO: 9226325 - DNA, 22 bp, Homo sapiens
tggctcagatttttgtaggctt

SEQ ID NO: 9226326 - DNA, 22 bp, Homo sapiens
tggctcagcattcactggtctt

SEQ ID NO: 9226327 - DNA, 22 bp, Homo sapiens
tggctcagtggcagccgcagct

SEQ ID NO: 9226328 - DNA, 23 bp, Homo sapiens
tggctcagggtctcttatgaagt

SEQ ID NO: 9226329 - DNA, 22 bp, Homo sapiens
tggctcagggtccccaaatggt

SEQ ID NO: 9226330 - DNA, 22 bp, Homo sapiens
tggctcagttccatcatctgga

SEQ ID NO: 9226331 - DNA, 22 bp, Homo sapiens
tggctcagtggcagccgcagct

SEQ ID NO: 9226332 - DNA, 22 bp, Homo sapiens
tggctccacaggccagggtgtg

SEQ ID NO: 9226333 - DNA, 22 bp, Homo sapiens
tggctcctcttctgggtgtccc

SEQ ID NO: 9226334 - DNA, 22 bp, Homo sapiens
tggctgggagctggaactgggc

SEQ ID NO: 9226335 - DNA, 22 bp, Homo sapiens
tggctgggagctggaactgggc

SEQ ID NO: 9226336 - DNA, 22 bp, Homo sapiens
tggctggccctgggagtgcaga

SEQ ID NO: 9226337 - DNA, 22 bp, Homo sapiens
tggctggcatagccattgctcc

SEQ ID NO: 9226338 - DNA, 22 bp, Homo sapiens
tggctggacagtgggcagtgga

SEQ ID NO: 9226339 - DNA, 23 bp, Homo sapiens
tggctggcagaaactgaagcatg

SEQ ID NO: 9226340 - DNA, 22 bp, Homo sapiens
tggctggagtgggagaagttta

SEQ ID NO: 9226341 - DNA, 22 bp, Homo sapiens
tggctggggcctgaatcctgca

SEQ ID NO: 9226342 - DNA, 22 bp, Homo sapiens
tggctgggtgctatccagtact

SEQ ID NO: 9226343 - DNA, 22 bp, Homo sapiens
tggctgtgtccctgtccagagt

SEQ ID NO: 9226344 - DNA, 22 bp, Homo sapiens
tgggaaagactcaggacaggag

SEQ ID NO: 9226345 - DNA, 22 bp, Homo sapiens
tggcttcttgggatgggtcatt

SEQ ID NO: 9226346 - DNA, 22 bp, Homo sapiens
tggcttcttcatatgtgatctt

SEQ ID NO: 9226347 - DNA, 22 bp, Homo sapiens
tggcttcttagaccagtggcct

SEQ ID NO: 9226348 - DNA, 22 bp, Homo sapiens
tggctttatacttaagcacaat

SEQ ID NO: 9226349 - DNA, 22 bp, Homo sapiens
tgggaacattttgagctgagag

SEQ ID NO: 9226350 - DNA, 22 bp, Homo sapiens
tgggaagaggcgggaggctgtt

SEQ ID NO: 9226351 - DNA, 22 bp, Homo sapiens
tgggaagactcctcaggaggcg

SEQ ID NO: 9226352 - DNA, 22 bp, Homo sapiens
tgggaaagtgttgaggtgtctt

SEQ ID NO: 9226353 - DNA, 22 bp, Homo sapiens
tgggaaagtgttgaggtgtctt

SEQ ID NO: 9226354 - DNA, 22 bp, Homo sapiens
tgggaaagtgtagcctgcaggc

SEQ ID NO: 9226355 - DNA, 22 bp, Homo sapiens
tggcttcctgcatggatcctct

SEQ ID NO: 9226356 - DNA, 19 bp, Homo sapiens
tggcttcctgactctcatc

SEQ ID NO: 9226357 - DNA, 22 bp, Homo sapiens
tggcttcctaggagcccgtgct

SEQ ID NO: 9226358 - DNA, 22 bp, Homo sapiens
tggcttccgccgcgggcctcgg

SEQ ID NO: 9226359 - DNA, 17 bp, Homo sapiens
tggcttccctgggccac

SEQ ID NO: 9226360 - DNA, 22 bp, Homo sapiens
tggcttcagagtctgagttctt

SEQ ID NO: 9226361 - DNA, 22 bp, Homo sapiens
tggcttctagcagtgttgattt

SEQ ID NO: 9226362 - DNA, 22 bp, Homo sapiens
tggcttcctggacagatgcggt

SEQ ID NO: 9226363 - DNA, 22 bp, Homo sapiens
tggcttcctgtgtaatgaggtg

SEQ ID NO: 9226364 - DNA, 22 bp, Homo sapiens
tggcttctattgctgtggcatt

SEQ ID NO: 9226365 - DNA, 22 bp, Homo sapiens
tggcttctgctttcagtggagg

SEQ ID NO: 9226366 - DNA, 22 bp, Homo sapiens
tggcttctctgtgtgagggaga

SEQ ID NO: 9226367 - DNA, 22 bp, Homo sapiens
tgggacaaggactagctccaat

SEQ ID NO: 9226368 - DNA, 22 bp, Homo sapiens
tgggacacacaaggtcagctct

SEQ ID NO: 9226369 - DNA, 22 bp, Homo sapiens
tgggacaggttggagagaagca

SEQ ID NO: 9226370 - DNA, 22 bp, Homo sapiens
tgggactgagaatatgatgggg

SEQ ID NO: 9226371 - DNA, 20 bp, Homo sapiens
tgggactgacccatctgagc

SEQ ID NO: 9226372 - DNA, 22 bp, Homo sapiens
tgggactcactcttttggccag

SEQ ID NO: 9226373 - DNA, 21 bp, Homo sapiens
tgggacagtgatggctcctcc

SEQ ID NO: 9226374 - DNA, 22 bp, Homo sapiens
tgggacagttgtcctccactct

SEQ ID NO: 9226375 - DNA, 22 bp, Homo sapiens
tgggacagttgtcctccactct

SEQ ID NO: 9226376 - DNA, 23 bp, Homo sapiens
tgggaagatatgtatgttcaagg

SEQ ID NO: 9226377 - DNA, 22 bp, Homo sapiens
tgggaagatatgagtgaccaac

SEQ ID NO: 9226378 - DNA, 22 bp, Homo sapiens
tgggaagatgaggtgccatggg

SEQ ID NO: 9226379 - DNA, 22 bp, Homo sapiens
tgggaagatgataattcacagt

SEQ ID NO: 9226380 - DNA, 22 bp, Homo sapiens
tgggaagatggagtgacaggca

SEQ ID NO: 9226381 - DNA, 22 bp, Homo sapiens
tgggaagggccgatggagcctc

SEQ ID NO: 9226382 - DNA, 22 bp, Homo sapiens
tgggaagggccgatggagcctc

SEQ ID NO: 9226383 - DNA, 22 bp, Homo sapiens
tgggaaggcgtggaagtagaag

SEQ ID NO: 9226384 - DNA, 22 bp, Homo sapiens
tgggaaggtacacgggaaagag

SEQ ID NO: 9226385 - DNA, 22 bp, Homo sapiens
tgggaaggtacacgggaaagag

SEQ ID NO: 9226386 - DNA, 22 bp, Homo sapiens
tgggaagggtcaacagctggaa

SEQ ID NO: 9226387 - DNA, 22 bp, Homo sapiens
tgggaagggtcaacagctggaa

SEQ ID NO: 9226388 - DNA, 22 bp, Homo sapiens
tgggaaggggagctggaaagga

SEQ ID NO: 9226389 - DNA, 22 bp, Homo sapiens
tgggaaggggagctggaaagga

SEQ ID NO: 9226390 - DNA, 22 bp, Homo sapiens
tgggagcaaatgactgggagat

SEQ ID NO: 9226391 - DNA, 22 bp, Homo sapiens
tgggagcaagctacttagggaa

SEQ ID NO: 9226392 - DNA, 21 bp, Homo sapiens
tgggagagggctcagctaccc

SEQ ID NO: 9226393 - DNA, 22 bp, Homo sapiens
tgggagactccagaactgatcc

SEQ ID NO: 9226394 - DNA, 22 bp, Homo sapiens
tgggagaagcatggggtgcaga

SEQ ID NO: 9226395 - DNA, 22 bp, Homo sapiens
tgggagaagcagcagccaagtg

SEQ ID NO: 9226396 - DNA, 22 bp, Homo sapiens
tgggagaaagaaccctgagtga

SEQ ID NO: 9226397 - DNA, 22 bp, Homo sapiens
tgggagaaagaaccctgagtga

SEQ ID NO: 9226398 - DNA, 22 bp, Homo sapiens
tgggacttcaatgcaatgaggt

SEQ ID NO: 9226399 - DNA, 22 bp, Homo sapiens
tgggagcaccctgaggagcttc

SEQ ID NO: 9226400 - DNA, 22 bp, Homo sapiens
tgggagcaagctggtgctggag

SEQ ID NO: 9226401 - DNA, 22 bp, Homo sapiens
tgggagcaagctggtgctggag

SEQ ID NO: 9226402 - DNA, 22 bp, Homo sapiens
tgggagcactctttgggaagca

SEQ ID NO: 9226403 - DNA, 22 bp, Homo sapiens
tgggagcaccttgagggcagaa

SEQ ID NO: 9226404 - DNA, 22 bp, Homo sapiens
tgggagcaccctgaggagcttc

SEQ ID NO: 9226405 - DNA, 22 bp, Homo sapiens
tgggagcaccctgaggagcttc

SEQ ID NO: 9226406 - DNA, 22 bp, Homo sapiens
tgggagcaccttgagggcagaa

SEQ ID NO: 9226407 - DNA, 22 bp, Homo sapiens
tgggagcagcagggagatgcgg

SEQ ID NO: 9226408 - DNA, 22 bp, Homo sapiens
tgggagcagccaacatggcctt

SEQ ID NO: 9226409 - DNA, 22 bp, Homo sapiens
tgggagctcctggagggcagga

SEQ ID NO: 9226410 - DNA, 22 bp, Homo sapiens
tgggagcagctttgcgagggag

SEQ ID NO: 9226411 - DNA, 22 bp, Homo sapiens
tgggaggatcgcttgagcccag

SEQ ID NO: 9226412 - DNA, 22 bp, Homo sapiens
tgggaggcagaagttgactgga

SEQ ID NO: 9226413 - DNA, 22 bp, Homo sapiens
tgggagctggggttggacgtct

SEQ ID NO: 9226414 - DNA, 22 bp, Homo sapiens
tgggagctctgagcctgctatg

SEQ ID NO: 9226415 - DNA, 22 bp, Homo sapiens
tgggaggacttgtgggcttcat

SEQ ID NO: 9226416 - DNA, 22 bp, Homo sapiens
tggaagaggccagaaagtggga

SEQ ID NO: 9226417 - DNA, 22 bp, Homo sapiens
tggaagagggagctgggtggcc

SEQ ID NO: 9226418 - DNA, 22 bp, Homo sapiens
tggaagaggtggaagtggcttc

SEQ ID NO: 9226419 - DNA, 22 bp, Homo sapiens
tggaagagaaaggagtggatct

SEQ ID NO: 9226420 - DNA, 22 bp, Homo sapiens
tggaagccaggaagcaggggtc

SEQ ID NO: 9226421 - DNA, 22 bp, Homo sapiens
tggaagcatagcagcgtgtgtg

SEQ ID NO: 9226422 - DNA, 22 bp, Homo sapiens
tggaagcatcacttcttgcctg

SEQ ID NO: 9226423 - DNA, 22 bp, Homo sapiens
tggaagcagtgattcttgtctg

SEQ ID NO: 9226424 - DNA, 22 bp, Homo sapiens
tggaagcagtcacttcctagtt

SEQ ID NO: 9226425 - DNA, 22 bp, Homo sapiens
tggaagcacttgggttttgttg

SEQ ID NO: 9226426 - DNA, 22 bp, Homo sapiens
tggaaggggagctggaaagggg

SEQ ID NO: 9226427 - DNA, 22 bp, Homo sapiens
tggaaggggagttgttccacgt

SEQ ID NO: 9226428 - DNA, 22 bp, Homo sapiens
tggaaggggccaggcgcggagt

SEQ ID NO: 9226429 - DNA, 22 bp, Homo sapiens
tggaaggggccaggcgcggagt

SEQ ID NO: 9226430 - DNA, 16 bp, Homo sapiens
tggaaggggtctccgg

SEQ ID NO: 9226431 - DNA, 22 bp, Homo sapiens
tggaaggggttacgcagcagga

SEQ ID NO: 9226432 - DNA, 20 bp, Homo sapiens
tggacacagccctgttgagt

SEQ ID NO: 9226433 - DNA, 18 bp, Homo sapiens
tggacacatggcctgggt

SEQ ID NO: 9226434 - DNA, 20 bp, Homo sapiens
tggacagaattagacacttt

SEQ ID NO: 9226435 - DNA, 22 bp, Homo sapiens
tggacacttaaaaacagataaa

SEQ ID NO: 9226436 - DNA, 22 bp, Homo sapiens
tggacactgtctccaggataaa

SEQ ID NO: 9226437 - DNA, 22 bp, Homo sapiens
tggacagcttgcagagccaccc

SEQ ID NO: 9226438 - DNA, 22 bp, Homo sapiens
tggacagcttgcagagccaccc

SEQ ID NO: 9226439 - DNA, 23 bp, Homo sapiens
tggacagcagcagcagtgtcacc

SEQ ID NO: 9226440 - DNA, 20 bp, Homo sapiens
tggaccaccctcctctttgc

SEQ ID NO: 9226441 - DNA, 22 bp, Homo sapiens
tggaccagcagccccagtgcct

SEQ ID NO: 9226442 - DNA, 22 bp, Homo sapiens
tggaccccctcaaggcagagct

SEQ ID NO: 9226443 - DNA, 22 bp, Homo sapiens
tggaccccagacaagccagggt

SEQ ID NO: 9226444 - DNA, 23 bp, Homo sapiens
tggaccctgcacaccagctctac

SEQ ID NO: 9226445 - DNA, 22 bp, Homo sapiens
tggacctggggtggcctcctct

SEQ ID NO: 9226446 - DNA, 22 bp, Homo sapiens
tggacctgctggatgggcaggt

SEQ ID NO: 9226447 - DNA, 22 bp, Homo sapiens
tggacctgagcctggccctgcc

SEQ ID NO: 9226448 - DNA, 21 bp, Homo sapiens
tggactggtgagtttaggctg

SEQ ID NO: 9226449 - DNA, 22 bp, Homo sapiens
tggactctaagcagaggatcta

SEQ ID NO: 9226450 - DNA, 20 bp, Homo sapiens
tggacctgtctctttaggga

SEQ ID NO: 9226451 - DNA, 19 bp, Homo sapiens
tggacctgtgcccatggct

SEQ ID NO: 9226452 - DNA, 17 bp, Homo sapiens
tgctttcttcctgccct

SEQ ID NO: 9226453 - DNA, 22 bp, Homo sapiens
tgctttctttagctcctgagtc

SEQ ID NO: 9226454 - DNA, 22 bp, Homo sapiens
tgctttctgctcttgtccacac

SEQ ID NO: 9226455 - DNA, 22 bp, Homo sapiens
tgctttataacttagtttatgg

SEQ ID NO: 9226456 - DNA, 22 bp, Homo sapiens
tgcttcttactcatatgctgat

SEQ ID NO: 9226457 - DNA, 22 bp, Homo sapiens
tgcttctttatgatgtatgatt

SEQ ID NO: 9226458 - DNA, 22 bp, Homo sapiens
tgcttctttactataggcaatt

SEQ ID NO: 9226459 - DNA, 19 bp, Homo sapiens
tgcttgcctgcctttccca

SEQ ID NO: 9226460 - DNA, 22 bp, Homo sapiens
tgcttgcaagagatgcaatgac

SEQ ID NO: 9226461 - DNA, 22 bp, Homo sapiens
tgctttaaaccatggatgtgag

SEQ ID NO: 9226462 - DNA, 22 bp, Homo sapiens
tggaaatatttgctcattatct

SEQ ID NO: 9226463 - DNA, 22 bp, Homo sapiens
tggaaatattgggtaatagttg

SEQ ID NO: 9226464 - DNA, 22 bp, Homo sapiens
tggaaatatgctccattctttt

SEQ ID NO: 9226465 - DNA, 22 bp, Homo sapiens
tggaaatatacaatgtgtctct

SEQ ID NO: 9226466 - DNA, 22 bp, Homo sapiens
tggaaatacaagaagtatgtca

SEQ ID NO: 9226467 - DNA, 22 bp, Homo sapiens
tggaaatacaagaagtatgtca

SEQ ID NO: 9226468 - DNA, 22 bp, Homo sapiens
tggaacgtcgtaatgttggtta

SEQ ID NO: 9226469 - DNA, 22 bp, Homo sapiens
tggaacctggcctgagctacca

SEQ ID NO: 9226470 - DNA, 22 bp, Homo sapiens
tggaaccatcaaagagatcctg

SEQ ID NO: 9226471 - DNA, 22 bp, Homo sapiens
tggaaccctcctactccagggc

SEQ ID NO: 9226472 - DNA, 22 bp, Homo sapiens
tgcttttagctagtaactagta

SEQ ID NO: 9226473 - DNA, 19 bp, Homo sapiens
tgctttgctcttggactca

SEQ ID NO: 9226474 - DNA, 22 bp, Homo sapiens
tgctttttagtactgtcttatt

SEQ ID NO: 9226475 - DNA, 19 bp, Homo sapiens
tggaaaatggattgaatca

SEQ ID NO: 9226476 - DNA, 22 bp, Homo sapiens
tggaaaacattgagataccaag

SEQ ID NO: 9226477 - DNA, 22 bp, Homo sapiens
tggaaaactttggtggtgaggg

SEQ ID NO: 9226478 - DNA, 22 bp, Homo sapiens
tggaaaacaaagctctcattat

SEQ ID NO: 9226479 - DNA, 22 bp, Homo sapiens
tggaaacacccacgcatgcata

SEQ ID NO: 9226480 - DNA, 18 bp, Homo sapiens
tggagcaggtaggcatga

SEQ ID NO: 9226481 - DNA, 22 bp, Homo sapiens
tggagcaggtgccaggtgtgtg

SEQ ID NO: 9226482 - DNA, 22 bp, Homo sapiens
tggagcaggaagtctatggctg

SEQ ID NO: 9226483 - DNA, 22 bp, Homo sapiens
tggagcaggtgctcagggtaat

SEQ ID NO: 9226484 - DNA, 22 bp, Homo sapiens
tggagcagtggtcctggagatg

SEQ ID NO: 9226485 - DNA, 22 bp, Homo sapiens
tggagccagcggcctgctgagg

SEQ ID NO: 9226486 - DNA, 22 bp, Homo sapiens
tggagccagcccaggcccctct

SEQ ID NO: 9226487 - DNA, 22 bp, Homo sapiens
tggagccagcccaggcccctct

SEQ ID NO: 9226488 - DNA, 22 bp, Homo sapiens
tggagctggaagacagtgatat

SEQ ID NO: 9226489 - DNA, 22 bp, Homo sapiens
tggagctggaagacagtgatat

SEQ ID NO: 9226490 - DNA, 22 bp, Homo sapiens
tggagctggaatttctgggcct

SEQ ID NO: 9226491 - DNA, 18 bp, Homo sapiens
tggagctgagtgctgtgc

SEQ ID NO: 9226492 - DNA, 22 bp, Homo sapiens
tggagctgcctggcacctacag

SEQ ID NO: 9226493 - DNA, 22 bp, Homo sapiens
tggagctggaagaatgtagacg

SEQ ID NO: 9226494 - DNA, 22 bp, Homo sapiens
tggagctggaagaatgtagacg

SEQ ID NO: 9226495 - DNA, 21 bp, Homo sapiens
tggagctccctgcatcccact

SEQ ID NO: 9226496 - DNA, 22 bp, Homo sapiens
tggagcctgttctgagaagccg

SEQ ID NO: 9226497 - DNA, 22 bp, Homo sapiens
tggagcctgttctgagaagccg

SEQ ID NO: 9226498 - DNA, 23 bp, Homo sapiens
tggagcctgggatacaatagatg

SEQ ID NO: 9226499 - DNA, 23 bp, Homo sapiens
tggagcctgggatacaatagatg

SEQ ID NO: 9226500 - DNA, 22 bp, Homo sapiens
tggagccttttacccacaggag

SEQ ID NO: 9226501 - DNA, 22 bp, Homo sapiens
tggagccttttgttctgggaca

SEQ ID NO: 9226502 - DNA, 22 bp, Homo sapiens
tggagctgaactttgaggccag

SEQ ID NO: 9226503 - DNA, 22 bp, Homo sapiens
tggagctgaactttgaggccag

SEQ ID NO: 9226504 - DNA, 22 bp, Homo sapiens
tggagccaggctggccctgcca

SEQ ID NO: 9226505 - DNA, 22 bp, Homo sapiens
tggagccagtgttgcccaacac

SEQ ID NO: 9226506 - DNA, 22 bp, Homo sapiens
tggagcccacggatgtcgcttt

SEQ ID NO: 9226507 - DNA, 18 bp, Homo sapiens
tggagccattgccaccat

SEQ ID NO: 9226508 - DNA, 18 bp, Homo sapiens
tggagccattgccaccat

SEQ ID NO: 9226509 - DNA, 22 bp, Homo sapiens
tggagcccatgagccataccag

SEQ ID NO: 9226510 - DNA, 22 bp, Homo sapiens
tggagcccaggtgcaagagagt

SEQ ID NO: 9226511 - DNA, 22 bp, Homo sapiens
tggagcccctcacccacacctg

SEQ ID NO: 9226512 - DNA, 22 bp, Homo sapiens
tggagcctcctcacactgtggc

SEQ ID NO: 9226513 - DNA, 22 bp, Homo sapiens
tggagcctgagtcagcggaggc

SEQ ID NO: 9226514 - DNA, 22 bp, Homo sapiens
tggagcccagacactggcattg

SEQ ID NO: 9226515 - DNA, 22 bp, Homo sapiens
tggagcccaggagaggataaac

SEQ ID NO: 9226516 - DNA, 22 bp, Homo sapiens
tggagcccagggtgagaaggag

SEQ ID NO: 9226517 - DNA, 22 bp, Homo sapiens
tggagaggagcaccatggccat

SEQ ID NO: 9226518 - DNA, 22 bp, Homo sapiens
tggagcagagatgggagcccaa

SEQ ID NO: 9226519 - DNA, 22 bp, Homo sapiens
tggagagtctctgagccagggc

SEQ ID NO: 9226520 - DNA, 22 bp, Homo sapiens
tggagcagagttcagcggggag

SEQ ID NO: 9226521 - DNA, 22 bp, Homo sapiens
tggagcagaggaagaaggcttt

SEQ ID NO: 9226522 - DNA, 22 bp, Homo sapiens
tggagcagcacaagaaagggga

SEQ ID NO: 9226523 - DNA, 22 bp, Homo sapiens
tggagcagccatgatgacagag

SEQ ID NO: 9226524 - DNA, 22 bp, Homo sapiens
tggagcagccatgatgacagag

SEQ ID NO: 9226525 - DNA, 22 bp, Homo sapiens
tggagaagtcaaagtgaacagg

SEQ ID NO: 9226526 - DNA, 22 bp, Homo sapiens
tggagaaggccggccaggagtg

SEQ ID NO: 9226527 - DNA, 22 bp, Homo sapiens
tggagaaggggcagggtctcca

SEQ ID NO: 9226528 - DNA, 22 bp, Homo sapiens
tggagaagattggtcaccattc

SEQ ID NO: 9226529 - DNA, 22 bp, Homo sapiens
tggagaaaaggttgaatccatc

SEQ ID NO: 9226530 - DNA, 21 bp, Homo sapiens
tggagagcccttgcctgagtc

SEQ ID NO: 9226531 - DNA, 22 bp, Homo sapiens
tggagggaacccaggctgctct

SEQ ID NO: 9226532 - DNA, 22 bp, Homo sapiens
tggaggctgtgtgcatgagacc

SEQ ID NO: 9226533 - DNA, 22 bp, Homo sapiens
tggagtgcaatagtaataaggt

SEQ ID NO: 9226534 - DNA, 22 bp, Homo sapiens
tggagtggacttcatgaggcca

SEQ ID NO: 9226535 - DNA, 22 bp, Homo sapiens
tggagtctgtgatgctctgggt

SEQ ID NO: 9226536 - DNA, 22 bp, Homo sapiens
tggaggtgtccaactcgtgggt

SEQ ID NO: 9226537 - DNA, 22 bp, Homo sapiens
tggataaatagatacacttgca

SEQ ID NO: 9226538 - DNA, 22 bp, Homo sapiens
tggataaaatctgtaaggctca

SEQ ID NO: 9226539 - DNA, 22 bp, Homo sapiens
tggaggcaccactggctgcccg

SEQ ID NO: 9226540 - DNA, 22 bp, Homo sapiens
tggaggccgaattagagcgttg

SEQ ID NO: 9226541 - DNA, 19 bp, Homo sapiens
tggaggcctcaggaaaaga

SEQ ID NO: 9226542 - DNA, 19 bp, Homo sapiens
tggaggccaggacacaggt

SEQ ID NO: 9226543 - DNA, 20 bp, Homo sapiens
tggagctgtggtaaggagca

SEQ ID NO: 9226544 - DNA, 22 bp, Homo sapiens
tggagcttgggactcttggtag

SEQ ID NO: 9226545 - DNA, 22 bp, Homo sapiens
tggagctgtcactcagaaccaa

SEQ ID NO: 9226546 - DNA, 22 bp, Homo sapiens
tggagctggtaaacagtgacat

SEQ ID NO: 9226547 - DNA, 20 bp, Homo sapiens
tggagctgtaatcttgtctg

SEQ ID NO: 9226548 - DNA, 22 bp, Homo sapiens
tggagctgtagccaccaccctg

SEQ ID NO: 9226549 - DNA, 22 bp, Homo sapiens
tggagctggtaaacagtgacat

SEQ ID NO: 9226550 - DNA, 22 bp, Homo sapiens
tggagctgggagtcctgggctg

SEQ ID NO: 9226551 - DNA, 23 bp, Homo sapiens
tggagctgggctcagaccctggg

SEQ ID NO: 9226552 - DNA, 22 bp, Homo sapiens
tggaggagggctggtgtctgta

SEQ ID NO: 9226553 - DNA, 22 bp, Homo sapiens
tggaggattaatctggaaagat

SEQ ID NO: 9226554 - DNA, 19 bp, Homo sapiens
tggaggagaggaaaagtca

SEQ ID NO: 9226555 - DNA, 19 bp, Homo sapiens
tggaggagaggaaaagtca

SEQ ID NO: 9226556 - DNA, 22 bp, Homo sapiens
tggaggagaactccctggctac

SEQ ID NO: 9226557 - DNA, 19 bp, Homo sapiens
tgctggagggtagtgagtc

SEQ ID NO: 9226558 - DNA, 22 bp, Homo sapiens
tgctggaggcctgactgtgttt

SEQ ID NO: 9226559 - DNA, 22 bp, Homo sapiens
tgctggaggagtttactgtggc

SEQ ID NO: 9226560 - DNA, 22 bp, Homo sapiens
tgctggaggagtttactgtggc

SEQ ID NO: 9226561 - DNA, 22 bp, Homo sapiens
tgctggaggccagaagtctgag

SEQ ID NO: 9226562 - DNA, 22 bp, Homo sapiens
tgctggagtggcactgtgtggc

SEQ ID NO: 9226563 - DNA, 23 bp, Homo sapiens
tgctggagtttactcaggccagc

SEQ ID NO: 9226564 - DNA, 18 bp, Homo sapiens
tgctggcaactactattg

SEQ ID NO: 9226565 - DNA, 22 bp, Homo sapiens
tgctggcatcttaatgttctgt

SEQ ID NO: 9226566 - DNA, 22 bp, Homo sapiens
tgctggctgtatatgtgagagt

SEQ ID NO: 9226567 - DNA, 22 bp, Homo sapiens
tgctggctgtatatgtgagagt

SEQ ID NO: 9226568 - DNA, 22 bp, Homo sapiens
tgctggctgtatatgtgagagt

SEQ ID NO: 9226569 - DNA, 22 bp, Homo sapiens
tgctggctgggctgctggagac

SEQ ID NO: 9226570 - DNA, 22 bp, Homo sapiens
tgctggctggcctggcctggac

SEQ ID NO: 9226571 - DNA, 22 bp, Homo sapiens
tgctggctggcctggcctggac

SEQ ID NO: 9226572 - DNA, 22 bp, Homo sapiens
tgctggctgcagtgctgtcaaa

SEQ ID NO: 9226573 - DNA, 22 bp, Homo sapiens
tgctggctgccaggttccctgt

SEQ ID NO: 9226574 - DNA, 22 bp, Homo sapiens
tgctggctgccaggttccctgt

SEQ ID NO: 9226575 - DNA, 22 bp, Homo sapiens
tgctggctggatcagagattgg

SEQ ID NO: 9226576 - DNA, 22 bp, Homo sapiens
tgctggctggatcagagattgg

SEQ ID NO: 9226577 - DNA, 22 bp, Homo sapiens
tgctggctgcagtgctgtcaaa

SEQ ID NO: 9226578 - DNA, 22 bp, Homo sapiens
tgctggctggagtgcctctgga

SEQ ID NO: 9226579 - DNA, 22 bp, Homo sapiens
tgctggctgttctagggaggcc

SEQ ID NO: 9226580 - DNA, 22 bp, Homo sapiens
tgctggcttatttagtaaatgt

SEQ ID NO: 9226581 - DNA, 22 bp, Homo sapiens
tgctggcttagatatcactgcc

SEQ ID NO: 9226582 - DNA, 23 bp, Homo sapiens
tgctggcttccagctgctccctc

SEQ ID NO: 9226583 - DNA, 23 bp, Homo sapiens
tgctggcttccagctgctccctc

SEQ ID NO: 9226584 - DNA, 22 bp, Homo sapiens
tgctggctgtccctacctggct

SEQ ID NO: 9226585 - DNA, 22 bp, Homo sapiens
tgctggctgtgtaccatctcaa

SEQ ID NO: 9226586 - DNA, 22 bp, Homo sapiens
tgctggctgttctagggaggcc

SEQ ID NO: 9226587 - DNA, 23 bp, Homo sapiens
tgctggctgtgttattgccaaca

SEQ ID NO: 9226588 - DNA, 23 bp, Homo sapiens
tgctggctgtgttattgccaaca

SEQ ID NO: 9226589 - DNA, 22 bp, Homo sapiens
tgctggctatttaaagaagaaa

SEQ ID NO: 9226590 - DNA, 22 bp, Homo sapiens
tgctggctcagtttgcagactc

SEQ ID NO: 9226591 - DNA, 22 bp, Homo sapiens
tgctggctcagtttgcagactc

SEQ ID NO: 9226592 - DNA, 22 bp, Homo sapiens
tgctggctcagtttgcagactc

SEQ ID NO: 9226593 - DNA, 22 bp, Homo sapiens
tgctggctcccaggagccgctg

SEQ ID NO: 9226594 - DNA, 22 bp, Homo sapiens
tgctggctccaacctggcatct

SEQ ID NO: 9226595 - DNA, 22 bp, Homo sapiens
tgctggctactgatggcaggcc

SEQ ID NO: 9226596 - DNA, 22 bp, Homo sapiens
tgctggctactgatggcaggcc

SEQ ID NO: 9226597 - DNA, 22 bp, Homo sapiens
tgctggcatttcaggactcacc

SEQ ID NO: 9226598 - DNA, 22 bp, Homo sapiens
tgctggctctgggccaagcagg

SEQ ID NO: 9226599 - DNA, 22 bp, Homo sapiens
tgctggctctgggccaagcagg

SEQ ID NO: 9226600 - DNA, 22 bp, Homo sapiens
tgctggctctaggctgagacag

SEQ ID NO: 9226601 - DNA, 22 bp, Homo sapiens
tgctggctctaggctgagacag

SEQ ID NO: 9226602 - DNA, 22 bp, Homo sapiens
tgctggctcctcgaggcttcgt

SEQ ID NO: 9226603 - DNA, 22 bp, Homo sapiens
tgctggctcccaggagccgctg

SEQ ID NO: 9226604 - DNA, 22 bp, Homo sapiens
tgctggctcctcgaggcttcgt

SEQ ID NO: 9226605 - DNA, 23 bp, Homo sapiens
tgctggctgaaacagccaaagga

SEQ ID NO: 9226606 - DNA, 23 bp, Homo sapiens
tgctggctgaaacagccaaagga

SEQ ID NO: 9226607 - DNA, 21 bp, Homo sapiens
tgctggctgaaaggcacagag

SEQ ID NO: 9226608 - DNA, 21 bp, Homo sapiens
tgctggctgaaaggcacagag

SEQ ID NO: 9226609 - DNA, 22 bp, Homo sapiens
tgctggctgaggcctgagcggg

SEQ ID NO: 9226610 - DNA, 22 bp, Homo sapiens
tgctggctgaggcctgagcggg

SEQ ID NO: 9226611 - DNA, 23 bp, Homo sapiens
tgctggagacaagtgtgagaagg

SEQ ID NO: 9226612 - DNA, 19 bp, Homo sapiens
tgctgcttccagctcactc

SEQ ID NO: 9226613 - DNA, 22 bp, Homo sapiens
tgctgcttcacctgttgtacag

SEQ ID NO: 9226614 - DNA, 22 bp, Homo sapiens
tgctgctttgatgtgtaaatca

SEQ ID NO: 9226615 - DNA, 22 bp, Homo sapiens
tgctgcttttgtatatcagaga

SEQ ID NO: 9226616 - DNA, 20 bp, Homo sapiens
tgctgctttgccactagttg

SEQ ID NO: 9226617 - DNA, 20 bp, Homo sapiens
tgctgctttgccactagttg

SEQ ID NO: 9226618 - DNA, 20 bp, Homo sapiens
tgctgcagtttcatgggact

SEQ ID NO: 9226619 - DNA, 22 bp, Homo sapiens
tgctgccacatttaaagagggg

SEQ ID NO: 9226620 - DNA, 22 bp, Homo sapiens
tgctgccaggtcttgctgtcca

SEQ ID NO: 9226621 - DNA, 22 bp, Homo sapiens
tgctgccagggctctgcccaca

SEQ ID NO: 9226622 - DNA, 22 bp, Homo sapiens
tgctgccagccaggccatggag

SEQ ID NO: 9226623 - DNA, 22 bp, Homo sapiens
tgctgccacctggtggctgaag

SEQ ID NO: 9226624 - DNA, 22 bp, Homo sapiens
tgctgctgaggctaaagtatag

SEQ ID NO: 9226625 - DNA, 22 bp, Homo sapiens
tgctgcctctgctgatatggcc

SEQ ID NO: 9226626 - DNA, 22 bp, Homo sapiens
tgctgcctccttcctgccagga

SEQ ID NO: 9226627 - DNA, 22 bp, Homo sapiens
tgctgccatggtcgctggtgtc

SEQ ID NO: 9226628 - DNA, 22 bp, Homo sapiens
tgctgccatctcaactgccctt

SEQ ID NO: 9226629 - DNA, 22 bp, Homo sapiens
tgctgcctaggaatctgtattt

SEQ ID NO: 9226630 - DNA, 22 bp, Homo sapiens
tgctgcctcaactgtcaggaac

SEQ ID NO: 9226631 - DNA, 22 bp, Homo sapiens
tgctgcctcagcttcctgggct

SEQ ID NO: 9226632 - DNA, 22 bp, Homo sapiens
tgctgcctccaactcctgggct

SEQ ID NO: 9226633 - DNA, 22 bp, Homo sapiens
tgctgcctaataagtcgagggt

SEQ ID NO: 9226634 - DNA, 20 bp, Homo sapiens
tgctgcctactaagccctca

SEQ ID NO: 9226635 - DNA, 22 bp, Homo sapiens
tgctgcctaacagaactctttc

SEQ ID NO: 9226636 - DNA, 22 bp, Homo sapiens
tgcttaatattgtgatgtaata

SEQ ID NO: 9226637 - DNA, 22 bp, Homo sapiens
tgcttccagctctctgtaaggt

SEQ ID NO: 9226638 - DNA, 22 bp, Homo sapiens
tgcttccaattcaaatctgtgg

SEQ ID NO: 9226639 - DNA, 22 bp, Homo sapiens
tgcttctgaactcagcatgtgg

SEQ ID NO: 9226640 - DNA, 22 bp, Homo sapiens
tgcttctgactaagctgcatga

SEQ ID NO: 9226641 - DNA, 22 bp, Homo sapiens
tgcttctgatgtgagcagcccc

SEQ ID NO: 9226642 - DNA, 22 bp, Homo sapiens
tgcttctcaaagaagcataatg

SEQ ID NO: 9226643 - DNA, 22 bp, Homo sapiens
tgcttctcaaagaagcataatg

SEQ ID NO: 9226644 - DNA, 22 bp, Homo sapiens
tgcttcccaaggtttcatgtgc

SEQ ID NO: 9226645 - DNA, 22 bp, Homo sapiens
tgcttccctcacttcacctggc

SEQ ID NO: 9226646 - DNA, 22 bp, Homo sapiens
tgcttccctcacttcacctggc

SEQ ID NO: 9226647 - DNA, 22 bp, Homo sapiens
tgcttccctgaaggcacaggag

SEQ ID NO: 9226648 - DNA, 23 bp, Homo sapiens
tgcttctctgcttgacagttctg

SEQ ID NO: 9226649 - DNA, 23 bp, Homo sapiens
tgcttctctgcttgacagttctg

SEQ ID NO: 9226650 - DNA, 21 bp, Homo sapiens
tgcttctctagatcaactact

SEQ ID NO: 9226651 - DNA, 22 bp, Homo sapiens
tgcttctcccaaccagggcctg

SEQ ID NO: 9226652 - DNA, 21 bp, Homo sapiens
tgcttctctagatcaactact

SEQ ID NO: 9226653 - DNA, 22 bp, Homo sapiens
tgctgggcatttatgcagatgg

SEQ ID NO: 9226654 - DNA, 22 bp, Homo sapiens
tgctgggccaaagcagggtttt

SEQ ID NO: 9226655 - DNA, 22 bp, Homo sapiens
tgctgggcctgcccctgtcagc

SEQ ID NO: 9226656 - DNA, 22 bp, Homo sapiens
tgctgggcccccagtgaccttc

SEQ ID NO: 9226657 - DNA, 20 bp, Homo sapiens
tgctgggccatcttgcatgc

SEQ ID NO: 9226658 - DNA, 22 bp, Homo sapiens
tgctgggcccagggagcctctg

SEQ ID NO: 9226659 - DNA, 23 bp, Homo sapiens
tgctgggcagagctggtgctgag

SEQ ID NO: 9226660 - DNA, 20 bp, Homo sapiens
tgctgggcatgcagtggaaa

SEQ ID NO: 9226661 - DNA, 22 bp, Homo sapiens
tgctggcttggaaggaaagcgc

SEQ ID NO: 9226662 - DNA, 22 bp, Homo sapiens
tgctggcttcctgtgcacagca

SEQ ID NO: 9226663 - DNA, 22 bp, Homo sapiens
tgctggcttcctgtgcacagca

SEQ ID NO: 9226664 - DNA, 22 bp, Homo sapiens
tgctgggcctttacctccaggg

SEQ ID NO: 9226665 - DNA, 22 bp, Homo sapiens
tgctgggcggtgggctcatccc

SEQ ID NO: 9226666 - DNA, 22 bp, Homo sapiens
tgctgggctagaagctgaggcc

SEQ ID NO: 9226667 - DNA, 22 bp, Homo sapiens
tgctgggctcaacctccagagc

SEQ ID NO: 9226668 - DNA, 22 bp, Homo sapiens
tgctgggctagggtggagctct

SEQ ID NO: 9226669 - DNA, 22 bp, Homo sapiens
tgctgggctagggtggagctct

SEQ ID NO: 9226670 - DNA, 22 bp, Homo sapiens
tgctgggctggggcctcagacc

SEQ ID NO: 9226671 - DNA, 22 bp, Homo sapiens
tgctgggctggagctgccaggg

SEQ ID NO: 9226672 - DNA, 21 bp, Homo sapiens
tgctgggctgcaggggatgca

SEQ ID NO: 9226673 - DNA, 22 bp, Homo sapiens
tgctgggcttcaactgcctgag

SEQ ID NO: 9226674 - DNA, 22 bp, Homo sapiens
tgctgggcttgaaagctgctaa

SEQ ID NO: 9226675 - DNA, 23 bp, Homo sapiens
tgctggggtagtttgtggcacag

SEQ ID NO: 9226676 - DNA, 22 bp, Homo sapiens
tgctggggcagaagagccaaga

SEQ ID NO: 9226677 - DNA, 23 bp, Homo sapiens
tgctggttcaaaaaggaaggagg

SEQ ID NO: 9226678 - DNA, 23 bp, Homo sapiens
tgctggtgtttttgggaccaggg

SEQ ID NO: 9226679 - DNA, 22 bp, Homo sapiens
tgctggtgattaaatcctgaag

SEQ ID NO: 9226680 - DNA, 22 bp, Homo sapiens
tgctggtggagaaagtggaggt

SEQ ID NO: 9226681 - DNA, 22 bp, Homo sapiens
tgctgggtggttgctcctcccg

SEQ ID NO: 9226682 - DNA, 22 bp, Homo sapiens
tgctccagcctatgctctccgg

SEQ ID NO: 9226683 - DNA, 20 bp, Homo sapiens
tgctccaggaacactggccg

SEQ ID NO: 9226684 - DNA, 22 bp, Homo sapiens
tgctccagcgctgccaccagtt

SEQ ID NO: 9226685 - DNA, 22 bp, Homo sapiens
tgctcctgatatctaatgtgta

SEQ ID NO: 9226686 - DNA, 22 bp, Homo sapiens
tgctccagggcctccagtgggg

SEQ ID NO: 9226687 - DNA, 19 bp, Homo sapiens
tgctccgctaaggcagaca

SEQ ID NO: 9226688 - DNA, 22 bp, Homo sapiens
tgctctgggattcagcagcctg

SEQ ID NO: 9226689 - DNA, 22 bp, Homo sapiens
tgctctgggctatctgagaaag

SEQ ID NO: 9226690 - DNA, 22 bp, Homo sapiens
tgctctgggctcaatggcagct

SEQ ID NO: 9226691 - DNA, 22 bp, Homo sapiens
tgctctggctggagcaatgact

SEQ ID NO: 9226692 - DNA, 22 bp, Homo sapiens
tgctctggctgggatgagtgca

SEQ ID NO: 9226693 - DNA, 23 bp, Homo sapiens
tgctctgggaggccctggagagc

SEQ ID NO: 9226694 - DNA, 22 bp, Homo sapiens
tgctctgggattcagcagcctg

SEQ ID NO: 9226695 - DNA, 17 bp, Homo sapiens
tgctcctgggacaagga

SEQ ID NO: 9226696 - DNA, 17 bp, Homo sapiens
tgctcctgtggcagcct

SEQ ID NO: 9226697 - DNA, 22 bp, Homo sapiens
tgctcctgtttcatcagctata

SEQ ID NO: 9226698 - DNA, 22 bp, Homo sapiens
tgctctagctcataggactcat

SEQ ID NO: 9226699 - DNA, 22 bp, Homo sapiens
tgctcgaggtccccaccggctc

SEQ ID NO: 9226700 - DNA, 22 bp, Homo sapiens
tgctgcaggccttggctgggaa

SEQ ID NO: 9226701 - DNA, 22 bp, Homo sapiens
tgctgcagggaagtcggggggt

SEQ ID NO: 9226702 - DNA, 19 bp, Homo sapiens
tgctgcagtcaggcgaggg

SEQ ID NO: 9226703 - DNA, 22 bp, Homo sapiens
tgctgcaggtgtgttcagtgag

SEQ ID NO: 9226704 - DNA, 22 bp, Homo sapiens
tgctgcagtcacacggctatct

SEQ ID NO: 9226705 - DNA, 22 bp, Homo sapiens
tgctgaggtcaccttgctgcta

SEQ ID NO: 9226706 - DNA, 22 bp, Homo sapiens
tgctgaggaggtggctgtgctt

SEQ ID NO: 9226707 - DNA, 22 bp, Homo sapiens
tgctgaaggcaggggaggtggc

SEQ ID NO: 9226708 - DNA, 22 bp, Homo sapiens
tgctgaaacaataacatactgg

SEQ ID NO: 9226709 - DNA, 22 bp, Homo sapiens
tgctctgtcaagaaaagatgcc

SEQ ID NO: 9226710 - DNA, 20 bp, Homo sapiens
tgctctgggggtggagagac

SEQ ID NO: 9226711 - DNA, 20 bp, Homo sapiens
tgctctgggggtggagagac

SEQ ID NO: 9226712 - DNA, 22 bp, Homo sapiens
tgctcagagctccagctctcct

SEQ ID NO: 9226713 - DNA, 22 bp, Homo sapiens
tgctcagagggtgatgtcattt

SEQ ID NO: 9226714 - DNA, 22 bp, Homo sapiens
tgctcagagactctccctgagc

SEQ ID NO: 9226715 - DNA, 18 bp, Homo sapiens
tgctcagagaaatcaagg

SEQ ID NO: 9226716 - DNA, 22 bp, Homo sapiens
tgctcagacaagctgaacagta

SEQ ID NO: 9226717 - DNA, 22 bp, Homo sapiens
tgctcagactagctccagggaa

SEQ ID NO: 9226718 - DNA, 22 bp, Homo sapiens
tgctcagacttaagaagatcag

SEQ ID NO: 9226719 - DNA, 22 bp, Homo sapiens
tgctcagaattgcgctggtgga

SEQ ID NO: 9226720 - DNA, 22 bp, Homo sapiens
tgctcagaagacttactggtta

SEQ ID NO: 9226721 - DNA, 21 bp, Homo sapiens
tgctcagattctccatctgga

SEQ ID NO: 9226722 - DNA, 22 bp, Homo sapiens
tgctcagattacagccccacat

SEQ ID NO: 9226723 - DNA, 22 bp, Homo sapiens
tgctcagagctctggtgcaggt

SEQ ID NO: 9226724 - DNA, 22 bp, Homo sapiens
tgctcagacttaagaagatcag

SEQ ID NO: 9226725 - DNA, 22 bp, Homo sapiens
tgctcagcagatctcaggagat

SEQ ID NO: 9226726 - DNA, 22 bp, Homo sapiens
tgctcagcagatctcaggagat

SEQ ID NO: 9226727 - DNA, 22 bp, Homo sapiens
tgctcagcagtcaaggtcatag

SEQ ID NO: 9226728 - DNA, 22 bp, Homo sapiens
tgctcagcgccaaagctgatgg

SEQ ID NO: 9226729 - DNA, 22 bp, Homo sapiens
tgctcagccgtgagcagagccg

SEQ ID NO: 9226730 - DNA, 19 bp, Homo sapiens
tgctcagctcctgtgagtc

SEQ ID NO: 9226731 - DNA, 22 bp, Homo sapiens
tgctcagctaggctgaagaaga

SEQ ID NO: 9226732 - DNA, 22 bp, Homo sapiens
tgctcaaatgtggacaactgat

SEQ ID NO: 9226733 - DNA, 22 bp, Homo sapiens
tgctcactgaactcttgctgtc

SEQ ID NO: 9226734 - DNA, 22 bp, Homo sapiens
tgctcagaaagccaccagagcg

SEQ ID NO: 9226735 - DNA, 22 bp, Homo sapiens
tgctcagaacatgattcaggcg

SEQ ID NO: 9226736 - DNA, 22 bp, Homo sapiens
tgctcagaactgtgaatacatg

SEQ ID NO: 9226737 - DNA, 22 bp, Homo sapiens
tgctcagaaacgaggtgcagcc

SEQ ID NO: 9226738 - DNA, 21 bp, Homo sapiens
tgctcatgagcccacagctgc

SEQ ID NO: 9226739 - DNA, 22 bp, Homo sapiens
tgctcatcaacatgatgatcat

SEQ ID NO: 9226740 - DNA, 22 bp, Homo sapiens
tgctcagctggtgccagggtcc

SEQ ID NO: 9226741 - DNA, 22 bp, Homo sapiens
tgctcagcttcagaggatcccc

SEQ ID NO: 9226742 - DNA, 22 bp, Homo sapiens
tgctcagcagtcaaggtcatag

SEQ ID NO: 9226743 - DNA, 22 bp, Homo sapiens
tgctcagctgctctgtattctt

SEQ ID NO: 9226744 - DNA, 18 bp, Homo sapiens
tgctcagctggtgctgaa

SEQ ID NO: 9226745 - DNA, 22 bp, Homo sapiens
tgctccagcaccaagagctcca

SEQ ID NO: 9226746 - DNA, 22 bp, Homo sapiens
tgctaaagcaaactgtgctact

SEQ ID NO: 9226747 - DNA, 22 bp, Homo sapiens
tgcgttgcgctcctgcagcagg

SEQ ID NO: 9226748 - DNA, 22 bp, Homo sapiens
tgcgggttggtggcatatgcag

SEQ ID NO: 9226749 - DNA, 22 bp, Homo sapiens
tgccttttgaagcctcacaggt

SEQ ID NO: 9226750 - DNA, 22 bp, Homo sapiens
tgccttttctgtagctctggaa

SEQ ID NO: 9226751 - DNA, 22 bp, Homo sapiens
tgccttttatggctagcctcag

SEQ ID NO: 9226752 - DNA, 22 bp, Homo sapiens
tgccttttccagcttccaggag

SEQ ID NO: 9226753 - DNA, 22 bp, Homo sapiens
tgccttttccagtttctagggg

SEQ ID NO: 9226754 - DNA, 22 bp, Homo sapiens
tgccttgcaggttttaaataca

SEQ ID NO: 9226755 - DNA, 22 bp, Homo sapiens
tgccttgacagttgtaagacct

SEQ ID NO: 9226756 - DNA, 22 bp, Homo sapiens
tgccttgaacatagtggacagt

SEQ ID NO: 9226757 - DNA, 22 bp, Homo sapiens
tgccttcttctccctggctcag

SEQ ID NO: 9226758 - DNA, 22 bp, Homo sapiens
tgcctggctaatttttgtatcc

SEQ ID NO: 9226759 - DNA, 22 bp, Homo sapiens
tgcctggccctgacagccctgg

SEQ ID NO: 9226760 - DNA, 21 bp, Homo sapiens
tgcctggcctttgcttttcct

SEQ ID NO: 9226761 - DNA, 22 bp, Homo sapiens
tgcctggggattgctctgggcc

SEQ ID NO: 9226762 - DNA, 22 bp, Homo sapiens
tgcctgggggactaaggccaaa

SEQ ID NO: 9226763 - DNA, 22 bp, Homo sapiens
tgcctggggttggcaaactgct

SEQ ID NO: 9226764 - DNA, 22 bp, Homo sapiens
tgcctgtcttcaggagtgtcac

SEQ ID NO: 9226765 - DNA, 22 bp, Homo sapiens
tgcctgggttgactcttagctg

SEQ ID NO: 9226766 - DNA, 22 bp, Homo sapiens
tgcctgggttcccaccccaaag

SEQ ID NO: 9226767 - DNA, 22 bp, Homo sapiens
tgcctgggtgtaaagggccaac

SEQ ID NO: 9226768 - DNA, 22 bp, Homo sapiens
tggttcctcagggcagctgtac

SEQ ID NO: 9226769 - DNA, 17 bp, Homo sapiens
tggttcttttcattccc

SEQ ID NO: 9226770 - DNA, 23 bp, Homo sapiens
tggttcttatgattttactacca

SEQ ID NO: 9226771 - DNA, 22 bp, Homo sapiens
tggttgtgagcgatggatggag

SEQ ID NO: 9226772 - DNA, 23 bp, Homo sapiens
tggtggggtcttggagacagcac

SEQ ID NO: 9226773 - DNA, 23 bp, Homo sapiens
tggtggggtcttggagacagcac

SEQ ID NO: 9226774 - DNA, 22 bp, Homo sapiens
tggtggggtcatcgtcagatgc

SEQ ID NO: 9226775 - DNA, 22 bp, Homo sapiens
tggtttgacaatgaggactggt

SEQ ID NO: 9226776 - DNA, 22 bp, Homo sapiens
tggtttgtatatgtttgtgaga

SEQ ID NO: 9226777 - DNA, 18 bp, Homo sapiens
tggtttgtcatgagaatt

SEQ ID NO: 9226778 - DNA, 20 bp, Homo sapiens
tgtaaaacaaggtgaatcct

SEQ ID NO: 9226779 - DNA, 22 bp, Homo sapiens
tgtaaaaccaaatcaatctagt

SEQ ID NO: 9226780 - DNA, 22 bp, Homo sapiens
tgtaaataatgcatgtaaatca

SEQ ID NO: 9226781 - DNA, 20 bp, Homo sapiens
tgtaaataggcattgtagtt

SEQ ID NO: 9226782 - DNA, 22 bp, Homo sapiens
tgtaaagatccttagcaacatc

SEQ ID NO: 9226783 - DNA, 18 bp, Homo sapiens
tgtaaacactttcattct

SEQ ID NO: 9226784 - DNA, 22 bp, Homo sapiens
tgtaaacaaatgcattcttgct

SEQ ID NO: 9226785 - DNA, 22 bp, Homo sapiens
tgtaacatatgtaaaagcacct

SEQ ID NO: 9226786 - DNA, 22 bp, Homo sapiens
tgtaacagtaagcctgtgagct

SEQ ID NO: 9226787 - DNA, 22 bp, Homo sapiens
tgtaacagtaagcctgtgagct

SEQ ID NO: 9226788 - DNA, 23 bp, Homo sapiens
tgtaacagagcactgattgacaa

SEQ ID NO: 9226789 - DNA, 22 bp, Homo sapiens
tgtaacagtagttactattctt

SEQ ID NO: 9226790 - DNA, 22 bp, Homo sapiens
tgtaacagttataacaatgtgg

SEQ ID NO: 9226791 - DNA, 23 bp, Homo sapiens
tgtaacaatttcatatacatgca

SEQ ID NO: 9226792 - DNA, 22 bp, Homo sapiens
tgtaagaaaagtaaatagtgac

SEQ ID NO: 9226793 - DNA, 22 bp, Homo sapiens
tgtaagaacaactgtcaaatgt

SEQ ID NO: 9226794 - DNA, 22 bp, Homo sapiens
tgtacacaattcttaacataca

SEQ ID NO: 9226795 - DNA, 22 bp, Homo sapiens
tgtaccagtgttgagaatgaga

SEQ ID NO: 9226796 - DNA, 22 bp, Homo sapiens
tgtaccaggccctgtggacatg

SEQ ID NO: 9226797 - DNA, 22 bp, Homo sapiens
tgtaccagtgttgagaatgaga

SEQ ID NO: 9226798 - DNA, 22 bp, Homo sapiens
tggtggcaatgtcctggagaag

SEQ ID NO: 9226799 - DNA, 22 bp, Homo sapiens
tggtggcaatgtcctggagaag

SEQ ID NO: 9226800 - DNA, 22 bp, Homo sapiens
tggtggcacaagggagagaatc

SEQ ID NO: 9226801 - DNA, 22 bp, Homo sapiens
tggtggcacaagggagagaatc

SEQ ID NO: 9226802 - DNA, 23 bp, Homo sapiens
tggtggcagaagtagcagatgac

SEQ ID NO: 9226803 - DNA, 23 bp, Homo sapiens
tggtggcagaagtagcagatgac

SEQ ID NO: 9226804 - DNA, 22 bp, Homo sapiens
tggtggcagagcaagagctgga

SEQ ID NO: 9226805 - DNA, 22 bp, Homo sapiens
tggtggcagcaggagggcccct

SEQ ID NO: 9226806 - DNA, 22 bp, Homo sapiens
tggtggcagctgggacagaggt

SEQ ID NO: 9226807 - DNA, 22 bp, Homo sapiens
tggtggcagtgagaaggagagg

SEQ ID NO: 9226808 - DNA, 22 bp, Homo sapiens
tggtgggagtccgctgtgctgc

SEQ ID NO: 9226809 - DNA, 22 bp, Homo sapiens
tggtgggagtccgctgtgctgc

SEQ ID NO: 9226810 - DNA, 22 bp, Homo sapiens
tggtgggagtgagggcatgcca

SEQ ID NO: 9226811 - DNA, 22 bp, Homo sapiens
tggtgggagtgagggcatgcca

SEQ ID NO: 9226812 - DNA, 22 bp, Homo sapiens
tggtgggcacagtgcccaggct

SEQ ID NO: 9226813 - DNA, 16 bp, Homo sapiens
tggtggggaggacagc

SEQ ID NO: 9226814 - DNA, 16 bp, Homo sapiens
tggtggggaggacagc

SEQ ID NO: 9226815 - DNA, 22 bp, Homo sapiens
tggtggggattccctccctggc

SEQ ID NO: 9226816 - DNA, 22 bp, Homo sapiens
tggtggggccagacttcagctc

SEQ ID NO: 9226817 - DNA, 22 bp, Homo sapiens
tggtgggggaggctgtctagca

SEQ ID NO: 9226818 - DNA, 22 bp, Homo sapiens
tggtggggctttccttctgctt

SEQ ID NO: 9226819 - DNA, 22 bp, Homo sapiens
tggtgcaggccaagctgcgagc

SEQ ID NO: 9226820 - DNA, 22 bp, Homo sapiens
tggtgcagtccaaagggagcag

SEQ ID NO: 9226821 - DNA, 22 bp, Homo sapiens
tggtgccattagccctgctgtt

SEQ ID NO: 9226822 - DNA, 22 bp, Homo sapiens
tggtgccattagccctgctgtt

SEQ ID NO: 9226823 - DNA, 22 bp, Homo sapiens
tggtgccaccctccttcagctg

SEQ ID NO: 9226824 - DNA, 22 bp, Homo sapiens
tggtgccacttcttaggctggt

SEQ ID NO: 9226825 - DNA, 22 bp, Homo sapiens
tggtgccatcatagctcactgc

SEQ ID NO: 9226826 - DNA, 22 bp, Homo sapiens
tggtgccatcatagctcactgc

SEQ ID NO: 9226827 - DNA, 22 bp, Homo sapiens
tggtgccaccctccttcagctg

SEQ ID NO: 9226828 - DNA, 22 bp, Homo sapiens
tggtgccaagcatgaggactct

SEQ ID NO: 9226829 - DNA, 23 bp, Homo sapiens
tggtgccacagctgaagtcaggt

SEQ ID NO: 9226830 - DNA, 22 bp, Homo sapiens
tggtgccacaagaatacaaagc

SEQ ID NO: 9226831 - DNA, 22 bp, Homo sapiens
tggtggcaaatcaggacacttc

SEQ ID NO: 9226832 - DNA, 22 bp, Homo sapiens
tggtggcaacattgctggagtg

SEQ ID NO: 9226833 - DNA, 22 bp, Homo sapiens
tggtccagacatttctgaggta

SEQ ID NO: 9226834 - DNA, 22 bp, Homo sapiens
tggtcattaattcttaccttta

SEQ ID NO: 9226835 - DNA, 22 bp, Homo sapiens
tggtcagaaggaagggctccta

SEQ ID NO: 9226836 - DNA, 22 bp, Homo sapiens
tggtcagagaagtagggacaat

SEQ ID NO: 9226837 - DNA, 22 bp, Homo sapiens
tggtcacccctaaataggaaag

SEQ ID NO: 9226838 - DNA, 22 bp, Homo sapiens
tggtcagaactcagcgtgcttg

SEQ ID NO: 9226839 - DNA, 22 bp, Homo sapiens
tggtcaggctgctctgcggcgt

SEQ ID NO: 9226840 - DNA, 22 bp, Homo sapiens
tggtcctggaaggtcctgaggg

SEQ ID NO: 9226841 - DNA, 22 bp, Homo sapiens
tggtcctggagagtgttccata

SEQ ID NO: 9226842 - DNA, 22 bp, Homo sapiens
tggtcctggagagtgttccata

SEQ ID NO: 9226843 - DNA, 22 bp, Homo sapiens
tggtcctgggcacagtatatgc

SEQ ID NO: 9226844 - DNA, 22 bp, Homo sapiens
tggtcctgggcacagtatatgc

SEQ ID NO: 9226845 - DNA, 22 bp, Homo sapiens
tggtcctggccttgaccccagg

SEQ ID NO: 9226846 - DNA, 22 bp, Homo sapiens
tggtcctggagatcaatatgca

SEQ ID NO: 9226847 - DNA, 22 bp, Homo sapiens
tggtcctgctacaggggattag

SEQ ID NO: 9226848 - DNA, 22 bp, Homo sapiens
tggtcctgcttgctgcttaaga

SEQ ID NO: 9226849 - DNA, 23 bp, Homo sapiens
tggtcctgccaacggtgcccctc

SEQ ID NO: 9226850 - DNA, 22 bp, Homo sapiens
tggtcctgcccacgcccatctg

SEQ ID NO: 9226851 - DNA, 22 bp, Homo sapiens
tggtcctgccccgtgcacagag

SEQ ID NO: 9226852 - DNA, 22 bp, Homo sapiens
tggtcctgaggcttgtttccac

SEQ ID NO: 9226853 - DNA, 22 bp, Homo sapiens
tggtcctgatcaccgctgggca

SEQ ID NO: 9226854 - DNA, 22 bp, Homo sapiens
tggtcctgcagtaatagacatc

SEQ ID NO: 9226855 - DNA, 22 bp, Homo sapiens
tggtcctgagaatcctgtcctc

SEQ ID NO: 9226856 - DNA, 22 bp, Homo sapiens
tggtcctgagcaccagcctgac

SEQ ID NO: 9226857 - DNA, 22 bp, Homo sapiens
tggtcctgtgttcttcctgcct

SEQ ID NO: 9226858 - DNA, 22 bp, Homo sapiens
tggtcctgtctcaaggagcctt

SEQ ID NO: 9226859 - DNA, 22 bp, Homo sapiens
tggtcctgtagctctctaagtt

SEQ ID NO: 9226860 - DNA, 20 bp, Homo sapiens
tggtcctgtcccacccactc

SEQ ID NO: 9226861 - DNA, 23 bp, Homo sapiens
tggtcctggttgaggtgggcccc

SEQ ID NO: 9226862 - DNA, 22 bp, Homo sapiens
tggtcctgtagcacttgattag

SEQ ID NO: 9226863 - DNA, 22 bp, Homo sapiens
tggtcctggggtgcaggctgac

SEQ ID NO: 9226864 - DNA, 22 bp, Homo sapiens
tggtcctggggatctgcagtga

SEQ ID NO: 9226865 - DNA, 22 bp, Homo sapiens
tggtcctggtgcaagtgcattt

SEQ ID NO: 9226866 - DNA, 22 bp, Homo sapiens
tggtcctggtcatctgggctgg

SEQ ID NO: 9226867 - DNA, 22 bp, Homo sapiens
tggtcctggtagcggtgtgctt

SEQ ID NO: 9226868 - DNA, 22 bp, Homo sapiens
tggtcctttaagtctttctctg

SEQ ID NO: 9226869 - DNA, 21 bp, Homo sapiens
tggtccttctttactgcctcc

SEQ ID NO: 9226870 - DNA, 22 bp, Homo sapiens
tggtccttgctatagagtgata

SEQ ID NO: 9226871 - DNA, 22 bp, Homo sapiens
tggtccttcttgaagagtgagt

SEQ ID NO: 9226872 - DNA, 22 bp, Homo sapiens
tggtcgaccagttggaaagtaa

SEQ ID NO: 9226873 - DNA, 22 bp, Homo sapiens
tggtctctgtgctcgggcatgg

SEQ ID NO: 9226874 - DNA, 22 bp, Homo sapiens
tgtattgaattgtgttatatct

SEQ ID NO: 9226875 - DNA, 22 bp, Homo sapiens
tgtatttaagctttacctaaaa

SEQ ID NO: 9226876 - DNA, 22 bp, Homo sapiens
tgtatttaagctttacctaaaa

SEQ ID NO: 9226877 - DNA, 22 bp, Homo sapiens
tgtattttcagagtggcatttc

SEQ ID NO: 9226878 - DNA, 22 bp, Homo sapiens
tgtattttgtgaggatcactct

SEQ ID NO: 9226879 - DNA, 22 bp, Homo sapiens
tgtcaaactgtgacttctaatg

SEQ ID NO: 9226880 - DNA, 22 bp, Homo sapiens
tgtcacagagcgtgcaacagaa

SEQ ID NO: 9226881 - DNA, 22 bp, Homo sapiens
tgtcaaagatgtctttgaaaat

SEQ ID NO: 9226882 - DNA, 22 bp, Homo sapiens
tgtcaaagacagaaggaaatgg

SEQ ID NO: 9226883 - DNA, 22 bp, Homo sapiens
tgtcaaacaccaacatttctcc

SEQ ID NO: 9226884 - DNA, 22 bp, Homo sapiens
tgtcaaaaccttggaggcaagg

SEQ ID NO: 9226885 - DNA, 22 bp, Homo sapiens
tgtcaaaaagctgggacaagca

SEQ ID NO: 9226886 - DNA, 22 bp, Homo sapiens
tgtatttttaggaatgcgctat

SEQ ID NO: 9226887 - DNA, 22 bp, Homo sapiens
tgtcaccacatttgtcaatatc

SEQ ID NO: 9226888 - DNA, 22 bp, Homo sapiens
tgtcaccatgccagcttctgcc

SEQ ID NO: 9226889 - DNA, 22 bp, Homo sapiens
tgtcacagagcgtgcaacagaa

SEQ ID NO: 9226890 - DNA, 22 bp, Homo sapiens
tgtcacagatcgtttttgagct

SEQ ID NO: 9226891 - DNA, 22 bp, Homo sapiens
tgtcacagggataccatggggc

SEQ ID NO: 9226892 - DNA, 22 bp, Homo sapiens
tgtataaatttaaattcctgct

SEQ ID NO: 9226893 - DNA, 22 bp, Homo sapiens
tgtatacattctcttgggtttg

SEQ ID NO: 9226894 - DNA, 22 bp, Homo sapiens
tgtagaagctagcctggagcca

SEQ ID NO: 9226895 - DNA, 22 bp, Homo sapiens
tgtagacatgcttttctgatga

SEQ ID NO: 9226896 - DNA, 20 bp, Homo sapiens
tgtagacagtgtgatccagg

SEQ ID NO: 9226897 - DNA, 22 bp, Homo sapiens
tgtagacaggatctagttaaaa

SEQ ID NO: 9226898 - DNA, 18 bp, Homo sapiens
tgtagacagggcatggaa

SEQ ID NO: 9226899 - DNA, 19 bp, Homo sapiens
tgtagcagtttaaaacaac

SEQ ID NO: 9226900 - DNA, 22 bp, Homo sapiens
tgtagcagagtatctctgtttt

SEQ ID NO: 9226901 - DNA, 22 bp, Homo sapiens
tgtagcagtgtctaccacatta

SEQ ID NO: 9226902 - DNA, 22 bp, Homo sapiens
tgtagatgagtcagggtgcatg

SEQ ID NO: 9226903 - DNA, 22 bp, Homo sapiens
tgtagatgagtcagggtgcacc

SEQ ID NO: 9226904 - DNA, 22 bp, Homo sapiens
tgtcctcagatatgtctactct

SEQ ID NO: 9226905 - DNA, 22 bp, Homo sapiens
tgtcctggggcgacttggggcc

SEQ ID NO: 9226906 - DNA, 22 bp, Homo sapiens
tgtcctggggacaagaggccct

SEQ ID NO: 9226907 - DNA, 22 bp, Homo sapiens
tgtcctgggtcaaatcctggtc

SEQ ID NO: 9226908 - DNA, 22 bp, Homo sapiens
tgtcctgggaatgggatgcagt

SEQ ID NO: 9226909 - DNA, 22 bp, Homo sapiens
tgtcctgggaggcggggtccag

SEQ ID NO: 9226910 - DNA, 22 bp, Homo sapiens
tgtcctgggtccctgctagaag

SEQ ID NO: 9226911 - DNA, 22 bp, Homo sapiens
tgtcctgggtccctgctagaag

SEQ ID NO: 9226912 - DNA, 22 bp, Homo sapiens
tgtcctgggtggatgcttcatt

SEQ ID NO: 9226913 - DNA, 22 bp, Homo sapiens
tgtccaggtggcctctgctgct

SEQ ID NO: 9226914 - DNA, 22 bp, Homo sapiens
tgtccaggtcagcagcagggac

SEQ ID NO: 9226915 - DNA, 22 bp, Homo sapiens
tgtccaggctaaagtgcagtgg

SEQ ID NO: 9226916 - DNA, 22 bp, Homo sapiens
tgtccaggctggagtgcagtgg

SEQ ID NO: 9226917 - DNA, 22 bp, Homo sapiens
tgtccctggactccaggagcca

SEQ ID NO: 9226918 - DNA, 22 bp, Homo sapiens
tgtccctggtggaggctggcag

SEQ ID NO: 9226919 - DNA, 22 bp, Homo sapiens
tgtccctgatccactggacccc

SEQ ID NO: 9226920 - DNA, 18 bp, Homo sapiens
tgtccctgcaaataacat

SEQ ID NO: 9226921 - DNA, 22 bp, Homo sapiens
tgtccccattctaagaggtggc

SEQ ID NO: 9226922 - DNA, 22 bp, Homo sapiens
tgtccccaaggttcagcccaca

SEQ ID NO: 9226923 - DNA, 22 bp, Homo sapiens
tgtccccaaggttcagcccaca

SEQ ID NO: 9226924 - DNA, 22 bp, Homo sapiens
tgtcatttagtcctctgtgtgt

SEQ ID NO: 9226925 - DNA, 22 bp, Homo sapiens
tgtcatttatgcttcttcagtg

SEQ ID NO: 9226926 - DNA, 22 bp, Homo sapiens
tgtcatttattctcttattcta

SEQ ID NO: 9226927 - DNA, 20 bp, Homo sapiens
tgtcatttatttatcaaatg

SEQ ID NO: 9226928 - DNA, 22 bp, Homo sapiens
tgtcatttactccataccctca

SEQ ID NO: 9226929 - DNA, 22 bp, Homo sapiens
tgtcatttaatagatatgatgg

SEQ ID NO: 9226930 - DNA, 22 bp, Homo sapiens
tgtccaggaattgaccctgcaa

SEQ ID NO: 9226931 - DNA, 22 bp, Homo sapiens
tgtcattttctggttagttaat

SEQ ID NO: 9226932 - DNA, 22 bp, Homo sapiens
tgtccagagtcacagagctcaa

SEQ ID NO: 9226933 - DNA, 22 bp, Homo sapiens
tgtcattttcagcttatgcttc

SEQ ID NO: 9226934 - DNA, 22 bp, Homo sapiens
tgtcattttatgtatgtggtct

SEQ ID NO: 9226935 - DNA, 22 bp, Homo sapiens
tgtcattttctaatctgttgtc

SEQ ID NO: 9226936 - DNA, 22 bp, Homo sapiens
tgtcattttcatcctaaggagc

SEQ ID NO: 9226937 - DNA, 22 bp, Homo sapiens
tgtcatttcctgaatgctgagt

SEQ ID NO: 9226938 - DNA, 22 bp, Homo sapiens
tgtcatagtgtggtagcagtgg

SEQ ID NO: 9226939 - DNA, 22 bp, Homo sapiens
tgtcagtttggctctaaagttt

SEQ ID NO: 9226940 - DNA, 20 bp, Homo sapiens
tgtcagtgcctgaggcacag

SEQ ID NO: 9226941 - DNA, 22 bp, Homo sapiens
tgtcagtggtagacccagaggt

SEQ ID NO: 9226942 - DNA, 18 bp, Homo sapiens
tgtcactctggagcccag

SEQ ID NO: 9226943 - DNA, 22 bp, Homo sapiens
tgtcactcaagttccaatttac

SEQ ID NO: 9226944 - DNA, 22 bp, Homo sapiens
tgtcactcgctcagtccctgtg

SEQ ID NO: 9226945 - DNA, 22 bp, Homo sapiens
tgtcactttggggagagttttg

SEQ ID NO: 9226946 - DNA, 22 bp, Homo sapiens
tgtcactttggggagagttttg

SEQ ID NO: 9226947 - DNA, 21 bp, Homo sapiens
tgtcagaaataagcatgtgat

SEQ ID NO: 9226948 - DNA, 22 bp, Homo sapiens
tgtcaggagccaccagcactcc

SEQ ID NO: 9226949 - DNA, 22 bp, Homo sapiens
tgggcacagaatagatggccca

SEQ ID NO: 9226950 - DNA, 22 bp, Homo sapiens
tgggcacagagtcccatctgcc

SEQ ID NO: 9226951 - DNA, 22 bp, Homo sapiens
tgggcacaaacatctgcctgtt

SEQ ID NO: 9226952 - DNA, 22 bp, Homo sapiens
tgggcacaaacatctgcctgtt

SEQ ID NO: 9226953 - DNA, 22 bp, Homo sapiens
tgggcagagagtagaggcaacg

SEQ ID NO: 9226954 - DNA, 22 bp, Homo sapiens
tgggcacatagttttatggtca

SEQ ID NO: 9226955 - DNA, 22 bp, Homo sapiens
tgggcagagatctggatcaaac

SEQ ID NO: 9226956 - DNA, 22 bp, Homo sapiens
tgggcagaggacagggaagatc

SEQ ID NO: 9226957 - DNA, 22 bp, Homo sapiens
tgggcagagtcgtggggaatag

SEQ ID NO: 9226958 - DNA, 22 bp, Homo sapiens
tgggcagagtcatacaggagac

SEQ ID NO: 9226959 - DNA, 23 bp, Homo sapiens
tgggatggattcaccagtgtgct

SEQ ID NO: 9226960 - DNA, 23 bp, Homo sapiens
tgggatggattcaccagtgtgct

SEQ ID NO: 9226961 - DNA, 23 bp, Homo sapiens
tgggatggattcaccagtgtgct

SEQ ID NO: 9226962 - DNA, 22 bp, Homo sapiens
tgggatagtagctgagagacaa

SEQ ID NO: 9226963 - DNA, 22 bp, Homo sapiens
tgggatagtggccaggaccccc

SEQ ID NO: 9226964 - DNA, 22 bp, Homo sapiens
tgggaggccgaggcaggtggat

SEQ ID NO: 9226965 - DNA, 22 bp, Homo sapiens
tgggaggcaggtaggtgatgat

SEQ ID NO: 9226966 - DNA, 22 bp, Homo sapiens
tgggaggccgaggcaggtggat

SEQ ID NO: 9226967 - DNA, 22 bp, Homo sapiens
tgggaggcccaggcctggcagg

SEQ ID NO: 9226968 - DNA, 22 bp, Homo sapiens
tgggcagcagcaaagccagact

SEQ ID NO: 9226969 - DNA, 22 bp, Homo sapiens
tgggcagattaatgcagtggct

SEQ ID NO: 9226970 - DNA, 22 bp, Homo sapiens
tgggcagatctttggtggctag

SEQ ID NO: 9226971 - DNA, 22 bp, Homo sapiens
tgggcagggagctggaaccaca

SEQ ID NO: 9226972 - DNA, 22 bp, Homo sapiens
tgggcagggagctggaaccaca

SEQ ID NO: 9226973 - DNA, 22 bp, Homo sapiens
tgggcagggagctggaaccaca

SEQ ID NO: 9226974 - DNA, 19 bp, Homo sapiens
tgggcagctccctctgtcc

SEQ ID NO: 9226975 - DNA, 23 bp, Homo sapiens
tgggcagcttctgcatgcccacc

SEQ ID NO: 9226976 - DNA, 22 bp, Homo sapiens
tgggcaggggccctgcttccgt

SEQ ID NO: 9226977 - DNA, 19 bp, Homo sapiens
tgggcaggttcagtaatgg

SEQ ID NO: 9226978 - DNA, 22 bp, Homo sapiens
tgggcatgagtggacagagaag

SEQ ID NO: 9226979 - DNA, 22 bp, Homo sapiens
tgggcagtgagaaaggtcaggt

SEQ ID NO: 9226980 - DNA, 22 bp, Homo sapiens
tgggcagtggctgggcctctct

SEQ ID NO: 9226981 - DNA, 22 bp, Homo sapiens
tgggccacctgctctgtttcta

SEQ ID NO: 9226982 - DNA, 22 bp, Homo sapiens
tgggccacctgcttttttgcat

SEQ ID NO: 9226983 - DNA, 22 bp, Homo sapiens
tgggccacagctcacacatcca

SEQ ID NO: 9226984 - DNA, 22 bp, Homo sapiens
tgggccacagctcacacatcca

SEQ ID NO: 9226985 - DNA, 22 bp, Homo sapiens
tgggccacaagccatgggacca

SEQ ID NO: 9226986 - DNA, 22 bp, Homo sapiens
tgggccacaagccatgggacca

SEQ ID NO: 9226987 - DNA, 22 bp, Homo sapiens
tgggccacacacagaagaatca

SEQ ID NO: 9226988 - DNA, 22 bp, Homo sapiens
tgggccacaagccatgggacca

SEQ ID NO: 9226989 - DNA, 22 bp, Homo sapiens
tgggccacgggggtggagagct

SEQ ID NO: 9226990 - DNA, 22 bp, Homo sapiens
tgggccacgggggtggagagct

SEQ ID NO: 9226991 - DNA, 22 bp, Homo sapiens
tgggccacgtcatctcccacaa

SEQ ID NO: 9226992 - DNA, 22 bp, Homo sapiens
tgggccacgtcatctcccacaa

SEQ ID NO: 9226993 - DNA, 22 bp, Homo sapiens
tgggccagcaattgctgctcag

SEQ ID NO: 9226994 - DNA, 22 bp, Homo sapiens
tgggctgagtgtggaactagtt

SEQ ID NO: 9226995 - DNA, 22 bp, Homo sapiens
tgggctgcaccctcagcctctg

SEQ ID NO: 9226996 - DNA, 22 bp, Homo sapiens
tgggctgcagagcccggccttc

SEQ ID NO: 9226997 - DNA, 22 bp, Homo sapiens
tgggctgaaatgctgtggacta

SEQ ID NO: 9226998 - DNA, 22 bp, Homo sapiens
tgggctctcacacatgttctga

SEQ ID NO: 9226999 - DNA, 22 bp, Homo sapiens
tgggctctgaagtcagtctgct

SEQ ID NO: 9227000 - DNA, 22 bp, Homo sapiens
tgggcgacagagcaagactccg

SEQ ID NO: 9227001 - DNA, 22 bp, Homo sapiens
tgggcctgtggcttggctctag

SEQ ID NO: 9227002 - DNA, 22 bp, Homo sapiens
tgggcctgtggcttggctctag

SEQ ID NO: 9227003 - DNA, 22 bp, Homo sapiens
tgggcctgtgatgctgggctat

SEQ ID NO: 9227004 - DNA, 22 bp, Homo sapiens
tgggctcaatctgcttctgttt

SEQ ID NO: 9227005 - DNA, 22 bp, Homo sapiens
tgggctcagtctgcacctgcgg

SEQ ID NO: 9227006 - DNA, 22 bp, Homo sapiens
tgggctcagccatgacctccac

SEQ ID NO: 9227007 - DNA, 22 bp, Homo sapiens
tgggcctcggggaagcccgtgt

SEQ ID NO: 9227008 - DNA, 19 bp, Homo sapiens
tgggcctctcatatctgcc

SEQ ID NO: 9227009 - DNA, 22 bp, Homo sapiens
tgggcctcggagcacaggagac

SEQ ID NO: 9227010 - DNA, 22 bp, Homo sapiens
tgggcctcctttccattcagag

SEQ ID NO: 9227011 - DNA, 22 bp, Homo sapiens
tgggcctcctttccattcagag

SEQ ID NO: 9227012 - DNA, 22 bp, Homo sapiens
tgggcctctgtttcctcatctg

SEQ ID NO: 9227013 - DNA, 20 bp, Homo sapiens
tgggcctctggtgcctctgg

SEQ ID NO: 9227014 - DNA, 22 bp, Homo sapiens
tgggcctgactcacctgcctcc

SEQ ID NO: 9227015 - DNA, 18 bp, Homo sapiens
tgggcctgcatcctagtc

SEQ ID NO: 9227016 - DNA, 21 bp, Homo sapiens
tgggcctgattcccagggtca

SEQ ID NO: 9227017 - DNA, 22 bp, Homo sapiens
tgggcctgccccaggcttcagc

SEQ ID NO: 9227018 - DNA, 22 bp, Homo sapiens
tgggcctgccccaggcttcagc

SEQ ID NO: 9227019 - DNA, 18 bp, Homo sapiens
tgggcctgcatcctagtc

SEQ ID NO: 9227020 - DNA, 22 bp, Homo sapiens
tgggcctgggctcctgtcctct

SEQ ID NO: 9227021 - DNA, 22 bp, Homo sapiens
tgggcctgggctggacagcctg

SEQ ID NO: 9227022 - DNA, 22 bp, Homo sapiens
tgggcctgggctggacagcctg

SEQ ID NO: 9227023 - DNA, 21 bp, Homo sapiens
tgggccagtagaaaggaaggc

SEQ ID NO: 9227024 - DNA, 17 bp, Homo sapiens
tgggccagtagaaggga

SEQ ID NO: 9227025 - DNA, 22 bp, Homo sapiens
tgggccaggtctgtgtcagctg

SEQ ID NO: 9227026 - DNA, 22 bp, Homo sapiens
tgggccaggcatgtgatcagca

SEQ ID NO: 9227027 - DNA, 22 bp, Homo sapiens
tgggcctcaccttcttggcagc

SEQ ID NO: 9227028 - DNA, 22 bp, Homo sapiens
tgggcctcaccttcttggcagc

SEQ ID NO: 9227029 - DNA, 22 bp, Homo sapiens
tgggcctcctgccctggcctag

SEQ ID NO: 9227030 - DNA, 22 bp, Homo sapiens
tgggcctcctgccctggcctag

SEQ ID NO: 9227031 - DNA, 22 bp, Homo sapiens
tgggcctcctccgacagccggg

SEQ ID NO: 9227032 - DNA, 22 bp, Homo sapiens
tgggcctcccatgtcttaggga

SEQ ID NO: 9227033 - DNA, 21 bp, Homo sapiens
tgggcctcaggcagctgtgac

SEQ ID NO: 9227034 - DNA, 21 bp, Homo sapiens
tgggcctcaggcagctgtgac

SEQ ID NO: 9227035 - DNA, 22 bp, Homo sapiens
tgggcctcatcttcaatgagtc

SEQ ID NO: 9227036 - DNA, 22 bp, Homo sapiens
tgggcctcatcttcaatgagtc

SEQ ID NO: 9227037 - DNA, 22 bp, Homo sapiens
tgggcctcagtttgcttaatgt

SEQ ID NO: 9227038 - DNA, 22 bp, Homo sapiens
tgggcctcatcttcaatgagtc

SEQ ID NO: 9227039 - DNA, 22 bp, Homo sapiens
tgggcctcatgcccagccaccc

SEQ ID NO: 9227040 - DNA, 22 bp, Homo sapiens
tggtaaggggtggaaccagagc

SEQ ID NO: 9227041 - DNA, 22 bp, Homo sapiens
tgggttctagagggaccagaac

SEQ ID NO: 9227042 - DNA, 22 bp, Homo sapiens
tggtatttaatatatgagagtt

SEQ ID NO: 9227043 - DNA, 22 bp, Homo sapiens
tggtatttccaggcttatggta

SEQ ID NO: 9227044 - DNA, 22 bp, Homo sapiens
tggtatttccaggcttatggta

SEQ ID NO: 9227045 - DNA, 22 bp, Homo sapiens
tggtatttctgtgcccagctca

SEQ ID NO: 9227046 - DNA, 22 bp, Homo sapiens
tggtattctttctgtagatcat

SEQ ID NO: 9227047 - DNA, 22 bp, Homo sapiens
tggtattacttctagacacaag

SEQ ID NO: 9227048 - DNA, 21 bp, Homo sapiens
tggtaggtactggcttcaggc

SEQ ID NO: 9227049 - DNA, 22 bp, Homo sapiens
tggtagggacactatgcagaaa

SEQ ID NO: 9227050 - DNA, 22 bp, Homo sapiens
tggtatctgtgaatgtgacatt

SEQ ID NO: 9227051 - DNA, 22 bp, Homo sapiens
tgggtgaggatgatgaggcagc

SEQ ID NO: 9227052 - DNA, 21 bp, Homo sapiens
tgggtggaagcgggaggccgc

SEQ ID NO: 9227053 - DNA, 22 bp, Homo sapiens
tgggtgcttcgtcagctctgag

SEQ ID NO: 9227054 - DNA, 22 bp, Homo sapiens
tgggtgccaacctctggtggcc

SEQ ID NO: 9227055 - DNA, 22 bp, Homo sapiens
tgggtgcaggtcttgtgccagg

SEQ ID NO: 9227056 - DNA, 16 bp, Homo sapiens
tgggtgggaggagcgg

SEQ ID NO: 9227057 - DNA, 16 bp, Homo sapiens
tgggtgggaggagcgg

SEQ ID NO: 9227058 - DNA, 22 bp, Homo sapiens
tgggtgggagcgccctgtctgg

SEQ ID NO: 9227059 - DNA, 22 bp, Homo sapiens
tgggtgggagcgccctgtctgg

SEQ ID NO: 9227060 - DNA, 21 bp, Homo sapiens
tgggtgggcagagtctcttca

SEQ ID NO: 9227061 - DNA, 17 bp, Homo sapiens
tgggtggtagggagagg

SEQ ID NO: 9227062 - DNA, 21 bp, Homo sapiens
tgggtgggcagagtctcttca

SEQ ID NO: 9227063 - DNA, 22 bp, Homo sapiens
tgggtggtccaggctcagcaga

SEQ ID NO: 9227064 - DNA, 22 bp, Homo sapiens
tgggtggtttatgagtgggttt

SEQ ID NO: 9227065 - DNA, 22 bp, Homo sapiens
tggggtggatagaaagtgatgt

SEQ ID NO: 9227066 - DNA, 22 bp, Homo sapiens
tggggtggaacccttctgctgg

SEQ ID NO: 9227067 - DNA, 22 bp, Homo sapiens
tggggtgccgacagggagggca

SEQ ID NO: 9227068 - DNA, 22 bp, Homo sapiens
tggggtggggttactcattctg

SEQ ID NO: 9227069 - DNA, 22 bp, Homo sapiens
tggggtgggcatgcgctgtcct

SEQ ID NO: 9227070 - DNA, 22 bp, Homo sapiens
tgggggtgaaagtctggacagt

SEQ ID NO: 9227071 - DNA, 22 bp, Homo sapiens
tgggggtgccctatgaggaagc

SEQ ID NO: 9227072 - DNA, 22 bp, Homo sapiens
tggggtctggagttgcccatga

SEQ ID NO: 9227073 - DNA, 23 bp, Homo sapiens
tggggttgaattgtagctgtgcc

SEQ ID NO: 9227074 - DNA, 22 bp, Homo sapiens
tggggttctttgtttcctgcct

SEQ ID NO: 9227075 - DNA, 22 bp, Homo sapiens
tgggtaggaatcgagtgtatgg

SEQ ID NO: 9227076 - DNA, 22 bp, Homo sapiens
tgggtagggagctggaatccta

SEQ ID NO: 9227077 - DNA, 22 bp, Homo sapiens
tgggtagggagctggaatccta

SEQ ID NO: 9227078 - DNA, 22 bp, Homo sapiens
tgggtaggggacgtggaagaaa

SEQ ID NO: 9227079 - DNA, 22 bp, Homo sapiens
tgggtaggggacgtggaagaaa

SEQ ID NO: 9227080 - DNA, 22 bp, Homo sapiens
tgggtccttgctgattgctgag

SEQ ID NO: 9227081 - DNA, 22 bp, Homo sapiens
tgggtccttgctggcttcaaag

SEQ ID NO: 9227082 - DNA, 22 bp, Homo sapiens
tgggtctccagttcagggcagg

SEQ ID NO: 9227083 - DNA, 22 bp, Homo sapiens
tgggtcctttttggacttcttc

SEQ ID NO: 9227084 - DNA, 22 bp, Homo sapiens
tgggtccttcaaagctgggtct

SEQ ID NO: 9227085 - DNA, 22 bp, Homo sapiens
tgggtccttgccatcttggagt

SEQ ID NO: 9227086 - DNA, 22 bp, Homo sapiens
tgggtccttgctaacttctatg

SEQ ID NO: 9227087 - DNA, 22 bp, Homo sapiens
tgggtcctgtctccttgttctg

SEQ ID NO: 9227088 - DNA, 20 bp, Homo sapiens
tgggtcctgtgggagaagaa

SEQ ID NO: 9227089 - DNA, 20 bp, Homo sapiens
tgggtctgcttggcttcagt

SEQ ID NO: 9227090 - DNA, 22 bp, Homo sapiens
tgggtctgtagggctgtccaat

SEQ ID NO: 9227091 - DNA, 22 bp, Homo sapiens
tgggtcctggctttgtcagggt

SEQ ID NO: 9227092 - DNA, 22 bp, Homo sapiens
tgggtcctggaaggcgacaggt

SEQ ID NO: 9227093 - DNA, 22 bp, Homo sapiens
tgggtcctgcactgcaagcacc

SEQ ID NO: 9227094 - DNA, 20 bp, Homo sapiens
tgggtcctgcttcttcctga

SEQ ID NO: 9227095 - DNA, 20 bp, Homo sapiens
tgggtcctgcacattctcca

SEQ ID NO: 9227096 - DNA, 22 bp, Homo sapiens
tgggtcctctgagagggcagcg

SEQ ID NO: 9227097 - DNA, 22 bp, Homo sapiens
tgggtcctctggagcagcagca

SEQ ID NO: 9227098 - DNA, 22 bp, Homo sapiens
tgggtcctcgtcttccaaggca

SEQ ID NO: 9227099 - DNA, 22 bp, Homo sapiens
tgggtcctaaatgcagtcacat

SEQ ID NO: 9227100 - DNA, 19 bp, Homo sapiens
tggggcctcctgtccctgg

SEQ ID NO: 9227101 - DNA, 22 bp, Homo sapiens
tggggcctgaaaggttctcgcc

SEQ ID NO: 9227102 - DNA, 22 bp, Homo sapiens
tggggccaggtggctgcaggtc

SEQ ID NO: 9227103 - DNA, 22 bp, Homo sapiens
tggggcacttatgatgtgccac

SEQ ID NO: 9227104 - DNA, 22 bp, Homo sapiens
tggggcaagaagtgccctgaag

SEQ ID NO: 9227105 - DNA, 22 bp, Homo sapiens
tggggcagcagacctttcttgg

SEQ ID NO: 9227106 - DNA, 22 bp, Homo sapiens
tggggcagcagacctttcttgg

SEQ ID NO: 9227107 - DNA, 22 bp, Homo sapiens
tggggcagagtaggattttggc

SEQ ID NO: 9227108 - DNA, 22 bp, Homo sapiens
tggggctaaacacgcctggcct

SEQ ID NO: 9227109 - DNA, 23 bp, Homo sapiens
tggggctctggcaggcctgaggt

SEQ ID NO: 9227110 - DNA, 22 bp, Homo sapiens
tggggctctccacagtgtctca

SEQ ID NO: 9227111 - DNA, 23 bp, Homo sapiens
tggggctgatggagacggaccag

SEQ ID NO: 9227112 - DNA, 22 bp, Homo sapiens
tggggctgaggagcctcactct

SEQ ID NO: 9227113 - DNA, 22 bp, Homo sapiens
tggggctgtccttagtctgaga

SEQ ID NO: 9227114 - DNA, 22 bp, Homo sapiens
tgggggagagtttagatgattt

SEQ ID NO: 9227115 - DNA, 22 bp, Homo sapiens
tgggggagattagagcttctta

SEQ ID NO: 9227116 - DNA, 22 bp, Homo sapiens
tggggctggcacagtctctatt

SEQ ID NO: 9227117 - DNA, 22 bp, Homo sapiens
tgggggctccaggctccaggga

SEQ ID NO: 9227118 - DNA, 22 bp, Homo sapiens
tgggggcagccaggctgtcaag

SEQ ID NO: 9227119 - DNA, 22 bp, Homo sapiens
tgggggcacttcgaggtcgcct

SEQ ID NO: 9227120 - DNA, 22 bp, Homo sapiens
tgggggcacttcgaggtcgcct

SEQ ID NO: 9227121 - DNA, 20 bp, Homo sapiens
tggggagttgagcacgagca

SEQ ID NO: 9227122 - DNA, 19 bp, Homo sapiens
tggggatgctgatgaccaa

SEQ ID NO: 9227123 - DNA, 22 bp, Homo sapiens
tggggaggttcgggaatcttgt

SEQ ID NO: 9227124 - DNA, 22 bp, Homo sapiens
tggggagtgatgcctcggataa

SEQ ID NO: 9227125 - DNA, 22 bp, Homo sapiens
tggggagtgatgcctcggataa

SEQ ID NO: 9227126 - DNA, 22 bp, Homo sapiens
tggggaggttcgggaatcttgt

SEQ ID NO: 9227127 - DNA, 22 bp, Homo sapiens
tggggaggtaacaatttcaggc

SEQ ID NO: 9227128 - DNA, 21 bp, Homo sapiens
tggggaggggacctgattatg

SEQ ID NO: 9227129 - DNA, 21 bp, Homo sapiens
tggggaggggacctgattatg

SEQ ID NO: 9227130 - DNA, 23 bp, Homo sapiens
tggggagggaagtcatttctgta

SEQ ID NO: 9227131 - DNA, 23 bp, Homo sapiens
tggggagggaagtcatttctgta

SEQ ID NO: 9227132 - DNA, 22 bp, Homo sapiens
tggggaggacgggcgccttcct

SEQ ID NO: 9227133 - DNA, 22 bp, Homo sapiens
tggggaggatatgtgagttatt

SEQ ID NO: 9227134 - DNA, 22 bp, Homo sapiens
tggggactgacagccaggcctc

SEQ ID NO: 9227135 - DNA, 22 bp, Homo sapiens
tggggaggaagtcagatttcag

SEQ ID NO: 9227136 - DNA, 22 bp, Homo sapiens
tggggaggaagtcagatttcag

SEQ ID NO: 9227137 - DNA, 18 bp, Homo sapiens
tgggcttgaaagcaaggt

SEQ ID NO: 9227138 - DNA, 22 bp, Homo sapiens
tgggcttctggagtggggcaga

SEQ ID NO: 9227139 - DNA, 22 bp, Homo sapiens
tgggcttcataattggtcctag

SEQ ID NO: 9227140 - DNA, 22 bp, Homo sapiens
tgggcttaggtacctccctggt

SEQ ID NO: 9227141 - DNA, 23 bp, Homo sapiens
tgggcttctgagaaagcacctaa

SEQ ID NO: 9227142 - DNA, 19 bp, Homo sapiens
tgggcttccccagggcaga

SEQ ID NO: 9227143 - DNA, 22 bp, Homo sapiens
tgggcttcctggagcctgtgct

SEQ ID NO: 9227144 - DNA, 22 bp, Homo sapiens
tgggcttcctggagcctgtgct

SEQ ID NO: 9227145 - DNA, 22 bp, Homo sapiens
tggggaagacagcagacactgt

SEQ ID NO: 9227146 - DNA, 22 bp, Homo sapiens
tggggaagcactttgaacttaa

SEQ ID NO: 9227147 - DNA, 22 bp, Homo sapiens
tggggaagacagcagacactgt

SEQ ID NO: 9227148 - DNA, 22 bp, Homo sapiens
tggggaagaataatgtatgtac

SEQ ID NO: 9227149 - DNA, 22 bp, Homo sapiens
tggggaagggcaccctggagac

SEQ ID NO: 9227150 - DNA, 22 bp, Homo sapiens
tggggaagggcaccctggagac

SEQ ID NO: 9227151 - DNA, 22 bp, Homo sapiens
tggggaaggcggagcttgcagc

SEQ ID NO: 9227152 - DNA, 17 bp, Homo sapiens
tggggaagctcagattt

SEQ ID NO: 9227153 - DNA, 22 bp, Homo sapiens
tggggaaggatcaccacaatct

SEQ ID NO: 9227154 - DNA, 16 bp, Homo sapiens
tggggaagctcgtgag

SEQ ID NO: 9227155 - DNA, 22 bp, Homo sapiens
tgtgagacaattgcatcagggc

SEQ ID NO: 9227156 - DNA, 22 bp, Homo sapiens
tgtgactggagtccagcccact

SEQ ID NO: 9227157 - DNA, 22 bp, Homo sapiens
tgtgactgagctgcagagtgtc

SEQ ID NO: 9227158 - DNA, 22 bp, Homo sapiens
tgtgagtgacagttcccttggt

SEQ ID NO: 9227159 - DNA, 22 bp, Homo sapiens
tgtgatggttcactgggcatga

SEQ ID NO: 9227160 - DNA, 22 bp, Homo sapiens
tgtgatggttcactgggcatga

SEQ ID NO: 9227161 - DNA, 22 bp, Homo sapiens
tgtgatctgccttggatctgca

SEQ ID NO: 9227162 - DNA, 22 bp, Homo sapiens
tgtgatatttgagtattgtcaa

SEQ ID NO: 9227163 - DNA, 19 bp, Homo sapiens
tgtgataagcagaattcca

SEQ ID NO: 9227164 - DNA, 22 bp, Homo sapiens
tgtgattatattgtagtacatt

SEQ ID NO: 9227165 - DNA, 22 bp, Homo sapiens
tgtgatttcactggtgacatgt

SEQ ID NO: 9227166 - DNA, 22 bp, Homo sapiens
tgtgatttcatctgaggccagg

SEQ ID NO: 9227167 - DNA, 22 bp, Homo sapiens
tgtgaaatcacaggctatttag

SEQ ID NO: 9227168 - DNA, 21 bp, Homo sapiens
tgtgaaatagctatgctacat

SEQ ID NO: 9227169 - DNA, 22 bp, Homo sapiens
tgtgaaaggagccatagacagt

SEQ ID NO: 9227170 - DNA, 22 bp, Homo sapiens
tgtgaaaggagccatagacagt

SEQ ID NO: 9227171 - DNA, 22 bp, Homo sapiens
tgtgaaaggaaggcatgaaaag

SEQ ID NO: 9227172 - DNA, 22 bp, Homo sapiens
tgtgaaattcttgaaatgcaca

SEQ ID NO: 9227173 - DNA, 22 bp, Homo sapiens
tgtgaaatgctattgtgacaaa

SEQ ID NO: 9227174 - DNA, 22 bp, Homo sapiens
tgtgctgagtgatcccattcct

SEQ ID NO: 9227175 - DNA, 22 bp, Homo sapiens
tgtgccttatgaattctttctg

SEQ ID NO: 9227176 - DNA, 22 bp, Homo sapiens
tgtgcctttcatcatgcttttg

SEQ ID NO: 9227177 - DNA, 22 bp, Homo sapiens
tgtgcctttaaggggagctgag

SEQ ID NO: 9227178 - DNA, 22 bp, Homo sapiens
tgtgcctggagtccctgaggag

SEQ ID NO: 9227179 - DNA, 22 bp, Homo sapiens
tgtgcctggcattctgggcttc

SEQ ID NO: 9227180 - DNA, 19 bp, Homo sapiens
tgtgcctctatagcatgtg

SEQ ID NO: 9227181 - DNA, 22 bp, Homo sapiens
tgtgcctcaccctgctcttggc

SEQ ID NO: 9227182 - DNA, 22 bp, Homo sapiens
tgtgccctgttaaatgcacagt

SEQ ID NO: 9227183 - DNA, 22 bp, Homo sapiens
tgtgcacatatactcatattcc

SEQ ID NO: 9227184 - DNA, 22 bp, Homo sapiens
tgtgcacaggaagctattctct

SEQ ID NO: 9227185 - DNA, 22 bp, Homo sapiens
tgtcttttggagcatctttctt

SEQ ID NO: 9227186 - DNA, 21 bp, Homo sapiens
tgtctttggcctcattcccag

SEQ ID NO: 9227187 - DNA, 22 bp, Homo sapiens
tgtcttttctactgtaagcata

SEQ ID NO: 9227188 - DNA, 22 bp, Homo sapiens
tgtcttttgccaaagatcagtt

SEQ ID NO: 9227189 - DNA, 22 bp, Homo sapiens
tgtcttcatgcctgaaagaaga

SEQ ID NO: 9227190 - DNA, 22 bp, Homo sapiens
tgtcttcagtaaaatacactat

SEQ ID NO: 9227191 - DNA, 22 bp, Homo sapiens
tgtcttcatctcagacacagtt

SEQ ID NO: 9227192 - DNA, 17 bp, Homo sapiens
tgtcttctgaagagagc

SEQ ID NO: 9227193 - DNA, 22 bp, Homo sapiens
tgtcttcgctacaatgaaaagg

SEQ ID NO: 9227194 - DNA, 22 bp, Homo sapiens
tgtcttgactttagagccagga

SEQ ID NO: 9227195 - DNA, 22 bp, Homo sapiens
tgtctttaagcaaacagtgttt

SEQ ID NO: 9227196 - DNA, 22 bp, Homo sapiens
tgtctgggagggacagggctac

SEQ ID NO: 9227197 - DNA, 22 bp, Homo sapiens
tgtctggcatagttgctccctg

SEQ ID NO: 9227198 - DNA, 22 bp, Homo sapiens
tgtctgtggcaattgtgggtaa

SEQ ID NO: 9227199 - DNA, 22 bp, Homo sapiens
tgtcttaatttggatgatgttt

SEQ ID NO: 9227200 - DNA, 22 bp, Homo sapiens
tgtctcttgttaatgattacta

SEQ ID NO: 9227201 - DNA, 22 bp, Homo sapiens
tgtctctgctttccttgcaggg

SEQ ID NO: 9227202 - DNA, 19 bp, Homo sapiens
tgtctctgaaagatgagct

SEQ ID NO: 9227203 - DNA, 22 bp, Homo sapiens
tgtctctgaaatatgtggctcc

SEQ ID NO: 9227204 - DNA, 22 bp, Homo sapiens
tgtctgaagcagccagtgctgt

SEQ ID NO: 9227205 - DNA, 22 bp, Homo sapiens
tgtctgagtgcatatgtgctgg

SEQ ID NO: 9227206 - DNA, 21 bp, Homo sapiens
tgtctgcctgcttcttcactc

SEQ ID NO: 9227207 - DNA, 22 bp, Homo sapiens
tgtctccagaaagcaccaggag

SEQ ID NO: 9227208 - DNA, 22 bp, Homo sapiens
tgtcgcagctgaaaatctcaat

SEQ ID NO: 9227209 - DNA, 21 bp, Homo sapiens
tgtctcctgttggcacatggc

SEQ ID NO: 9227210 - DNA, 21 bp, Homo sapiens
tgtctcctgttggcacatggc

SEQ ID NO: 9227211 - DNA, 22 bp, Homo sapiens
tgtctcctgggtcccttccacc

SEQ ID NO: 9227212 - DNA, 22 bp, Homo sapiens
tgtctccatggtgaagcagggt

SEQ ID NO: 9227213 - DNA, 22 bp, Homo sapiens
tgtctccattttcaagtagcag

SEQ ID NO: 9227214 - DNA, 22 bp, Homo sapiens
tgtctcctatttcctgctaagg

SEQ ID NO: 9227215 - DNA, 22 bp, Homo sapiens
tgtgggaggaattagaatggga

SEQ ID NO: 9227216 - DNA, 22 bp, Homo sapiens
tgtgggaggattcagaattggg

SEQ ID NO: 9227217 - DNA, 20 bp, Homo sapiens
tgtgggcccttggctggcaa

SEQ ID NO: 9227218 - DNA, 22 bp, Homo sapiens
tgtgggccctaggcaccttgtc

SEQ ID NO: 9227219 - DNA, 22 bp, Homo sapiens
tgtggggacctggctgccaccc

SEQ ID NO: 9227220 - DNA, 22 bp, Homo sapiens
tgtgtacatatctatcctagat

SEQ ID NO: 9227221 - DNA, 22 bp, Homo sapiens
tgtggctgcaggcgatggagga

SEQ ID NO: 9227222 - DNA, 22 bp, Homo sapiens
tgtgggaagatgttgcaggaga

SEQ ID NO: 9227223 - DNA, 22 bp, Homo sapiens
tgtgggagaaggaagcaagctg

SEQ ID NO: 9227224 - DNA, 22 bp, Homo sapiens
tgtgggagaaggaagcaagctg

SEQ ID NO: 9227225 - DNA, 22 bp, Homo sapiens
tgtggctgactcctggtcccca

SEQ ID NO: 9227226 - DNA, 22 bp, Homo sapiens
tgtggccttgcagcctggaggt

SEQ ID NO: 9227227 - DNA, 20 bp, Homo sapiens
tgtgtgtgtacttctaaata

SEQ ID NO: 9227228 - DNA, 22 bp, Homo sapiens
tgtgtgtgttcctcctcagcta

SEQ ID NO: 9227229 - DNA, 22 bp, Homo sapiens
tgtgtgtgggcggaacggcccc

SEQ ID NO: 9227230 - DNA, 22 bp, Homo sapiens
tgtgtgtgtaaaagcatttata

SEQ ID NO: 9227231 - DNA, 22 bp, Homo sapiens
tgtgtgtgcaggagagcaggtg

SEQ ID NO: 9227232 - DNA, 22 bp, Homo sapiens
tgtgtgtgtttctgctcataca

SEQ ID NO: 9227233 - DNA, 22 bp, Homo sapiens
tgtgtgtgtttctgctcataca

SEQ ID NO: 9227234 - DNA, 22 bp, Homo sapiens
tgtgtgtgtttataaatctaaa

SEQ ID NO: 9227235 - DNA, 22 bp, Homo sapiens
tgttaaagtggataagctgaat

SEQ ID NO: 9227236 - DNA, 19 bp, Homo sapiens
tgtgtgtttatatatgtat

SEQ ID NO: 9227237 - DNA, 22 bp, Homo sapiens
tgtgtgcattcacatgcatgcc

SEQ ID NO: 9227238 - DNA, 22 bp, Homo sapiens
tgtgtgcatgttaatgagaaaa

SEQ ID NO: 9227239 - DNA, 19 bp, Homo sapiens
tgtgtgcatgcgcacgtgt

SEQ ID NO: 9227240 - DNA, 19 bp, Homo sapiens
tgtgtgctgactgccagag

SEQ ID NO: 9227241 - DNA, 21 bp, Homo sapiens
tgtgtgggcatatctgctgca

SEQ ID NO: 9227242 - DNA, 22 bp, Homo sapiens
tgtgtgggagcacgggctgttg

SEQ ID NO: 9227243 - DNA, 22 bp, Homo sapiens
tgtgtgggagcacgggctgttg

SEQ ID NO: 9227244 - DNA, 22 bp, Homo sapiens
tgtgtgtgagtcctggctttcc

SEQ ID NO: 9227245 - DNA, 22 bp, Homo sapiens
tgtgtgtgcacatgcatataca

SEQ ID NO: 9227246 - DNA, 22 bp, Homo sapiens
tgtgtgtgaaccattgagggct

SEQ ID NO: 9227247 - DNA, 22 bp, Homo sapiens
tgtgtgtgaaccattgagggct

SEQ ID NO: 9227248 - DNA, 22 bp, Homo sapiens
ttaaacagacagtaaatgaaac

SEQ ID NO: 9227249 - DNA, 22 bp, Homo sapiens
ttaaaatttccccaccatgtat

SEQ ID NO: 9227250 - DNA, 22 bp, Homo sapiens
ttaaaattatggcccatttgga

SEQ ID NO: 9227251 - DNA, 22 bp, Homo sapiens
ttaaaatttccccaccatgtat

SEQ ID NO: 9227252 - DNA, 22 bp, Homo sapiens
ttaaacacctgtctagtgtagc

SEQ ID NO: 9227253 - DNA, 17 bp, Homo sapiens
tgttttttccctgttct

SEQ ID NO: 9227254 - DNA, 22 bp, Homo sapiens
tgtttttttatatacctgaagt

SEQ ID NO: 9227255 - DNA, 20 bp, Homo sapiens
ttaaaaagagtcacaggaga

SEQ ID NO: 9227256 - DNA, 20 bp, Homo sapiens
ttaaaaagagtcacaggaga

SEQ ID NO: 9227257 - DNA, 22 bp, Homo sapiens
ttaaaaatatgtagggcccgat

SEQ ID NO: 9227258 - DNA, 22 bp, Homo sapiens
ttaaaaccatcagctgtaagat

SEQ ID NO: 9227259 - DNA, 22 bp, Homo sapiens
ttaaaacagcgtgaatctggca

SEQ ID NO: 9227260 - DNA, 22 bp, Homo sapiens
ttaaaagaatcctgttatcctc

SEQ ID NO: 9227261 - DNA, 22 bp, Homo sapiens
ttaaaagagacttcctttgttt

SEQ ID NO: 9227262 - DNA, 22 bp, Homo sapiens
tgtttgctctgactatcttgcg

SEQ ID NO: 9227263 - DNA, 22 bp, Homo sapiens
tgtttgtggaatattctttaag

SEQ ID NO: 9227264 - DNA, 20 bp, Homo sapiens
tgtttgtgccagctttgtca

SEQ ID NO: 9227265 - DNA, 20 bp, Homo sapiens
tgtttgtgccagctttgtca

SEQ ID NO: 9227266 - DNA, 22 bp, Homo sapiens
tgttttaagggtcaactgtcac

SEQ ID NO: 9227267 - DNA, 22 bp, Homo sapiens
tgttttaatctcccattgctct

SEQ ID NO: 9227268 - DNA, 22 bp, Homo sapiens
tgttaaatgtattatgtgttct

SEQ ID NO: 9227269 - DNA, 22 bp, Homo sapiens
tgttaaatgttcctttactgga

SEQ ID NO: 9227270 - DNA, 22 bp, Homo sapiens
tgttaaatgagattggaatttg

SEQ ID NO: 9227271 - DNA, 22 bp, Homo sapiens
tgttacttcttatttcttacat

SEQ ID NO: 9227272 - DNA, 22 bp, Homo sapiens
tgttagatacacgaaaaaactt

SEQ ID NO: 9227273 - DNA, 22 bp, Homo sapiens
tgttaggactccccagaagctg

SEQ ID NO: 9227274 - DNA, 22 bp, Homo sapiens
tgttagtattggcaaatttgtt

SEQ ID NO: 9227275 - DNA, 22 bp, Homo sapiens
tgttcttagcaggagcatctat

SEQ ID NO: 9227276 - DNA, 22 bp, Homo sapiens
tgtttatagggtctgtcacttg

SEQ ID NO: 9227277 - DNA, 22 bp, Homo sapiens
tgttgtactcaacagatgaatt

SEQ ID NO: 9227278 - DNA, 22 bp, Homo sapiens
tgttgagactgagggagtcagc

SEQ ID NO: 9227279 - DNA, 22 bp, Homo sapiens
ttagtctctttgcattgccata

SEQ ID NO: 9227280 - DNA, 22 bp, Homo sapiens
ttagtcaatagtgaatatagag

SEQ ID NO: 9227281 - DNA, 22 bp, Homo sapiens
ttagtcaaatcattctgtttct

SEQ ID NO: 9227282 - DNA, 22 bp, Homo sapiens
ttagtgcaattcagagaacaat

SEQ ID NO: 9227283 - DNA, 22 bp, Homo sapiens
ttagtgcaaacctcagagacac

SEQ ID NO: 9227284 - DNA, 22 bp, Homo sapiens
ttattctgagagttgaagtaat

SEQ ID NO: 9227285 - DNA, 22 bp, Homo sapiens
ttattccattcagttcaacaag

SEQ ID NO: 9227286 - DNA, 22 bp, Homo sapiens
ttagcagcaatggcatcaacta

SEQ ID NO: 9227287 - DNA, 22 bp, Homo sapiens
ttagcagcaatggcatcaacta

SEQ ID NO: 9227288 - DNA, 22 bp, Homo sapiens
ttagcagctaagtcatgctgca

SEQ ID NO: 9227289 - DNA, 22 bp, Homo sapiens
ttagcagctaaactgacagacc

SEQ ID NO: 9227290 - DNA, 22 bp, Homo sapiens
ttagcagcatccctggcctgta

SEQ ID NO: 9227291 - DNA, 22 bp, Homo sapiens
ttagcagcggtcagttttgaag

SEQ ID NO: 9227292 - DNA, 22 bp, Homo sapiens
ttagcagcttagactgcctggg

SEQ ID NO: 9227293 - DNA, 22 bp, Homo sapiens
ttagcagcttttaaatggttct

SEQ ID NO: 9227294 - DNA, 22 bp, Homo sapiens
ttagggttacaccagcctcctg

SEQ ID NO: 9227295 - DNA, 22 bp, Homo sapiens
ttagtaattagaaagtaattct

SEQ ID NO: 9227296 - DNA, 22 bp, Homo sapiens
ttagaacatagcaacagaatta

SEQ ID NO: 9227297 - DNA, 22 bp, Homo sapiens
ttagaacagtagaagaaagggt

SEQ ID NO: 9227298 - DNA, 22 bp, Homo sapiens
ttagaacagtagaagaaagggt

SEQ ID NO: 9227299 - DNA, 22 bp, Homo sapiens
ttagaacactgagaaagtgatg

SEQ ID NO: 9227300 - DNA, 22 bp, Homo sapiens
ttagaaatacaagtgaggttga

SEQ ID NO: 9227301 - DNA, 22 bp, Homo sapiens
ttagaaaggggtgaatcaatgg

SEQ ID NO: 9227302 - DNA, 22 bp, Homo sapiens
ttaaagcaaaaactaggatgga

SEQ ID NO: 9227303 - DNA, 22 bp, Homo sapiens
ttaaagagtaatcataggtcaa

SEQ ID NO: 9227304 - DNA, 22 bp, Homo sapiens
ttaaagaggcatgggaatgtat

SEQ ID NO: 9227305 - DNA, 22 bp, Homo sapiens
ttaaagagaactcaatgaatga

SEQ ID NO: 9227306 - DNA, 22 bp, Homo sapiens
ttaaagaatagtgcccctattg

SEQ ID NO: 9227307 - DNA, 22 bp, Homo sapiens
ttaataataatgagcccatttt

SEQ ID NO: 9227308 - DNA, 22 bp, Homo sapiens
ttaataagtagtagttattgtt

SEQ ID NO: 9227309 - DNA, 22 bp, Homo sapiens
ttacaaagtgctgcaccatttt

SEQ ID NO: 9227310 - DNA, 22 bp, Homo sapiens
ttacaaagttctgagttcaaac

SEQ ID NO: 9227311 - DNA, 22 bp, Homo sapiens
ttacaacaaaggcacgtgcatg

SEQ ID NO: 9227312 - DNA, 22 bp, Homo sapiens
ttacagatactttgtaggcaag

SEQ ID NO: 9227313 - DNA, 22 bp, Homo sapiens
ttacacaaaaataagatatggc

SEQ ID NO: 9227314 - DNA, 22 bp, Homo sapiens
ttacaattgagtctattgtatg

SEQ ID NO: 9227315 - DNA, 23 bp, Homo sapiens
ttacagctaactgctgttattag

SEQ ID NO: 9227316 - DNA, 22 bp, Homo sapiens
ttacatgttctcatacacagag

SEQ ID NO: 9227317 - DNA, 22 bp, Homo sapiens
ttacatgtggtgtgaagaagag

SEQ ID NO: 9227318 - DNA, 22 bp, Homo sapiens
ttacattcaatttctagaggta

SEQ ID NO: 9227319 - DNA, 22 bp, Homo sapiens
ttacattcagaaagatttgagt

SEQ ID NO: 9227320 - DNA, 22 bp, Homo sapiens
ttacattcaaggaactcattct

SEQ ID NO: 9227321 - DNA, 22 bp, Homo sapiens
ttacattcccagtgtgcagcat

SEQ ID NO: 9227322 - DNA, 22 bp, Homo sapiens
ttacattcattgaagtgattca

SEQ ID NO: 9227323 - DNA, 21 bp, Homo sapiens
ttacattcagaggagtggaag

SEQ ID NO: 9227324 - DNA, 22 bp, Homo sapiens
ttacattcttggaatcttgttt

SEQ ID NO: 9227325 - DNA, 22 bp, Homo sapiens
ttacattcttatctcagttatt

SEQ ID NO: 9227326 - DNA, 22 bp, Homo sapiens
ttcagccagtcatcagtcttgt

SEQ ID NO: 9227327 - DNA, 21 bp, Homo sapiens
ttcagctctgcttcagggaat

SEQ ID NO: 9227328 - DNA, 21 bp, Homo sapiens
ttcagctcggtctggcatgat

SEQ ID NO: 9227329 - DNA, 22 bp, Homo sapiens
ttcagctctagtaagcagacac

SEQ ID NO: 9227330 - DNA, 22 bp, Homo sapiens
ttcagctcagcactgacaagat

SEQ ID NO: 9227331 - DNA, 22 bp, Homo sapiens
ttcagctcaacgcacttctgag

SEQ ID NO: 9227332 - DNA, 22 bp, Homo sapiens
ttcaggaaatgtctgcctacca

SEQ ID NO: 9227333 - DNA, 22 bp, Homo sapiens
ttcaggaaatgtctgcctacca

SEQ ID NO: 9227334 - DNA, 22 bp, Homo sapiens
ttcaggaaattggagtccttct

SEQ ID NO: 9227335 - DNA, 22 bp, Homo sapiens
ttcaggaaggtcctatagcaga

SEQ ID NO: 9227336 - DNA, 22 bp, Homo sapiens
ttcaggaagtgctgcctggtgt

SEQ ID NO: 9227337 - DNA, 22 bp, Homo sapiens
ttcacctgtcactgcacaactg

SEQ ID NO: 9227338 - DNA, 22 bp, Homo sapiens
ttcaccctggaccagaaattgg

SEQ ID NO: 9227339 - DNA, 19 bp, Homo sapiens
ttcactaattgtaagattt

SEQ ID NO: 9227340 - DNA, 22 bp, Homo sapiens
ttcagcagtgcagacacccagt

SEQ ID NO: 9227341 - DNA, 22 bp, Homo sapiens
ttcagcagtcgtccaggaaaag

SEQ ID NO: 9227342 - DNA, 22 bp, Homo sapiens
ttcaccagaggttagaatattt

SEQ ID NO: 9227343 - DNA, 22 bp, Homo sapiens
ttcacattgtgcagattatggt

SEQ ID NO: 9227344 - DNA, 22 bp, Homo sapiens
ttcattcatctctaaaatgcct

SEQ ID NO: 9227345 - DNA, 22 bp, Homo sapiens
ttccagatatttttatgtggaa

SEQ ID NO: 9227346 - DNA, 22 bp, Homo sapiens
ttccagatgtttaagttctgct

SEQ ID NO: 9227347 - DNA, 22 bp, Homo sapiens
ttccagcaggcagacaggagat

SEQ ID NO: 9227348 - DNA, 22 bp, Homo sapiens
ttccagccatggtttccctatg

SEQ ID NO: 9227349 - DNA, 20 bp, Homo sapiens
ttccagccgccacttccgcc

SEQ ID NO: 9227350 - DNA, 22 bp, Homo sapiens
ttccagcccgcgacttgttcag

SEQ ID NO: 9227351 - DNA, 22 bp, Homo sapiens
ttccagccactttatactgcta

SEQ ID NO: 9227352 - DNA, 22 bp, Homo sapiens
ttccagccagatttgctgggtt

SEQ ID NO: 9227353 - DNA, 22 bp, Homo sapiens
ttccagcctttatccatccaga

SEQ ID NO: 9227354 - DNA, 22 bp, Homo sapiens
ttccagagtcagccactgggag

SEQ ID NO: 9227355 - DNA, 22 bp, Homo sapiens
ttccagctaactcacatccctt

SEQ ID NO: 9227356 - DNA, 22 bp, Homo sapiens
ttccaggaaaacagttggaagt

SEQ ID NO: 9227357 - DNA, 22 bp, Homo sapiens
ttccaggaacaaactcacctta

SEQ ID NO: 9227358 - DNA, 22 bp, Homo sapiens
ttccaggaaaacagttggaagt

SEQ ID NO: 9227359 - DNA, 22 bp, Homo sapiens
ttccaggaacaaactcacctta

SEQ ID NO: 9227360 - DNA, 22 bp, Homo sapiens
aaacagataatgctataaatgg

SEQ ID NO: 9227361 - DNA, 22 bp, Homo sapiens
aaacagagtttggtaaatagcc

SEQ ID NO: 9227362 - DNA, 22 bp, Homo sapiens
aaagccaggcagccaagccagt

SEQ ID NO: 9227363 - DNA, 22 bp, Homo sapiens
aaacactgtgggacatcttact

SEQ ID NO: 9227364 - DNA, 22 bp, Homo sapiens
aaacactgaagacctatctggt

SEQ ID NO: 9227365 - DNA, 22 bp, Homo sapiens
aaagccactgcatgtgtagtat

SEQ ID NO: 9227366 - DNA, 22 bp, Homo sapiens
aaagccagagcaagctgtcaca

SEQ ID NO: 9227367 - DNA, 22 bp, Homo sapiens
aaagccagaattcgtccagcct

SEQ ID NO: 9227368 - DNA, 22 bp, Homo sapiens
aaagccagcaaggtgagtttca

SEQ ID NO: 9227369 - DNA, 22 bp, Homo sapiens
aaagccagctctgagctgcacc

SEQ ID NO: 9227370 - DNA, 22 bp, Homo sapiens
aaagccagagtgtgttagagac

SEQ ID NO: 9227371 - DNA, 22 bp, Homo sapiens
aaacagctgtcattgttttaaa

SEQ ID NO: 9227372 - DNA, 22 bp, Homo sapiens
aaacagctggtctcaaatgttc

SEQ ID NO: 9227373 - DNA, 22 bp, Homo sapiens
aaacatgatgcctgtactaaga

SEQ ID NO: 9227374 - DNA, 22 bp, Homo sapiens
aaacagctcaagaagttactct

SEQ ID NO: 9227375 - DNA, 22 bp, Homo sapiens
aaacagctccttagtttccatc

SEQ ID NO: 9227376 - DNA, 22 bp, Homo sapiens
aaacagctgggaggtagaggcg

SEQ ID NO: 9227377 - DNA, 22 bp, Homo sapiens
aaacagctgggaggtagaggcg

SEQ ID NO: 9227378 - DNA, 22 bp, Homo sapiens
aaacagctgcagtacacggcct

SEQ ID NO: 9227379 - DNA, 22 bp, Homo sapiens
aaacagctgcactgctgatgtc

SEQ ID NO: 9227380 - DNA, 22 bp, Homo sapiens
aaacagctaagtacattcaagg

SEQ ID NO: 9227381 - DNA, 22 bp, Homo sapiens
aaacagctacttctgtataatg

SEQ ID NO: 9227382 - DNA, 22 bp, Homo sapiens
aaacagctacttctgtataatg

SEQ ID NO: 9227383 - DNA, 22 bp, Homo sapiens
aaacagctaatggccaggaata

SEQ ID NO: 9227384 - DNA, 20 bp, Homo sapiens
aaacagctaaaccagctctc

SEQ ID NO: 9227385 - DNA, 22 bp, Homo sapiens
aaacagcagctgtttaatttgc

SEQ ID NO: 9227386 - DNA, 22 bp, Homo sapiens
aaacagcaatggagaagccagg

SEQ ID NO: 9227387 - DNA, 22 bp, Homo sapiens
aaacagcaatggagaagccagg

SEQ ID NO: 9227388 - DNA, 22 bp, Homo sapiens
aaacagcaatggagaagccagg

SEQ ID NO: 9227389 - DNA, 22 bp, Homo sapiens
aaactgtatagggaaaagtaga

SEQ ID NO: 9227390 - DNA, 22 bp, Homo sapiens
aaactgtatatttatggcatgt

SEQ ID NO: 9227391 - DNA, 22 bp, Homo sapiens
aaactgtcacctaatgtatttt

SEQ ID NO: 9227392 - DNA, 22 bp, Homo sapiens
aaactgtaagagaataaactac

SEQ ID NO: 9227393 - DNA, 22 bp, Homo sapiens
aaactgtaagagaataaactac

SEQ ID NO: 9227394 - DNA, 22 bp, Homo sapiens
aaactgtaagagaataaactac

SEQ ID NO: 9227395 - DNA, 22 bp, Homo sapiens
aaactgtaagagaataaactac

SEQ ID NO: 9227396 - DNA, 22 bp, Homo sapiens
aaactgtagtgcttcgatctga

SEQ ID NO: 9227397 - DNA, 22 bp, Homo sapiens
aaacattccctaatgtgtccgt

SEQ ID NO: 9227398 - DNA, 22 bp, Homo sapiens
aaacattgagcacttgctattt

SEQ ID NO: 9227399 - DNA, 22 bp, Homo sapiens
aaacattgagcacttgctattt

SEQ ID NO: 9227400 - DNA, 22 bp, Homo sapiens
aaacattgatgggaagtttaat

SEQ ID NO: 9227401 - DNA, 22 bp, Homo sapiens
aaacattgatgggaagtttaat

SEQ ID NO: 9227402 - DNA, 22 bp, Homo sapiens
aaacattgtaattttagcatgg

SEQ ID NO: 9227403 - DNA, 22 bp, Homo sapiens
aaacattgctaaataatgctgc

SEQ ID NO: 9227404 - DNA, 22 bp, Homo sapiens
aaacatgtaagttcagatcacc

SEQ ID NO: 9227405 - DNA, 22 bp, Homo sapiens
aaacatgtaattctgcttaaga

SEQ ID NO: 9227406 - DNA, 22 bp, Homo sapiens
aaacatgctggatttagaatat

SEQ ID NO: 9227407 - DNA, 22 bp, Homo sapiens
aaacatgctggatttagaatat

SEQ ID NO: 9227408 - DNA, 22 bp, Homo sapiens
aaacatgatgtcatatatgcca

SEQ ID NO: 9227409 - DNA, 22 bp, Homo sapiens
aaacatgatgtcatatatgcca

SEQ ID NO: 9227410 - DNA, 22 bp, Homo sapiens
aaacatgcattcaagaaaatct

SEQ ID NO: 9227411 - DNA, 22 bp, Homo sapiens
aaacattagacaccatatgctc

SEQ ID NO: 9227412 - DNA, 20 bp, Homo sapiens
aaacattcatgtacaagtga

SEQ ID NO: 9227413 - DNA, 22 bp, Homo sapiens
aaacattccatttctatgtaag

SEQ ID NO: 9227414 - DNA, 22 bp, Homo sapiens
aaacattccatttctatgtaag

SEQ ID NO: 9227415 - DNA, 22 bp, Homo sapiens
aaagatcagtctgaagcaacat

SEQ ID NO: 9227416 - DNA, 22 bp, Homo sapiens
aaagatcagaggatagctgagt

SEQ ID NO: 9227417 - DNA, 22 bp, Homo sapiens
aaagagcaagctgagatttgaa

SEQ ID NO: 9227418 - DNA, 22 bp, Homo sapiens
aaagagatgtgccaaatagcct

SEQ ID NO: 9227419 - DNA, 22 bp, Homo sapiens
aaagagacaccaaagactctag

SEQ ID NO: 9227420 - DNA, 20 bp, Homo sapiens
aaagagaagcctcaccttgt

SEQ ID NO: 9227421 - DNA, 20 bp, Homo sapiens
aaagagaagcctcaccttgt

SEQ ID NO: 9227422 - DNA, 21 bp, Homo sapiens
aaagagacaaatggcatatac

SEQ ID NO: 9227423 - DNA, 22 bp, Homo sapiens
aaagagaaaatgatctgtacat

SEQ ID NO: 9227424 - DNA, 22 bp, Homo sapiens
aaagagaaacttagaagcctga

SEQ ID NO: 9227425 - DNA, 22 bp, Homo sapiens
aaagactttcacctagcaaaga

SEQ ID NO: 9227426 - DNA, 22 bp, Homo sapiens
aaagactttcacctagcaaaga

SEQ ID NO: 9227427 - DNA, 22 bp, Homo sapiens
aaagacttgggagcagtatgct

SEQ ID NO: 9227428 - DNA, 22 bp, Homo sapiens
aaagaacaatgtggaatctcct

SEQ ID NO: 9227429 - DNA, 22 bp, Homo sapiens
aaagaacaatgtggaatctcct

SEQ ID NO: 9227430 - DNA, 23 bp, Homo sapiens
aaagactgaggaaagtctctgtc

SEQ ID NO: 9227431 - DNA, 22 bp, Homo sapiens
aaagactaagaagagtattatt

SEQ ID NO: 9227432 - DNA, 22 bp, Homo sapiens
aaagactacacgggaaagagct

SEQ ID NO: 9227433 - DNA, 22 bp, Homo sapiens
aaagacatgacacattggagag

SEQ ID NO: 9227434 - DNA, 22 bp, Homo sapiens
aaagacatgacacattggagag

SEQ ID NO: 9227435 - DNA, 22 bp, Homo sapiens
aaagactaagaagagtattatt

SEQ ID NO: 9227436 - DNA, 20 bp, Homo sapiens
aaactgtctgtcagtatcta

SEQ ID NO: 9227437 - DNA, 22 bp, Homo sapiens
aaactgtgaagcaagtacaagg

SEQ ID NO: 9227438 - DNA, 22 bp, Homo sapiens
aaactgtgaagcaagtacaagg

SEQ ID NO: 9227439 - DNA, 22 bp, Homo sapiens
aaatagttcagcttgtaaaccc

SEQ ID NO: 9227440 - DNA, 22 bp, Homo sapiens
aaatagttagccctgcatatat

SEQ ID NO: 9227441 - DNA, 22 bp, Homo sapiens
aaatagttcagccacggtgact

SEQ ID NO: 9227442 - DNA, 22 bp, Homo sapiens
aaacttttcctgctcttgtcct

SEQ ID NO: 9227443 - DNA, 22 bp, Homo sapiens
aaagaaatacctttctcagctt

SEQ ID NO: 9227444 - DNA, 22 bp, Homo sapiens
aaagaaatacctttctcagctt

SEQ ID NO: 9227445 - DNA, 22 bp, Homo sapiens
aaagaaatagatggcatttaaa

SEQ ID NO: 9227446 - DNA, 21 bp, Homo sapiens
aaagaaatctcccattggtag

SEQ ID NO: 9227447 - DNA, 22 bp, Homo sapiens
aaagaacaaattagctgtttta

SEQ ID NO: 9227448 - DNA, 22 bp, Homo sapiens
aaagaaacctatcagccacatg

SEQ ID NO: 9227449 - DNA, 22 bp, Homo sapiens
aaagaaacctatcagccacatg

SEQ ID NO: 9227450 - DNA, 22 bp, Homo sapiens
aaactttttcttaggtatgtct

SEQ ID NO: 9227451 - DNA, 22 bp, Homo sapiens
aaacttttttaggttcataggc

SEQ ID NO: 9227452 - DNA, 22 bp, Homo sapiens
aaacttttttaggttcataggc

SEQ ID NO: 9227453 - DNA, 22 bp, Homo sapiens
aaactttttattctaatgtcta

SEQ ID NO: 9227454 - DNA, 22 bp, Homo sapiens
aaaaggtagttgccaaataagg

SEQ ID NO: 9227455 - DNA, 22 bp, Homo sapiens
aaaaggtagttgccaaataagg

SEQ ID NO: 9227456 - DNA, 22 bp, Homo sapiens
aaaaggaggacatggttacaga

SEQ ID NO: 9227457 - DNA, 22 bp, Homo sapiens
aaaagggactactctcagctcc

SEQ ID NO: 9227458 - DNA, 22 bp, Homo sapiens
aaaagtaattgcaattttgtag

SEQ ID NO: 9227459 - DNA, 22 bp, Homo sapiens
aaaagtaattgcaattttgtag

SEQ ID NO: 9227460 - DNA, 22 bp, Homo sapiens
aaaagtaattgatgcaatcgta

SEQ ID NO: 9227461 - DNA, 22 bp, Homo sapiens
aaaaggttttgagtacaaatat

SEQ ID NO: 9227462 - DNA, 22 bp, Homo sapiens
aaacagcttgtttcaggaaagt

SEQ ID NO: 9227463 - DNA, 22 bp, Homo sapiens
aaacagctttcagaatctctca

SEQ ID NO: 9227464 - DNA, 22 bp, Homo sapiens
aaacagctttcagaatctctca

SEQ ID NO: 9227465 - DNA, 22 bp, Homo sapiens
aaaagtaattgtggttttggcc

SEQ ID NO: 9227466 - DNA, 22 bp, Homo sapiens
aaaagtaattgcagttttgcca

SEQ ID NO: 9227467 - DNA, 22 bp, Homo sapiens
aaaagtaattgcaattttgtag

SEQ ID NO: 9227468 - DNA, 22 bp, Homo sapiens
aaaagtaattgcagttttgtca

SEQ ID NO: 9227469 - DNA, 22 bp, Homo sapiens
aaaactttcagggatacagaaa

SEQ ID NO: 9227470 - DNA, 22 bp, Homo sapiens
aaaactttcagggatacagaaa

SEQ ID NO: 9227471 - DNA, 22 bp, Homo sapiens
aaaactgtatcttcttgggact

SEQ ID NO: 9227472 - DNA, 22 bp, Homo sapiens
aaaactgaggtttcctgaagaa

SEQ ID NO: 9227473 - DNA, 22 bp, Homo sapiens
aaaactgaaccttgagatcttt

SEQ ID NO: 9227474 - DNA, 22 bp, Homo sapiens
aaaactgaaccttgagatcttt

SEQ ID NO: 9227475 - DNA, 22 bp, Homo sapiens
aaaattatagatctagtgcctg

SEQ ID NO: 9227476 - DNA, 22 bp, Homo sapiens
aaaattcatggcttgggaaaag

SEQ ID NO: 9227477 - DNA, 22 bp, Homo sapiens
aaaattcatggcttgggaaaag

SEQ ID NO: 9227478 - DNA, 22 bp, Homo sapiens
aaaattcatagaactgtacgct

SEQ ID NO: 9227479 - DNA, 22 bp, Homo sapiens
aaaaggcatggaggttgatagt

SEQ ID NO: 9227480 - DNA, 22 bp, Homo sapiens
aaaacagtttttgctaactgct

SEQ ID NO: 9227481 - DNA, 22 bp, Homo sapiens
aaaaggcagtgcaagagagggt

SEQ ID NO: 9227482 - DNA, 22 bp, Homo sapiens
aaaactctgcagttagtttcta

SEQ ID NO: 9227483 - DNA, 22 bp, Homo sapiens
aaaaccaggcttgctgtgctcg

SEQ ID NO: 9227484 - DNA, 22 bp, Homo sapiens
aaaacataaactgacagcccat

SEQ ID NO: 9227485 - DNA, 22 bp, Homo sapiens
aaaaagatgtcctgaagtttag

SEQ ID NO: 9227486 - DNA, 22 bp, Homo sapiens
aaaaagtcatattcttgttcct

SEQ ID NO: 9227487 - DNA, 22 bp, Homo sapiens
aaaaagtattggccatggttga

SEQ ID NO: 9227488 - DNA, 22 bp, Homo sapiens
aaaaagtctgcaaaggaggttg

SEQ ID NO: 9227489 - DNA, 22 bp, Homo sapiens
aaaaggaggcaaacagcctaga

SEQ ID NO: 9227490 - DNA, 22 bp, Homo sapiens
aaaaggaggtcactttattcct

SEQ ID NO: 9227491 - DNA, 22 bp, Homo sapiens
aaacacatcattcatgtcgtca

SEQ ID NO: 9227492 - DNA, 22 bp, Homo sapiens
aaacacaagaggcagggtacag

SEQ ID NO: 9227493 - DNA, 22 bp, Homo sapiens
aaagagcttgcttgctttatat

SEQ ID NO: 9227494 - DNA, 22 bp, Homo sapiens
aaagagctcacagtccactgga

SEQ ID NO: 9227495 - DNA, 22 bp, Homo sapiens
aaagagctcttactctagtgta

SEQ ID NO: 9227496 - DNA, 22 bp, Homo sapiens
aaagagctggcatttatagtct

SEQ ID NO: 9227497 - DNA, 22 bp, Homo sapiens
aaacactcatgtgttactctcc

SEQ ID NO: 9227498 - DNA, 22 bp, Homo sapiens
aaacactaataacagtggctgg

SEQ ID NO: 9227499 - DNA, 22 bp, Homo sapiens
aaacacattagccctgtggaaa

SEQ ID NO: 9227500 - DNA, 22 bp, Homo sapiens
aaaattgaggctcatgttaaat

SEQ ID NO: 9227501 - DNA, 19 bp, Homo sapiens
aaaattgcgtattttgagg

SEQ ID NO: 9227502 - DNA, 22 bp, Homo sapiens
aaaattgaggccagtatgccat

SEQ ID NO: 9227503 - DNA, 22 bp, Homo sapiens
aaaattgagagttatagatggt

SEQ ID NO: 9227504 - DNA, 22 bp, Homo sapiens
aaaattgagagtcttgtgcaag

SEQ ID NO: 9227505 - DNA, 22 bp, Homo sapiens
aaaattgagagtcttgtgcaag

SEQ ID NO: 9227506 - DNA, 22 bp, Homo sapiens
aaaattggttcctttctgaggc

SEQ ID NO: 9227507 - DNA, 22 bp, Homo sapiens
aaagagcatggaaagttcagga

SEQ ID NO: 9227508 - DNA, 22 bp, Homo sapiens
aaagagctaacattgccgagat

SEQ ID NO: 9227509 - DNA, 22 bp, Homo sapiens
aaaattctgtcattaaattgtg

SEQ ID NO: 9227510 - DNA, 22 bp, Homo sapiens
aaaattgaagtgatcaggaact

SEQ ID NO: 9227511 - DNA, 22 bp, Homo sapiens
aaaattcattcctcagactgcc

SEQ ID NO: 9227512 - DNA, 22 bp, Homo sapiens
aaaattctcttgatcttgacag

SEQ ID NO: 9227513 - DNA, 22 bp, Homo sapiens
aaaattctcttgatcttgacag

SEQ ID NO: 9227514 - DNA, 22 bp, Homo sapiens
aaacagtattatcaatatattt

SEQ ID NO: 9227515 - DNA, 22 bp, Homo sapiens
aaacagtagaagtgtattttat

SEQ ID NO: 9227516 - DNA, 22 bp, Homo sapiens
aaacagtactcgatttttgtag

SEQ ID NO: 9227517 - DNA, 22 bp, Homo sapiens
aaacagtaagttctagtattat

SEQ ID NO: 9227518 - DNA, 22 bp, Homo sapiens
aaacaggcttatattttgctct

SEQ ID NO: 9227519 - DNA, 22 bp, Homo sapiens
aaacaggcacatagtaacattt

SEQ ID NO: 9227520 - DNA, 20 bp, Homo sapiens
aaaatatgtataactcttct

SEQ ID NO: 9227521 - DNA, 22 bp, Homo sapiens
aaaatatggggtgagcccagag

SEQ ID NO: 9227522 - DNA, 20 bp, Homo sapiens
aaaatatgtataactcttct

SEQ ID NO: 9227523 - DNA, 22 bp, Homo sapiens
aaaatactgtggagtgttgaaa

SEQ ID NO: 9227524 - DNA, 22 bp, Homo sapiens
aaacagtattatcaatatattt

SEQ ID NO: 9227525 - DNA, 22 bp, Homo sapiens
aaaatattttagggccaggaga

SEQ ID NO: 9227526 - DNA, 22 bp, Homo sapiens
aaaatattttagggccaggaga

SEQ ID NO: 9227527 - DNA, 22 bp, Homo sapiens
aaaatattttagggccaggaga

SEQ ID NO: 9227528 - DNA, 22 bp, Homo sapiens
aaaatattttagggccaggaga

SEQ ID NO: 9227529 - DNA, 22 bp, Homo sapiens
aaaatattttagggccaggaga

SEQ ID NO: 9227530 - DNA, 22 bp, Homo sapiens
aaaatatgtataactcttctgc

SEQ ID NO: 9227531 - DNA, 22 bp, Homo sapiens
aaaatatgtataactcttctgc

SEQ ID NO: 9227532 - DNA, 22 bp, Homo sapiens
aaactgcagccttgagttcagg

SEQ ID NO: 9227533 - DNA, 17 bp, Homo sapiens
aaactggggtcaggagc

SEQ ID NO: 9227534 - DNA, 22 bp, Homo sapiens
aaactgggattcttcacaaggt

SEQ ID NO: 9227535 - DNA, 22 bp, Homo sapiens
aaactggtaatcggcaagtgag

SEQ ID NO: 9227536 - DNA, 22 bp, Homo sapiens
aaactgggttgtggtcagtggt

SEQ ID NO: 9227537 - DNA, 19 bp, Homo sapiens
aaagcagaggagcatctga

SEQ ID NO: 9227538 - DNA, 22 bp, Homo sapiens
aaagcagaggtgatatgactta

SEQ ID NO: 9227539 - DNA, 22 bp, Homo sapiens
aaagcagagcagggcacttatg

SEQ ID NO: 9227540 - DNA, 22 bp, Homo sapiens
aaagcactttgagactgacagg

SEQ ID NO: 9227541 - DNA, 22 bp, Homo sapiens
aaagcacttcaggagcagtttg

SEQ ID NO: 9227542 - DNA, 22 bp, Homo sapiens
aacatacagtgagcagtggact

SEQ ID NO: 9227543 - DNA, 22 bp, Homo sapiens
aacatacagtgagcagtggact

SEQ ID NO: 9227544 - DNA, 22 bp, Homo sapiens
aacatacatatttcagtgtcca

SEQ ID NO: 9227545 - DNA, 22 bp, Homo sapiens
aacataatgtggccaaagtcac

SEQ ID NO: 9227546 - DNA, 22 bp, Homo sapiens
aacataatgtggccaaagtcac

SEQ ID NO: 9227547 - DNA, 22 bp, Homo sapiens
aacatacttatactaaataatg

SEQ ID NO: 9227548 - DNA, 22 bp, Homo sapiens
aacatagaagatggttaattgt

SEQ ID NO: 9227549 - DNA, 22 bp, Homo sapiens
aacatagaattgttatattttc

SEQ ID NO: 9227550 - DNA, 22 bp, Homo sapiens
aacatagaatggctccagagct

SEQ ID NO: 9227551 - DNA, 22 bp, Homo sapiens
aaagcctcccaggttatgagta

SEQ ID NO: 9227552 - DNA, 22 bp, Homo sapiens
aaagccattacaaaatttcata

SEQ ID NO: 9227553 - DNA, 22 bp, Homo sapiens
aacatagaattgttatattttc

SEQ ID NO: 9227554 - DNA, 22 bp, Homo sapiens
aacatagaattgttatattttc

SEQ ID NO: 9227555 - DNA, 22 bp, Homo sapiens
aacatagctttactcaaatgac

SEQ ID NO: 9227556 - DNA, 22 bp, Homo sapiens
aacatataaactcttaagttca

SEQ ID NO: 9227557 - DNA, 22 bp, Homo sapiens
aaagcaaacagaaccccaagct

SEQ ID NO: 9227558 - DNA, 23 bp, Homo sapiens
aaagcaaggaattggcaacagag

SEQ ID NO: 9227559 - DNA, 23 bp, Homo sapiens
aaagcaaggaattggcaacagag

SEQ ID NO: 9227560 - DNA, 22 bp, Homo sapiens
aacacattttgcctaggcaata

SEQ ID NO: 9227561 - DNA, 22 bp, Homo sapiens
aacactgtatcagtcttcaata

SEQ ID NO: 9227562 - DNA, 22 bp, Homo sapiens
aacactgtcttatacttcaatg

SEQ ID NO: 9227563 - DNA, 22 bp, Homo sapiens
aacactgtcttatacttcaatg

SEQ ID NO: 9227564 - DNA, 22 bp, Homo sapiens
aacactgtcttatacttcaatg

SEQ ID NO: 9227565 - DNA, 22 bp, Homo sapiens
aacactgtcagcctttgatgga

SEQ ID NO: 9227566 - DNA, 22 bp, Homo sapiens
aacactgtggtcttttcagtaa

SEQ ID NO: 9227567 - DNA, 22 bp, Homo sapiens
aacactgtgcccaccctagtcc

SEQ ID NO: 9227568 - DNA, 22 bp, Homo sapiens
aacactgtgcccaccctagtcc

SEQ ID NO: 9227569 - DNA, 22 bp, Homo sapiens
aacactgtgcagtgtaatgctg

SEQ ID NO: 9227570 - DNA, 22 bp, Homo sapiens
aacactgtgaggtaatgaccta

SEQ ID NO: 9227571 - DNA, 20 bp, Homo sapiens
aacactgtgcgtggtaggtg

SEQ ID NO: 9227572 - DNA, 22 bp, Homo sapiens
aacactgtgctccccaggctgt

SEQ ID NO: 9227573 - DNA, 22 bp, Homo sapiens
aacactgtggtcttttcagtaa

SEQ ID NO: 9227574 - DNA, 21 bp, Homo sapiens
aaagatgtttcttttcctcac

SEQ ID NO: 9227575 - DNA, 22 bp, Homo sapiens
aaagattaaatcaaattggtca

SEQ ID NO: 9227576 - DNA, 22 bp, Homo sapiens
aaagattagataagatagattt

SEQ ID NO: 9227577 - DNA, 22 bp, Homo sapiens
aaagatttgaaattaggcatca

SEQ ID NO: 9227578 - DNA, 22 bp, Homo sapiens
aaagatttcagaagcctgtgcc

SEQ ID NO: 9227579 - DNA, 22 bp, Homo sapiens
aaagattatggcattgaaatac

SEQ ID NO: 9227580 - DNA, 22 bp, Homo sapiens
aaagatttaagaataatttgtg

SEQ ID NO: 9227581 - DNA, 22 bp, Homo sapiens
aagaacatgaagtcacaaatgc

SEQ ID NO: 9227582 - DNA, 22 bp, Homo sapiens
aagaacatgaagtcacaaatgc

SEQ ID NO: 9227583 - DNA, 22 bp, Homo sapiens
aagaacatgagttatgatgatt

SEQ ID NO: 9227584 - DNA, 22 bp, Homo sapiens
aagaacatgaacctcttctaac

SEQ ID NO: 9227585 - DNA, 22 bp, Homo sapiens
aagaacatgaacctcttctaac

SEQ ID NO: 9227586 - DNA, 22 bp, Homo sapiens
aagaacatgaacctcttctaac

SEQ ID NO: 9227587 - DNA, 22 bp, Homo sapiens
aagaacatgaacacaatgttta

SEQ ID NO: 9227588 - DNA, 22 bp, Homo sapiens
aagaacatgaacacaatgttta

SEQ ID NO: 9227589 - DNA, 22 bp, Homo sapiens
aagaacatgaacacaatgttta

SEQ ID NO: 9227590 - DNA, 22 bp, Homo sapiens
aagaacataacagaagctgtgt

SEQ ID NO: 9227591 - DNA, 22 bp, Homo sapiens
aagaacataacagaagctgtgt

SEQ ID NO: 9227592 - DNA, 22 bp, Homo sapiens
aagaacataaacagaaggacag

SEQ ID NO: 9227593 - DNA, 22 bp, Homo sapiens
aagaacagttgggaggtgagcc

SEQ ID NO: 9227594 - DNA, 22 bp, Homo sapiens
aagaacagttgggaggtgagcc

SEQ ID NO: 9227595 - DNA, 22 bp, Homo sapiens
aaagtaaagattgggaatgtgt

SEQ ID NO: 9227596 - DNA, 22 bp, Homo sapiens
aaaggtttttcagcagggagat

SEQ ID NO: 9227597 - DNA, 22 bp, Homo sapiens
aaaggtttttatttatcctgga

SEQ ID NO: 9227598 - DNA, 22 bp, Homo sapiens
aaaggttttgttcatcgatttt

SEQ ID NO: 9227599 - DNA, 22 bp, Homo sapiens
aaagtaagaccaagtgatcatt

SEQ ID NO: 9227600 - DNA, 22 bp, Homo sapiens
aaagtaagatttgcatttcaga

SEQ ID NO: 9227601 - DNA, 22 bp, Homo sapiens
aagaaataagacttctctgtcc

SEQ ID NO: 9227602 - DNA, 22 bp, Homo sapiens
aagaaataagacttctctgtcc

SEQ ID NO: 9227603 - DNA, 22 bp, Homo sapiens
aactgtaatttttacatagtaa

SEQ ID NO: 9227604 - DNA, 22 bp, Homo sapiens
aactgtaagaaataaaattctg

SEQ ID NO: 9227605 - DNA, 22 bp, Homo sapiens
aactgtaagagaataaatgtgt

SEQ ID NO: 9227606 - DNA, 22 bp, Homo sapiens
aactgtaagagaataaatgtgt

SEQ ID NO: 9227607 - DNA, 22 bp, Homo sapiens
aactgtctaaggagaatatgaa

SEQ ID NO: 9227608 - DNA, 22 bp, Homo sapiens
aactgtatacaattgtcagaca

SEQ ID NO: 9227609 - DNA, 23 bp, Homo sapiens
aactgtcttgcaagtgtgatacc

SEQ ID NO: 9227610 - DNA, 22 bp, Homo sapiens
aactgtgtccttagctctcact

SEQ ID NO: 9227611 - DNA, 22 bp, Homo sapiens
aaaggttttctagggttgaggg

SEQ ID NO: 9227612 - DNA, 22 bp, Homo sapiens
aaaggttttgccctgggtattc

SEQ ID NO: 9227613 - DNA, 22 bp, Homo sapiens
aaaggttttctgacccttagta

SEQ ID NO: 9227614 - DNA, 22 bp, Homo sapiens
aaaggttttggtaaggctttaa

SEQ ID NO: 9227615 - DNA, 22 bp, Homo sapiens
aaagcctcccaggttatgagta

SEQ ID NO: 9227616 - DNA, 22 bp, Homo sapiens
aaagccttggtcatctggttcc

SEQ ID NO: 9227617 - DNA, 22 bp, Homo sapiens
aacccaggagttggaggctgtg

SEQ ID NO: 9227618 - DNA, 22 bp, Homo sapiens
aacccaggaggcagaggctgca

SEQ ID NO: 9227619 - DNA, 22 bp, Homo sapiens
aacccagggtggaggttgcagt

SEQ ID NO: 9227620 - DNA, 22 bp, Homo sapiens
aacccagggtgaggggagtcta

SEQ ID NO: 9227621 - DNA, 22 bp, Homo sapiens
aacccatgttggaagcttatca

SEQ ID NO: 9227622 - DNA, 22 bp, Homo sapiens
aacccaggagacaggttgcagt

SEQ ID NO: 9227623 - DNA, 22 bp, Homo sapiens
aacccagccgtgtagctgccgc

SEQ ID NO: 9227624 - DNA, 22 bp, Homo sapiens
aaaggcagagttgttggaggca

SEQ ID NO: 9227625 - DNA, 22 bp, Homo sapiens
aaaggcagtgggtatgtggatc

SEQ ID NO: 9227626 - DNA, 22 bp, Homo sapiens
aaaggcagtgggtatgtggatc

SEQ ID NO: 9227627 - DNA, 20 bp, Homo sapiens
aaagtgcacagatacagctc

SEQ ID NO: 9227628 - DNA, 22 bp, Homo sapiens
aaagtgatttaagtacctcagg

SEQ ID NO: 9227629 - DNA, 22 bp, Homo sapiens
aagacagagggaagcaatgatg

SEQ ID NO: 9227630 - DNA, 22 bp, Homo sapiens
aagacagagggaagcaatgatg

SEQ ID NO: 9227631 - DNA, 22 bp, Homo sapiens
aagacagagggaagcaatgatg

SEQ ID NO: 9227632 - DNA, 22 bp, Homo sapiens
aaagtgcactctcagtgctgct

SEQ ID NO: 9227633 - DNA, 22 bp, Homo sapiens
aagaacatgatggccatgtgca

SEQ ID NO: 9227634 - DNA, 22 bp, Homo sapiens
aagaacatgctataattatctt

SEQ ID NO: 9227635 - DNA, 22 bp, Homo sapiens
aagaacatgctataattatctt

SEQ ID NO: 9227636 - DNA, 22 bp, Homo sapiens
aagactctatctttagagatca

SEQ ID NO: 9227637 - DNA, 22 bp, Homo sapiens
aaagttgtttcctaaggtctaa

SEQ ID NO: 9227638 - DNA, 22 bp, Homo sapiens
aaagttgttgttcacaggttat

SEQ ID NO: 9227639 - DNA, 22 bp, Homo sapiens
aaagtttacagtgcacatgggt

SEQ ID NO: 9227640 - DNA, 22 bp, Homo sapiens
aagactagaccagtgaatagga

SEQ ID NO: 9227641 - DNA, 22 bp, Homo sapiens
aagactaaatgtgttctaaagt

SEQ ID NO: 9227642 - DNA, 22 bp, Homo sapiens
aagacctctgaagtacctggtg

SEQ ID NO: 9227643 - DNA, 22 bp, Homo sapiens
aagaggtaatgactgcttgagt

SEQ ID NO: 9227644 - DNA, 22 bp, Homo sapiens
aagaggtaaccatagcaaccac

SEQ ID NO: 9227645 - DNA, 22 bp, Homo sapiens
aagaggggtgtgtgtcaaccca

SEQ ID NO: 9227646 - DNA, 22 bp, Homo sapiens
aagaggggtggtctgtgaggat

SEQ ID NO: 9227647 - DNA, 22 bp, Homo sapiens
aagaggggtggtctgtgaggat

SEQ ID NO: 9227648 - DNA, 22 bp, Homo sapiens
aaatacatttacagtcgtggct

SEQ ID NO: 9227649 - DNA, 22 bp, Homo sapiens
aaatactgctgctattcctttt

SEQ ID NO: 9227650 - DNA, 22 bp, Homo sapiens
aaatactggcaagtgctaattc

SEQ ID NO: 9227651 - DNA, 22 bp, Homo sapiens
aaatactggcaagtgctaattc

SEQ ID NO: 9227652 - DNA, 22 bp, Homo sapiens
aaatactgggctcaaaagggtt

SEQ ID NO: 9227653 - DNA, 22 bp, Homo sapiens
aagataaactcttgatttctga

SEQ ID NO: 9227654 - DNA, 22 bp, Homo sapiens
aagataaactcttgatttctga

SEQ ID NO: 9227655 - DNA, 22 bp, Homo sapiens
aagataaactcttgatttctga

SEQ ID NO: 9227656 - DNA, 22 bp, Homo sapiens
aaagtttcccaaagtaatgtga

SEQ ID NO: 9227657 - DNA, 22 bp, Homo sapiens
aaagtttgaatgatatattagt

SEQ ID NO: 9227658 - DNA, 23 bp, Homo sapiens
aaagtttgaagcaacagtagttg

SEQ ID NO: 9227659 - DNA, 22 bp, Homo sapiens
aaagtttgttatatgataagga

SEQ ID NO: 9227660 - DNA, 22 bp, Homo sapiens
aaagtttggattagcagttaga

SEQ ID NO: 9227661 - DNA, 22 bp, Homo sapiens
aaagtttgtcacttggctagaa

SEQ ID NO: 9227662 - DNA, 22 bp, Homo sapiens
aaagttttagctgtccagttcc

SEQ ID NO: 9227663 - DNA, 22 bp, Homo sapiens
aaagttttagaactaggaagca

SEQ ID NO: 9227664 - DNA, 22 bp, Homo sapiens
aagagggctgcaatcttattgc

SEQ ID NO: 9227665 - DNA, 22 bp, Homo sapiens
aagagggctcgatttggcaaaa

SEQ ID NO: 9227666 - DNA, 22 bp, Homo sapiens
aagagggaggtgcgggtgcaga

SEQ ID NO: 9227667 - DNA, 22 bp, Homo sapiens
aagagggaggtgcgggtgcaga

SEQ ID NO: 9227668 - DNA, 22 bp, Homo sapiens
aagagggaggtgcgggtgcaga

SEQ ID NO: 9227669 - DNA, 22 bp, Homo sapiens
aagaggaggatgctttacagct

SEQ ID NO: 9227670 - DNA, 22 bp, Homo sapiens
aagcaggcatcttggaggtcaa

SEQ ID NO: 9227671 - DNA, 22 bp, Homo sapiens
aagattcagccaaattgttcat

SEQ ID NO: 9227672 - DNA, 22 bp, Homo sapiens
aagattcagttgatgtgttcca

SEQ ID NO: 9227673 - DNA, 22 bp, Homo sapiens
aagattcacagagtgaatgaaa

SEQ ID NO: 9227674 - DNA, 22 bp, Homo sapiens
aagattatggcagataacaatt

SEQ ID NO: 9227675 - DNA, 22 bp, Homo sapiens
aagcagcatatgacagcatcca

SEQ ID NO: 9227676 - DNA, 22 bp, Homo sapiens
aagattctcactgctcaacttt

SEQ ID NO: 9227677 - DNA, 22 bp, Homo sapiens
aagattctacaaactctggtaa

SEQ ID NO: 9227678 - DNA, 20 bp, Homo sapiens
aagattcattgtaattaggg

SEQ ID NO: 9227679 - DNA, 22 bp, Homo sapiens
aagattctagaggaacttctta

SEQ ID NO: 9227680 - DNA, 22 bp, Homo sapiens
aagattctacagtaggtacatt

SEQ ID NO: 9227681 - DNA, 22 bp, Homo sapiens
aagatcctgcttttgcttctgt

SEQ ID NO: 9227682 - DNA, 22 bp, Homo sapiens
aagatgttgcattagaatacct

SEQ ID NO: 9227683 - DNA, 22 bp, Homo sapiens
aagatccatgggaatgtttggc

SEQ ID NO: 9227684 - DNA, 21 bp, Homo sapiens
aagatccaagcaggcacttgt

SEQ ID NO: 9227685 - DNA, 22 bp, Homo sapiens
aagatccaggcaaaagttggaa

SEQ ID NO: 9227686 - DNA, 22 bp, Homo sapiens
aagattaaaggggagacaagct

SEQ ID NO: 9227687 - DNA, 22 bp, Homo sapiens
aagattaaaggggagacaagct

SEQ ID NO: 9227688 - DNA, 14 bp, Homo sapiens
aagatcaccttcct

SEQ ID NO: 9227689 - DNA, 22 bp, Homo sapiens
aagatcagaactttatacagga

SEQ ID NO: 9227690 - DNA, 22 bp, Homo sapiens
aagatattcaaagatttattag

SEQ ID NO: 9227691 - DNA, 22 bp, Homo sapiens
aagatattcaaagatttattag

SEQ ID NO: 9227692 - DNA, 22 bp, Homo sapiens
aagatattttagaacattcact

SEQ ID NO: 9227693 - DNA, 22 bp, Homo sapiens
aagccgggcctgagaaatgaca

SEQ ID NO: 9227694 - DNA, 22 bp, Homo sapiens
aagcccttggcgcacaccgggc

SEQ ID NO: 9227695 - DNA, 22 bp, Homo sapiens
aagcccttttcaagatacaaca

SEQ ID NO: 9227696 - DNA, 22 bp, Homo sapiens
aagccttaaatgtttctaatat

SEQ ID NO: 9227697 - DNA, 22 bp, Homo sapiens
aaatgcatgtagaataatagag

SEQ ID NO: 9227698 - DNA, 22 bp, Homo sapiens
aagccttatggggacagttttg

SEQ ID NO: 9227699 - DNA, 22 bp, Homo sapiens
aaatctgtaagcaattgctcag

SEQ ID NO: 9227700 - DNA, 22 bp, Homo sapiens
aaatctgagaaatattgtccag

SEQ ID NO: 9227701 - DNA, 22 bp, Homo sapiens
aaatctctgaacttaataatgc

SEQ ID NO: 9227702 - DNA, 22 bp, Homo sapiens
aaatctgtttctcatagggtag

SEQ ID NO: 9227703 - DNA, 22 bp, Homo sapiens
aagcccagatgggagcatttca

SEQ ID NO: 9227704 - DNA, 22 bp, Homo sapiens
aaatctcagcccttattttaga

SEQ ID NO: 9227705 - DNA, 22 bp, Homo sapiens
aaatctcagcccttattttaga

SEQ ID NO: 9227706 - DNA, 22 bp, Homo sapiens
aaatctcactgtagtcaaagtg

SEQ ID NO: 9227707 - DNA, 22 bp, Homo sapiens
aaatctctgaacttaataatgc

SEQ ID NO: 9227708 - DNA, 22 bp, Homo sapiens
aaatctcaggcctctatttact

SEQ ID NO: 9227709 - DNA, 22 bp, Homo sapiens
aagcaggcattccagagacaat

SEQ ID NO: 9227710 - DNA, 22 bp, Homo sapiens
aaatctcaatttgaattgtagc

SEQ ID NO: 9227711 - DNA, 22 bp, Homo sapiens
aagcaggcgagggcctggagca

SEQ ID NO: 9227712 - DNA, 22 bp, Homo sapiens
aatggcttctgaagcacacttt

SEQ ID NO: 9227713 - DNA, 21 bp, Homo sapiens
aatggcttatacagaagtaag

SEQ ID NO: 9227714 - DNA, 22 bp, Homo sapiens
aatggcttatgtaatgctgttt

SEQ ID NO: 9227715 - DNA, 22 bp, Homo sapiens
aatggctttcagcaaggataga

SEQ ID NO: 9227716 - DNA, 22 bp, Homo sapiens
aatggcttctttttggtataat

SEQ ID NO: 9227717 - DNA, 22 bp, Homo sapiens
aatggcttaccctggattgtgt

SEQ ID NO: 9227718 - DNA, 21 bp, Homo sapiens
aatggctgggcaaggtctctc

SEQ ID NO: 9227719 - DNA, 22 bp, Homo sapiens
aatggctgccagggcaggaggt

SEQ ID NO: 9227720 - DNA, 22 bp, Homo sapiens
aatggctgccagggcaggaggt

SEQ ID NO: 9227721 - DNA, 22 bp, Homo sapiens
aatgctttcaaaaatgtgcagt

SEQ ID NO: 9227722 - DNA, 22 bp, Homo sapiens
aactagtttagctttttaagac

SEQ ID NO: 9227723 - DNA, 22 bp, Homo sapiens
aatgctttcttataaccactgc

SEQ ID NO: 9227724 - DNA, 22 bp, Homo sapiens
aactagtcagtgattctcagaa

SEQ ID NO: 9227725 - DNA, 22 bp, Homo sapiens
aactagagcttccagcttcttg

SEQ ID NO: 9227726 - DNA, 22 bp, Homo sapiens
aactagaacgagaaagctgaac

SEQ ID NO: 9227727 - DNA, 22 bp, Homo sapiens
aactagaaccacttgtatttcc

SEQ ID NO: 9227728 - DNA, 22 bp, Homo sapiens
aatgacatgctttttaattata

SEQ ID NO: 9227729 - DNA, 22 bp, Homo sapiens
aatgacatgctttttaattata

SEQ ID NO: 9227730 - DNA, 22 bp, Homo sapiens
aatgacagagcactgaacttgg

SEQ ID NO: 9227731 - DNA, 23 bp, Homo sapiens
aatgacacctcataggtaacttc

SEQ ID NO: 9227732 - DNA, 22 bp, Homo sapiens
aatgacagagatagaagggatg

SEQ ID NO: 9227733 - DNA, 22 bp, Homo sapiens
aaccttgagggatgaggtagtg

SEQ ID NO: 9227734 - DNA, 22 bp, Homo sapiens
aacgaatagggatttttctaac

SEQ ID NO: 9227735 - DNA, 22 bp, Homo sapiens
aacctttgaggggagctctttc

SEQ ID NO: 9227736 - DNA, 22 bp, Homo sapiens
aatgaacaacactgaaggaaga

SEQ ID NO: 9227737 - DNA, 22 bp, Homo sapiens
aatgaacaagaaagactttgag

SEQ ID NO: 9227738 - DNA, 22 bp, Homo sapiens
aacctgagtcttttgatttgct

SEQ ID NO: 9227739 - DNA, 22 bp, Homo sapiens
aacctgaatttaattgaaatga

SEQ ID NO: 9227740 - DNA, 22 bp, Homo sapiens
aacctgagatactggtctttat

SEQ ID NO: 9227741 - DNA, 22 bp, Homo sapiens
aacctgagcgcgttgctttcta

SEQ ID NO: 9227742 - DNA, 20 bp, Homo sapiens
aacctgaggcagtgttccag

SEQ ID NO: 9227743 - DNA, 22 bp, Homo sapiens
aaccctggccctggaataggca

SEQ ID NO: 9227744 - DNA, 22 bp, Homo sapiens
aacctaggactatagatatcat

SEQ ID NO: 9227745 - DNA, 22 bp, Homo sapiens
aacctcaaactcttgggcttaa

SEQ ID NO: 9227746 - DNA, 22 bp, Homo sapiens
aacctcaaactcttgggcttaa

SEQ ID NO: 9227747 - DNA, 22 bp, Homo sapiens
aacctgaaactacattcttgat

SEQ ID NO: 9227748 - DNA, 22 bp, Homo sapiens
aacatgttgagttgaaagtagc

SEQ ID NO: 9227749 - DNA, 22 bp, Homo sapiens
aacatgtgtcttgcatttcttg

SEQ ID NO: 9227750 - DNA, 22 bp, Homo sapiens
aacagcttagaaatgttgctaa

SEQ ID NO: 9227751 - DNA, 22 bp, Homo sapiens
aacagctgttcgcagatgtagg

SEQ ID NO: 9227752 - DNA, 22 bp, Homo sapiens
aacagcttgagactggatatgc

SEQ ID NO: 9227753 - DNA, 22 bp, Homo sapiens
aacagcttcatcacatggcata

SEQ ID NO: 9227754 - DNA, 22 bp, Homo sapiens
aacagctgtctgcctatctctg

SEQ ID NO: 9227755 - DNA, 22 bp, Homo sapiens
aacagcttactcaatggtgatt

SEQ ID NO: 9227756 - DNA, 22 bp, Homo sapiens
aacataaatttgaagtggcaaa

SEQ ID NO: 9227757 - DNA, 22 bp, Homo sapiens
aacatatttggctgatattccc

SEQ ID NO: 9227758 - DNA, 22 bp, Homo sapiens
aacatcaggatcttgttacagt

SEQ ID NO: 9227759 - DNA, 22 bp, Homo sapiens
aacatcacaatttcatttatgc

SEQ ID NO: 9227760 - DNA, 22 bp, Homo sapiens
aacatcagaagtagaagactca

SEQ ID NO: 9227761 - DNA, 22 bp, Homo sapiens
aacatcatcctttgagtattta

SEQ ID NO: 9227762 - DNA, 22 bp, Homo sapiens
aacatcatcatgaacaactaat

SEQ ID NO: 9227763 - DNA, 19 bp, Homo sapiens
aacatcatggctctttcca

SEQ ID NO: 9227764 - DNA, 22 bp, Homo sapiens
aacatcattatgtccattaatg

SEQ ID NO: 9227765 - DNA, 22 bp, Homo sapiens
aacagctgcaaaaggttgcctg

SEQ ID NO: 9227766 - DNA, 22 bp, Homo sapiens
aagtgtaagcaaagctcaagct

SEQ ID NO: 9227767 - DNA, 22 bp, Homo sapiens
aagtgtaaattcacagacttca

SEQ ID NO: 9227768 - DNA, 22 bp, Homo sapiens
aagtgtaaattcacagacttca

SEQ ID NO: 9227769 - DNA, 22 bp, Homo sapiens
aagtggtgtgttggaagaaatc

SEQ ID NO: 9227770 - DNA, 22 bp, Homo sapiens
aacatctttttgtttgctgaaa

SEQ ID NO: 9227771 - DNA, 22 bp, Homo sapiens
aacatctttgccaaattgctat

SEQ ID NO: 9227772 - DNA, 22 bp, Homo sapiens
aacatctttgataaacttagtg

SEQ ID NO: 9227773 - DNA, 19 bp, Homo sapiens
aacatctttccagtagagg

SEQ ID NO: 9227774 - DNA, 22 bp, Homo sapiens
aacatgaaaacctccacagcaa

SEQ ID NO: 9227775 - DNA, 22 bp, Homo sapiens
aatagacaagcaccctggtaaa

SEQ ID NO: 9227776 - DNA, 22 bp, Homo sapiens
aacatgaaaagcccagagaggt

SEQ ID NO: 9227777 - DNA, 22 bp, Homo sapiens
aacatcttaagatagaagggga

SEQ ID NO: 9227778 - DNA, 22 bp, Homo sapiens
aacatcttgtactgcacatttt

SEQ ID NO: 9227779 - DNA, 22 bp, Homo sapiens
aatagatactacttagatgtag

SEQ ID NO: 9227780 - DNA, 22 bp, Homo sapiens
aatagatactacttagatgtag

SEQ ID NO: 9227781 - DNA, 22 bp, Homo sapiens
aatagagagcagctttgcggtt

SEQ ID NO: 9227782 - DNA, 22 bp, Homo sapiens
aatagactccagggtctatttt

SEQ ID NO: 9227783 - DNA, 22 bp, Homo sapiens
aatagattcatggttaagagca

SEQ ID NO: 9227784 - DNA, 22 bp, Homo sapiens
aatagattcatggttaagagca

SEQ ID NO: 9227785 - DNA, 22 bp, Homo sapiens
aacatgtctttagagaaacatt

SEQ ID NO: 9227786 - DNA, 22 bp, Homo sapiens
aacatgtatcgctttttaatat

SEQ ID NO: 9227787 - DNA, 22 bp, Homo sapiens
aaatgcatttcactaatgtttc

SEQ ID NO: 9227788 - DNA, 22 bp, Homo sapiens
aaatgcattggtttctacttgt

SEQ ID NO: 9227789 - DNA, 22 bp, Homo sapiens
aaatgcattctgttttcactag

SEQ ID NO: 9227790 - DNA, 22 bp, Homo sapiens
aaggaagacacagatgaagtga

SEQ ID NO: 9227791 - DNA, 22 bp, Homo sapiens
aaggaagacttgagaaggttcc

SEQ ID NO: 9227792 - DNA, 22 bp, Homo sapiens
aaggaagacttgagaaggttcc

SEQ ID NO: 9227793 - DNA, 22 bp, Homo sapiens
aaggaagagaatccttctcaga

SEQ ID NO: 9227794 - DNA, 22 bp, Homo sapiens
aaggaagagtctagaacaggca

SEQ ID NO: 9227795 - DNA, 22 bp, Homo sapiens
aaggaagatatatcaagcttaa

SEQ ID NO: 9227796 - DNA, 22 bp, Homo sapiens
aaatgtcaaggtgatagatgca

SEQ ID NO: 9227797 - DNA, 22 bp, Homo sapiens
aaatgtcagaggaacatattga

SEQ ID NO: 9227798 - DNA, 22 bp, Homo sapiens
aaatgtcagaagctttacttct

SEQ ID NO: 9227799 - DNA, 22 bp, Homo sapiens
aaatgtcagaagctttacttct

SEQ ID NO: 9227800 - DNA, 22 bp, Homo sapiens
aaatgtcagaaaacatggagtg

SEQ ID NO: 9227801 - DNA, 22 bp, Homo sapiens
aaatgtcagaaaacatggagtg

SEQ ID NO: 9227802 - DNA, 22 bp, Homo sapiens
aaggcagccctggctcagcctg

SEQ ID NO: 9227803 - DNA, 22 bp, Homo sapiens
aaggcagccctggctcagcctg

SEQ ID NO: 9227804 - DNA, 22 bp, Homo sapiens
aaattattcaaaaagctgtgtt

SEQ ID NO: 9227805 - DNA, 22 bp, Homo sapiens
aaggcagcaggatttggtgact

SEQ ID NO: 9227806 - DNA, 22 bp, Homo sapiens
aaggcagcagtgcacgactgat

SEQ ID NO: 9227807 - DNA, 22 bp, Homo sapiens
aaggcagatataaagactagag

SEQ ID NO: 9227808 - DNA, 22 bp, Homo sapiens
aaggcagatataaagactagag

SEQ ID NO: 9227809 - DNA, 22 bp, Homo sapiens
aaggcacttaacgtgggaggat

SEQ ID NO: 9227810 - DNA, 22 bp, Homo sapiens
aaatgtctacttcccatctgta

SEQ ID NO: 9227811 - DNA, 22 bp, Homo sapiens
aaggcagcaccgcctcctgaaa

SEQ ID NO: 9227812 - DNA, 22 bp, Homo sapiens
aaggcagcacagcaactgctca

SEQ ID NO: 9227813 - DNA, 22 bp, Homo sapiens
aaggcagcagaggaaaggtgct

SEQ ID NO: 9227814 - DNA, 22 bp, Homo sapiens
aaggcagcaactaatggatctc

SEQ ID NO: 9227815 - DNA, 23 bp, Homo sapiens
aaattattgctcttcaattgcct

SEQ ID NO: 9227816 - DNA, 22 bp, Homo sapiens
aaattattctcatgtgtttctt

SEQ ID NO: 9227817 - DNA, 22 bp, Homo sapiens
aaggctgagagtcacagtccta

SEQ ID NO: 9227818 - DNA, 21 bp, Homo sapiens
aaattcacctagtaaaacttc

SEQ ID NO: 9227819 - DNA, 22 bp, Homo sapiens
aaggctgagccagggcccctat

SEQ ID NO: 9227820 - DNA, 22 bp, Homo sapiens
aaggctgagccagggcccctat

SEQ ID NO: 9227821 - DNA, 22 bp, Homo sapiens
aaggctgggtaacctgtccact

SEQ ID NO: 9227822 - DNA, 22 bp, Homo sapiens
aaggctgggtttgggatgtgat

SEQ ID NO: 9227823 - DNA, 22 bp, Homo sapiens
aaggctgggtttgggatgtgat

SEQ ID NO: 9227824 - DNA, 22 bp, Homo sapiens
aaggctggtcagatgtggtgaa

SEQ ID NO: 9227825 - DNA, 19 bp, Homo sapiens
aaggctggtaccataggtt

SEQ ID NO: 9227826 - DNA, 19 bp, Homo sapiens
aaggctggtaccataggtt

SEQ ID NO: 9227827 - DNA, 22 bp, Homo sapiens
aacagacaactcctgtggctca

SEQ ID NO: 9227828 - DNA, 22 bp, Homo sapiens
aacagaattgctgctgccaatg

SEQ ID NO: 9227829 - DNA, 22 bp, Homo sapiens
aacagaatagttgatgtacagt

SEQ ID NO: 9227830 - DNA, 22 bp, Homo sapiens
aacagaatatcaaaagattatg

SEQ ID NO: 9227831 - DNA, 22 bp, Homo sapiens
aacagaatatcaaaagattatg

SEQ ID NO: 9227832 - DNA, 22 bp, Homo sapiens
aacagaatcttgggttcttttc

SEQ ID NO: 9227833 - DNA, 22 bp, Homo sapiens
aacagaatgcaggggatgctgc

SEQ ID NO: 9227834 - DNA, 22 bp, Homo sapiens
aacagaagggggtatttacatt

SEQ ID NO: 9227835 - DNA, 22 bp, Homo sapiens
aacagaacccgagtgtgaatct

SEQ ID NO: 9227836 - DNA, 22 bp, Homo sapiens
aacagaaaaggtaggtggcttt

SEQ ID NO: 9227837 - DNA, 22 bp, Homo sapiens
aacactttcttccttgctcagg

SEQ ID NO: 9227838 - DNA, 22 bp, Homo sapiens
aacactttctattattatggtt

SEQ ID NO: 9227839 - DNA, 22 bp, Homo sapiens
aacactttcctgcctttctgat

SEQ ID NO: 9227840 - DNA, 22 bp, Homo sapiens
aacactttggaatagagatagg

SEQ ID NO: 9227841 - DNA, 22 bp, Homo sapiens
aacactttttagtaaagattga

SEQ ID NO: 9227842 - DNA, 22 bp, Homo sapiens
aacactttttagtaaagattga

SEQ ID NO: 9227843 - DNA, 20 bp, Homo sapiens
aacacagggttaccatcaga

SEQ ID NO: 9227844 - DNA, 22 bp, Homo sapiens
aacactgtatcagtcttcaata

SEQ ID NO: 9227845 - DNA, 22 bp, Homo sapiens
aacactgtatcagtcttcaata

SEQ ID NO: 9227846 - DNA, 22 bp, Homo sapiens
aacacagtttctgcattggtag

SEQ ID NO: 9227847 - DNA, 22 bp, Homo sapiens
aacacagttttccaaaatagag

SEQ ID NO: 9227848 - DNA, 22 bp, Homo sapiens
aacacagatcaaaatatttcct

SEQ ID NO: 9227849 - DNA, 22 bp, Homo sapiens
aacacagctaatttctgtcaat

SEQ ID NO: 9227850 - DNA, 22 bp, Homo sapiens
aacacagatcaaaatatttcct

SEQ ID NO: 9227851 - DNA, 22 bp, Homo sapiens
aacacagggactcccaggagaa

SEQ ID NO: 9227852 - DNA, 22 bp, Homo sapiens
aacacaggccagcctgtgcagt

SEQ ID NO: 9227853 - DNA, 22 bp, Homo sapiens
aacacaggcatactggctccag

SEQ ID NO: 9227854 - DNA, 22 bp, Homo sapiens
aacacagaagtgccaagagcca

SEQ ID NO: 9227855 - DNA, 22 bp, Homo sapiens
aacacagacatagtgattacag

SEQ ID NO: 9227856 - DNA, 22 bp, Homo sapiens
aacacaatcttccagtttgctg

SEQ ID NO: 9227857 - DNA, 20 bp, Homo sapiens
aacacactggtggcatcagg

SEQ ID NO: 9227858 - DNA, 22 bp, Homo sapiens
aacacagagtatttgaagcatt

SEQ ID NO: 9227859 - DNA, 20 bp, Homo sapiens
aacacagataccaaaggttg

SEQ ID NO: 9227860 - DNA, 20 bp, Homo sapiens
aacacagataccaaaggttg

SEQ ID NO: 9227861 - DNA, 22 bp, Homo sapiens
aacacagacatagtgattacag

SEQ ID NO: 9227862 - DNA, 23 bp, Homo sapiens
aacacaaagctgattccagtggc

SEQ ID NO: 9227863 - DNA, 22 bp, Homo sapiens
aaattttaaggctggaacttaa

SEQ ID NO: 9227864 - DNA, 22 bp, Homo sapiens
aaattttaaggctggaacttaa

SEQ ID NO: 9227865 - DNA, 22 bp, Homo sapiens
aacaatgcttgccaagtgtgat

SEQ ID NO: 9227866 - DNA, 22 bp, Homo sapiens
aaatttgtcaacttcatatgtt

SEQ ID NO: 9227867 - DNA, 22 bp, Homo sapiens
aaatttgccagatcaattctga

SEQ ID NO: 9227868 - DNA, 22 bp, Homo sapiens
aaatttgataagccattgttac

SEQ ID NO: 9227869 - DNA, 22 bp, Homo sapiens
aaatttctgttgttttgagcca

SEQ ID NO: 9227870 - DNA, 22 bp, Homo sapiens
aaatttcttgaggctctctagc

SEQ ID NO: 9227871 - DNA, 22 bp, Homo sapiens
aaatttctaagtcaagaagaac

SEQ ID NO: 9227872 - DNA, 22 bp, Homo sapiens
aaatttctaagtcaagaagaac

SEQ ID NO: 9227873 - DNA, 22 bp, Homo sapiens
aaggctggtcagatgtggtgaa

SEQ ID NO: 9227874 - DNA, 22 bp, Homo sapiens
aaggctggtggattatgaggtc

SEQ ID NO: 9227875 - DNA, 22 bp, Homo sapiens
aaggctggtggattatgaggtc

SEQ ID NO: 9227876 - DNA, 22 bp, Homo sapiens
aaggctggtggattatgaggtc

SEQ ID NO: 9227877 - DNA, 22 bp, Homo sapiens
aaggctggttccatccctggtg

SEQ ID NO: 9227878 - DNA, 22 bp, Homo sapiens
aagagaatatcgatagcactct

SEQ ID NO: 9227879 - DNA, 22 bp, Homo sapiens
aagagactatggtgtctatgaa

SEQ ID NO: 9227880 - DNA, 22 bp, Homo sapiens
aagagactaagaaagggcaata

SEQ ID NO: 9227881 - DNA, 22 bp, Homo sapiens
acaatgttctgtctgacttgtc

SEQ ID NO: 9227882 - DNA, 22 bp, Homo sapiens
aagagacttctagatttgttga

SEQ ID NO: 9227883 - DNA, 22 bp, Homo sapiens
aagagactgtaaaggcgtgagt

SEQ ID NO: 9227884 - DNA, 22 bp, Homo sapiens
acaatgtttctctttagtcatt

SEQ ID NO: 9227885 - DNA, 22 bp, Homo sapiens
acacaaactgctagaaaattgg

SEQ ID NO: 9227886 - DNA, 22 bp, Homo sapiens
acacaaactgctagaaaattgg

SEQ ID NO: 9227887 - DNA, 22 bp, Homo sapiens
acacaaactgctagaaaattgg

SEQ ID NO: 9227888 - DNA, 22 bp, Homo sapiens
acacaaactgctagaaaattgg

SEQ ID NO: 9227889 - DNA, 22 bp, Homo sapiens
acacaaagttggatgacaaaat

SEQ ID NO: 9227890 - DNA, 22 bp, Homo sapiens
acacaaacagtctatagcacca

SEQ ID NO: 9227891 - DNA, 22 bp, Homo sapiens
acacaaacagtctatagcacca

SEQ ID NO: 9227892 - DNA, 22 bp, Homo sapiens
acacaaaatcaaagtcctaggc

SEQ ID NO: 9227893 - DNA, 22 bp, Homo sapiens
acacaaactgctagaaaattgg

SEQ ID NO: 9227894 - DNA, 21 bp, Homo sapiens
acacaaacctcctcagcctgg

SEQ ID NO: 9227895 - DNA, 22 bp, Homo sapiens
aagagcaacttggaaacactca

SEQ ID NO: 9227896 - DNA, 22 bp, Homo sapiens
acacaaagttggatgacaaaat

SEQ ID NO: 9227897 - DNA, 22 bp, Homo sapiens
aagagcagattcctagtggagc

SEQ ID NO: 9227898 - DNA, 22 bp, Homo sapiens
aagagaaagcagactttgtcat

SEQ ID NO: 9227899 - DNA, 22 bp, Homo sapiens
aagagaaagcagactttgtcat

SEQ ID NO: 9227900 - DNA, 22 bp, Homo sapiens
aagactttctgtaaagctacag

SEQ ID NO: 9227901 - DNA, 22 bp, Homo sapiens
aagactttctcccaaatcctca

SEQ ID NO: 9227902 - DNA, 22 bp, Homo sapiens
aagactttctcccaaatcctca

SEQ ID NO: 9227903 - DNA, 22 bp, Homo sapiens
aagactttctggggtgtaaagg

SEQ ID NO: 9227904 - DNA, 20 bp, Homo sapiens
aagagaagaagtctttgaaa

SEQ ID NO: 9227905 - DNA, 22 bp, Homo sapiens
aagaccatcacagagacacttg

SEQ ID NO: 9227906 - DNA, 22 bp, Homo sapiens
aagacttgaccaggttgaaggc

SEQ ID NO: 9227907 - DNA, 22 bp, Homo sapiens
aagacttgaccaggttgaaggc

SEQ ID NO: 9227908 - DNA, 22 bp, Homo sapiens
aagactttccctcatcagaacg

SEQ ID NO: 9227909 - DNA, 20 bp, Homo sapiens
aattttatctccatcctttg

SEQ ID NO: 9227910 - DNA, 20 bp, Homo sapiens
aattttatctccatcctttg

SEQ ID NO: 9227911 - DNA, 20 bp, Homo sapiens
aattttatctccatcctttg

SEQ ID NO: 9227912 - DNA, 20 bp, Homo sapiens
aattttatctccatcctttg

SEQ ID NO: 9227913 - DNA, 20 bp, Homo sapiens
aattttatctccatcctttg

SEQ ID NO: 9227914 - DNA, 22 bp, Homo sapiens
aagaccataatgtaagatgaat

SEQ ID NO: 9227915 - DNA, 22 bp, Homo sapiens
aattttaatcagtggtgctgag

SEQ ID NO: 9227916 - DNA, 22 bp, Homo sapiens
aattttactaatctgagtgtga

SEQ ID NO: 9227917 - DNA, 22 bp, Homo sapiens
aattttaagcatatgactggtt

SEQ ID NO: 9227918 - DNA, 22 bp, Homo sapiens
aatttgttacacagcaatataa

SEQ ID NO: 9227919 - DNA, 22 bp, Homo sapiens
aatttcagctcaaacttgtgtt

SEQ ID NO: 9227920 - DNA, 22 bp, Homo sapiens
aatttcagtatgaagtttcaca

SEQ ID NO: 9227921 - DNA, 22 bp, Homo sapiens
aatttcagaactatctgggagt

SEQ ID NO: 9227922 - DNA, 22 bp, Homo sapiens
aatttcagaggtagagattcta

SEQ ID NO: 9227923 - DNA, 22 bp, Homo sapiens
aatttcagatgtcataaatata

SEQ ID NO: 9227924 - DNA, 22 bp, Homo sapiens
aatttcagatattaaagaatga

SEQ ID NO: 9227925 - DNA, 20 bp, Homo sapiens
aagaaacttgaaagtacaag

SEQ ID NO: 9227926 - DNA, 20 bp, Homo sapiens
aagaaacttgaaagtacaag

SEQ ID NO: 9227927 - DNA, 22 bp, Homo sapiens
aagaaagataaggtttgcttgg

SEQ ID NO: 9227928 - DNA, 22 bp, Homo sapiens
aattcacaatgtgtagtcatgc

SEQ ID NO: 9227929 - DNA, 22 bp, Homo sapiens
aattcccatttgcagaaaatca

SEQ ID NO: 9227930 - DNA, 22 bp, Homo sapiens
aattcccatttgcagaaaatca

SEQ ID NO: 9227931 - DNA, 22 bp, Homo sapiens
aattcccactatatgccaagca

SEQ ID NO: 9227932 - DNA, 21 bp, Homo sapiens
aattcccagaaacagcacaag

SEQ ID NO: 9227933 - DNA, 22 bp, Homo sapiens
aattcccaccttctctcttttg

SEQ ID NO: 9227934 - DNA, 22 bp, Homo sapiens
aattctctccagggtaacatca

SEQ ID NO: 9227935 - DNA, 22 bp, Homo sapiens
aattctataggcaagctatttt

SEQ ID NO: 9227936 - DNA, 22 bp, Homo sapiens
aattctataggcaagctatttt

SEQ ID NO: 9227937 - DNA, 22 bp, Homo sapiens
aattcctctatctttcttcaag

SEQ ID NO: 9227938 - DNA, 22 bp, Homo sapiens
aattctaaatgtaatttagaat

SEQ ID NO: 9227939 - DNA, 22 bp, Homo sapiens
aattctataggcaagctatttt

SEQ ID NO: 9227940 - DNA, 22 bp, Homo sapiens
aattctgagaacaaaaggtact

SEQ ID NO: 9227941 - DNA, 22 bp, Homo sapiens
aattctgagaacaaaaggtact

SEQ ID NO: 9227942 - DNA, 22 bp, Homo sapiens
aagaaattaatgtgccattact

SEQ ID NO: 9227943 - DNA, 22 bp, Homo sapiens
aagaaattaaggaatgcaacga

SEQ ID NO: 9227944 - DNA, 22 bp, Homo sapiens
aagaaattaaggaatgcaacga

SEQ ID NO: 9227945 - DNA, 22 bp, Homo sapiens
aagaacaactgctttaaaagca

SEQ ID NO: 9227946 - DNA, 22 bp, Homo sapiens
aatttaaggaggccttcactct

SEQ ID NO: 9227947 - DNA, 17 bp, Homo sapiens
aagaacactcaatagca

SEQ ID NO: 9227948 - DNA, 17 bp, Homo sapiens
aagaacactcaatagca

SEQ ID NO: 9227949 - DNA, 22 bp, Homo sapiens
aatttaatcaagttctgctctg

SEQ ID NO: 9227950 - DNA, 22 bp, Homo sapiens
aatttaatcaagttctgctctg

SEQ ID NO: 9227951 - DNA, 22 bp, Homo sapiens
aatttcactggaaaagataatt

SEQ ID NO: 9227952 - DNA, 22 bp, Homo sapiens
aatttcactgtggagcacattt

SEQ ID NO: 9227953 - DNA, 21 bp, Homo sapiens
aactggcagaccaactatggc

SEQ ID NO: 9227954 - DNA, 22 bp, Homo sapiens
aactggcatatgaacttgttct

SEQ ID NO: 9227955 - DNA, 22 bp, Homo sapiens
aactggaatagcacaggaaaag

SEQ ID NO: 9227956 - DNA, 22 bp, Homo sapiens
aatggctttgagtattttctgg

SEQ ID NO: 9227957 - DNA, 22 bp, Homo sapiens
aatgggaaagagactagatgct

SEQ ID NO: 9227958 - DNA, 22 bp, Homo sapiens
aactgcttgtaaataatgttga

SEQ ID NO: 9227959 - DNA, 22 bp, Homo sapiens
aactgcttgagatatgtttgtc

SEQ ID NO: 9227960 - DNA, 22 bp, Homo sapiens
aactgcttgagatatgtttgtc

SEQ ID NO: 9227961 - DNA, 22 bp, Homo sapiens
aactgcttcttactgctgggca

SEQ ID NO: 9227962 - DNA, 22 bp, Homo sapiens
aactggaagagtgaatataact

SEQ ID NO: 9227963 - DNA, 22 bp, Homo sapiens
aactgcttgtaaataatgttga

SEQ ID NO: 9227964 - DNA, 22 bp, Homo sapiens
aactgcttgtaaataatgttga

SEQ ID NO: 9227965 - DNA, 17 bp, Homo sapiens
aactgctttttttagcc

SEQ ID NO: 9227966 - DNA, 17 bp, Homo sapiens
aactgctttttttagcc

SEQ ID NO: 9227967 - DNA, 22 bp, Homo sapiens
aactgctttttgatctcaggag

SEQ ID NO: 9227968 - DNA, 22 bp, Homo sapiens
aagaaacctagtctggagcagc

SEQ ID NO: 9227969 - DNA, 22 bp, Homo sapiens
aagaaactgttgcgtgacagcg

SEQ ID NO: 9227970 - DNA, 22 bp, Homo sapiens
aagaaaccaaccctgccagcac

SEQ ID NO: 9227971 - DNA, 22 bp, Homo sapiens
aagaaacaaccactgctctcct

SEQ ID NO: 9227972 - DNA, 22 bp, Homo sapiens
aagaaacaaccactgctctcct

SEQ ID NO: 9227973 - DNA, 22 bp, Homo sapiens
aagaaaagaaacctgaggcttt

SEQ ID NO: 9227974 - DNA, 22 bp, Homo sapiens
aagaaaagatgtttggttttca

SEQ ID NO: 9227975 - DNA, 22 bp, Homo sapiens
aagaaaatcagttctggtcagt

SEQ ID NO: 9227976 - DNA, 22 bp, Homo sapiens
aagaaaacatgatctaatttaa

SEQ ID NO: 9227977 - DNA, 22 bp, Homo sapiens
aagaaaacaatgacttgccagc

SEQ ID NO: 9227978 - DNA, 22 bp, Homo sapiens
aagaaaacaatgacttgccagc

SEQ ID NO: 9227979 - DNA, 22 bp, Homo sapiens
aagaaaacatgatctaatttaa

SEQ ID NO: 9227980 - DNA, 22 bp, Homo sapiens
aagatgaaaatttactgtgatg

SEQ ID NO: 9227981 - DNA, 22 bp, Homo sapiens
aagatccttggttctgctttcc

SEQ ID NO: 9227982 - DNA, 22 bp, Homo sapiens
aagatgaagaacatgagcacac

SEQ ID NO: 9227983 - DNA, 22 bp, Homo sapiens
acacattatgagcagttgtctt

SEQ ID NO: 9227984 - DNA, 22 bp, Homo sapiens
acacatgctgataagaatataa

SEQ ID NO: 9227985 - DNA, 22 bp, Homo sapiens
acacattatctcattaaatact

SEQ ID NO: 9227986 - DNA, 21 bp, Homo sapiens
acacattatgagcatagactc

SEQ ID NO: 9227987 - DNA, 22 bp, Homo sapiens
acacattcctgcagacatgatg

SEQ ID NO: 9227988 - DNA, 22 bp, Homo sapiens
acacattcatgagtgcatgcac

SEQ ID NO: 9227989 - DNA, 22 bp, Homo sapiens
aagagcaggctgctgtggagta

SEQ ID NO: 9227990 - DNA, 22 bp, Homo sapiens
acacatgctcataaataaatag

SEQ ID NO: 9227991 - DNA, 20 bp, Homo sapiens
acacatgcatagagagagag

SEQ ID NO: 9227992 - DNA, 22 bp, Homo sapiens
acacatgcacaacagttctttc

SEQ ID NO: 9227993 - DNA, 22 bp, Homo sapiens
acacatgcaggtatacatgttc

SEQ ID NO: 9227994 - DNA, 22 bp, Homo sapiens
acacatgagaaacatcagttgt

SEQ ID NO: 9227995 - DNA, 22 bp, Homo sapiens
aagcaaagagataaccttttgg

SEQ ID NO: 9227996 - DNA, 22 bp, Homo sapiens
aagcaagacagaagttactgcc

SEQ ID NO: 9227997 - DNA, 22 bp, Homo sapiens
aagcaagaggaaatgtggacct

SEQ ID NO: 9227998 - DNA, 22 bp, Homo sapiens
aagcaaggcaacctatgtccag

SEQ ID NO: 9227999 - DNA, 22 bp, Homo sapiens
aagcaaggccggaaggaaactc

SEQ ID NO: 9228000 - DNA, 22 bp, Homo sapiens
aagatgtgaaattgtctctggg

SEQ ID NO: 9228001 - DNA, 22 bp, Homo sapiens
aagatgtaaaggcaatataaag

SEQ ID NO: 9228002 - DNA, 22 bp, Homo sapiens
aagatgtatcagttaagtcttc

SEQ ID NO: 9228003 - DNA, 22 bp, Homo sapiens
aagatgcttgcaaatttctgaa

SEQ ID NO: 9228004 - DNA, 22 bp, Homo sapiens
aagatgcttattgctcctgcag

SEQ ID NO: 9228005 - DNA, 22 bp, Homo sapiens
aagatgatagatctgtcaatgt

SEQ ID NO: 9228006 - DNA, 22 bp, Homo sapiens
aagatgataggacttgcttaag

SEQ ID NO: 9228007 - DNA, 22 bp, Homo sapiens
aagatgatgttgtgttttcact

SEQ ID NO: 9228008 - DNA, 22 bp, Homo sapiens
aagatgcacaatgtggcaatta

SEQ ID NO: 9228009 - DNA, 22 bp, Homo sapiens
aagatgcacaatgtggcaatta

SEQ ID NO: 9228010 - DNA, 22 bp, Homo sapiens
aagatgcagcaaactacttttt

SEQ ID NO: 9228011 - DNA, 22 bp, Homo sapiens
aagatgcatgctgaagctggct

SEQ ID NO: 9228012 - DNA, 22 bp, Homo sapiens
aagatgcagctttacaataagg

SEQ ID NO: 9228013 - DNA, 22 bp, Homo sapiens
aagatgcagctttacaataagg

SEQ ID NO: 9228014 - DNA, 22 bp, Homo sapiens
aagatgcggttgaccatggtgt

SEQ ID NO: 9228015 - DNA, 22 bp, Homo sapiens
aagcagcttaaattagagcctg

SEQ ID NO: 9228016 - DNA, 22 bp, Homo sapiens
aagcagcttaaattagagcctg

SEQ ID NO: 9228017 - DNA, 22 bp, Homo sapiens
aagcagctgtgtgacataatct

SEQ ID NO: 9228018 - DNA, 22 bp, Homo sapiens
acagcagagcctggtacttact

SEQ ID NO: 9228019 - DNA, 22 bp, Homo sapiens
acagccagggcattgtcgccga

SEQ ID NO: 9228020 - DNA, 22 bp, Homo sapiens
aagcagcttttgaagagtgagg

SEQ ID NO: 9228021 - DNA, 22 bp, Homo sapiens
aagcagcttccccaaagtgcct

SEQ ID NO: 9228022 - DNA, 22 bp, Homo sapiens
acagcagagacactcaggaggc

SEQ ID NO: 9228023 - DNA, 21 bp, Homo sapiens
acagcagagatcaagactaag

SEQ ID NO: 9228024 - DNA, 21 bp, Homo sapiens
acagcagagatcaagactaag

SEQ ID NO: 9228025 - DNA, 22 bp, Homo sapiens
acagcagagccagtggctctag

SEQ ID NO: 9228026 - DNA, 22 bp, Homo sapiens
aagcagaggccacagagtgggc

SEQ ID NO: 9228027 - DNA, 22 bp, Homo sapiens
aagcagaggaccgacggaggga

SEQ ID NO: 9228028 - DNA, 22 bp, Homo sapiens
aagcagagggtatggccaggtt

SEQ ID NO: 9228029 - DNA, 22 bp, Homo sapiens
aagcagaggtagggtgtgcagt

SEQ ID NO: 9228030 - DNA, 22 bp, Homo sapiens
aagcagagggtatggccaggtt

SEQ ID NO: 9228031 - DNA, 22 bp, Homo sapiens
acagcaaaagacaagaacttaa

SEQ ID NO: 9228032 - DNA, 22 bp, Homo sapiens
aagcacccaatttacagcagtt

SEQ ID NO: 9228033 - DNA, 22 bp, Homo sapiens
aagcacaatttaggactgaaat

SEQ ID NO: 9228034 - DNA, 22 bp, Homo sapiens
aagcaattgtcctgtctctaca

SEQ ID NO: 9228035 - DNA, 19 bp, Homo sapiens
aagcaatgttgtgaatcta

SEQ ID NO: 9228036 - DNA, 19 bp, Homo sapiens
aagcaatgttgtgaatcta

SEQ ID NO: 9228037 - DNA, 19 bp, Homo sapiens
aagcaatgttgtgaatcta

SEQ ID NO: 9228038 - DNA, 22 bp, Homo sapiens
aagcaatgttagaggccttagg

SEQ ID NO: 9228039 - DNA, 22 bp, Homo sapiens
aagcaatgttagaggccttagg

SEQ ID NO: 9228040 - DNA, 22 bp, Homo sapiens
aagcaatgtgtttgaaaggcca

SEQ ID NO: 9228041 - DNA, 22 bp, Homo sapiens
aagcaatgtgtttgaaaggcca

SEQ ID NO: 9228042 - DNA, 22 bp, Homo sapiens
aagcaatgtgttaatgaatgag

SEQ ID NO: 9228043 - DNA, 22 bp, Homo sapiens
aagcaatgtgttaatgaatgag

SEQ ID NO: 9228044 - DNA, 23 bp, Homo sapiens
aagcaatgctgagccagttctga

SEQ ID NO: 9228045 - DNA, 23 bp, Homo sapiens
aagcaatgctgagccagttctga

SEQ ID NO: 9228046 - DNA, 22 bp, Homo sapiens
aagcagaagttgatctaccata

SEQ ID NO: 9228047 - DNA, 22 bp, Homo sapiens
aagcagaatttaatagaaaggt

SEQ ID NO: 9228048 - DNA, 20 bp, Homo sapiens
aagcagaagctgctctcagc

SEQ ID NO: 9228049 - DNA, 22 bp, Homo sapiens
aagcagaatttcccactagttg

SEQ ID NO: 9228050 - DNA, 18 bp, Homo sapiens
aagcagacagcagacagt

SEQ ID NO: 9228051 - DNA, 22 bp, Homo sapiens
aagcagagaatctgggagcgag

SEQ ID NO: 9228052 - DNA, 22 bp, Homo sapiens
aagcagagcctgagacagggat

SEQ ID NO: 9228053 - DNA, 22 bp, Homo sapiens
aagcagagcctgagacagggat

SEQ ID NO: 9228054 - DNA, 22 bp, Homo sapiens
aagcagagccaccagctttgga

SEQ ID NO: 9228055 - DNA, 20 bp, Homo sapiens
agcagatagcgggagagttt

SEQ ID NO: 9228056 - DNA, 22 bp, Homo sapiens
agcagagtgtgaaggcagggct

SEQ ID NO: 9228057 - DNA, 22 bp, Homo sapiens
agcagatatgatacttaattta

SEQ ID NO: 9228058 - DNA, 22 bp, Homo sapiens
agcagatgaatcccagataaag

SEQ ID NO: 9228059 - DNA, 22 bp, Homo sapiens
agcagatgagcctcatgactgg

SEQ ID NO: 9228060 - DNA, 18 bp, Homo sapiens
agcagagcccatgcattc

SEQ ID NO: 9228061 - DNA, 19 bp, Homo sapiens
agcagagccctgaagatcc

SEQ ID NO: 9228062 - DNA, 19 bp, Homo sapiens
agcagagccctgaagatcc

SEQ ID NO: 9228063 - DNA, 22 bp, Homo sapiens
agcagagcccttccatggcctt

SEQ ID NO: 9228064 - DNA, 22 bp, Homo sapiens
agcagagcccttccatggcctt

SEQ ID NO: 9228065 - DNA, 23 bp, Homo sapiens
agcagcaaaaatttatctttctg

SEQ ID NO: 9228066 - DNA, 22 bp, Homo sapiens
agcagatgtttcagagcaggct

SEQ ID NO: 9228067 - DNA, 22 bp, Homo sapiens
agcagatgtttcagagcaggct

SEQ ID NO: 9228068 - DNA, 22 bp, Homo sapiens
agcagcaaagaataggccctct

SEQ ID NO: 9228069 - DNA, 22 bp, Homo sapiens
agcagatggtgtcatgggatgg

SEQ ID NO: 9228070 - DNA, 22 bp, Homo sapiens
agcagatgggagatggagctgc

SEQ ID NO: 9228071 - DNA, 22 bp, Homo sapiens
agcagatggagaatggagtcag

SEQ ID NO: 9228072 - DNA, 22 bp, Homo sapiens
agcagatgagcctcatgactgg

SEQ ID NO: 9228073 - DNA, 22 bp, Homo sapiens
agcagatgcattatgattgaaa

SEQ ID NO: 9228074 - DNA, 22 bp, Homo sapiens
agcagagcagaatgtgaaggtg

SEQ ID NO: 9228075 - DNA, 18 bp, Homo sapiens
agcagagagtgaatggga

SEQ ID NO: 9228076 - DNA, 22 bp, Homo sapiens
agcagagcatgctaagtgactc

SEQ ID NO: 9228077 - DNA, 19 bp, Homo sapiens
agcagagcagggccgtggg

SEQ ID NO: 9228078 - DNA, 22 bp, Homo sapiens
agcagagccagaattggaccag

SEQ ID NO: 9228079 - DNA, 22 bp, Homo sapiens
agcagagccaggtctctctgta

SEQ ID NO: 9228080 - DNA, 22 bp, Homo sapiens
acaatgcacctattttaaaact

SEQ ID NO: 9228081 - DNA, 22 bp, Homo sapiens
acaatgcaccagcatcttcacc

SEQ ID NO: 9228082 - DNA, 23 bp, Homo sapiens
acaatgcactttaaatggttccc

SEQ ID NO: 9228083 - DNA, 22 bp, Homo sapiens
agcagaacctgcagacctgtct

SEQ ID NO: 9228084 - DNA, 22 bp, Homo sapiens
agcagaactgatgagacttgag

SEQ ID NO: 9228085 - DNA, 22 bp, Homo sapiens
agcagagaggaggtggccctgt

SEQ ID NO: 9228086 - DNA, 21 bp, Homo sapiens
acaatgcatggaactcatggc

SEQ ID NO: 9228087 - DNA, 22 bp, Homo sapiens
acaatgctgcagggaaattagg

SEQ ID NO: 9228088 - DNA, 22 bp, Homo sapiens
acaatgctccctgtagtcagga

SEQ ID NO: 9228089 - DNA, 22 bp, Homo sapiens
acaatgctcatatttatgccaa

SEQ ID NO: 9228090 - DNA, 17 bp, Homo sapiens
agcagctgggttgatct

SEQ ID NO: 9228091 - DNA, 22 bp, Homo sapiens
agcagctggtaggagtggccac

SEQ ID NO: 9228092 - DNA, 22 bp, Homo sapiens
agcagctggtgagcaagctcag

SEQ ID NO: 9228093 - DNA, 22 bp, Homo sapiens
agcagctggggcctgtgacgat

SEQ ID NO: 9228094 - DNA, 22 bp, Homo sapiens
agcagctgggctcagagctggg

SEQ ID NO: 9228095 - DNA, 22 bp, Homo sapiens
acacagatgctatttagtctct

SEQ ID NO: 9228096 - DNA, 22 bp, Homo sapiens
acacagatgctatttagtctct

SEQ ID NO: 9228097 - DNA, 22 bp, Homo sapiens
agcagctgagccccagctgtga

SEQ ID NO: 9228098 - DNA, 22 bp, Homo sapiens
acacagataatgctcatatagg

SEQ ID NO: 9228099 - DNA, 22 bp, Homo sapiens
acacagatattgtacttgatcc

SEQ ID NO: 9228100 - DNA, 22 bp, Homo sapiens
acacagatattgtacttgatcc

SEQ ID NO: 9228101 - DNA, 22 bp, Homo sapiens
acacagatattgtacttgatcc

SEQ ID NO: 9228102 - DNA, 22 bp, Homo sapiens
acacagatattttgaatacata

SEQ ID NO: 9228103 - DNA, 22 bp, Homo sapiens
acacagatgatgttccaggaac

SEQ ID NO: 9228104 - DNA, 22 bp, Homo sapiens
acacagatgcattacacatcta

SEQ ID NO: 9228105 - DNA, 22 bp, Homo sapiens
acacagagtttgacacatggga

SEQ ID NO: 9228106 - DNA, 22 bp, Homo sapiens
acacagagtttgacacatggga

SEQ ID NO: 9228107 - DNA, 22 bp, Homo sapiens
acacagagtggtttgtagaata

SEQ ID NO: 9228108 - DNA, 22 bp, Homo sapiens
acacagagttattatgtgaact

SEQ ID NO: 9228109 - DNA, 22 bp, Homo sapiens
acacagagttattatgtgaact

SEQ ID NO: 9228110 - DNA, 22 bp, Homo sapiens
acacagagttattatgtgaact

SEQ ID NO: 9228111 - DNA, 20 bp, Homo sapiens
acacagagtgagtctgcttg

SEQ ID NO: 9228112 - DNA, 22 bp, Homo sapiens
acacagagtccttactgaggta

SEQ ID NO: 9228113 - DNA, 22 bp, Homo sapiens
acacagagtccttactgaggta

SEQ ID NO: 9228114 - DNA, 22 bp, Homo sapiens
acacagagtatttagaaggggt

SEQ ID NO: 9228115 - DNA, 22 bp, Homo sapiens
acacagaggtggccactctttt

SEQ ID NO: 9228116 - DNA, 22 bp, Homo sapiens
acacagagtatcttttgcctag

SEQ ID NO: 9228117 - DNA, 22 bp, Homo sapiens
acacagaggcatgacagtggct

SEQ ID NO: 9228118 - DNA, 22 bp, Homo sapiens
acacagagcttctcaactggga

SEQ ID NO: 9228119 - DNA, 22 bp, Homo sapiens
acacagaggaaagtgtgaaggg

SEQ ID NO: 9228120 - DNA, 22 bp, Homo sapiens
acacagaggaaagtgtgaaggg

SEQ ID NO: 9228121 - DNA, 22 bp, Homo sapiens
acacagaggcatgacagtggct

SEQ ID NO: 9228122 - DNA, 21 bp, Homo sapiens
acacagaggcatcatcacttt

SEQ ID NO: 9228123 - DNA, 18 bp, Homo sapiens
acacaggctgacagcacc

SEQ ID NO: 9228124 - DNA, 22 bp, Homo sapiens
acacaggcatagccatacatgt

SEQ ID NO: 9228125 - DNA, 22 bp, Homo sapiens
acacaggcatagccatacatgt

SEQ ID NO: 9228126 - DNA, 17 bp, Homo sapiens
acacagggagagggagc

SEQ ID NO: 9228127 - DNA, 17 bp, Homo sapiens
acacagggagagggagc

SEQ ID NO: 9228128 - DNA, 22 bp, Homo sapiens
acacagggcagagagctggctc

SEQ ID NO: 9228129 - DNA, 19 bp, Homo sapiens
acacagggatcagagggtt

SEQ ID NO: 9228130 - DNA, 22 bp, Homo sapiens
acacatgctgataagaatataa

SEQ ID NO: 9228131 - DNA, 22 bp, Homo sapiens
acacatgtaaaacacttagcaa

SEQ ID NO: 9228132 - DNA, 22 bp, Homo sapiens
acacatgttcaagaatgttcag

SEQ ID NO: 9228133 - DNA, 19 bp, Homo sapiens
acacatgtgtgttatgtgc

SEQ ID NO: 9228134 - DNA, 22 bp, Homo sapiens
acacatgtgtctgcatgcagtg

SEQ ID NO: 9228135 - DNA, 22 bp, Homo sapiens
acacattaaaacgtctacaatg

SEQ ID NO: 9228136 - DNA, 22 bp, Homo sapiens
acacattaaaacgtctacaatg

SEQ ID NO: 9228137 - DNA, 22 bp, Homo sapiens
acacatgtatatgcttgtgtgt

SEQ ID NO: 9228138 - DNA, 22 bp, Homo sapiens
acacatgtacagattagtattt

SEQ ID NO: 9228139 - DNA, 22 bp, Homo sapiens
acacatgtatgttttgtatttg

SEQ ID NO: 9228140 - DNA, 20 bp, Homo sapiens
acacatgtgcgtgttcagta

SEQ ID NO: 9228141 - DNA, 22 bp, Homo sapiens
acacatgtgattctaagacagc

SEQ ID NO: 9228142 - DNA, 22 bp, Homo sapiens
acacatgtgattctaagacagc

SEQ ID NO: 9228143 - DNA, 22 bp, Homo sapiens
acacatgtgattctaagacagc

SEQ ID NO: 9228144 - DNA, 20 bp, Homo sapiens
acacatgtcaagctaaaggc

SEQ ID NO: 9228145 - DNA, 22 bp, Homo sapiens
acacccaggaataaggactggg

SEQ ID NO: 9228146 - DNA, 22 bp, Homo sapiens
acactagctaaatgctgattaa

SEQ ID NO: 9228147 - DNA, 22 bp, Homo sapiens
acactagtctcttcttgacttg

SEQ ID NO: 9228148 - DNA, 22 bp, Homo sapiens
acactataagacagatacagca

SEQ ID NO: 9228149 - DNA, 22 bp, Homo sapiens
acactagtggaaattgatttgt

SEQ ID NO: 9228150 - DNA, 22 bp, Homo sapiens
acactagtagaatagtgtttgc

SEQ ID NO: 9228151 - DNA, 22 bp, Homo sapiens
acacattaacctttgaaattct

SEQ ID NO: 9228152 - DNA, 22 bp, Homo sapiens
acactgaagagcactttcaaag

SEQ ID NO: 9228153 - DNA, 22 bp, Homo sapiens
acactgaatatacaatgaatat

SEQ ID NO: 9228154 - DNA, 22 bp, Homo sapiens
acactgattgtagtctgtggtg

SEQ ID NO: 9228155 - DNA, 22 bp, Homo sapiens
acactgatgttggccctggtca

SEQ ID NO: 9228156 - DNA, 19 bp, Homo sapiens
acactgatcagatcagcag

SEQ ID NO: 9228157 - DNA, 22 bp, Homo sapiens
acactgcagatgaaagcataag

SEQ ID NO: 9228158 - DNA, 22 bp, Homo sapiens
acactttacagcttcctttgca

SEQ ID NO: 9228159 - DNA, 22 bp, Homo sapiens
acactttacagaatgttttgat

SEQ ID NO: 9228160 - DNA, 22 bp, Homo sapiens
acacttcagcagtatgcttggg

SEQ ID NO: 9228161 - DNA, 22 bp, Homo sapiens
acactttagtatgaagaggtag

SEQ ID NO: 9228162 - DNA, 22 bp, Homo sapiens
acactttagaaaaaagaatggt

SEQ ID NO: 9228163 - DNA, 22 bp, Homo sapiens
acactgaatgtttaagaacttg

SEQ ID NO: 9228164 - DNA, 22 bp, Homo sapiens
acactgagattttcctgacacc

SEQ ID NO: 9228165 - DNA, 22 bp, Homo sapiens
acagagctgggtgccccctgga

SEQ ID NO: 9228166 - DNA, 22 bp, Homo sapiens
acagagctgggatctgaaccca

SEQ ID NO: 9228167 - DNA, 19 bp, Homo sapiens
acagagctctctgcttctg

SEQ ID NO: 9228168 - DNA, 22 bp, Homo sapiens
acagagctcccagccatctcct

SEQ ID NO: 9228169 - DNA, 22 bp, Homo sapiens
acagatgatttttatgaaaaca

SEQ ID NO: 9228170 - DNA, 22 bp, Homo sapiens
acagatgctctgatgtctgggt

SEQ ID NO: 9228171 - DNA, 22 bp, Homo sapiens
acagatgcaaggaaatgattgc

SEQ ID NO: 9228172 - DNA, 20 bp, Homo sapiens
agccctgtttcctggagaga

SEQ ID NO: 9228173 - DNA, 22 bp, Homo sapiens
agcctcctggagtttctgggat

SEQ ID NO: 9228174 - DNA, 22 bp, Homo sapiens
agcctcctgtagccctcaccca

SEQ ID NO: 9228175 - DNA, 22 bp, Homo sapiens
agcctcctgtagccctcaccca

SEQ ID NO: 9228176 - DNA, 22 bp, Homo sapiens
acagagcatttgggacagagag

SEQ ID NO: 9228177 - DNA, 22 bp, Homo sapiens
agcctctgatgatcacaggggg

SEQ ID NO: 9228178 - DNA, 22 bp, Homo sapiens
agcctctctttctggtggctaa

SEQ ID NO: 9228179 - DNA, 21 bp, Homo sapiens
acagatgggatgagcacactg

SEQ ID NO: 9228180 - DNA, 19 bp, Homo sapiens
agctcctgattgtgcctcg

SEQ ID NO: 9228181 - DNA, 19 bp, Homo sapiens
agctcctgattgtgcctcg

SEQ ID NO: 9228182 - DNA, 22 bp, Homo sapiens
agctcccagagctcgagagtaa

SEQ ID NO: 9228183 - DNA, 22 bp, Homo sapiens
agctcccagaaggccctgcgcc

SEQ ID NO: 9228184 - DNA, 22 bp, Homo sapiens
acagattcactgcactggccat

SEQ ID NO: 9228185 - DNA, 21 bp, Homo sapiens
acagattagcacaatgcaggc

SEQ ID NO: 9228186 - DNA, 22 bp, Homo sapiens
acagatgtggagtttgcatgat

SEQ ID NO: 9228187 - DNA, 17 bp, Homo sapiens
agctcctgcccatggct

SEQ ID NO: 9228188 - DNA, 22 bp, Homo sapiens
agctcctgcgcacggtgcacac

SEQ ID NO: 9228189 - DNA, 22 bp, Homo sapiens
agctcctgcccaggaaggctct

SEQ ID NO: 9228190 - DNA, 22 bp, Homo sapiens
agctcctgcagactcctgctca

SEQ ID NO: 9228191 - DNA, 22 bp, Homo sapiens
agctcctgcagactcctgctca

SEQ ID NO: 9228192 - DNA, 22 bp, Homo sapiens
agctcctgcacccagccttgag

SEQ ID NO: 9228193 - DNA, 22 bp, Homo sapiens
acagcaatgagtaactccttgg

SEQ ID NO: 9228194 - DNA, 22 bp, Homo sapiens
agctcctgctctttgtccctaa

SEQ ID NO: 9228195 - DNA, 22 bp, Homo sapiens
acagcacaatctgagtcccaga

SEQ ID NO: 9228196 - DNA, 22 bp, Homo sapiens
acagcacaatctgagtcccaga

SEQ ID NO: 9228197 - DNA, 22 bp, Homo sapiens
acagcacaggagttgaatgggc

SEQ ID NO: 9228198 - DNA, 22 bp, Homo sapiens
acagcacagagtggtatggctg

SEQ ID NO: 9228199 - DNA, 22 bp, Homo sapiens
acagagaaagtgggctgaagat

SEQ ID NO: 9228200 - DNA, 22 bp, Homo sapiens
acagagacaatatttgtaaagt

SEQ ID NO: 9228201 - DNA, 22 bp, Homo sapiens
acagagacaatatttgtaaagt

SEQ ID NO: 9228202 - DNA, 22 bp, Homo sapiens
acagagacaaatgttagtagtt

SEQ ID NO: 9228203 - DNA, 23 bp, Homo sapiens
acagagacaatggtttcatcttg

SEQ ID NO: 9228204 - DNA, 22 bp, Homo sapiens
acagagacacggaagctaaaga

SEQ ID NO: 9228205 - DNA, 22 bp, Homo sapiens
acagagaccagcatcttctgcc

SEQ ID NO: 9228206 - DNA, 22 bp, Homo sapiens
acagagacaggcagacagtctt

SEQ ID NO: 9228207 - DNA, 22 bp, Homo sapiens
acagagacctggccttgctttg

SEQ ID NO: 9228208 - DNA, 22 bp, Homo sapiens
acagagaccagttacagcgtcc

SEQ ID NO: 9228209 - DNA, 22 bp, Homo sapiens
acagagactaagcttttcatca

SEQ ID NO: 9228210 - DNA, 22 bp, Homo sapiens
acagagactcatgaaagatgac

SEQ ID NO: 9228211 - DNA, 22 bp, Homo sapiens
acagagactaagcttttcatca

SEQ ID NO: 9228212 - DNA, 23 bp, Homo sapiens
acagagactgccaagatattctc

SEQ ID NO: 9228213 - DNA, 22 bp, Homo sapiens
acagagactgggagcaagaggc

SEQ ID NO: 9228214 - DNA, 20 bp, Homo sapiens
acagagactgagacacttgc

SEQ ID NO: 9228215 - DNA, 22 bp, Homo sapiens
acagagacttggagcaggctga

SEQ ID NO: 9228216 - DNA, 22 bp, Homo sapiens
acagagactgggatgcctgcct

SEQ ID NO: 9228217 - DNA, 22 bp, Homo sapiens
acagagagaaacaatcagcagc

SEQ ID NO: 9228218 - DNA, 22 bp, Homo sapiens
acagagaaagtgggctgaagat

SEQ ID NO: 9228219 - DNA, 21 bp, Homo sapiens
acagagaaagagcagcctcct

SEQ ID NO: 9228220 - DNA, 22 bp, Homo sapiens
acagacattcagctaagtctat

SEQ ID NO: 9228221 - DNA, 22 bp, Homo sapiens
agccagggtctctcgctctgtt

SEQ ID NO: 9228222 - DNA, 22 bp, Homo sapiens
agccagggtctctcgctctgtt

SEQ ID NO: 9228223 - DNA, 19 bp, Homo sapiens
agccagggtgagaaggagc

SEQ ID NO: 9228224 - DNA, 22 bp, Homo sapiens
agccagggggacgctttctggc

SEQ ID NO: 9228225 - DNA, 22 bp, Homo sapiens
agccagggtaaggtacttagta

SEQ ID NO: 9228226 - DNA, 19 bp, Homo sapiens
agccagggtccagacatgt

SEQ ID NO: 9228227 - DNA, 19 bp, Homo sapiens
agccagggtccagacatgt

SEQ ID NO: 9228228 - DNA, 22 bp, Homo sapiens
acagaaacccagaaaacctctc

SEQ ID NO: 9228229 - DNA, 22 bp, Homo sapiens
acagaaaagtttacttttgctc

SEQ ID NO: 9228230 - DNA, 22 bp, Homo sapiens
acagaaaagtttacttttgctc

SEQ ID NO: 9228231 - DNA, 22 bp, Homo sapiens
acactttatcaatattcaaaaa

SEQ ID NO: 9228232 - DNA, 22 bp, Homo sapiens
acactttatcaatattcaaaaa

SEQ ID NO: 9228233 - DNA, 22 bp, Homo sapiens
acactttatcaatattcaaaaa

SEQ ID NO: 9228234 - DNA, 22 bp, Homo sapiens
acactttatcaatattcaaaaa

SEQ ID NO: 9228235 - DNA, 22 bp, Homo sapiens
acactttgctacatttcatatt

SEQ ID NO: 9228236 - DNA, 22 bp, Homo sapiens
acactttgggctggataattat

SEQ ID NO: 9228237 - DNA, 22 bp, Homo sapiens
acactttgtcctttttcattgt

SEQ ID NO: 9228238 - DNA, 22 bp, Homo sapiens
acactttgaagatggaaacttg

SEQ ID NO: 9228239 - DNA, 22 bp, Homo sapiens
acactttgaagatggaaacttg

SEQ ID NO: 9228240 - DNA, 22 bp, Homo sapiens
acactttgatagataatgcagg

SEQ ID NO: 9228241 - DNA, 22 bp, Homo sapiens
acactttgttgtggcatatacg

SEQ ID NO: 9228242 - DNA, 22 bp, Homo sapiens
agccaggggattcatcagggac

SEQ ID NO: 9228243 - DNA, 22 bp, Homo sapiens
acagacagattttgtctgatgt

SEQ ID NO: 9228244 - DNA, 22 bp, Homo sapiens
acagacagattttgtctgatgt

SEQ ID NO: 9228245 - DNA, 22 bp, Homo sapiens
acagacagaggctccatgagga

SEQ ID NO: 9228246 - DNA, 22 bp, Homo sapiens
acagacagaggctccatgagga

SEQ ID NO: 9228247 - DNA, 22 bp, Homo sapiens
acagaattaatgaaaattacaa

SEQ ID NO: 9228248 - DNA, 22 bp, Homo sapiens
acagaattaatgaaaattacaa

SEQ ID NO: 9228249 - DNA, 20 bp, Homo sapiens
acagaaagagagaatgtcag

SEQ ID NO: 9228250 - DNA, 22 bp, Homo sapiens
agagccaggcggctgggcacct

SEQ ID NO: 9228251 - DNA, 22 bp, Homo sapiens
agagacaggatatctgctcatg

SEQ ID NO: 9228252 - DNA, 22 bp, Homo sapiens
agagacagggttttgccatgtt

SEQ ID NO: 9228253 - DNA, 22 bp, Homo sapiens
agagcaggtggcaactctggga

SEQ ID NO: 9228254 - DNA, 22 bp, Homo sapiens
agagacagggttttgccatgtt

SEQ ID NO: 9228255 - DNA, 22 bp, Homo sapiens
agagacagggttttgccatgtt

SEQ ID NO: 9228256 - DNA, 22 bp, Homo sapiens
agagccaggctcccatggggca

SEQ ID NO: 9228257 - DNA, 22 bp, Homo sapiens
agagccaggctcccatggggca

SEQ ID NO: 9228258 - DNA, 22 bp, Homo sapiens
agagccagttacaactgtggag

SEQ ID NO: 9228259 - DNA, 22 bp, Homo sapiens
agagccagttacaactgtggag

SEQ ID NO: 9228260 - DNA, 22 bp, Homo sapiens
agagccagttaagcacttacag

SEQ ID NO: 9228261 - DNA, 22 bp, Homo sapiens
aattctgatgaataaatcatcc

SEQ ID NO: 9228262 - DNA, 22 bp, Homo sapiens
aattctgatgagtcagagaaag

SEQ ID NO: 9228263 - DNA, 22 bp, Homo sapiens
aattccatccatttgtttcaac

SEQ ID NO: 9228264 - DNA, 22 bp, Homo sapiens
aattctgaggagggaagaggaa

SEQ ID NO: 9228265 - DNA, 22 bp, Homo sapiens
aattccatatctgtgattatta

SEQ ID NO: 9228266 - DNA, 22 bp, Homo sapiens
agagcctggaggttctgctgaa

SEQ ID NO: 9228267 - DNA, 22 bp, Homo sapiens
agagcctggaggttctgctgaa

SEQ ID NO: 9228268 - DNA, 22 bp, Homo sapiens
agagcctggcaaaaggtcctgc

SEQ ID NO: 9228269 - DNA, 22 bp, Homo sapiens
agagcctggacctgggctctga

SEQ ID NO: 9228270 - DNA, 22 bp, Homo sapiens
agagcctggacttttctgagcc

SEQ ID NO: 9228271 - DNA, 22 bp, Homo sapiens
agagccagttgttaagcactta

SEQ ID NO: 9228272 - DNA, 22 bp, Homo sapiens
agagcctgcatctagcctcaga

SEQ ID NO: 9228273 - DNA, 22 bp, Homo sapiens
agagcctgcatctagcctcaga

SEQ ID NO: 9228274 - DNA, 22 bp, Homo sapiens
agagcctggacctgagctacaa

SEQ ID NO: 9228275 - DNA, 22 bp, Homo sapiens
agagcctggacctgggctctga

SEQ ID NO: 9228276 - DNA, 22 bp, Homo sapiens
agagcctggacctgagctacaa

SEQ ID NO: 9228277 - DNA, 22 bp, Homo sapiens
agagcctggacctgagctacaa

SEQ ID NO: 9228278 - DNA, 22 bp, Homo sapiens
agagcctgctgtgtaagtcaca

SEQ ID NO: 9228279 - DNA, 20 bp, Homo sapiens
agagcctggaaaaagacatc

SEQ ID NO: 9228280 - DNA, 22 bp, Homo sapiens
agagcctgctacctcattccag

SEQ ID NO: 9228281 - DNA, 22 bp, Homo sapiens
agagcctgctgtgtaagtcaca

SEQ ID NO: 9228282 - DNA, 22 bp, Homo sapiens
aattaaaagataacccatgagt

SEQ ID NO: 9228283 - DNA, 22 bp, Homo sapiens
aattaaaagataacccatgagt

SEQ ID NO: 9228284 - DNA, 22 bp, Homo sapiens
aattaaaaaaggagagcttgct

SEQ ID NO: 9228285 - DNA, 22 bp, Homo sapiens
aattaaaaaaggagagcttgct

SEQ ID NO: 9228286 - DNA, 22 bp, Homo sapiens
aattaaaaaaggagagcttgct

SEQ ID NO: 9228287 - DNA, 22 bp, Homo sapiens
aattaaaagataacccatgagt

SEQ ID NO: 9228288 - DNA, 22 bp, Homo sapiens
aattaacaaatgtagctgtgat

SEQ ID NO: 9228289 - DNA, 22 bp, Homo sapiens
aattaacagagggcttattact

SEQ ID NO: 9228290 - DNA, 22 bp, Homo sapiens
agagacagatctgagggacctc

SEQ ID NO: 9228291 - DNA, 22 bp, Homo sapiens
agagacaggatatctgctcatg

SEQ ID NO: 9228292 - DNA, 22 bp, Homo sapiens
agagacaggatatctgctcatg

SEQ ID NO: 9228293 - DNA, 22 bp, Homo sapiens
agaccctgtcagtgttaggaaa

SEQ ID NO: 9228294 - DNA, 20 bp, Homo sapiens
agaccctgtgtcctgtggcc

SEQ ID NO: 9228295 - DNA, 20 bp, Homo sapiens
agaccctgtgtcctgtggcc

SEQ ID NO: 9228296 - DNA, 22 bp, Homo sapiens
agaccctgtcagtgttaggaaa

SEQ ID NO: 9228297 - DNA, 22 bp, Homo sapiens
aattaaaaaaggagagcttgct

SEQ ID NO: 9228298 - DNA, 22 bp, Homo sapiens
aattaaaaaaggagagcttgct

SEQ ID NO: 9228299 - DNA, 22 bp, Homo sapiens
agaccctgcattttccagggtt

SEQ ID NO: 9228300 - DNA, 22 bp, Homo sapiens
agaccctgcacctctcgtgggc

SEQ ID NO: 9228301 - DNA, 22 bp, Homo sapiens
agaccctgcacctctcgtgggc

SEQ ID NO: 9228302 - DNA, 22 bp, Homo sapiens
agaccccctttaatggaagtgc

SEQ ID NO: 9228303 - DNA, 22 bp, Homo sapiens
aatgtgtacatgacagatagaa

SEQ ID NO: 9228304 - DNA, 22 bp, Homo sapiens
aatgtggggaagccatggctga

SEQ ID NO: 9228305 - DNA, 22 bp, Homo sapiens
aatggcaagctgaactcagaag

SEQ ID NO: 9228306 - DNA, 22 bp, Homo sapiens
aatggcacctgctatatactga

SEQ ID NO: 9228307 - DNA, 22 bp, Homo sapiens
aatggcaccttcaagaagaaaa

SEQ ID NO: 9228308 - DNA, 22 bp, Homo sapiens
aatggcaccttcaagaagaaaa

SEQ ID NO: 9228309 - DNA, 22 bp, Homo sapiens
aatggcaagctgaactcagaag

SEQ ID NO: 9228310 - DNA, 22 bp, Homo sapiens
aatggcaaggaaaccgttacca

SEQ ID NO: 9228311 - DNA, 22 bp, Homo sapiens
aatggcacaagagtaaactgtt

SEQ ID NO: 9228312 - DNA, 22 bp, Homo sapiens
agacaattagcacatcacgggg

SEQ ID NO: 9228313 - DNA, 22 bp, Homo sapiens
aatggcagaggcaaagatggta

SEQ ID NO: 9228314 - DNA, 22 bp, Homo sapiens
aatggcagaatgggccagaagc

SEQ ID NO: 9228315 - DNA, 22 bp, Homo sapiens
aatgggataatagaagtagaat

SEQ ID NO: 9228316 - DNA, 22 bp, Homo sapiens
aatgggattaagaaagatcttg

SEQ ID NO: 9228317 - DNA, 22 bp, Homo sapiens
aatgggaagccagaagacaagg

SEQ ID NO: 9228318 - DNA, 22 bp, Homo sapiens
aatgggaagtcactactgttac

SEQ ID NO: 9228319 - DNA, 23 bp, Homo sapiens
agaagcagcttctggagtatcgg

SEQ ID NO: 9228320 - DNA, 22 bp, Homo sapiens
agaagcagctttcaaggtgatt

SEQ ID NO: 9228321 - DNA, 22 bp, Homo sapiens
agaagcagactctgaggcaagg

SEQ ID NO: 9228322 - DNA, 22 bp, Homo sapiens
agacaatgtcaaggtgatcatc

SEQ ID NO: 9228323 - DNA, 22 bp, Homo sapiens
agacaatggagggaaatacttc

SEQ ID NO: 9228324 - DNA, 22 bp, Homo sapiens
agacaatggctaagtaacctgt

SEQ ID NO: 9228325 - DNA, 21 bp, Homo sapiens
agacaatgctgtaaaattcag

SEQ ID NO: 9228326 - DNA, 22 bp, Homo sapiens
agacaatggaccaagcaccttc

SEQ ID NO: 9228327 - DNA, 22 bp, Homo sapiens
agacaatggagagcagagtact

SEQ ID NO: 9228328 - DNA, 22 bp, Homo sapiens
aatggttacagaaatgaaagta

SEQ ID NO: 9228329 - DNA, 22 bp, Homo sapiens
aatggtttaacatatgcttgag

SEQ ID NO: 9228330 - DNA, 23 bp, Homo sapiens
aatggtcttcctccacccctctg

SEQ ID NO: 9228331 - DNA, 22 bp, Homo sapiens
aatggtttggactattcaatag

SEQ ID NO: 9228332 - DNA, 22 bp, Homo sapiens
aatggtttgtacctgtccttgg

SEQ ID NO: 9228333 - DNA, 22 bp, Homo sapiens
aatgggataggtcttcaggaat

SEQ ID NO: 9228334 - DNA, 23 bp, Homo sapiens
aatgggtgcaactatccatgaca

SEQ ID NO: 9228335 - DNA, 22 bp, Homo sapiens
aatgggttgctttccacagcct

SEQ ID NO: 9228336 - DNA, 22 bp, Homo sapiens
aatgggtttctgtcccagctct

SEQ ID NO: 9228337 - DNA, 22 bp, Homo sapiens
aatggtaatttgcagaaagtcc

SEQ ID NO: 9228338 - DNA, 22 bp, Homo sapiens
aatgtaaaatatcttgtacttg

SEQ ID NO: 9228339 - DNA, 18 bp, Homo sapiens
aatgtgaatatttacttc

SEQ ID NO: 9228340 - DNA, 22 bp, Homo sapiens
aatgtgaactttgtcatgtaac

SEQ ID NO: 9228341 - DNA, 22 bp, Homo sapiens
aatgtgagccaatgcccgtggg

SEQ ID NO: 9228342 - DNA, 22 bp, Homo sapiens
agaggctgttacactcccagat

SEQ ID NO: 9228343 - DNA, 22 bp, Homo sapiens
agaggctgttacactcccagat

SEQ ID NO: 9228344 - DNA, 22 bp, Homo sapiens
agaggctgttacactcccagat

SEQ ID NO: 9228345 - DNA, 22 bp, Homo sapiens
agaggctgagaaaccctcttct

SEQ ID NO: 9228346 - DNA, 22 bp, Homo sapiens
agaggctgatggagtagtgtct

SEQ ID NO: 9228347 - DNA, 22 bp, Homo sapiens
agaggctgtgcccaccaggcaa

SEQ ID NO: 9228348 - DNA, 19 bp, Homo sapiens
acaaagctgtgagcagctt

SEQ ID NO: 9228349 - DNA, 22 bp, Homo sapiens
acaaagcttagacctaagagat

SEQ ID NO: 9228350 - DNA, 22 bp, Homo sapiens
acaaagcttagacctaagagat

SEQ ID NO: 9228351 - DNA, 20 bp, Homo sapiens
agaggcttccttgggaggag

SEQ ID NO: 9228352 - DNA, 22 bp, Homo sapiens
agaggcttcctgccacctgaga

SEQ ID NO: 9228353 - DNA, 22 bp, Homo sapiens
acaaagaaggaattggtcttta

SEQ ID NO: 9228354 - DNA, 22 bp, Homo sapiens
agagggggtgttccagaagcat

SEQ ID NO: 9228355 - DNA, 22 bp, Homo sapiens
agagggggtgtcagcactgcag

SEQ ID NO: 9228356 - DNA, 22 bp, Homo sapiens
agagggggtgtcagcactgcag

SEQ ID NO: 9228357 - DNA, 22 bp, Homo sapiens
agagggggaaaatagaggtgtt

SEQ ID NO: 9228358 - DNA, 22 bp, Homo sapiens
agagggggaaaatagaggtgtt

SEQ ID NO: 9228359 - DNA, 22 bp, Homo sapiens
agagggggaaaatagaggtgtt

SEQ ID NO: 9228360 - DNA, 22 bp, Homo sapiens
acaaagtaggtcatcaaagctc

SEQ ID NO: 9228361 - DNA, 22 bp, Homo sapiens
acaaagtaggtcatcaaagctc

SEQ ID NO: 9228362 - DNA, 22 bp, Homo sapiens
acaaaggtgagcagaagacaca

SEQ ID NO: 9228363 - DNA, 18 bp, Homo sapiens
acaaaggtctgcaagacc

SEQ ID NO: 9228364 - DNA, 22 bp, Homo sapiens
aattgcatgttaatgactaagt

SEQ ID NO: 9228365 - DNA, 22 bp, Homo sapiens
aattgcataaaattcaactctg

SEQ ID NO: 9228366 - DNA, 22 bp, Homo sapiens
aattgcactttagcaatggtga

SEQ ID NO: 9228367 - DNA, 22 bp, Homo sapiens
aattgatggacagagatgaaga

SEQ ID NO: 9228368 - DNA, 22 bp, Homo sapiens
aattcttaatcccataaagtga

SEQ ID NO: 9228369 - DNA, 22 bp, Homo sapiens
aattcttaatcccataaagtga

SEQ ID NO: 9228370 - DNA, 22 bp, Homo sapiens
aattgaacaagtaatagaagag

SEQ ID NO: 9228371 - DNA, 22 bp, Homo sapiens
agaggctcttgcccttcccaca

SEQ ID NO: 9228372 - DNA, 22 bp, Homo sapiens
agaggctctggtgggagttggt

SEQ ID NO: 9228373 - DNA, 22 bp, Homo sapiens
agaggctctggtgcagcatgca

SEQ ID NO: 9228374 - DNA, 22 bp, Homo sapiens
agaggctgaatgatgtcatcat

SEQ ID NO: 9228375 - DNA, 22 bp, Homo sapiens
agaggctgagaaaccctcttct

SEQ ID NO: 9228376 - DNA, 22 bp, Homo sapiens
agaggctgaatgatgtcatcat

SEQ ID NO: 9228377 - DNA, 22 bp, Homo sapiens
agaggccctctctctcctgatg

SEQ ID NO: 9228378 - DNA, 22 bp, Homo sapiens
aattgcttagttgcaactatgc

SEQ ID NO: 9228379 - DNA, 22 bp, Homo sapiens
aattgcttcattaacatttagg

SEQ ID NO: 9228380 - DNA, 22 bp, Homo sapiens
aattgcttcattaacatttagg

SEQ ID NO: 9228381 - DNA, 22 bp, Homo sapiens
acaatgatgcagatgagtaaga

SEQ ID NO: 9228382 - DNA, 22 bp, Homo sapiens
acaatgaccaaaatgtttccag

SEQ ID NO: 9228383 - DNA, 22 bp, Homo sapiens
acaatgaatttaataccttatt

SEQ ID NO: 9228384 - DNA, 22 bp, Homo sapiens
acaatgaatttaataccttatt

SEQ ID NO: 9228385 - DNA, 19 bp, Homo sapiens
acaatgaatgtgttctctt

SEQ ID NO: 9228386 - DNA, 22 bp, Homo sapiens
acaatgaatatcatgaagtact

SEQ ID NO: 9228387 - DNA, 19 bp, Homo sapiens
acaatgaatgtgttctctt

SEQ ID NO: 9228388 - DNA, 22 bp, Homo sapiens
acaatgaatatcatgaagtact

SEQ ID NO: 9228389 - DNA, 22 bp, Homo sapiens
acaatgaagctccactgagctt

SEQ ID NO: 9228390 - DNA, 22 bp, Homo sapiens
acaatgaagggagacacttgct

SEQ ID NO: 9228391 - DNA, 22 bp, Homo sapiens
acaatgaagataatgttgcagt

SEQ ID NO: 9228392 - DNA, 22 bp, Homo sapiens
acaatgaagataatgttgcagt

SEQ ID NO: 9228393 - DNA, 22 bp, Homo sapiens
acaatgaacgctttttaactgt

SEQ ID NO: 9228394 - DNA, 22 bp, Homo sapiens
acaatgaacgctttttaactgt

SEQ ID NO: 9228395 - DNA, 22 bp, Homo sapiens
acaatgaaccaaatttaccaat

SEQ ID NO: 9228396 - DNA, 22 bp, Homo sapiens
acaatgaaaggtattctgaact

SEQ ID NO: 9228397 - DNA, 22 bp, Homo sapiens
acaatgaacacacaaggaattc

SEQ ID NO: 9228398 - DNA, 22 bp, Homo sapiens
acaatcccacaagaaacactgg

SEQ ID NO: 9228399 - DNA, 22 bp, Homo sapiens
acaatgaaaaaatttactgtgg

SEQ ID NO: 9228400 - DNA, 22 bp, Homo sapiens
acaatgaaaaaatttactgtgg

SEQ ID NO: 9228401 - DNA, 22 bp, Homo sapiens
acaagcagagattaaatgtttt

SEQ ID NO: 9228402 - DNA, 22 bp, Homo sapiens
acaagcagagattaaatgtttt

SEQ ID NO: 9228403 - DNA, 22 bp, Homo sapiens
acaagatttaatgcaacccaag

SEQ ID NO: 9228404 - DNA, 22 bp, Homo sapiens
acaagatttggctgaaactcca

SEQ ID NO: 9228405 - DNA, 23 bp, Homo sapiens
acaagatagggataaaaagataa

SEQ ID NO: 9228406 - DNA, 23 bp, Homo sapiens
acaagatagggataaaaagataa

SEQ ID NO: 9228407 - DNA, 22 bp, Homo sapiens
acaagataggttgagtctagcc

SEQ ID NO: 9228408 - DNA, 22 bp, Homo sapiens
acaagcatcaggttcagcaata

SEQ ID NO: 9228409 - DNA, 22 bp, Homo sapiens
acaagcatgggctttgacatca

SEQ ID NO: 9228410 - DNA, 22 bp, Homo sapiens
acaagcatgtggtaaaaagacc

SEQ ID NO: 9228411 - DNA, 22 bp, Homo sapiens
acaagcatgtggtaaaaagacc

SEQ ID NO: 9228412 - DNA, 17 bp, Homo sapiens
acaagcagtggccatgg

SEQ ID NO: 9228413 - DNA, 22 bp, Homo sapiens
acaagcataagtgagatgaata

SEQ ID NO: 9228414 - DNA, 22 bp, Homo sapiens
acaagctccttattcagctggg

SEQ ID NO: 9228415 - DNA, 22 bp, Homo sapiens
acaatagacaaagtgaatggct

SEQ ID NO: 9228416 - DNA, 22 bp, Homo sapiens
acaatagacaaagtgaatggct

SEQ ID NO: 9228417 - DNA, 22 bp, Homo sapiens
acaagagacaagaggttcttct

SEQ ID NO: 9228418 - DNA, 22 bp, Homo sapiens
acaagaattatttctagttaac

SEQ ID NO: 9228419 - DNA, 22 bp, Homo sapiens
acaagaattatttctagttaac

SEQ ID NO: 9228420 - DNA, 22 bp, Homo sapiens
acaagaatttacatgtagtgga

SEQ ID NO: 9228421 - DNA, 22 bp, Homo sapiens
acaagaatttacatgtagtgga

SEQ ID NO: 9228422 - DNA, 22 bp, Homo sapiens
acaagatagcttagaagattca

SEQ ID NO: 9228423 - DNA, 22 bp, Homo sapiens
agataacttttgggtattcatg

SEQ ID NO: 9228424 - DNA, 22 bp, Homo sapiens
agataagatagtccagcacaat

SEQ ID NO: 9228425 - DNA, 22 bp, Homo sapiens
agataatgaatttattgaatgt

SEQ ID NO: 9228426 - DNA, 22 bp, Homo sapiens
agataataagtctggtaataat

SEQ ID NO: 9228427 - DNA, 22 bp, Homo sapiens
agataacatttattgaatgtaa

SEQ ID NO: 9228428 - DNA, 22 bp, Homo sapiens
agataaattcctaagatttcag

SEQ ID NO: 9228429 - DNA, 17 bp, Homo sapiens
acaacagaaatgtattc

SEQ ID NO: 9228430 - DNA, 22 bp, Homo sapiens
agaggggttaagtgctagtccg

SEQ ID NO: 9228431 - DNA, 22 bp, Homo sapiens
acaacaatctaccctagcttct

SEQ ID NO: 9228432 - DNA, 22 bp, Homo sapiens
acaacacagcaaaaccccatct

SEQ ID NO: 9228433 - DNA, 22 bp, Homo sapiens
agaagcagaaggaagcagggcc

SEQ ID NO: 9228434 - DNA, 22 bp, Homo sapiens
agaagcagaaggaagcagggcc

SEQ ID NO: 9228435 - DNA, 22 bp, Homo sapiens
agaagcagaaaagggcactttt

SEQ ID NO: 9228436 - DNA, 22 bp, Homo sapiens
aatgcaaacagcccagaatcca

SEQ ID NO: 9228437 - DNA, 22 bp, Homo sapiens
aatgatgtgagtttttattctc

SEQ ID NO: 9228438 - DNA, 22 bp, Homo sapiens
aatgattgcaaacattgagaac

SEQ ID NO: 9228439 - DNA, 22 bp, Homo sapiens
aatgattactgatcgcatagga

SEQ ID NO: 9228440 - DNA, 23 bp, Homo sapiens
aatgatttcatgatgatagcagc

SEQ ID NO: 9228441 - DNA, 22 bp, Homo sapiens
aatgatgagttctaatagaccc

SEQ ID NO: 9228442 - DNA, 22 bp, Homo sapiens
aatgatggatttagacaagctg

SEQ ID NO: 9228443 - DNA, 22 bp, Homo sapiens
aatgatggttaaacactggagg

SEQ ID NO: 9228444 - DNA, 22 bp, Homo sapiens
aatgatggtttcatcacttgaa

SEQ ID NO: 9228445 - DNA, 22 bp, Homo sapiens
agaaattatgcagtagttttat

SEQ ID NO: 9228446 - DNA, 22 bp, Homo sapiens
agaaatgacacacatgagacat

SEQ ID NO: 9228447 - DNA, 22 bp, Homo sapiens
agaaatgacacacatgagacat

SEQ ID NO: 9228448 - DNA, 22 bp, Homo sapiens
agaacaatgcgtattttactcc

SEQ ID NO: 9228449 - DNA, 20 bp, Homo sapiens
agaacaagtactaaaggaga

SEQ ID NO: 9228450 - DNA, 22 bp, Homo sapiens
aatgatgagaactggagtaatt

SEQ ID NO: 9228451 - DNA, 22 bp, Homo sapiens
agaaatgacaagactgatcagg

SEQ ID NO: 9228452 - DNA, 22 bp, Homo sapiens
agaaatgaaaccaaagcctaga

SEQ ID NO: 9228453 - DNA, 22 bp, Homo sapiens
agaaatagaggaaaggtttgac

SEQ ID NO: 9228454 - DNA, 22 bp, Homo sapiens
aatcaggatgactgtcatttca

SEQ ID NO: 9228455 - DNA, 22 bp, Homo sapiens
aatcaggagtgtgcactttgat

SEQ ID NO: 9228456 - DNA, 22 bp, Homo sapiens
aatcagctaaataaactagtca

SEQ ID NO: 9228457 - DNA, 22 bp, Homo sapiens
aatcagcaggcttctaaatttt

SEQ ID NO: 9228458 - DNA, 22 bp, Homo sapiens
aatcagcaaatgcttactcagg

SEQ ID NO: 9228459 - DNA, 22 bp, Homo sapiens
aatcagaatcagttgacacagc

SEQ ID NO: 9228460 - DNA, 15 bp, Homo sapiens
aatcagaagtgtggc

SEQ ID NO: 9228461 - DNA, 22 bp, Homo sapiens
aatcagaatcagttgacacagc

SEQ ID NO: 9228462 - DNA, 22 bp, Homo sapiens
aatcagaaattgagggtctggt

SEQ ID NO: 9228463 - DNA, 22 bp, Homo sapiens
aatcagaatttattgaatcttt

SEQ ID NO: 9228464 - DNA, 22 bp, Homo sapiens
aatcagaaattctacatcacaa

SEQ ID NO: 9228465 - DNA, 22 bp, Homo sapiens
aatcagaaccttgggtcataac

SEQ ID NO: 9228466 - DNA, 22 bp, Homo sapiens
aatcagaacgctcgatcttcgg

SEQ ID NO: 9228467 - DNA, 22 bp, Homo sapiens
aatcagaaccttgggtcataac

SEQ ID NO: 9228468 - DNA, 22 bp, Homo sapiens
aatcagaactcctaccacagag

SEQ ID NO: 9228469 - DNA, 22 bp, Homo sapiens
aatcagaacttctcagggtggg

SEQ ID NO: 9228470 - DNA, 22 bp, Homo sapiens
aatcagagaagtttcctatgcc

SEQ ID NO: 9228471 - DNA, 22 bp, Homo sapiens
aatcagaatttgtcccctgagt

SEQ ID NO: 9228472 - DNA, 22 bp, Homo sapiens
aatactgagatcccacaaagca

SEQ ID NO: 9228473 - DNA, 20 bp, Homo sapiens
aatactaaacacaaagcagt

SEQ ID NO: 9228474 - DNA, 22 bp, Homo sapiens
aatactatgtagccaaaataat

SEQ ID NO: 9228475 - DNA, 22 bp, Homo sapiens
aatactatgtagccaaaataat

SEQ ID NO: 9228476 - DNA, 22 bp, Homo sapiens
aatactatgtagccaaaataat

SEQ ID NO: 9228477 - DNA, 22 bp, Homo sapiens
actgggctgtggacacccagcg

SEQ ID NO: 9228478 - DNA, 22 bp, Homo sapiens
actgggcttcacttggcacatc

SEQ ID NO: 9228479 - DNA, 22 bp, Homo sapiens
aatatagttctagaaatatttt

SEQ ID NO: 9228480 - DNA, 22 bp, Homo sapiens
aatatagttctagaaatatttt

SEQ ID NO: 9228481 - DNA, 22 bp, Homo sapiens
aatatagttctagaaatatttt

SEQ ID NO: 9228482 - DNA, 22 bp, Homo sapiens
aatatagctcactataccatgg

SEQ ID NO: 9228483 - DNA, 22 bp, Homo sapiens
aatatagctcactataccatgg

SEQ ID NO: 9228484 - DNA, 22 bp, Homo sapiens
aatagtctctcccacaccatcc

SEQ ID NO: 9228485 - DNA, 22 bp, Homo sapiens
aatagtagtcgccttttgtaag

SEQ ID NO: 9228486 - DNA, 22 bp, Homo sapiens
aatagtatttatttggaaaaag

SEQ ID NO: 9228487 - DNA, 22 bp, Homo sapiens
aatatactatactactttctgg

SEQ ID NO: 9228488 - DNA, 22 bp, Homo sapiens
aatatactatactactttctgg

SEQ ID NO: 9228489 - DNA, 22 bp, Homo sapiens
aatatagcattgtatgactgtg

SEQ ID NO: 9228490 - DNA, 22 bp, Homo sapiens
aatatagcattgtatgactgtg

SEQ ID NO: 9228491 - DNA, 22 bp, Homo sapiens
actttgaaatgtgtaagagaga

SEQ ID NO: 9228492 - DNA, 22 bp, Homo sapiens
aatcacatctcattcaacagcc

SEQ ID NO: 9228493 - DNA, 22 bp, Homo sapiens
actttgaaactaaaattcatta

SEQ ID NO: 9228494 - DNA, 22 bp, Homo sapiens
aatcagaaaggctaaggaagca

SEQ ID NO: 9228495 - DNA, 20 bp, Homo sapiens
aatcagaaagtgtgagctct

SEQ ID NO: 9228496 - DNA, 19 bp, Homo sapiens
aatcagaaatatcgaggcc

SEQ ID NO: 9228497 - DNA, 22 bp, Homo sapiens
aatcagaaagatcttgatgaga

SEQ ID NO: 9228498 - DNA, 22 bp, Homo sapiens
aatcagaaagaggtcatgttgc

SEQ ID NO: 9228499 - DNA, 22 bp, Homo sapiens
aatcacatgaaaactgtgtgtt

SEQ ID NO: 9228500 - DNA, 22 bp, Homo sapiens
actttcttaggctgtataaatg

SEQ ID NO: 9228501 - DNA, 22 bp, Homo sapiens
actttcttaggctgtataaatg

SEQ ID NO: 9228502 - DNA, 22 bp, Homo sapiens
actttcttatccatgatctcac

SEQ ID NO: 9228503 - DNA, 22 bp, Homo sapiens
actttcttctactacttggaga

SEQ ID NO: 9228504 - DNA, 22 bp, Homo sapiens
actttatttcctattgcatcca

SEQ ID NO: 9228505 - DNA, 22 bp, Homo sapiens
actttatttcctattgcatcca

SEQ ID NO: 9228506 - DNA, 22 bp, Homo sapiens
actttctgtcatctagacaagt

SEQ ID NO: 9228507 - DNA, 21 bp, Homo sapiens
actttctgtgggttcaagcat

SEQ ID NO: 9228508 - DNA, 22 bp, Homo sapiens
actttctgtggttaccagggag

SEQ ID NO: 9228509 - DNA, 22 bp, Homo sapiens
actttctgttagatgaatggat

SEQ ID NO: 9228510 - DNA, 22 bp, Homo sapiens
actgttgaagtgccagcttgat

SEQ ID NO: 9228511 - DNA, 22 bp, Homo sapiens
actgttctgccaagatcaacgt

SEQ ID NO: 9228512 - DNA, 19 bp, Homo sapiens
actgttctaacttgcagct

SEQ ID NO: 9228513 - DNA, 23 bp, Homo sapiens
actttattgaccccaggtcagtt

SEQ ID NO: 9228514 - DNA, 22 bp, Homo sapiens
actttatgtttgatatctatgg

SEQ ID NO: 9228515 - DNA, 20 bp, Homo sapiens
actttatgagttcaattttg

SEQ ID NO: 9228516 - DNA, 22 bp, Homo sapiens
actgaggttgaaatagtgatgt

SEQ ID NO: 9228517 - DNA, 22 bp, Homo sapiens
actgaggttgtagtaggaattc

SEQ ID NO: 9228518 - DNA, 21 bp, Homo sapiens
actgaggttagatgccttgcc

SEQ ID NO: 9228519 - DNA, 20 bp, Homo sapiens
actgaggttagataacaggt

SEQ ID NO: 9228520 - DNA, 22 bp, Homo sapiens
actgaggttattgcaataaaat

SEQ ID NO: 9228521 - DNA, 22 bp, Homo sapiens
actgagtgtaggactttgagtt

SEQ ID NO: 9228522 - DNA, 22 bp, Homo sapiens
actgaggtttttagtgttaaat

SEQ ID NO: 9228523 - DNA, 22 bp, Homo sapiens
actgaggtttacttgaaggaga

SEQ ID NO: 9228524 - DNA, 22 bp, Homo sapiens
actgaggtttcattttatcgct

SEQ ID NO: 9228525 - DNA, 22 bp, Homo sapiens
actgaggtttacttgaaggaga

SEQ ID NO: 9228526 - DNA, 22 bp, Homo sapiens
actgatacggttttagagtcca

SEQ ID NO: 9228527 - DNA, 22 bp, Homo sapiens
actgagttatgggtatgccttg

SEQ ID NO: 9228528 - DNA, 22 bp, Homo sapiens
actgatcacagatatgtatatt

SEQ ID NO: 9228529 - DNA, 22 bp, Homo sapiens
actgatcaagggtttaatttta

SEQ ID NO: 9228530 - DNA, 22 bp, Homo sapiens
actgcactccaacctgggtgac

SEQ ID NO: 9228531 - DNA, 22 bp, Homo sapiens
actgcactccagcctcggggtc

SEQ ID NO: 9228532 - DNA, 22 bp, Homo sapiens
actctgcttattgctgcaggca

SEQ ID NO: 9228533 - DNA, 22 bp, Homo sapiens
actctggcaagcttccacttcc

SEQ ID NO: 9228534 - DNA, 21 bp, Homo sapiens
actctgctgcgggcttggcct

SEQ ID NO: 9228535 - DNA, 22 bp, Homo sapiens
actgagagaacgggctgctccc

SEQ ID NO: 9228536 - DNA, 23 bp, Homo sapiens
actgaggtactgaggttgtgaca

SEQ ID NO: 9228537 - DNA, 22 bp, Homo sapiens
actgaggtataattgacataac

SEQ ID NO: 9228538 - DNA, 22 bp, Homo sapiens
actgaggtagggcacacctagg

SEQ ID NO: 9228539 - DNA, 22 bp, Homo sapiens
actgaggtagggcacacctagg

SEQ ID NO: 9228540 - DNA, 22 bp, Homo sapiens
actgaggtggggtctgcttgga

SEQ ID NO: 9228541 - DNA, 22 bp, Homo sapiens
actgaggtctcaggtggggaag

SEQ ID NO: 9228542 - DNA, 22 bp, Homo sapiens
actgaggtctatcatgagccag

SEQ ID NO: 9228543 - DNA, 22 bp, Homo sapiens
actgaggtctatcatgagccag

SEQ ID NO: 9228544 - DNA, 22 bp, Homo sapiens
actgaggtcatgcatagtttct

SEQ ID NO: 9228545 - DNA, 22 bp, Homo sapiens
actgaggtcaggggtatgtgat

SEQ ID NO: 9228546 - DNA, 22 bp, Homo sapiens
actggagtaaaggtcacttgtg

SEQ ID NO: 9228547 - DNA, 16 bp, Homo sapiens
actggagtggggatgc

SEQ ID NO: 9228548 - DNA, 22 bp, Homo sapiens
actggagttattatttgcagct

SEQ ID NO: 9228549 - DNA, 20 bp, Homo sapiens
actggagttcatgctaagag

SEQ ID NO: 9228550 - DNA, 22 bp, Homo sapiens
actggagttcatggtaaagtca

SEQ ID NO: 9228551 - DNA, 22 bp, Homo sapiens
actggagttgattacataaaac

SEQ ID NO: 9228552 - DNA, 22 bp, Homo sapiens
actggagtgtttggaggatgca

SEQ ID NO: 9228553 - DNA, 22 bp, Homo sapiens
actggagtgagtatcgatgaac

SEQ ID NO: 9228554 - DNA, 22 bp, Homo sapiens
actggagtccagacccaagagg

SEQ ID NO: 9228555 - DNA, 22 bp, Homo sapiens
actggagtcagggaaaaagtgt

SEQ ID NO: 9228556 - DNA, 22 bp, Homo sapiens
actggagtagatctgactgagt

SEQ ID NO: 9228557 - DNA, 22 bp, Homo sapiens
actggagtattgtttaatacca

SEQ ID NO: 9228558 - DNA, 22 bp, Homo sapiens
actggagtacagtggcgtgaac

SEQ ID NO: 9228559 - DNA, 20 bp, Homo sapiens
actggagtaccctagagaag

SEQ ID NO: 9228560 - DNA, 22 bp, Homo sapiens
actggactcacgtattcctgag

SEQ ID NO: 9228561 - DNA, 18 bp, Homo sapiens
actggagcattagcagct

SEQ ID NO: 9228562 - DNA, 22 bp, Homo sapiens
actgctaaatctccatcgatta

SEQ ID NO: 9228563 - DNA, 22 bp, Homo sapiens
actgctagtgagaaaataacca

SEQ ID NO: 9228564 - DNA, 22 bp, Homo sapiens
actgcactccagcctgggtgac

SEQ ID NO: 9228565 - DNA, 22 bp, Homo sapiens
actggcccgggagcagaggcct

SEQ ID NO: 9228566 - DNA, 22 bp, Homo sapiens
actggcctatcagcatgagtct

SEQ ID NO: 9228567 - DNA, 22 bp, Homo sapiens
actggccaggagctggaaatac

SEQ ID NO: 9228568 - DNA, 22 bp, Homo sapiens
actggccaggcacagctgtggg

SEQ ID NO: 9228569 - DNA, 22 bp, Homo sapiens
actggccaggcgaaccacactg

SEQ ID NO: 9228570 - DNA, 22 bp, Homo sapiens
actggccaggcagcagtagctt

SEQ ID NO: 9228571 - DNA, 22 bp, Homo sapiens
aatacgtggttactctatagag

SEQ ID NO: 9228572 - DNA, 22 bp, Homo sapiens
aataccagagacagtgtttacc

SEQ ID NO: 9228573 - DNA, 22 bp, Homo sapiens
acggtgctgggtattggggttc

SEQ ID NO: 9228574 - DNA, 22 bp, Homo sapiens
acgtagtgtgttgtggaaagag

SEQ ID NO: 9228575 - DNA, 22 bp, Homo sapiens
acgtgcaggatctggttggcga

SEQ ID NO: 9228576 - DNA, 22 bp, Homo sapiens
acgtcatcgttgtcatcgtcat

SEQ ID NO: 9228577 - DNA, 22 bp, Homo sapiens
acggggctagagaaggtttctt

SEQ ID NO: 9228578 - DNA, 22 bp, Homo sapiens
acgggtggctgaggaggcctct

SEQ ID NO: 9228579 - DNA, 22 bp, Homo sapiens
acggtgcagcctgtcccttctc

SEQ ID NO: 9228580 - DNA, 22 bp, Homo sapiens
acgggtggtaatgagaaaagga

SEQ ID NO: 9228581 - DNA, 22 bp, Homo sapiens
acctttatgaaacagctgtcgt

SEQ ID NO: 9228582 - DNA, 22 bp, Homo sapiens
acctttatggagaacttgggat

SEQ ID NO: 9228583 - DNA, 22 bp, Homo sapiens
acctaacttacctaggtccaca

SEQ ID NO: 9228584 - DNA, 22 bp, Homo sapiens
acctagaatttaaaacattgct

SEQ ID NO: 9228585 - DNA, 22 bp, Homo sapiens
acctacatggctttaagtaagt

SEQ ID NO: 9228586 - DNA, 20 bp, Homo sapiens
acgtggccaccagtggctta

SEQ ID NO: 9228587 - DNA, 20 bp, Homo sapiens
acgtggccaccagtggctta

SEQ ID NO: 9228588 - DNA, 20 bp, Homo sapiens
acgtggccaccagtggctta

SEQ ID NO: 9228589 - DNA, 22 bp, Homo sapiens
acgtggagagaatagggcacca

SEQ ID NO: 9228590 - DNA, 22 bp, Homo sapiens
aagtcctttatcctaaaaggtc

SEQ ID NO: 9228591 - DNA, 22 bp, Homo sapiens
aagtcgtggcaggcttgcacga

SEQ ID NO: 9228592 - DNA, 22 bp, Homo sapiens
aagtctcagaaaactagtgtgg

SEQ ID NO: 9228593 - DNA, 22 bp, Homo sapiens
aagtctctcatggctgacagca

SEQ ID NO: 9228594 - DNA, 22 bp, Homo sapiens
actacactccaattttctaggt

SEQ ID NO: 9228595 - DNA, 22 bp, Homo sapiens
aagtctctttacctctccaggc

SEQ ID NO: 9228596 - DNA, 22 bp, Homo sapiens
actatacaccaaaatattaagg

SEQ ID NO: 9228597 - DNA, 22 bp, Homo sapiens
actatacaccaaaatattaagg

SEQ ID NO: 9228598 - DNA, 22 bp, Homo sapiens
actagttttccataatatagga

SEQ ID NO: 9228599 - DNA, 22 bp, Homo sapiens
actataaaaggataaaccagaa

SEQ ID NO: 9228600 - DNA, 22 bp, Homo sapiens
actataaaaggataaaccagaa

SEQ ID NO: 9228601 - DNA, 22 bp, Homo sapiens
actatacattgaatgttaaggt

SEQ ID NO: 9228602 - DNA, 22 bp, Homo sapiens
actcactctttcaattgaaaga

SEQ ID NO: 9228603 - DNA, 22 bp, Homo sapiens
actcagaagatataatgactca

SEQ ID NO: 9228604 - DNA, 23 bp, Homo sapiens
actccccagtctcttcttgccaa

SEQ ID NO: 9228605 - DNA, 19 bp, Homo sapiens
actctacagtgtgtacaac

SEQ ID NO: 9228606 - DNA, 23 bp, Homo sapiens
actctcaggttctttccagcagg

SEQ ID NO: 9228607 - DNA, 22 bp, Homo sapiens
actctcagggacagggtctggg

SEQ ID NO: 9228608 - DNA, 22 bp, Homo sapiens
actctccctgctatccacttcc

SEQ ID NO: 9228609 - DNA, 22 bp, Homo sapiens
actctcccacgttcgactctaa

SEQ ID NO: 9228610 - DNA, 22 bp, Homo sapiens
actctcccagctatatgtggtg

SEQ ID NO: 9228611 - DNA, 22 bp, Homo sapiens
aaggagagtacaggagttggta

SEQ ID NO: 9228612 - DNA, 22 bp, Homo sapiens
aaggagagagctttgctggaac

SEQ ID NO: 9228613 - DNA, 22 bp, Homo sapiens
aaggagagtacaggagttggta

SEQ ID NO: 9228614 - DNA, 22 bp, Homo sapiens
aaggagctcccggcagaccagg

SEQ ID NO: 9228615 - DNA, 22 bp, Homo sapiens
aaggagcgcttagggggcagaa

SEQ ID NO: 9228616 - DNA, 22 bp, Homo sapiens
aaggagctatgcataactgatc

SEQ ID NO: 9228617 - DNA, 17 bp, Homo sapiens
aaggagctgagagatgg

SEQ ID NO: 9228618 - DNA, 22 bp, Homo sapiens
aagctggagagttaggtgaata

SEQ ID NO: 9228619 - DNA, 22 bp, Homo sapiens
aaggacaggctaacctgacatt

SEQ ID NO: 9228620 - DNA, 20 bp, Homo sapiens
aagctggaagaccagcattg

SEQ ID NO: 9228621 - DNA, 22 bp, Homo sapiens
aaggagacatttgcagagcacc

SEQ ID NO: 9228622 - DNA, 22 bp, Homo sapiens
aaggagaatttggcttgtgatg

SEQ ID NO: 9228623 - DNA, 22 bp, Homo sapiens
acagtgttgaggtgcttgtttc

SEQ ID NO: 9228624 - DNA, 22 bp, Homo sapiens
acagtgttgtatttagtttgat

SEQ ID NO: 9228625 - DNA, 22 bp, Homo sapiens
acagtgttgtggctcttaatag

SEQ ID NO: 9228626 - DNA, 22 bp, Homo sapiens
acagtgttgtggctcttaatag

SEQ ID NO: 9228627 - DNA, 22 bp, Homo sapiens
acagtgtttaaaataatatgct

SEQ ID NO: 9228628 - DNA, 22 bp, Homo sapiens
acagtgtttaaaataatatgct

SEQ ID NO: 9228629 - DNA, 22 bp, Homo sapiens
acagtgtttaaaaatcagatct

SEQ ID NO: 9228630 - DNA, 22 bp, Homo sapiens
acagtgtttaaaaatcagatct

SEQ ID NO: 9228631 - DNA, 22 bp, Homo sapiens
acagtgttcttggcgctgagtg

SEQ ID NO: 9228632 - DNA, 22 bp, Homo sapiens
acagtgttcttgatattacagt

SEQ ID NO: 9228633 - DNA, 22 bp, Homo sapiens
acagtgtccttgtggtccctgt

SEQ ID NO: 9228634 - DNA, 22 bp, Homo sapiens
acagtctttagagtattgtcct

SEQ ID NO: 9228635 - DNA, 22 bp, Homo sapiens
aaggaggaataaagaggtggtg

SEQ ID NO: 9228636 - DNA, 22 bp, Homo sapiens
aaggaggaataaagaggtggtg

SEQ ID NO: 9228637 - DNA, 22 bp, Homo sapiens
acagtctgtcccccaggtgcta

SEQ ID NO: 9228638 - DNA, 22 bp, Homo sapiens
acagtgtttcacttaaccgttt

SEQ ID NO: 9228639 - DNA, 22 bp, Homo sapiens
acagtgtttatgtacagattgt

SEQ ID NO: 9228640 - DNA, 22 bp, Homo sapiens
acagtgtttatgtacagattgt

SEQ ID NO: 9228641 - DNA, 22 bp, Homo sapiens
acagtgtttaagagatggcatt

SEQ ID NO: 9228642 - DNA, 22 bp, Homo sapiens
acagtgtttggcaatgcatgca

SEQ ID NO: 9228643 - DNA, 22 bp, Homo sapiens
aaggaggaattctgagttcatg

SEQ ID NO: 9228644 - DNA, 22 bp, Homo sapiens
aaggaggacacccaggactggg

SEQ ID NO: 9228645 - DNA, 22 bp, Homo sapiens
aaggaggaatttcagggtgaat

SEQ ID NO: 9228646 - DNA, 22 bp, Homo sapiens
aaggaggaatttcagggtgaat

SEQ ID NO: 9228647 - DNA, 22 bp, Homo sapiens
aaggaggagcggaggcttgttg

SEQ ID NO: 9228648 - DNA, 22 bp, Homo sapiens
aaggaggagtggggtcctggaa

SEQ ID NO: 9228649 - DNA, 22 bp, Homo sapiens
aaggcagagattagcagaatga

SEQ ID NO: 9228650 - DNA, 22 bp, Homo sapiens
aaggcagagggctggatcagag

SEQ ID NO: 9228651 - DNA, 22 bp, Homo sapiens
aaggcagagggctggatcagag

SEQ ID NO: 9228652 - DNA, 19 bp, Homo sapiens
acatatgtggatatacatg

SEQ ID NO: 9228653 - DNA, 22 bp, Homo sapiens
acatatgtctatttcatgtaaa

SEQ ID NO: 9228654 - DNA, 20 bp, Homo sapiens
acatatgtgtgcatatcttt

SEQ ID NO: 9228655 - DNA, 22 bp, Homo sapiens
acatatgtgtctgcacatgccc

SEQ ID NO: 9228656 - DNA, 22 bp, Homo sapiens
acatatgcgatcataggatgca

SEQ ID NO: 9228657 - DNA, 22 bp, Homo sapiens
acatatgctcatctgcattccc

SEQ ID NO: 9228658 - DNA, 22 bp, Homo sapiens
acatatgtatatgtacacagtc

SEQ ID NO: 9228659 - DNA, 22 bp, Homo sapiens
acatatgcgatcataggatgca

SEQ ID NO: 9228660 - DNA, 22 bp, Homo sapiens
acatatgctcatctgcattccc

SEQ ID NO: 9228661 - DNA, 22 bp, Homo sapiens
acatatgcgatcataggatgca

SEQ ID NO: 9228662 - DNA, 22 bp, Homo sapiens
acatatgcgatcataggatgca

SEQ ID NO: 9228663 - DNA, 22 bp, Homo sapiens
aagcattttgttttaagaatga

SEQ ID NO: 9228664 - DNA, 22 bp, Homo sapiens
aagcattttgttttaagaatga

SEQ ID NO: 9228665 - DNA, 21 bp, Homo sapiens
acagcctgtcatctcatggtc

SEQ ID NO: 9228666 - DNA, 22 bp, Homo sapiens
acagcctggactggctctctgc

SEQ ID NO: 9228667 - DNA, 22 bp, Homo sapiens
acagcctggcctgagttaaggc

SEQ ID NO: 9228668 - DNA, 22 bp, Homo sapiens
acagcctgtgtaccagctggga

SEQ ID NO: 9228669 - DNA, 22 bp, Homo sapiens
acagcctgtgtaccagctggga

SEQ ID NO: 9228670 - DNA, 22 bp, Homo sapiens
acagcctgtgtaccagctggga

SEQ ID NO: 9228671 - DNA, 22 bp, Homo sapiens
acagcctgtttgatctggtgct

SEQ ID NO: 9228672 - DNA, 22 bp, Homo sapiens
acagcctgtttgatctggtgct

SEQ ID NO: 9228673 - DNA, 19 bp, Homo sapiens
acagcctgttggtggggct

SEQ ID NO: 9228674 - DNA, 22 bp, Homo sapiens
aagcggagcatttgaacttgaa

SEQ ID NO: 9228675 - DNA, 22 bp, Homo sapiens
aagctatacaatgcacaaatga

SEQ ID NO: 9228676 - DNA, 22 bp, Homo sapiens
aagccttttccacctaatagag

SEQ ID NO: 9228677 - DNA, 22 bp, Homo sapiens
aagccaaggttttggtcacagc

SEQ ID NO: 9228678 - DNA, 22 bp, Homo sapiens
aagccaaaggctccagtgacct

SEQ ID NO: 9228679 - DNA, 22 bp, Homo sapiens
aagctgcctagagttgaatgtc

SEQ ID NO: 9228680 - DNA, 22 bp, Homo sapiens
aagctgcctgccacgctagata

SEQ ID NO: 9228681 - DNA, 22 bp, Homo sapiens
aagctgcctgccacgctagata

SEQ ID NO: 9228682 - DNA, 22 bp, Homo sapiens
aagctgcctgggaggaagggct

SEQ ID NO: 9228683 - DNA, 18 bp, Homo sapiens
aagctgccctcaggcagg

SEQ ID NO: 9228684 - DNA, 19 bp, Homo sapiens
acagggcagcaataggata

SEQ ID NO: 9228685 - DNA, 22 bp, Homo sapiens
aagctgccctgtgttagagttc

SEQ ID NO: 9228686 - DNA, 22 bp, Homo sapiens
aagctgccctcattcccagtgc

SEQ ID NO: 9228687 - DNA, 22 bp, Homo sapiens
aagctgccttccatgtgaggaa

SEQ ID NO: 9228688 - DNA, 22 bp, Homo sapiens
aagctgccttccatgtgaggaa

SEQ ID NO: 9228689 - DNA, 23 bp, Homo sapiens
aagctgccttcgcagttggtctg

SEQ ID NO: 9228690 - DNA, 23 bp, Homo sapiens
aagctgccttcgcagttggtctg

SEQ ID NO: 9228691 - DNA, 22 bp, Homo sapiens
aagctgctttgtcaggaatatg

SEQ ID NO: 9228692 - DNA, 22 bp, Homo sapiens
aagctgccttgctgaggagaaa

SEQ ID NO: 9228693 - DNA, 22 bp, Homo sapiens
acagggcagagggcagttggta

SEQ ID NO: 9228694 - DNA, 22 bp, Homo sapiens
acagggcagagtgaaatgctat

SEQ ID NO: 9228695 - DNA, 22 bp, Homo sapiens
acagggcagagaggcaggcttg

SEQ ID NO: 9228696 - DNA, 22 bp, Homo sapiens
acagggcagagaggcaggcttg

SEQ ID NO: 9228697 - DNA, 22 bp, Homo sapiens
acagggcagaaatgttgcatct

SEQ ID NO: 9228698 - DNA, 17 bp, Homo sapiens
acagggcagaaacagct

SEQ ID NO: 9228699 - DNA, 17 bp, Homo sapiens
acagggcagaaacagct

SEQ ID NO: 9228700 - DNA, 17 bp, Homo sapiens
acagggcagaaacagct

SEQ ID NO: 9228701 - DNA, 22 bp, Homo sapiens
aagctctgctcagcagactagg

SEQ ID NO: 9228702 - DNA, 22 bp, Homo sapiens
aagctctggggtacacatctgc

SEQ ID NO: 9228703 - DNA, 22 bp, Homo sapiens
aagctcagagtctcggagggaa

SEQ ID NO: 9228704 - DNA, 22 bp, Homo sapiens
aagctcagagtagctcagcgtc

SEQ ID NO: 9228705 - DNA, 22 bp, Homo sapiens
aagctcagcatgtctcctagaa

SEQ ID NO: 9228706 - DNA, 22 bp, Homo sapiens
aagctatgggggagtttcaacc

SEQ ID NO: 9228707 - DNA, 22 bp, Homo sapiens
aagctccccgaaacccacctct

SEQ ID NO: 9228708 - DNA, 19 bp, Homo sapiens
aagctccagcagatccttt

SEQ ID NO: 9228709 - DNA, 22 bp, Homo sapiens
aagctccccgaaacccacctct

SEQ ID NO: 9228710 - DNA, 22 bp, Homo sapiens
aagctcaggaaagagtctggtt

SEQ ID NO: 9228711 - DNA, 22 bp, Homo sapiens
aagctcaggctggacctggctt

SEQ ID NO: 9228712 - DNA, 22 bp, Homo sapiens
aagctcagtgatgcctccaggg

SEQ ID NO: 9228713 - DNA, 22 bp, Homo sapiens
aaggcctttctagctttgtgct

SEQ ID NO: 9228714 - DNA, 22 bp, Homo sapiens
aaggccttctcttgtgtctgtg

SEQ ID NO: 9228715 - DNA, 22 bp, Homo sapiens
aaggccttgcctgacagcacca

SEQ ID NO: 9228716 - DNA, 20 bp, Homo sapiens
aaggcagagtgggttggagc

SEQ ID NO: 9228717 - DNA, 22 bp, Homo sapiens
aaggctaaattctgtactgcat

SEQ ID NO: 9228718 - DNA, 23 bp, Homo sapiens
acattgttcaatgaaagttagga

SEQ ID NO: 9228719 - DNA, 22 bp, Homo sapiens
acattgttcacaggggcttctc

SEQ ID NO: 9228720 - DNA, 22 bp, Homo sapiens
acattgttcctgagaacttggg

SEQ ID NO: 9228721 - DNA, 22 bp, Homo sapiens
acattgttccagcgatagagaa

SEQ ID NO: 9228722 - DNA, 22 bp, Homo sapiens
acattcttcttgtgaatttact

SEQ ID NO: 9228723 - DNA, 22 bp, Homo sapiens
acattgttagtagaccagtggc

SEQ ID NO: 9228724 - DNA, 22 bp, Homo sapiens
aaggctctctgatggcagcagt

SEQ ID NO: 9228725 - DNA, 22 bp, Homo sapiens
acatttaaatacctatgtttct

SEQ ID NO: 9228726 - DNA, 22 bp, Homo sapiens
acatttaaatacctatgtttct

SEQ ID NO: 9228727 - DNA, 22 bp, Homo sapiens
acatttaaatatgccttatatt

SEQ ID NO: 9228728 - DNA, 22 bp, Homo sapiens
acatttaaatatgccttatatt

SEQ ID NO: 9228729 - DNA, 22 bp, Homo sapiens
acattgtttgagaatacagatg

SEQ ID NO: 9228730 - DNA, 22 bp, Homo sapiens
acattgtttggaggagtgagag

SEQ ID NO: 9228731 - DNA, 22 bp, Homo sapiens
acatttaaatacctatgtttct

SEQ ID NO: 9228732 - DNA, 22 bp, Homo sapiens
acattgtttctgaccatgatga

SEQ ID NO: 9228733 - DNA, 22 bp, Homo sapiens
acattgttgtttgcagcacagg

SEQ ID NO: 9228734 - DNA, 22 bp, Homo sapiens
acattgttgtgcaattatagtt

SEQ ID NO: 9228735 - DNA, 22 bp, Homo sapiens
acattgttctacttctagttag

SEQ ID NO: 9228736 - DNA, 22 bp, Homo sapiens
acattgttgcctagccatgagt

SEQ ID NO: 9228737 - DNA, 22 bp, Homo sapiens
acattgttgagcctcttgttca

SEQ ID NO: 9228738 - DNA, 19 bp, Homo sapiens
aaggctggagaaggcctct

SEQ ID NO: 9228739 - DNA, 19 bp, Homo sapiens
aaggctggagaaggcctct

SEQ ID NO: 9228740 - DNA, 19 bp, Homo sapiens
aaggctggagaaggcctct

SEQ ID NO: 9228741 - DNA, 22 bp, Homo sapiens
aaggctggacctggatgaatct

SEQ ID NO: 9228742 - DNA, 22 bp, Homo sapiens
aaggctgcttttaacatgcata

SEQ ID NO: 9228743 - DNA, 19 bp, Homo sapiens
acatttaaattcagatctc

SEQ ID NO: 9228744 - DNA, 21 bp, Homo sapiens
aaggctggagatgcaggtctg

SEQ ID NO: 9228745 - DNA, 22 bp, Homo sapiens
aaggctggagatggttggaatg

SEQ ID NO: 9228746 - DNA, 21 bp, Homo sapiens
aaggctggagatgcaggtctg

SEQ ID NO: 9228747 - DNA, 21 bp, Homo sapiens
aaggctggagatgcaggtctg

SEQ ID NO: 9228748 - DNA, 22 bp, Homo sapiens
acatttctcttgatgtctctat

SEQ ID NO: 9228749 - DNA, 22 bp, Homo sapiens
acatttctgcatctcagagcta

SEQ ID NO: 9228750 - DNA, 22 bp, Homo sapiens
acatttctcttgatgtctctat

SEQ ID NO: 9228751 - DNA, 22 bp, Homo sapiens
acatttctgagcagggagctgt

SEQ ID NO: 9228752 - DNA, 22 bp, Homo sapiens
acatttcatgttttccagagca

SEQ ID NO: 9228753 - DNA, 23 bp, Homo sapiens
acatttcatataaaagggatcag

SEQ ID NO: 9228754 - DNA, 22 bp, Homo sapiens
aaggctgggaaacatgcaggcc

SEQ ID NO: 9228755 - DNA, 22 bp, Homo sapiens
aaggctgggaaacatgcaggcc

SEQ ID NO: 9228756 - DNA, 22 bp, Homo sapiens
aaggctggcaatatatttgtta

SEQ ID NO: 9228757 - DNA, 22 bp, Homo sapiens
acatttcttccctttagcagaa

SEQ ID NO: 9228758 - DNA, 22 bp, Homo sapiens
acatttcttccacatgctgctg

SEQ ID NO: 9228759 - DNA, 22 bp, Homo sapiens
acatttcttccctttagcagaa

SEQ ID NO: 9228760 - DNA, 22 bp, Homo sapiens
acatttcttagcctagttccag

SEQ ID NO: 9228761 - DNA, 22 bp, Homo sapiens
acatttctgtcttagggactgt

SEQ ID NO: 9228762 - DNA, 22 bp, Homo sapiens
acatttctggagtttctcaaca

SEQ ID NO: 9228763 - DNA, 22 bp, Homo sapiens
acatttctggagtttctcaaca

SEQ ID NO: 9228764 - DNA, 22 bp, Homo sapiens
acccaggaggtggaggctgcag

SEQ ID NO: 9228765 - DNA, 22 bp, Homo sapiens
acccaggaggtggaggctgcag

SEQ ID NO: 9228766 - DNA, 22 bp, Homo sapiens
acccaggaggtgacacagggct

SEQ ID NO: 9228767 - DNA, 22 bp, Homo sapiens
acccaggaggtgacacagggct

SEQ ID NO: 9228768 - DNA, 22 bp, Homo sapiens
acccaggaggtggaggctgcag

SEQ ID NO: 9228769 - DNA, 22 bp, Homo sapiens
acccaggataatctgtgtatct

SEQ ID NO: 9228770 - DNA, 22 bp, Homo sapiens
acccaggataatctgtgtatct

SEQ ID NO: 9228771 - DNA, 22 bp, Homo sapiens
acccaggataatctgtgtatct

SEQ ID NO: 9228772 - DNA, 22 bp, Homo sapiens
acccaggatagagtgctgcagt

SEQ ID NO: 9228773 - DNA, 22 bp, Homo sapiens
acccaggaggcaaggttgcagt

SEQ ID NO: 9228774 - DNA, 22 bp, Homo sapiens
acccaggaggcagaggttgcag

SEQ ID NO: 9228775 - DNA, 22 bp, Homo sapiens
acccaggaggcagaggttgcag

SEQ ID NO: 9228776 - DNA, 22 bp, Homo sapiens
acccaggagccgtgagaggtta

SEQ ID NO: 9228777 - DNA, 22 bp, Homo sapiens
acccaggagccgtgagaggtta

SEQ ID NO: 9228778 - DNA, 22 bp, Homo sapiens
acccaggaggcaaggttgcagt

SEQ ID NO: 9228779 - DNA, 22 bp, Homo sapiens
acccaggagctctggggtcctc

SEQ ID NO: 9228780 - DNA, 22 bp, Homo sapiens
acccaggagctctggggtcctc

SEQ ID NO: 9228781 - DNA, 22 bp, Homo sapiens
acccagaggtgtctagcaagct

SEQ ID NO: 9228782 - DNA, 22 bp, Homo sapiens
acccagagtaacagatggattc

SEQ ID NO: 9228783 - DNA, 22 bp, Homo sapiens
acccagagctgggcttggcaaa

SEQ ID NO: 9228784 - DNA, 22 bp, Homo sapiens
acccagaggcggaggttgcagt

SEQ ID NO: 9228785 - DNA, 22 bp, Homo sapiens
acccaggagccgtgagaggtta

SEQ ID NO: 9228786 - DNA, 22 bp, Homo sapiens
acccagagtcatgtttattccc

SEQ ID NO: 9228787 - DNA, 22 bp, Homo sapiens
accctgagaaagtcacatgcat

SEQ ID NO: 9228788 - DNA, 22 bp, Homo sapiens
accctgagatgccacagcatga

SEQ ID NO: 9228789 - DNA, 22 bp, Homo sapiens
accctgagaaagtcacatgcat

SEQ ID NO: 9228790 - DNA, 19 bp, Homo sapiens
accctgagaggtggtccgg

SEQ ID NO: 9228791 - DNA, 22 bp, Homo sapiens
accctgagccaaaccagttaga

SEQ ID NO: 9228792 - DNA, 20 bp, Homo sapiens
accctgaggctccccagcct

SEQ ID NO: 9228793 - DNA, 22 bp, Homo sapiens
acccccttcgcacactctttca

SEQ ID NO: 9228794 - DNA, 22 bp, Homo sapiens
acccaggatagagtgctgcagt

SEQ ID NO: 9228795 - DNA, 22 bp, Homo sapiens
acccaggatagagtgctgcagt

SEQ ID NO: 9228796 - DNA, 22 bp, Homo sapiens
accctgaggggtatagcagaag

SEQ ID NO: 9228797 - DNA, 22 bp, Homo sapiens
accctgaggggtatagcagaag

SEQ ID NO: 9228798 - DNA, 22 bp, Homo sapiens
accctgagggatgagagttgca

SEQ ID NO: 9228799 - DNA, 22 bp, Homo sapiens
accctgagtcactgtctgtctg

SEQ ID NO: 9228800 - DNA, 22 bp, Homo sapiens
accctgaggggtatagcagaag

SEQ ID NO: 9228801 - DNA, 22 bp, Homo sapiens
accctgatataggtccaagagc

SEQ ID NO: 9228802 - DNA, 22 bp, Homo sapiens
accctgagtcagacagcctgac

SEQ ID NO: 9228803 - DNA, 22 bp, Homo sapiens
accctgcagggcagaggctggt

SEQ ID NO: 9228804 - DNA, 22 bp, Homo sapiens
accctgccgtgggctgcttgtg

SEQ ID NO: 9228805 - DNA, 22 bp, Homo sapiens
accctgccgtgggctgcttgtg

SEQ ID NO: 9228806 - DNA, 21 bp, Homo sapiens
accctttgtttatgaatcagc

SEQ ID NO: 9228807 - DNA, 22 bp, Homo sapiens
accgggaagtcctgcactgggc

SEQ ID NO: 9228808 - DNA, 22 bp, Homo sapiens
accgcagtgacgtgggacttcc

SEQ ID NO: 9228809 - DNA, 22 bp, Homo sapiens
aagggctgtaagccaagtaaag

SEQ ID NO: 9228810 - DNA, 22 bp, Homo sapiens
aagggctgtaagccaagtaaag

SEQ ID NO: 9228811 - DNA, 22 bp, Homo sapiens
aagggctgtaagccaagtaaag

SEQ ID NO: 9228812 - DNA, 22 bp, Homo sapiens
aagggctggtctagaaagggag

SEQ ID NO: 9228813 - DNA, 22 bp, Homo sapiens
aagggctgggtctggttaaccc

SEQ ID NO: 9228814 - DNA, 22 bp, Homo sapiens
aagggctggtctagaaagggag

SEQ ID NO: 9228815 - DNA, 21 bp, Homo sapiens
accaggcttgtgggagggagc

SEQ ID NO: 9228816 - DNA, 22 bp, Homo sapiens
accagggcaaatgtttgtactc

SEQ ID NO: 9228817 - DNA, 21 bp, Homo sapiens
accaggcttgtgggagggagc

SEQ ID NO: 9228818 - DNA, 22 bp, Homo sapiens
accagggcacaggagtctgaag

SEQ ID NO: 9228819 - DNA, 22 bp, Homo sapiens
accagggcaaatgtttgtactc

SEQ ID NO: 9228820 - DNA, 21 bp, Homo sapiens
accaggcttgtgggagggagc

SEQ ID NO: 9228821 - DNA, 21 bp, Homo sapiens
accaggcttgtgggagggagc

SEQ ID NO: 9228822 - DNA, 22 bp, Homo sapiens
accaggcttgatgatttgctta

SEQ ID NO: 9228823 - DNA, 22 bp, Homo sapiens
accaggcttgatgatttgctta

SEQ ID NO: 9228824 - DNA, 22 bp, Homo sapiens
accaggcttgatgatttgctta

SEQ ID NO: 9228825 - DNA, 22 bp, Homo sapiens
accatgttggccaagctggtct

SEQ ID NO: 9228826 - DNA, 22 bp, Homo sapiens
accatgttggccaagctggtct

SEQ ID NO: 9228827 - DNA, 22 bp, Homo sapiens
accatgttggccaagctggtct

SEQ ID NO: 9228828 - DNA, 22 bp, Homo sapiens
acccagagctgggcttggcaaa

SEQ ID NO: 9228829 - DNA, 19 bp, Homo sapiens
acccagagccctttgcagg

SEQ ID NO: 9228830 - DNA, 19 bp, Homo sapiens
acccagagccctttgcagg

SEQ ID NO: 9228831 - DNA, 22 bp, Homo sapiens
aagggctgtagacaagattgct

SEQ ID NO: 9228832 - DNA, 22 bp, Homo sapiens
aagggctgtagtttgttgatca

SEQ ID NO: 9228833 - DNA, 22 bp, Homo sapiens
aagggctgttatgtttttatac

SEQ ID NO: 9228834 - DNA, 22 bp, Homo sapiens
aaggggaaaaagtgttaggagt

SEQ ID NO: 9228835 - DNA, 21 bp, Homo sapiens
acattttctgttttaggaagt

SEQ ID NO: 9228836 - DNA, 22 bp, Homo sapiens
acattttgaaagggaaattgtt

SEQ ID NO: 9228837 - DNA, 22 bp, Homo sapiens
accaggctgttgggcccagtgt

SEQ ID NO: 9228838 - DNA, 22 bp, Homo sapiens
accaggcttgataccaagaaat

SEQ ID NO: 9228839 - DNA, 22 bp, Homo sapiens
accaggcttgataccaagaaat

SEQ ID NO: 9228840 - DNA, 22 bp, Homo sapiens
accaggcttgataccaagaaat

SEQ ID NO: 9228841 - DNA, 19 bp, Homo sapiens
accaggcttatggtcagtg

SEQ ID NO: 9228842 - DNA, 19 bp, Homo sapiens
accaggcttatggtcagtg

SEQ ID NO: 9228843 - DNA, 19 bp, Homo sapiens
accaggcttatggtcagtg

SEQ ID NO: 9228844 - DNA, 22 bp, Homo sapiens
accaggcttaatcctttgctat

SEQ ID NO: 9228845 - DNA, 19 bp, Homo sapiens
accaggcttatggtcagtg

SEQ ID NO: 9228846 - DNA, 22 bp, Homo sapiens
accaggctgttgggcccagtgt

SEQ ID NO: 9228847 - DNA, 22 bp, Homo sapiens
accaggcttaatcctttgctat

SEQ ID NO: 9228848 - DNA, 22 bp, Homo sapiens
acattttacaccaagacttctt

SEQ ID NO: 9228849 - DNA, 21 bp, Homo sapiens
acattttctgttttaggaagt

SEQ ID NO: 9228850 - DNA, 22 bp, Homo sapiens
acattttacagttgtctggcta

SEQ ID NO: 9228851 - DNA, 22 bp, Homo sapiens
acattttaatatgcttagtgtg

SEQ ID NO: 9228852 - DNA, 22 bp, Homo sapiens
acagtgttctgctttttaatcc

SEQ ID NO: 9228853 - DNA, 22 bp, Homo sapiens
acagtgttttagaaaagcttga

SEQ ID NO: 9228854 - DNA, 20 bp, Homo sapiens
acagtgtttttgagtagagc

SEQ ID NO: 9228855 - DNA, 22 bp, Homo sapiens
acagtgttttatgagaattgtt

SEQ ID NO: 9228856 - DNA, 22 bp, Homo sapiens
acagtgttttatgagaattgtt

SEQ ID NO: 9228857 - DNA, 22 bp, Homo sapiens
acagtgttttgtctggcagggc

SEQ ID NO: 9228858 - DNA, 22 bp, Homo sapiens
acagtgttttcttaaggagaaa

SEQ ID NO: 9228859 - DNA, 22 bp, Homo sapiens
acagtgattggcactgattcag

SEQ ID NO: 9228860 - DNA, 22 bp, Homo sapiens
acagtgattattagttggtggt

SEQ ID NO: 9228861 - DNA, 22 bp, Homo sapiens
acagttattttcccagcattta

SEQ ID NO: 9228862 - DNA, 22 bp, Homo sapiens
acagttcaagacatcagtatga

SEQ ID NO: 9228863 - DNA, 22 bp, Homo sapiens
acagttcaagtcttagacaaca

SEQ ID NO: 9228864 - DNA, 22 bp, Homo sapiens
acagttcaagtcttagacaaca

SEQ ID NO: 9228865 - DNA, 22 bp, Homo sapiens
acagttcagacaagtgttccat

SEQ ID NO: 9228866 - DNA, 23 bp, Homo sapiens
acagttatagctgtgaataacat

SEQ ID NO: 9228867 - DNA, 22 bp, Homo sapiens
aggcaggattgctgacaacaat

SEQ ID NO: 9228868 - DNA, 21 bp, Homo sapiens
aggcaggattcaaacacagag

SEQ ID NO: 9228869 - DNA, 22 bp, Homo sapiens
acataaatagattattgggagg

SEQ ID NO: 9228870 - DNA, 22 bp, Homo sapiens
acataaatagattattgggagg

SEQ ID NO: 9228871 - DNA, 22 bp, Homo sapiens
acataaatagattattgggagg

SEQ ID NO: 9228872 - DNA, 22 bp, Homo sapiens
acagtttgttccttttcattgc

SEQ ID NO: 9228873 - DNA, 22 bp, Homo sapiens
aggcagcatccagaggagaatg

SEQ ID NO: 9228874 - DNA, 22 bp, Homo sapiens
aggcagcatgctctgcttctac

SEQ ID NO: 9228875 - DNA, 21 bp, Homo sapiens
aggcagcatctgatttatatg

SEQ ID NO: 9228876 - DNA, 22 bp, Homo sapiens
aggcagcatgctctgcttctac

SEQ ID NO: 9228877 - DNA, 22 bp, Homo sapiens
aggcagcatccagaggagaatg

SEQ ID NO: 9228878 - DNA, 22 bp, Homo sapiens
aggcagcagtgataagatagga

SEQ ID NO: 9228879 - DNA, 22 bp, Homo sapiens
aggcagcatgggccccagctcc

SEQ ID NO: 9228880 - DNA, 22 bp, Homo sapiens
aggcagcatgggccccagctcc

SEQ ID NO: 9228881 - DNA, 22 bp, Homo sapiens
acagggcaacctctgggagact

SEQ ID NO: 9228882 - DNA, 22 bp, Homo sapiens
acagggcaacctctgggagact

SEQ ID NO: 9228883 - DNA, 22 bp, Homo sapiens
acagggcaacctctgggagact

SEQ ID NO: 9228884 - DNA, 18 bp, Homo sapiens
acagggatggggtaagtg

SEQ ID NO: 9228885 - DNA, 18 bp, Homo sapiens
acagggagggcgctgggg

SEQ ID NO: 9228886 - DNA, 22 bp, Homo sapiens
aggaatggttatggggatagta

SEQ ID NO: 9228887 - DNA, 22 bp, Homo sapiens
aggaatgtcatagaataatcat

SEQ ID NO: 9228888 - DNA, 22 bp, Homo sapiens
acagggagtctgaggggatagt

SEQ ID NO: 9228889 - DNA, 22 bp, Homo sapiens
acagggagtctgaggggatagt

SEQ ID NO: 9228890 - DNA, 22 bp, Homo sapiens
acaggtggacacagcagcagtc

SEQ ID NO: 9228891 - DNA, 22 bp, Homo sapiens
acaggtggagtggttagcaggc

SEQ ID NO: 9228892 - DNA, 22 bp, Homo sapiens
acaggtgcatgctaccatgtct

SEQ ID NO: 9228893 - DNA, 22 bp, Homo sapiens
acaggtggaaacatggtgttgg

SEQ ID NO: 9228894 - DNA, 22 bp, Homo sapiens
aggagctgttttgttcagcaaa

SEQ ID NO: 9228895 - DNA, 21 bp, Homo sapiens
aggagctgtgttagctggtcg

SEQ ID NO: 9228896 - DNA, 21 bp, Homo sapiens
aggagctgtgttagctggtcg

SEQ ID NO: 9228897 - DNA, 22 bp, Homo sapiens
acaggtggtagagtggaaagag

SEQ ID NO: 9228898 - DNA, 22 bp, Homo sapiens
acaggtggccccgagggagtgg

SEQ ID NO: 9228899 - DNA, 22 bp, Homo sapiens
acaggtggcataggcagtttga

SEQ ID NO: 9228900 - DNA, 22 bp, Homo sapiens
acaggtggccccgagggagtgg

SEQ ID NO: 9228901 - DNA, 22 bp, Homo sapiens
acaggtggcttattggctgatt

SEQ ID NO: 9228902 - DNA, 22 bp, Homo sapiens
acaggtggcttattggctgatt

SEQ ID NO: 9228903 - DNA, 22 bp, Homo sapiens
acaggtggcttattggctgatt

SEQ ID NO: 9228904 - DNA, 22 bp, Homo sapiens
acaggtggtaaaatggactgtc

SEQ ID NO: 9228905 - DNA, 22 bp, Homo sapiens
acaggtggtaaaatggactgtc

SEQ ID NO: 9228906 - DNA, 22 bp, Homo sapiens
acaggtggggaggctgaggttc

SEQ ID NO: 9228907 - DNA, 22 bp, Homo sapiens
acaggtgggcttaagagtcggc

SEQ ID NO: 9228908 - DNA, 22 bp, Homo sapiens
acaggtgggcttaagagtcggc

SEQ ID NO: 9228909 - DNA, 22 bp, Homo sapiens
aggagtgcaaatagtccagaga

SEQ ID NO: 9228910 - DNA, 22 bp, Homo sapiens
aggagtggaattactgggttct

SEQ ID NO: 9228911 - DNA, 22 bp, Homo sapiens
acagtgaggaagcagctgtgct

SEQ ID NO: 9228912 - DNA, 22 bp, Homo sapiens
acagtgaggacagggactgtgt

SEQ ID NO: 9228913 - DNA, 22 bp, Homo sapiens
aggagtgagctttggggtcaga

SEQ ID NO: 9228914 - DNA, 22 bp, Homo sapiens
aggagtgagtgtcctcagcaga

SEQ ID NO: 9228915 - DNA, 17 bp, Homo sapiens
aggagtctcagatgagc

SEQ ID NO: 9228916 - DNA, 22 bp, Homo sapiens
aggagtcactcagggcttcatc

SEQ ID NO: 9228917 - DNA, 22 bp, Homo sapiens
aggagggtgatccgggctggtc

SEQ ID NO: 9228918 - DNA, 22 bp, Homo sapiens
aggagggtgatccgggctggtc

SEQ ID NO: 9228919 - DNA, 22 bp, Homo sapiens
aggagtcagattgtttgaatgt

SEQ ID NO: 9228920 - DNA, 22 bp, Homo sapiens
aggaggaactcagaaagaaggt

SEQ ID NO: 9228921 - DNA, 22 bp, Homo sapiens
acagtaaatcaacagaatatct

SEQ ID NO: 9228922 - DNA, 21 bp, Homo sapiens
aggaggaacccgtggctgggc

SEQ ID NO: 9228923 - DNA, 21 bp, Homo sapiens
acagtaaattccctgcaaaga

SEQ ID NO: 9228924 - DNA, 22 bp, Homo sapiens
acagtaagggtaaataagaaca

SEQ ID NO: 9228925 - DNA, 17 bp, Homo sapiens
acagtaactatgttatg

SEQ ID NO: 9228926 - DNA, 17 bp, Homo sapiens
acagtaactatgttatg

SEQ ID NO: 9228927 - DNA, 22 bp, Homo sapiens
acagtaattaaggtctgaaacg

SEQ ID NO: 9228928 - DNA, 22 bp, Homo sapiens
acagctctccctcagagaaatg

SEQ ID NO: 9228929 - DNA, 22 bp, Homo sapiens
acagctcctactgaagccatgt

SEQ ID NO: 9228930 - DNA, 22 bp, Homo sapiens
acagctctccctcagagaaatg

SEQ ID NO: 9228931 - DNA, 22 bp, Homo sapiens
acagctctgagatattactatt

SEQ ID NO: 9228932 - DNA, 22 bp, Homo sapiens
acagctctgggtgcaggaggtg

SEQ ID NO: 9228933 - DNA, 22 bp, Homo sapiens
acagctctgcattttgggttaa

SEQ ID NO: 9228934 - DNA, 22 bp, Homo sapiens
acagctcttaggcagaaccaac

SEQ ID NO: 9228935 - DNA, 22 bp, Homo sapiens
acagctcttaggcagaaccaac

SEQ ID NO: 9228936 - DNA, 22 bp, Homo sapiens
acagctcttaggcagaaccaac

SEQ ID NO: 9228937 - DNA, 22 bp, Homo sapiens
acagctctgtgtattgtcatct

SEQ ID NO: 9228938 - DNA, 22 bp, Homo sapiens
acagctcttcttcaagcctggc

SEQ ID NO: 9228939 - DNA, 22 bp, Homo sapiens
acagctcagacatcactgctct

SEQ ID NO: 9228940 - DNA, 22 bp, Homo sapiens
acagctcagacatcactgctct

SEQ ID NO: 9228941 - DNA, 22 bp, Homo sapiens
acagctcatttgtaaaacggag

SEQ ID NO: 9228942 - DNA, 22 bp, Homo sapiens
acagctcatttgtaaaacggag

SEQ ID NO: 9228943 - DNA, 23 bp, Homo sapiens
agctgggcaaggatccgggctcc

SEQ ID NO: 9228944 - DNA, 20 bp, Homo sapiens
agctgggcaattatgactat

SEQ ID NO: 9228945 - DNA, 22 bp, Homo sapiens
agctgggcaccccgctgcgtct

SEQ ID NO: 9228946 - DNA, 22 bp, Homo sapiens
agctggggctgcagagaacagg

SEQ ID NO: 9228947 - DNA, 23 bp, Homo sapiens
acagctgcacctggccgcctggc

SEQ ID NO: 9228948 - DNA, 23 bp, Homo sapiens
acagctgcacctggccgcctggc

SEQ ID NO: 9228949 - DNA, 22 bp, Homo sapiens
agctgcctgtgtagaaccatct

SEQ ID NO: 9228950 - DNA, 22 bp, Homo sapiens
agctgcctgtcctaggccatca

SEQ ID NO: 9228951 - DNA, 22 bp, Homo sapiens
agctgccttatggagtatgaaa

SEQ ID NO: 9228952 - DNA, 22 bp, Homo sapiens
agctgccttatggagtatgaaa

SEQ ID NO: 9228953 - DNA, 22 bp, Homo sapiens
agctgcctgggcttgtacacct

SEQ ID NO: 9228954 - DNA, 22 bp, Homo sapiens
agctgcccccagggctgtgctt

SEQ ID NO: 9228955 - DNA, 22 bp, Homo sapiens
agctgccccatgagaggcaggt

SEQ ID NO: 9228956 - DNA, 22 bp, Homo sapiens
agctgccccatgagaggcaggt

SEQ ID NO: 9228957 - DNA, 22 bp, Homo sapiens
acagcctgctgcctgcttcttg

SEQ ID NO: 9228958 - DNA, 22 bp, Homo sapiens
acagcctgctgcctgcttcttg

SEQ ID NO: 9228959 - DNA, 22 bp, Homo sapiens
acagccttgggttctctggggg

SEQ ID NO: 9228960 - DNA, 22 bp, Homo sapiens
agctgctatgacaacaccagcc

SEQ ID NO: 9228961 - DNA, 17 bp, Homo sapiens
agctgccttgcttgagc

SEQ ID NO: 9228962 - DNA, 21 bp, Homo sapiens
agctgcctttagagagaacca

SEQ ID NO: 9228963 - DNA, 22 bp, Homo sapiens
agctgccatcctgttcagcacc

SEQ ID NO: 9228964 - DNA, 22 bp, Homo sapiens
agctgccatccgaggtgtcaga

SEQ ID NO: 9228965 - DNA, 22 bp, Homo sapiens
agctgccatcagcctttggatg

SEQ ID NO: 9228966 - DNA, 17 bp, Homo sapiens
agctgccagggagtgtg

SEQ ID NO: 9228967 - DNA, 22 bp, Homo sapiens
agctgccaggcccctgagaacc

SEQ ID NO: 9228968 - DNA, 22 bp, Homo sapiens
agctgccagggactgggcatgg

SEQ ID NO: 9228969 - DNA, 22 bp, Homo sapiens
agctgcccagctaggaagaagg

SEQ ID NO: 9228970 - DNA, 22 bp, Homo sapiens
agctgcccagataggaggaggc

SEQ ID NO: 9228971 - DNA, 21 bp, Homo sapiens
agctgcccagagtagggaagg

SEQ ID NO: 9228972 - DNA, 22 bp, Homo sapiens
agctgcccaatcctgcagggcg

SEQ ID NO: 9228973 - DNA, 22 bp, Homo sapiens
agctgccatctgaagaactgca

SEQ ID NO: 9228974 - DNA, 22 bp, Homo sapiens
agctgcccaatcctgcagggcg

SEQ ID NO: 9228975 - DNA, 22 bp, Homo sapiens
agctgccagcatcccggaaggg

SEQ ID NO: 9228976 - DNA, 22 bp, Homo sapiens
agctgccagcatcccggaaggg

SEQ ID NO: 9228977 - DNA, 22 bp, Homo sapiens
agctgcaggcccatgctcagtc

SEQ ID NO: 9228978 - DNA, 22 bp, Homo sapiens
agctgccagatgacagtgctat

SEQ ID NO: 9228979 - DNA, 22 bp, Homo sapiens
agctgcaggcccatgctcagtc

SEQ ID NO: 9228980 - DNA, 22 bp, Homo sapiens
acagcagacagtcggcttcctg

SEQ ID NO: 9228981 - DNA, 21 bp, Homo sapiens
acagcagacaggcttaggacc

SEQ ID NO: 9228982 - DNA, 22 bp, Homo sapiens
acagcacttattcagcacagtg

SEQ ID NO: 9228983 - DNA, 22 bp, Homo sapiens
acagcactggtcccgcaagcct

SEQ ID NO: 9228984 - DNA, 22 bp, Homo sapiens
acagcagacacaggcacgctgt

SEQ ID NO: 9228985 - DNA, 22 bp, Homo sapiens
acagcacttgggttttcctgtt

SEQ ID NO: 9228986 - DNA, 22 bp, Homo sapiens
acagctgtggggactcttgccc

SEQ ID NO: 9228987 - DNA, 22 bp, Homo sapiens
acagctgtggggactcttgccc

SEQ ID NO: 9228988 - DNA, 22 bp, Homo sapiens
acagcttcgaggatctcatccc

SEQ ID NO: 9228989 - DNA, 22 bp, Homo sapiens
acaggcaggtaatttacatatt

SEQ ID NO: 9228990 - DNA, 22 bp, Homo sapiens
acaggcaggtaatttacatatt

SEQ ID NO: 9228991 - DNA, 22 bp, Homo sapiens
acaggccagcctggggtaaggt

SEQ ID NO: 9228992 - DNA, 22 bp, Homo sapiens
acaggccataaaggcaggccct

SEQ ID NO: 9228993 - DNA, 22 bp, Homo sapiens
acagctgtgggctctgcatata

SEQ ID NO: 9228994 - DNA, 22 bp, Homo sapiens
acagctgtgacttagagaagtt

SEQ ID NO: 9228995 - DNA, 22 bp, Homo sapiens
acagctgtgaagcaagcactct

SEQ ID NO: 9228996 - DNA, 22 bp, Homo sapiens
acagctgtattcaagttgcaag

SEQ ID NO: 9228997 - DNA, 22 bp, Homo sapiens
agctgggtcttgggccaggaga

SEQ ID NO: 9228998 - DNA, 22 bp, Homo sapiens
acaggcctggaaaggaaggagt

SEQ ID NO: 9228999 - DNA, 22 bp, Homo sapiens
acaggcctagctaatgctttcc

SEQ ID NO: 9229000 - DNA, 18 bp, Homo sapiens
acaggcctcagtcctgca

SEQ ID NO: 9229001 - DNA, 22 bp, Homo sapiens
acaggcctatgttccattgcag

SEQ ID NO: 9229002 - DNA, 22 bp, Homo sapiens
acaggcctcaagacacccaggt

SEQ ID NO: 9229003 - DNA, 22 bp, Homo sapiens
acaggcctgacacacagagggc

SEQ ID NO: 9229004 - DNA, 22 bp, Homo sapiens
acaggcctgagattttgcattt

SEQ ID NO: 9229005 - DNA, 17 bp, Homo sapiens
acaggcctgcttgcact

SEQ ID NO: 9229006 - DNA, 22 bp, Homo sapiens
aggaagggctgtttctccaaga

SEQ ID NO: 9229007 - DNA, 22 bp, Homo sapiens
aggaagggctgtttctccaaga

SEQ ID NO: 9229008 - DNA, 22 bp, Homo sapiens
aggaatgatagtaaaagagaat

SEQ ID NO: 9229009 - DNA, 22 bp, Homo sapiens
aggaatgattcaagacttggct

SEQ ID NO: 9229010 - DNA, 18 bp, Homo sapiens
acaggctgtgggaatggt

SEQ ID NO: 9229011 - DNA, 18 bp, Homo sapiens
acaggctgtgggaatggt

SEQ ID NO: 9229012 - DNA, 22 bp, Homo sapiens
acaggctgttggggtccagggt

SEQ ID NO: 9229013 - DNA, 18 bp, Homo sapiens
acaggctgtgggaatggt

SEQ ID NO: 9229014 - DNA, 22 bp, Homo sapiens
acaggctgtacttctaatcatc

SEQ ID NO: 9229015 - DNA, 22 bp, Homo sapiens
acaggctggtttgtaaaagatg

SEQ ID NO: 9229016 - DNA, 22 bp, Homo sapiens
aggaatgtaacaggagtaaaaa

SEQ ID NO: 9229017 - DNA, 19 bp, Homo sapiens
aggaatggaattaattctg

SEQ ID NO: 9229018 - DNA, 19 bp, Homo sapiens
aggaatggaattaattctg

SEQ ID NO: 9229019 - DNA, 23 bp, Homo sapiens
aggaatggctagaagtgtgaccc

SEQ ID NO: 9229020 - DNA, 19 bp, Homo sapiens
aggaatggaattaattctg

SEQ ID NO: 9229021 - DNA, 23 bp, Homo sapiens
aggaatggctagaagtgtgaccc

SEQ ID NO: 9229022 - DNA, 22 bp, Homo sapiens
acaggctctggggcaggatggc

SEQ ID NO: 9229023 - DNA, 22 bp, Homo sapiens
acaggctgcccgctccccacct

SEQ ID NO: 9229024 - DNA, 22 bp, Homo sapiens
acaggctgccacttgcatccaa

SEQ ID NO: 9229025 - DNA, 21 bp, Homo sapiens
acaggctctggggatgctggg

SEQ ID NO: 9229026 - DNA, 22 bp, Homo sapiens
agctttatgcttcctacaagct

SEQ ID NO: 9229027 - DNA, 22 bp, Homo sapiens
acaggctgcctaccaagtatca

SEQ ID NO: 9229028 - DNA, 22 bp, Homo sapiens
acaggctgctgagccatttgct

SEQ ID NO: 9229029 - DNA, 22 bp, Homo sapiens
acaggctgctgagccatttgct

SEQ ID NO: 9229030 - DNA, 22 bp, Homo sapiens
acaggctgcccgctccccacct

SEQ ID NO: 9229031 - DNA, 22 bp, Homo sapiens
acaggctgcccgctccccacct

SEQ ID NO: 9229032 - DNA, 22 bp, Homo sapiens
acaggctgcccgctccccacct

SEQ ID NO: 9229033 - DNA, 22 bp, Homo sapiens
acaggctgcctaccaagtatca

SEQ ID NO: 9229034 - DNA, 22 bp, Homo sapiens
acaggctgcctaccaagtatca

SEQ ID NO: 9229035 - DNA, 22 bp, Homo sapiens
acaggctgctgggctccgtgct

SEQ ID NO: 9229036 - DNA, 22 bp, Homo sapiens
acaggctgctgggctccgtgct

SEQ ID NO: 9229037 - DNA, 22 bp, Homo sapiens
acaggctggaggaggaccaaga

SEQ ID NO: 9229038 - DNA, 22 bp, Homo sapiens
acaggctgctgggctccgtgct

SEQ ID NO: 9229039 - DNA, 22 bp, Homo sapiens
acaggctggtggtcctggccat

SEQ ID NO: 9229040 - DNA, 22 bp, Homo sapiens
acaggctggtggtcctggccat

SEQ ID NO: 9229041 - DNA, 22 bp, Homo sapiens
acaggctggtggtcctggccat

SEQ ID NO: 9229042 - DNA, 22 bp, Homo sapiens
acaggctggtggtcctggccat

SEQ ID NO: 9229043 - DNA, 22 bp, Homo sapiens
acaggctggtggtcctggccat

SEQ ID NO: 9229044 - DNA, 22 bp, Homo sapiens
acaggctgggcgcttcctgcgg

SEQ ID NO: 9229045 - DNA, 22 bp, Homo sapiens
acaggctgggcgcttcctgcgg

SEQ ID NO: 9229046 - DNA, 22 bp, Homo sapiens
aggctaggggaacactagaatc

SEQ ID NO: 9229047 - DNA, 22 bp, Homo sapiens
aggctaggccttgccctggaac

SEQ ID NO: 9229048 - DNA, 22 bp, Homo sapiens
aggctatttccactcttctcat

SEQ ID NO: 9229049 - DNA, 22 bp, Homo sapiens
aggctatttccactcttctcat

SEQ ID NO: 9229050 - DNA, 22 bp, Homo sapiens
aggctagggtaacagatgtggc

SEQ ID NO: 9229051 - DNA, 22 bp, Homo sapiens
acatttaaccaaactgtttaat

SEQ ID NO: 9229052 - DNA, 22 bp, Homo sapiens
acatttaacctttgaggaactg

SEQ ID NO: 9229053 - DNA, 22 bp, Homo sapiens
acatttaatgatcctactgtga

SEQ ID NO: 9229054 - DNA, 22 bp, Homo sapiens
aggccttaagaacaaaactatt

SEQ ID NO: 9229055 - DNA, 22 bp, Homo sapiens
aggccttatctccaaatacagt

SEQ ID NO: 9229056 - DNA, 22 bp, Homo sapiens
aggctagatagagggtcatctt

SEQ ID NO: 9229057 - DNA, 22 bp, Homo sapiens
aggcgcctgcgggatccttgcc

SEQ ID NO: 9229058 - DNA, 22 bp, Homo sapiens
aggcgcctgcgggatccttgcc

SEQ ID NO: 9229059 - DNA, 22 bp, Homo sapiens
acatttacagtgctagacaatc

SEQ ID NO: 9229060 - DNA, 22 bp, Homo sapiens
acatttacagtgctagacaatc

SEQ ID NO: 9229061 - DNA, 22 bp, Homo sapiens
acatttagtatgagtctctgta

SEQ ID NO: 9229062 - DNA, 18 bp, Homo sapiens
acatttaggagagtcaat

SEQ ID NO: 9229063 - DNA, 19 bp, Homo sapiens
acatttagaatgtacttgc

SEQ ID NO: 9229064 - DNA, 23 bp, Homo sapiens
acatttcaatactgagggtctga

SEQ ID NO: 9229065 - DNA, 22 bp, Homo sapiens
acatttatataactcactagga

SEQ ID NO: 9229066 - DNA, 22 bp, Homo sapiens
aggctgaggctggcagctccag

SEQ ID NO: 9229067 - DNA, 22 bp, Homo sapiens
aggctgaggctggcagctccag

SEQ ID NO: 9229068 - DNA, 22 bp, Homo sapiens
aggctgaggctggcagctccag

SEQ ID NO: 9229069 - DNA, 22 bp, Homo sapiens
aggctgaggcgggtagatcacc

SEQ ID NO: 9229070 - DNA, 22 bp, Homo sapiens
aggctgaggctggcagctccag

SEQ ID NO: 9229071 - DNA, 22 bp, Homo sapiens
aggctgaggcgggtagatcacc

SEQ ID NO: 9229072 - DNA, 22 bp, Homo sapiens
aggctgaggatccctgtgttct

SEQ ID NO: 9229073 - DNA, 22 bp, Homo sapiens
aggctgaggatccctgtgttct

SEQ ID NO: 9229074 - DNA, 22 bp, Homo sapiens
acatttcactgttcacagcagg

SEQ ID NO: 9229075 - DNA, 22 bp, Homo sapiens
aggctgagggctcctgagggca

SEQ ID NO: 9229076 - DNA, 22 bp, Homo sapiens
aggctgagggctcctgagggca

SEQ ID NO: 9229077 - DNA, 22 bp, Homo sapiens
aggctgaggctttccttggaga

SEQ ID NO: 9229078 - DNA, 22 bp, Homo sapiens
aggctgaggctttccttggaga

SEQ ID NO: 9229079 - DNA, 22 bp, Homo sapiens
aggctgaggctttccttggaga

SEQ ID NO: 9229080 - DNA, 22 bp, Homo sapiens
aggctgaggctttccttggaga

SEQ ID NO: 9229081 - DNA, 22 bp, Homo sapiens
aggctgaggctttccttggaga

SEQ ID NO: 9229082 - DNA, 22 bp, Homo sapiens
aggctgagggctcctgagggca

SEQ ID NO: 9229083 - DNA, 22 bp, Homo sapiens
aggctgagggctcctgagggca

SEQ ID NO: 9229084 - DNA, 22 bp, Homo sapiens
aggctgagggctcctgagggca

SEQ ID NO: 9229085 - DNA, 22 bp, Homo sapiens
aggctgagggctcctgagggca

SEQ ID NO: 9229086 - DNA, 22 bp, Homo sapiens
aggctgagtgctcccctagatg

SEQ ID NO: 9229087 - DNA, 22 bp, Homo sapiens
aggctgagtgctcccctagatg

SEQ ID NO: 9229088 - DNA, 20 bp, Homo sapiens
aggctgagttctatgcactt

SEQ ID NO: 9229089 - DNA, 22 bp, Homo sapiens
aggctgagtgctcccctagatg

SEQ ID NO: 9229090 - DNA, 20 bp, Homo sapiens
aggctgagttctatgcactt

SEQ ID NO: 9229091 - DNA, 22 bp, Homo sapiens
aggctgagtttctcattctcgc

SEQ ID NO: 9229092 - DNA, 20 bp, Homo sapiens
aggctgagttctatgcactt

SEQ ID NO: 9229093 - DNA, 22 bp, Homo sapiens
aggctgagtttctcattctcgc

SEQ ID NO: 9229094 - DNA, 22 bp, Homo sapiens
aggctgatgctggctgaggctg

SEQ ID NO: 9229095 - DNA, 22 bp, Homo sapiens
aggctgagtttctcattctcgc

SEQ ID NO: 9229096 - DNA, 22 bp, Homo sapiens
aggctgagtttctcattctcgc

SEQ ID NO: 9229097 - DNA, 22 bp, Homo sapiens
aggctgagtttctcattctcgc

SEQ ID NO: 9229098 - DNA, 19 bp, Homo sapiens
aggctgcaaggtggtgggc

SEQ ID NO: 9229099 - DNA, 22 bp, Homo sapiens
aggctgatgctggctgaggctg

SEQ ID NO: 9229100 - DNA, 22 bp, Homo sapiens
aggccctggtcaggtctggctg

SEQ ID NO: 9229101 - DNA, 22 bp, Homo sapiens
aggccctgtaaggtgtggagat

SEQ ID NO: 9229102 - DNA, 22 bp, Homo sapiens
aggccctggtcaggtctggctg

SEQ ID NO: 9229103 - DNA, 22 bp, Homo sapiens
aggccctgtaaggtgtggagat

SEQ ID NO: 9229104 - DNA, 22 bp, Homo sapiens
aggccctgtccatggtgctgaa

SEQ ID NO: 9229105 - DNA, 22 bp, Homo sapiens
aggccctgtccatggtgctgaa

SEQ ID NO: 9229106 - DNA, 22 bp, Homo sapiens
aggccctgttatgagccactgt

SEQ ID NO: 9229107 - DNA, 20 bp, Homo sapiens
acatgcagtggtcatttcag

SEQ ID NO: 9229108 - DNA, 20 bp, Homo sapiens
acatgcagtggtcatttcag

SEQ ID NO: 9229109 - DNA, 22 bp, Homo sapiens
acatgcagtgaggatcttagaa

SEQ ID NO: 9229110 - DNA, 22 bp, Homo sapiens
acatgcagaattcttagagagc

SEQ ID NO: 9229111 - DNA, 22 bp, Homo sapiens
acatgcagaattcttagagagc

SEQ ID NO: 9229112 - DNA, 22 bp, Homo sapiens
acatgcacggcaccatcttctg

SEQ ID NO: 9229113 - DNA, 22 bp, Homo sapiens
acatggcacccagatctcaaaa

SEQ ID NO: 9229114 - DNA, 19 bp, Homo sapiens
acatggcatcccaggaggt

SEQ ID NO: 9229115 - DNA, 19 bp, Homo sapiens
acatggcatcccaggaggt

SEQ ID NO: 9229116 - DNA, 22 bp, Homo sapiens
aggcctgcctggagcctggctg

SEQ ID NO: 9229117 - DNA, 22 bp, Homo sapiens
acatggcaaaagggactttaca

SEQ ID NO: 9229118 - DNA, 22 bp, Homo sapiens
acatggaaaactaactgctttt

SEQ ID NO: 9229119 - DNA, 22 bp, Homo sapiens
aggcccttcttggtggctcagg

SEQ ID NO: 9229120 - DNA, 22 bp, Homo sapiens
acatggaatgtgtactaagtta

SEQ ID NO: 9229121 - DNA, 22 bp, Homo sapiens
acatggaagcaaagttctattt

SEQ ID NO: 9229122 - DNA, 22 bp, Homo sapiens
acatggaagataaaaatactca

SEQ ID NO: 9229123 - DNA, 22 bp, Homo sapiens
aggcagggctcatttcttaggc

SEQ ID NO: 9229124 - DNA, 22 bp, Homo sapiens
acatgaaagttattctgagttg

SEQ ID NO: 9229125 - DNA, 22 bp, Homo sapiens
aggcaggggagctggaagggta

SEQ ID NO: 9229126 - DNA, 22 bp, Homo sapiens
aggcaggggagctggaagggta

SEQ ID NO: 9229127 - DNA, 22 bp, Homo sapiens
aggcaggggagctggaagggta

SEQ ID NO: 9229128 - DNA, 22 bp, Homo sapiens
aggcagggctgggattagactc

SEQ ID NO: 9229129 - DNA, 22 bp, Homo sapiens
acatgattcttgataggcattg

SEQ ID NO: 9229130 - DNA, 22 bp, Homo sapiens
acatgatttcagggaattctca

SEQ ID NO: 9229131 - DNA, 22 bp, Homo sapiens
acatgatcttatgtagaagatc

SEQ ID NO: 9229132 - DNA, 22 bp, Homo sapiens
acatgcacacctatatacatgt

SEQ ID NO: 9229133 - DNA, 22 bp, Homo sapiens
acatgcacacgattcagtctgg

SEQ ID NO: 9229134 - DNA, 22 bp, Homo sapiens
acatgatttttctttgactcta

SEQ ID NO: 9229135 - DNA, 22 bp, Homo sapiens
acatgattttagtatcataata

SEQ ID NO: 9229136 - DNA, 22 bp, Homo sapiens
acatgatttgcatgatttgtaa

SEQ ID NO: 9229137 - DNA, 22 bp, Homo sapiens
acatttttgggttgatgtctga

SEQ ID NO: 9229138 - DNA, 22 bp, Homo sapiens
acatttttctaggaggcaaggt

SEQ ID NO: 9229139 - DNA, 22 bp, Homo sapiens
accaaaaagatatgttgaagcc

SEQ ID NO: 9229140 - DNA, 22 bp, Homo sapiens
acattttttagagtcccacatt

SEQ ID NO: 9229141 - DNA, 22 bp, Homo sapiens
accaaaaattgtggggctgaat

SEQ ID NO: 9229142 - DNA, 22 bp, Homo sapiens
accaaaacctgctactaaagga

SEQ ID NO: 9229143 - DNA, 22 bp, Homo sapiens
accaaaacctgctactaaagga

SEQ ID NO: 9229144 - DNA, 22 bp, Homo sapiens
aggctggagtgtgcagtggcgc

SEQ ID NO: 9229145 - DNA, 22 bp, Homo sapiens
acatttttcacatttgtagggt

SEQ ID NO: 9229146 - DNA, 22 bp, Homo sapiens
acatttttatcctgagtgccag

SEQ ID NO: 9229147 - DNA, 22 bp, Homo sapiens
acatttttattcatcaaagcag

SEQ ID NO: 9229148 - DNA, 22 bp, Homo sapiens
acatttttactgggcatctgca

SEQ ID NO: 9229149 - DNA, 22 bp, Homo sapiens
acatttgtcttctttcagatta

SEQ ID NO: 9229150 - DNA, 22 bp, Homo sapiens
agggaagagcttgcaagaaacc

SEQ ID NO: 9229151 - DNA, 22 bp, Homo sapiens
agggaagagcttgcaagaaacc

SEQ ID NO: 9229152 - DNA, 22 bp, Homo sapiens
aggctggcaaggcagatgtgtg

SEQ ID NO: 9229153 - DNA, 20 bp, Homo sapiens
aggctggcactcctggccag

SEQ ID NO: 9229154 - DNA, 22 bp, Homo sapiens
aggctggagtgtgcagtggcgc

SEQ ID NO: 9229155 - DNA, 22 bp, Homo sapiens
aggctggagtgtgcagtggcgc

SEQ ID NO: 9229156 - DNA, 22 bp, Homo sapiens
aggctggatttatggggacttc

SEQ ID NO: 9229157 - DNA, 22 bp, Homo sapiens
agggacagatgaatgactgagt

SEQ ID NO: 9229158 - DNA, 22 bp, Homo sapiens
agggacagatgaatgactgagt

SEQ ID NO: 9229159 - DNA, 22 bp, Homo sapiens
agggacacttgctttcaggccc

SEQ ID NO: 9229160 - DNA, 22 bp, Homo sapiens
agggacagatgaatgactgagt

SEQ ID NO: 9229161 - DNA, 22 bp, Homo sapiens
agggaattcactggaacgccct

SEQ ID NO: 9229162 - DNA, 22 bp, Homo sapiens
agggaagaggaccagagtctct

SEQ ID NO: 9229163 - DNA, 22 bp, Homo sapiens
agggaagcaatgattattattc

SEQ ID NO: 9229164 - DNA, 22 bp, Homo sapiens
agggaagcaatattagatatca

SEQ ID NO: 9229165 - DNA, 22 bp, Homo sapiens
agggaagatgtctcatcttagg

SEQ ID NO: 9229166 - DNA, 22 bp, Homo sapiens
agggaagcaatattagatatca

SEQ ID NO: 9229167 - DNA, 22 bp, Homo sapiens
agggaagcagcagccgcctgtc

SEQ ID NO: 9229168 - DNA, 22 bp, Homo sapiens
agggaagcaggaatagctctga

SEQ ID NO: 9229169 - DNA, 22 bp, Homo sapiens
agggaagcttgttactgagaag

SEQ ID NO: 9229170 - DNA, 22 bp, Homo sapiens
agggaagctgctgggtccacct

SEQ ID NO: 9229171 - DNA, 22 bp, Homo sapiens
agggaagccctggctgagaccc

SEQ ID NO: 9229172 - DNA, 22 bp, Homo sapiens
agggaagccaagccttagagaa

SEQ ID NO: 9229173 - DNA, 22 bp, Homo sapiens
agggaagccaagccttagagaa

SEQ ID NO: 9229174 - DNA, 22 bp, Homo sapiens
agggaagccccgaggaggcacc

SEQ ID NO: 9229175 - DNA, 19 bp, Homo sapiens
accaggcctcagaggccct

SEQ ID NO: 9229176 - DNA, 22 bp, Homo sapiens
accaggagttgggggtgggacc

SEQ ID NO: 9229177 - DNA, 22 bp, Homo sapiens
accaggagttgggggtgggacc

SEQ ID NO: 9229178 - DNA, 22 bp, Homo sapiens
agggcctgggtctgtactcctc

SEQ ID NO: 9229179 - DNA, 22 bp, Homo sapiens
agggcctggtgacctgggtcct

SEQ ID NO: 9229180 - DNA, 22 bp, Homo sapiens
accccaggaagtggaggtcatg

SEQ ID NO: 9229181 - DNA, 22 bp, Homo sapiens
agggcctggttctgtgtaggga

SEQ ID NO: 9229182 - DNA, 22 bp, Homo sapiens
accccagctctgagccacacca

SEQ ID NO: 9229183 - DNA, 22 bp, Homo sapiens
accctcaacaaattcactctat

SEQ ID NO: 9229184 - DNA, 22 bp, Homo sapiens
acccgggaggcaggagtcatag

SEQ ID NO: 9229185 - DNA, 22 bp, Homo sapiens
acccaggcgggagtgcagtgtc

SEQ ID NO: 9229186 - DNA, 22 bp, Homo sapiens
acccaggctagagtgcagtggt

SEQ ID NO: 9229187 - DNA, 22 bp, Homo sapiens
acccaggctagggtgcagtggc

SEQ ID NO: 9229188 - DNA, 22 bp, Homo sapiens
agggcctgggccagcacccttt

SEQ ID NO: 9229189 - DNA, 22 bp, Homo sapiens
agggcctgggatgtcctcctag

SEQ ID NO: 9229190 - DNA, 22 bp, Homo sapiens
agggcctgggaagaggaaccct

SEQ ID NO: 9229191 - DNA, 22 bp, Homo sapiens
agggcctggggtagcttactgc

SEQ ID NO: 9229192 - DNA, 22 bp, Homo sapiens
agggcctgggccagcacccttt

SEQ ID NO: 9229193 - DNA, 22 bp, Homo sapiens
acccaggctggagtgcagtgac

SEQ ID NO: 9229194 - DNA, 17 bp, Homo sapiens
acccaggctctatcttg

SEQ ID NO: 9229195 - DNA, 22 bp, Homo sapiens
accatgttggccaagctggtct

SEQ ID NO: 9229196 - DNA, 22 bp, Homo sapiens
accatgttggccaagctggtct

SEQ ID NO: 9229197 - DNA, 22 bp, Homo sapiens
accatcaagaccttatctagtt

SEQ ID NO: 9229198 - DNA, 22 bp, Homo sapiens
accattgccccctagtgtctgt

SEQ ID NO: 9229199 - DNA, 22 bp, Homo sapiens
accattgccccctagtgtctgt

SEQ ID NO: 9229200 - DNA, 22 bp, Homo sapiens
accattctgtctctttacaaat

SEQ ID NO: 9229201 - DNA, 20 bp, Homo sapiens
accattaatgtaagctttgt

SEQ ID NO: 9229202 - DNA, 20 bp, Homo sapiens
agggcagcttgaggagccgg

SEQ ID NO: 9229203 - DNA, 22 bp, Homo sapiens
agggcagcttccatagtctggc

SEQ ID NO: 9229204 - DNA, 22 bp, Homo sapiens
agggcagtgggaaagcctgctc

SEQ ID NO: 9229205 - DNA, 20 bp, Homo sapiens
agggcagcttgaggagccgg

SEQ ID NO: 9229206 - DNA, 22 bp, Homo sapiens
acccaaagcaatattcatcagt

SEQ ID NO: 9229207 - DNA, 22 bp, Homo sapiens
agggcatctctaacagtctcct

SEQ ID NO: 9229208 - DNA, 22 bp, Homo sapiens
agggcatctagttccctctctt

SEQ ID NO: 9229209 - DNA, 23 bp, Homo sapiens
agggcatgaagcagaggacgtgg

SEQ ID NO: 9229210 - DNA, 22 bp, Homo sapiens
agggcagttcagccacaggctc

SEQ ID NO: 9229211 - DNA, 22 bp, Homo sapiens
acccaggagcaggctgggcagt

SEQ ID NO: 9229212 - DNA, 22 bp, Homo sapiens
acccaggagcaggctgggcagt

SEQ ID NO: 9229213 - DNA, 22 bp, Homo sapiens
acccaggagcaggctgggcagt

SEQ ID NO: 9229214 - DNA, 22 bp, Homo sapiens
acccaggagcaggctgggcagt

SEQ ID NO: 9229215 - DNA, 22 bp, Homo sapiens
atcatttatgccccaattagat

SEQ ID NO: 9229216 - DNA, 22 bp, Homo sapiens
atcattgtaaataatgctgcca

SEQ ID NO: 9229217 - DNA, 22 bp, Homo sapiens
atcatttaaaacaagtctctat

SEQ ID NO: 9229218 - DNA, 22 bp, Homo sapiens
atcattgaatataagtgctatt

SEQ ID NO: 9229219 - DNA, 21 bp, Homo sapiens
atcattctggaaaattcaagc

SEQ ID NO: 9229220 - DNA, 19 bp, Homo sapiens
atcagcaaggtaggatgtg

SEQ ID NO: 9229221 - DNA, 22 bp, Homo sapiens
atcagcaagcatttattgagtg

SEQ ID NO: 9229222 - DNA, 22 bp, Homo sapiens
atccagcacttgttcatgtgaa

SEQ ID NO: 9229223 - DNA, 22 bp, Homo sapiens
atccagctttgtctggtcttcg

SEQ ID NO: 9229224 - DNA, 22 bp, Homo sapiens
agaacctttctttagaaattca

SEQ ID NO: 9229225 - DNA, 22 bp, Homo sapiens
agaagaaatgaggccgttctgc

SEQ ID NO: 9229226 - DNA, 22 bp, Homo sapiens
agaagaaatgaggccgttctgc

SEQ ID NO: 9229227 - DNA, 22 bp, Homo sapiens
atccagagacccaaggacagaa

SEQ ID NO: 9229228 - DNA, 22 bp, Homo sapiens
atccacttggctggttgttcta

SEQ ID NO: 9229229 - DNA, 22 bp, Homo sapiens
atccacttgccactgtatagtt

SEQ ID NO: 9229230 - DNA, 20 bp, Homo sapiens
atcactggagaaggaaacct

SEQ ID NO: 9229231 - DNA, 22 bp, Homo sapiens
atcactggagtgaaaggcaaac

SEQ ID NO: 9229232 - DNA, 20 bp, Homo sapiens
atcactggagaaggaaacct

SEQ ID NO: 9229233 - DNA, 22 bp, Homo sapiens
atcactgtggaaaactgtatgg

SEQ ID NO: 9229234 - DNA, 22 bp, Homo sapiens
atcactgtggcccaaaacctca

SEQ ID NO: 9229235 - DNA, 22 bp, Homo sapiens
atcacattgttagcatagactg

SEQ ID NO: 9229236 - DNA, 21 bp, Homo sapiens
atcaccagcagaagctgcaga

SEQ ID NO: 9229237 - DNA, 22 bp, Homo sapiens
atcacatttatagtggcacgca

SEQ ID NO: 9229238 - DNA, 22 bp, Homo sapiens
atcaccaggcaaaatgtcagag

SEQ ID NO: 9229239 - DNA, 23 bp, Homo sapiens
atcaccagcggaagctgcagacc

SEQ ID NO: 9229240 - DNA, 22 bp, Homo sapiens
atcaccaggcaaaatgtcagag

SEQ ID NO: 9229241 - DNA, 20 bp, Homo sapiens
agaaacagcacaattctgtt

SEQ ID NO: 9229242 - DNA, 22 bp, Homo sapiens
agaaacagaagggaaagctttt

SEQ ID NO: 9229243 - DNA, 22 bp, Homo sapiens
agaaacagaagggaaagctttt

SEQ ID NO: 9229244 - DNA, 20 bp, Homo sapiens
agaaacagcacaattctgtt

SEQ ID NO: 9229245 - DNA, 20 bp, Homo sapiens
agaaacagcacaattctgtt

SEQ ID NO: 9229246 - DNA, 22 bp, Homo sapiens
agaaacatcattggaacacaag

SEQ ID NO: 9229247 - DNA, 22 bp, Homo sapiens
agaaacatcattgtttggtatt

SEQ ID NO: 9229248 - DNA, 22 bp, Homo sapiens
agaaacagcattagcatcaatt

SEQ ID NO: 9229249 - DNA, 22 bp, Homo sapiens
agaaacagcattagcatcaatt

SEQ ID NO: 9229250 - DNA, 22 bp, Homo sapiens
agaaacatattcagtgagtaat

SEQ ID NO: 9229251 - DNA, 22 bp, Homo sapiens
agaaacatcattggaacacaag

SEQ ID NO: 9229252 - DNA, 22 bp, Homo sapiens
agaaacatcctgctttccattt

SEQ ID NO: 9229253 - DNA, 22 bp, Homo sapiens
agaaacatcctgctttccattt

SEQ ID NO: 9229254 - DNA, 22 bp, Homo sapiens
agaaacatcgcttagtcctcat

SEQ ID NO: 9229255 - DNA, 22 bp, Homo sapiens
agaaacatttagattatatgtc

SEQ ID NO: 9229256 - DNA, 22 bp, Homo sapiens
agaaacatttagattatatgtc

SEQ ID NO: 9229257 - DNA, 21 bp, Homo sapiens
atcacattggctgttattatt

SEQ ID NO: 9229258 - DNA, 22 bp, Homo sapiens
atcacaaaggctgcttcatgat

SEQ ID NO: 9229259 - DNA, 22 bp, Homo sapiens
atcacattgccagtgattaccc

SEQ ID NO: 9229260 - DNA, 22 bp, Homo sapiens
atagttgtgtggggattctggt

SEQ ID NO: 9229261 - DNA, 22 bp, Homo sapiens
acttggttctaactagtgtata

SEQ ID NO: 9229262 - DNA, 22 bp, Homo sapiens
acttggtgtattagctctcact

SEQ ID NO: 9229263 - DNA, 22 bp, Homo sapiens
atataatagtttcataaaggct

SEQ ID NO: 9229264 - DNA, 22 bp, Homo sapiens
atataatagtttcataaaggct

SEQ ID NO: 9229265 - DNA, 22 bp, Homo sapiens
atataatagtttcataaaggct

SEQ ID NO: 9229266 - DNA, 22 bp, Homo sapiens
atataattgttctgaagtgttt

SEQ ID NO: 9229267 - DNA, 22 bp, Homo sapiens
atataattaatttagctgcctc

SEQ ID NO: 9229268 - DNA, 22 bp, Homo sapiens
atataattctcaggtttgacta

SEQ ID NO: 9229269 - DNA, 22 bp, Homo sapiens
atataatgattttctggtgagt

SEQ ID NO: 9229270 - DNA, 22 bp, Homo sapiens
atatacaaagggcaacctcgct

SEQ ID NO: 9229271 - DNA, 22 bp, Homo sapiens
actttgtataagacaataaaga

SEQ ID NO: 9229272 - DNA, 22 bp, Homo sapiens
atatataacctggataaggctt

SEQ ID NO: 9229273 - DNA, 22 bp, Homo sapiens
atatctacctagcttaggctga

SEQ ID NO: 9229274 - DNA, 22 bp, Homo sapiens
atatcctttactgtgtcacaga

SEQ ID NO: 9229275 - DNA, 22 bp, Homo sapiens
atatattttgaatagcctctgt

SEQ ID NO: 9229276 - DNA, 19 bp, Homo sapiens
atatccttgagaaagggaa

SEQ ID NO: 9229277 - DNA, 22 bp, Homo sapiens
atatccttgagacgtggctact

SEQ ID NO: 9229278 - DNA, 22 bp, Homo sapiens
atatatttgagaatattcatga

SEQ ID NO: 9229279 - DNA, 22 bp, Homo sapiens
atatatttgagaatattcatga

SEQ ID NO: 9229280 - DNA, 22 bp, Homo sapiens
atatatttgagaatattcatga

SEQ ID NO: 9229281 - DNA, 22 bp, Homo sapiens
atatatttactctcctgttgca

SEQ ID NO: 9229282 - DNA, 22 bp, Homo sapiens
atatatttactctcctgttgca

SEQ ID NO: 9229283 - DNA, 22 bp, Homo sapiens
atatatttgagaatattcatga

SEQ ID NO: 9229284 - DNA, 22 bp, Homo sapiens
atatgaaaagaagtcaccattg

SEQ ID NO: 9229285 - DNA, 22 bp, Homo sapiens
agaaaattagattttactgtgt

SEQ ID NO: 9229286 - DNA, 22 bp, Homo sapiens
agaaaattactccagagacaag

SEQ ID NO: 9229287 - DNA, 22 bp, Homo sapiens
agaaaataaattgatggtggaa

SEQ ID NO: 9229288 - DNA, 22 bp, Homo sapiens
agaaacaacttgtttctcttgc

SEQ ID NO: 9229289 - DNA, 22 bp, Homo sapiens
agaaaatttaaagagacacaca

SEQ ID NO: 9229290 - DNA, 22 bp, Homo sapiens
agaaaatttaaagagacacaca

SEQ ID NO: 9229291 - DNA, 22 bp, Homo sapiens
agaaacagaaccaggtgtcatt

SEQ ID NO: 9229292 - DNA, 22 bp, Homo sapiens
agaaacaacttgtttctcttgc

SEQ ID NO: 9229293 - DNA, 22 bp, Homo sapiens
acttgccataaatgaaaatact

SEQ ID NO: 9229294 - DNA, 22 bp, Homo sapiens
acttgccccagaattgctgctg

SEQ ID NO: 9229295 - DNA, 20 bp, Homo sapiens
acttggaactcatttttctt

SEQ ID NO: 9229296 - DNA, 22 bp, Homo sapiens
acttggaaagatgcaacacagt

SEQ ID NO: 9229297 - DNA, 22 bp, Homo sapiens
acttggaaaattcaaaatggca

SEQ ID NO: 9229298 - DNA, 22 bp, Homo sapiens
acttgctcaatgcttgaagcca

SEQ ID NO: 9229299 - DNA, 22 bp, Homo sapiens
acttgcctccatattttattgc

SEQ ID NO: 9229300 - DNA, 22 bp, Homo sapiens
acttggccttatttccacagaa

SEQ ID NO: 9229301 - DNA, 21 bp, Homo sapiens
acttggccaggcccccacctg

SEQ ID NO: 9229302 - DNA, 22 bp, Homo sapiens
acttggcaggtcaggggatatt

SEQ ID NO: 9229303 - DNA, 22 bp, Homo sapiens
acttggagagcattgctgggga

SEQ ID NO: 9229304 - DNA, 22 bp, Homo sapiens
acttggagagcattgctgggga

SEQ ID NO: 9229305 - DNA, 23 bp, Homo sapiens
acttggaagcagtgaacaacttt

SEQ ID NO: 9229306 - DNA, 22 bp, Homo sapiens
acttgcaaagtgagggagtgtt

SEQ ID NO: 9229307 - DNA, 22 bp, Homo sapiens
acttgattttgaacctttctac

SEQ ID NO: 9229308 - DNA, 22 bp, Homo sapiens
acttgattttgaacctttctac

SEQ ID NO: 9229309 - DNA, 22 bp, Homo sapiens
acttcattcattttcacgaatg

SEQ ID NO: 9229310 - DNA, 22 bp, Homo sapiens
acttcattgtaatattatagca

SEQ ID NO: 9229311 - DNA, 22 bp, Homo sapiens
acttcattgctaagaacaaggt

SEQ ID NO: 9229312 - DNA, 22 bp, Homo sapiens
acttcattgtaatattatagca

SEQ ID NO: 9229313 - DNA, 22 bp, Homo sapiens
acttcattgtaatattatagca

SEQ ID NO: 9229314 - DNA, 22 bp, Homo sapiens
acttcatgctttagagagatga

SEQ ID NO: 9229315 - DNA, 22 bp, Homo sapiens
acttcatgcagaagagagctgt

SEQ ID NO: 9229316 - DNA, 22 bp, Homo sapiens
actgtgtgaaacatcaatgtgt

SEQ ID NO: 9229317 - DNA, 22 bp, Homo sapiens
actgtgtgactgttattactgt

SEQ ID NO: 9229318 - DNA, 18 bp, Homo sapiens
actgtgtgaattagctcc

SEQ ID NO: 9229319 - DNA, 22 bp, Homo sapiens
actgtgtgaaacatcaatgtgt

SEQ ID NO: 9229320 - DNA, 22 bp, Homo sapiens
actgtgtgaaacatcaatgtgt

SEQ ID NO: 9229321 - DNA, 22 bp, Homo sapiens
actgtgtcctatttccttgaca

SEQ ID NO: 9229322 - DNA, 22 bp, Homo sapiens
actgtgtcctcatgtggcagaa

SEQ ID NO: 9229323 - DNA, 19 bp, Homo sapiens
actgtgtggaagtgtgatt

SEQ ID NO: 9229324 - DNA, 22 bp, Homo sapiens
actgtgtggaaatttgtgaggg

SEQ ID NO: 9229325 - DNA, 22 bp, Homo sapiens
actgtgtggaaatttgtgaggg

SEQ ID NO: 9229326 - DNA, 22 bp, Homo sapiens
actgtgtgccctgacgccaggg

SEQ ID NO: 9229327 - DNA, 22 bp, Homo sapiens
actgtgtgaggctgggtgagtc

SEQ ID NO: 9229328 - DNA, 22 bp, Homo sapiens
actgttaaagtaattaattgtc

SEQ ID NO: 9229329 - DNA, 22 bp, Homo sapiens
actgttaacggtatgatgctcg

SEQ ID NO: 9229330 - DNA, 21 bp, Homo sapiens
actgttaagacgtagctgggg

SEQ ID NO: 9229331 - DNA, 22 bp, Homo sapiens
actgttaagtatgaagtaaggc

SEQ ID NO: 9229332 - DNA, 22 bp, Homo sapiens
actgttaattcaatcaacaggt

SEQ ID NO: 9229333 - DNA, 22 bp, Homo sapiens
actgtgtggaccactctgaggc

SEQ ID NO: 9229334 - DNA, 22 bp, Homo sapiens
actgtgtggaccactctgaggc

SEQ ID NO: 9229335 - DNA, 22 bp, Homo sapiens
actgtgtgtttgtctagcacag

SEQ ID NO: 9229336 - DNA, 22 bp, Homo sapiens
actgtgtgggccgctcactggg

SEQ ID NO: 9229337 - DNA, 22 bp, Homo sapiens
actgtgtgggccgctcactggg

SEQ ID NO: 9229338 - DNA, 22 bp, Homo sapiens
actgtgtggaccactctgaggc

SEQ ID NO: 9229339 - DNA, 22 bp, Homo sapiens
acttagaattaaatatttttgg

SEQ ID NO: 9229340 - DNA, 22 bp, Homo sapiens
actgttatgggtgtcagcttaa

SEQ ID NO: 9229341 - DNA, 18 bp, Homo sapiens
actgttatctgataaggc

SEQ ID NO: 9229342 - DNA, 22 bp, Homo sapiens
acttcaaacaattaacagagaa

SEQ ID NO: 9229343 - DNA, 22 bp, Homo sapiens
acttcagagactttatggtcca

SEQ ID NO: 9229344 - DNA, 22 bp, Homo sapiens
acttcacaggttttcataaaac

SEQ ID NO: 9229345 - DNA, 22 bp, Homo sapiens
agtttccaaatattgttttagc

SEQ ID NO: 9229346 - DNA, 23 bp, Homo sapiens
agtttccacccagggtagaaggg

SEQ ID NO: 9229347 - DNA, 22 bp, Homo sapiens
agtttcatttcttagtaccagt

SEQ ID NO: 9229348 - DNA, 22 bp, Homo sapiens
agtttcatgtagccatatttac

SEQ ID NO: 9229349 - DNA, 21 bp, Homo sapiens
agtttcctcaactgcagaagg

SEQ ID NO: 9229350 - DNA, 21 bp, Homo sapiens
agtttcctcatctgcatagga

SEQ ID NO: 9229351 - DNA, 22 bp, Homo sapiens
agtttcctcatctgtaaaatga

SEQ ID NO: 9229352 - DNA, 22 bp, Homo sapiens
agtttccactggagacactgtg

SEQ ID NO: 9229353 - DNA, 22 bp, Homo sapiens
actgtgtatgatatgtactggg

SEQ ID NO: 9229354 - DNA, 20 bp, Homo sapiens
actgtgtaaacatgattcat

SEQ ID NO: 9229355 - DNA, 22 bp, Homo sapiens
actgtgtattctaatgactaaa

SEQ ID NO: 9229356 - DNA, 22 bp, Homo sapiens
actgtgctatctactgaattat

SEQ ID NO: 9229357 - DNA, 22 bp, Homo sapiens
agtttcctcatgttaatatgga

SEQ ID NO: 9229358 - DNA, 22 bp, Homo sapiens
actgtgaacggactgaagccca

SEQ ID NO: 9229359 - DNA, 22 bp, Homo sapiens
actgtgaatcactactagtaga

SEQ ID NO: 9229360 - DNA, 22 bp, Homo sapiens
actgtcatgatcgaagatgtca

SEQ ID NO: 9229361 - DNA, 20 bp, Homo sapiens
actgtctggggacctcatta

SEQ ID NO: 9229362 - DNA, 22 bp, Homo sapiens
actgtctggatggaagccagcg

SEQ ID NO: 9229363 - DNA, 22 bp, Homo sapiens
actgtctggaggcagagaggga

SEQ ID NO: 9229364 - DNA, 22 bp, Homo sapiens
actgtcttcaaatgaatatatt

SEQ ID NO: 9229365 - DNA, 22 bp, Homo sapiens
actgtctgtgccagatgctggg

SEQ ID NO: 9229366 - DNA, 22 bp, Homo sapiens
actgtctgtctcccaattatgc

SEQ ID NO: 9229367 - DNA, 22 bp, Homo sapiens
actgtcatcttgtaagcaatgt

SEQ ID NO: 9229368 - DNA, 22 bp, Homo sapiens
actgtcatgatcgaagatgtca

SEQ ID NO: 9229369 - DNA, 22 bp, Homo sapiens
agtttacagatgctacaggagc

SEQ ID NO: 9229370 - DNA, 22 bp, Homo sapiens
agtttacagttctcatcgcaac

SEQ ID NO: 9229371 - DNA, 22 bp, Homo sapiens
agtttacagatgtagtaggggt

SEQ ID NO: 9229372 - DNA, 18 bp, Homo sapiens
agttgctagatgctgtag

SEQ ID NO: 9229373 - DNA, 22 bp, Homo sapiens
agtttacactatgaaaagacta

SEQ ID NO: 9229374 - DNA, 21 bp, Homo sapiens
agtttacaactgtccagcccc

SEQ ID NO: 9229375 - DNA, 22 bp, Homo sapiens
agtttacactatgaaaagacta

SEQ ID NO: 9229376 - DNA, 22 bp, Homo sapiens
agttgctcaatgtggctgtgga

SEQ ID NO: 9229377 - DNA, 22 bp, Homo sapiens
agttgcagccttcaggagaccc

SEQ ID NO: 9229378 - DNA, 22 bp, Homo sapiens
actgtaaaatacataagtattg

SEQ ID NO: 9229379 - DNA, 22 bp, Homo sapiens
actgtaaaactgctttggaaac

SEQ ID NO: 9229380 - DNA, 22 bp, Homo sapiens
actgtaaagagaactgtgggct

SEQ ID NO: 9229381 - DNA, 17 bp, Homo sapiens
actggttttggcagcat

SEQ ID NO: 9229382 - DNA, 22 bp, Homo sapiens
actgtaaaacaggtttcatcat

SEQ ID NO: 9229383 - DNA, 22 bp, Homo sapiens
agtttatgtaaaattagtaatg

SEQ ID NO: 9229384 - DNA, 22 bp, Homo sapiens
acctcccagctctgagcttggg

SEQ ID NO: 9229385 - DNA, 22 bp, Homo sapiens
acctccccacatggtagtgagt

SEQ ID NO: 9229386 - DNA, 22 bp, Homo sapiens
agggttaattggtgtcctgagg

SEQ ID NO: 9229387 - DNA, 22 bp, Homo sapiens
agggttaattggtgtcctgagg

SEQ ID NO: 9229388 - DNA, 22 bp, Homo sapiens
acctcccagctctgagcttggg

SEQ ID NO: 9229389 - DNA, 22 bp, Homo sapiens
agggtgtgctgttgggtctttc

SEQ ID NO: 9229390 - DNA, 22 bp, Homo sapiens
agggtggtatttaacaactgga

SEQ ID NO: 9229391 - DNA, 22 bp, Homo sapiens
agggtggggtgctacatcttta

SEQ ID NO: 9229392 - DNA, 22 bp, Homo sapiens
agggtggggtgctacatcttta

SEQ ID NO: 9229393 - DNA, 22 bp, Homo sapiens
agggtgtcagccacggaatggg

SEQ ID NO: 9229394 - DNA, 22 bp, Homo sapiens
agggtggtggcgatgaggacat

SEQ ID NO: 9229395 - DNA, 22 bp, Homo sapiens
agggtggggtgctacatcttta

SEQ ID NO: 9229396 - DNA, 20 bp, Homo sapiens
agggtggggacgttctgact

SEQ ID NO: 9229397 - DNA, 20 bp, Homo sapiens
agggtggggacgttctgact

SEQ ID NO: 9229398 - DNA, 20 bp, Homo sapiens
acctccctctgtgggtggga

SEQ ID NO: 9229399 - DNA, 22 bp, Homo sapiens
acctccctcgccgtccactctg

SEQ ID NO: 9229400 - DNA, 22 bp, Homo sapiens
acctcccctcaccaatctggtt

SEQ ID NO: 9229401 - DNA, 22 bp, Homo sapiens
agggctggtatgtccatgaaag

SEQ ID NO: 9229402 - DNA, 22 bp, Homo sapiens
agggctggtatgtccatgaaag

SEQ ID NO: 9229403 - DNA, 22 bp, Homo sapiens
agggctggtatgtccatgaaag

SEQ ID NO: 9229404 - DNA, 22 bp, Homo sapiens
agggctggtatgtccatgaaag

SEQ ID NO: 9229405 - DNA, 22 bp, Homo sapiens
agggctgtttttggcacctggg

SEQ ID NO: 9229406 - DNA, 22 bp, Homo sapiens
agggctgtttttggcacctggg

SEQ ID NO: 9229407 - DNA, 22 bp, Homo sapiens
agggcttgtggtcgtggctgtg

SEQ ID NO: 9229408 - DNA, 22 bp, Homo sapiens
agggtgggctagactcttcccc

SEQ ID NO: 9229409 - DNA, 22 bp, Homo sapiens
agggtgggctagactcttcccc

SEQ ID NO: 9229410 - DNA, 20 bp, Homo sapiens
agggtggggacgttctgact

SEQ ID NO: 9229411 - DNA, 20 bp, Homo sapiens
agggtggggacgttctgact

SEQ ID NO: 9229412 - DNA, 20 bp, Homo sapiens
agggtggggacgttctgact

SEQ ID NO: 9229413 - DNA, 20 bp, Homo sapiens
agggtggggacgttctgact

SEQ ID NO: 9229414 - DNA, 22 bp, Homo sapiens
acctggagatccatggtgtcga

SEQ ID NO: 9229415 - DNA, 21 bp, Homo sapiens
aggtacaggtcttgtgagtct

SEQ ID NO: 9229416 - DNA, 22 bp, Homo sapiens
acctgccttctcaaggacatga

SEQ ID NO: 9229417 - DNA, 22 bp, Homo sapiens
acctgcccggggacattccttt

SEQ ID NO: 9229418 - DNA, 22 bp, Homo sapiens
acctgcccatgaaaatggggag

SEQ ID NO: 9229419 - DNA, 22 bp, Homo sapiens
acctgcccagactcagatccta

SEQ ID NO: 9229420 - DNA, 22 bp, Homo sapiens
acctgcccacttcccatgacat

SEQ ID NO: 9229421 - DNA, 22 bp, Homo sapiens
acctgcccacacttccttccca

SEQ ID NO: 9229422 - DNA, 22 bp, Homo sapiens
acctccctggccttctgattcc

SEQ ID NO: 9229423 - DNA, 23 bp, Homo sapiens
acctgctccatgtcaccttcact

SEQ ID NO: 9229424 - DNA, 22 bp, Homo sapiens
acctgctcaactggcttctcgc

SEQ ID NO: 9229425 - DNA, 22 bp, Homo sapiens
acctgccttctcaaggacatga

SEQ ID NO: 9229426 - DNA, 22 bp, Homo sapiens
acctgcttgagccagtatgaga

SEQ ID NO: 9229427 - DNA, 22 bp, Homo sapiens
aggtacataggaaagtggagct

SEQ ID NO: 9229428 - DNA, 23 bp, Homo sapiens
aggtacatatacttggaggtcag

SEQ ID NO: 9229429 - DNA, 22 bp, Homo sapiens
aggtacatctatggggatagaa

SEQ ID NO: 9229430 - DNA, 22 bp, Homo sapiens
aggtacatggggtgtgtgcacg

SEQ ID NO: 9229431 - DNA, 22 bp, Homo sapiens
aggtactaccagggattttcag

SEQ ID NO: 9229432 - DNA, 22 bp, Homo sapiens
aggtagaggcctccaggcagca

SEQ ID NO: 9229433 - DNA, 22 bp, Homo sapiens
aggtagaggcctccaggcagca

SEQ ID NO: 9229434 - DNA, 22 bp, Homo sapiens
aggtagaggcctccaggcagca

SEQ ID NO: 9229435 - DNA, 22 bp, Homo sapiens
aggtactgaaaaaatgtttgca

SEQ ID NO: 9229436 - DNA, 22 bp, Homo sapiens
aggtagaagagcaaggaataac

SEQ ID NO: 9229437 - DNA, 22 bp, Homo sapiens
acctgtggatcagattcttgta

SEQ ID NO: 9229438 - DNA, 22 bp, Homo sapiens
acctgtgttttccctcagtttc

SEQ ID NO: 9229439 - DNA, 22 bp, Homo sapiens
acctgtctgcatgatctaaaac

SEQ ID NO: 9229440 - DNA, 23 bp, Homo sapiens
acctgtctgcctcccaccatcaa

SEQ ID NO: 9229441 - DNA, 22 bp, Homo sapiens
acctgtctgggctacatttgca

SEQ ID NO: 9229442 - DNA, 22 bp, Homo sapiens
acctgtctataaaagtgaatac

SEQ ID NO: 9229443 - DNA, 22 bp, Homo sapiens
acctgtctataaaagtgaatac

SEQ ID NO: 9229444 - DNA, 22 bp, Homo sapiens
aggtagctatccagacgctgaa

SEQ ID NO: 9229445 - DNA, 22 bp, Homo sapiens
accttaaaactgacacatggag

SEQ ID NO: 9229446 - DNA, 22 bp, Homo sapiens
accttaaaggccgaagtaaaga

SEQ ID NO: 9229447 - DNA, 22 bp, Homo sapiens
accttaaatgtgacatagtcta

SEQ ID NO: 9229448 - DNA, 22 bp, Homo sapiens
accttagaaaatcaaaattaga

SEQ ID NO: 9229449 - DNA, 22 bp, Homo sapiens
accttagaccagcaagatattt

SEQ ID NO: 9229450 - DNA, 22 bp, Homo sapiens
acctgtttacctgcacctgttt

SEQ ID NO: 9229451 - DNA, 22 bp, Homo sapiens
accttattttgaaatagattgt

SEQ ID NO: 9229452 - DNA, 22 bp, Homo sapiens
accttattcttgcccttagatg

SEQ ID NO: 9229453 - DNA, 22 bp, Homo sapiens
accttagctgttaaaactaagt

SEQ ID NO: 9229454 - DNA, 22 bp, Homo sapiens
accttcagacatcaactatctc

SEQ ID NO: 9229455 - DNA, 21 bp, Homo sapiens
accttcagtgttctcagctgc

SEQ ID NO: 9229456 - DNA, 22 bp, Homo sapiens
accttcaggtgagcacacagat

SEQ ID NO: 9229457 - DNA, 19 bp, Homo sapiens
actaaaaatgatgtttgag

SEQ ID NO: 9229458 - DNA, 22 bp, Homo sapiens
actaaaacagtggctagtagac

SEQ ID NO: 9229459 - DNA, 22 bp, Homo sapiens
actaaagaagccaaagttttct

SEQ ID NO: 9229460 - DNA, 22 bp, Homo sapiens
actaaaaactactgccaatagc

SEQ ID NO: 9229461 - DNA, 22 bp, Homo sapiens
acgttatatctgaaaaaagtga

SEQ ID NO: 9229462 - DNA, 22 bp, Homo sapiens
acgggccttctcttcaggcgag

SEQ ID NO: 9229463 - DNA, 22 bp, Homo sapiens
acgttaaacatttagcatagta

SEQ ID NO: 9229464 - DNA, 20 bp, Homo sapiens
actatgaagttagccctcca

SEQ ID NO: 9229465 - DNA, 22 bp, Homo sapiens
actatgatgtattttgcatcta

SEQ ID NO: 9229466 - DNA, 22 bp, Homo sapiens
actatgatgtattttgcatcta

SEQ ID NO: 9229467 - DNA, 21 bp, Homo sapiens
actatgtcatttaagtcactg

SEQ ID NO: 9229468 - DNA, 18 bp, Homo sapiens
actatgctgaataaatgg

SEQ ID NO: 9229469 - DNA, 22 bp, Homo sapiens
actaaatagcctctggtagttg

SEQ ID NO: 9229470 - DNA, 22 bp, Homo sapiens
actaaatagttttgacagaaca

SEQ ID NO: 9229471 - DNA, 22 bp, Homo sapiens
actaaatagttttgacagaaca

SEQ ID NO: 9229472 - DNA, 22 bp, Homo sapiens
actaaagtcatcaaagaacttt

SEQ ID NO: 9229473 - DNA, 22 bp, Homo sapiens
actatacattgaatgttaaggt

SEQ ID NO: 9229474 - DNA, 22 bp, Homo sapiens
actaaatagttttgacagaaca

SEQ ID NO: 9229475 - DNA, 19 bp, Homo sapiens
actcaagtctaatgaaatc

SEQ ID NO: 9229476 - DNA, 18 bp, Homo sapiens
actcaagggtggagagaa

SEQ ID NO: 9229477 - DNA, 22 bp, Homo sapiens
actattcaagtgctcattcaga

SEQ ID NO: 9229478 - DNA, 22 bp, Homo sapiens
actcacagcatgagcttggcag

SEQ ID NO: 9229479 - DNA, 22 bp, Homo sapiens
actcattgaaacttaagatcta

SEQ ID NO: 9229480 - DNA, 22 bp, Homo sapiens
actcatgttttctctagctgga

SEQ ID NO: 9229481 - DNA, 22 bp, Homo sapiens
actcatttaaacatttactgaa

SEQ ID NO: 9229482 - DNA, 22 bp, Homo sapiens
actcacagcagactatgaggga

SEQ ID NO: 9229483 - DNA, 22 bp, Homo sapiens
actcacagactgcaggtttatt

SEQ ID NO: 9229484 - DNA, 22 bp, Homo sapiens
actcacaagtgatgtgaatggc

SEQ ID NO: 9229485 - DNA, 23 bp, Homo sapiens
actcacaaagcaggatcatgttg

SEQ ID NO: 9229486 - DNA, 22 bp, Homo sapiens
agtggctgatgtaggcagtggg

SEQ ID NO: 9229487 - DNA, 22 bp, Homo sapiens
actgctttagacctagagctct

SEQ ID NO: 9229488 - DNA, 22 bp, Homo sapiens
actgctttaaaaaagcaagctt

SEQ ID NO: 9229489 - DNA, 20 bp, Homo sapiens
actgcttctttctctgacct

SEQ ID NO: 9229490 - DNA, 22 bp, Homo sapiens
actgcttctccaatgaattaga

SEQ ID NO: 9229491 - DNA, 23 bp, Homo sapiens
agtggctgagagtgtttcatatg

SEQ ID NO: 9229492 - DNA, 22 bp, Homo sapiens
actgctttaaaaaagcaagctt

SEQ ID NO: 9229493 - DNA, 22 bp, Homo sapiens
actgcttctccaatgaattaga

SEQ ID NO: 9229494 - DNA, 22 bp, Homo sapiens
actgcttacaaaaggaaagaat

SEQ ID NO: 9229495 - DNA, 22 bp, Homo sapiens
actgctgtgatctgatgtaatt

SEQ ID NO: 9229496 - DNA, 22 bp, Homo sapiens
actgctgtgatctgatgtaatt

SEQ ID NO: 9229497 - DNA, 22 bp, Homo sapiens
actgctgattatgaaagtgaca

SEQ ID NO: 9229498 - DNA, 22 bp, Homo sapiens
actgctgatataagaaaagatt

SEQ ID NO: 9229499 - DNA, 22 bp, Homo sapiens
actgctcacgcattacttgagc

SEQ ID NO: 9229500 - DNA, 22 bp, Homo sapiens
actgctcaaggatctggtaggg

SEQ ID NO: 9229501 - DNA, 22 bp, Homo sapiens
agtggctgctatgatcaggaca

SEQ ID NO: 9229502 - DNA, 22 bp, Homo sapiens
agtggctgccaagagcaatgct

SEQ ID NO: 9229503 - DNA, 22 bp, Homo sapiens
actggagttgggtcaagattct

SEQ ID NO: 9229504 - DNA, 22 bp, Homo sapiens
actggacagaggaaatatggag

SEQ ID NO: 9229505 - DNA, 22 bp, Homo sapiens
actggagttttaaaggaacttg

SEQ ID NO: 9229506 - DNA, 22 bp, Homo sapiens
actggatggtgtcatgagcagc

SEQ ID NO: 9229507 - DNA, 22 bp, Homo sapiens
actggcagccacaactggcagg

SEQ ID NO: 9229508 - DNA, 22 bp, Homo sapiens
actggcagccacaactggcagg

SEQ ID NO: 9229509 - DNA, 22 bp, Homo sapiens
actggcactatgttggagaaat

SEQ ID NO: 9229510 - DNA, 22 bp, Homo sapiens
actgcaacctccacctcctggg

SEQ ID NO: 9229511 - DNA, 22 bp, Homo sapiens
actgcaacctccacctcctggg

SEQ ID NO: 9229512 - DNA, 22 bp, Homo sapiens
actgcaacctccacctcctggg

SEQ ID NO: 9229513 - DNA, 22 bp, Homo sapiens
actgcaacctccacctcctggg

SEQ ID NO: 9229514 - DNA, 22 bp, Homo sapiens
actgcaacctccacctcctggg

SEQ ID NO: 9229515 - DNA, 22 bp, Homo sapiens
actgcaacctccacctcctggg

SEQ ID NO: 9229516 - DNA, 22 bp, Homo sapiens
actgcaacacctcctgggttca

SEQ ID NO: 9229517 - DNA, 22 bp, Homo sapiens
actgcaacacctcctgggttca

SEQ ID NO: 9229518 - DNA, 22 bp, Homo sapiens
actgcaaagggaagccctttct

SEQ ID NO: 9229519 - DNA, 22 bp, Homo sapiens
actgcaaagggaagccctttct

SEQ ID NO: 9229520 - DNA, 22 bp, Homo sapiens
actgcaacacctcctgggttca

SEQ ID NO: 9229521 - DNA, 22 bp, Homo sapiens
actgcctgtgcactggtctttt

SEQ ID NO: 9229522 - DNA, 22 bp, Homo sapiens
actgcctgtagctcttcatctc

SEQ ID NO: 9229523 - DNA, 22 bp, Homo sapiens
actgcaacctccgcctgccagg

SEQ ID NO: 9229524 - DNA, 22 bp, Homo sapiens
actgcaacctccgcctgccagg

SEQ ID NO: 9229525 - DNA, 22 bp, Homo sapiens
actgcaacctccgcctgccagg

SEQ ID NO: 9229526 - DNA, 22 bp, Homo sapiens
actgcaacctccgcctgccagg

SEQ ID NO: 9229527 - DNA, 20 bp, Homo sapiens
actgcaagtcacttttaggg

SEQ ID NO: 9229528 - DNA, 22 bp, Homo sapiens
actgaataatggtctgtgatct

SEQ ID NO: 9229529 - DNA, 23 bp, Homo sapiens
actgattcttgaagttgacaagt

SEQ ID NO: 9229530 - DNA, 22 bp, Homo sapiens
actgatttcagggatgagaaga

SEQ ID NO: 9229531 - DNA, 22 bp, Homo sapiens
actgatgttcagccatgttctg

SEQ ID NO: 9229532 - DNA, 22 bp, Homo sapiens
actgatgtgatttcaaattcca

SEQ ID NO: 9229533 - DNA, 22 bp, Homo sapiens
actgatgttaaccctctcttct

SEQ ID NO: 9229534 - DNA, 22 bp, Homo sapiens
actgatgttaaccctctcttct

SEQ ID NO: 9229535 - DNA, 22 bp, Homo sapiens
actgatgtgacagctgagcaga

SEQ ID NO: 9229536 - DNA, 22 bp, Homo sapiens
actgatgaaaggtaagactcca

SEQ ID NO: 9229537 - DNA, 22 bp, Homo sapiens
actgatgaaaactaataaatta

SEQ ID NO: 9229538 - DNA, 22 bp, Homo sapiens
actgatctgttttcagattctg

SEQ ID NO: 9229539 - DNA, 22 bp, Homo sapiens
actgaggtaattgtgaggatta

SEQ ID NO: 9229540 - DNA, 22 bp, Homo sapiens
agtctgggctgtctgcaggagt

SEQ ID NO: 9229541 - DNA, 22 bp, Homo sapiens
agtctgggcatttaggatgttg

SEQ ID NO: 9229542 - DNA, 22 bp, Homo sapiens
agtctgggtgtgaatgaacttg

SEQ ID NO: 9229543 - DNA, 22 bp, Homo sapiens
agtctgggtgtgaatgaacttg

SEQ ID NO: 9229544 - DNA, 22 bp, Homo sapiens
actcttcagtacaataatatct

SEQ ID NO: 9229545 - DNA, 22 bp, Homo sapiens
agtctcttaattttttctaagt

SEQ ID NO: 9229546 - DNA, 22 bp, Homo sapiens
agtctcttcctcatgcatatgt

SEQ ID NO: 9229547 - DNA, 20 bp, Homo sapiens
agtctggcacctattcctgt

SEQ ID NO: 9229548 - DNA, 20 bp, Homo sapiens
agtctggcatgatgcaggca

SEQ ID NO: 9229549 - DNA, 22 bp, Homo sapiens
agtctggccttgccttgtcgag

SEQ ID NO: 9229550 - DNA, 22 bp, Homo sapiens
agtctgggaactgggaacgttt

SEQ ID NO: 9229551 - DNA, 22 bp, Homo sapiens
agtctgggaactgggaacgttt

SEQ ID NO: 9229552 - DNA, 22 bp, Homo sapiens
agtctggctttttgatgagctt

SEQ ID NO: 9229553 - DNA, 22 bp, Homo sapiens
agtctgggagaaggtgagatta

SEQ ID NO: 9229554 - DNA, 22 bp, Homo sapiens
actgaaatgaaatctatcatct

SEQ ID NO: 9229555 - DNA, 22 bp, Homo sapiens
actgaaatggggacagtcctta

SEQ ID NO: 9229556 - DNA, 22 bp, Homo sapiens
actgaaatgaaatctatcatct

SEQ ID NO: 9229557 - DNA, 22 bp, Homo sapiens
actgaaatgaaatctatcatct

SEQ ID NO: 9229558 - DNA, 22 bp, Homo sapiens
actgaaatatttagaagtgaag

SEQ ID NO: 9229559 - DNA, 22 bp, Homo sapiens
actgaacaccatttataacatt

SEQ ID NO: 9229560 - DNA, 22 bp, Homo sapiens
actgaacacttttgaaagatta

SEQ ID NO: 9229561 - DNA, 22 bp, Homo sapiens
actgaacacttttgaaagatta

SEQ ID NO: 9229562 - DNA, 22 bp, Homo sapiens
actgaacaccatttataacatt

SEQ ID NO: 9229563 - DNA, 22 bp, Homo sapiens
actgaaaatgaattagaaacag

SEQ ID NO: 9229564 - DNA, 22 bp, Homo sapiens
actgaaaatgaattagaaacag

SEQ ID NO: 9229565 - DNA, 22 bp, Homo sapiens
actgaaaatgaattagaaacag

SEQ ID NO: 9229566 - DNA, 22 bp, Homo sapiens
actgaaatactgctcttggatt

SEQ ID NO: 9229567 - DNA, 22 bp, Homo sapiens
actgaagaacgcatcagtggtt

SEQ ID NO: 9229568 - DNA, 22 bp, Homo sapiens
actgaacatccataagattttt

SEQ ID NO: 9229569 - DNA, 22 bp, Homo sapiens
actgaagagaagcattttctgc

SEQ ID NO: 9229570 - DNA, 18 bp, Homo sapiens
actgaagatgcaagacct

SEQ ID NO: 9229571 - DNA, 23 bp, Homo sapiens
actgaagatgtcttagtggccct

SEQ ID NO: 9229572 - DNA, 22 bp, Homo sapiens
actccacatttgaacacagttc

SEQ ID NO: 9229573 - DNA, 22 bp, Homo sapiens
actccacaccacgggggccgcc

SEQ ID NO: 9229574 - DNA, 22 bp, Homo sapiens
actccaaggccacatgcattcc

SEQ ID NO: 9229575 - DNA, 21 bp, Homo sapiens
actccaaacaagttaagctgt

SEQ ID NO: 9229576 - DNA, 22 bp, Homo sapiens
actcattttataacactgtagt

SEQ ID NO: 9229577 - DNA, 22 bp, Homo sapiens
actcatttgcatgatgtgctat

SEQ ID NO: 9229578 - DNA, 22 bp, Homo sapiens
actcatttgacactttaaactg

SEQ ID NO: 9229579 - DNA, 22 bp, Homo sapiens
actcatttaaacatttactgaa

SEQ ID NO: 9229580 - DNA, 22 bp, Homo sapiens
actccagaggcagctgtgctga

SEQ ID NO: 9229581 - DNA, 22 bp, Homo sapiens
actccaggcatctgcttctgct

SEQ ID NO: 9229582 - DNA, 22 bp, Homo sapiens
agtctcttaaagacagtgttga

SEQ ID NO: 9229583 - DNA, 22 bp, Homo sapiens
agtctctgtgagctcccaatgg

SEQ ID NO: 9229584 - DNA, 22 bp, Homo sapiens
agtctctgaggttcagatgcct

SEQ ID NO: 9229585 - DNA, 19 bp, Homo sapiens
agtctctgaggcctaagtt

SEQ ID NO: 9229586 - DNA, 22 bp, Homo sapiens
agtcggaagctgtgcgtaaatc

SEQ ID NO: 9229587 - DNA, 22 bp, Homo sapiens
agtctacaacgcaagcaacatg

SEQ ID NO: 9229588 - DNA, 22 bp, Homo sapiens
actccagggctgaacgaggccc

SEQ ID NO: 9229589 - DNA, 22 bp, Homo sapiens
actccagggctccatcccttgt

SEQ ID NO: 9229590 - DNA, 22 bp, Homo sapiens
attataaatattttctaggggt

SEQ ID NO: 9229591 - DNA, 22 bp, Homo sapiens
attataaatattttctaggggt

SEQ ID NO: 9229592 - DNA, 22 bp, Homo sapiens
attataaatattttctaggggt

SEQ ID NO: 9229593 - DNA, 22 bp, Homo sapiens
attataaacctttgagggtggg

SEQ ID NO: 9229594 - DNA, 22 bp, Homo sapiens
attataaagaacatgtgtgtgg

SEQ ID NO: 9229595 - DNA, 22 bp, Homo sapiens
attataaacctttgagggtggg

SEQ ID NO: 9229596 - DNA, 22 bp, Homo sapiens
attataaagaacatgtgtgtgg

SEQ ID NO: 9229597 - DNA, 22 bp, Homo sapiens
attataaagaacatgtgtgtgg

SEQ ID NO: 9229598 - DNA, 22 bp, Homo sapiens
attataaagaacatgtgtgtgg

SEQ ID NO: 9229599 - DNA, 22 bp, Homo sapiens
attcacaattagaagtagataa

SEQ ID NO: 9229600 - DNA, 22 bp, Homo sapiens
attcagcagttcctgcttcagt

SEQ ID NO: 9229601 - DNA, 22 bp, Homo sapiens
attcagcacatctttgtacagc

SEQ ID NO: 9229602 - DNA, 22 bp, Homo sapiens
attcagcataatcagtagcttg

SEQ ID NO: 9229603 - DNA, 22 bp, Homo sapiens
attcagcagttcctgcttcagt

SEQ ID NO: 9229604 - DNA, 22 bp, Homo sapiens
attcagcataatcagtagcttg

SEQ ID NO: 9229605 - DNA, 22 bp, Homo sapiens
attcagcaaacatttattgtgt

SEQ ID NO: 9229606 - DNA, 22 bp, Homo sapiens
attcacagggacaatgggagag

SEQ ID NO: 9229607 - DNA, 22 bp, Homo sapiens
attcacagtttcctcatattct

SEQ ID NO: 9229608 - DNA, 22 bp, Homo sapiens
agaggggctcatatcctgtcat

SEQ ID NO: 9229609 - DNA, 22 bp, Homo sapiens
agagggcaagtgtagtccagta

SEQ ID NO: 9229610 - DNA, 22 bp, Homo sapiens
agagggtgaatgagatagaaaa

SEQ ID NO: 9229611 - DNA, 23 bp, Homo sapiens
agagggtgcaacatggggatcta

SEQ ID NO: 9229612 - DNA, 22 bp, Homo sapiens
agagggcaagtgtagtccagta

SEQ ID NO: 9229613 - DNA, 23 bp, Homo sapiens
agagggagatgtttttctcaaga

SEQ ID NO: 9229614 - DNA, 22 bp, Homo sapiens
agagggagcccagtcatagctg

SEQ ID NO: 9229615 - DNA, 22 bp, Homo sapiens
agagggagcccagtcatagctg

SEQ ID NO: 9229616 - DNA, 22 bp, Homo sapiens
attcagcattggcaccatggat

SEQ ID NO: 9229617 - DNA, 17 bp, Homo sapiens
attctgtaaggttggat

SEQ ID NO: 9229618 - DNA, 22 bp, Homo sapiens
attctgtaattgaactgtgttg

SEQ ID NO: 9229619 - DNA, 22 bp, Homo sapiens
attctggggctggttattttga

SEQ ID NO: 9229620 - DNA, 21 bp, Homo sapiens
agagggagagtggcccttcca

SEQ ID NO: 9229621 - DNA, 22 bp, Homo sapiens
attaaagttgaaattgaactga

SEQ ID NO: 9229622 - DNA, 22 bp, Homo sapiens
attaaatactgcaggctaagca

SEQ ID NO: 9229623 - DNA, 22 bp, Homo sapiens
attagattgtaaatgttttcac

SEQ ID NO: 9229624 - DNA, 22 bp, Homo sapiens
attagctgacctctaaggagcc

SEQ ID NO: 9229625 - DNA, 22 bp, Homo sapiens
attagcattgctactctcaaga

SEQ ID NO: 9229626 - DNA, 19 bp, Homo sapiens
attagcatgcttgaggatg

SEQ ID NO: 9229627 - DNA, 22 bp, Homo sapiens
attagcatgccaagcttttaga

SEQ ID NO: 9229628 - DNA, 22 bp, Homo sapiens
attagcatgccaagcttttaga

SEQ ID NO: 9229629 - DNA, 22 bp, Homo sapiens
attagctatatgctatgtgcca

SEQ ID NO: 9229630 - DNA, 19 bp, Homo sapiens
attagcagacttcctttca

SEQ ID NO: 9229631 - DNA, 22 bp, Homo sapiens
attagcataagtgttcggtgca

SEQ ID NO: 9229632 - DNA, 22 bp, Homo sapiens
attaaagacagcagatggatgg

SEQ ID NO: 9229633 - DNA, 22 bp, Homo sapiens
attaaagaaacccagcatgtga

SEQ ID NO: 9229634 - DNA, 22 bp, Homo sapiens
attaaagaaacccagcatgtga

SEQ ID NO: 9229635 - DNA, 22 bp, Homo sapiens
attaaagaaacccagcatgtga

SEQ ID NO: 9229636 - DNA, 22 bp, Homo sapiens
attaaagctatccagtcatgaa

SEQ ID NO: 9229637 - DNA, 22 bp, Homo sapiens
attaaagctatccagtcatgaa

SEQ ID NO: 9229638 - DNA, 22 bp, Homo sapiens
attaaagctatccagtcatgaa

SEQ ID NO: 9229639 - DNA, 22 bp, Homo sapiens
atgtttgttgaacatctactgc

SEQ ID NO: 9229640 - DNA, 22 bp, Homo sapiens
atgtttgttgatcatttatgaa

SEQ ID NO: 9229641 - DNA, 22 bp, Homo sapiens
atgttttaaatatgtgtgtaaa

SEQ ID NO: 9229642 - DNA, 22 bp, Homo sapiens
atgtttgtaggtaagtgacact

SEQ ID NO: 9229643 - DNA, 22 bp, Homo sapiens
atgtttgtcaggattgtaatta

SEQ ID NO: 9229644 - DNA, 22 bp, Homo sapiens
atgtttgtccctgacatcctct

SEQ ID NO: 9229645 - DNA, 22 bp, Homo sapiens
atgtttctgaagtttacagata

SEQ ID NO: 9229646 - DNA, 22 bp, Homo sapiens
atgtttatgttgggctatattt

SEQ ID NO: 9229647 - DNA, 22 bp, Homo sapiens
atgttacacataggcataaatg

SEQ ID NO: 9229648 - DNA, 22 bp, Homo sapiens
atgttacaattcaaaatgctgc

SEQ ID NO: 9229649 - DNA, 22 bp, Homo sapiens
atgtttctgaagtttacagata

SEQ ID NO: 9229650 - DNA, 22 bp, Homo sapiens
atgtttctgagtgtatatacat

SEQ ID NO: 9229651 - DNA, 22 bp, Homo sapiens
atgtttctgagtgtatatacat

SEQ ID NO: 9229652 - DNA, 22 bp, Homo sapiens
atgtttctgaagtttacagata

SEQ ID NO: 9229653 - DNA, 17 bp, Homo sapiens
atgttaatttcacattt

SEQ ID NO: 9229654 - DNA, 22 bp, Homo sapiens
atgttaaatggtttattattaa

SEQ ID NO: 9229655 - DNA, 23 bp, Homo sapiens
atgttaagtgaaataggccagga

SEQ ID NO: 9229656 - DNA, 20 bp, Homo sapiens
atgttaaatagcatttagag

SEQ ID NO: 9229657 - DNA, 22 bp, Homo sapiens
atgttaaatagccatttgtttg

SEQ ID NO: 9229658 - DNA, 22 bp, Homo sapiens
atgttaaatggtttattattaa

SEQ ID NO: 9229659 - DNA, 20 bp, Homo sapiens
atgttaaatagcatttagag

SEQ ID NO: 9229660 - DNA, 22 bp, Homo sapiens
atgttaaatagccatttgtttg

SEQ ID NO: 9229661 - DNA, 22 bp, Homo sapiens
atgtgtgtacacacgtgactct

SEQ ID NO: 9229662 - DNA, 22 bp, Homo sapiens
atgtgtgtaaacaagtataatt

SEQ ID NO: 9229663 - DNA, 22 bp, Homo sapiens
atgtgtgtaaacaagtataatt

SEQ ID NO: 9229664 - DNA, 22 bp, Homo sapiens
atgttaaataatcccttaaagc

SEQ ID NO: 9229665 - DNA, 23 bp, Homo sapiens
atgtgtgggaggtcagagagcca

SEQ ID NO: 9229666 - DNA, 23 bp, Homo sapiens
atgtgtgggaggtcagagagcca

SEQ ID NO: 9229667 - DNA, 22 bp, Homo sapiens
atgtgtatccatctgtctattt

SEQ ID NO: 9229668 - DNA, 22 bp, Homo sapiens
atttccaaaaccacttattgcc

SEQ ID NO: 9229669 - DNA, 21 bp, Homo sapiens
atttccaagggtacctaagat

SEQ ID NO: 9229670 - DNA, 22 bp, Homo sapiens
atttccaagaaagctttaggat

SEQ ID NO: 9229671 - DNA, 19 bp, Homo sapiens
atttccaagaattggagag

SEQ ID NO: 9229672 - DNA, 19 bp, Homo sapiens
atttccaagaattggagag

SEQ ID NO: 9229673 - DNA, 22 bp, Homo sapiens
atttccaatctctgcatatggg

SEQ ID NO: 9229674 - DNA, 22 bp, Homo sapiens
atttccaatctctgcatatggg

SEQ ID NO: 9229675 - DNA, 22 bp, Homo sapiens
atttccacataagggaaataag

SEQ ID NO: 9229676 - DNA, 22 bp, Homo sapiens
atttccaccggctcaggaagtt

SEQ ID NO: 9229677 - DNA, 22 bp, Homo sapiens
agatggtagactatggaacgta

SEQ ID NO: 9229678 - DNA, 22 bp, Homo sapiens
agatggtaggtggcaggactga

SEQ ID NO: 9229679 - DNA, 22 bp, Homo sapiens
agatggtaatcacatttatctg

SEQ ID NO: 9229680 - DNA, 19 bp, Homo sapiens
agatggggaagagtgtgag

SEQ ID NO: 9229681 - DNA, 22 bp, Homo sapiens
agatgggcgccctggactgagg

SEQ ID NO: 9229682 - DNA, 22 bp, Homo sapiens
agatggttcagaattataaaga

SEQ ID NO: 9229683 - DNA, 20 bp, Homo sapiens
agatggtgggctggaacacc

SEQ ID NO: 9229684 - DNA, 22 bp, Homo sapiens
agatgtaagaccttcatgaggg

SEQ ID NO: 9229685 - DNA, 22 bp, Homo sapiens
agatggttttgtctttatgatt

SEQ ID NO: 9229686 - DNA, 23 bp, Homo sapiens
agatgaaagcttcccatcacagt

SEQ ID NO: 9229687 - DNA, 22 bp, Homo sapiens
agatgaaatttgtgttgagttg

SEQ ID NO: 9229688 - DNA, 22 bp, Homo sapiens
agatgaagactcaggagcaggt

SEQ ID NO: 9229689 - DNA, 22 bp, Homo sapiens
atttcattgaagttaattcttc

SEQ ID NO: 9229690 - DNA, 22 bp, Homo sapiens
agatgaattgatgttggacaga

SEQ ID NO: 9229691 - DNA, 22 bp, Homo sapiens
atttcattgaagttaattcttc

SEQ ID NO: 9229692 - DNA, 22 bp, Homo sapiens
agatgaaaagataagcagcaat

SEQ ID NO: 9229693 - DNA, 22 bp, Homo sapiens
agatccagggttggatttgcat

SEQ ID NO: 9229694 - DNA, 22 bp, Homo sapiens
atttattgaagcttattacgtt

SEQ ID NO: 9229695 - DNA, 22 bp, Homo sapiens
agatgaaagatttttatagaga

SEQ ID NO: 9229696 - DNA, 22 bp, Homo sapiens
agatgtggaacactagactgct

SEQ ID NO: 9229697 - DNA, 22 bp, Homo sapiens
atttgctgatcatctagctaat

SEQ ID NO: 9229698 - DNA, 19 bp, Homo sapiens
agatgtctatttgactatc

SEQ ID NO: 9229699 - DNA, 22 bp, Homo sapiens
agatgtgcctccaaggggtgca

SEQ ID NO: 9229700 - DNA, 22 bp, Homo sapiens
atttgcttctgctaaacaactt

SEQ ID NO: 9229701 - DNA, 22 bp, Homo sapiens
atttgcttctagtcagttccat

SEQ ID NO: 9229702 - DNA, 22 bp, Homo sapiens
atttgcttcatagatctgtgga

SEQ ID NO: 9229703 - DNA, 22 bp, Homo sapiens
atttgcttagattcagcacttt

SEQ ID NO: 9229704 - DNA, 22 bp, Homo sapiens
atttgcttatctccacagttgt

SEQ ID NO: 9229705 - DNA, 22 bp, Homo sapiens
atttgcttgtaaatgtatgcct

SEQ ID NO: 9229706 - DNA, 22 bp, Homo sapiens
atttgcttggtcttctctccgt

SEQ ID NO: 9229707 - DNA, 22 bp, Homo sapiens
atttgcttcttgcttccagcac

SEQ ID NO: 9229708 - DNA, 22 bp, Homo sapiens
atttgcttctgtgaaatcaagt

SEQ ID NO: 9229709 - DNA, 22 bp, Homo sapiens
agcaaacagtttctggggatct

SEQ ID NO: 9229710 - DNA, 22 bp, Homo sapiens
agcaaaagatagattaacaaga

SEQ ID NO: 9229711 - DNA, 22 bp, Homo sapiens
agcaaaataaggtaatttattg

SEQ ID NO: 9229712 - DNA, 22 bp, Homo sapiens
agcaaaataaggtaatttattg

SEQ ID NO: 9229713 - DNA, 17 bp, Homo sapiens
agcaaaagtatcaaagc

SEQ ID NO: 9229714 - DNA, 22 bp, Homo sapiens
agatttcaatgtgagcattagt

SEQ ID NO: 9229715 - DNA, 22 bp, Homo sapiens
agatttcacatgctgctctatt

SEQ ID NO: 9229716 - DNA, 22 bp, Homo sapiens
atttgctttcaggtataaaagg

SEQ ID NO: 9229717 - DNA, 22 bp, Homo sapiens
atttgctttaaggtataaaagg

SEQ ID NO: 9229718 - DNA, 22 bp, Homo sapiens
atttgcttgttcaccagtactt

SEQ ID NO: 9229719 - DNA, 22 bp, Homo sapiens
atttgcttgtgctatgaaagtt

SEQ ID NO: 9229720 - DNA, 22 bp, Homo sapiens
agagtggggaaggtgttgagaa

SEQ ID NO: 9229721 - DNA, 22 bp, Homo sapiens
agagtgggcctctgagtcccag

SEQ ID NO: 9229722 - DNA, 22 bp, Homo sapiens
agagtgggacacgggcgctgtc

SEQ ID NO: 9229723 - DNA, 22 bp, Homo sapiens
agagtgggacacgggcgctgtc

SEQ ID NO: 9229724 - DNA, 22 bp, Homo sapiens
agagtgggacacgggcgctgtc

SEQ ID NO: 9229725 - DNA, 23 bp, Homo sapiens
atttacaggttaaatgaaatcag

SEQ ID NO: 9229726 - DNA, 23 bp, Homo sapiens
atttacaggttaaatgaaatcag

SEQ ID NO: 9229727 - DNA, 23 bp, Homo sapiens
atttacaggttaaatgaaatcag

SEQ ID NO: 9229728 - DNA, 22 bp, Homo sapiens
atttagaagttggagggcaaga

SEQ ID NO: 9229729 - DNA, 22 bp, Homo sapiens
atttagaagttggagggcaaga

SEQ ID NO: 9229730 - DNA, 22 bp, Homo sapiens
atttagcaagagtacaaaataa

SEQ ID NO: 9229731 - DNA, 22 bp, Homo sapiens
atttagcaagagtacaaaataa

SEQ ID NO: 9229732 - DNA, 22 bp, Homo sapiens
atttagagaataagacataaat

SEQ ID NO: 9229733 - DNA, 22 bp, Homo sapiens
atttattatgggatttggctca

SEQ ID NO: 9229734 - DNA, 22 bp, Homo sapiens
atttattatgggatttggctca

SEQ ID NO: 9229735 - DNA, 22 bp, Homo sapiens
atttattatgggatttggctca

SEQ ID NO: 9229736 - DNA, 22 bp, Homo sapiens
atttattatgggatttggctca

SEQ ID NO: 9229737 - DNA, 22 bp, Homo sapiens
atttagcagtcctcctcacaat

SEQ ID NO: 9229738 - DNA, 22 bp, Homo sapiens
atttagctttctctcactggtg

SEQ ID NO: 9229739 - DNA, 22 bp, Homo sapiens
atttagcacctccatctcaaca

SEQ ID NO: 9229740 - DNA, 17 bp, Homo sapiens
atttagcaagtagacag

SEQ ID NO: 9229741 - DNA, 22 bp, Homo sapiens
atttattgaacactgactatgt

SEQ ID NO: 9229742 - DNA, 22 bp, Homo sapiens
atttattgaacactgactatgt

SEQ ID NO: 9229743 - DNA, 22 bp, Homo sapiens
atttattgaacactgactatgt

SEQ ID NO: 9229744 - DNA, 22 bp, Homo sapiens
atttattgaacactgactatgt

SEQ ID NO: 9229745 - DNA, 22 bp, Homo sapiens
atttattattgtggttacttct

SEQ ID NO: 9229746 - DNA, 22 bp, Homo sapiens
atttattattgtggttacttct

SEQ ID NO: 9229747 - DNA, 22 bp, Homo sapiens
atttattattgtggttacttct

SEQ ID NO: 9229748 - DNA, 22 bp, Homo sapiens
atttattattgtggttacttct

SEQ ID NO: 9229749 - DNA, 22 bp, Homo sapiens
atttattattgtggttacttct

SEQ ID NO: 9229750 - DNA, 22 bp, Homo sapiens
attcttcatgttgaagctgtca

SEQ ID NO: 9229751 - DNA, 23 bp, Homo sapiens
attcttcattatcttctagaaaa

SEQ ID NO: 9229752 - DNA, 23 bp, Homo sapiens
attcttcattatcttctagaaaa

SEQ ID NO: 9229753 - DNA, 19 bp, Homo sapiens
attcttctcaaatatccat

SEQ ID NO: 9229754 - DNA, 22 bp, Homo sapiens
attcttctaatatgatcgtgtt

SEQ ID NO: 9229755 - DNA, 19 bp, Homo sapiens
attcttctcaaatatccat

SEQ ID NO: 9229756 - DNA, 22 bp, Homo sapiens
attcttctcccttagggcccag

SEQ ID NO: 9229757 - DNA, 22 bp, Homo sapiens
attcttctcccttagggcccag

SEQ ID NO: 9229758 - DNA, 22 bp, Homo sapiens
agagggtgggcacgtgatggat

SEQ ID NO: 9229759 - DNA, 22 bp, Homo sapiens
agagggtgggcacgtgatggat

SEQ ID NO: 9229760 - DNA, 22 bp, Homo sapiens
agaggtagaaaataatggagag

SEQ ID NO: 9229761 - DNA, 22 bp, Homo sapiens
agaggtagaggttgcagtgagc

SEQ ID NO: 9229762 - DNA, 22 bp, Homo sapiens
agaggtagaggttgcagtgagc

SEQ ID NO: 9229763 - DNA, 22 bp, Homo sapiens
agaggtatatattctccatatt

SEQ ID NO: 9229764 - DNA, 22 bp, Homo sapiens
atttaagggatttggagaccaa

SEQ ID NO: 9229765 - DNA, 22 bp, Homo sapiens
atttaagattgcgtattcatgt

SEQ ID NO: 9229766 - DNA, 22 bp, Homo sapiens
atttaagggatttggagaccaa

SEQ ID NO: 9229767 - DNA, 22 bp, Homo sapiens
atttaataccacttggtgcttt

SEQ ID NO: 9229768 - DNA, 18 bp, Homo sapiens
atttaatgaactgaaagc

SEQ ID NO: 9229769 - DNA, 22 bp, Homo sapiens
atttaatgggtagacattgtta

SEQ ID NO: 9229770 - DNA, 23 bp, Homo sapiens
atttaatgctgagttgaatgtta

SEQ ID NO: 9229771 - DNA, 22 bp, Homo sapiens
atttaaattttctgatggagag

SEQ ID NO: 9229772 - DNA, 22 bp, Homo sapiens
atttaaattttctgatggagag

SEQ ID NO: 9229773 - DNA, 22 bp, Homo sapiens
atttaaattttctgatggagag

SEQ ID NO: 9229774 - DNA, 22 bp, Homo sapiens
atttaaattttctgatggagag

SEQ ID NO: 9229775 - DNA, 22 bp, Homo sapiens
attgttaataactattacattg

SEQ ID NO: 9229776 - DNA, 18 bp, Homo sapiens
attgttaatagagtactt

SEQ ID NO: 9229777 - DNA, 19 bp, Homo sapiens
attcttctcaaatatccat

SEQ ID NO: 9229778 - DNA, 22 bp, Homo sapiens
attcttctctgggttgggttca

SEQ ID NO: 9229779 - DNA, 19 bp, Homo sapiens
attcttctcttcctgctgt

SEQ ID NO: 9229780 - DNA, 19 bp, Homo sapiens
attcttctcttcctgctgt

SEQ ID NO: 9229781 - DNA, 22 bp, Homo sapiens
atttaagactgacttcaccagt

SEQ ID NO: 9229782 - DNA, 22 bp, Homo sapiens
atttaagactgacttcaccagt

SEQ ID NO: 9229783 - DNA, 22 bp, Homo sapiens
atttaagaggctgctagagtat

SEQ ID NO: 9229784 - DNA, 22 bp, Homo sapiens
atttaagattgcgtattcatgt

SEQ ID NO: 9229785 - DNA, 22 bp, Homo sapiens
atttaagattgcgtattcatgt

SEQ ID NO: 9229786 - DNA, 22 bp, Homo sapiens
atgcagggtctccgtgtgacga

SEQ ID NO: 9229787 - DNA, 22 bp, Homo sapiens
atgcagggtctccgtgtgacga

SEQ ID NO: 9229788 - DNA, 23 bp, Homo sapiens
atgcagggttacagggctgactt

SEQ ID NO: 9229789 - DNA, 22 bp, Homo sapiens
atgcaggggcagcagagcctgg

SEQ ID NO: 9229790 - DNA, 22 bp, Homo sapiens
atgcaggggccgcctggccagg

SEQ ID NO: 9229791 - DNA, 22 bp, Homo sapiens
atgcagggattaaatgactgcc

SEQ ID NO: 9229792 - DNA, 23 bp, Homo sapiens
atggaaatagcatgtgtcattta

SEQ ID NO: 9229793 - DNA, 22 bp, Homo sapiens
atggaaatacacaagaggtttc

SEQ ID NO: 9229794 - DNA, 22 bp, Homo sapiens
atggaaagtgcatggaagtcat

SEQ ID NO: 9229795 - DNA, 22 bp, Homo sapiens
atggaaaggctgtggaaactta

SEQ ID NO: 9229796 - DNA, 22 bp, Homo sapiens
atggaaagggaagcaaggaaca

SEQ ID NO: 9229797 - DNA, 22 bp, Homo sapiens
atggaaaggctgtggaaactta

SEQ ID NO: 9229798 - DNA, 22 bp, Homo sapiens
atggaaagccagtgttccatca

SEQ ID NO: 9229799 - DNA, 22 bp, Homo sapiens
atggaaagctaagccatttacc

SEQ ID NO: 9229800 - DNA, 19 bp, Homo sapiens
atggaaaatgccagactga

SEQ ID NO: 9229801 - DNA, 19 bp, Homo sapiens
atggaaaatgccagactga

SEQ ID NO: 9229802 - DNA, 22 bp, Homo sapiens
agactacatatgccacatgaag

SEQ ID NO: 9229803 - DNA, 22 bp, Homo sapiens
agactacagaatggcattgttt

SEQ ID NO: 9229804 - DNA, 22 bp, Homo sapiens
agactctgaggagccctgagac

SEQ ID NO: 9229805 - DNA, 22 bp, Homo sapiens
agactctgaaatctaggtgcaa

SEQ ID NO: 9229806 - DNA, 22 bp, Homo sapiens
agactaaaagaaggaagctacc

SEQ ID NO: 9229807 - DNA, 22 bp, Homo sapiens
agactaaataatgatttactgg

SEQ ID NO: 9229808 - DNA, 22 bp, Homo sapiens
agactaaatagttacaggtagg

SEQ ID NO: 9229809 - DNA, 22 bp, Homo sapiens
agactaaattgggatgtgttgt

SEQ ID NO: 9229810 - DNA, 22 bp, Homo sapiens
agacgctattttgaggggtcta

SEQ ID NO: 9229811 - DNA, 22 bp, Homo sapiens
agacggattacctgaggtcagg

SEQ ID NO: 9229812 - DNA, 22 bp, Homo sapiens
atggaaatcaggttcatccaag

SEQ ID NO: 9229813 - DNA, 22 bp, Homo sapiens
atggaaatcaggttcatccaag

SEQ ID NO: 9229814 - DNA, 22 bp, Homo sapiens
atggaaatcgatgtctaagtta

SEQ ID NO: 9229815 - DNA, 22 bp, Homo sapiens
atggaaatccaagtcaccgtag

SEQ ID NO: 9229816 - DNA, 22 bp, Homo sapiens
atggaaatatctttagagctta

SEQ ID NO: 9229817 - DNA, 22 bp, Homo sapiens
atggagtgggccaattttagtg

SEQ ID NO: 9229818 - DNA, 22 bp, Homo sapiens
atggcagatggctggagcaggt

SEQ ID NO: 9229819 - DNA, 22 bp, Homo sapiens
atggataagtcaaagagtatcc

SEQ ID NO: 9229820 - DNA, 22 bp, Homo sapiens
atggcagatggctggagcaggt

SEQ ID NO: 9229821 - DNA, 22 bp, Homo sapiens
atggcagatggctggagcaggt

SEQ ID NO: 9229822 - DNA, 22 bp, Homo sapiens
atggcagatggctggagcaggt

SEQ ID NO: 9229823 - DNA, 22 bp, Homo sapiens
atggataagaacaaatatctga

SEQ ID NO: 9229824 - DNA, 22 bp, Homo sapiens
atggataagtcaaagagtatcc

SEQ ID NO: 9229825 - DNA, 22 bp, Homo sapiens
atggataagaacaaatatctga

SEQ ID NO: 9229826 - DNA, 22 bp, Homo sapiens
atggataagaacaaatatctga

SEQ ID NO: 9229827 - DNA, 22 bp, Homo sapiens
atggataacccagttcatttct

SEQ ID NO: 9229828 - DNA, 22 bp, Homo sapiens
atggagtttggggtcaaatact

SEQ ID NO: 9229829 - DNA, 22 bp, Homo sapiens
atggcagcatagtggcaagtta

SEQ ID NO: 9229830 - DNA, 22 bp, Homo sapiens
atggcagcaaatgtctggctgg

SEQ ID NO: 9229831 - DNA, 19 bp, Homo sapiens
atggcagcagcagctctcc

SEQ ID NO: 9229832 - DNA, 22 bp, Homo sapiens
atggcagcctgagcagaggaat

SEQ ID NO: 9229833 - DNA, 22 bp, Homo sapiens
atggcagcctgaacacttcctg

SEQ ID NO: 9229834 - DNA, 22 bp, Homo sapiens
atggctcagcgcctttctgtgg

SEQ ID NO: 9229835 - DNA, 22 bp, Homo sapiens
atggctcagcgcctttctgtgg

SEQ ID NO: 9229836 - DNA, 18 bp, Homo sapiens
atggctcaggaatggctt

SEQ ID NO: 9229837 - DNA, 18 bp, Homo sapiens
atggctcaggaatggctt

SEQ ID NO: 9229838 - DNA, 22 bp, Homo sapiens
atggctgggtcaccatcagggt

SEQ ID NO: 9229839 - DNA, 22 bp, Homo sapiens
atggctgggtcaccatcagggt

SEQ ID NO: 9229840 - DNA, 22 bp, Homo sapiens
atggctggtgatactggagtga

SEQ ID NO: 9229841 - DNA, 22 bp, Homo sapiens
atgggaggatgctcgggtgctc

SEQ ID NO: 9229842 - DNA, 22 bp, Homo sapiens
atgggaggcaaagatcgcagaa

SEQ ID NO: 9229843 - DNA, 22 bp, Homo sapiens
atgggaggcaaagatcgcagaa

SEQ ID NO: 9229844 - DNA, 22 bp, Homo sapiens
atgggaggcagacactaagttc

SEQ ID NO: 9229845 - DNA, 22 bp, Homo sapiens
atgggaggcagcagagcccagc

SEQ ID NO: 9229846 - DNA, 22 bp, Homo sapiens
atgggtggagggtgacacggat

SEQ ID NO: 9229847 - DNA, 22 bp, Homo sapiens
atgggaggcaggctcagaaccg

SEQ ID NO: 9229848 - DNA, 22 bp, Homo sapiens
atgggaggcagcagagcccagc

SEQ ID NO: 9229849 - DNA, 22 bp, Homo sapiens
atgggaggcagcagagcccagc

SEQ ID NO: 9229850 - DNA, 22 bp, Homo sapiens
atgggaggcagcagagcccagc

SEQ ID NO: 9229851 - DNA, 22 bp, Homo sapiens
atgggaggaaggaggcccttga

SEQ ID NO: 9229852 - DNA, 22 bp, Homo sapiens
atgggaggaaggaggcccttga

SEQ ID NO: 9229853 - DNA, 22 bp, Homo sapiens
atgggaggaagagaagatgtct

SEQ ID NO: 9229854 - DNA, 22 bp, Homo sapiens
atgggaggatcacttgaggcca

SEQ ID NO: 9229855 - DNA, 22 bp, Homo sapiens
atgtaaaagattattttcctgt

SEQ ID NO: 9229856 - DNA, 20 bp, Homo sapiens
atgtaaaattataaggctga

SEQ ID NO: 9229857 - DNA, 22 bp, Homo sapiens
atgtacacatgcatgcatgtgc

SEQ ID NO: 9229858 - DNA, 22 bp, Homo sapiens
atgggtggccccgtgtgcagtc

SEQ ID NO: 9229859 - DNA, 22 bp, Homo sapiens
atgggtggagggtgacacggat

SEQ ID NO: 9229860 - DNA, 20 bp, Homo sapiens
atgtaaaagacagggagtag

SEQ ID NO: 9229861 - DNA, 22 bp, Homo sapiens
atgtcccaagatacagctagag

SEQ ID NO: 9229862 - DNA, 22 bp, Homo sapiens
atgtcccaagatacagctagag

SEQ ID NO: 9229863 - DNA, 22 bp, Homo sapiens
atgtacagtggaaactaacaaa

SEQ ID NO: 9229864 - DNA, 22 bp, Homo sapiens
atgtacataaaatgtataatga

SEQ ID NO: 9229865 - DNA, 22 bp, Homo sapiens
atgtccaagtcacagattttca

SEQ ID NO: 9229866 - DNA, 22 bp, Homo sapiens
atgtccaatttctgaggctgct

SEQ ID NO: 9229867 - DNA, 22 bp, Homo sapiens
atgtcaaatcagttttatcaga

SEQ ID NO: 9229868 - DNA, 22 bp, Homo sapiens
atgtcaaatcagttttatcaga

SEQ ID NO: 9229869 - DNA, 22 bp, Homo sapiens
agaagattattagagactttgt

SEQ ID NO: 9229870 - DNA, 22 bp, Homo sapiens
agaagatttaggttgacgctat

SEQ ID NO: 9229871 - DNA, 22 bp, Homo sapiens
agaagcaaggtctgtcagtata

SEQ ID NO: 9229872 - DNA, 23 bp, Homo sapiens
agaagcaatgctttttttcctct

SEQ ID NO: 9229873 - DNA, 22 bp, Homo sapiens
atcttattgctgttgccagata

SEQ ID NO: 9229874 - DNA, 22 bp, Homo sapiens
atcttatgagacccataaagat

SEQ ID NO: 9229875 - DNA, 22 bp, Homo sapiens
atcttatgttgtattcaaaatc

SEQ ID NO: 9229876 - DNA, 22 bp, Homo sapiens
atctttacagtgtaagtgcaga

SEQ ID NO: 9229877 - DNA, 22 bp, Homo sapiens
atctttaaagacatgtgaactt

SEQ ID NO: 9229878 - DNA, 22 bp, Homo sapiens
atctttaaagacatgtgaactt

SEQ ID NO: 9229879 - DNA, 22 bp, Homo sapiens
agaagagaaatagtgccactgt

SEQ ID NO: 9229880 - DNA, 22 bp, Homo sapiens
agaagacagagtctacattcta

SEQ ID NO: 9229881 - DNA, 22 bp, Homo sapiens
agaagaaatgtgaaggccactg

SEQ ID NO: 9229882 - DNA, 20 bp, Homo sapiens
agaagaggatacaaccaggc

SEQ ID NO: 9229883 - DNA, 22 bp, Homo sapiens
agaagatgttgcagttgatgcg

SEQ ID NO: 9229884 - DNA, 22 bp, Homo sapiens
agaagagccctttaagggggaa

SEQ ID NO: 9229885 - DNA, 22 bp, Homo sapiens
agaagagcctggggaccatggc

SEQ ID NO: 9229886 - DNA, 22 bp, Homo sapiens
agaatacatcaatctattttct

SEQ ID NO: 9229887 - DNA, 22 bp, Homo sapiens
agaatacatcaatctattttct

SEQ ID NO: 9229888 - DNA, 22 bp, Homo sapiens
agaatacatcaatctattttct

SEQ ID NO: 9229889 - DNA, 22 bp, Homo sapiens
agaatacatctagtgctgcatg

SEQ ID NO: 9229890 - DNA, 22 bp, Homo sapiens
agaatagttttacttttctatg

SEQ ID NO: 9229891 - DNA, 22 bp, Homo sapiens
agaatactaggcttcagaaagg

SEQ ID NO: 9229892 - DNA, 22 bp, Homo sapiens
agaatactaggcttcagaaagg

SEQ ID NO: 9229893 - DNA, 22 bp, Homo sapiens
atctttgtgctaatgtagttct

SEQ ID NO: 9229894 - DNA, 20 bp, Homo sapiens
atctttgtctctgtagttgt

SEQ ID NO: 9229895 - DNA, 22 bp, Homo sapiens
agaagtttggtccttttcaagg

SEQ ID NO: 9229896 - DNA, 22 bp, Homo sapiens
agaatacaattgttcagtaata

SEQ ID NO: 9229897 - DNA, 22 bp, Homo sapiens
agaatacaattgttcagtaata

SEQ ID NO: 9229898 - DNA, 21 bp, Homo sapiens
atctttattacgcagagaaga

SEQ ID NO: 9229899 - DNA, 22 bp, Homo sapiens
agaaggccaatagggtgcactg

SEQ ID NO: 9229900 - DNA, 22 bp, Homo sapiens
agaaggcctaacttgggggcaa

SEQ ID NO: 9229901 - DNA, 22 bp, Homo sapiens
agacacagtataagcacaacaa

SEQ ID NO: 9229902 - DNA, 22 bp, Homo sapiens
agacacagtataagcacaacaa

SEQ ID NO: 9229903 - DNA, 22 bp, Homo sapiens
agacacagtctgtctggaggag

SEQ ID NO: 9229904 - DNA, 22 bp, Homo sapiens
agacacagtctgtctggaggag

SEQ ID NO: 9229905 - DNA, 22 bp, Homo sapiens
agacacataggaccacactgtg

SEQ ID NO: 9229906 - DNA, 22 bp, Homo sapiens
agacaggcagaggctgcagagg

SEQ ID NO: 9229907 - DNA, 22 bp, Homo sapiens
agacaggcagaggctgcagagg

SEQ ID NO: 9229908 - DNA, 22 bp, Homo sapiens
agacacagtgctgggtgctgag

SEQ ID NO: 9229909 - DNA, 22 bp, Homo sapiens
atgcaggcagacactgtgggca

SEQ ID NO: 9229910 - DNA, 22 bp, Homo sapiens
atgcagggacctttgctttggt

SEQ ID NO: 9229911 - DNA, 22 bp, Homo sapiens
atgcagggaggtaagaggtgcc

SEQ ID NO: 9229912 - DNA, 22 bp, Homo sapiens
agacagtgattcttcacatttc

SEQ ID NO: 9229913 - DNA, 22 bp, Homo sapiens
agacagtgatgtaagcaggagt

SEQ ID NO: 9229914 - DNA, 22 bp, Homo sapiens
agacagtgatgtaagcaggagt

SEQ ID NO: 9229915 - DNA, 22 bp, Homo sapiens
agacagtgcaagaagagcaggc

SEQ ID NO: 9229916 - DNA, 22 bp, Homo sapiens
agacagtgcaagaagagcaggc

SEQ ID NO: 9229917 - DNA, 22 bp, Homo sapiens
agacagtgatggacaggcagac

SEQ ID NO: 9229918 - DNA, 17 bp, Homo sapiens
agacagtgagtgccttg

SEQ ID NO: 9229919 - DNA, 22 bp, Homo sapiens
agacagtgacttagtgaccaga

SEQ ID NO: 9229920 - DNA, 21 bp, Homo sapiens
agacagtaactcttctactcc

SEQ ID NO: 9229921 - DNA, 22 bp, Homo sapiens
agacaatttttggttttgcaag

SEQ ID NO: 9229922 - DNA, 22 bp, Homo sapiens
agacacagaagttgctgttggg

SEQ ID NO: 9229923 - DNA, 22 bp, Homo sapiens
agacacagaagttgctgttggg

SEQ ID NO: 9229924 - DNA, 22 bp, Homo sapiens
agacacagaagttgctgttggg

SEQ ID NO: 9229925 - DNA, 22 bp, Homo sapiens
agacacagcaataactactgtt

SEQ ID NO: 9229926 - DNA, 22 bp, Homo sapiens
agaattagccggattcttgttt

SEQ ID NO: 9229927 - DNA, 22 bp, Homo sapiens
agaattacataaatacatgaat

SEQ ID NO: 9229928 - DNA, 22 bp, Homo sapiens
agacaatacatttattcccttt

SEQ ID NO: 9229929 - DNA, 20 bp, Homo sapiens
agaattcttaccctttgatg

SEQ ID NO: 9229930 - DNA, 22 bp, Homo sapiens
agaattctgttcttcgggtgtg

SEQ ID NO: 9229931 - DNA, 22 bp, Homo sapiens
agaattctggagttgggaggaa

SEQ ID NO: 9229932 - DNA, 21 bp, Homo sapiens
agaattcttaagtattctaat

SEQ ID NO: 9229933 - DNA, 22 bp, Homo sapiens
agaattctccttcagggcagga

SEQ ID NO: 9229934 - DNA, 22 bp, Homo sapiens
agaattctgacaatagaattgg

SEQ ID NO: 9229935 - DNA, 22 bp, Homo sapiens
agaattctgacaatagaattgg

SEQ ID NO: 9229936 - DNA, 22 bp, Homo sapiens
agaattctcttccattgaaaca

SEQ ID NO: 9229937 - DNA, 22 bp, Homo sapiens
agaattctcttccattgaaaca

SEQ ID NO: 9229938 - DNA, 22 bp, Homo sapiens
agaatgtagtcttggagattta

SEQ ID NO: 9229939 - DNA, 22 bp, Homo sapiens
agaatgcattttgtgtagctat

SEQ ID NO: 9229940 - DNA, 22 bp, Homo sapiens
agaatgctcttcaaaatctagc

SEQ ID NO: 9229941 - DNA, 22 bp, Homo sapiens
agaatgtgttattagagaagga

SEQ ID NO: 9229942 - DNA, 22 bp, Homo sapiens
agaatgttttcatgagaatgaa

SEQ ID NO: 9229943 - DNA, 22 bp, Homo sapiens
agaatgtgttttaacatgggaa

SEQ ID NO: 9229944 - DNA, 22 bp, Homo sapiens
agaatcttgggcaaattcatct

SEQ ID NO: 9229945 - DNA, 22 bp, Homo sapiens
agaatctttctgaatgactgtg

SEQ ID NO: 9229946 - DNA, 22 bp, Homo sapiens
agaatctttcctcattgctgtc

SEQ ID NO: 9229947 - DNA, 22 bp, Homo sapiens
agaatgatagctagtatttact

SEQ ID NO: 9229948 - DNA, 22 bp, Homo sapiens
agaatgaattaatcaactggaa

SEQ ID NO: 9229949 - DNA, 22 bp, Homo sapiens
cagaaccaggaactgatggaga

SEQ ID NO: 9229950 - DNA, 22 bp, Homo sapiens
cagaactgggcagggagcagag

SEQ ID NO: 9229951 - DNA, 22 bp, Homo sapiens
cagaactgggcagggagcagag

SEQ ID NO: 9229952 - DNA, 22 bp, Homo sapiens
agccacagcgaacctctcttcc

SEQ ID NO: 9229953 - DNA, 22 bp, Homo sapiens
agccacagcgaacctctcttcc

SEQ ID NO: 9229954 - DNA, 22 bp, Homo sapiens
agccacagctccttggtggaga

SEQ ID NO: 9229955 - DNA, 22 bp, Homo sapiens
agccacagctccttggtggaga

SEQ ID NO: 9229956 - DNA, 22 bp, Homo sapiens
agccacagctccttggtggaga

SEQ ID NO: 9229957 - DNA, 22 bp, Homo sapiens
cagaaatgacaaagtaagagga

SEQ ID NO: 9229958 - DNA, 22 bp, Homo sapiens
agccacagcaacaagtgcaatt

SEQ ID NO: 9229959 - DNA, 22 bp, Homo sapiens
agccacagcatgtgtgtatgta

SEQ ID NO: 9229960 - DNA, 22 bp, Homo sapiens
agccacagcatgtgtgtatgta

SEQ ID NO: 9229961 - DNA, 22 bp, Homo sapiens
agccacagcacattgtaagaaa

SEQ ID NO: 9229962 - DNA, 22 bp, Homo sapiens
agccacagcacattgtaagaaa

SEQ ID NO: 9229963 - DNA, 22 bp, Homo sapiens
agccacagcacattgtaagaaa

SEQ ID NO: 9229964 - DNA, 22 bp, Homo sapiens
agccacagcccacaggactctt

SEQ ID NO: 9229965 - DNA, 23 bp, Homo sapiens
agccacagccagagctatctcca

SEQ ID NO: 9229966 - DNA, 22 bp, Homo sapiens
agccacagcatgtgtgtatgta

SEQ ID NO: 9229967 - DNA, 22 bp, Homo sapiens
agccacagagagggagctgcaa

SEQ ID NO: 9229968 - DNA, 22 bp, Homo sapiens
agccacagagcaggagaccttt

SEQ ID NO: 9229969 - DNA, 22 bp, Homo sapiens
agccacagagcaggagaccttt

SEQ ID NO: 9229970 - DNA, 22 bp, Homo sapiens
agccacagagcaggagaccttt

SEQ ID NO: 9229971 - DNA, 22 bp, Homo sapiens
agccacagaggttgatgtggtt

SEQ ID NO: 9229972 - DNA, 22 bp, Homo sapiens
agccacagaggttgatgtggtt

SEQ ID NO: 9229973 - DNA, 19 bp, Homo sapiens
agccacagaacttgcagga

SEQ ID NO: 9229974 - DNA, 19 bp, Homo sapiens
agccacagaacttgcagga

SEQ ID NO: 9229975 - DNA, 19 bp, Homo sapiens
agccacagaacttgcagga

SEQ ID NO: 9229976 - DNA, 22 bp, Homo sapiens
agccacagagagggagctgcaa

SEQ ID NO: 9229977 - DNA, 22 bp, Homo sapiens
agccacaaaggcttgcctcgga

SEQ ID NO: 9229978 - DNA, 22 bp, Homo sapiens
agccaagctgatctcctgctga

SEQ ID NO: 9229979 - DNA, 22 bp, Homo sapiens
agccacacctgtcctgccagct

SEQ ID NO: 9229980 - DNA, 22 bp, Homo sapiens
agccacacctgtcctgccagct

SEQ ID NO: 9229981 - DNA, 22 bp, Homo sapiens
agccacacagcttaatgacaga

SEQ ID NO: 9229982 - DNA, 22 bp, Homo sapiens
cactgaaacaggtattgctggt

SEQ ID NO: 9229983 - DNA, 22 bp, Homo sapiens
agccaggatggtctcgatcggc

SEQ ID NO: 9229984 - DNA, 22 bp, Homo sapiens
agccaggatggtctcgatcggc

SEQ ID NO: 9229985 - DNA, 22 bp, Homo sapiens
agccagctccctcccctgcagg

SEQ ID NO: 9229986 - DNA, 21 bp, Homo sapiens
agccagctatcacacagcatt

SEQ ID NO: 9229987 - DNA, 22 bp, Homo sapiens
cagacagacagccgtggccacc

SEQ ID NO: 9229988 - DNA, 22 bp, Homo sapiens
cagacagacagccgtggccacc

SEQ ID NO: 9229989 - DNA, 22 bp, Homo sapiens
agccaggcagggctctcgctct

SEQ ID NO: 9229990 - DNA, 22 bp, Homo sapiens
agccaggattggctgagcctta

SEQ ID NO: 9229991 - DNA, 21 bp, Homo sapiens
agccaggcaagcacccccact

SEQ ID NO: 9229992 - DNA, 21 bp, Homo sapiens
agccaggcaagcacccccact

SEQ ID NO: 9229993 - DNA, 22 bp, Homo sapiens
agccaggcagactctctttctt

SEQ ID NO: 9229994 - DNA, 22 bp, Homo sapiens
agccaggcagactctctttctt

SEQ ID NO: 9229995 - DNA, 22 bp, Homo sapiens
cagaagaatggtgtctgagctc

SEQ ID NO: 9229996 - DNA, 22 bp, Homo sapiens
cagaagcagtgagagatgtgca

SEQ ID NO: 9229997 - DNA, 22 bp, Homo sapiens
cagaacttcatattgacgttag

SEQ ID NO: 9229998 - DNA, 22 bp, Homo sapiens
cagaagaaagtggggagacaag

SEQ ID NO: 9229999 - DNA, 22 bp, Homo sapiens
cagaagcctgcctcagatgcac

SEQ ID NO: 9230000 - DNA, 22 bp, Homo sapiens
cagaagctgaggagtgaggcaa

SEQ ID NO: 9230001 - DNA, 22 bp, Homo sapiens
cagaagcattgactccttgctc

SEQ ID NO: 9230002 - DNA, 22 bp, Homo sapiens
cagaagcattgactccttgctc

SEQ ID NO: 9230003 - DNA, 22 bp, Homo sapiens
cagaagcattgactccttgctc

SEQ ID NO: 9230004 - DNA, 22 bp, Homo sapiens
cagaagcattccagcaaatagt

SEQ ID NO: 9230005 - DNA, 22 bp, Homo sapiens
cagaagcattccagcaaatagt

SEQ ID NO: 9230006 - DNA, 23 bp, Homo sapiens
cagagctggctcagagctgcctg

SEQ ID NO: 9230007 - DNA, 19 bp, Homo sapiens
agcccccagacagcaggcc

SEQ ID NO: 9230008 - DNA, 22 bp, Homo sapiens
cagagctggagggaaccctggc

SEQ ID NO: 9230009 - DNA, 22 bp, Homo sapiens
cagagctggagggaaccctggc

SEQ ID NO: 9230010 - DNA, 22 bp, Homo sapiens
cagagctggagggaaccctggc

SEQ ID NO: 9230011 - DNA, 22 bp, Homo sapiens
cagagctggcggtgagaagaca

SEQ ID NO: 9230012 - DNA, 23 bp, Homo sapiens
cagagctggctcagagctgcctg

SEQ ID NO: 9230013 - DNA, 22 bp, Homo sapiens
agccctcatggaacagctccta

SEQ ID NO: 9230014 - DNA, 22 bp, Homo sapiens
agccctcatggaacagctccta

SEQ ID NO: 9230015 - DNA, 22 bp, Homo sapiens
agcccggcttccccggttgcta

SEQ ID NO: 9230016 - DNA, 22 bp, Homo sapiens
agcccggcttccccggttgcta

SEQ ID NO: 9230017 - DNA, 22 bp, Homo sapiens
agccccttgtgggcgcacagca

SEQ ID NO: 9230018 - DNA, 19 bp, Homo sapiens
agccccttggtactgtcct

SEQ ID NO: 9230019 - DNA, 22 bp, Homo sapiens
agccccttggaacacagggctg

SEQ ID NO: 9230020 - DNA, 22 bp, Homo sapiens
agccccttgctgccctctagag

SEQ ID NO: 9230021 - DNA, 22 bp, Homo sapiens
agcccaggagcctttggagggt

SEQ ID NO: 9230022 - DNA, 22 bp, Homo sapiens
agcccaggaggtggaggttgca

SEQ ID NO: 9230023 - DNA, 22 bp, Homo sapiens
agcccaggaagttgaggcttgc

SEQ ID NO: 9230024 - DNA, 22 bp, Homo sapiens
agcccaggaagttgaggcttgc

SEQ ID NO: 9230025 - DNA, 22 bp, Homo sapiens
agcccaggagtttgaggctgtg

SEQ ID NO: 9230026 - DNA, 22 bp, Homo sapiens
agcccaggagtttgaggctgtg

SEQ ID NO: 9230027 - DNA, 22 bp, Homo sapiens
agcccaggagtttgaggctgtg

SEQ ID NO: 9230028 - DNA, 22 bp, Homo sapiens
agcccaggagtccttaaggacc

SEQ ID NO: 9230029 - DNA, 22 bp, Homo sapiens
agcccaggagtttgaggctgtg

SEQ ID NO: 9230030 - DNA, 22 bp, Homo sapiens
cagagctggagcttgaatggag

SEQ ID NO: 9230031 - DNA, 22 bp, Homo sapiens
cagagctggagcttgaatggag

SEQ ID NO: 9230032 - DNA, 22 bp, Homo sapiens
cagagctgcttcccagtttgtg

SEQ ID NO: 9230033 - DNA, 22 bp, Homo sapiens
cagagctgcttcccagtttgtg

SEQ ID NO: 9230034 - DNA, 22 bp, Homo sapiens
cagagctggagaagtggattta

SEQ ID NO: 9230035 - DNA, 22 bp, Homo sapiens
agccagggttagaagatagtca

SEQ ID NO: 9230036 - DNA, 22 bp, Homo sapiens
agccaggtcagctcaccctgct

SEQ ID NO: 9230037 - DNA, 22 bp, Homo sapiens
agccaggttaaaccacagtcaa

SEQ ID NO: 9230038 - DNA, 22 bp, Homo sapiens
agccaggttgggccttttcttt

SEQ ID NO: 9230039 - DNA, 22 bp, Homo sapiens
agccaggtgcagtggcacacac

SEQ ID NO: 9230040 - DNA, 22 bp, Homo sapiens
cagacagcaggcctggatgtgt

SEQ ID NO: 9230041 - DNA, 17 bp, Homo sapiens
cagacagatatcctggg

SEQ ID NO: 9230042 - DNA, 22 bp, Homo sapiens
cagacagacctgcaagggcaca

SEQ ID NO: 9230043 - DNA, 22 bp, Homo sapiens
cagacagacctgcaagggcaca

SEQ ID NO: 9230044 - DNA, 22 bp, Homo sapiens
cagacagaggctgtatgagggc

SEQ ID NO: 9230045 - DNA, 22 bp, Homo sapiens
cagacagagctcacaagtcttt

SEQ ID NO: 9230046 - DNA, 22 bp, Homo sapiens
agccagtgatgaagactctgga

SEQ ID NO: 9230047 - DNA, 22 bp, Homo sapiens
cagagagggagcagtagtctct

SEQ ID NO: 9230048 - DNA, 22 bp, Homo sapiens
agccagtagatcgggaggatgt

SEQ ID NO: 9230049 - DNA, 19 bp, Homo sapiens
agccagtgagcctctgggt

SEQ ID NO: 9230050 - DNA, 22 bp, Homo sapiens
cagagatgggtcgcagagatgg

SEQ ID NO: 9230051 - DNA, 22 bp, Homo sapiens
agcccagccggattcccagttc

SEQ ID NO: 9230052 - DNA, 22 bp, Homo sapiens
cagagagggcggccctggcttc

SEQ ID NO: 9230053 - DNA, 22 bp, Homo sapiens
cagagagggcggccctggcttc

SEQ ID NO: 9230054 - DNA, 22 bp, Homo sapiens
cagaggcctttctacagtgata

SEQ ID NO: 9230055 - DNA, 22 bp, Homo sapiens
cagaggcgaggcagctgaacct

SEQ ID NO: 9230056 - DNA, 22 bp, Homo sapiens
cagaggctaagagtgtccaaag

SEQ ID NO: 9230057 - DNA, 22 bp, Homo sapiens
cagaggctaagatgagtgggtg

SEQ ID NO: 9230058 - DNA, 22 bp, Homo sapiens
cagaggctaagatgagtgggtg

SEQ ID NO: 9230059 - DNA, 22 bp, Homo sapiens
cagaggctaagatgagtgggtg

SEQ ID NO: 9230060 - DNA, 22 bp, Homo sapiens
cagaggctaagggtagcttggg

SEQ ID NO: 9230061 - DNA, 22 bp, Homo sapiens
cagaggctagactgtgcttcct

SEQ ID NO: 9230062 - DNA, 22 bp, Homo sapiens
cagcacagcacagcggtgactc

SEQ ID NO: 9230063 - DNA, 22 bp, Homo sapiens
cagcacagctgaggggctgtct

SEQ ID NO: 9230064 - DNA, 19 bp, Homo sapiens
cagcaagaatgaaggcata

SEQ ID NO: 9230065 - DNA, 20 bp, Homo sapiens
cagcacagagcttggctcta

SEQ ID NO: 9230066 - DNA, 22 bp, Homo sapiens
cagaggctcaccagcctttcac

SEQ ID NO: 9230067 - DNA, 22 bp, Homo sapiens
cagaggctcaccagcctttcac

SEQ ID NO: 9230068 - DNA, 22 bp, Homo sapiens
cagaggctcagatggccctggc

SEQ ID NO: 9230069 - DNA, 22 bp, Homo sapiens
cagcaagaatcagacaacctca

SEQ ID NO: 9230070 - DNA, 22 bp, Homo sapiens
cagaggctcttcctcactgccc

SEQ ID NO: 9230071 - DNA, 22 bp, Homo sapiens
cagcacagctgaggggctgtct

SEQ ID NO: 9230072 - DNA, 22 bp, Homo sapiens
cagcacaggaagtgggccttca

SEQ ID NO: 9230073 - DNA, 22 bp, Homo sapiens
cagcacaggcaggggaactata

SEQ ID NO: 9230074 - DNA, 22 bp, Homo sapiens
agcctcagggctctgcgcagac

SEQ ID NO: 9230075 - DNA, 22 bp, Homo sapiens
agcctcagggctctgcgcagac

SEQ ID NO: 9230076 - DNA, 22 bp, Homo sapiens
agcctcagggctctgcgcagac

SEQ ID NO: 9230077 - DNA, 23 bp, Homo sapiens
agcctcagccggtggcagaagtg

SEQ ID NO: 9230078 - DNA, 22 bp, Homo sapiens
agcctcagcacgcagctctgtg

SEQ ID NO: 9230079 - DNA, 22 bp, Homo sapiens
agcctcagcacgcagctctgtg

SEQ ID NO: 9230080 - DNA, 23 bp, Homo sapiens
agcctcagccggtggcagaagtg

SEQ ID NO: 9230081 - DNA, 23 bp, Homo sapiens
agcctcagccggtggcagaagtg

SEQ ID NO: 9230082 - DNA, 22 bp, Homo sapiens
cagcacagtacaaggcacggat

SEQ ID NO: 9230083 - DNA, 22 bp, Homo sapiens
cagcacagggcttgagaggtgt

SEQ ID NO: 9230084 - DNA, 22 bp, Homo sapiens
cagcacagggcttgagaggtgt

SEQ ID NO: 9230085 - DNA, 22 bp, Homo sapiens
agcctcagcacgcagctctgtg

SEQ ID NO: 9230086 - DNA, 22 bp, Homo sapiens
cagcagaggttttgctccatga

SEQ ID NO: 9230087 - DNA, 22 bp, Homo sapiens
cagcagcagcttagtggtcccc

SEQ ID NO: 9230088 - DNA, 22 bp, Homo sapiens
cagcagcagccccaggaaggtt

SEQ ID NO: 9230089 - DNA, 22 bp, Homo sapiens
cagcagcagtggctgcagaaca

SEQ ID NO: 9230090 - DNA, 22 bp, Homo sapiens
agcctggtttaagcattttata

SEQ ID NO: 9230091 - DNA, 22 bp, Homo sapiens
agcctgtccagaggacagggct

SEQ ID NO: 9230092 - DNA, 22 bp, Homo sapiens
cagcagcatgaattcgagccac

SEQ ID NO: 9230093 - DNA, 22 bp, Homo sapiens
cagcagcatcaggtctgtggtt

SEQ ID NO: 9230094 - DNA, 22 bp, Homo sapiens
agcctcagtttcaggcctcctc

SEQ ID NO: 9230095 - DNA, 21 bp, Homo sapiens
agcctcaggttgttggttctt

SEQ ID NO: 9230096 - DNA, 22 bp, Homo sapiens
agcctcagtgtcaccatctacc

SEQ ID NO: 9230097 - DNA, 20 bp, Homo sapiens
cagcagaaatggggtgggaa

SEQ ID NO: 9230098 - DNA, 22 bp, Homo sapiens
cagcagagcttatgttgggtca

SEQ ID NO: 9230099 - DNA, 22 bp, Homo sapiens
cagcagagcttattaactaaaa

SEQ ID NO: 9230100 - DNA, 22 bp, Homo sapiens
cagcagaggaaagcaaatctaa

SEQ ID NO: 9230101 - DNA, 22 bp, Homo sapiens
cagcagaggttggaacagttct

SEQ ID NO: 9230102 - DNA, 22 bp, Homo sapiens
cagcagaggttggaacagttct

SEQ ID NO: 9230103 - DNA, 22 bp, Homo sapiens
cagcagaggtggttcacattgt

SEQ ID NO: 9230104 - DNA, 22 bp, Homo sapiens
cagcagagggagccattgaaat

SEQ ID NO: 9230105 - DNA, 22 bp, Homo sapiens
cagcagagggagccattgaaat

SEQ ID NO: 9230106 - DNA, 22 bp, Homo sapiens
cagccctggcgcccccagatct

SEQ ID NO: 9230107 - DNA, 22 bp, Homo sapiens
cagccctggctagggcgagggc

SEQ ID NO: 9230108 - DNA, 22 bp, Homo sapiens
agctcctgtgtgaagcctccct

SEQ ID NO: 9230109 - DNA, 22 bp, Homo sapiens
agctcctcctgtgccaggccag

SEQ ID NO: 9230110 - DNA, 22 bp, Homo sapiens
cagccctggccccaggtggtct

SEQ ID NO: 9230111 - DNA, 20 bp, Homo sapiens
agctcctcatcactggaggt

SEQ ID NO: 9230112 - DNA, 21 bp, Homo sapiens
agctccctgtttcctcactct

SEQ ID NO: 9230113 - DNA, 21 bp, Homo sapiens
agctccctgtttcctcactct

SEQ ID NO: 9230114 - DNA, 21 bp, Homo sapiens
agctccctgtttcctcactct

SEQ ID NO: 9230115 - DNA, 22 bp, Homo sapiens
agctccctgcacgaccctgccc

SEQ ID NO: 9230116 - DNA, 22 bp, Homo sapiens
cagccagctgaatgtaccatga

SEQ ID NO: 9230117 - DNA, 22 bp, Homo sapiens
cagccagctggcactgtgagta

SEQ ID NO: 9230118 - DNA, 22 bp, Homo sapiens
cagccagcctctcaaccatgca

SEQ ID NO: 9230119 - DNA, 22 bp, Homo sapiens
cagccagatcagggcaggggtt

SEQ ID NO: 9230120 - DNA, 22 bp, Homo sapiens
cagccagatcagggcaggggtt

SEQ ID NO: 9230121 - DNA, 22 bp, Homo sapiens
cagccagcctctcaaccatgca

SEQ ID NO: 9230122 - DNA, 22 bp, Homo sapiens
cagccagatcagggcaggggtt

SEQ ID NO: 9230123 - DNA, 22 bp, Homo sapiens
cagccagatcaaactcagatgt

SEQ ID NO: 9230124 - DNA, 22 bp, Homo sapiens
cagccagatcaaactcagatgt

SEQ ID NO: 9230125 - DNA, 22 bp, Homo sapiens
cagccagaggggccagagtcgg

SEQ ID NO: 9230126 - DNA, 22 bp, Homo sapiens
cagccagaggctgcgaggggcc

SEQ ID NO: 9230127 - DNA, 22 bp, Homo sapiens
cagccagaggctgcgaggggcc

SEQ ID NO: 9230128 - DNA, 22 bp, Homo sapiens
cagccagagaaagggcactgcc

SEQ ID NO: 9230129 - DNA, 22 bp, Homo sapiens
cagccagagaaagggcactgcc

SEQ ID NO: 9230130 - DNA, 22 bp, Homo sapiens
cagccagagaggaaggaatgca

SEQ ID NO: 9230131 - DNA, 22 bp, Homo sapiens
cagccagagaggaaggaatgca

SEQ ID NO: 9230132 - DNA, 22 bp, Homo sapiens
agctccagggaaagagtggatc

SEQ ID NO: 9230133 - DNA, 22 bp, Homo sapiens
agctcccagagtcctctgccca

SEQ ID NO: 9230134 - DNA, 22 bp, Homo sapiens
agctcccagcagagctggccac

SEQ ID NO: 9230135 - DNA, 22 bp, Homo sapiens
agctcccaggcagtcatgagga

SEQ ID NO: 9230136 - DNA, 22 bp, Homo sapiens
agctcccagctcctttgagaga

SEQ ID NO: 9230137 - DNA, 22 bp, Homo sapiens
agctcccctcgtttctctccat

SEQ ID NO: 9230138 - DNA, 22 bp, Homo sapiens
agctcccattatcttctgaaac

SEQ ID NO: 9230139 - DNA, 22 bp, Homo sapiens
agctccctgagatgccacagca

SEQ ID NO: 9230140 - DNA, 22 bp, Homo sapiens
agctcccagggctgggcaagtt

SEQ ID NO: 9230141 - DNA, 22 bp, Homo sapiens
agctcccaggcagtcatgagga

SEQ ID NO: 9230142 - DNA, 22 bp, Homo sapiens
agctcacagtgtccttcctcaa

SEQ ID NO: 9230143 - DNA, 22 bp, Homo sapiens
agctcagaaatgccagtaggta

SEQ ID NO: 9230144 - DNA, 22 bp, Homo sapiens
agctcagaactgcagacatgtg

SEQ ID NO: 9230145 - DNA, 22 bp, Homo sapiens
agctcagaactgcagacatgtg

SEQ ID NO: 9230146 - DNA, 22 bp, Homo sapiens
agctcagaagcctatgcatagt

SEQ ID NO: 9230147 - DNA, 22 bp, Homo sapiens
agctcacagaaatcctgcagga

SEQ ID NO: 9230148 - DNA, 22 bp, Homo sapiens
agctcaatgcaacctccgcctc

SEQ ID NO: 9230149 - DNA, 22 bp, Homo sapiens
agctaggagattttgtgaggct

SEQ ID NO: 9230150 - DNA, 22 bp, Homo sapiens
agctaggataagcagagactgg

SEQ ID NO: 9230151 - DNA, 22 bp, Homo sapiens
agctcaatgcaacctccgcctc

SEQ ID NO: 9230152 - DNA, 22 bp, Homo sapiens
cagcaggaggtgagtagcaggt

SEQ ID NO: 9230153 - DNA, 23 bp, Homo sapiens
cagcaggagggtgcctgggctgc

SEQ ID NO: 9230154 - DNA, 23 bp, Homo sapiens
cagcaggagggtgcctgggctgc

SEQ ID NO: 9230155 - DNA, 22 bp, Homo sapiens
cagcaggaggtgagatgtgacc

SEQ ID NO: 9230156 - DNA, 22 bp, Homo sapiens
agccttctctgaaattctgttt

SEQ ID NO: 9230157 - DNA, 22 bp, Homo sapiens
agccttctctgaaattctgttt

SEQ ID NO: 9230158 - DNA, 22 bp, Homo sapiens
agcctttaacacttcacattga

SEQ ID NO: 9230159 - DNA, 23 bp, Homo sapiens
cagcaggagggtgcctgggctgc

SEQ ID NO: 9230160 - DNA, 18 bp, Homo sapiens
agcagctgtgccacactg

SEQ ID NO: 9230161 - DNA, 18 bp, Homo sapiens
agcagctgtgccacactg

SEQ ID NO: 9230162 - DNA, 22 bp, Homo sapiens
agcagctgtggaaaagtaacta

SEQ ID NO: 9230163 - DNA, 22 bp, Homo sapiens
agcagctgtcccttaacatcag

SEQ ID NO: 9230164 - DNA, 18 bp, Homo sapiens
agcagctgtcagaatgcc

SEQ ID NO: 9230165 - DNA, 22 bp, Homo sapiens
agcagctgtactttcatctgtt

SEQ ID NO: 9230166 - DNA, 22 bp, Homo sapiens
agcagctgggctcagagctggg

SEQ ID NO: 9230167 - DNA, 22 bp, Homo sapiens
caatgataatggctgtatttat

SEQ ID NO: 9230168 - DNA, 22 bp, Homo sapiens
agcagctgtactttcatctgtt

SEQ ID NO: 9230169 - DNA, 22 bp, Homo sapiens
caatgacatggataatcatatt

SEQ ID NO: 9230170 - DNA, 22 bp, Homo sapiens
caatgacactctgcacagtgct

SEQ ID NO: 9230171 - DNA, 22 bp, Homo sapiens
caatgaacacagcaatttcata

SEQ ID NO: 9230172 - DNA, 22 bp, Homo sapiens
agcagctgtttgttgaattggt

SEQ ID NO: 9230173 - DNA, 22 bp, Homo sapiens
agcagcttacatgtggcctatc

SEQ ID NO: 9230174 - DNA, 22 bp, Homo sapiens
agcagctgtggggacaagggta

SEQ ID NO: 9230175 - DNA, 20 bp, Homo sapiens
agcagctgtgttttcatcct

SEQ ID NO: 9230176 - DNA, 22 bp, Homo sapiens
cacaggagctgtggggcagtgt

SEQ ID NO: 9230177 - DNA, 22 bp, Homo sapiens
agcagcttctttcactcctgga

SEQ ID NO: 9230178 - DNA, 22 bp, Homo sapiens
agcaggagacatgggggtggtg

SEQ ID NO: 9230179 - DNA, 22 bp, Homo sapiens
agcaggagagcagtgcgtggtc

SEQ ID NO: 9230180 - DNA, 22 bp, Homo sapiens
agcaggagagcagtgcgtggtc

SEQ ID NO: 9230181 - DNA, 22 bp, Homo sapiens
cacaggctgcccgcagctggga

SEQ ID NO: 9230182 - DNA, 22 bp, Homo sapiens
agcaggagcatttccatgattc

SEQ ID NO: 9230183 - DNA, 22 bp, Homo sapiens
agcaggagatggggcgtgatgt

SEQ ID NO: 9230184 - DNA, 22 bp, Homo sapiens
cacaggaggcaatggtaagatt

SEQ ID NO: 9230185 - DNA, 22 bp, Homo sapiens
cacaggagggagcgggcagcca

SEQ ID NO: 9230186 - DNA, 22 bp, Homo sapiens
cacaggaggaggtgcccgggcc

SEQ ID NO: 9230187 - DNA, 22 bp, Homo sapiens
cacaggaggaggccagagcgta

SEQ ID NO: 9230188 - DNA, 22 bp, Homo sapiens
agcaggagaacactgtggctct

SEQ ID NO: 9230189 - DNA, 22 bp, Homo sapiens
cacagggcctggggcagctgct

SEQ ID NO: 9230190 - DNA, 22 bp, Homo sapiens
cacagggcaggtactctcagag

SEQ ID NO: 9230191 - DNA, 22 bp, Homo sapiens
cacagggcagtgctgcccactc

SEQ ID NO: 9230192 - DNA, 22 bp, Homo sapiens
cacagggccttgtgtgactgca

SEQ ID NO: 9230193 - DNA, 22 bp, Homo sapiens
cacagggctttgatggctgagt

SEQ ID NO: 9230194 - DNA, 22 bp, Homo sapiens
cacagtacttaattctctaaat

SEQ ID NO: 9230195 - DNA, 22 bp, Homo sapiens
cacagtattcactgggcagatt

SEQ ID NO: 9230196 - DNA, 22 bp, Homo sapiens
cacagtatgatctaaagtaagt

SEQ ID NO: 9230197 - DNA, 22 bp, Homo sapiens
cacagtatgatctaaagtaagt

SEQ ID NO: 9230198 - DNA, 22 bp, Homo sapiens
agcagtggctgaagatgttcct

SEQ ID NO: 9230199 - DNA, 22 bp, Homo sapiens
agcagtggcctggggctctgtg

SEQ ID NO: 9230200 - DNA, 22 bp, Homo sapiens
agcagttgtagtcatggaaaat

SEQ ID NO: 9230201 - DNA, 22 bp, Homo sapiens
caccaggtgctggaggacatca

SEQ ID NO: 9230202 - DNA, 22 bp, Homo sapiens
caccagggtacaatttcgcaga

SEQ ID NO: 9230203 - DNA, 22 bp, Homo sapiens
caccaggggcagagaccaaagt

SEQ ID NO: 9230204 - DNA, 22 bp, Homo sapiens
caccagggctctgagctctgaa

SEQ ID NO: 9230205 - DNA, 22 bp, Homo sapiens
caccagggcagcagcctagtct

SEQ ID NO: 9230206 - DNA, 22 bp, Homo sapiens
caccaggctggagtgcagtggc

SEQ ID NO: 9230207 - DNA, 22 bp, Homo sapiens
caccaggctggagtgcagtggc

SEQ ID NO: 9230208 - DNA, 22 bp, Homo sapiens
caccagggacaatgctaggggt

SEQ ID NO: 9230209 - DNA, 22 bp, Homo sapiens
caccagggacaatgctaggggt

SEQ ID NO: 9230210 - DNA, 22 bp, Homo sapiens
caccaggctggagtgcagtggc

SEQ ID NO: 9230211 - DNA, 22 bp, Homo sapiens
caccagggcagcagcctagtct

SEQ ID NO: 9230212 - DNA, 22 bp, Homo sapiens
caccagggacaatgctaggggt

SEQ ID NO: 9230213 - DNA, 22 bp, Homo sapiens
caccagggacaatgctaggggt

SEQ ID NO: 9230214 - DNA, 22 bp, Homo sapiens
agcaggtgcgttacttcactct

SEQ ID NO: 9230215 - DNA, 21 bp, Homo sapiens
agcaggtgctgttggaggaaa

SEQ ID NO: 9230216 - DNA, 20 bp, Homo sapiens
agcagtttcctaactcagct

SEQ ID NO: 9230217 - DNA, 22 bp, Homo sapiens
agcagtttggcccgagcagttc

SEQ ID NO: 9230218 - DNA, 22 bp, Homo sapiens
agcataaactcagggacacaca

SEQ ID NO: 9230219 - DNA, 22 bp, Homo sapiens
agcataagttggtacagccact

SEQ ID NO: 9230220 - DNA, 22 bp, Homo sapiens
agcataagttggtacagccact

SEQ ID NO: 9230221 - DNA, 22 bp, Homo sapiens
cactctgggctcttgtttcaga

SEQ ID NO: 9230222 - DNA, 22 bp, Homo sapiens
cactctgcagctgaagggctgg

SEQ ID NO: 9230223 - DNA, 23 bp, Homo sapiens
agcaggtaggttgaaattttcct

SEQ ID NO: 9230224 - DNA, 22 bp, Homo sapiens
cacatcttccagagtagctaaa

SEQ ID NO: 9230225 - DNA, 22 bp, Homo sapiens
agcaggtgatgtgagtctggaa

SEQ ID NO: 9230226 - DNA, 22 bp, Homo sapiens
agcaggtgatgtgagtctggaa

SEQ ID NO: 9230227 - DNA, 22 bp, Homo sapiens
agcaggtgatcgcgtgtgctcc

SEQ ID NO: 9230228 - DNA, 22 bp, Homo sapiens
agcaggtgatgtgagtctggaa

SEQ ID NO: 9230229 - DNA, 22 bp, Homo sapiens
cacatctactgatattccagga

SEQ ID NO: 9230230 - DNA, 22 bp, Homo sapiens
cacatccttcagctgagcccag

SEQ ID NO: 9230231 - DNA, 16 bp, Homo sapiens
cacatatatttatatg

SEQ ID NO: 9230232 - DNA, 23 bp, Homo sapiens
cacagtcatttactttgccatca

SEQ ID NO: 9230233 - DNA, 22 bp, Homo sapiens
cacagtcacatatctatgtgtg

SEQ ID NO: 9230234 - DNA, 22 bp, Homo sapiens
cacagtcaccttatcaggatgt

SEQ ID NO: 9230235 - DNA, 22 bp, Homo sapiens
agcagggcctctggcactggtc

SEQ ID NO: 9230236 - DNA, 16 bp, Homo sapiens
agcagggcgggaagga

SEQ ID NO: 9230237 - DNA, 18 bp, Homo sapiens
agcagaattctagggttc

SEQ ID NO: 9230238 - DNA, 22 bp, Homo sapiens
agcagacaacccagatgaccca

SEQ ID NO: 9230239 - DNA, 22 bp, Homo sapiens
agcagacaattgcctggatgga

SEQ ID NO: 9230240 - DNA, 22 bp, Homo sapiens
agcagacaattgcctggatgga

SEQ ID NO: 9230241 - DNA, 21 bp, Homo sapiens
agcagacacttgtgaccttcc

SEQ ID NO: 9230242 - DNA, 22 bp, Homo sapiens
caactgagcagtagcgtctgga

SEQ ID NO: 9230243 - DNA, 22 bp, Homo sapiens
caactgaactgatatcaactat

SEQ ID NO: 9230244 - DNA, 22 bp, Homo sapiens
caactgttataaatcaacagag

SEQ ID NO: 9230245 - DNA, 22 bp, Homo sapiens
caacttcactgtgcctctagtt

SEQ ID NO: 9230246 - DNA, 22 bp, Homo sapiens
caactgggataaagagctaaag

SEQ ID NO: 9230247 - DNA, 22 bp, Homo sapiens
agcagcacacgggagaaagaca

SEQ ID NO: 9230248 - DNA, 22 bp, Homo sapiens
agcagcaaggaacagaatggac

SEQ ID NO: 9230249 - DNA, 21 bp, Homo sapiens
agcagagtgctttgactttgt

SEQ ID NO: 9230250 - DNA, 22 bp, Homo sapiens
caacttcactgtgcctctagtt

SEQ ID NO: 9230251 - DNA, 22 bp, Homo sapiens
agcagcagaagggagacccagg

SEQ ID NO: 9230252 - DNA, 22 bp, Homo sapiens
agcagcagaaggtttgcaccca

SEQ ID NO: 9230253 - DNA, 22 bp, Homo sapiens
caaggcaggcagttcacttgag

SEQ ID NO: 9230254 - DNA, 22 bp, Homo sapiens
agcagcacccagagccatgtct

SEQ ID NO: 9230255 - DNA, 22 bp, Homo sapiens
agcagcacctgtcctcgctgct

SEQ ID NO: 9230256 - DNA, 22 bp, Homo sapiens
agcagcacgagtccacaaatcc

SEQ ID NO: 9230257 - DNA, 22 bp, Homo sapiens
caatcttagagagattctttta

SEQ ID NO: 9230258 - DNA, 22 bp, Homo sapiens
caatcttagtggcttacaaaga

SEQ ID NO: 9230259 - DNA, 22 bp, Homo sapiens
caatgaaaatgaggactcctgt

SEQ ID NO: 9230260 - DNA, 22 bp, Homo sapiens
caatcttagtggcttacaaaga

SEQ ID NO: 9230261 - DNA, 22 bp, Homo sapiens
caatcttacttttgaaaagtga

SEQ ID NO: 9230262 - DNA, 22 bp, Homo sapiens
caatcttacttttgaaaagtga

SEQ ID NO: 9230263 - DNA, 22 bp, Homo sapiens
caatcttacttttgaaaagtga

SEQ ID NO: 9230264 - DNA, 22 bp, Homo sapiens
caatgaaaatttaagttgcagc

SEQ ID NO: 9230265 - DNA, 22 bp, Homo sapiens
agcagcatgttgggatgtgaaa

SEQ ID NO: 9230266 - DNA, 22 bp, Homo sapiens
caaggcaggtctgaggaggttg

SEQ ID NO: 9230267 - DNA, 22 bp, Homo sapiens
caaggcagtccctactccctgc

SEQ ID NO: 9230268 - DNA, 22 bp, Homo sapiens
attttctgagtccagaatttac

SEQ ID NO: 9230269 - DNA, 22 bp, Homo sapiens
attttctctcaaaccttaaaat

SEQ ID NO: 9230270 - DNA, 22 bp, Homo sapiens
attttctattctgctggtttag

SEQ ID NO: 9230271 - DNA, 22 bp, Homo sapiens
attttctatgttgtaattgtta

SEQ ID NO: 9230272 - DNA, 22 bp, Homo sapiens
attttctctcaaaccttaaaat

SEQ ID NO: 9230273 - DNA, 22 bp, Homo sapiens
attttctctttgtatatgctag

SEQ ID NO: 9230274 - DNA, 22 bp, Homo sapiens
agcacagatgtgagtggaggct

SEQ ID NO: 9230275 - DNA, 22 bp, Homo sapiens
agcacagataacatggagtgga

SEQ ID NO: 9230276 - DNA, 22 bp, Homo sapiens
agcacagatggatgtattcatt

SEQ ID NO: 9230277 - DNA, 19 bp, Homo sapiens
agcacagagagtctatagc

SEQ ID NO: 9230278 - DNA, 22 bp, Homo sapiens
agcacagagattatttacaaga

SEQ ID NO: 9230279 - DNA, 22 bp, Homo sapiens
agcacagagaagatttcaatta

SEQ ID NO: 9230280 - DNA, 22 bp, Homo sapiens
agcacagagttgcagagagcgt

SEQ ID NO: 9230281 - DNA, 22 bp, Homo sapiens
agcacagagctcggggaatgga

SEQ ID NO: 9230282 - DNA, 22 bp, Homo sapiens
caaatgatagagccgattatca

SEQ ID NO: 9230283 - DNA, 22 bp, Homo sapiens
caaatgatagagccgattatca

SEQ ID NO: 9230284 - DNA, 22 bp, Homo sapiens
caaatgatccttgcaagctgtg

SEQ ID NO: 9230285 - DNA, 22 bp, Homo sapiens
caaatattccaggtacatccct

SEQ ID NO: 9230286 - DNA, 22 bp, Homo sapiens
caaatattccaggtacatccct

SEQ ID NO: 9230287 - DNA, 22 bp, Homo sapiens
caaatgatactgtttttagtct

SEQ ID NO: 9230288 - DNA, 22 bp, Homo sapiens
caaatgatgcatggctagtgag

SEQ ID NO: 9230289 - DNA, 22 bp, Homo sapiens
caaatgcaggtcagcaggtgtc

SEQ ID NO: 9230290 - DNA, 22 bp, Homo sapiens
caaatgcaggtcataacctgag

SEQ ID NO: 9230291 - DNA, 22 bp, Homo sapiens
caaatgcaggtcagcaggtgtc

SEQ ID NO: 9230292 - DNA, 22 bp, Homo sapiens
caaatgcatagaaagatgaaac

SEQ ID NO: 9230293 - DNA, 22 bp, Homo sapiens
caaatgtttcttgaacaccaac

SEQ ID NO: 9230294 - DNA, 22 bp, Homo sapiens
caaattaatgtgtctcaaaata

SEQ ID NO: 9230295 - DNA, 22 bp, Homo sapiens
agcactgttatgggatgactta

SEQ ID NO: 9230296 - DNA, 22 bp, Homo sapiens
agcagaagaaagccacatgact

SEQ ID NO: 9230297 - DNA, 22 bp, Homo sapiens
agcacttaactgacagtactat

SEQ ID NO: 9230298 - DNA, 17 bp, Homo sapiens
agcagaagtcagaggga

SEQ ID NO: 9230299 - DNA, 22 bp, Homo sapiens
agcagaagaaagccacatgact

SEQ ID NO: 9230300 - DNA, 17 bp, Homo sapiens
agcagaagtcagaggga

SEQ ID NO: 9230301 - DNA, 22 bp, Homo sapiens
atgtctttataaatgtataatg

SEQ ID NO: 9230302 - DNA, 22 bp, Homo sapiens
atgtctttattaatatcatgcc

SEQ ID NO: 9230303 - DNA, 22 bp, Homo sapiens
gaggcctggagccgcctaggcg

SEQ ID NO: 9230304 - DNA, 23 bp, Homo sapiens
gaggcctggccctgccacatctc

SEQ ID NO: 9230305 - DNA, 22 bp, Homo sapiens
gaggcctggctctgccctcctg

SEQ ID NO: 9230306 - DNA, 22 bp, Homo sapiens
gaggcctggctgggaggaggtg

SEQ ID NO: 9230307 - DNA, 22 bp, Homo sapiens
atgtcttttatgattacgggat

SEQ ID NO: 9230308 - DNA, 22 bp, Homo sapiens
atgtgaaaatccaatggcagca

SEQ ID NO: 9230309 - DNA, 22 bp, Homo sapiens
atgtgaaaaatttcttattaca

SEQ ID NO: 9230310 - DNA, 22 bp, Homo sapiens
atgtctttcttgtgtcccaaga

SEQ ID NO: 9230311 - DNA, 22 bp, Homo sapiens
atgtctttgccatagttcatat

SEQ ID NO: 9230312 - DNA, 22 bp, Homo sapiens
atgtgaaaatccaatggcagca

SEQ ID NO: 9230313 - DNA, 22 bp, Homo sapiens
atgtgaaacctgtgagtagagt

SEQ ID NO: 9230314 - DNA, 20 bp, Homo sapiens
gaggctgcggactgctggac

SEQ ID NO: 9230315 - DNA, 20 bp, Homo sapiens
gaggctgcggactgctggac

SEQ ID NO: 9230316 - DNA, 22 bp, Homo sapiens
gaggctgctgagagccctgttt

SEQ ID NO: 9230317 - DNA, 22 bp, Homo sapiens
gaggctgcggggaggagcctgc

SEQ ID NO: 9230318 - DNA, 20 bp, Homo sapiens
gaggctgcggactgctggac

SEQ ID NO: 9230319 - DNA, 22 bp, Homo sapiens
gaggctgcggggaggagcctgc

SEQ ID NO: 9230320 - DNA, 22 bp, Homo sapiens
gaggggagcccccatcctccag

SEQ ID NO: 9230321 - DNA, 22 bp, Homo sapiens
gaggggagcccccatcctccag

SEQ ID NO: 9230322 - DNA, 22 bp, Homo sapiens
gaggggagcatgatctagattg

SEQ ID NO: 9230323 - DNA, 16 bp, Homo sapiens
gaggggagcagtaggc

SEQ ID NO: 9230324 - DNA, 22 bp, Homo sapiens
gaggggagcatgatctagattg

SEQ ID NO: 9230325 - DNA, 22 bp, Homo sapiens
gaggggagcatgatctagattg

SEQ ID NO: 9230326 - DNA, 16 bp, Homo sapiens
gaggggagcagtaggc

SEQ ID NO: 9230327 - DNA, 22 bp, Homo sapiens
gaggggagaggcttatggatca

SEQ ID NO: 9230328 - DNA, 22 bp, Homo sapiens
gaggggagaggcttatggatca

SEQ ID NO: 9230329 - DNA, 22 bp, Homo sapiens
gaggggagaaggcactaaccag

SEQ ID NO: 9230330 - DNA, 22 bp, Homo sapiens
gaggggagacagggaaatcagt

SEQ ID NO: 9230331 - DNA, 22 bp, Homo sapiens
atgtgtgtatgtgcctatatct

SEQ ID NO: 9230332 - DNA, 22 bp, Homo sapiens
atgtgtgtgatgggcgccgcca

SEQ ID NO: 9230333 - DNA, 22 bp, Homo sapiens
atgtgtgtgatgggcgccgcca

SEQ ID NO: 9230334 - DNA, 22 bp, Homo sapiens
atgtgtgtgcatttctctccct

SEQ ID NO: 9230335 - DNA, 22 bp, Homo sapiens
atgtgtgtgcatttctctccct

SEQ ID NO: 9230336 - DNA, 22 bp, Homo sapiens
atgtgtgtacacacgtgactct

SEQ ID NO: 9230337 - DNA, 22 bp, Homo sapiens
atgtgtgtacacacgtgactct

SEQ ID NO: 9230338 - DNA, 22 bp, Homo sapiens
atgtgtgtatatatagtcattt

SEQ ID NO: 9230339 - DNA, 22 bp, Homo sapiens
atgtgtgtatatatagtcattt

SEQ ID NO: 9230340 - DNA, 22 bp, Homo sapiens
atgtgtgtatatatagtcattt

SEQ ID NO: 9230341 - DNA, 22 bp, Homo sapiens
atgtgtgtatatatagtcattt

SEQ ID NO: 9230342 - DNA, 22 bp, Homo sapiens
atgtgtatgagtgtgcttcttt

SEQ ID NO: 9230343 - DNA, 22 bp, Homo sapiens
gaggctgctttgatgacaggag

SEQ ID NO: 9230344 - DNA, 22 bp, Homo sapiens
gaggctgctttcctcctatcct

SEQ ID NO: 9230345 - DNA, 22 bp, Homo sapiens
gaggctgctgttagccctgggc

SEQ ID NO: 9230346 - DNA, 22 bp, Homo sapiens
gaggctgctttgatgacaggag

SEQ ID NO: 9230347 - DNA, 22 bp, Homo sapiens
gaggggaagacttctggacagt

SEQ ID NO: 9230348 - DNA, 22 bp, Homo sapiens
atgtgtccacaggtgtgagaga

SEQ ID NO: 9230349 - DNA, 22 bp, Homo sapiens
gaggagctgaggctgaggcctc

SEQ ID NO: 9230350 - DNA, 22 bp, Homo sapiens
atgtagaaagttattgtcactg

SEQ ID NO: 9230351 - DNA, 22 bp, Homo sapiens
atgtactgactgtacttttaaa

SEQ ID NO: 9230352 - DNA, 17 bp, Homo sapiens
gaggagctccagtaggt

SEQ ID NO: 9230353 - DNA, 18 bp, Homo sapiens
atgtacatttgctaaagc

SEQ ID NO: 9230354 - DNA, 22 bp, Homo sapiens
atgtacatttagatcatttctg

SEQ ID NO: 9230355 - DNA, 18 bp, Homo sapiens
atgtacatttgctaaagc

SEQ ID NO: 9230356 - DNA, 22 bp, Homo sapiens
atgtacatttgtagtaatatca

SEQ ID NO: 9230357 - DNA, 22 bp, Homo sapiens
atgtacattttcctaatgtttt

SEQ ID NO: 9230358 - DNA, 22 bp, Homo sapiens
atgtacatttgtagtaatatca

SEQ ID NO: 9230359 - DNA, 22 bp, Homo sapiens
atgtacattcttctcaccgaag

SEQ ID NO: 9230360 - DNA, 22 bp, Homo sapiens
atgtacatgtttaagtgaagga

SEQ ID NO: 9230361 - DNA, 22 bp, Homo sapiens
gaggccaggagtgctgtaagtt

SEQ ID NO: 9230362 - DNA, 22 bp, Homo sapiens
gaggccaccctatgggtcccag

SEQ ID NO: 9230363 - DNA, 23 bp, Homo sapiens
gaggccacattcccctgcttgag

SEQ ID NO: 9230364 - DNA, 22 bp, Homo sapiens
gaggagctgggaccctgtcatc

SEQ ID NO: 9230365 - DNA, 22 bp, Homo sapiens
gaggagctgggctgagagggtc

SEQ ID NO: 9230366 - DNA, 22 bp, Homo sapiens
gaggagctggcagcgtctccgc

SEQ ID NO: 9230367 - DNA, 22 bp, Homo sapiens
gaggccagggatgcaatgagag

SEQ ID NO: 9230368 - DNA, 22 bp, Homo sapiens
gaggccagggatgcaatgagag

SEQ ID NO: 9230369 - DNA, 22 bp, Homo sapiens
gaggccagggatgcaatgagag

SEQ ID NO: 9230370 - DNA, 22 bp, Homo sapiens
gaggccaggggcctggagatga

SEQ ID NO: 9230371 - DNA, 22 bp, Homo sapiens
gaggccagggtaccatcaacat

SEQ ID NO: 9230372 - DNA, 22 bp, Homo sapiens
gagctgggcctcagaacacagt

SEQ ID NO: 9230373 - DNA, 22 bp, Homo sapiens
gagctgggcctcagaacacagt

SEQ ID NO: 9230374 - DNA, 22 bp, Homo sapiens
atggtcaggcaaggagggctgg

SEQ ID NO: 9230375 - DNA, 22 bp, Homo sapiens
gagctgggcctgcgagtgctgc

SEQ ID NO: 9230376 - DNA, 22 bp, Homo sapiens
gagctgggcctgcgagtgctgc

SEQ ID NO: 9230377 - DNA, 21 bp, Homo sapiens
gagctgggcgaggctccgggg

SEQ ID NO: 9230378 - DNA, 22 bp, Homo sapiens
gagctggggcagcttaggagtg

SEQ ID NO: 9230379 - DNA, 22 bp, Homo sapiens
atgtacaatctatcacaagaag

SEQ ID NO: 9230380 - DNA, 22 bp, Homo sapiens
gagctggggcagcttaggagtg

SEQ ID NO: 9230381 - DNA, 22 bp, Homo sapiens
atgtacaatctatcacaagaag

SEQ ID NO: 9230382 - DNA, 22 bp, Homo sapiens
atgtacaattctccttggtagg

SEQ ID NO: 9230383 - DNA, 22 bp, Homo sapiens
atgtacatctttataacaagct

SEQ ID NO: 9230384 - DNA, 22 bp, Homo sapiens
atggtatagagccacatgtatt

SEQ ID NO: 9230385 - DNA, 22 bp, Homo sapiens
atggtcaaagataaagtgatct

SEQ ID NO: 9230386 - DNA, 22 bp, Homo sapiens
atgggttcaagtgattctcctg

SEQ ID NO: 9230387 - DNA, 22 bp, Homo sapiens
atgggttcaagtgattctcctg

SEQ ID NO: 9230388 - DNA, 22 bp, Homo sapiens
atggctggcactggcctgggtt

SEQ ID NO: 9230389 - DNA, 22 bp, Homo sapiens
atggctggaggccgggcttcct

SEQ ID NO: 9230390 - DNA, 22 bp, Homo sapiens
atggcccaaaacctcctccctc

SEQ ID NO: 9230391 - DNA, 22 bp, Homo sapiens
gagcagtgactggagcatgaga

SEQ ID NO: 9230392 - DNA, 22 bp, Homo sapiens
gagccaggaggcagagactgca

SEQ ID NO: 9230393 - DNA, 22 bp, Homo sapiens
gagccaggcccgtacttgctgt

SEQ ID NO: 9230394 - DNA, 22 bp, Homo sapiens
gagccaggcccgtacttgctgt

SEQ ID NO: 9230395 - DNA, 22 bp, Homo sapiens
gagccagggctgtgagctgagc

SEQ ID NO: 9230396 - DNA, 22 bp, Homo sapiens
atggcagggcacagctctagtt

SEQ ID NO: 9230397 - DNA, 22 bp, Homo sapiens
atggcaggatacccagtccggc

SEQ ID NO: 9230398 - DNA, 22 bp, Homo sapiens
gagaacacttatggattattct

SEQ ID NO: 9230399 - DNA, 22 bp, Homo sapiens
gagaacactaatggtttcttaa

SEQ ID NO: 9230400 - DNA, 22 bp, Homo sapiens
atggcagagggattgaacagct

SEQ ID NO: 9230401 - DNA, 22 bp, Homo sapiens
gagagctgtttatcttcttcaa

SEQ ID NO: 9230402 - DNA, 22 bp, Homo sapiens
gagagctgtttatcttcttcaa

SEQ ID NO: 9230403 - DNA, 22 bp, Homo sapiens
gagagctgtggtttgaccaggc

SEQ ID NO: 9230404 - DNA, 22 bp, Homo sapiens
gagagctgtgttcattctacca

SEQ ID NO: 9230405 - DNA, 22 bp, Homo sapiens
gagagctgtgttcattctacca

SEQ ID NO: 9230406 - DNA, 22 bp, Homo sapiens
gagagctgtggtttgaccaggc

SEQ ID NO: 9230407 - DNA, 22 bp, Homo sapiens
gagagctgtccggctgagcagc

SEQ ID NO: 9230408 - DNA, 22 bp, Homo sapiens
gagagctgtccggctgagcagc

SEQ ID NO: 9230409 - DNA, 22 bp, Homo sapiens
gagagctgtggtttgaccaggc

SEQ ID NO: 9230410 - DNA, 22 bp, Homo sapiens
atggccagtctgttggacagca

SEQ ID NO: 9230411 - DNA, 22 bp, Homo sapiens
atgccactgcgctccagcctgg

SEQ ID NO: 9230412 - DNA, 22 bp, Homo sapiens
atgccactgcgctccagcctgg

SEQ ID NO: 9230413 - DNA, 22 bp, Homo sapiens
atgccactgcgctccagcctgg

SEQ ID NO: 9230414 - DNA, 22 bp, Homo sapiens
atgccactgcacttcagcttgg

SEQ ID NO: 9230415 - DNA, 22 bp, Homo sapiens
atgccactgcgctccagcctgg

SEQ ID NO: 9230416 - DNA, 22 bp, Homo sapiens
atgccactgcacttcagcttgg

SEQ ID NO: 9230417 - DNA, 22 bp, Homo sapiens
gacagaggcaagaccagaagcc

SEQ ID NO: 9230418 - DNA, 23 bp, Homo sapiens
gacagagtgagaccttgtcttac

SEQ ID NO: 9230419 - DNA, 23 bp, Homo sapiens
gacagagtgagaccttgtcttac

SEQ ID NO: 9230420 - DNA, 23 bp, Homo sapiens
gacagagtgagaccttgtcttac

SEQ ID NO: 9230421 - DNA, 23 bp, Homo sapiens
gacagagtgagaccttgtcttac

SEQ ID NO: 9230422 - DNA, 23 bp, Homo sapiens
gacagagtgagaccttgtcttac

SEQ ID NO: 9230423 - DNA, 22 bp, Homo sapiens
gacagatgagggagtattctca

SEQ ID NO: 9230424 - DNA, 22 bp, Homo sapiens
gacagagtgcagggctagaaga

SEQ ID NO: 9230425 - DNA, 22 bp, Homo sapiens
gacagagttgttgatgtatgct

SEQ ID NO: 9230426 - DNA, 23 bp, Homo sapiens
gacagagtgagaccttgtcttac

SEQ ID NO: 9230427 - DNA, 22 bp, Homo sapiens
atggaaatgttccatatattga

SEQ ID NO: 9230428 - DNA, 22 bp, Homo sapiens
atggaaatgttccatatattga

SEQ ID NO: 9230429 - DNA, 21 bp, Homo sapiens
atggaaattggcaaatgctac

SEQ ID NO: 9230430 - DNA, 21 bp, Homo sapiens
atggaaattggcaaatgctac

SEQ ID NO: 9230431 - DNA, 22 bp, Homo sapiens
atggaacagattaaagtgaggg

SEQ ID NO: 9230432 - DNA, 22 bp, Homo sapiens
atggaacaagaactcagattta

SEQ ID NO: 9230433 - DNA, 22 bp, Homo sapiens
atggaacatcaggttaagaaat

SEQ ID NO: 9230434 - DNA, 22 bp, Homo sapiens
atggaacatgaattaatatggt

SEQ ID NO: 9230435 - DNA, 22 bp, Homo sapiens
atggaaatgatggaacattaaa

SEQ ID NO: 9230436 - DNA, 22 bp, Homo sapiens
atggaaaaggctgatttcatta

SEQ ID NO: 9230437 - DNA, 22 bp, Homo sapiens
atgccacttcattccagcctcg

SEQ ID NO: 9230438 - DNA, 22 bp, Homo sapiens
atgccactgcgctccagcctgg

SEQ ID NO: 9230439 - DNA, 22 bp, Homo sapiens
atgccacttcattccagcctcg

SEQ ID NO: 9230440 - DNA, 22 bp, Homo sapiens
atgccactgcgctctagcctgg

SEQ ID NO: 9230441 - DNA, 22 bp, Homo sapiens
atggagctgtagggagcagtgg

SEQ ID NO: 9230442 - DNA, 22 bp, Homo sapiens
atggagacgcaagggacctagg

SEQ ID NO: 9230443 - DNA, 22 bp, Homo sapiens
atggagagtgaaagtctctcta

SEQ ID NO: 9230444 - DNA, 22 bp, Homo sapiens
gagaaatatggctcagttccac

SEQ ID NO: 9230445 - DNA, 22 bp, Homo sapiens
gagaaataggcaatggtatcta

SEQ ID NO: 9230446 - DNA, 20 bp, Homo sapiens
atggaggaagggcaagagaa

SEQ ID NO: 9230447 - DNA, 22 bp, Homo sapiens
gagaaatgagtgattcactttt

SEQ ID NO: 9230448 - DNA, 22 bp, Homo sapiens
gagaaatgcatgcatgtcatca

SEQ ID NO: 9230449 - DNA, 22 bp, Homo sapiens
gagaacacatgcagactgggta

SEQ ID NO: 9230450 - DNA, 22 bp, Homo sapiens
gagaacacgaggaggcccagcg

SEQ ID NO: 9230451 - DNA, 22 bp, Homo sapiens
atggacagtgtgaagcagatag

SEQ ID NO: 9230452 - DNA, 22 bp, Homo sapiens
atggactcactaattcctccac

SEQ ID NO: 9230453 - DNA, 22 bp, Homo sapiens
atggaagttggaaccattcata

SEQ ID NO: 9230454 - DNA, 22 bp, Homo sapiens
atggaataggctgctctttaaa

SEQ ID NO: 9230455 - DNA, 22 bp, Homo sapiens
atggaatatagtcttatatctc

SEQ ID NO: 9230456 - DNA, 22 bp, Homo sapiens
atggaagcagaccggaggaata

SEQ ID NO: 9230457 - DNA, 20 bp, Homo sapiens
atggaagctgctcttctcct

SEQ ID NO: 9230458 - DNA, 22 bp, Homo sapiens
atggaagctgaaaaagacacgg

SEQ ID NO: 9230459 - DNA, 22 bp, Homo sapiens
atggaaggtcctacagagcgca

SEQ ID NO: 9230460 - DNA, 22 bp, Homo sapiens
atggaagacagataaggcagaa

SEQ ID NO: 9230461 - DNA, 22 bp, Homo sapiens
atggaagactaacagaaacatg

SEQ ID NO: 9230462 - DNA, 22 bp, Homo sapiens
atggaagactaacagaaacatg

SEQ ID NO: 9230463 - DNA, 22 bp, Homo sapiens
atggaagagtccccatggatga

SEQ ID NO: 9230464 - DNA, 22 bp, Homo sapiens
atgaagataagaccaggctgga

SEQ ID NO: 9230465 - DNA, 22 bp, Homo sapiens
atgaagactatttgaaggtgcc

SEQ ID NO: 9230466 - DNA, 22 bp, Homo sapiens
atgaagataatagcattggttg

SEQ ID NO: 9230467 - DNA, 22 bp, Homo sapiens
atgaagatggttcaactggcct

SEQ ID NO: 9230468 - DNA, 22 bp, Homo sapiens
atgaagatattcttgttttctg

SEQ ID NO: 9230469 - DNA, 22 bp, Homo sapiens
atgaagatttcccagagacatg

SEQ ID NO: 9230470 - DNA, 22 bp, Homo sapiens
atgaagatttataattgccttt

SEQ ID NO: 9230471 - DNA, 22 bp, Homo sapiens
atgaagcaacagccctcctatt

SEQ ID NO: 9230472 - DNA, 22 bp, Homo sapiens
atgaagcaattagaaacttgaa

SEQ ID NO: 9230473 - DNA, 21 bp, Homo sapiens
atgaagcaagggtcacacgtg

SEQ ID NO: 9230474 - DNA, 22 bp, Homo sapiens
atgaagcagcgttgtagagtga

SEQ ID NO: 9230475 - DNA, 22 bp, Homo sapiens
atgagcttcccagacaggatgg

SEQ ID NO: 9230476 - DNA, 22 bp, Homo sapiens
atgagcttcccagacaggatgg

SEQ ID NO: 9230477 - DNA, 22 bp, Homo sapiens
atgaagcagatttattactcac

SEQ ID NO: 9230478 - DNA, 22 bp, Homo sapiens
atgaagcagaatttcccactct

SEQ ID NO: 9230479 - DNA, 22 bp, Homo sapiens
atgaagcagactcaggtggtgc

SEQ ID NO: 9230480 - DNA, 22 bp, Homo sapiens
atgaagcagcctcttccctctg

SEQ ID NO: 9230481 - DNA, 22 bp, Homo sapiens
atgaggcagatgttgcatgagg

SEQ ID NO: 9230482 - DNA, 22 bp, Homo sapiens
atgaggcagatgttgcatgagg

SEQ ID NO: 9230483 - DNA, 22 bp, Homo sapiens
atgaggcagagggctgtgccag

SEQ ID NO: 9230484 - DNA, 22 bp, Homo sapiens
atgaggcagctgacagctgttc

SEQ ID NO: 9230485 - DNA, 22 bp, Homo sapiens
atgaggcagcacatgggattgt

SEQ ID NO: 9230486 - DNA, 22 bp, Homo sapiens
gaaagcacgatagtagcaaaag

SEQ ID NO: 9230487 - DNA, 22 bp, Homo sapiens
gaaagcacagttcatgagacaa

SEQ ID NO: 9230488 - DNA, 22 bp, Homo sapiens
gaaagcaagttgactgcagaat

SEQ ID NO: 9230489 - DNA, 22 bp, Homo sapiens
gaaagatatttattggcaacag

SEQ ID NO: 9230490 - DNA, 22 bp, Homo sapiens
atgaggcagtctggcctgaggg

SEQ ID NO: 9230491 - DNA, 22 bp, Homo sapiens
atgaggcaggtggaggctgcca

SEQ ID NO: 9230492 - DNA, 22 bp, Homo sapiens
atgaggcaggagtgcagtggca

SEQ ID NO: 9230493 - DNA, 22 bp, Homo sapiens
atgaggtcttattgcagtagtt

SEQ ID NO: 9230494 - DNA, 22 bp, Homo sapiens
atgaggtctggcaatcagaaac

SEQ ID NO: 9230495 - DNA, 22 bp, Homo sapiens
atgaggtccagggaagttaaat

SEQ ID NO: 9230496 - DNA, 22 bp, Homo sapiens
atgaggtcattcttggattaca

SEQ ID NO: 9230497 - DNA, 17 bp, Homo sapiens
atgaggtcattaagata

SEQ ID NO: 9230498 - DNA, 22 bp, Homo sapiens
atgaggtcatcttgaagtaggg

SEQ ID NO: 9230499 - DNA, 22 bp, Homo sapiens
atgaggtcatcctggagtaagg

SEQ ID NO: 9230500 - DNA, 23 bp, Homo sapiens
atgaggtcagccataagacggaa

SEQ ID NO: 9230501 - DNA, 22 bp, Homo sapiens
atgaggtattcgtaatatttcc

SEQ ID NO: 9230502 - DNA, 22 bp, Homo sapiens
atgaggtcacagtgtttggcat

SEQ ID NO: 9230503 - DNA, 22 bp, Homo sapiens
atgaggccacagttatagattt

SEQ ID NO: 9230504 - DNA, 22 bp, Homo sapiens
atgaggccaccttctacatttc

SEQ ID NO: 9230505 - DNA, 23 bp, Homo sapiens
atgaggtaaagatcagctttaaa

SEQ ID NO: 9230506 - DNA, 22 bp, Homo sapiens
gaaagcagctaagtcttatgat

SEQ ID NO: 9230507 - DNA, 22 bp, Homo sapiens
gaaagcagtaaatgggtcccat

SEQ ID NO: 9230508 - DNA, 22 bp, Homo sapiens
atgaggtaagcactgggcccaa

SEQ ID NO: 9230509 - DNA, 22 bp, Homo sapiens
atgaggtactagtatatacgta

SEQ ID NO: 9230510 - DNA, 22 bp, Homo sapiens
atgaggtaatagggcagtgggg

SEQ ID NO: 9230511 - DNA, 22 bp, Homo sapiens
atgaggtagtattagaaggaga

SEQ ID NO: 9230512 - DNA, 22 bp, Homo sapiens
atgaggtaggacatcaggaaat

SEQ ID NO: 9230513 - DNA, 22 bp, Homo sapiens
atgaggtatctcatttcctgaa

SEQ ID NO: 9230514 - DNA, 19 bp, Homo sapiens
atgaggtagcagctggtgc

SEQ ID NO: 9230515 - DNA, 19 bp, Homo sapiens
atgaggtagcagctggtgc

SEQ ID NO: 9230516 - DNA, 22 bp, Homo sapiens
atgaggtagcttggcccagggg

SEQ ID NO: 9230517 - DNA, 22 bp, Homo sapiens
atgaggtagctgtggctggctg

SEQ ID NO: 9230518 - DNA, 22 bp, Homo sapiens
atgagtgtgaagttagctcagt

SEQ ID NO: 9230519 - DNA, 22 bp, Homo sapiens
atgagttcattgcatttgacag

SEQ ID NO: 9230520 - DNA, 22 bp, Homo sapiens
atgagttgaagctacaagaggc

SEQ ID NO: 9230521 - DNA, 22 bp, Homo sapiens
atgagttaggggcctgagtgga

SEQ ID NO: 9230522 - DNA, 20 bp, Homo sapiens
atgagtttaaacattcagag

SEQ ID NO: 9230523 - DNA, 22 bp, Homo sapiens
atgatacaagcaaaactaatca

SEQ ID NO: 9230524 - DNA, 22 bp, Homo sapiens
atgatacaagcaaaactaatca

SEQ ID NO: 9230525 - DNA, 22 bp, Homo sapiens
atgatacacctaggagtgggag

SEQ ID NO: 9230526 - DNA, 22 bp, Homo sapiens
atgcaaaagactatttgttgct

SEQ ID NO: 9230527 - DNA, 22 bp, Homo sapiens
atgcaaaaactgcacttacgct

SEQ ID NO: 9230528 - DNA, 22 bp, Homo sapiens
atgcaaaagtaactgtgatttt

SEQ ID NO: 9230529 - DNA, 20 bp, Homo sapiens
atgattttgcactaacttca

SEQ ID NO: 9230530 - DNA, 22 bp, Homo sapiens
atgattcagcaattttatatct

SEQ ID NO: 9230531 - DNA, 22 bp, Homo sapiens
atgattttttctaacacagtcg

SEQ ID NO: 9230532 - DNA, 22 bp, Homo sapiens
atgcagacatgggagagttgag

SEQ ID NO: 9230533 - DNA, 21 bp, Homo sapiens
atgcagagaactccagggaag

SEQ ID NO: 9230534 - DNA, 23 bp, Homo sapiens
atgcagagaataacaaatgccat

SEQ ID NO: 9230535 - DNA, 22 bp, Homo sapiens
atgcagagacagatgtggcatg

SEQ ID NO: 9230536 - DNA, 22 bp, Homo sapiens
atgcagagcttccagtggcctg

SEQ ID NO: 9230537 - DNA, 22 bp, Homo sapiens
atgcagagacagatgtggcatg

SEQ ID NO: 9230538 - DNA, 19 bp, Homo sapiens
atgcagagaatggcagtag

SEQ ID NO: 9230539 - DNA, 22 bp, Homo sapiens
atgcagataagaatcaggtttg

SEQ ID NO: 9230540 - DNA, 22 bp, Homo sapiens
atgcagatatgcaaactgtagt

SEQ ID NO: 9230541 - DNA, 22 bp, Homo sapiens
atgcagatgggtgccaaagtct

SEQ ID NO: 9230542 - DNA, 22 bp, Homo sapiens
atgcagatttaattagtatagg

SEQ ID NO: 9230543 - DNA, 22 bp, Homo sapiens
atgcagaagcagaacttacaca

SEQ ID NO: 9230544 - DNA, 22 bp, Homo sapiens
atgcacttaaataacataactt

SEQ ID NO: 9230545 - DNA, 20 bp, Homo sapiens
atgcaaactcacaaaatacc

SEQ ID NO: 9230546 - DNA, 22 bp, Homo sapiens
atgcaaaattaccattctgttc

SEQ ID NO: 9230547 - DNA, 22 bp, Homo sapiens
atgcaaaagtaattgcaatttt

SEQ ID NO: 9230548 - DNA, 22 bp, Homo sapiens
atgcaaaagtagttgcagtttt

SEQ ID NO: 9230549 - DNA, 22 bp, Homo sapiens
atgcaaaataaggcagaaacat

SEQ ID NO: 9230550 - DNA, 22 bp, Homo sapiens
atgcaaataaacagtctagttg

SEQ ID NO: 9230551 - DNA, 22 bp, Homo sapiens
atgcattgaggatgacatgagt

SEQ ID NO: 9230552 - DNA, 22 bp, Homo sapiens
atgcattctggaaagtagcaat

SEQ ID NO: 9230553 - DNA, 22 bp, Homo sapiens
atgcatttatgtgtgtacattg

SEQ ID NO: 9230554 - DNA, 22 bp, Homo sapiens
atgcatttatgtgtgtacattg

SEQ ID NO: 9230555 - DNA, 22 bp, Homo sapiens
gacactctcctccagtggatag

SEQ ID NO: 9230556 - DNA, 22 bp, Homo sapiens
atgcattcagcggaatgcttag

SEQ ID NO: 9230557 - DNA, 22 bp, Homo sapiens
atgcatgttaagctcttaaaat

SEQ ID NO: 9230558 - DNA, 22 bp, Homo sapiens
atgcatgtgtgagagcaagagg

SEQ ID NO: 9230559 - DNA, 22 bp, Homo sapiens
atgcatgtattatctagatgag

SEQ ID NO: 9230560 - DNA, 22 bp, Homo sapiens
atgcatgatcctgagcaaccca

SEQ ID NO: 9230561 - DNA, 22 bp, Homo sapiens
atgcatgcacacactgcattgc

SEQ ID NO: 9230562 - DNA, 22 bp, Homo sapiens
atgcatgcttcttatagtactt

SEQ ID NO: 9230563 - DNA, 22 bp, Homo sapiens
atgcatgcttcttatagtactt

SEQ ID NO: 9230564 - DNA, 22 bp, Homo sapiens
atgcatcttatcaaaaattata

SEQ ID NO: 9230565 - DNA, 22 bp, Homo sapiens
atgcatatgccgtagaataagt

SEQ ID NO: 9230566 - DNA, 22 bp, Homo sapiens
atgcatatgccgtagaataagt

SEQ ID NO: 9230567 - DNA, 22 bp, Homo sapiens
atgcatatgcatggacactcag

SEQ ID NO: 9230568 - DNA, 22 bp, Homo sapiens
atgcagctcatttgtttaaaag

SEQ ID NO: 9230569 - DNA, 22 bp, Homo sapiens
cttggtttacctaaacaatagg

SEQ ID NO: 9230570 - DNA, 22 bp, Homo sapiens
cttgtaaacttgagcagggcat

SEQ ID NO: 9230571 - DNA, 22 bp, Homo sapiens
cttgtaaaatatccagttaagg

SEQ ID NO: 9230572 - DNA, 22 bp, Homo sapiens
cttggtgcattactcaatctgt

SEQ ID NO: 9230573 - DNA, 22 bp, Homo sapiens
atcttcctttgccatgggatag

SEQ ID NO: 9230574 - DNA, 22 bp, Homo sapiens
atcttcttcaaggatctggagc

SEQ ID NO: 9230575 - DNA, 22 bp, Homo sapiens
atcttctggtcaaatttttgca

SEQ ID NO: 9230576 - DNA, 22 bp, Homo sapiens
cttggcctgcccagccagaagg

SEQ ID NO: 9230577 - DNA, 22 bp, Homo sapiens
cttgggtgttttaaaactagat

SEQ ID NO: 9230578 - DNA, 22 bp, Homo sapiens
cttggcagtttcggaaggatga

SEQ ID NO: 9230579 - DNA, 20 bp, Homo sapiens
cttggcctacttagctttgt

SEQ ID NO: 9230580 - DNA, 22 bp, Homo sapiens
cttggcattgtgttgatagaag

SEQ ID NO: 9230581 - DNA, 22 bp, Homo sapiens
cttggccagacagggagctcca

SEQ ID NO: 9230582 - DNA, 22 bp, Homo sapiens
cttggcatgttcatctgcttgg

SEQ ID NO: 9230583 - DNA, 22 bp, Homo sapiens
atctacagctgtctgcacagta

SEQ ID NO: 9230584 - DNA, 22 bp, Homo sapiens
atctacagcagtgccaggtagc

SEQ ID NO: 9230585 - DNA, 19 bp, Homo sapiens
atctacaattattctcagt

SEQ ID NO: 9230586 - DNA, 22 bp, Homo sapiens
atctacaggatagtttaatatt

SEQ ID NO: 9230587 - DNA, 22 bp, Homo sapiens
atctacaggattttacagagtt

SEQ ID NO: 9230588 - DNA, 22 bp, Homo sapiens
atctacaggattttacagagtt

SEQ ID NO: 9230589 - DNA, 22 bp, Homo sapiens
atctacaggattttacagagtt

SEQ ID NO: 9230590 - DNA, 22 bp, Homo sapiens
atctacaggctgaggtgggagg

SEQ ID NO: 9230591 - DNA, 22 bp, Homo sapiens
atctacagtgcacaggacagcc

SEQ ID NO: 9230592 - DNA, 22 bp, Homo sapiens
atctacaggctgaggtgggagg

SEQ ID NO: 9230593 - DNA, 22 bp, Homo sapiens
atctacatgttgatttaaagaa

SEQ ID NO: 9230594 - DNA, 22 bp, Homo sapiens
atctactcctgaatatatctag

SEQ ID NO: 9230595 - DNA, 22 bp, Homo sapiens
atctactcagtaactgcttagg

SEQ ID NO: 9230596 - DNA, 22 bp, Homo sapiens
atctaggatttgaatgcacagt

SEQ ID NO: 9230597 - DNA, 22 bp, Homo sapiens
atctagcaccaaactagctttt

SEQ ID NO: 9230598 - DNA, 22 bp, Homo sapiens
cttgcctttgtcttcaaaggct

SEQ ID NO: 9230599 - DNA, 22 bp, Homo sapiens
cttgctgagataaatgctgtct

SEQ ID NO: 9230600 - DNA, 22 bp, Homo sapiens
cttgctcattaagtagctcaca

SEQ ID NO: 9230601 - DNA, 22 bp, Homo sapiens
cttgctctagatgttcagagct

SEQ ID NO: 9230602 - DNA, 22 bp, Homo sapiens
cttgctcacagtacctggcttg

SEQ ID NO: 9230603 - DNA, 22 bp, Homo sapiens
atctattatgctgagaaactgt

SEQ ID NO: 9230604 - DNA, 22 bp, Homo sapiens
cttgagtcatataaagacagag

SEQ ID NO: 9230605 - DNA, 20 bp, Homo sapiens
cttgagttcagagctgtcat

SEQ ID NO: 9230606 - DNA, 22 bp, Homo sapiens
atctatacccatcatgatttaa

SEQ ID NO: 9230607 - DNA, 22 bp, Homo sapiens
cttgatattttaaacatacagt

SEQ ID NO: 9230608 - DNA, 22 bp, Homo sapiens
cttgatcctaggatggaaggga

SEQ ID NO: 9230609 - DNA, 19 bp, Homo sapiens
cttgcctgttcctacagct

SEQ ID NO: 9230610 - DNA, 22 bp, Homo sapiens
cttgcctgtggctagttggctc

SEQ ID NO: 9230611 - DNA, 23 bp, Homo sapiens
cttgcctggcctctctgcccaga

SEQ ID NO: 9230612 - DNA, 22 bp, Homo sapiens
atgaaatgattgaaatctttac

SEQ ID NO: 9230613 - DNA, 22 bp, Homo sapiens
atgaaatgaagttggcctggct

SEQ ID NO: 9230614 - DNA, 22 bp, Homo sapiens
atgaaatattctttggtaagaa

SEQ ID NO: 9230615 - DNA, 22 bp, Homo sapiens
atgaaatattctttggtaagaa

SEQ ID NO: 9230616 - DNA, 22 bp, Homo sapiens
atgaaatatcttgaagaaattc

SEQ ID NO: 9230617 - DNA, 22 bp, Homo sapiens
atgaaatatcttgaagaaattc

SEQ ID NO: 9230618 - DNA, 22 bp, Homo sapiens
atgaaatatcttgaagaaattc

SEQ ID NO: 9230619 - DNA, 22 bp, Homo sapiens
atgaaatatcttgaagaaattc

SEQ ID NO: 9230620 - DNA, 22 bp, Homo sapiens
atgaaatatcttgaagaaattc

SEQ ID NO: 9230621 - DNA, 22 bp, Homo sapiens
atgaaatatcttgaagaaattc

SEQ ID NO: 9230622 - DNA, 22 bp, Homo sapiens
atgaaatatcttgaagaaattc

SEQ ID NO: 9230623 - DNA, 22 bp, Homo sapiens
atgaaatgattgaaatctttac

SEQ ID NO: 9230624 - DNA, 22 bp, Homo sapiens
atgaaatggtggttttccattt

SEQ ID NO: 9230625 - DNA, 23 bp, Homo sapiens
atgaaatgctggctcagggaggt

SEQ ID NO: 9230626 - DNA, 22 bp, Homo sapiens
atgaaatgtatgagtctgggtt

SEQ ID NO: 9230627 - DNA, 22 bp, Homo sapiens
atgaaatgtgaatgcttttcat

SEQ ID NO: 9230628 - DNA, 22 bp, Homo sapiens
atgaaatgtctggatctttttc

SEQ ID NO: 9230629 - DNA, 22 bp, Homo sapiens
cttttattttgaattaagggct

SEQ ID NO: 9230630 - DNA, 22 bp, Homo sapiens
cttttattttgaattaagggct

SEQ ID NO: 9230631 - DNA, 22 bp, Homo sapiens
cttttattttgaattaagggct

SEQ ID NO: 9230632 - DNA, 22 bp, Homo sapiens
cttttattttgaattaagggct

SEQ ID NO: 9230633 - DNA, 22 bp, Homo sapiens
cttttactgtgaaaagaaactg

SEQ ID NO: 9230634 - DNA, 22 bp, Homo sapiens
cttttattttgaattaagggct

SEQ ID NO: 9230635 - DNA, 22 bp, Homo sapiens
atgaaattaatcaacacataca

SEQ ID NO: 9230636 - DNA, 22 bp, Homo sapiens
cttttacatttgttgaagagta

SEQ ID NO: 9230637 - DNA, 22 bp, Homo sapiens
cttttcatgagtctgttatggg

SEQ ID NO: 9230638 - DNA, 22 bp, Homo sapiens
cttttcatgccagcccatcaca

SEQ ID NO: 9230639 - DNA, 22 bp, Homo sapiens
atgaagactatttgaaggtgcc

SEQ ID NO: 9230640 - DNA, 22 bp, Homo sapiens
atgaagactaatgtgaatggga

SEQ ID NO: 9230641 - DNA, 23 bp, Homo sapiens
cttttcattgccttagcgcagag

SEQ ID NO: 9230642 - DNA, 22 bp, Homo sapiens
cttttcaaacgctgatgtcagt

SEQ ID NO: 9230643 - DNA, 22 bp, Homo sapiens
cttttcaaacgctgatgtcagt

SEQ ID NO: 9230644 - DNA, 19 bp, Homo sapiens
cttttcaagccatcagttt

SEQ ID NO: 9230645 - DNA, 19 bp, Homo sapiens
cttttcatcaacagccaat

SEQ ID NO: 9230646 - DNA, 22 bp, Homo sapiens
atgaaaacggaccagagctatt

SEQ ID NO: 9230647 - DNA, 22 bp, Homo sapiens
atgaaaacggaccagagctatt

SEQ ID NO: 9230648 - DNA, 22 bp, Homo sapiens
atgaaaactttagcctcattag

SEQ ID NO: 9230649 - DNA, 22 bp, Homo sapiens
atctttttactaacactgctta

SEQ ID NO: 9230650 - DNA, 22 bp, Homo sapiens
atcttgaatgaatgactcttta

SEQ ID NO: 9230651 - DNA, 22 bp, Homo sapiens
atcttttacattactgcccaga

SEQ ID NO: 9230652 - DNA, 22 bp, Homo sapiens
atctttgttgctctcatttctg

SEQ ID NO: 9230653 - DNA, 22 bp, Homo sapiens
atcttttactacaaatcaggtg

SEQ ID NO: 9230654 - DNA, 22 bp, Homo sapiens
cttgttaaaatgcagattccaa

SEQ ID NO: 9230655 - DNA, 22 bp, Homo sapiens
cttgttaaaatgccgattctga

SEQ ID NO: 9230656 - DNA, 22 bp, Homo sapiens
cttgttaaaatgcagattccaa

SEQ ID NO: 9230657 - DNA, 22 bp, Homo sapiens
cttgttaaattatataagcaga

SEQ ID NO: 9230658 - DNA, 22 bp, Homo sapiens
cttgttaaaatgccgattctga

SEQ ID NO: 9230659 - DNA, 22 bp, Homo sapiens
atgaaaagggagtgatatttgt

SEQ ID NO: 9230660 - DNA, 22 bp, Homo sapiens
atgaaatatcttgaagaaattc

SEQ ID NO: 9230661 - DNA, 22 bp, Homo sapiens
atgaaatatcttgaagaaattc

SEQ ID NO: 9230662 - DNA, 22 bp, Homo sapiens
atgaaacatgagaaatggagag

SEQ ID NO: 9230663 - DNA, 22 bp, Homo sapiens
cttgtttattatgcactgtaga

SEQ ID NO: 9230664 - DNA, 22 bp, Homo sapiens
attctatagacagaaggtcaat

SEQ ID NO: 9230665 - DNA, 22 bp, Homo sapiens
attctcaaaacataacttcact

SEQ ID NO: 9230666 - DNA, 22 bp, Homo sapiens
attctattttttaagaagtagt

SEQ ID NO: 9230667 - DNA, 22 bp, Homo sapiens
attctagacatctgcagttgtt

SEQ ID NO: 9230668 - DNA, 22 bp, Homo sapiens
attctagcagatattggaaatt

SEQ ID NO: 9230669 - DNA, 22 bp, Homo sapiens
attctcagctttcaaatagaca

SEQ ID NO: 9230670 - DNA, 22 bp, Homo sapiens
attctcaatggctactttcata

SEQ ID NO: 9230671 - DNA, 22 bp, Homo sapiens
attctgtctttttaaaataata

SEQ ID NO: 9230672 - DNA, 22 bp, Homo sapiens
attcttaattgccatgctgtat

SEQ ID NO: 9230673 - DNA, 22 bp, Homo sapiens
attcttaattgccatgctgtat

SEQ ID NO: 9230674 - DNA, 22 bp, Homo sapiens
attcttacaaagcagagtctgt

SEQ ID NO: 9230675 - DNA, 22 bp, Homo sapiens
attcttacaaatgaaactgcaa

SEQ ID NO: 9230676 - DNA, 22 bp, Homo sapiens
attcttattatagtaaaacagt

SEQ ID NO: 9230677 - DNA, 22 bp, Homo sapiens
attcttattatagtaaaacagt

SEQ ID NO: 9230678 - DNA, 22 bp, Homo sapiens
attcttattatagtaaaacagt

SEQ ID NO: 9230679 - DNA, 22 bp, Homo sapiens
attcttaattccaaagactgag

SEQ ID NO: 9230680 - DNA, 22 bp, Homo sapiens
attctgtgtgtactgagatggg

SEQ ID NO: 9230681 - DNA, 22 bp, Homo sapiens
attcttcactgtttcagaatga

SEQ ID NO: 9230682 - DNA, 22 bp, Homo sapiens
attcttcactgtttcagaatga

SEQ ID NO: 9230683 - DNA, 22 bp, Homo sapiens
attgacaatgtatttgtatctg

SEQ ID NO: 9230684 - DNA, 22 bp, Homo sapiens
attgacaattctatgcagagca

SEQ ID NO: 9230685 - DNA, 22 bp, Homo sapiens
attgacagcaggggctgtcact

SEQ ID NO: 9230686 - DNA, 22 bp, Homo sapiens
attgacaaatggatgttgacat

SEQ ID NO: 9230687 - DNA, 22 bp, Homo sapiens
attgacaagcagtatgtcttag

SEQ ID NO: 9230688 - DNA, 22 bp, Homo sapiens
attgcttactaatcatcttcag

SEQ ID NO: 9230689 - DNA, 22 bp, Homo sapiens
attgcactttcccctgtgagaa

SEQ ID NO: 9230690 - DNA, 22 bp, Homo sapiens
attgaagcatggagatgaggca

SEQ ID NO: 9230691 - DNA, 22 bp, Homo sapiens
attgaatagatgcattatacta

SEQ ID NO: 9230692 - DNA, 22 bp, Homo sapiens
attgacaaatctgaacatacgg

SEQ ID NO: 9230693 - DNA, 22 bp, Homo sapiens
attgaagattaaatgcttcctt

SEQ ID NO: 9230694 - DNA, 20 bp, Homo sapiens
attgaaatttttctgagatt

SEQ ID NO: 9230695 - DNA, 22 bp, Homo sapiens
attgaaaaatgactattgctta

SEQ ID NO: 9230696 - DNA, 22 bp, Homo sapiens
attgaaattgatgaaattcttg

SEQ ID NO: 9230697 - DNA, 22 bp, Homo sapiens
attcttcagaatatctggcact

SEQ ID NO: 9230698 - DNA, 22 bp, Homo sapiens
attcctcatttgttgagaacca

SEQ ID NO: 9230699 - DNA, 22 bp, Homo sapiens
attcctcatttgttgagaacca

SEQ ID NO: 9230700 - DNA, 22 bp, Homo sapiens
attcctcattatttactgagga

SEQ ID NO: 9230701 - DNA, 22 bp, Homo sapiens
attcctaaggaaggctggcaag

SEQ ID NO: 9230702 - DNA, 22 bp, Homo sapiens
attcctaaagtaatacactaga

SEQ ID NO: 9230703 - DNA, 22 bp, Homo sapiens
gcagagcttctgtccttcagga

SEQ ID NO: 9230704 - DNA, 22 bp, Homo sapiens
gcagagcttctgtccttcagga

SEQ ID NO: 9230705 - DNA, 22 bp, Homo sapiens
attccttctaaaacgctgccct

SEQ ID NO: 9230706 - DNA, 22 bp, Homo sapiens
attcctgagacttatctgtttc

SEQ ID NO: 9230707 - DNA, 22 bp, Homo sapiens
attccttgtttcactgaaaagg

SEQ ID NO: 9230708 - DNA, 22 bp, Homo sapiens
gcagcaggtccgcatcatcatc

SEQ ID NO: 9230709 - DNA, 22 bp, Homo sapiens
attccttgtttcactgaaaagg

SEQ ID NO: 9230710 - DNA, 22 bp, Homo sapiens
gcagcaggcttttcataccttg

SEQ ID NO: 9230711 - DNA, 22 bp, Homo sapiens
gcagcaggcttttcataccttg

SEQ ID NO: 9230712 - DNA, 22 bp, Homo sapiens
gcagcagggagcaggggtgtca

SEQ ID NO: 9230713 - DNA, 22 bp, Homo sapiens
gcagcagggtgccagctttgca

SEQ ID NO: 9230714 - DNA, 22 bp, Homo sapiens
attctagaaggcaaagcaaggg

SEQ ID NO: 9230715 - DNA, 18 bp, Homo sapiens
attctagaagatgccttg

SEQ ID NO: 9230716 - DNA, 22 bp, Homo sapiens
attctacatgatagaagggaga

SEQ ID NO: 9230717 - DNA, 22 bp, Homo sapiens
attctacacctctctcatttag

SEQ ID NO: 9230718 - DNA, 23 bp, Homo sapiens
gcagagctgccctattgccttgg

SEQ ID NO: 9230719 - DNA, 22 bp, Homo sapiens
gcagagctgcagcgaggcctgg

SEQ ID NO: 9230720 - DNA, 18 bp, Homo sapiens
gcagagctgggattccca

SEQ ID NO: 9230721 - DNA, 22 bp, Homo sapiens
gcagagctgggtctgtatccaa

SEQ ID NO: 9230722 - DNA, 22 bp, Homo sapiens
gcagagctgggtctgtatccaa

SEQ ID NO: 9230723 - DNA, 21 bp, Homo sapiens
gcagagctggaaccaggaccc

SEQ ID NO: 9230724 - DNA, 22 bp, Homo sapiens
gcagagctgttaatggagctga

SEQ ID NO: 9230725 - DNA, 20 bp, Homo sapiens
gcagagctgttctgtgggga

SEQ ID NO: 9230726 - DNA, 20 bp, Homo sapiens
gcagagctgttctgtgggga

SEQ ID NO: 9230727 - DNA, 22 bp, Homo sapiens
gcagagctgtctaagtcacttc

SEQ ID NO: 9230728 - DNA, 22 bp, Homo sapiens
gcagagctgtctaagtcacttc

SEQ ID NO: 9230729 - DNA, 22 bp, Homo sapiens
gcagagctgtctaagtcacttc

SEQ ID NO: 9230730 - DNA, 22 bp, Homo sapiens
attcagttagccacagctattc

SEQ ID NO: 9230731 - DNA, 22 bp, Homo sapiens
attcagtgggtgctcagcacaa

SEQ ID NO: 9230732 - DNA, 22 bp, Homo sapiens
attcagtgtttgcagcaacttt

SEQ ID NO: 9230733 - DNA, 22 bp, Homo sapiens
attatttatcctcttggtctat

SEQ ID NO: 9230734 - DNA, 22 bp, Homo sapiens
attatttcagtcagacactggc

SEQ ID NO: 9230735 - DNA, 22 bp, Homo sapiens
attcagagattgttattcagac

SEQ ID NO: 9230736 - DNA, 22 bp, Homo sapiens
attcagagattgttattcagac

SEQ ID NO: 9230737 - DNA, 21 bp, Homo sapiens
attcagagtaattcatcttta

SEQ ID NO: 9230738 - DNA, 22 bp, Homo sapiens
attcagtgccaaggagaacttg

SEQ ID NO: 9230739 - DNA, 22 bp, Homo sapiens
attatttagaaatcgattgaaa

SEQ ID NO: 9230740 - DNA, 22 bp, Homo sapiens
attattgttttaatagtagaga

SEQ ID NO: 9230741 - DNA, 22 bp, Homo sapiens
attattgttttaatagtagaga

SEQ ID NO: 9230742 - DNA, 22 bp, Homo sapiens
attattgttttaatagtagaga

SEQ ID NO: 9230743 - DNA, 22 bp, Homo sapiens
attattgttagtgacagggtga

SEQ ID NO: 9230744 - DNA, 22 bp, Homo sapiens
attattgttgcggctgttaccg

SEQ ID NO: 9230745 - DNA, 22 bp, Homo sapiens
attattgtactttcaataaggt

SEQ ID NO: 9230746 - DNA, 22 bp, Homo sapiens
attattgtgtaaaatgaggctt

SEQ ID NO: 9230747 - DNA, 22 bp, Homo sapiens
attattgtgataggtgtcagtg

SEQ ID NO: 9230748 - DNA, 22 bp, Homo sapiens
attattgtcatcttaatcttaa

SEQ ID NO: 9230749 - DNA, 22 bp, Homo sapiens
attattgtcatcttaatcttaa

SEQ ID NO: 9230750 - DNA, 22 bp, Homo sapiens
attattgtactttcaataaggt

SEQ ID NO: 9230751 - DNA, 22 bp, Homo sapiens
attattgccagctattacaaca

SEQ ID NO: 9230752 - DNA, 22 bp, Homo sapiens
attattgctgacatggtgttga

SEQ ID NO: 9230753 - DNA, 22 bp, Homo sapiens
attacaaaagaagggagaaggt

SEQ ID NO: 9230754 - DNA, 22 bp, Homo sapiens
attaatttttctgacagccaca

SEQ ID NO: 9230755 - DNA, 22 bp, Homo sapiens
attacaaaagaagggagaaggt

SEQ ID NO: 9230756 - DNA, 22 bp, Homo sapiens
attacaaaagaagggagaaggt

SEQ ID NO: 9230757 - DNA, 22 bp, Homo sapiens
attacaaaagaagggagaaggt

SEQ ID NO: 9230758 - DNA, 22 bp, Homo sapiens
attacaataaggtttatttgta

SEQ ID NO: 9230759 - DNA, 22 bp, Homo sapiens
attacaataaggtttatttgta

SEQ ID NO: 9230760 - DNA, 22 bp, Homo sapiens
attacaataaggtttatttgta

SEQ ID NO: 9230761 - DNA, 22 bp, Homo sapiens
attacaataatacatgctcatt

SEQ ID NO: 9230762 - DNA, 22 bp, Homo sapiens
gcaaggctgagcacatttgcat

SEQ ID NO: 9230763 - DNA, 22 bp, Homo sapiens
gcaaggctgctgccacccatct

SEQ ID NO: 9230764 - DNA, 22 bp, Homo sapiens
gcaaggctgtgcactttgcatt

SEQ ID NO: 9230765 - DNA, 22 bp, Homo sapiens
attaagatgtgggaaaatttaa

SEQ ID NO: 9230766 - DNA, 22 bp, Homo sapiens
gatgatattttgactggagaat

SEQ ID NO: 9230767 - DNA, 22 bp, Homo sapiens
attaagatgtgggaaaatttaa

SEQ ID NO: 9230768 - DNA, 22 bp, Homo sapiens
attaatttccaggcactgtgct

SEQ ID NO: 9230769 - DNA, 22 bp, Homo sapiens
attaattttacctttgtaaaca

SEQ ID NO: 9230770 - DNA, 22 bp, Homo sapiens
attaattttacctttgtaaaca

SEQ ID NO: 9230771 - DNA, 22 bp, Homo sapiens
attaattttacctttgtaaaca

SEQ ID NO: 9230772 - DNA, 22 bp, Homo sapiens
attaatttccaggcactgtgct

SEQ ID NO: 9230773 - DNA, 22 bp, Homo sapiens
attaatgtgtagccaacttaat

SEQ ID NO: 9230774 - DNA, 22 bp, Homo sapiens
attattgcaagcagtgaaggga

SEQ ID NO: 9230775 - DNA, 22 bp, Homo sapiens
attattgcaatttgacattcag

SEQ ID NO: 9230776 - DNA, 20 bp, Homo sapiens
attattcatacatgtgtgac

SEQ ID NO: 9230777 - DNA, 22 bp, Homo sapiens
attattcagtcttgtaaggagt

SEQ ID NO: 9230778 - DNA, 20 bp, Homo sapiens
attagagctacatggctaca

SEQ ID NO: 9230779 - DNA, 22 bp, Homo sapiens
attattaaagctacatcaagga

SEQ ID NO: 9230780 - DNA, 22 bp, Homo sapiens
attagagcagtgtattatgata

SEQ ID NO: 9230781 - DNA, 22 bp, Homo sapiens
attagagattatgaattcctag

SEQ ID NO: 9230782 - DNA, 22 bp, Homo sapiens
attattcaatcatattaaaagt

SEQ ID NO: 9230783 - DNA, 22 bp, Homo sapiens
gcaaggctttgtgaattttaaa

SEQ ID NO: 9230784 - DNA, 21 bp, Homo sapiens
gcaaggcttttgtgtttccca

SEQ ID NO: 9230785 - DNA, 22 bp, Homo sapiens
gcaagggtgtgaaccaatgaga

SEQ ID NO: 9230786 - DNA, 17 bp, Homo sapiens
gcaagggatgggagatt

SEQ ID NO: 9230787 - DNA, 23 bp, Homo sapiens
gcaagtgaggcgtcagcagtcaa

SEQ ID NO: 9230788 - DNA, 22 bp, Homo sapiens
attagaagatagtgatttctgc

SEQ ID NO: 9230789 - DNA, 22 bp, Homo sapiens
attagaagcgtgaatcctttca

SEQ ID NO: 9230790 - DNA, 21 bp, Homo sapiens
attagaaggtatttagggcct

SEQ ID NO: 9230791 - DNA, 23 bp, Homo sapiens
attagaaaggctttctggtgaaa

SEQ ID NO: 9230792 - DNA, 22 bp, Homo sapiens
gcaataaaatgtaatgattggg

SEQ ID NO: 9230793 - DNA, 22 bp, Homo sapiens
attagaatgacagaaatgaggc

SEQ ID NO: 9230794 - DNA, 22 bp, Homo sapiens
attagaatgaagtataggattt

SEQ ID NO: 9230795 - DNA, 22 bp, Homo sapiens
attagaattatgcttgctaatg

SEQ ID NO: 9230796 - DNA, 22 bp, Homo sapiens
attagaatgcagggttcattgt

SEQ ID NO: 9230797 - DNA, 22 bp, Homo sapiens
attagaattatgcttgctaatg

SEQ ID NO: 9230798 - DNA, 22 bp, Homo sapiens
attaaatggtggtcattcattt

SEQ ID NO: 9230799 - DNA, 22 bp, Homo sapiens
attaaaagcttcccaagagtta

SEQ ID NO: 9230800 - DNA, 22 bp, Homo sapiens
attaaatactgcaggctaagca

SEQ ID NO: 9230801 - DNA, 22 bp, Homo sapiens
attaaaattccaaggtatgcca

SEQ ID NO: 9230802 - DNA, 22 bp, Homo sapiens
attaaaattccaaggtatgcca

SEQ ID NO: 9230803 - DNA, 22 bp, Homo sapiens
atgtttttcataccagtgttgg

SEQ ID NO: 9230804 - DNA, 22 bp, Homo sapiens
atgtttttcataccagtgttgg

SEQ ID NO: 9230805 - DNA, 22 bp, Homo sapiens
atgtttttaaatagacttacag

SEQ ID NO: 9230806 - DNA, 22 bp, Homo sapiens
atgtttttgagatacaaacaga

SEQ ID NO: 9230807 - DNA, 22 bp, Homo sapiens
atgtttttgagatacaaacaga

SEQ ID NO: 9230808 - DNA, 22 bp, Homo sapiens
atgtttttgagatacaaacaga

SEQ ID NO: 9230809 - DNA, 22 bp, Homo sapiens
atgtttttggaaatgggaacat

SEQ ID NO: 9230810 - DNA, 22 bp, Homo sapiens
atgtttttggaaatgggaacat

SEQ ID NO: 9230811 - DNA, 22 bp, Homo sapiens
attaaaagcttcccaagagtta

SEQ ID NO: 9230812 - DNA, 22 bp, Homo sapiens
attaaaagagataatgtgtgtt

SEQ ID NO: 9230813 - DNA, 22 bp, Homo sapiens
atgtttttggcttcaagtttct

SEQ ID NO: 9230814 - DNA, 22 bp, Homo sapiens
gatgagtaatagctaatggttc

SEQ ID NO: 9230815 - DNA, 22 bp, Homo sapiens
attaaattaagtggctaattta

SEQ ID NO: 9230816 - DNA, 22 bp, Homo sapiens
attaaattagcaaactgtgaaa

SEQ ID NO: 9230817 - DNA, 22 bp, Homo sapiens
atgttttctccatgttatgctt

SEQ ID NO: 9230818 - DNA, 22 bp, Homo sapiens
atgttttctccatgttatgctt

SEQ ID NO: 9230819 - DNA, 22 bp, Homo sapiens
atgttttctttcagacttccct

SEQ ID NO: 9230820 - DNA, 22 bp, Homo sapiens
atgttttctttcagacttccct

SEQ ID NO: 9230821 - DNA, 22 bp, Homo sapiens
atgttttctttcagacttccct

SEQ ID NO: 9230822 - DNA, 22 bp, Homo sapiens
atgttttgattggttaggtctg

SEQ ID NO: 9230823 - DNA, 22 bp, Homo sapiens
atgttttcctgggagagcactc

SEQ ID NO: 9230824 - DNA, 22 bp, Homo sapiens
atgttttcctgggagagcactc

SEQ ID NO: 9230825 - DNA, 22 bp, Homo sapiens
atgttttctagagtttaaaatc

SEQ ID NO: 9230826 - DNA, 22 bp, Homo sapiens
atgttttctagagtttaaaatc

SEQ ID NO: 9230827 - DNA, 22 bp, Homo sapiens
atgttttctagagtttaaaatc

SEQ ID NO: 9230828 - DNA, 22 bp, Homo sapiens
atgttttcaaagtaaacttgta

SEQ ID NO: 9230829 - DNA, 22 bp, Homo sapiens
atgttttcaaagtaaacttgta

SEQ ID NO: 9230830 - DNA, 22 bp, Homo sapiens
atgttttcaaagtaaacttgta

SEQ ID NO: 9230831 - DNA, 22 bp, Homo sapiens
atgttttattaccaacttgtac

SEQ ID NO: 9230832 - DNA, 22 bp, Homo sapiens
atgttttattaccaacttgtac

SEQ ID NO: 9230833 - DNA, 22 bp, Homo sapiens
atgttttattaccaacttgtac

SEQ ID NO: 9230834 - DNA, 22 bp, Homo sapiens
atgttttccccaaatgatcttc

SEQ ID NO: 9230835 - DNA, 22 bp, Homo sapiens
atgttttccccaaatgatcttc

SEQ ID NO: 9230836 - DNA, 22 bp, Homo sapiens
atgttttccattgccatggaaa

SEQ ID NO: 9230837 - DNA, 22 bp, Homo sapiens
atgttttccattgccatggaaa

SEQ ID NO: 9230838 - DNA, 22 bp, Homo sapiens
atgttttaccctttgcacaaac

SEQ ID NO: 9230839 - DNA, 22 bp, Homo sapiens
atgttttaccctttgcacaaac

SEQ ID NO: 9230840 - DNA, 22 bp, Homo sapiens
atgttttaccctttgcacaaac

SEQ ID NO: 9230841 - DNA, 22 bp, Homo sapiens
atgttttatattttgcagcagt

SEQ ID NO: 9230842 - DNA, 20 bp, Homo sapiens
atgttttataaaagaacggg

SEQ ID NO: 9230843 - DNA, 23 bp, Homo sapiens
atgttttatgtctctagctgcca

SEQ ID NO: 9230844 - DNA, 23 bp, Homo sapiens
atgttttatgtctctagctgcca

SEQ ID NO: 9230845 - DNA, 22 bp, Homo sapiens
atgttttatgttccactcaagg

SEQ ID NO: 9230846 - DNA, 22 bp, Homo sapiens
atgttttatgttccactcaagg

SEQ ID NO: 9230847 - DNA, 22 bp, Homo sapiens
atgttttatattttgcagcagt

SEQ ID NO: 9230848 - DNA, 22 bp, Homo sapiens
atgtgtgtgtatatacacacat

SEQ ID NO: 9230849 - DNA, 22 bp, Homo sapiens
atgtgtgtgtgcgcgcgcagga

SEQ ID NO: 9230850 - DNA, 22 bp, Homo sapiens
atgtgttctgaggcagatgact

SEQ ID NO: 9230851 - DNA, 22 bp, Homo sapiens
atgtgttcagttgacaggagca

SEQ ID NO: 9230852 - DNA, 22 bp, Homo sapiens
atgtgttcacgtgcacatgtgc

SEQ ID NO: 9230853 - DNA, 22 bp, Homo sapiens
atgtgtgtgtttaatcctcaaa

SEQ ID NO: 9230854 - DNA, 22 bp, Homo sapiens
atgtgtgtgtttaatcctcaaa

SEQ ID NO: 9230855 - DNA, 22 bp, Homo sapiens
atgtgtgtgtttaatcctcaaa

SEQ ID NO: 9230856 - DNA, 22 bp, Homo sapiens
atgtgttttggtggatcattca

SEQ ID NO: 9230857 - DNA, 22 bp, Homo sapiens
atgtgtttttattctggcatgt

SEQ ID NO: 9230858 - DNA, 22 bp, Homo sapiens
atgtgttttggtaatttctgct

SEQ ID NO: 9230859 - DNA, 22 bp, Homo sapiens
atgtgttttggtaatttctgct

SEQ ID NO: 9230860 - DNA, 22 bp, Homo sapiens
atgtgttttggtaatttctgct

SEQ ID NO: 9230861 - DNA, 22 bp, Homo sapiens
atgtgtttataattactcaatc

SEQ ID NO: 9230862 - DNA, 22 bp, Homo sapiens
atgtgtttggttatatggtatt

SEQ ID NO: 9230863 - DNA, 22 bp, Homo sapiens
atgtgtttataattactcaatc

SEQ ID NO: 9230864 - DNA, 22 bp, Homo sapiens
atgtgtttgtacctttaaatat

SEQ ID NO: 9230865 - DNA, 22 bp, Homo sapiens
atgtgtttgtacctttaaatat

SEQ ID NO: 9230866 - DNA, 22 bp, Homo sapiens
atttcacaaaccatcctgattt

SEQ ID NO: 9230867 - DNA, 22 bp, Homo sapiens
gccaggcctgcaagtgctggtg

SEQ ID NO: 9230868 - DNA, 22 bp, Homo sapiens
atttcagattcgagaggaagtg

SEQ ID NO: 9230869 - DNA, 22 bp, Homo sapiens
atttcagattcagaaatgtagg

SEQ ID NO: 9230870 - DNA, 22 bp, Homo sapiens
atttcagatgaccaaatggaaa

SEQ ID NO: 9230871 - DNA, 22 bp, Homo sapiens
atttcagactgtgttggaaaat

SEQ ID NO: 9230872 - DNA, 22 bp, Homo sapiens
atttcagaatgtcctaatttag

SEQ ID NO: 9230873 - DNA, 22 bp, Homo sapiens
atttcagaatgtcctaatttag

SEQ ID NO: 9230874 - DNA, 21 bp, Homo sapiens
atttcagagcacacaagtaaa

SEQ ID NO: 9230875 - DNA, 21 bp, Homo sapiens
atttcagagcacacaagtaaa

SEQ ID NO: 9230876 - DNA, 22 bp, Homo sapiens
atttattgagacttaacaaccc

SEQ ID NO: 9230877 - DNA, 22 bp, Homo sapiens
atttattgagacttaacaaccc

SEQ ID NO: 9230878 - DNA, 22 bp, Homo sapiens
atttattgagacttaacaaccc

SEQ ID NO: 9230879 - DNA, 22 bp, Homo sapiens
atttattatgggatttggcaca

SEQ ID NO: 9230880 - DNA, 22 bp, Homo sapiens
atttattgagacttaacaaccc

SEQ ID NO: 9230881 - DNA, 22 bp, Homo sapiens
atttattgagagggaggggaat

SEQ ID NO: 9230882 - DNA, 22 bp, Homo sapiens
atttattgagagggaggggaat

SEQ ID NO: 9230883 - DNA, 22 bp, Homo sapiens
atttattgagagggaggggaat

SEQ ID NO: 9230884 - DNA, 22 bp, Homo sapiens
atttattgagcctttcctatgt

SEQ ID NO: 9230885 - DNA, 22 bp, Homo sapiens
atttattgagcctttcctatgt

SEQ ID NO: 9230886 - DNA, 22 bp, Homo sapiens
atttattgagagggaggggaat

SEQ ID NO: 9230887 - DNA, 22 bp, Homo sapiens
gccaggcatttgttaggtgctg

SEQ ID NO: 9230888 - DNA, 22 bp, Homo sapiens
atttattggatgcttacttggg

SEQ ID NO: 9230889 - DNA, 22 bp, Homo sapiens
atttattggatgcttacttggg

SEQ ID NO: 9230890 - DNA, 22 bp, Homo sapiens
atttattggatgcttacttggg

SEQ ID NO: 9230891 - DNA, 22 bp, Homo sapiens
atttattgagcctttcctatgt

SEQ ID NO: 9230892 - DNA, 22 bp, Homo sapiens
atttattgagcctttcctatgt

SEQ ID NO: 9230893 - DNA, 22 bp, Homo sapiens
atttattggatgcttacttggg

SEQ ID NO: 9230894 - DNA, 22 bp, Homo sapiens
atttcagtgtcttcttctccct

SEQ ID NO: 9230895 - DNA, 22 bp, Homo sapiens
atttcagtgagaaagcaatcaa

SEQ ID NO: 9230896 - DNA, 22 bp, Homo sapiens
atttcagtgttggttagcaagc

SEQ ID NO: 9230897 - DNA, 22 bp, Homo sapiens
atttcagtgtcttcttctccct

SEQ ID NO: 9230898 - DNA, 22 bp, Homo sapiens
atttcagtagtccttacttgta

SEQ ID NO: 9230899 - DNA, 22 bp, Homo sapiens
atttcagtagaaaatcttgatt

SEQ ID NO: 9230900 - DNA, 22 bp, Homo sapiens
atttcagggtgtcttccaactg

SEQ ID NO: 9230901 - DNA, 22 bp, Homo sapiens
atttcagcccagtatgagcccc

SEQ ID NO: 9230902 - DNA, 22 bp, Homo sapiens
atttcatgagttattatagtgg

SEQ ID NO: 9230903 - DNA, 22 bp, Homo sapiens
atttcatgagttattatagtgg

SEQ ID NO: 9230904 - DNA, 21 bp, Homo sapiens
atttcatggtgcttttaagaa

SEQ ID NO: 9230905 - DNA, 22 bp, Homo sapiens
atttcagtgttttaagagttca

SEQ ID NO: 9230906 - DNA, 22 bp, Homo sapiens
atttcatatgtatcacctagcc

SEQ ID NO: 9230907 - DNA, 22 bp, Homo sapiens
atttctagacttagaactctta

SEQ ID NO: 9230908 - DNA, 22 bp, Homo sapiens
atttcctttgcaaagactgtgc

SEQ ID NO: 9230909 - DNA, 22 bp, Homo sapiens
atttcctttgcaaagactgtgc

SEQ ID NO: 9230910 - DNA, 22 bp, Homo sapiens
atttctactgtgagaaacatga

SEQ ID NO: 9230911 - DNA, 22 bp, Homo sapiens
atttctacagtacacatgcatt

SEQ ID NO: 9230912 - DNA, 22 bp, Homo sapiens
atttccttgcaacttaggcatg

SEQ ID NO: 9230913 - DNA, 22 bp, Homo sapiens
atttccttcccagatttggttc

SEQ ID NO: 9230914 - DNA, 22 bp, Homo sapiens
atttccttcggacagtttgggt

SEQ ID NO: 9230915 - DNA, 22 bp, Homo sapiens
atttccttgcaagtttctgtaa

SEQ ID NO: 9230916 - DNA, 22 bp, Homo sapiens
atttcctttgcaaagactgtgc

SEQ ID NO: 9230917 - DNA, 16 bp, Homo sapiens
atttccttgtgagttt

SEQ ID NO: 9230918 - DNA, 22 bp, Homo sapiens
atttcctagcctctcttgcagt

SEQ ID NO: 9230919 - DNA, 22 bp, Homo sapiens
atttcatgtgaagaagagataa

SEQ ID NO: 9230920 - DNA, 22 bp, Homo sapiens
atttcatgtgaagaagagataa

SEQ ID NO: 9230921 - DNA, 22 bp, Homo sapiens
atttccttcatcagcctatcct

SEQ ID NO: 9230922 - DNA, 22 bp, Homo sapiens
atttcctagggtagatgtcaca

SEQ ID NO: 9230923 - DNA, 22 bp, Homo sapiens
attggaaatacagtagaaaaat

SEQ ID NO: 9230924 - DNA, 21 bp, Homo sapiens
attggaaaaggtagttggctt

SEQ ID NO: 9230925 - DNA, 22 bp, Homo sapiens
attggaaagtgtctagtgtggt

SEQ ID NO: 9230926 - DNA, 22 bp, Homo sapiens
attggaaatacagtagaaaaat

SEQ ID NO: 9230927 - DNA, 22 bp, Homo sapiens
attggagaagaacatgaattag

SEQ ID NO: 9230928 - DNA, 22 bp, Homo sapiens
attgcttcaactgttcaatggg

SEQ ID NO: 9230929 - DNA, 22 bp, Homo sapiens
attgcttttgagctagaatttt

SEQ ID NO: 9230930 - DNA, 22 bp, Homo sapiens
attgcttttgagctagaatttt

SEQ ID NO: 9230931 - DNA, 22 bp, Homo sapiens
attgctttgtacatgcctagca

SEQ ID NO: 9230932 - DNA, 21 bp, Homo sapiens
atttacaaaacagtcccttcc

SEQ ID NO: 9230933 - DNA, 22 bp, Homo sapiens
atttaattttctcaacagtgct

SEQ ID NO: 9230934 - DNA, 22 bp, Homo sapiens
atttaattttctcaacagtgct

SEQ ID NO: 9230935 - DNA, 22 bp, Homo sapiens
atttaattttctcaacagtgct

SEQ ID NO: 9230936 - DNA, 22 bp, Homo sapiens
atttaatttatagatgtggata

SEQ ID NO: 9230937 - DNA, 22 bp, Homo sapiens
atttaatttgtgtctttagctg

SEQ ID NO: 9230938 - DNA, 22 bp, Homo sapiens
atttaatttgtgtctttagctg

SEQ ID NO: 9230939 - DNA, 22 bp, Homo sapiens
atttaatttggagagagaaacc

SEQ ID NO: 9230940 - DNA, 22 bp, Homo sapiens
atttaatttggagagagaaacc

SEQ ID NO: 9230941 - DNA, 22 bp, Homo sapiens
atttaattaatcatggtgaatt

SEQ ID NO: 9230942 - DNA, 22 bp, Homo sapiens
atttaatttacatttgacagag

SEQ ID NO: 9230943 - DNA, 22 bp, Homo sapiens
atttaattgttcttctggctat

SEQ ID NO: 9230944 - DNA, 22 bp, Homo sapiens
atttaattgttcttctggctat

SEQ ID NO: 9230945 - DNA, 22 bp, Homo sapiens
atttaatttacatttgacagag

SEQ ID NO: 9230946 - DNA, 22 bp, Homo sapiens
atttacagaaacttaatcatag

SEQ ID NO: 9230947 - DNA, 22 bp, Homo sapiens
atttacagaaacttaatcatag

SEQ ID NO: 9230948 - DNA, 22 bp, Homo sapiens
gccaggagggaaaggacaattt

SEQ ID NO: 9230949 - DNA, 19 bp, Homo sapiens
gccaggagggctctggctg

SEQ ID NO: 9230950 - DNA, 19 bp, Homo sapiens
gccaggagggctctggctg

SEQ ID NO: 9230951 - DNA, 22 bp, Homo sapiens
gccaggaggcttaactggacag

SEQ ID NO: 9230952 - DNA, 22 bp, Homo sapiens
gccaggaggcttaactggacag

SEQ ID NO: 9230953 - DNA, 22 bp, Homo sapiens
gccagctggagtgagagtgggc

SEQ ID NO: 9230954 - DNA, 22 bp, Homo sapiens
atttacagaagcatgtaatagc

SEQ ID NO: 9230955 - DNA, 22 bp, Homo sapiens
atttacagaagcatgtaatagc

SEQ ID NO: 9230956 - DNA, 22 bp, Homo sapiens
atttagaagctaatttttcaga

SEQ ID NO: 9230957 - DNA, 22 bp, Homo sapiens
atttagaagctaatttttcaga

SEQ ID NO: 9230958 - DNA, 22 bp, Homo sapiens
atttagaagctaatttttcaga

SEQ ID NO: 9230959 - DNA, 22 bp, Homo sapiens
atttagaactttgtttgccaat

SEQ ID NO: 9230960 - DNA, 22 bp, Homo sapiens
atttagaaattccaaaagtatt

SEQ ID NO: 9230961 - DNA, 22 bp, Homo sapiens
atttagaaccccttccaacctg

SEQ ID NO: 9230962 - DNA, 22 bp, Homo sapiens
atttactttgctgagatccatc

SEQ ID NO: 9230963 - DNA, 22 bp, Homo sapiens
gccaggaggggagagtgtgtca

SEQ ID NO: 9230964 - DNA, 20 bp, Homo sapiens
gccaggagggtgtgatgagc

SEQ ID NO: 9230965 - DNA, 20 bp, Homo sapiens
gccaggagggtgtgatgagc

SEQ ID NO: 9230966 - DNA, 17 bp, Homo sapiens
gccaggaggtttgagct

SEQ ID NO: 9230967 - DNA, 21 bp, Homo sapiens
gccaggagtagattacattta

SEQ ID NO: 9230968 - DNA, 20 bp, Homo sapiens
gccaggagggtgtgatgagc

SEQ ID NO: 9230969 - DNA, 22 bp, Homo sapiens
gccaggaggtcagcccctcaac

SEQ ID NO: 9230970 - DNA, 22 bp, Homo sapiens
gccaggagtgtcccactcattt

SEQ ID NO: 9230971 - DNA, 22 bp, Homo sapiens
gccaggagtgtgtggctatgtt

SEQ ID NO: 9230972 - DNA, 22 bp, Homo sapiens
gccaggagtgtcccactcattt

SEQ ID NO: 9230973 - DNA, 22 bp, Homo sapiens
caaaacattcagagagctcact

SEQ ID NO: 9230974 - DNA, 19 bp, Homo sapiens
gcgaggaagtcactgtggc

SEQ ID NO: 9230975 - DNA, 19 bp, Homo sapiens
gcgaggaagtcactgtggt

SEQ ID NO: 9230976 - DNA, 22 bp, Homo sapiens
caaaacattctctgcagcaggg

SEQ ID NO: 9230977 - DNA, 22 bp, Homo sapiens
gcctgtctcttggaacttggta

SEQ ID NO: 9230978 - DNA, 22 bp, Homo sapiens
gcctgtctgcagggctgtcatt

SEQ ID NO: 9230979 - DNA, 20 bp, Homo sapiens
gcctgtcctgagtgtcatgg

SEQ ID NO: 9230980 - DNA, 22 bp, Homo sapiens
gcctgtcctggatgctctgcaa

SEQ ID NO: 9230981 - DNA, 22 bp, Homo sapiens
gcctgtctgcgtcacgcttatt

SEQ ID NO: 9230982 - DNA, 22 bp, Homo sapiens
gcctgtctgcgtcacgcttatt

SEQ ID NO: 9230983 - DNA, 22 bp, Homo sapiens
gcctgtctgcagggctgtcatt

SEQ ID NO: 9230984 - DNA, 22 bp, Homo sapiens
gcctgtgcatagcagcggactc

SEQ ID NO: 9230985 - DNA, 22 bp, Homo sapiens
gcctgtccactaaacagccaag

SEQ ID NO: 9230986 - DNA, 22 bp, Homo sapiens
gcctgtccactaaacagccaag

SEQ ID NO: 9230987 - DNA, 23 bp, Homo sapiens
gcctgggagttgcgatctgcccg

SEQ ID NO: 9230988 - DNA, 22 bp, Homo sapiens
gcctgtcaattttgtgtacaat

SEQ ID NO: 9230989 - DNA, 22 bp, Homo sapiens
gcctgggagtgcacagtgaggt

SEQ ID NO: 9230990 - DNA, 22 bp, Homo sapiens
gcctgggagggcagcagtgtgg

SEQ ID NO: 9230991 - DNA, 22 bp, Homo sapiens
gcctgggagggcagcagtgtgg

SEQ ID NO: 9230992 - DNA, 22 bp, Homo sapiens
gcctgggagtgcacagtgaggt

SEQ ID NO: 9230993 - DNA, 22 bp, Homo sapiens
gcctgggagtgcacagtgaggt

SEQ ID NO: 9230994 - DNA, 22 bp, Homo sapiens
gcgagggcacgcggttgaaggc

SEQ ID NO: 9230995 - DNA, 22 bp, Homo sapiens
gcgaggaggggtgctgggcccc

SEQ ID NO: 9230996 - DNA, 22 bp, Homo sapiens
caaacattccgcttctcccagg

SEQ ID NO: 9230997 - DNA, 22 bp, Homo sapiens
caaactgagcatcagaaagttt

SEQ ID NO: 9230998 - DNA, 22 bp, Homo sapiens
caaactgaacacgaaagtcttt

SEQ ID NO: 9230999 - DNA, 22 bp, Homo sapiens
caaaccttgcagaactgggcag

SEQ ID NO: 9231000 - DNA, 22 bp, Homo sapiens
caaacattgcactttctgctat

SEQ ID NO: 9231001 - DNA, 22 bp, Homo sapiens
caaacattgcactttctgctat

SEQ ID NO: 9231002 - DNA, 22 bp, Homo sapiens
gctcaggagctgacagcctcaa

SEQ ID NO: 9231003 - DNA, 22 bp, Homo sapiens
gctcaggatcagccacctcttt

SEQ ID NO: 9231004 - DNA, 22 bp, Homo sapiens
caaaggcacacatacctttctg

SEQ ID NO: 9231005 - DNA, 22 bp, Homo sapiens
caaaggtattctcattttggaa

SEQ ID NO: 9231006 - DNA, 22 bp, Homo sapiens
caaaggcaacatatacttgttt

SEQ ID NO: 9231007 - DNA, 22 bp, Homo sapiens
gctcaggaaacagcagggcttg

SEQ ID NO: 9231008 - DNA, 22 bp, Homo sapiens
caaactttcagttataacatga

SEQ ID NO: 9231009 - DNA, 22 bp, Homo sapiens
caaacttgtctatctaggaatc

SEQ ID NO: 9231010 - DNA, 22 bp, Homo sapiens
caaacttggtggattagtacag

SEQ ID NO: 9231011 - DNA, 22 bp, Homo sapiens
atttctcagcacttcctatctc

SEQ ID NO: 9231012 - DNA, 22 bp, Homo sapiens
atttctcagtaatctcagcaat

SEQ ID NO: 9231013 - DNA, 22 bp, Homo sapiens
atttctcaccctacctcactcc

SEQ ID NO: 9231014 - DNA, 22 bp, Homo sapiens
atttctcaaccaggtcaaaaag

SEQ ID NO: 9231015 - DNA, 22 bp, Homo sapiens
gcctcactgcagccccaggaag

SEQ ID NO: 9231016 - DNA, 22 bp, Homo sapiens
gcctcactgcagccccaggaag

SEQ ID NO: 9231017 - DNA, 22 bp, Homo sapiens
gcctccacttttgctggcttct

SEQ ID NO: 9231018 - DNA, 21 bp, Homo sapiens
gcctccagccagatggcctcc

SEQ ID NO: 9231019 - DNA, 22 bp, Homo sapiens
gcctccagcccacgcaggcctg

SEQ ID NO: 9231020 - DNA, 21 bp, Homo sapiens
gcctctccaaatcctgccttc

SEQ ID NO: 9231021 - DNA, 21 bp, Homo sapiens
gcctctccaaatcctgccttc

SEQ ID NO: 9231022 - DNA, 22 bp, Homo sapiens
gcctctcctcttaataccatta

SEQ ID NO: 9231023 - DNA, 22 bp, Homo sapiens
gcctctccgagccactgcctct

SEQ ID NO: 9231024 - DNA, 22 bp, Homo sapiens
gcctccccaaagtgctgacagc

SEQ ID NO: 9231025 - DNA, 22 bp, Homo sapiens
gcctccagtttttttctgaact

SEQ ID NO: 9231026 - DNA, 22 bp, Homo sapiens
gcctccagggtagaggaggaag

SEQ ID NO: 9231027 - DNA, 22 bp, Homo sapiens
gcctccagctggggcatttcag

SEQ ID NO: 9231028 - DNA, 22 bp, Homo sapiens
gcctccagggatgattccttcc

SEQ ID NO: 9231029 - DNA, 22 bp, Homo sapiens
gcctccagggtagaggaggaag

SEQ ID NO: 9231030 - DNA, 22 bp, Homo sapiens
gcctccagcccacgcaggcctg

SEQ ID NO: 9231031 - DNA, 18 bp, Homo sapiens
gcctgcctagagcttgcc

SEQ ID NO: 9231032 - DNA, 18 bp, Homo sapiens
gcctgcctagagcttgcc

SEQ ID NO: 9231033 - DNA, 22 bp, Homo sapiens
gcctctctgggctgccgaggct

SEQ ID NO: 9231034 - DNA, 22 bp, Homo sapiens
gcctgctgaacctcatgcagtc

SEQ ID NO: 9231035 - DNA, 22 bp, Homo sapiens
gcctgctggaggagcctcaggg

SEQ ID NO: 9231036 - DNA, 22 bp, Homo sapiens
gcctgctggaggagcctcaggg

SEQ ID NO: 9231037 - DNA, 22 bp, Homo sapiens
gcctgctggctgtccattgcag

SEQ ID NO: 9231038 - DNA, 22 bp, Homo sapiens
gcctggagctcggctgagggcg

SEQ ID NO: 9231039 - DNA, 22 bp, Homo sapiens
gcctggagctcggctgagggcg

SEQ ID NO: 9231040 - DNA, 22 bp, Homo sapiens
gcctggagctactggacactga

SEQ ID NO: 9231041 - DNA, 22 bp, Homo sapiens
gcctggagctactggacactga

SEQ ID NO: 9231042 - DNA, 22 bp, Homo sapiens
gcctggagctactggacactga

SEQ ID NO: 9231043 - DNA, 22 bp, Homo sapiens
gcctggagctactggacactga

SEQ ID NO: 9231044 - DNA, 22 bp, Homo sapiens
gcctggagctcatgtgggcatt

SEQ ID NO: 9231045 - DNA, 22 bp, Homo sapiens
gcctgggagattaattaggaag

SEQ ID NO: 9231046 - DNA, 22 bp, Homo sapiens
gcctgggagcacatcggggtcc

SEQ ID NO: 9231047 - DNA, 22 bp, Homo sapiens
gcctggagctctccacttgggg

SEQ ID NO: 9231048 - DNA, 22 bp, Homo sapiens
gcctggagctctccacttgggg

SEQ ID NO: 9231049 - DNA, 22 bp, Homo sapiens
gcctggagctctccacttgggg

SEQ ID NO: 9231050 - DNA, 22 bp, Homo sapiens
gcctgggagagggatagtgcag

SEQ ID NO: 9231051 - DNA, 22 bp, Homo sapiens
gcctgggagagggatagtgcag

SEQ ID NO: 9231052 - DNA, 22 bp, Homo sapiens
cacagtgtctgtgcttcagtgt

SEQ ID NO: 9231053 - DNA, 22 bp, Homo sapiens
cacagtgtgactgaccttcagc

SEQ ID NO: 9231054 - DNA, 22 bp, Homo sapiens
cacagtgtctgtgcttcagtgt

SEQ ID NO: 9231055 - DNA, 22 bp, Homo sapiens
ggcagatggaagaggctgggtc

SEQ ID NO: 9231056 - DNA, 22 bp, Homo sapiens
ggcagatggaagaggctgggtc

SEQ ID NO: 9231057 - DNA, 22 bp, Homo sapiens
ggcagcagtggctgctattgtc

SEQ ID NO: 9231058 - DNA, 22 bp, Homo sapiens
ggcagcagtggctgctattgtc

SEQ ID NO: 9231059 - DNA, 22 bp, Homo sapiens
ggcagcagttacaaatgtgcag

SEQ ID NO: 9231060 - DNA, 22 bp, Homo sapiens
ggcagcatctctggcagcagct

SEQ ID NO: 9231061 - DNA, 20 bp, Homo sapiens
ggcagccaatcagcgtgccg

SEQ ID NO: 9231062 - DNA, 22 bp, Homo sapiens
ggcagccagagggcagctggat

SEQ ID NO: 9231063 - DNA, 22 bp, Homo sapiens
ggcagccaccctgggaggcaga

SEQ ID NO: 9231064 - DNA, 22 bp, Homo sapiens
ggcagcatttagagcacagtgt

SEQ ID NO: 9231065 - DNA, 22 bp, Homo sapiens
cacagtgtagactaataataga

SEQ ID NO: 9231066 - DNA, 16 bp, Homo sapiens
cacagtgctgctgctc

SEQ ID NO: 9231067 - DNA, 22 bp, Homo sapiens
ggcagagcttgcagtgagccga

SEQ ID NO: 9231068 - DNA, 22 bp, Homo sapiens
ggcagagctgcatgagcactca

SEQ ID NO: 9231069 - DNA, 22 bp, Homo sapiens
ggcagagctgcatgagcactca

SEQ ID NO: 9231070 - DNA, 22 bp, Homo sapiens
ggcagagctagtggcttctctt

SEQ ID NO: 9231071 - DNA, 20 bp, Homo sapiens
ggcactggaagcacacagga

SEQ ID NO: 9231072 - DNA, 20 bp, Homo sapiens
ggcactggaagcacacagga

SEQ ID NO: 9231073 - DNA, 22 bp, Homo sapiens
ggcacatgtatgtgggagtgtg

SEQ ID NO: 9231074 - DNA, 22 bp, Homo sapiens
ggcactgctgtaggcagtgagg

SEQ ID NO: 9231075 - DNA, 22 bp, Homo sapiens
ggcactggaaggatcatgtgag

SEQ ID NO: 9231076 - DNA, 22 bp, Homo sapiens
ggcactgggaatgcagtgatga

SEQ ID NO: 9231077 - DNA, 22 bp, Homo sapiens
ggcactgggagaggtgagacgg

SEQ ID NO: 9231078 - DNA, 22 bp, Homo sapiens
ggcactgggagaggtgagacgg

SEQ ID NO: 9231079 - DNA, 22 bp, Homo sapiens
ggcactgggcaccggctgaggg

SEQ ID NO: 9231080 - DNA, 22 bp, Homo sapiens
ggcagagccttctggagctcgc

SEQ ID NO: 9231081 - DNA, 22 bp, Homo sapiens
ggcagagccttctggagctcgc

SEQ ID NO: 9231082 - DNA, 22 bp, Homo sapiens
ggcagagcagccccagggtttg

SEQ ID NO: 9231083 - DNA, 22 bp, Homo sapiens
ggcacagggaggccctggtgtg

SEQ ID NO: 9231084 - DNA, 22 bp, Homo sapiens
ggcacagggggctgaggactag

SEQ ID NO: 9231085 - DNA, 22 bp, Homo sapiens
ggcacagggtgatgttgcagtt

SEQ ID NO: 9231086 - DNA, 22 bp, Homo sapiens
ggcacagggggctgaggactag

SEQ ID NO: 9231087 - DNA, 22 bp, Homo sapiens
ggcacaaggtttaaataacatc

SEQ ID NO: 9231088 - DNA, 22 bp, Homo sapiens
ggcacagggagccgcagttgca

SEQ ID NO: 9231089 - DNA, 22 bp, Homo sapiens
ggcacagggagccgcagttgca

SEQ ID NO: 9231090 - DNA, 22 bp, Homo sapiens
ggatgggagcagaggacgacca

SEQ ID NO: 9231091 - DNA, 22 bp, Homo sapiens
ggatgggaacttggtagggcat

SEQ ID NO: 9231092 - DNA, 22 bp, Homo sapiens
ggatgggaacttggtagggcat

SEQ ID NO: 9231093 - DNA, 22 bp, Homo sapiens
ggagggagtttcattcctgccc

SEQ ID NO: 9231094 - DNA, 22 bp, Homo sapiens
ggagggagtcagctgattagaa

SEQ ID NO: 9231095 - DNA, 22 bp, Homo sapiens
ggagggagtcagctgattagaa

SEQ ID NO: 9231096 - DNA, 22 bp, Homo sapiens
ggagggagtcagctgattagaa

SEQ ID NO: 9231097 - DNA, 22 bp, Homo sapiens
ggagggagcatccccttgctga

SEQ ID NO: 9231098 - DNA, 22 bp, Homo sapiens
ggaggcggaggttgcagtgagc

SEQ ID NO: 9231099 - DNA, 22 bp, Homo sapiens
ggagggagcatccccttgctga

SEQ ID NO: 9231100 - DNA, 22 bp, Homo sapiens
cacagggaggcggtcactggct

SEQ ID NO: 9231101 - DNA, 22 bp, Homo sapiens
ggatgggtgactttgggcaatg

SEQ ID NO: 9231102 - DNA, 22 bp, Homo sapiens
ggatgtgaatctgggctgagac

SEQ ID NO: 9231103 - DNA, 18 bp, Homo sapiens
ggatgtgattttggtttt

SEQ ID NO: 9231104 - DNA, 22 bp, Homo sapiens
ggatgttctggggttctcttgt

SEQ ID NO: 9231105 - DNA, 22 bp, Homo sapiens
ggatgtgaatctgggctgagac

SEQ ID NO: 9231106 - DNA, 22 bp, Homo sapiens
cacagcttatgccactgattgg

SEQ ID NO: 9231107 - DNA, 22 bp, Homo sapiens
cacagcttagaaaagaagccat

SEQ ID NO: 9231108 - DNA, 22 bp, Homo sapiens
cacagcttcagtttctgacttg

SEQ ID NO: 9231109 - DNA, 22 bp, Homo sapiens
cacagcttatgccactgattgg

SEQ ID NO: 9231110 - DNA, 22 bp, Homo sapiens
cacagcttccattagaatgaga

SEQ ID NO: 9231111 - DNA, 22 bp, Homo sapiens
cacagcttccattagaatgaga

SEQ ID NO: 9231112 - DNA, 22 bp, Homo sapiens
cacagcttcccaaagtggacct

SEQ ID NO: 9231113 - DNA, 22 bp, Homo sapiens
cacagcttcccgtgcatggaga

SEQ ID NO: 9231114 - DNA, 22 bp, Homo sapiens
cacagctgtcagctgacctagg

SEQ ID NO: 9231115 - DNA, 22 bp, Homo sapiens
cacagctgtatccaggagatcc

SEQ ID NO: 9231116 - DNA, 22 bp, Homo sapiens
cacagctggtgcactagctctg

SEQ ID NO: 9231117 - DNA, 22 bp, Homo sapiens
cacagctggtgacagagcccag

SEQ ID NO: 9231118 - DNA, 22 bp, Homo sapiens
cacagctgaagtagccatgtgg

SEQ ID NO: 9231119 - DNA, 22 bp, Homo sapiens
cacactgtcaggtaaataacac

SEQ ID NO: 9231120 - DNA, 22 bp, Homo sapiens
cacactgtccccttctccccag

SEQ ID NO: 9231121 - DNA, 22 bp, Homo sapiens
cacactgtcaggtaaataacac

SEQ ID NO: 9231122 - DNA, 22 bp, Homo sapiens
cacactgactggaatcaaggat

SEQ ID NO: 9231123 - DNA, 22 bp, Homo sapiens
cacactcattagtcatttctct

SEQ ID NO: 9231124 - DNA, 22 bp, Homo sapiens
cacactgtcaggtaaataacac

SEQ ID NO: 9231125 - DNA, 22 bp, Homo sapiens
ggaggccaaggcaggtggatca

SEQ ID NO: 9231126 - DNA, 22 bp, Homo sapiens
cacagcttgtttagtgactcac

SEQ ID NO: 9231127 - DNA, 22 bp, Homo sapiens
cacagcttgggctctgacaata

SEQ ID NO: 9231128 - DNA, 22 bp, Homo sapiens
ggaggccaaggcaggtggatcg

SEQ ID NO: 9231129 - DNA, 20 bp, Homo sapiens
cacagcttgccttttatgac

SEQ ID NO: 9231130 - DNA, 20 bp, Homo sapiens
cacagcttgccttttatgac

SEQ ID NO: 9231131 - DNA, 22 bp, Homo sapiens
cacagcttgggctctgacaata

SEQ ID NO: 9231132 - DNA, 22 bp, Homo sapiens
cacagcttcttccattccactc

SEQ ID NO: 9231133 - DNA, 22 bp, Homo sapiens
cacagcttctgtctgacccatg

SEQ ID NO: 9231134 - DNA, 22 bp, Homo sapiens
cacagcttctgagtgaggattt

SEQ ID NO: 9231135 - DNA, 22 bp, Homo sapiens
cacagcttctgagtgaggattt

SEQ ID NO: 9231136 - DNA, 22 bp, Homo sapiens
cacagcttctccttgatatcgc

SEQ ID NO: 9231137 - DNA, 22 bp, Homo sapiens
cacagcttctccccgctgcggc

SEQ ID NO: 9231138 - DNA, 22 bp, Homo sapiens
ggaggcggaggctgcagtgagc

SEQ ID NO: 9231139 - DNA, 22 bp, Homo sapiens
ggaggcggagcttgcagtgagc

SEQ ID NO: 9231140 - DNA, 22 bp, Homo sapiens
ggaggcggacacaggtagtgtt

SEQ ID NO: 9231141 - DNA, 22 bp, Homo sapiens
ggaggcggaagttgcagtgagc

SEQ ID NO: 9231142 - DNA, 22 bp, Homo sapiens
ggcagctgattagcatcaagga

SEQ ID NO: 9231143 - DNA, 22 bp, Homo sapiens
ggcagctgagcatggctacctt

SEQ ID NO: 9231144 - DNA, 22 bp, Homo sapiens
ggcagctgagcatggctacctt

SEQ ID NO: 9231145 - DNA, 22 bp, Homo sapiens
ggcagctgagcatggctacctt

SEQ ID NO: 9231146 - DNA, 22 bp, Homo sapiens
caccaggctggagtgcagtggc

SEQ ID NO: 9231147 - DNA, 22 bp, Homo sapiens
caccaggttccgggcagagctg

SEQ ID NO: 9231148 - DNA, 22 bp, Homo sapiens
caccaggttccgggcagagctg

SEQ ID NO: 9231149 - DNA, 22 bp, Homo sapiens
caccaggctggagtgcagaggt

SEQ ID NO: 9231150 - DNA, 22 bp, Homo sapiens
caccaggctggagtgcagtggc

SEQ ID NO: 9231151 - DNA, 20 bp, Homo sapiens
caccagtcatgagtcaatac

SEQ ID NO: 9231152 - DNA, 22 bp, Homo sapiens
ggcagctgacctagcaccatcc

SEQ ID NO: 9231153 - DNA, 19 bp, Homo sapiens
ggcagctcttgtcttctgc

SEQ ID NO: 9231154 - DNA, 22 bp, Homo sapiens
ggcagccagagggcagctggat

SEQ ID NO: 9231155 - DNA, 22 bp, Homo sapiens
ggcagccagagggcagctggat

SEQ ID NO: 9231156 - DNA, 21 bp, Homo sapiens
ggcagctgaccgcgcggtgca

SEQ ID NO: 9231157 - DNA, 22 bp, Homo sapiens
cacccagcacagagggaggcga

SEQ ID NO: 9231158 - DNA, 22 bp, Homo sapiens
ggcagtgtccttgcagctctac

SEQ ID NO: 9231159 - DNA, 22 bp, Homo sapiens
cacccagagggcttgctgaaca

SEQ ID NO: 9231160 - DNA, 22 bp, Homo sapiens
cacccagagcctgagagggata

SEQ ID NO: 9231161 - DNA, 20 bp, Homo sapiens
ggcagttaaggcacagtcat

SEQ ID NO: 9231162 - DNA, 20 bp, Homo sapiens
ggcagttaaggcacagtcat

SEQ ID NO: 9231163 - DNA, 22 bp, Homo sapiens
ggcagtgttccagaccttcacc

SEQ ID NO: 9231164 - DNA, 22 bp, Homo sapiens
cacccacatggaaattcacagt

SEQ ID NO: 9231165 - DNA, 22 bp, Homo sapiens
cacccacattccatcactctgc

SEQ ID NO: 9231166 - DNA, 22 bp, Homo sapiens
caccctcccgtcagcccctggg

SEQ ID NO: 9231167 - DNA, 22 bp, Homo sapiens
caccctcccgtcagcccctggg

SEQ ID NO: 9231168 - DNA, 20 bp, Homo sapiens
caccctcccagcacctatgc

SEQ ID NO: 9231169 - DNA, 22 bp, Homo sapiens
cactctgagaaacactaaacca

SEQ ID NO: 9231170 - DNA, 22 bp, Homo sapiens
cactctgagaagtacaagctcc

SEQ ID NO: 9231171 - DNA, 22 bp, Homo sapiens
caccctggctggaggtgcagtg

SEQ ID NO: 9231172 - DNA, 22 bp, Homo sapiens
caccctgctctgctgtgcggcc

SEQ ID NO: 9231173 - DNA, 22 bp, Homo sapiens
caccctgctctgctgtgcggcc

SEQ ID NO: 9231174 - DNA, 22 bp, Homo sapiens
caccctggaaagaaggtctggg

SEQ ID NO: 9231175 - DNA, 22 bp, Homo sapiens
caccctgcccactagcaatctg

SEQ ID NO: 9231176 - DNA, 22 bp, Homo sapiens
cacccaggttggagtgcagtgg

SEQ ID NO: 9231177 - DNA, 22 bp, Homo sapiens
cacccaggctggaatgcaatgg

SEQ ID NO: 9231178 - DNA, 22 bp, Homo sapiens
ggcatagatttctttaggttta

SEQ ID NO: 9231179 - DNA, 22 bp, Homo sapiens
cacccaggttggagtgcagtgg

SEQ ID NO: 9231180 - DNA, 22 bp, Homo sapiens
cacccaggttggagtgcagtgg

SEQ ID NO: 9231181 - DNA, 22 bp, Homo sapiens
cacccattaaccaaagagtgaa

SEQ ID NO: 9231182 - DNA, 22 bp, Homo sapiens
cacccagtaagcatgaggccct

SEQ ID NO: 9231183 - DNA, 22 bp, Homo sapiens
cacccatgtttccctctgtctt

SEQ ID NO: 9231184 - DNA, 22 bp, Homo sapiens
caccccagcttctcaggataga

SEQ ID NO: 9231185 - DNA, 22 bp, Homo sapiens
ggctagggagacagagggcatg

SEQ ID NO: 9231186 - DNA, 22 bp, Homo sapiens
ggctagggagacagagggcatg

SEQ ID NO: 9231187 - DNA, 22 bp, Homo sapiens
cactgcccactccttcgtccaa

SEQ ID NO: 9231188 - DNA, 22 bp, Homo sapiens
cactgcccaccaagtggctggt

SEQ ID NO: 9231189 - DNA, 22 bp, Homo sapiens
cactgccatgttgatagatgtg

SEQ ID NO: 9231190 - DNA, 22 bp, Homo sapiens
cactgcagttccccagtgcgca

SEQ ID NO: 9231191 - DNA, 22 bp, Homo sapiens
cactgcagtaactctaggactg

SEQ ID NO: 9231192 - DNA, 22 bp, Homo sapiens
ggctagggatctagaccaggac

SEQ ID NO: 9231193 - DNA, 22 bp, Homo sapiens
ggctcaagcagtctgcctgcct

SEQ ID NO: 9231194 - DNA, 22 bp, Homo sapiens
ggctcaatgcaacttctgcctc

SEQ ID NO: 9231195 - DNA, 22 bp, Homo sapiens
ggctatggaaatggcaggacat

SEQ ID NO: 9231196 - DNA, 22 bp, Homo sapiens
ggctatggaagataaggctgaa

SEQ ID NO: 9231197 - DNA, 22 bp, Homo sapiens
ggctatggcaaagaactcagat

SEQ ID NO: 9231198 - DNA, 22 bp, Homo sapiens
cactgctttaaggctgagtaac

SEQ ID NO: 9231199 - DNA, 22 bp, Homo sapiens
cactgcctggaaggagagacat

SEQ ID NO: 9231200 - DNA, 21 bp, Homo sapiens
cactggaattttctgtgacat

SEQ ID NO: 9231201 - DNA, 22 bp, Homo sapiens
cactggaggtcagtggagcact

SEQ ID NO: 9231202 - DNA, 22 bp, Homo sapiens
cactggatttccaggaatactc

SEQ ID NO: 9231203 - DNA, 22 bp, Homo sapiens
ggcctctcatgtcctgggcttc

SEQ ID NO: 9231204 - DNA, 22 bp, Homo sapiens
ggcctctcatgcccagagccaa

SEQ ID NO: 9231205 - DNA, 22 bp, Homo sapiens
ggcctcggcccactgctgcggt

SEQ ID NO: 9231206 - DNA, 22 bp, Homo sapiens
ggcctcgcggcttctggtggct

SEQ ID NO: 9231207 - DNA, 22 bp, Homo sapiens
ggcctcgcggcttctggtggct

SEQ ID NO: 9231208 - DNA, 22 bp, Homo sapiens
ggcctcgcggcttctggtggct

SEQ ID NO: 9231209 - DNA, 22 bp, Homo sapiens
ggcctcgcggcttctggtggct

SEQ ID NO: 9231210 - DNA, 22 bp, Homo sapiens
ggcctctcatgtcctgggcttc

SEQ ID NO: 9231211 - DNA, 22 bp, Homo sapiens
cactgcactccagcttgggtga

SEQ ID NO: 9231212 - DNA, 22 bp, Homo sapiens
cactgcactccagcttgggtga

SEQ ID NO: 9231213 - DNA, 23 bp, Homo sapiens
cactgcagcgtggtctggcagga

SEQ ID NO: 9231214 - DNA, 23 bp, Homo sapiens
cactgcagcgtggtctggcagga

SEQ ID NO: 9231215 - DNA, 22 bp, Homo sapiens
cactgcagcctcgctctcctga

SEQ ID NO: 9231216 - DNA, 21 bp, Homo sapiens
cactgcagccttgacctgggc

SEQ ID NO: 9231217 - DNA, 23 bp, Homo sapiens
cactgcagcgtggtctggcagga

SEQ ID NO: 9231218 - DNA, 22 bp, Homo sapiens
cactgcaggtctgagatggggg

SEQ ID NO: 9231219 - DNA, 22 bp, Homo sapiens
cactgcagcctcaaattcctgg

SEQ ID NO: 9231220 - DNA, 22 bp, Homo sapiens
cactgcagcaccatgcagggct

SEQ ID NO: 9231221 - DNA, 22 bp, Homo sapiens
cactgcagatcagaggctgaga

SEQ ID NO: 9231222 - DNA, 22 bp, Homo sapiens
cactgcactccatcctgggaaa

SEQ ID NO: 9231223 - DNA, 22 bp, Homo sapiens
cactgaccatggccaattggca

SEQ ID NO: 9231224 - DNA, 22 bp, Homo sapiens
cactgactccaaaaataaagaa

SEQ ID NO: 9231225 - DNA, 22 bp, Homo sapiens
cactgagagatgtgtcacagca

SEQ ID NO: 9231226 - DNA, 22 bp, Homo sapiens
cactgaggctgggggagaaggt

SEQ ID NO: 9231227 - DNA, 23 bp, Homo sapiens
ggcctcctggtctaggctagact

SEQ ID NO: 9231228 - DNA, 22 bp, Homo sapiens
gcttggctgtgagctttgctgt

SEQ ID NO: 9231229 - DNA, 22 bp, Homo sapiens
gcttgggatatgctgatgtaaa

SEQ ID NO: 9231230 - DNA, 22 bp, Homo sapiens
caatttctcgaactctaatcca

SEQ ID NO: 9231231 - DNA, 22 bp, Homo sapiens
caatttctctttatatctcaca

SEQ ID NO: 9231232 - DNA, 22 bp, Homo sapiens
gcttggccagcagccgggatgc

SEQ ID NO: 9231233 - DNA, 22 bp, Homo sapiens
gcttggccctgccgcctgggtc

SEQ ID NO: 9231234 - DNA, 22 bp, Homo sapiens
gcttggcatttgctgggagctg

SEQ ID NO: 9231235 - DNA, 22 bp, Homo sapiens
gcttccaggggctgtgggctga

SEQ ID NO: 9231236 - DNA, 20 bp, Homo sapiens
gcttctcagggcttctctga

SEQ ID NO: 9231237 - DNA, 22 bp, Homo sapiens
gcttctcatgtttatttttaca

SEQ ID NO: 9231238 - DNA, 22 bp, Homo sapiens
gctgtggcctccagcactcccc

SEQ ID NO: 9231239 - DNA, 22 bp, Homo sapiens
gcttctccagaccttcatcccc

SEQ ID NO: 9231240 - DNA, 22 bp, Homo sapiens
gcttctcctcccgctcccaggc

SEQ ID NO: 9231241 - DNA, 22 bp, Homo sapiens
gcttctcctcccgctcccaggc

SEQ ID NO: 9231242 - DNA, 22 bp, Homo sapiens
gcttctctcaggagcatcagcc

SEQ ID NO: 9231243 - DNA, 22 bp, Homo sapiens
gcttctctggctggtctgccac

SEQ ID NO: 9231244 - DNA, 22 bp, Homo sapiens
gctgtctgccgcaggctgccac

SEQ ID NO: 9231245 - DNA, 22 bp, Homo sapiens
gctgtctgcatctctagagctt

SEQ ID NO: 9231246 - DNA, 22 bp, Homo sapiens
gctgtgctgattcattccctgc

SEQ ID NO: 9231247 - DNA, 22 bp, Homo sapiens
gctgtggccaacaaaccacttt

SEQ ID NO: 9231248 - DNA, 22 bp, Homo sapiens
gctgtggagtacagagctggtt

SEQ ID NO: 9231249 - DNA, 22 bp, Homo sapiens
gctgtggagtacagagctggtt

SEQ ID NO: 9231250 - DNA, 20 bp, Homo sapiens
gctgtggcaaagctttgtgt

SEQ ID NO: 9231251 - DNA, 22 bp, Homo sapiens
gctgtctgcatctctagagctt

SEQ ID NO: 9231252 - DNA, 22 bp, Homo sapiens
gctgtctgagaacatggtggaa

SEQ ID NO: 9231253 - DNA, 20 bp, Homo sapiens
gctgtctgacagttcccaga

SEQ ID NO: 9231254 - DNA, 22 bp, Homo sapiens
gctgtctgagaacatggtggaa

SEQ ID NO: 9231255 - DNA, 22 bp, Homo sapiens
caaggaggcagtgggacttgaa

SEQ ID NO: 9231256 - DNA, 22 bp, Homo sapiens
caaggattctcactagactaga

SEQ ID NO: 9231257 - DNA, 20 bp, Homo sapiens
caaggcagaccagagtgagt

SEQ ID NO: 9231258 - DNA, 22 bp, Homo sapiens
caaggcagaattcagactcagg

SEQ ID NO: 9231259 - DNA, 22 bp, Homo sapiens
gctgtctcatgggtgctagtcc

SEQ ID NO: 9231260 - DNA, 22 bp, Homo sapiens
gctgtctccatagctgtgtgtc

SEQ ID NO: 9231261 - DNA, 22 bp, Homo sapiens
gctgtacaaattccacaagaga

SEQ ID NO: 9231262 - DNA, 22 bp, Homo sapiens
cacaagggagcttagaaaacat

SEQ ID NO: 9231263 - DNA, 19 bp, Homo sapiens
cacaacttcgcttgattcc

SEQ ID NO: 9231264 - DNA, 21 bp, Homo sapiens
ggaaaattcagagtgcaattt

SEQ ID NO: 9231265 - DNA, 22 bp, Homo sapiens
ggaaaaggccacagggacacat

SEQ ID NO: 9231266 - DNA, 22 bp, Homo sapiens
ggaaaagacaggttaactgtga

SEQ ID NO: 9231267 - DNA, 22 bp, Homo sapiens
ggaaaagacagaattctagaat

SEQ ID NO: 9231268 - DNA, 22 bp, Homo sapiens
cacaataaatgtttgctgatga

SEQ ID NO: 9231269 - DNA, 22 bp, Homo sapiens
cacaatcataatgtatgtacat

SEQ ID NO: 9231270 - DNA, 22 bp, Homo sapiens
cacaatgcagcatgtaaatgca

SEQ ID NO: 9231271 - DNA, 22 bp, Homo sapiens
cacaatgtctggtaggccactt

SEQ ID NO: 9231272 - DNA, 22 bp, Homo sapiens
cacaatgcagcatgtaaatgca

SEQ ID NO: 9231273 - DNA, 22 bp, Homo sapiens
cacaatgcgtacatatatcaaa

SEQ ID NO: 9231274 - DNA, 22 bp, Homo sapiens
cacaaagtgggtggaaaactaa

SEQ ID NO: 9231275 - DNA, 22 bp, Homo sapiens
ggaaaactgtatttgaataact

SEQ ID NO: 9231276 - DNA, 17 bp, Homo sapiens
ggaaaagaagagtagga

SEQ ID NO: 9231277 - DNA, 22 bp, Homo sapiens
ggaaaagaattgcagtgaagta

SEQ ID NO: 9231278 - DNA, 22 bp, Homo sapiens
ggaaaagaaagggactgattgg

SEQ ID NO: 9231279 - DNA, 17 bp, Homo sapiens
ggaaaagaagagtagga

SEQ ID NO: 9231280 - DNA, 22 bp, Homo sapiens
cacaaacatcaatcctgttttc

SEQ ID NO: 9231281 - DNA, 22 bp, Homo sapiens
cacaaacatcaatcctgttttc

SEQ ID NO: 9231282 - DNA, 23 bp, Homo sapiens
cacaaaggttccattctctcacc

SEQ ID NO: 9231283 - DNA, 22 bp, Homo sapiens
cacaaaatctttctcgattatt

SEQ ID NO: 9231284 - DNA, 21 bp, Homo sapiens
cacaccaggcatgtcttgagc

SEQ ID NO: 9231285 - DNA, 23 bp, Homo sapiens
cacaccaggagccgtctgggcca

SEQ ID NO: 9231286 - DNA, 22 bp, Homo sapiens
cacaccagaggttacctgcaaa

SEQ ID NO: 9231287 - DNA, 21 bp, Homo sapiens
cacaccaaacaggaacaggga

SEQ ID NO: 9231288 - DNA, 22 bp, Homo sapiens
cacacattccaaaatcaagggt

SEQ ID NO: 9231289 - DNA, 21 bp, Homo sapiens
cacaccaaacaggaacaggga

SEQ ID NO: 9231290 - DNA, 22 bp, Homo sapiens
cacacatttcagatgctacaat

SEQ ID NO: 9231291 - DNA, 22 bp, Homo sapiens
cacacatttcagatgctacaat

SEQ ID NO: 9231292 - DNA, 22 bp, Homo sapiens
cacacccaaatttctctctcag

SEQ ID NO: 9231293 - DNA, 21 bp, Homo sapiens
cacaccaggcatgtcttgagc

SEQ ID NO: 9231294 - DNA, 19 bp, Homo sapiens
cacacccatgcttgccaag

SEQ ID NO: 9231295 - DNA, 22 bp, Homo sapiens
cacacctgtaataccagctact

SEQ ID NO: 9231296 - DNA, 22 bp, Homo sapiens
cacacattagagccaatgtcag

SEQ ID NO: 9231297 - DNA, 22 bp, Homo sapiens
cacacatcaacctagacattgt

SEQ ID NO: 9231298 - DNA, 22 bp, Homo sapiens
cacacattaatatcaaaggctc

SEQ ID NO: 9231299 - DNA, 22 bp, Homo sapiens
cacaatttgttttatcagtatt

SEQ ID NO: 9231300 - DNA, 22 bp, Homo sapiens
cacaatttcagttgcatgcaac

SEQ ID NO: 9231301 - DNA, 22 bp, Homo sapiens
cacaatttccaagtcatgttat

SEQ ID NO: 9231302 - DNA, 22 bp, Homo sapiens
gctgcagccaaattcattgtca

SEQ ID NO: 9231303 - DNA, 22 bp, Homo sapiens
gctgcagcagaagttctcagag

SEQ ID NO: 9231304 - DNA, 22 bp, Homo sapiens
gctgcagatcccacccattccc

SEQ ID NO: 9231305 - DNA, 19 bp, Homo sapiens
gctgcagagtattcttggg

SEQ ID NO: 9231306 - DNA, 22 bp, Homo sapiens
gctgcagagggaggggctcgca

SEQ ID NO: 9231307 - DNA, 19 bp, Homo sapiens
gctcctggatgacctgtgg

SEQ ID NO: 9231308 - DNA, 19 bp, Homo sapiens
gctcctggatgacctgtgg

SEQ ID NO: 9231309 - DNA, 20 bp, Homo sapiens
gctgaggtggaggaaggaga

SEQ ID NO: 9231310 - DNA, 20 bp, Homo sapiens
gctgaggtggaggaaggaga

SEQ ID NO: 9231311 - DNA, 22 bp, Homo sapiens
gctgaggtggaggaaggagacc

SEQ ID NO: 9231312 - DNA, 22 bp, Homo sapiens
gctgaggtggaggaaggagacc

SEQ ID NO: 9231313 - DNA, 22 bp, Homo sapiens
gctgcagacttctcatctcatt

SEQ ID NO: 9231314 - DNA, 22 bp, Homo sapiens
gctgcagagacagctgccgatg

SEQ ID NO: 9231315 - DNA, 22 bp, Homo sapiens
gctcctggagagattgagaaag

SEQ ID NO: 9231316 - DNA, 22 bp, Homo sapiens
gctcctggagagattgagaaag

SEQ ID NO: 9231317 - DNA, 18 bp, Homo sapiens
gctcctggaccaggtcac

SEQ ID NO: 9231318 - DNA, 18 bp, Homo sapiens
gctcctggagtctgactc

SEQ ID NO: 9231319 - DNA, 22 bp, Homo sapiens
caaagtatattggattgaatgg

SEQ ID NO: 9231320 - DNA, 22 bp, Homo sapiens
caaagtaatttggagatatata

SEQ ID NO: 9231321 - DNA, 22 bp, Homo sapiens
caaagtatatttcatagtctca

SEQ ID NO: 9231322 - DNA, 22 bp, Homo sapiens
caaaggttggaaatgtttacca

SEQ ID NO: 9231323 - DNA, 22 bp, Homo sapiens
caaaggttatgaaccacttgta

SEQ ID NO: 9231324 - DNA, 22 bp, Homo sapiens
caaaggttgttgagagtgcagg

SEQ ID NO: 9231325 - DNA, 22 bp, Homo sapiens
caaaggtttcacagtagcccat

SEQ ID NO: 9231326 - DNA, 22 bp, Homo sapiens
gctgccacattttcaggactaa

SEQ ID NO: 9231327 - DNA, 21 bp, Homo sapiens
gctgccaccgcgtgctccagg

SEQ ID NO: 9231328 - DNA, 22 bp, Homo sapiens
gctgccaccgtggagatgagtg

SEQ ID NO: 9231329 - DNA, 22 bp, Homo sapiens
gctgccaatccagctgtgggag

SEQ ID NO: 9231330 - DNA, 22 bp, Homo sapiens
gctgcatggagggtgcccagga

SEQ ID NO: 9231331 - DNA, 19 bp, Homo sapiens
caacagtactggtttgtcc

SEQ ID NO: 9231332 - DNA, 22 bp, Homo sapiens
gctgccaccgtggagatgagtg

SEQ ID NO: 9231333 - DNA, 22 bp, Homo sapiens
caacactgacaatggactgatt

SEQ ID NO: 9231334 - DNA, 22 bp, Homo sapiens
gctgcagtgagccaagatcgtg

SEQ ID NO: 9231335 - DNA, 22 bp, Homo sapiens
gctgcagtgagccaagatcgtg

SEQ ID NO: 9231336 - DNA, 22 bp, Homo sapiens
gctgcatgacagacaggcctgg

SEQ ID NO: 9231337 - DNA, 22 bp, Homo sapiens
gctgcagtgagccaagatcgtg

SEQ ID NO: 9231338 - DNA, 22 bp, Homo sapiens
gctgcaggtttgtctagtctgg

SEQ ID NO: 9231339 - DNA, 22 bp, Homo sapiens
gctgcaggtttgtctagtctgg

SEQ ID NO: 9231340 - DNA, 17 bp, Homo sapiens
gctgcagcggtaggcag

SEQ ID NO: 9231341 - DNA, 22 bp, Homo sapiens
caacatataatatttgagttct

SEQ ID NO: 9231342 - DNA, 22 bp, Homo sapiens
caacatataatatttgagttct

SEQ ID NO: 9231343 - DNA, 22 bp, Homo sapiens
caacatatgattttgtatataa

SEQ ID NO: 9231344 - DNA, 22 bp, Homo sapiens
caacattcaaccaacatttatg

SEQ ID NO: 9231345 - DNA, 22 bp, Homo sapiens
gctgccttttgctcctcccacc

SEQ ID NO: 9231346 - DNA, 22 bp, Homo sapiens
gctgctggcactggagtgagcc

SEQ ID NO: 9231347 - DNA, 22 bp, Homo sapiens
caagagctcaccggagagcatt

SEQ ID NO: 9231348 - DNA, 22 bp, Homo sapiens
caagagctcaccggagagcatt

SEQ ID NO: 9231349 - DNA, 22 bp, Homo sapiens
caagagctgaggctggagaggt

SEQ ID NO: 9231350 - DNA, 22 bp, Homo sapiens
caagagctgcaaatagcgtgac

SEQ ID NO: 9231351 - DNA, 22 bp, Homo sapiens
caagagctgaggctggagaggt

SEQ ID NO: 9231352 - DNA, 22 bp, Homo sapiens
caagacaagatctaagcatgct

SEQ ID NO: 9231353 - DNA, 22 bp, Homo sapiens
gctgctggccccacatgctcca

SEQ ID NO: 9231354 - DNA, 22 bp, Homo sapiens
caagacaagatctaagcatgct

SEQ ID NO: 9231355 - DNA, 22 bp, Homo sapiens
gctgccttcccaggcctttgct

SEQ ID NO: 9231356 - DNA, 22 bp, Homo sapiens
gctgccttccaaagagttttat

SEQ ID NO: 9231357 - DNA, 22 bp, Homo sapiens
gctgcctgccttgcctggagga

SEQ ID NO: 9231358 - DNA, 22 bp, Homo sapiens
gctgcctgccttgcctggagga

SEQ ID NO: 9231359 - DNA, 22 bp, Homo sapiens
caactacaggaaaagtcattca

SEQ ID NO: 9231360 - DNA, 22 bp, Homo sapiens
caacctcatagaaagaaaatgt

SEQ ID NO: 9231361 - DNA, 22 bp, Homo sapiens
gctgccttcccggaatgtcatc

SEQ ID NO: 9231362 - DNA, 22 bp, Homo sapiens
gctgccttcccaggcctttgct

SEQ ID NO: 9231363 - DNA, 20 bp, Homo sapiens
gctgccttgtcctgcttggt

SEQ ID NO: 9231364 - DNA, 20 bp, Homo sapiens
gctgccttgtcctgcttggt

SEQ ID NO: 9231365 - DNA, 22 bp, Homo sapiens
caagatgcccctggtagggatc

SEQ ID NO: 9231366 - DNA, 22 bp, Homo sapiens
caagatggagaagcagcaaggg

SEQ ID NO: 9231367 - DNA, 22 bp, Homo sapiens
caaggacactgagctttgtaaa

SEQ ID NO: 9231368 - DNA, 22 bp, Homo sapiens
caaggacactccctgctgggca

SEQ ID NO: 9231369 - DNA, 22 bp, Homo sapiens
caaggaatcccatttctaactc

SEQ ID NO: 9231370 - DNA, 22 bp, Homo sapiens
caaggaatatttaagaacgtca

SEQ ID NO: 9231371 - DNA, 22 bp, Homo sapiens
caaggaagttttaggagaggaa

SEQ ID NO: 9231372 - DNA, 22 bp, Homo sapiens
caaggagaaaacggcttctgaa

SEQ ID NO: 9231373 - DNA, 22 bp, Homo sapiens
caaggagataaaatgttgagct

SEQ ID NO: 9231374 - DNA, 22 bp, Homo sapiens
caaggaggaagatgcaggggac

SEQ ID NO: 9231375 - DNA, 22 bp, Homo sapiens
caaggaggaagatgcaggggac

SEQ ID NO: 9231376 - DNA, 22 bp, Homo sapiens
caaggaggcagtgggacttgaa

SEQ ID NO: 9231377 - DNA, 22 bp, Homo sapiens
caagatgacaaggctggaggct

SEQ ID NO: 9231378 - DNA, 22 bp, Homo sapiens
caagatgatccctgaaggcagc

SEQ ID NO: 9231379 - DNA, 22 bp, Homo sapiens
caagatgaaactacagggagga

SEQ ID NO: 9231380 - DNA, 22 bp, Homo sapiens
caagataatttattctgagttt

SEQ ID NO: 9231381 - DNA, 22 bp, Homo sapiens
caagatattgatttccagctga

SEQ ID NO: 9231382 - DNA, 22 bp, Homo sapiens
caagaggcaaattgtctagaag

SEQ ID NO: 9231383 - DNA, 22 bp, Homo sapiens
caagagctttagaaatgctcat

SEQ ID NO: 9231384 - DNA, 18 bp, Homo sapiens
caagagctgctcctggcc

SEQ ID NO: 9231385 - DNA, 22 bp, Homo sapiens
caagagctggagaggcagtcta

SEQ ID NO: 9231386 - DNA, 22 bp, Homo sapiens
caagaggctaaactgggctatt

SEQ ID NO: 9231387 - DNA, 22 bp, Homo sapiens
caagagggaacctaagatgtat

SEQ ID NO: 9231388 - DNA, 22 bp, Homo sapiens
caagataaagccaccagaagct

SEQ ID NO: 9231389 - DNA, 22 bp, Homo sapiens
caagataagatcatttacacta

SEQ ID NO: 9231390 - DNA, 22 bp, Homo sapiens
caagataaaatcagcattccaa

SEQ ID NO: 9231391 - DNA, 23 bp, Homo sapiens
gggaagctccatggaggtgctgg

SEQ ID NO: 9231392 - DNA, 22 bp, Homo sapiens
gggaagctgaagctagagaaaa

SEQ ID NO: 9231393 - DNA, 22 bp, Homo sapiens
gggaagctgcgtggtctagggc

SEQ ID NO: 9231394 - DNA, 22 bp, Homo sapiens
gggaaggaaagttattagcaga

SEQ ID NO: 9231395 - DNA, 22 bp, Homo sapiens
gggaaggaaagttattagcaga

SEQ ID NO: 9231396 - DNA, 23 bp, Homo sapiens
gggaaaggatatgatcctagggg

SEQ ID NO: 9231397 - DNA, 22 bp, Homo sapiens
gggaaggacacagccatgactg

SEQ ID NO: 9231398 - DNA, 22 bp, Homo sapiens
gggaaggacacagccatgactg

SEQ ID NO: 9231399 - DNA, 22 bp, Homo sapiens
gggaaggacattctgggctcag

SEQ ID NO: 9231400 - DNA, 22 bp, Homo sapiens
gggaaggacacagccatgactg

SEQ ID NO: 9231401 - DNA, 22 bp, Homo sapiens
gggaaggaggtggacctgcccc

SEQ ID NO: 9231402 - DNA, 22 bp, Homo sapiens
gggaaggaggtggcttgaagtg

SEQ ID NO: 9231403 - DNA, 22 bp, Homo sapiens
gggaaggagcctgcttgctaga

SEQ ID NO: 9231404 - DNA, 22 bp, Homo sapiens
gggaaggagcctgcttgctaga

SEQ ID NO: 9231405 - DNA, 22 bp, Homo sapiens
gggaaggaggtggcttgaagtg

SEQ ID NO: 9231406 - DNA, 22 bp, Homo sapiens
gggaatgttgactgagagcagg

SEQ ID NO: 9231407 - DNA, 22 bp, Homo sapiens
gggactggaactactggtgcag

SEQ ID NO: 9231408 - DNA, 22 bp, Homo sapiens
gggactctgagagcctgagggt

SEQ ID NO: 9231409 - DNA, 19 bp, Homo sapiens
gggactggaggatgtggag

SEQ ID NO: 9231410 - DNA, 19 bp, Homo sapiens
gggactggaggatgtggag

SEQ ID NO: 9231411 - DNA, 22 bp, Homo sapiens
gggactggatagatgtgggtga

SEQ ID NO: 9231412 - DNA, 22 bp, Homo sapiens
gggactggagtagaggccggtg

SEQ ID NO: 9231413 - DNA, 22 bp, Homo sapiens
gggactggcacagggctgggag

SEQ ID NO: 9231414 - DNA, 22 bp, Homo sapiens
gggactggcacagggctgggag

SEQ ID NO: 9231415 - DNA, 22 bp, Homo sapiens
gggactgggagatcctcctggc

SEQ ID NO: 9231416 - DNA, 22 bp, Homo sapiens
gggacagaggcaaactagcaga

SEQ ID NO: 9231417 - DNA, 22 bp, Homo sapiens
gggacagaaggaagtgagcaca

SEQ ID NO: 9231418 - DNA, 22 bp, Homo sapiens
gggacagaaggaagtgagcaca

SEQ ID NO: 9231419 - DNA, 22 bp, Homo sapiens
cactggcttgatgggtaatgcc

SEQ ID NO: 9231420 - DNA, 22 bp, Homo sapiens
cactggctaaagataagctcaa

SEQ ID NO: 9231421 - DNA, 22 bp, Homo sapiens
cactggcccattcctgtctggc

SEQ ID NO: 9231422 - DNA, 22 bp, Homo sapiens
cagaaggctttgtggagtagac

SEQ ID NO: 9231423 - DNA, 22 bp, Homo sapiens
cagaaggcaaacaaaaggattt

SEQ ID NO: 9231424 - DNA, 22 bp, Homo sapiens
cagaaggcatagatgaaggcct

SEQ ID NO: 9231425 - DNA, 22 bp, Homo sapiens
cagaaggcaaggcctgccacgc

SEQ ID NO: 9231426 - DNA, 22 bp, Homo sapiens
cagaagtaagattactgtgaga

SEQ ID NO: 9231427 - DNA, 22 bp, Homo sapiens
cagaagtaagattactgtgagt

SEQ ID NO: 9231428 - DNA, 22 bp, Homo sapiens
cagaagtaagattactgtgaga

SEQ ID NO: 9231429 - DNA, 21 bp, Homo sapiens
cagaagtaagggtaacttctc

SEQ ID NO: 9231430 - DNA, 22 bp, Homo sapiens
cagaagtaagattactgtgagt

SEQ ID NO: 9231431 - DNA, 22 bp, Homo sapiens
gggaaactcacaggtgcagggg

SEQ ID NO: 9231432 - DNA, 22 bp, Homo sapiens
gggaaactagaagcagggttat

SEQ ID NO: 9231433 - DNA, 22 bp, Homo sapiens
gggaaactttcacaatgtccag

SEQ ID NO: 9231434 - DNA, 22 bp, Homo sapiens
gggaaactgtccagttctcccc

SEQ ID NO: 9231435 - DNA, 22 bp, Homo sapiens
gggaaacttctgctaaaaccag

SEQ ID NO: 9231436 - DNA, 22 bp, Homo sapiens
gggaaactgcaactcagagagg

SEQ ID NO: 9231437 - DNA, 22 bp, Homo sapiens
gggaaactggggactgaatctg

SEQ ID NO: 9231438 - DNA, 22 bp, Homo sapiens
gggaaactgaattcaggactct

SEQ ID NO: 9231439 - DNA, 21 bp, Homo sapiens
gggaaactctgcttaacagag

SEQ ID NO: 9231440 - DNA, 22 bp, Homo sapiens
gggaaactcaggcatttccact

SEQ ID NO: 9231441 - DNA, 22 bp, Homo sapiens
gggagcagcctgcctcccacct

SEQ ID NO: 9231442 - DNA, 22 bp, Homo sapiens
gggagcactgagaggcaggtag

SEQ ID NO: 9231443 - DNA, 19 bp, Homo sapiens
gggagcaggaaagctgtgg

SEQ ID NO: 9231444 - DNA, 22 bp, Homo sapiens
gggagcagcctgcctcccacct

SEQ ID NO: 9231445 - DNA, 22 bp, Homo sapiens
gggagcaggacataatagcaat

SEQ ID NO: 9231446 - DNA, 22 bp, Homo sapiens
gggagcaggagcctgcctgcca

SEQ ID NO: 9231447 - DNA, 22 bp, Homo sapiens
cagacaggcaggtgctgctttg

SEQ ID NO: 9231448 - DNA, 22 bp, Homo sapiens
cagacaggctagccagactcac

SEQ ID NO: 9231449 - DNA, 22 bp, Homo sapiens
cagacaggcaggtgctgctttg

SEQ ID NO: 9231450 - DNA, 22 bp, Homo sapiens
cagacaggcaggtgctgctttg

SEQ ID NO: 9231451 - DNA, 22 bp, Homo sapiens
cagacaggcaggtgagagctcc

SEQ ID NO: 9231452 - DNA, 22 bp, Homo sapiens
cagacaggcaggtgagagctcc

SEQ ID NO: 9231453 - DNA, 22 bp, Homo sapiens
cagacaggcaggtgagagctcc

SEQ ID NO: 9231454 - DNA, 22 bp, Homo sapiens
cagacaggaattctggcgtggt

SEQ ID NO: 9231455 - DNA, 22 bp, Homo sapiens
cagacaggaattctggcgtggt

SEQ ID NO: 9231456 - DNA, 22 bp, Homo sapiens
cagacaggagactggatcatgg

SEQ ID NO: 9231457 - DNA, 22 bp, Homo sapiens
cagacaggaattctggcgtggt

SEQ ID NO: 9231458 - DNA, 22 bp, Homo sapiens
cagaagtgaatgtgataaacca

SEQ ID NO: 9231459 - DNA, 22 bp, Homo sapiens
gggactggccagggtttggaat

SEQ ID NO: 9231460 - DNA, 22 bp, Homo sapiens
cagaagtgatgttgagctagtc

SEQ ID NO: 9231461 - DNA, 22 bp, Homo sapiens
cagaagtgcaatttaaattagg

SEQ ID NO: 9231462 - DNA, 22 bp, Homo sapiens
cagaagtggcatcattcaagag

SEQ ID NO: 9231463 - DNA, 22 bp, Homo sapiens
cagaagtggcctcagagggagt

SEQ ID NO: 9231464 - DNA, 22 bp, Homo sapiens
cagaagttatgtcaatggtcat

SEQ ID NO: 9231465 - DNA, 22 bp, Homo sapiens
cagaagttagtgtctgccagta

SEQ ID NO: 9231466 - DNA, 22 bp, Homo sapiens
cagaagttgccacatgaccctt

SEQ ID NO: 9231467 - DNA, 22 bp, Homo sapiens
cagaagtttgaatgagagcctg

SEQ ID NO: 9231468 - DNA, 22 bp, Homo sapiens
cagaagttttgctctcttgggt

SEQ ID NO: 9231469 - DNA, 22 bp, Homo sapiens
cagacaggaagttcagaagaaa

SEQ ID NO: 9231470 - DNA, 22 bp, Homo sapiens
cagacagaaggctccttgaggt

SEQ ID NO: 9231471 - DNA, 22 bp, Homo sapiens
cagacagaaggctccttgaggt

SEQ ID NO: 9231472 - DNA, 22 bp, Homo sapiens
cagacaggaattctggcgtggt

SEQ ID NO: 9231473 - DNA, 22 bp, Homo sapiens
gggcaaggcagaagagttggag

SEQ ID NO: 9231474 - DNA, 22 bp, Homo sapiens
gggcaaggcagaagagttggag

SEQ ID NO: 9231475 - DNA, 22 bp, Homo sapiens
gggcaagctcttcagaagctct

SEQ ID NO: 9231476 - DNA, 18 bp, Homo sapiens
gggcaagcggctgtcacc

SEQ ID NO: 9231477 - DNA, 22 bp, Homo sapiens
gggcaattcacagggttgttat

SEQ ID NO: 9231478 - DNA, 22 bp, Homo sapiens
gggcaattaaggtcccgtttcc

SEQ ID NO: 9231479 - DNA, 22 bp, Homo sapiens
cagacagggccctgtgatggta

SEQ ID NO: 9231480 - DNA, 22 bp, Homo sapiens
cagacagggccctgtgatggta

SEQ ID NO: 9231481 - DNA, 22 bp, Homo sapiens
cagacagggccctgtgatggta

SEQ ID NO: 9231482 - DNA, 22 bp, Homo sapiens
cagacaggggtaaccttcctca

SEQ ID NO: 9231483 - DNA, 22 bp, Homo sapiens
cagacagggacctcgctccaga

SEQ ID NO: 9231484 - DNA, 22 bp, Homo sapiens
cagacagggccctgtgatggta

SEQ ID NO: 9231485 - DNA, 22 bp, Homo sapiens
cagacagggacctcgctccaga

SEQ ID NO: 9231486 - DNA, 17 bp, Homo sapiens
cagacaggctgtcaccc

SEQ ID NO: 9231487 - DNA, 17 bp, Homo sapiens
cagacaggctgtcaccc

SEQ ID NO: 9231488 - DNA, 17 bp, Homo sapiens
cagacaggctgtcaccc

SEQ ID NO: 9231489 - DNA, 17 bp, Homo sapiens
cagacaggctgtcaccc

SEQ ID NO: 9231490 - DNA, 22 bp, Homo sapiens
cagacaggctagccagactcac

SEQ ID NO: 9231491 - DNA, 22 bp, Homo sapiens
gggaggtgaaaggtcatgtgtg

SEQ ID NO: 9231492 - DNA, 22 bp, Homo sapiens
gggaggtcagggtgcctgctgg

SEQ ID NO: 9231493 - DNA, 22 bp, Homo sapiens
gggagggtctgagagctgcacc

SEQ ID NO: 9231494 - DNA, 22 bp, Homo sapiens
gggagggtgttctcccaagaac

SEQ ID NO: 9231495 - DNA, 22 bp, Homo sapiens
gggaggggttgcatgtttgagt

SEQ ID NO: 9231496 - DNA, 22 bp, Homo sapiens
gggaggggttgcatgtttgagt

SEQ ID NO: 9231497 - DNA, 22 bp, Homo sapiens
gggagggcttggacccagatgt

SEQ ID NO: 9231498 - DNA, 22 bp, Homo sapiens
gggagggccagtgctctctaga

SEQ ID NO: 9231499 - DNA, 22 bp, Homo sapiens
gggagcaggagcctgcctgcca

SEQ ID NO: 9231500 - DNA, 20 bp, Homo sapiens
gggaggccagcctcagagaa

SEQ ID NO: 9231501 - DNA, 22 bp, Homo sapiens
gggagggccaggctcacccagg

SEQ ID NO: 9231502 - DNA, 19 bp, Homo sapiens
cagaggccagaagcacagg

SEQ ID NO: 9231503 - DNA, 22 bp, Homo sapiens
cagaggccagggggctcacaaa

SEQ ID NO: 9231504 - DNA, 22 bp, Homo sapiens
cagaggccatatttcttcactc

SEQ ID NO: 9231505 - DNA, 22 bp, Homo sapiens
cagaggccatatttcttcactc

SEQ ID NO: 9231506 - DNA, 22 bp, Homo sapiens
cagaggcccagtgagagggctg

SEQ ID NO: 9231507 - DNA, 21 bp, Homo sapiens
cagaggcctatcacagactcc

SEQ ID NO: 9231508 - DNA, 21 bp, Homo sapiens
cagaggcctatcacagactcc

SEQ ID NO: 9231509 - DNA, 22 bp, Homo sapiens
cagaggccccagaactagctct

SEQ ID NO: 9231510 - DNA, 22 bp, Homo sapiens
cagaggcccagtgagagggctg

SEQ ID NO: 9231511 - DNA, 22 bp, Homo sapiens
cagaggccccagaactagctct

SEQ ID NO: 9231512 - DNA, 22 bp, Homo sapiens
cagaggcctcacttccagccag

SEQ ID NO: 9231513 - DNA, 22 bp, Homo sapiens
cagaggcctcacttccagccag

SEQ ID NO: 9231514 - DNA, 22 bp, Homo sapiens
cagaggcctcacttccagccag

SEQ ID NO: 9231515 - DNA, 22 bp, Homo sapiens
cagaggcctatccagtgtccat

SEQ ID NO: 9231516 - DNA, 21 bp, Homo sapiens
cagaggcctcatgctctgtgc

SEQ ID NO: 9231517 - DNA, 22 bp, Homo sapiens
ggggaagaaatctgggttcttc

SEQ ID NO: 9231518 - DNA, 22 bp, Homo sapiens
ggggaagaaccgggattcccat

SEQ ID NO: 9231519 - DNA, 22 bp, Homo sapiens
ggggaagaatgctctctagaga

SEQ ID NO: 9231520 - DNA, 22 bp, Homo sapiens
ggggaagaatgctctctagaga

SEQ ID NO: 9231521 - DNA, 20 bp, Homo sapiens
ggggaagaaaaggatgtgat

SEQ ID NO: 9231522 - DNA, 20 bp, Homo sapiens
ggggaagaaaaggatgtgat

SEQ ID NO: 9231523 - DNA, 22 bp, Homo sapiens
cagagctggtgtgtcctggcat

SEQ ID NO: 9231524 - DNA, 22 bp, Homo sapiens
cagagctggtgtgtcctggcat

SEQ ID NO: 9231525 - DNA, 22 bp, Homo sapiens
cagagctggtgtgtcctggcat

SEQ ID NO: 9231526 - DNA, 22 bp, Homo sapiens
cagagctggtgtgtcctggcat

SEQ ID NO: 9231527 - DNA, 22 bp, Homo sapiens
cagagctggtgtgtcctggcat

SEQ ID NO: 9231528 - DNA, 22 bp, Homo sapiens
cagagctggtaagtggtagagg

SEQ ID NO: 9231529 - DNA, 20 bp, Homo sapiens
cagaggcattttcagactct

SEQ ID NO: 9231530 - DNA, 21 bp, Homo sapiens
cagaggcaggctctgtgtgtg

SEQ ID NO: 9231531 - DNA, 22 bp, Homo sapiens
cagaggccacctgtggccactg

SEQ ID NO: 9231532 - DNA, 22 bp, Homo sapiens
cagagctggtgttacaagtcca

SEQ ID NO: 9231533 - DNA, 22 bp, Homo sapiens
cagagctggtgttacaagtcca

SEQ ID NO: 9231534 - DNA, 22 bp, Homo sapiens
cagagctggtgtgtcctggcat

SEQ ID NO: 9231535 - DNA, 22 bp, Homo sapiens
cagagctgtcatttgccagtga

SEQ ID NO: 9231536 - DNA, 22 bp, Homo sapiens
gggtgccacagagcttccactt

SEQ ID NO: 9231537 - DNA, 22 bp, Homo sapiens
gggtgcagtggttcacgcctgt

SEQ ID NO: 9231538 - DNA, 22 bp, Homo sapiens
cagaggctgctctgggtggcat

SEQ ID NO: 9231539 - DNA, 22 bp, Homo sapiens
cagaggctggatggacttgcct

SEQ ID NO: 9231540 - DNA, 22 bp, Homo sapiens
gggtgcagggtctccagcagct

SEQ ID NO: 9231541 - DNA, 22 bp, Homo sapiens
gggtgcagggtctccagcagct

SEQ ID NO: 9231542 - DNA, 22 bp, Homo sapiens
gggtgcaggggaccctagggac

SEQ ID NO: 9231543 - DNA, 22 bp, Homo sapiens
gggtgcaggggaccctagggac

SEQ ID NO: 9231544 - DNA, 22 bp, Homo sapiens
gggtcgggcaggcgccctcgtc

SEQ ID NO: 9231545 - DNA, 22 bp, Homo sapiens
gggtctaggagacatgggcaag

SEQ ID NO: 9231546 - DNA, 22 bp, Homo sapiens
cagaggcctggcttggacacct

SEQ ID NO: 9231547 - DNA, 22 bp, Homo sapiens
cagaggcctggcttggacacct

SEQ ID NO: 9231548 - DNA, 22 bp, Homo sapiens
cagaggctgtgtaggcagactg

SEQ ID NO: 9231549 - DNA, 22 bp, Homo sapiens
cagaggcttatacctgattagg

SEQ ID NO: 9231550 - DNA, 22 bp, Homo sapiens
cagaggcttcaagtcattctcc

SEQ ID NO: 9231551 - DNA, 22 bp, Homo sapiens
cagaggcttcaagtcattctcc

SEQ ID NO: 9231552 - DNA, 22 bp, Homo sapiens
cagaggcttggcattatcatgc

SEQ ID NO: 9231553 - DNA, 22 bp, Homo sapiens
cagaggtagccgagtgcaatcg

SEQ ID NO: 9231554 - DNA, 22 bp, Homo sapiens
cagaggctttgccctggaaacc

SEQ ID NO: 9231555 - DNA, 22 bp, Homo sapiens
cagaggctgggacctcaggcat

SEQ ID NO: 9231556 - DNA, 22 bp, Homo sapiens
cagaggctgggacctcaggcat

SEQ ID NO: 9231557 - DNA, 22 bp, Homo sapiens
cagaggctgggacctcaggcat

SEQ ID NO: 9231558 - DNA, 22 bp, Homo sapiens
cagaggctggcggccgccccga

SEQ ID NO: 9231559 - DNA, 22 bp, Homo sapiens
cagaggctgtgtaggcagactg

SEQ ID NO: 9231560 - DNA, 22 bp, Homo sapiens
cagaggctgggacctcaggcat

SEQ ID NO: 9231561 - DNA, 22 bp, Homo sapiens
cagaggtagggagctatgttat

SEQ ID NO: 9231562 - DNA, 22 bp, Homo sapiens
cagaggtgtacagagggaggcc

SEQ ID NO: 9231563 - DNA, 22 bp, Homo sapiens
cagaggtgtacagagggaggcc

SEQ ID NO: 9231564 - DNA, 23 bp, Homo sapiens
cagaggtgtcagtgcccagtgtc

SEQ ID NO: 9231565 - DNA, 22 bp, Homo sapiens
cagaggtgtacagagggaggcc

SEQ ID NO: 9231566 - DNA, 23 bp, Homo sapiens
cagaggtgtcagtgcccagtgtc

SEQ ID NO: 9231567 - DNA, 22 bp, Homo sapiens
cagaggtttgatcgagtaggtc

SEQ ID NO: 9231568 - DNA, 22 bp, Homo sapiens
cagagtaaacctgtcatcaaga

SEQ ID NO: 9231569 - DNA, 22 bp, Homo sapiens
cagagctgattggatccagaga

SEQ ID NO: 9231570 - DNA, 22 bp, Homo sapiens
cagagctgagaatgttgatgct

SEQ ID NO: 9231571 - DNA, 22 bp, Homo sapiens
cagagctgagtcttcaaggttg

SEQ ID NO: 9231572 - DNA, 22 bp, Homo sapiens
cagagctgattggatccagaga

SEQ ID NO: 9231573 - DNA, 22 bp, Homo sapiens
cagagctgcaaatgcccctccg

SEQ ID NO: 9231574 - DNA, 22 bp, Homo sapiens
cagagctgcaaatgcccctccg

SEQ ID NO: 9231575 - DNA, 22 bp, Homo sapiens
cagagctgcacattctatgatg

SEQ ID NO: 9231576 - DNA, 22 bp, Homo sapiens
cagagctgacccaaggattgaa

SEQ ID NO: 9231577 - DNA, 22 bp, Homo sapiens
cagagctgagaatgttgatgct

SEQ ID NO: 9231578 - DNA, 21 bp, Homo sapiens
cagagctgaagggtgtagtgt

SEQ ID NO: 9231579 - DNA, 22 bp, Homo sapiens
cagagcctgctgccttctgaag

SEQ ID NO: 9231580 - DNA, 22 bp, Homo sapiens
cagagcctgctcacgtctctgt

SEQ ID NO: 9231581 - DNA, 22 bp, Homo sapiens
gggcgccgtgggaaacagccgg

SEQ ID NO: 9231582 - DNA, 22 bp, Homo sapiens
gggcgcatcacctgaggtcagg

SEQ ID NO: 9231583 - DNA, 19 bp, Homo sapiens
cagagctgctggcctcgtc

SEQ ID NO: 9231584 - DNA, 19 bp, Homo sapiens
cagagctgctggcctcgtc

SEQ ID NO: 9231585 - DNA, 19 bp, Homo sapiens
cagagctgctggcctcgtc

SEQ ID NO: 9231586 - DNA, 22 bp, Homo sapiens
cagagctgctcatggtggccag

SEQ ID NO: 9231587 - DNA, 22 bp, Homo sapiens
cagagctgcagattgaaggcat

SEQ ID NO: 9231588 - DNA, 22 bp, Homo sapiens
cagagctgcagattgaaggcat

SEQ ID NO: 9231589 - DNA, 22 bp, Homo sapiens
cagagctgcagattgaaggcat

SEQ ID NO: 9231590 - DNA, 22 bp, Homo sapiens
cagagctgcagattgaaggcat

SEQ ID NO: 9231591 - DNA, 22 bp, Homo sapiens
cagagctgcgctttttcctggt

SEQ ID NO: 9231592 - DNA, 22 bp, Homo sapiens
cagagctgcgctttttcctggt

SEQ ID NO: 9231593 - DNA, 22 bp, Homo sapiens
ggggaacaccgggcagaggcgc

SEQ ID NO: 9231594 - DNA, 22 bp, Homo sapiens
ggggaaattgtggctgacagtg

SEQ ID NO: 9231595 - DNA, 23 bp, Homo sapiens
ggggaaagaccatgcttgaggac

SEQ ID NO: 9231596 - DNA, 22 bp, Homo sapiens
ggggaaactgaggcacagacag

SEQ ID NO: 9231597 - DNA, 22 bp, Homo sapiens
ggggaaacatgttgttcagacc

SEQ ID NO: 9231598 - DNA, 21 bp, Homo sapiens
gggcgaggcctgatgtggctc

SEQ ID NO: 9231599 - DNA, 22 bp, Homo sapiens
gggcgagggcgaaagcgagagc

SEQ ID NO: 9231600 - DNA, 21 bp, Homo sapiens
gggcgaggcctgatgtggctc

SEQ ID NO: 9231601 - DNA, 22 bp, Homo sapiens
gggcgagggcgaaagcgagagc

SEQ ID NO: 9231602 - DNA, 22 bp, Homo sapiens
gggcgaggactgactctgggca

SEQ ID NO: 9231603 - DNA, 23 bp, Homo sapiens
gggccttggatttgtggagttca

SEQ ID NO: 9231604 - DNA, 21 bp, Homo sapiens
gggccttgagtgtgcggtggg

SEQ ID NO: 9231605 - DNA, 22 bp, Homo sapiens
cagagcccctcgtctccaccac

SEQ ID NO: 9231606 - DNA, 22 bp, Homo sapiens
cagagcccctcagctctctccc

SEQ ID NO: 9231607 - DNA, 22 bp, Homo sapiens
cagagcccctcagctctctccc

SEQ ID NO: 9231608 - DNA, 22 bp, Homo sapiens
cagagccctagtcctgatggcc

SEQ ID NO: 9231609 - DNA, 22 bp, Homo sapiens
cagagccctgggcacatggtag

SEQ ID NO: 9231610 - DNA, 22 bp, Homo sapiens
gggcactgtgctaggtgctgag

SEQ ID NO: 9231611 - DNA, 22 bp, Homo sapiens
gggcactgtgctgggtgcttta

SEQ ID NO: 9231612 - DNA, 22 bp, Homo sapiens
gggcactgtgctgggtgcttta

SEQ ID NO: 9231613 - DNA, 22 bp, Homo sapiens
gggcactgtggggcccatgctg

SEQ ID NO: 9231614 - DNA, 22 bp, Homo sapiens
gggcactgtgttcagagtgcag

SEQ ID NO: 9231615 - DNA, 22 bp, Homo sapiens
gggcactgtgttcagagtgcag

SEQ ID NO: 9231616 - DNA, 22 bp, Homo sapiens
gggcactgtggggcccatgctg

SEQ ID NO: 9231617 - DNA, 22 bp, Homo sapiens
cagagccagctgtccttggcat

SEQ ID NO: 9231618 - DNA, 22 bp, Homo sapiens
cagagccagctgtccttggcat

SEQ ID NO: 9231619 - DNA, 22 bp, Homo sapiens
cagagccagctgtccttggcat

SEQ ID NO: 9231620 - DNA, 22 bp, Homo sapiens
cagagcccatggcacatgtgga

SEQ ID NO: 9231621 - DNA, 22 bp, Homo sapiens
gggcagagaaatggacagttgg

SEQ ID NO: 9231622 - DNA, 22 bp, Homo sapiens
gggcagagaaatggacagttgg

SEQ ID NO: 9231623 - DNA, 19 bp, Homo sapiens
gggcagaatggcatctcag

SEQ ID NO: 9231624 - DNA, 22 bp, Homo sapiens
cagcccagcactaagtagattt

SEQ ID NO: 9231625 - DNA, 22 bp, Homo sapiens
cagcccagcagtcttagcctgc

SEQ ID NO: 9231626 - DNA, 22 bp, Homo sapiens
cagcccagcagggtctggccct

SEQ ID NO: 9231627 - DNA, 22 bp, Homo sapiens
cagccacttgtgatgctgggga

SEQ ID NO: 9231628 - DNA, 22 bp, Homo sapiens
cagccacttgtgatgctgggga

SEQ ID NO: 9231629 - DNA, 22 bp, Homo sapiens
cagccacttgtgatgctgggga

SEQ ID NO: 9231630 - DNA, 22 bp, Homo sapiens
cagccacttcgagcttcctgat

SEQ ID NO: 9231631 - DNA, 22 bp, Homo sapiens
cagccacttcgagcttcctgat

SEQ ID NO: 9231632 - DNA, 22 bp, Homo sapiens
cagccactgtggtctagctgca

SEQ ID NO: 9231633 - DNA, 22 bp, Homo sapiens
cagccactgtggtctagctgca

SEQ ID NO: 9231634 - DNA, 22 bp, Homo sapiens
cagccactggtgccaggctgtt

SEQ ID NO: 9231635 - DNA, 22 bp, Homo sapiens
cagccactggtgccaggctgtt

SEQ ID NO: 9231636 - DNA, 22 bp, Homo sapiens
cagccactgtggaatagccccc

SEQ ID NO: 9231637 - DNA, 22 bp, Homo sapiens
cagccactgacaggaatggtcc

SEQ ID NO: 9231638 - DNA, 22 bp, Homo sapiens
cagccactggtgccaggctgtt

SEQ ID NO: 9231639 - DNA, 22 bp, Homo sapiens
cagccactgacaggaatggtcc

SEQ ID NO: 9231640 - DNA, 22 bp, Homo sapiens
cagccactgaactcctggctat

SEQ ID NO: 9231641 - DNA, 22 bp, Homo sapiens
cagccactgaactcctggctat

SEQ ID NO: 9231642 - DNA, 22 bp, Homo sapiens
cagccactctcagacagtccca

SEQ ID NO: 9231643 - DNA, 22 bp, Homo sapiens
cagccactctcagacagtccca

SEQ ID NO: 9231644 - DNA, 22 bp, Homo sapiens
cagccactgaactcctggctat

SEQ ID NO: 9231645 - DNA, 22 bp, Homo sapiens
cagccactacaattggttccat

SEQ ID NO: 9231646 - DNA, 22 bp, Homo sapiens
cagccactcggccataaaggct

SEQ ID NO: 9231647 - DNA, 22 bp, Homo sapiens
cagccaccatacagcagaagct

SEQ ID NO: 9231648 - DNA, 22 bp, Homo sapiens
cagccaaatgagtcataaatgt

SEQ ID NO: 9231649 - DNA, 22 bp, Homo sapiens
cagcattgtaagaatgaagacc

SEQ ID NO: 9231650 - DNA, 22 bp, Homo sapiens
cagcattgatcccaggctgtgg

SEQ ID NO: 9231651 - DNA, 18 bp, Homo sapiens
cagcattagcagcttcca

SEQ ID NO: 9231652 - DNA, 22 bp, Homo sapiens
gtattttactgctcaaagctct

SEQ ID NO: 9231653 - DNA, 22 bp, Homo sapiens
gtattttactgctcaaagctct

SEQ ID NO: 9231654 - DNA, 22 bp, Homo sapiens
gtattttaagtgactactaggt

SEQ ID NO: 9231655 - DNA, 22 bp, Homo sapiens
gtattttactgctcaaagctct

SEQ ID NO: 9231656 - DNA, 22 bp, Homo sapiens
gtattttactgctcaaagctct

SEQ ID NO: 9231657 - DNA, 22 bp, Homo sapiens
gtatttgatagatttcaaagga

SEQ ID NO: 9231658 - DNA, 22 bp, Homo sapiens
gtatttgatacatgaaatggtg

SEQ ID NO: 9231659 - DNA, 22 bp, Homo sapiens
cagagtcagagctccatggagt

SEQ ID NO: 9231660 - DNA, 22 bp, Homo sapiens
cagagtactgggagaacagaag

SEQ ID NO: 9231661 - DNA, 19 bp, Homo sapiens
cagagtacaccagatagga

SEQ ID NO: 9231662 - DNA, 22 bp, Homo sapiens
gggtgggactctttggcctgag

SEQ ID NO: 9231663 - DNA, 22 bp, Homo sapiens
gggtgggactctttggcctgag

SEQ ID NO: 9231664 - DNA, 22 bp, Homo sapiens
gggtgggaaggctaagggattg

SEQ ID NO: 9231665 - DNA, 22 bp, Homo sapiens
gggtgggaaggctaagggattg

SEQ ID NO: 9231666 - DNA, 22 bp, Homo sapiens
gggtgggaaggctaagggattg

SEQ ID NO: 9231667 - DNA, 22 bp, Homo sapiens
gggtgggactgaagtctgaggg

SEQ ID NO: 9231668 - DNA, 22 bp, Homo sapiens
gggtgggagaaatgagtatcta

SEQ ID NO: 9231669 - DNA, 20 bp, Homo sapiens
gggtgggagagtctgagggt

SEQ ID NO: 9231670 - DNA, 20 bp, Homo sapiens
gggtgggagagtctgagggt

SEQ ID NO: 9231671 - DNA, 21 bp, Homo sapiens
gggtgggaggacacagcaggc

SEQ ID NO: 9231672 - DNA, 21 bp, Homo sapiens
gggtgggaggacacagcaggc

SEQ ID NO: 9231673 - DNA, 22 bp, Homo sapiens
gggtgggagtctggccctcaaa

SEQ ID NO: 9231674 - DNA, 22 bp, Homo sapiens
gggtgggatctgtggagcctca

SEQ ID NO: 9231675 - DNA, 22 bp, Homo sapiens
ggtgggacaggtaggagtggct

SEQ ID NO: 9231676 - DNA, 22 bp, Homo sapiens
ggtggggctaggacctcaggat

SEQ ID NO: 9231677 - DNA, 22 bp, Homo sapiens
ggtgggggagacttggtcaaga

SEQ ID NO: 9231678 - DNA, 22 bp, Homo sapiens
ggtgggggagacttggtcaaga

SEQ ID NO: 9231679 - DNA, 22 bp, Homo sapiens
ggtggggctcagcaatctgtgt

SEQ ID NO: 9231680 - DNA, 22 bp, Homo sapiens
ggtggggttttaggctgctgca

SEQ ID NO: 9231681 - DNA, 22 bp, Homo sapiens
ggtggggttttaggctgctgca

SEQ ID NO: 9231682 - DNA, 22 bp, Homo sapiens
cagcaagggataaagagttact

SEQ ID NO: 9231683 - DNA, 22 bp, Homo sapiens
ggtgggtattgaatacaggtgt

SEQ ID NO: 9231684 - DNA, 22 bp, Homo sapiens
ggtgggtattgaatacaggtgt

SEQ ID NO: 9231685 - DNA, 22 bp, Homo sapiens
ggtgggtatagttagggcctct

SEQ ID NO: 9231686 - DNA, 22 bp, Homo sapiens
ggttccccaggcggcccttgga

SEQ ID NO: 9231687 - DNA, 22 bp, Homo sapiens
ggttccccaggcggcccttgga

SEQ ID NO: 9231688 - DNA, 22 bp, Homo sapiens
ggttctcttcctcctgactgag

SEQ ID NO: 9231689 - DNA, 22 bp, Homo sapiens
ggttctccttgagtgtcccagg

SEQ ID NO: 9231690 - DNA, 22 bp, Homo sapiens
ggttcctgtgcctctagctggc

SEQ ID NO: 9231691 - DNA, 22 bp, Homo sapiens
ggttcctgtacttagctatgta

SEQ ID NO: 9231692 - DNA, 23 bp, Homo sapiens
cagcaagtgaattccaagagaga

SEQ ID NO: 9231693 - DNA, 22 bp, Homo sapiens
cagcaatggcaggcggagagtg

SEQ ID NO: 9231694 - DNA, 22 bp, Homo sapiens
cagcaatggcaggcggagagtg

SEQ ID NO: 9231695 - DNA, 22 bp, Homo sapiens
cagcacaattttcaggagtcca

SEQ ID NO: 9231696 - DNA, 22 bp, Homo sapiens
ggtgtgcctggggcttagctgc

SEQ ID NO: 9231697 - DNA, 22 bp, Homo sapiens
ggtgtgccacttcactgagcag

SEQ ID NO: 9231698 - DNA, 22 bp, Homo sapiens
ggtgtgcctggggcttagctgc

SEQ ID NO: 9231699 - DNA, 22 bp, Homo sapiens
gtaaaattgcaattacttttgc

SEQ ID NO: 9231700 - DNA, 22 bp, Homo sapiens
gtaaaattgcaattacttttgc

SEQ ID NO: 9231701 - DNA, 22 bp, Homo sapiens
gtaaaattctagcatctgaaag

SEQ ID NO: 9231702 - DNA, 22 bp, Homo sapiens
gtaaacaacacaaatcatttga

SEQ ID NO: 9231703 - DNA, 22 bp, Homo sapiens
ggttgaatatctttatgttggt

SEQ ID NO: 9231704 - DNA, 22 bp, Homo sapiens
ggttgcaaactcctgggatcaa

SEQ ID NO: 9231705 - DNA, 22 bp, Homo sapiens
ggttgctgggggtggcagagct

SEQ ID NO: 9231706 - DNA, 22 bp, Homo sapiens
ggttggacactaggtaggagcg

SEQ ID NO: 9231707 - DNA, 22 bp, Homo sapiens
gtaaaatagaataacgtggcta

SEQ ID NO: 9231708 - DNA, 20 bp, Homo sapiens
gtaaaatatggtctttgggt

SEQ ID NO: 9231709 - DNA, 22 bp, Homo sapiens
gtaaaatagaataacgtggcta

SEQ ID NO: 9231710 - DNA, 20 bp, Homo sapiens
gtaaaatatggtctttgggt

SEQ ID NO: 9231711 - DNA, 20 bp, Homo sapiens
gtaaaatatggtctttgggt

SEQ ID NO: 9231712 - DNA, 22 bp, Homo sapiens
cagcagcactctgcgggtcccc

SEQ ID NO: 9231713 - DNA, 22 bp, Homo sapiens
gtagggatggaagccatgaaat

SEQ ID NO: 9231714 - DNA, 22 bp, Homo sapiens
gtagggagcccagagcccagtg

SEQ ID NO: 9231715 - DNA, 22 bp, Homo sapiens
cagcagcagagatactggtttc

SEQ ID NO: 9231716 - DNA, 22 bp, Homo sapiens
cagcagcagattcagcgtctgg

SEQ ID NO: 9231717 - DNA, 22 bp, Homo sapiens
gtatcttgactccatgcctcag

SEQ ID NO: 9231718 - DNA, 19 bp, Homo sapiens
gtatatttatatggctgta

SEQ ID NO: 9231719 - DNA, 22 bp, Homo sapiens
cagcagcaacaacggaagcctt

SEQ ID NO: 9231720 - DNA, 22 bp, Homo sapiens
cagcagcaacaacggaagcctt

SEQ ID NO: 9231721 - DNA, 22 bp, Homo sapiens
cagcagcaacaatagcggtcac

SEQ ID NO: 9231722 - DNA, 22 bp, Homo sapiens
cagcagcaaggtgagggtggag

SEQ ID NO: 9231723 - DNA, 22 bp, Homo sapiens
cagcagcaacaacggaagcctt

SEQ ID NO: 9231724 - DNA, 22 bp, Homo sapiens
cagcagcaaatctagaagagga

SEQ ID NO: 9231725 - DNA, 21 bp, Homo sapiens
cagcagagtaatgcattcgta

SEQ ID NO: 9231726 - DNA, 22 bp, Homo sapiens
cagcagagctgtgtgggaaggg

SEQ ID NO: 9231727 - DNA, 22 bp, Homo sapiens
cagcagagtttggcttctaatg

SEQ ID NO: 9231728 - DNA, 22 bp, Homo sapiens
cagcagagtatggcactcaact

SEQ ID NO: 9231729 - DNA, 22 bp, Homo sapiens
gtatgatcaacttcatgtccta

SEQ ID NO: 9231730 - DNA, 22 bp, Homo sapiens
cagcagcctagggttccatcat

SEQ ID NO: 9231731 - DNA, 22 bp, Homo sapiens
cagcagcctcaagtttattttc

SEQ ID NO: 9231732 - DNA, 22 bp, Homo sapiens
cagcagcctggagggggccacg

SEQ ID NO: 9231733 - DNA, 22 bp, Homo sapiens
cagcagcctggagggggccacg

SEQ ID NO: 9231734 - DNA, 22 bp, Homo sapiens
cagcagcctggagggggccacg

SEQ ID NO: 9231735 - DNA, 22 bp, Homo sapiens
cagcagcctggcccctcctcgg

SEQ ID NO: 9231736 - DNA, 22 bp, Homo sapiens
cagcagctacttggagcagcag

SEQ ID NO: 9231737 - DNA, 22 bp, Homo sapiens
cagcaggccatgctgcttttca

SEQ ID NO: 9231738 - DNA, 22 bp, Homo sapiens
cagcaggcccagagtttcatgg

SEQ ID NO: 9231739 - DNA, 22 bp, Homo sapiens
cagcaggcaggtgggccaagtc

SEQ ID NO: 9231740 - DNA, 22 bp, Homo sapiens
cagcaggatatggtggagagag

SEQ ID NO: 9231741 - DNA, 22 bp, Homo sapiens
cagcaggcagccatttcactgt

SEQ ID NO: 9231742 - DNA, 22 bp, Homo sapiens
cagcaggcagccatttcactgt

SEQ ID NO: 9231743 - DNA, 22 bp, Homo sapiens
gtatttcttggaaatcctttta

SEQ ID NO: 9231744 - DNA, 22 bp, Homo sapiens
gtatttctggtaactgctgcta

SEQ ID NO: 9231745 - DNA, 22 bp, Homo sapiens
cagcaggcggcccgcgggcccg

SEQ ID NO: 9231746 - DNA, 22 bp, Homo sapiens
cagcaggcccaggtgctggtga

SEQ ID NO: 9231747 - DNA, 22 bp, Homo sapiens
cagcaggcccaggtgctggtga

SEQ ID NO: 9231748 - DNA, 22 bp, Homo sapiens
catgaaatgtgttaatctcttg

SEQ ID NO: 9231749 - DNA, 22 bp, Homo sapiens
catgaaatgttagaattagaca

SEQ ID NO: 9231750 - DNA, 22 bp, Homo sapiens
catgaaatgttagaattagaca

SEQ ID NO: 9231751 - DNA, 22 bp, Homo sapiens
catgaaatgttagaattagaca

SEQ ID NO: 9231752 - DNA, 22 bp, Homo sapiens
catgaaatgtgttaatctcttg

SEQ ID NO: 9231753 - DNA, 22 bp, Homo sapiens
aggaggcagatgcttggctgta

SEQ ID NO: 9231754 - DNA, 22 bp, Homo sapiens
aggaggcactcactctcagggt

SEQ ID NO: 9231755 - DNA, 22 bp, Homo sapiens
aggaggcactcactctcagggt

SEQ ID NO: 9231756 - DNA, 22 bp, Homo sapiens
catgaaatattagtaactgttt

SEQ ID NO: 9231757 - DNA, 22 bp, Homo sapiens
catgagtcatagtgaagcagga

SEQ ID NO: 9231758 - DNA, 22 bp, Homo sapiens
catgaggtgataaagctgggat

SEQ ID NO: 9231759 - DNA, 22 bp, Homo sapiens
aggaggtgttgatagaaggttt

SEQ ID NO: 9231760 - DNA, 22 bp, Homo sapiens
catgcacagtgatatctgaaga

SEQ ID NO: 9231761 - DNA, 22 bp, Homo sapiens
aggaggtggctgaacttgaggg

SEQ ID NO: 9231762 - DNA, 22 bp, Homo sapiens
aggaggtggctgaacttgaggg

SEQ ID NO: 9231763 - DNA, 22 bp, Homo sapiens
aggaggtggcctgagcgtgccc

SEQ ID NO: 9231764 - DNA, 22 bp, Homo sapiens
aggaggtgtagatttcctgtca

SEQ ID NO: 9231765 - DNA, 22 bp, Homo sapiens
aggaggtgtagatttcctgtca

SEQ ID NO: 9231766 - DNA, 22 bp, Homo sapiens
aggaggtgctagagaagatgtt

SEQ ID NO: 9231767 - DNA, 22 bp, Homo sapiens
aggaggtgctgtttgtcctgga

SEQ ID NO: 9231768 - DNA, 22 bp, Homo sapiens
aggaggtgctgtttgtcctgga

SEQ ID NO: 9231769 - DNA, 22 bp, Homo sapiens
aggaggtggcctgagcgtgccc

SEQ ID NO: 9231770 - DNA, 22 bp, Homo sapiens
catgcaggcctatggagcagtg

SEQ ID NO: 9231771 - DNA, 22 bp, Homo sapiens
catgcagatatttttattgtgg

SEQ ID NO: 9231772 - DNA, 22 bp, Homo sapiens
catgcagatgtcatgaggcatg

SEQ ID NO: 9231773 - DNA, 22 bp, Homo sapiens
catgcagagtttattaccatct

SEQ ID NO: 9231774 - DNA, 22 bp, Homo sapiens
catgcctgtaatcccagctctt

SEQ ID NO: 9231775 - DNA, 20 bp, Homo sapiens
catgcctgctggtatctggc

SEQ ID NO: 9231776 - DNA, 22 bp, Homo sapiens
catgccagttttgagatgcacc

SEQ ID NO: 9231777 - DNA, 22 bp, Homo sapiens
catgccagttttgagatgcacc

SEQ ID NO: 9231778 - DNA, 22 bp, Homo sapiens
catgccagggcttgctgcctgg

SEQ ID NO: 9231779 - DNA, 22 bp, Homo sapiens
catggccaggcccagggcccag

SEQ ID NO: 9231780 - DNA, 22 bp, Homo sapiens
catggccaggccaagagagtac

SEQ ID NO: 9231781 - DNA, 22 bp, Homo sapiens
aggcacaggcctcagcacccag

SEQ ID NO: 9231782 - DNA, 22 bp, Homo sapiens
aggcacaggaggtggtaagaag

SEQ ID NO: 9231783 - DNA, 22 bp, Homo sapiens
aggcacaggaatgtcatccagt

SEQ ID NO: 9231784 - DNA, 22 bp, Homo sapiens
aggcacaggaatgtcatccagt

SEQ ID NO: 9231785 - DNA, 22 bp, Homo sapiens
aggcacaggaggtggtaagaag

SEQ ID NO: 9231786 - DNA, 22 bp, Homo sapiens
aggcacagcctcccttcacatg

SEQ ID NO: 9231787 - DNA, 22 bp, Homo sapiens
aggcacagcctcccttcacatg

SEQ ID NO: 9231788 - DNA, 22 bp, Homo sapiens
aggcacaggaatgtcatccagt

SEQ ID NO: 9231789 - DNA, 22 bp, Homo sapiens
aggcacaggaacaggaaaagag

SEQ ID NO: 9231790 - DNA, 22 bp, Homo sapiens
aggcacaaaagcagggtgacca

SEQ ID NO: 9231791 - DNA, 22 bp, Homo sapiens
aggcaattgtttgtgtaatagg

SEQ ID NO: 9231792 - DNA, 22 bp, Homo sapiens
aggcacagcctcccccaactcc

SEQ ID NO: 9231793 - DNA, 22 bp, Homo sapiens
aggcaatgcagatagatgaatg

SEQ ID NO: 9231794 - DNA, 23 bp, Homo sapiens
aggcaatgccctgctgagaactc

SEQ ID NO: 9231795 - DNA, 22 bp, Homo sapiens
cattatgccaaagtagaaatat

SEQ ID NO: 9231796 - DNA, 20 bp, Homo sapiens
cattatggttgggcacagtg

SEQ ID NO: 9231797 - DNA, 20 bp, Homo sapiens
cattatggttgggcacagtg

SEQ ID NO: 9231798 - DNA, 22 bp, Homo sapiens
cattatggcagccaggatattg

SEQ ID NO: 9231799 - DNA, 22 bp, Homo sapiens
cattatggcagccaggatattg

SEQ ID NO: 9231800 - DNA, 22 bp, Homo sapiens
cattatggaagtgaagagctct

SEQ ID NO: 9231801 - DNA, 22 bp, Homo sapiens
cattatggaagacagtgtggtg

SEQ ID NO: 9231802 - DNA, 22 bp, Homo sapiens
catggccctcttctggagcaat

SEQ ID NO: 9231803 - DNA, 22 bp, Homo sapiens
catggcctcaaaggactgcaga

SEQ ID NO: 9231804 - DNA, 22 bp, Homo sapiens
catggcctgcctcctcctggtg

SEQ ID NO: 9231805 - DNA, 22 bp, Homo sapiens
catggccttgagtgactgcact

SEQ ID NO: 9231806 - DNA, 22 bp, Homo sapiens
cattaagatttttttctactgg

SEQ ID NO: 9231807 - DNA, 19 bp, Homo sapiens
aggcagaggcttggctagc

SEQ ID NO: 9231808 - DNA, 19 bp, Homo sapiens
aggcagcacccagtccttg

SEQ ID NO: 9231809 - DNA, 19 bp, Homo sapiens
aggcagcacccagtccttg

SEQ ID NO: 9231810 - DNA, 22 bp, Homo sapiens
cattccttaacgtggggagtct

SEQ ID NO: 9231811 - DNA, 22 bp, Homo sapiens
cattcctattatgtccctagtg

SEQ ID NO: 9231812 - DNA, 22 bp, Homo sapiens
cattcaaaagctccatgtttgt

SEQ ID NO: 9231813 - DNA, 22 bp, Homo sapiens
cattcaaaatgggctgacctgt

SEQ ID NO: 9231814 - DNA, 22 bp, Homo sapiens
cattcccacgtgttctttgctt

SEQ ID NO: 9231815 - DNA, 22 bp, Homo sapiens
cattcccatgactcctgctcag

SEQ ID NO: 9231816 - DNA, 22 bp, Homo sapiens
cattccagagctgcctctgcta

SEQ ID NO: 9231817 - DNA, 22 bp, Homo sapiens
cattccagctctcatactctgg

SEQ ID NO: 9231818 - DNA, 22 bp, Homo sapiens
cattccaagtatatacatgata

SEQ ID NO: 9231819 - DNA, 22 bp, Homo sapiens
cattcatttgcccagtaagtca

SEQ ID NO: 9231820 - DNA, 22 bp, Homo sapiens
cattccaagtatatacatgata

SEQ ID NO: 9231821 - DNA, 18 bp, Homo sapiens
cattccaagttctacctc

SEQ ID NO: 9231822 - DNA, 21 bp, Homo sapiens
catttacatgacagattggtt

SEQ ID NO: 9231823 - DNA, 22 bp, Homo sapiens
aggcagcagtcatgaggaaaga

SEQ ID NO: 9231824 - DNA, 22 bp, Homo sapiens
aggcagcatttctgcttatcca

SEQ ID NO: 9231825 - DNA, 22 bp, Homo sapiens
aggcagcatttctgcttatcca

SEQ ID NO: 9231826 - DNA, 19 bp, Homo sapiens
aggcagcattctggggctt

SEQ ID NO: 9231827 - DNA, 19 bp, Homo sapiens
aggcagcattctggggctt

SEQ ID NO: 9231828 - DNA, 22 bp, Homo sapiens
aggcagccagttcaggtttctt

SEQ ID NO: 9231829 - DNA, 22 bp, Homo sapiens
aggcagcatttgaatccaggtc

SEQ ID NO: 9231830 - DNA, 22 bp, Homo sapiens
aggcagcagcttgctggttgcc

SEQ ID NO: 9231831 - DNA, 21 bp, Homo sapiens
aggcagcaggatccagggaca

SEQ ID NO: 9231832 - DNA, 22 bp, Homo sapiens
aggcagcagaaaacaaatggtt

SEQ ID NO: 9231833 - DNA, 22 bp, Homo sapiens
aggcagcagactgttaatcaga

SEQ ID NO: 9231834 - DNA, 22 bp, Homo sapiens
aggcagcagaggttgaggaaag

SEQ ID NO: 9231835 - DNA, 18 bp, Homo sapiens
aggcagcagcatcttctc

SEQ ID NO: 9231836 - DNA, 22 bp, Homo sapiens
aggcagcagaggttgaggaaag

SEQ ID NO: 9231837 - DNA, 22 bp, Homo sapiens
aggagagttcacactggtcaga

SEQ ID NO: 9231838 - DNA, 22 bp, Homo sapiens
aggagagtcttgagtcactggt

SEQ ID NO: 9231839 - DNA, 22 bp, Homo sapiens
aggagagtcttgagtcactggt

SEQ ID NO: 9231840 - DNA, 22 bp, Homo sapiens
aggagagttcacactggtcaga

SEQ ID NO: 9231841 - DNA, 22 bp, Homo sapiens
aggagagtaccattgggccgca

SEQ ID NO: 9231842 - DNA, 22 bp, Homo sapiens
aggagagtaccattgggccgca

SEQ ID NO: 9231843 - DNA, 22 bp, Homo sapiens
aggagagtcttgagtcactggt

SEQ ID NO: 9231844 - DNA, 22 bp, Homo sapiens
aggagaggctctaactctgtgt

SEQ ID NO: 9231845 - DNA, 22 bp, Homo sapiens
aggagaggctctaactctgtgt

SEQ ID NO: 9231846 - DNA, 22 bp, Homo sapiens
aggagagcaggccagccgtccc

SEQ ID NO: 9231847 - DNA, 22 bp, Homo sapiens
aggagagaatgttccaggcttg

SEQ ID NO: 9231848 - DNA, 22 bp, Homo sapiens
aggagagaatgttccaggcttg

SEQ ID NO: 9231849 - DNA, 22 bp, Homo sapiens
aggagactgtgaattgactgtc

SEQ ID NO: 9231850 - DNA, 22 bp, Homo sapiens
aggagagaattactgggtgtca

SEQ ID NO: 9231851 - DNA, 22 bp, Homo sapiens
aggagctgaagtctctgcactc

SEQ ID NO: 9231852 - DNA, 22 bp, Homo sapiens
aggagctgaaacttctcatatg

SEQ ID NO: 9231853 - DNA, 22 bp, Homo sapiens
aggagctgaaacttctcatatg

SEQ ID NO: 9231854 - DNA, 20 bp, Homo sapiens
aggagctgaattagagggtt

SEQ ID NO: 9231855 - DNA, 22 bp, Homo sapiens
aggagctgagggagcgcccttg

SEQ ID NO: 9231856 - DNA, 20 bp, Homo sapiens
aggagctgaattagagggtt

SEQ ID NO: 9231857 - DNA, 22 bp, Homo sapiens
aggagctgagggagcgcccttg

SEQ ID NO: 9231858 - DNA, 22 bp, Homo sapiens
aggagctgagggagcgcccttg

SEQ ID NO: 9231859 - DNA, 22 bp, Homo sapiens
aggagctgagtcagcccgacag

SEQ ID NO: 9231860 - DNA, 22 bp, Homo sapiens
aggagctgagtcagcccgacag

SEQ ID NO: 9231861 - DNA, 22 bp, Homo sapiens
aggaggaatacaatccagcagc

SEQ ID NO: 9231862 - DNA, 22 bp, Homo sapiens
aggaggaatacaatccagcagc

SEQ ID NO: 9231863 - DNA, 22 bp, Homo sapiens
aggaggaattgacacagaagcc

SEQ ID NO: 9231864 - DNA, 21 bp, Homo sapiens
aggaggagagcttggcctacc

SEQ ID NO: 9231865 - DNA, 22 bp, Homo sapiens
aggaggaggctggagtacaccc

SEQ ID NO: 9231866 - DNA, 22 bp, Homo sapiens
aggaggaggctggagtacaccc

SEQ ID NO: 9231867 - DNA, 22 bp, Homo sapiens
aggaggcaactgagatttagaa

SEQ ID NO: 9231868 - DNA, 22 bp, Homo sapiens
aggaggaggtgggacacagtga

SEQ ID NO: 9231869 - DNA, 21 bp, Homo sapiens
cagtcctgcaaataattcttt

SEQ ID NO: 9231870 - DNA, 18 bp, Homo sapiens
cagtcccaaaccttagga

SEQ ID NO: 9231871 - DNA, 22 bp, Homo sapiens
aggaaggactgcagcatttggt

SEQ ID NO: 9231872 - DNA, 22 bp, Homo sapiens
cagtccatatgccataattctt

SEQ ID NO: 9231873 - DNA, 22 bp, Homo sapiens
cagtcctgctagtgtgaaaagc

SEQ ID NO: 9231874 - DNA, 22 bp, Homo sapiens
cagtcctgggcacagccctggg

SEQ ID NO: 9231875 - DNA, 19 bp, Homo sapiens
aggaaggaacctgagtctg

SEQ ID NO: 9231876 - DNA, 19 bp, Homo sapiens
aggaaggaacctgagtctg

SEQ ID NO: 9231877 - DNA, 20 bp, Homo sapiens
aggaaggaagtttgcatgga

SEQ ID NO: 9231878 - DNA, 20 bp, Homo sapiens
aggaaggaagtttgcatgga

SEQ ID NO: 9231879 - DNA, 20 bp, Homo sapiens
aggaaggaagtttgcatgga

SEQ ID NO: 9231880 - DNA, 22 bp, Homo sapiens
aggaaggactgcagcatttggt

SEQ ID NO: 9231881 - DNA, 22 bp, Homo sapiens
aggaaggactgcagcatttggt

SEQ ID NO: 9231882 - DNA, 20 bp, Homo sapiens
aggaagctgagatgtagagg

SEQ ID NO: 9231883 - DNA, 22 bp, Homo sapiens
aggaagctgctaagaaacaatg

SEQ ID NO: 9231884 - DNA, 22 bp, Homo sapiens
aggaagctgggaaactgacatt

SEQ ID NO: 9231885 - DNA, 22 bp, Homo sapiens
aggaagctgggaaactgacatt

SEQ ID NO: 9231886 - DNA, 22 bp, Homo sapiens
aggaagcttggggcagggctac

SEQ ID NO: 9231887 - DNA, 22 bp, Homo sapiens
aggagaaagactggacagccaa

SEQ ID NO: 9231888 - DNA, 22 bp, Homo sapiens
aggagaaagactggacagccaa

SEQ ID NO: 9231889 - DNA, 20 bp, Homo sapiens
aggagaaattcgggacacct

SEQ ID NO: 9231890 - DNA, 20 bp, Homo sapiens
aggagaaattcgggacacct

SEQ ID NO: 9231891 - DNA, 22 bp, Homo sapiens
aggactgacttttgccatgaaa

SEQ ID NO: 9231892 - DNA, 22 bp, Homo sapiens
aggactgacttttgccatgaaa

SEQ ID NO: 9231893 - DNA, 22 bp, Homo sapiens
aggacaggattccttgccttgc

SEQ ID NO: 9231894 - DNA, 22 bp, Homo sapiens
aggactttagagccagaaagac

SEQ ID NO: 9231895 - DNA, 22 bp, Homo sapiens
aggactgacttttgccatgaaa

SEQ ID NO: 9231896 - DNA, 22 bp, Homo sapiens
aggagaaaacagtgttttgcct

SEQ ID NO: 9231897 - DNA, 21 bp, Homo sapiens
aggacaggaactggctgaata

SEQ ID NO: 9231898 - DNA, 21 bp, Homo sapiens
aggacaggaactggctgaata

SEQ ID NO: 9231899 - DNA, 22 bp, Homo sapiens
aggacagcatatgggaaccagt

SEQ ID NO: 9231900 - DNA, 19 bp, Homo sapiens
aggagaagactctctcccc

SEQ ID NO: 9231901 - DNA, 23 bp, Homo sapiens
aggagaagagatttccacatgca

SEQ ID NO: 9231902 - DNA, 23 bp, Homo sapiens
aggagaagagatttccacatgca

SEQ ID NO: 9231903 - DNA, 22 bp, Homo sapiens
aggagaagccaagttgtgagca

SEQ ID NO: 9231904 - DNA, 22 bp, Homo sapiens
cagtctctcttgtagtgcagct

SEQ ID NO: 9231905 - DNA, 22 bp, Homo sapiens
cagtctctctgaagtattaaga

SEQ ID NO: 9231906 - DNA, 22 bp, Homo sapiens
cagtctctcttgtagtgcagct

SEQ ID NO: 9231907 - DNA, 22 bp, Homo sapiens
cagtctctggcagctgctggcc

SEQ ID NO: 9231908 - DNA, 22 bp, Homo sapiens
cagtctctctccttgcaggcgt

SEQ ID NO: 9231909 - DNA, 22 bp, Homo sapiens
aggagaagccaagttgtgagca

SEQ ID NO: 9231910 - DNA, 22 bp, Homo sapiens
cagtctctggtgagttgacagt

SEQ ID NO: 9231911 - DNA, 22 bp, Homo sapiens
cagtctctgtcatctcatggga

SEQ ID NO: 9231912 - DNA, 22 bp, Homo sapiens
cagtctctgtcatctcatggga

SEQ ID NO: 9231913 - DNA, 22 bp, Homo sapiens
cagtctcttttcagctccatcc

SEQ ID NO: 9231914 - DNA, 22 bp, Homo sapiens
cagtctcttttcagctccatcc

SEQ ID NO: 9231915 - DNA, 22 bp, Homo sapiens
aggagacactgagacttcacca

SEQ ID NO: 9231916 - DNA, 22 bp, Homo sapiens
aggagacagccaggggcctgag

SEQ ID NO: 9231917 - DNA, 22 bp, Homo sapiens
cagtctcttgcttcattagttg

SEQ ID NO: 9231918 - DNA, 22 bp, Homo sapiens
cagctttgtcctgcaaacctga

SEQ ID NO: 9231919 - DNA, 16 bp, Homo sapiens
cagctttgtctcctcg

SEQ ID NO: 9231920 - DNA, 22 bp, Homo sapiens
cagctttgtctgattcctcttt

SEQ ID NO: 9231921 - DNA, 22 bp, Homo sapiens
cagctttgtcatttgatttggg

SEQ ID NO: 9231922 - DNA, 22 bp, Homo sapiens
cagctttggcccagtcgggagg

SEQ ID NO: 9231923 - DNA, 22 bp, Homo sapiens
cagctttggagtgtgagtgctg

SEQ ID NO: 9231924 - DNA, 22 bp, Homo sapiens
cagctttgccaagtaaggtctt

SEQ ID NO: 9231925 - DNA, 22 bp, Homo sapiens
cagctttgccctttgcccaatc

SEQ ID NO: 9231926 - DNA, 22 bp, Homo sapiens
cagctttgcaggctggtcagtg

SEQ ID NO: 9231927 - DNA, 22 bp, Homo sapiens
cagctttgattctttctgccat

SEQ ID NO: 9231928 - DNA, 22 bp, Homo sapiens
cagctttgtgacttcggacaag

SEQ ID NO: 9231929 - DNA, 21 bp, Homo sapiens
cagctttgtctgtcttcgggg

SEQ ID NO: 9231930 - DNA, 22 bp, Homo sapiens
cagctttgtgcaatgcagtctc

SEQ ID NO: 9231931 - DNA, 22 bp, Homo sapiens
cagctttgtggccttgacctcg

SEQ ID NO: 9231932 - DNA, 21 bp, Homo sapiens
agctgcagtcaagccagaggt

SEQ ID NO: 9231933 - DNA, 22 bp, Homo sapiens
agctgcagtcaagctgggccac

SEQ ID NO: 9231934 - DNA, 22 bp, Homo sapiens
agctgcagtcaagctgggccac

SEQ ID NO: 9231935 - DNA, 22 bp, Homo sapiens
agctgcagtatgaggctggtgg

SEQ ID NO: 9231936 - DNA, 22 bp, Homo sapiens
agctgcaggcctctcctgggga

SEQ ID NO: 9231937 - DNA, 22 bp, Homo sapiens
agctgcaggcctctcctgggga

SEQ ID NO: 9231938 - DNA, 22 bp, Homo sapiens
agctgcagtaaagctctccagg

SEQ ID NO: 9231939 - DNA, 22 bp, Homo sapiens
agctgcaggttcagcattccac

SEQ ID NO: 9231940 - DNA, 22 bp, Homo sapiens
agctgcagggcttgggtttccc

SEQ ID NO: 9231941 - DNA, 22 bp, Homo sapiens
agctgcaggttcagcattccac

SEQ ID NO: 9231942 - DNA, 22 bp, Homo sapiens
agctgcaggcccatgctcagtc

SEQ ID NO: 9231943 - DNA, 22 bp, Homo sapiens
agctgcaggcccatgctcagtc

SEQ ID NO: 9231944 - DNA, 22 bp, Homo sapiens
agctgcaggcccatgctcagtc

SEQ ID NO: 9231945 - DNA, 22 bp, Homo sapiens
agctgcaggcctctcctgggga

SEQ ID NO: 9231946 - DNA, 22 bp, Homo sapiens
agctgcaggcctctcctgggga

SEQ ID NO: 9231947 - DNA, 23 bp, Homo sapiens
agctgaggctgtgggtgtcagag

SEQ ID NO: 9231948 - DNA, 22 bp, Homo sapiens
agctgaggctctgagagggaag

SEQ ID NO: 9231949 - DNA, 23 bp, Homo sapiens
agctgaggctgtgggtgtcagag

SEQ ID NO: 9231950 - DNA, 22 bp, Homo sapiens
agctgaggctctgagagggaag

SEQ ID NO: 9231951 - DNA, 22 bp, Homo sapiens
agctgaggctctgagagggaag

SEQ ID NO: 9231952 - DNA, 22 bp, Homo sapiens
agctgaggctctgagagggaag

SEQ ID NO: 9231953 - DNA, 22 bp, Homo sapiens
agctgaggctctgagagggaag

SEQ ID NO: 9231954 - DNA, 22 bp, Homo sapiens
agctgaggctctgagagggaag

SEQ ID NO: 9231955 - DNA, 22 bp, Homo sapiens
agctgaggccacgagtgaaggg

SEQ ID NO: 9231956 - DNA, 22 bp, Homo sapiens
agctgaggccacgagtgaaggg

SEQ ID NO: 9231957 - DNA, 22 bp, Homo sapiens
agctgaggccacgagtgaaggg

SEQ ID NO: 9231958 - DNA, 22 bp, Homo sapiens
agctgaggcctgatttcgccgt

SEQ ID NO: 9231959 - DNA, 22 bp, Homo sapiens
agctgaggcctgatttcgccgt

SEQ ID NO: 9231960 - DNA, 22 bp, Homo sapiens
agctgaggcatggacaggctgc

SEQ ID NO: 9231961 - DNA, 22 bp, Homo sapiens
agctgaggcatggacaggctgc

SEQ ID NO: 9231962 - DNA, 22 bp, Homo sapiens
agctgaggcatggacaggctgc

SEQ ID NO: 9231963 - DNA, 23 bp, Homo sapiens
agctgaggcagaggggcattctc

SEQ ID NO: 9231964 - DNA, 23 bp, Homo sapiens
agctgaggcagaggggcattctc

SEQ ID NO: 9231965 - DNA, 22 bp, Homo sapiens
agctgaggcatgatgctatcag

SEQ ID NO: 9231966 - DNA, 22 bp, Homo sapiens
agctgaggcatggacaggctgc

SEQ ID NO: 9231967 - DNA, 22 bp, Homo sapiens
agctgaggcatggacaggctgc

SEQ ID NO: 9231968 - DNA, 22 bp, Homo sapiens
agctctctgataaattgataaa

SEQ ID NO: 9231969 - DNA, 22 bp, Homo sapiens
agctctctgataaattgataaa

SEQ ID NO: 9231970 - DNA, 22 bp, Homo sapiens
agctctcttccagatccacttg

SEQ ID NO: 9231971 - DNA, 23 bp, Homo sapiens
agctctgaaatagggaaagagga

SEQ ID NO: 9231972 - DNA, 22 bp, Homo sapiens
agctctcccatagggcaagatc

SEQ ID NO: 9231973 - DNA, 22 bp, Homo sapiens
agctcctgtgtgaagcctccct

SEQ ID NO: 9231974 - DNA, 18 bp, Homo sapiens
agctctcccccacatgcc

SEQ ID NO: 9231975 - DNA, 18 bp, Homo sapiens
agctctcccccacatgcc

SEQ ID NO: 9231976 - DNA, 22 bp, Homo sapiens
agctctggaactcccggctgct

SEQ ID NO: 9231977 - DNA, 22 bp, Homo sapiens
agctctggaactcccggctgct

SEQ ID NO: 9231978 - DNA, 22 bp, Homo sapiens
agctctggaagccctggtagtt

SEQ ID NO: 9231979 - DNA, 22 bp, Homo sapiens
cagctcctgcctgggcagctgt

SEQ ID NO: 9231980 - DNA, 22 bp, Homo sapiens
cagctcctgcctgggcagctgt

SEQ ID NO: 9231981 - DNA, 22 bp, Homo sapiens
cagctcctgggccatctcctag

SEQ ID NO: 9231982 - DNA, 22 bp, Homo sapiens
cagctcctgggccatctcctag

SEQ ID NO: 9231983 - DNA, 22 bp, Homo sapiens
cagcttctgtttattgtgtgcc

SEQ ID NO: 9231984 - DNA, 22 bp, Homo sapiens
cagcttctggcgtggagcctga

SEQ ID NO: 9231985 - DNA, 22 bp, Homo sapiens
cagcttctgctcatggaggggt

SEQ ID NO: 9231986 - DNA, 22 bp, Homo sapiens
cagctgttgtcacctcacatcc

SEQ ID NO: 9231987 - DNA, 21 bp, Homo sapiens
cagcttcttctgtgacctggt

SEQ ID NO: 9231988 - DNA, 22 bp, Homo sapiens
cagctctgacacagtacaaaat

SEQ ID NO: 9231989 - DNA, 22 bp, Homo sapiens
cagctgttgtcacctcacatcc

SEQ ID NO: 9231990 - DNA, 22 bp, Homo sapiens
cagctgttgtcacctcacatcc

SEQ ID NO: 9231991 - DNA, 22 bp, Homo sapiens
cagctgttgtctctcacatatt

SEQ ID NO: 9231992 - DNA, 22 bp, Homo sapiens
cagctgttgtgatccatttacg

SEQ ID NO: 9231993 - DNA, 22 bp, Homo sapiens
cagctgttgtctctcacatatt

SEQ ID NO: 9231994 - DNA, 22 bp, Homo sapiens
cagctctgaagaaaggtgtcta

SEQ ID NO: 9231995 - DNA, 22 bp, Homo sapiens
cagctctgaagaaaggtgtcta

SEQ ID NO: 9231996 - DNA, 22 bp, Homo sapiens
cagctctctaaggtcttgcttt

SEQ ID NO: 9231997 - DNA, 22 bp, Homo sapiens
cagctctcacaccctcctccca

SEQ ID NO: 9231998 - DNA, 22 bp, Homo sapiens
cagctcctgttggtcttgagga

SEQ ID NO: 9231999 - DNA, 22 bp, Homo sapiens
cagctctcacacttagcttcta

SEQ ID NO: 9232000 - DNA, 22 bp, Homo sapiens
cagctctcacacttagcttcta

SEQ ID NO: 9232001 - DNA, 22 bp, Homo sapiens
agctggctgccttctccttagg

SEQ ID NO: 9232002 - DNA, 22 bp, Homo sapiens
agctggctgggtgccagtctcc

SEQ ID NO: 9232003 - DNA, 22 bp, Homo sapiens
agctggcttctctgcagacatt

SEQ ID NO: 9232004 - DNA, 22 bp, Homo sapiens
agctggctttgagctgggaggt

SEQ ID NO: 9232005 - DNA, 22 bp, Homo sapiens
caggaggttgtaagagcaggcc

SEQ ID NO: 9232006 - DNA, 22 bp, Homo sapiens
caggaggttgtaagagcaggcc

SEQ ID NO: 9232007 - DNA, 22 bp, Homo sapiens
agctgctctttgaaggacactt

SEQ ID NO: 9232008 - DNA, 22 bp, Homo sapiens
agctgctgagccaggctgatgt

SEQ ID NO: 9232009 - DNA, 22 bp, Homo sapiens
agctgctctcactggacgcctg

SEQ ID NO: 9232010 - DNA, 22 bp, Homo sapiens
agctgctcctttcctgcaggcg

SEQ ID NO: 9232011 - DNA, 21 bp, Homo sapiens
agctgctccagggagctcagg

SEQ ID NO: 9232012 - DNA, 21 bp, Homo sapiens
caggaaaagcggaagtctagc

SEQ ID NO: 9232013 - DNA, 22 bp, Homo sapiens
caggacagacagaatgcctaac

SEQ ID NO: 9232014 - DNA, 22 bp, Homo sapiens
caggacagacagaatgcctaac

SEQ ID NO: 9232015 - DNA, 22 bp, Homo sapiens
caggacagaaataaggaatata

SEQ ID NO: 9232016 - DNA, 22 bp, Homo sapiens
caggacagaaataaggaatata

SEQ ID NO: 9232017 - DNA, 22 bp, Homo sapiens
caggacagagcccagactgtgt

SEQ ID NO: 9232018 - DNA, 19 bp, Homo sapiens
caggacagacttcaaagcc

SEQ ID NO: 9232019 - DNA, 22 bp, Homo sapiens
caggacagaccaagatcgtgct

SEQ ID NO: 9232020 - DNA, 22 bp, Homo sapiens
agctggcatactttgctaggaa

SEQ ID NO: 9232021 - DNA, 22 bp, Homo sapiens
agctggcatactttgctaggaa

SEQ ID NO: 9232022 - DNA, 22 bp, Homo sapiens
agctggcagtcggccttgatgc

SEQ ID NO: 9232023 - DNA, 22 bp, Homo sapiens
agctggcagtcatcctagtgag

SEQ ID NO: 9232024 - DNA, 23 bp, Homo sapiens
agctggaggctgtctactcccaa

SEQ ID NO: 9232025 - DNA, 22 bp, Homo sapiens
agctggaggataactcacttct

SEQ ID NO: 9232026 - DNA, 22 bp, Homo sapiens
agctggaggataactcacttct

SEQ ID NO: 9232027 - DNA, 22 bp, Homo sapiens
caggacagagcccagactgtgt

SEQ ID NO: 9232028 - DNA, 22 bp, Homo sapiens
caggcctggagtgcaatggcac

SEQ ID NO: 9232029 - DNA, 22 bp, Homo sapiens
caggcctggcccccggcacacc

SEQ ID NO: 9232030 - DNA, 22 bp, Homo sapiens
caggcctcccggtgcacactga

SEQ ID NO: 9232031 - DNA, 22 bp, Homo sapiens
caggcctcccggtgcacactga

SEQ ID NO: 9232032 - DNA, 22 bp, Homo sapiens
caggcctggctgcagctcgcct

SEQ ID NO: 9232033 - DNA, 22 bp, Homo sapiens
caggcctggctgcagctcgcct

SEQ ID NO: 9232034 - DNA, 22 bp, Homo sapiens
caggcctggcccccggcacacc

SEQ ID NO: 9232035 - DNA, 22 bp, Homo sapiens
caggcctggttgagccctgaga

SEQ ID NO: 9232036 - DNA, 22 bp, Homo sapiens
caggcctggggctggcttccag

SEQ ID NO: 9232037 - DNA, 22 bp, Homo sapiens
agctgtggcagcagccgtggca

SEQ ID NO: 9232038 - DNA, 22 bp, Homo sapiens
agctgtggcagcagccgtggca

SEQ ID NO: 9232039 - DNA, 22 bp, Homo sapiens
agctgtgtagggaatcagagaa

SEQ ID NO: 9232040 - DNA, 22 bp, Homo sapiens
agctgtgtagggaatcagagaa

SEQ ID NO: 9232041 - DNA, 22 bp, Homo sapiens
agctgtgtgacctagggcaagc

SEQ ID NO: 9232042 - DNA, 22 bp, Homo sapiens
agctgtgtcatcctggaaaatg

SEQ ID NO: 9232043 - DNA, 22 bp, Homo sapiens
agctgtgtcctgaagacactgc

SEQ ID NO: 9232044 - DNA, 22 bp, Homo sapiens
agctgtgtgactctaagcaagt

SEQ ID NO: 9232045 - DNA, 22 bp, Homo sapiens
caggcctcagagagtggcgggg

SEQ ID NO: 9232046 - DNA, 22 bp, Homo sapiens
caggcctcaggggctcaggctg

SEQ ID NO: 9232047 - DNA, 22 bp, Homo sapiens
caggcctcaggggctcaggctg

SEQ ID NO: 9232048 - DNA, 22 bp, Homo sapiens
caggcctcaggggctcaggctg

SEQ ID NO: 9232049 - DNA, 22 bp, Homo sapiens
caggcctccactccacgcagac

SEQ ID NO: 9232050 - DNA, 22 bp, Homo sapiens
agctgggacagacaactatgtt

SEQ ID NO: 9232051 - DNA, 22 bp, Homo sapiens
agctgggactcaactgtctggg

SEQ ID NO: 9232052 - DNA, 22 bp, Homo sapiens
agctgggaagagttttctgcag

SEQ ID NO: 9232053 - DNA, 22 bp, Homo sapiens
agctgggaagagttttctgcag

SEQ ID NO: 9232054 - DNA, 23 bp, Homo sapiens
agctgggaattttctgaagcttt

SEQ ID NO: 9232055 - DNA, 22 bp, Homo sapiens
agctgttttcttctaggaagac

SEQ ID NO: 9232056 - DNA, 22 bp, Homo sapiens
agctgttttctaatgcatttga

SEQ ID NO: 9232057 - DNA, 22 bp, Homo sapiens
agctgtttgtacttagatagta

SEQ ID NO: 9232058 - DNA, 21 bp, Homo sapiens
agctgtttgaagctatattgg

SEQ ID NO: 9232059 - DNA, 20 bp, Homo sapiens
agctgtttacatggatttct

SEQ ID NO: 9232060 - DNA, 22 bp, Homo sapiens
agctgtttaaatgacttacttt

SEQ ID NO: 9232061 - DNA, 22 bp, Homo sapiens
agctgttgtctgcaggagaagc

SEQ ID NO: 9232062 - DNA, 18 bp, Homo sapiens
agctgttgttgactctgt

SEQ ID NO: 9232063 - DNA, 22 bp, Homo sapiens
agctgtttccataaatgagaca

SEQ ID NO: 9232064 - DNA, 23 bp, Homo sapiens
agctgtgtggccttgggcaagtt

SEQ ID NO: 9232065 - DNA, 22 bp, Homo sapiens
agctgtgtgcccatggtggagg

SEQ ID NO: 9232066 - DNA, 22 bp, Homo sapiens
agctgtgtggtgtctgacagct

SEQ ID NO: 9232067 - DNA, 22 bp, Homo sapiens
agctgtgtgtgcttgggattat

SEQ ID NO: 9232068 - DNA, 22 bp, Homo sapiens
agctgtgtggtttgggcaaatt

SEQ ID NO: 9232069 - DNA, 22 bp, Homo sapiens
agctgtgtgtttccactgagct

SEQ ID NO: 9232070 - DNA, 22 bp, Homo sapiens
agctgtgtgtttccactgagct

SEQ ID NO: 9232071 - DNA, 22 bp, Homo sapiens
agctgtgtttccagatggtagc

SEQ ID NO: 9232072 - DNA, 22 bp, Homo sapiens
agctgttccctcactgcagtca

SEQ ID NO: 9232073 - DNA, 22 bp, Homo sapiens
agctgttggctggctgagctct

SEQ ID NO: 9232074 - DNA, 22 bp, Homo sapiens
agctgtgtttccagatggtagc

SEQ ID NO: 9232075 - DNA, 22 bp, Homo sapiens
agcttctgttcatcttccaggc

SEQ ID NO: 9232076 - DNA, 22 bp, Homo sapiens
agcttacagttcaatgacaaag

SEQ ID NO: 9232077 - DNA, 22 bp, Homo sapiens
agcttctgttcatcttccaggc

SEQ ID NO: 9232078 - DNA, 22 bp, Homo sapiens
agcttcttttacagctcatgct

SEQ ID NO: 9232079 - DNA, 22 bp, Homo sapiens
agcttcttttacagctcatgct

SEQ ID NO: 9232080 - DNA, 22 bp, Homo sapiens
agcttaaactctttgaagttat

SEQ ID NO: 9232081 - DNA, 22 bp, Homo sapiens
agctgtttttccagtctctgga

SEQ ID NO: 9232082 - DNA, 22 bp, Homo sapiens
agcttacagttcaatgacaaag

SEQ ID NO: 9232083 - DNA, 22 bp, Homo sapiens
agcttacaccccccaagattct

SEQ ID NO: 9232084 - DNA, 22 bp, Homo sapiens
agcttaaagtatttaaatttca

SEQ ID NO: 9232085 - DNA, 22 bp, Homo sapiens
agcttaaagtatttaaatttca

SEQ ID NO: 9232086 - DNA, 22 bp, Homo sapiens
agcttggtgttgcctgcttgag

SEQ ID NO: 9232087 - DNA, 23 bp, Homo sapiens
agcttgcttttcccagtactgca

SEQ ID NO: 9232088 - DNA, 22 bp, Homo sapiens
agcttgggcaacacagcaagac

SEQ ID NO: 9232089 - DNA, 22 bp, Homo sapiens
agcttgcctccccctcttagga

SEQ ID NO: 9232090 - DNA, 22 bp, Homo sapiens
agcttgcctcttaatcacctca

SEQ ID NO: 9232091 - DNA, 22 bp, Homo sapiens
agcttgagttttggatgaagtg

SEQ ID NO: 9232092 - DNA, 18 bp, Homo sapiens
agcttgcctcaagctttt

SEQ ID NO: 9232093 - DNA, 18 bp, Homo sapiens
aggaagcaggaggaaggc

SEQ ID NO: 9232094 - DNA, 22 bp, Homo sapiens
aggaagctcaaagccatgatgt

SEQ ID NO: 9232095 - DNA, 22 bp, Homo sapiens
aggaactggtgggaggtgattg

SEQ ID NO: 9232096 - DNA, 22 bp, Homo sapiens
aggaactggggctattcaccct

SEQ ID NO: 9232097 - DNA, 22 bp, Homo sapiens
aggaagctcggagagggcaaat

SEQ ID NO: 9232098 - DNA, 22 bp, Homo sapiens
aggaagctcctggagagccagt

SEQ ID NO: 9232099 - DNA, 22 bp, Homo sapiens
aggaagctcattttgacatatc

SEQ ID NO: 9232100 - DNA, 22 bp, Homo sapiens
aggaagctcaaagccatgatgt

SEQ ID NO: 9232101 - DNA, 22 bp, Homo sapiens
aggaaccagaggttgagcaact

SEQ ID NO: 9232102 - DNA, 22 bp, Homo sapiens
aggaactgatgagcagccaggg

SEQ ID NO: 9232103 - DNA, 22 bp, Homo sapiens
aggaactgatgagcagccaggg

SEQ ID NO: 9232104 - DNA, 20 bp, Homo sapiens
aggaactggaagggaggaaa

SEQ ID NO: 9232105 - DNA, 23 bp, Homo sapiens
aggaactgcttcatttttgaaag

SEQ ID NO: 9232106 - DNA, 22 bp, Homo sapiens
aggaacaactgattcagtcaac

SEQ ID NO: 9232107 - DNA, 22 bp, Homo sapiens
aggaacaactgattcagtcaac

SEQ ID NO: 9232108 - DNA, 22 bp, Homo sapiens
aggaacaattgataaactcaca

SEQ ID NO: 9232109 - DNA, 22 bp, Homo sapiens
aggaacaagggagccttttctc

SEQ ID NO: 9232110 - DNA, 22 bp, Homo sapiens
aggaaattgagaatcagaataa

SEQ ID NO: 9232111 - DNA, 22 bp, Homo sapiens
aggaaattgggacacagagaaa

SEQ ID NO: 9232112 - DNA, 23 bp, Homo sapiens
cagggccaggcagcagctgtcac

SEQ ID NO: 9232113 - DNA, 22 bp, Homo sapiens
aggaaaggggtaggtgtggacg

SEQ ID NO: 9232114 - DNA, 22 bp, Homo sapiens
aggaaaggggtaggtgtggacg

SEQ ID NO: 9232115 - DNA, 22 bp, Homo sapiens
aggaaaggggtaggtgtggacg

SEQ ID NO: 9232116 - DNA, 22 bp, Homo sapiens
cagggccagcgcccaggcccag

SEQ ID NO: 9232117 - DNA, 21 bp, Homo sapiens
agcttgtgtgtatcacagtgt

SEQ ID NO: 9232118 - DNA, 21 bp, Homo sapiens
agcttgttattaattcagaac

SEQ ID NO: 9232119 - DNA, 22 bp, Homo sapiens
agcttgttggggaaggagaaag

SEQ ID NO: 9232120 - DNA, 22 bp, Homo sapiens
agctttaaaaatccaatatcca

SEQ ID NO: 9232121 - DNA, 22 bp, Homo sapiens
agctttaaagcatatttctaag

SEQ ID NO: 9232122 - DNA, 22 bp, Homo sapiens
agctttaaatcaatccagtgag

SEQ ID NO: 9232123 - DNA, 22 bp, Homo sapiens
aggaaagaagtacattctcatg

SEQ ID NO: 9232124 - DNA, 18 bp, Homo sapiens
aggaaagacgaagagggc

SEQ ID NO: 9232125 - DNA, 22 bp, Homo sapiens
aggaaacggcaaaactgcttag

SEQ ID NO: 9232126 - DNA, 17 bp, Homo sapiens
aggaaacattttctttc

SEQ ID NO: 9232127 - DNA, 22 bp, Homo sapiens
aggaaagctcccagtagggctc

SEQ ID NO: 9232128 - DNA, 21 bp, Homo sapiens
aggaaaggaagtccccagggt

SEQ ID NO: 9232129 - DNA, 21 bp, Homo sapiens
aggaaaggaagtccccagggt

SEQ ID NO: 9232130 - DNA, 22 bp, Homo sapiens
aggaaagactggggccccagaa

SEQ ID NO: 9232131 - DNA, 22 bp, Homo sapiens
aggaaagatggaaggaggataa

SEQ ID NO: 9232132 - DNA, 22 bp, Homo sapiens
aggaaagcaatggctgagaaca

SEQ ID NO: 9232133 - DNA, 22 bp, Homo sapiens
aggaaagcaatggctgagaaca

SEQ ID NO: 9232134 - DNA, 22 bp, Homo sapiens
aggaaagatggaaggaggataa

SEQ ID NO: 9232135 - DNA, 22 bp, Homo sapiens
cagggccagcgcccaggcccag

SEQ ID NO: 9232136 - DNA, 22 bp, Homo sapiens
cagggccagccatcctgctggg

SEQ ID NO: 9232137 - DNA, 23 bp, Homo sapiens
agggagatgccacaaagatgccc

SEQ ID NO: 9232138 - DNA, 22 bp, Homo sapiens
agggagcaaaggtttcagggtt

SEQ ID NO: 9232139 - DNA, 22 bp, Homo sapiens
agggagcagcagccacaggatg

SEQ ID NO: 9232140 - DNA, 22 bp, Homo sapiens
agggagcagcagccacaggatg

SEQ ID NO: 9232141 - DNA, 22 bp, Homo sapiens
agggagcagcagccacaggatg

SEQ ID NO: 9232142 - DNA, 22 bp, Homo sapiens
agggagcagggctcctttgggt

SEQ ID NO: 9232143 - DNA, 22 bp, Homo sapiens
agggagcagggctcctttgggt

SEQ ID NO: 9232144 - DNA, 18 bp, Homo sapiens
agggagcatctggttgcc

SEQ ID NO: 9232145 - DNA, 22 bp, Homo sapiens
agggagcatgggtgaagcaggc

SEQ ID NO: 9232146 - DNA, 18 bp, Homo sapiens
agggagcatctggttgcc

SEQ ID NO: 9232147 - DNA, 22 bp, Homo sapiens
agggagccagagttgggagctc

SEQ ID NO: 9232148 - DNA, 22 bp, Homo sapiens
agggagcatgggtgaagcaggc

SEQ ID NO: 9232149 - DNA, 22 bp, Homo sapiens
agggagcatgggtgaagcaggc

SEQ ID NO: 9232150 - DNA, 21 bp, Homo sapiens
agggagcatgttagctttcga

SEQ ID NO: 9232151 - DNA, 22 bp, Homo sapiens
agggagcatgggtgaagcaggc

SEQ ID NO: 9232152 - DNA, 21 bp, Homo sapiens
agggagcatgttagctttcga

SEQ ID NO: 9232153 - DNA, 22 bp, Homo sapiens
agggagccagagttgggagctc

SEQ ID NO: 9232154 - DNA, 22 bp, Homo sapiens
ccccatgaagtagggtctctga

SEQ ID NO: 9232155 - DNA, 22 bp, Homo sapiens
agggaggaaggaactccttcta

SEQ ID NO: 9232156 - DNA, 19 bp, Homo sapiens
ccccagggtaggctagggg

SEQ ID NO: 9232157 - DNA, 22 bp, Homo sapiens
ccccaggtggatggctcgcata

SEQ ID NO: 9232158 - DNA, 22 bp, Homo sapiens
ccccagggtcagtgtgtggagg

SEQ ID NO: 9232159 - DNA, 22 bp, Homo sapiens
ccccagggactggtttcatgga

SEQ ID NO: 9232160 - DNA, 22 bp, Homo sapiens
ccccagggaagctttgcttact

SEQ ID NO: 9232161 - DNA, 22 bp, Homo sapiens
agggagaggttgaaacctcagt

SEQ ID NO: 9232162 - DNA, 22 bp, Homo sapiens
agggagaggttgaaacctcagt

SEQ ID NO: 9232163 - DNA, 22 bp, Homo sapiens
agggagaaggtttagctgtgag

SEQ ID NO: 9232164 - DNA, 22 bp, Homo sapiens
agggagaatgaccaaggtatat

SEQ ID NO: 9232165 - DNA, 22 bp, Homo sapiens
agggagaatgaccaaggtatat

SEQ ID NO: 9232166 - DNA, 23 bp, Homo sapiens
agggaagggggcttattccacag

SEQ ID NO: 9232167 - DNA, 23 bp, Homo sapiens
agggaagggggcttattccacag

SEQ ID NO: 9232168 - DNA, 22 bp, Homo sapiens
agggaagggcagggtctatgca

SEQ ID NO: 9232169 - DNA, 22 bp, Homo sapiens
aggcttagaaattcagctgagt

SEQ ID NO: 9232170 - DNA, 22 bp, Homo sapiens
agggaaggaaaagctgtcgctt

SEQ ID NO: 9232171 - DNA, 22 bp, Homo sapiens
agggaaggaggccatgtgtccc

SEQ ID NO: 9232172 - DNA, 22 bp, Homo sapiens
agggaaggaaaagctgtcgctt

SEQ ID NO: 9232173 - DNA, 19 bp, Homo sapiens
agggaaggattctgtcatt

SEQ ID NO: 9232174 - DNA, 22 bp, Homo sapiens
agggaaggcttttgacatttcc

SEQ ID NO: 9232175 - DNA, 22 bp, Homo sapiens
agggaaggaggttagaacccac

SEQ ID NO: 9232176 - DNA, 22 bp, Homo sapiens
agggaaggaggttagaacccac

SEQ ID NO: 9232177 - DNA, 22 bp, Homo sapiens
agggaaggaggttagaacccac

SEQ ID NO: 9232178 - DNA, 22 bp, Homo sapiens
cccagcagtggttctcaaactt

SEQ ID NO: 9232179 - DNA, 22 bp, Homo sapiens
cccagcagttgttggtgcacat

SEQ ID NO: 9232180 - DNA, 22 bp, Homo sapiens
cccagcatcccagtgggcagca

SEQ ID NO: 9232181 - DNA, 22 bp, Homo sapiens
cccagcatcctcagggagcggg

SEQ ID NO: 9232182 - DNA, 22 bp, Homo sapiens
cccagcatcccagtgggcagca

SEQ ID NO: 9232183 - DNA, 22 bp, Homo sapiens
cccagcctcagctttacttcca

SEQ ID NO: 9232184 - DNA, 22 bp, Homo sapiens
cccagcatcctcagggagcggg

SEQ ID NO: 9232185 - DNA, 22 bp, Homo sapiens
cccagcagtacccaagcccttg

SEQ ID NO: 9232186 - DNA, 22 bp, Homo sapiens
cccagcagtacccaagcccttg

SEQ ID NO: 9232187 - DNA, 22 bp, Homo sapiens
cccagcagtaaccagtggaaat

SEQ ID NO: 9232188 - DNA, 22 bp, Homo sapiens
cccagcacaggcaattccatac

SEQ ID NO: 9232189 - DNA, 22 bp, Homo sapiens
ccatgagtagcgatttcatttt

SEQ ID NO: 9232190 - DNA, 22 bp, Homo sapiens
ccatctccagtttattcttcct

SEQ ID NO: 9232191 - DNA, 22 bp, Homo sapiens
ccagtttttccagtgctttctg

SEQ ID NO: 9232192 - DNA, 22 bp, Homo sapiens
ccagtttttccagtgctttctg

SEQ ID NO: 9232193 - DNA, 22 bp, Homo sapiens
ccagtttttccagtgctttctg

SEQ ID NO: 9232194 - DNA, 22 bp, Homo sapiens
ccagttttgccatggtaacact

SEQ ID NO: 9232195 - DNA, 21 bp, Homo sapiens
ccataattttgtttcagaagt

SEQ ID NO: 9232196 - DNA, 22 bp, Homo sapiens
ccatcctgtctgtggcctcagg

SEQ ID NO: 9232197 - DNA, 21 bp, Homo sapiens
ccataattttgtttcagaagt

SEQ ID NO: 9232198 - DNA, 21 bp, Homo sapiens
ccataatcttaggatcaaaat

SEQ ID NO: 9232199 - DNA, 22 bp, Homo sapiens
cccagctctgccatctacccac

SEQ ID NO: 9232200 - DNA, 22 bp, Homo sapiens
cccagctctgccatctacccac

SEQ ID NO: 9232201 - DNA, 22 bp, Homo sapiens
cccagctctggaaggtggggga

SEQ ID NO: 9232202 - DNA, 22 bp, Homo sapiens
cccagctctggaaggtggggga

SEQ ID NO: 9232203 - DNA, 22 bp, Homo sapiens
cccagctctgcagacctgccct

SEQ ID NO: 9232204 - DNA, 22 bp, Homo sapiens
cccagctctgcagacctgccct

SEQ ID NO: 9232205 - DNA, 22 bp, Homo sapiens
cccagctctgcagacctgccct

SEQ ID NO: 9232206 - DNA, 22 bp, Homo sapiens
cccagctctgcagacctgccct

SEQ ID NO: 9232207 - DNA, 22 bp, Homo sapiens
cccagctctgcagacctgccct

SEQ ID NO: 9232208 - DNA, 22 bp, Homo sapiens
cccagctctgccatctacccac

SEQ ID NO: 9232209 - DNA, 22 bp, Homo sapiens
cccagctctctgctcttagcct

SEQ ID NO: 9232210 - DNA, 22 bp, Homo sapiens
cccagctctctcagttctgctt

SEQ ID NO: 9232211 - DNA, 22 bp, Homo sapiens
cccagctctctcagttctgctt

SEQ ID NO: 9232212 - DNA, 22 bp, Homo sapiens
cccagctctctgctcttagcct

SEQ ID NO: 9232213 - DNA, 22 bp, Homo sapiens
cccagctctctgctcttagcct

SEQ ID NO: 9232214 - DNA, 22 bp, Homo sapiens
cccagctctctgctcttagcct

SEQ ID NO: 9232215 - DNA, 22 bp, Homo sapiens
cccagctctcgcacttactagc

SEQ ID NO: 9232216 - DNA, 22 bp, Homo sapiens
cccagctctcgcacttactagc

SEQ ID NO: 9232217 - DNA, 19 bp, Homo sapiens
cccagctctcgtggtgtgc

SEQ ID NO: 9232218 - DNA, 22 bp, Homo sapiens
cccagctctcgcacttactagc

SEQ ID NO: 9232219 - DNA, 22 bp, Homo sapiens
cccagctctctcagttctgctt

SEQ ID NO: 9232220 - DNA, 19 bp, Homo sapiens
cccagctctcgtggtgtgc

SEQ ID NO: 9232221 - DNA, 22 bp, Homo sapiens
aggctgtgtttcccctggagct

SEQ ID NO: 9232222 - DNA, 22 bp, Homo sapiens
aggcttaatgagttaaatcact

SEQ ID NO: 9232223 - DNA, 22 bp, Homo sapiens
aggcttaaatgctcatatcagt

SEQ ID NO: 9232224 - DNA, 22 bp, Homo sapiens
aggctgtgtggtcatggtggct

SEQ ID NO: 9232225 - DNA, 22 bp, Homo sapiens
aggctgtgtttaagtggtaatg

SEQ ID NO: 9232226 - DNA, 22 bp, Homo sapiens
aggctgtgtttcccctggagct

SEQ ID NO: 9232227 - DNA, 22 bp, Homo sapiens
cccagcctctgggctcacccaa

SEQ ID NO: 9232228 - DNA, 22 bp, Homo sapiens
cccagcctctgtttgctcctct

SEQ ID NO: 9232229 - DNA, 22 bp, Homo sapiens
cccagctctaggagtggtggca

SEQ ID NO: 9232230 - DNA, 22 bp, Homo sapiens
cccagctcgccgccgatgtgcg

SEQ ID NO: 9232231 - DNA, 22 bp, Homo sapiens
cccagctcgccgccgatgtgcg

SEQ ID NO: 9232232 - DNA, 22 bp, Homo sapiens
cccagctcgccgccgatgtgcg

SEQ ID NO: 9232233 - DNA, 22 bp, Homo sapiens
cccagctccttgtttgcatctc

SEQ ID NO: 9232234 - DNA, 22 bp, Homo sapiens
cccagctccttgtttgcatctc

SEQ ID NO: 9232235 - DNA, 22 bp, Homo sapiens
cccagctccttggatgggcagg

SEQ ID NO: 9232236 - DNA, 22 bp, Homo sapiens
cccagctccttggatgggcagg

SEQ ID NO: 9232237 - DNA, 22 bp, Homo sapiens
cccagctccttggatgggcagg

SEQ ID NO: 9232238 - DNA, 22 bp, Homo sapiens
cccagctccttggatgggcagg

SEQ ID NO: 9232239 - DNA, 19 bp, Homo sapiens
ccctgggggtttctggtac

SEQ ID NO: 9232240 - DNA, 22 bp, Homo sapiens
ccctggggctgagggatggccg

SEQ ID NO: 9232241 - DNA, 22 bp, Homo sapiens
ccctggggctgagggatggccg

SEQ ID NO: 9232242 - DNA, 22 bp, Homo sapiens
ccctgggttctggctgggctgc

SEQ ID NO: 9232243 - DNA, 18 bp, Homo sapiens
cccttagcctttcctctc

SEQ ID NO: 9232244 - DNA, 22 bp, Homo sapiens
cccttagccaggaaatcgacct

SEQ ID NO: 9232245 - DNA, 21 bp, Homo sapiens
ccctgtgttccacagcagaca

SEQ ID NO: 9232246 - DNA, 21 bp, Homo sapiens
ccctgtgttccacagcagaca

SEQ ID NO: 9232247 - DNA, 22 bp, Homo sapiens
ccctgttaatgtcaacctgcct

SEQ ID NO: 9232248 - DNA, 22 bp, Homo sapiens
cccttcagggttaagtagaggg

SEQ ID NO: 9232249 - DNA, 23 bp, Homo sapiens
cccttcagcgagggcattaaggt

SEQ ID NO: 9232250 - DNA, 22 bp, Homo sapiens
cccttagctcacaagctaaagc

SEQ ID NO: 9232251 - DNA, 22 bp, Homo sapiens
cccttagctcaatttcttgccc

SEQ ID NO: 9232252 - DNA, 22 bp, Homo sapiens
cccttagctggtgagcccagcg

SEQ ID NO: 9232253 - DNA, 22 bp, Homo sapiens
cccttagctccaaggggtttgg

SEQ ID NO: 9232254 - DNA, 22 bp, Homo sapiens
cctcaagtcaattctgtctcgc

SEQ ID NO: 9232255 - DNA, 20 bp, Homo sapiens
cctcaagcagactgacagct

SEQ ID NO: 9232256 - DNA, 19 bp, Homo sapiens
cctcaagtatgaagaggcc

SEQ ID NO: 9232257 - DNA, 18 bp, Homo sapiens
cctcacagacttccatgt

SEQ ID NO: 9232258 - DNA, 22 bp, Homo sapiens
cctcacacagttatctcttcat

SEQ ID NO: 9232259 - DNA, 22 bp, Homo sapiens
cctcagagacagtaactggaat

SEQ ID NO: 9232260 - DNA, 22 bp, Homo sapiens
cctcagagactgcatcttccct

SEQ ID NO: 9232261 - DNA, 22 bp, Homo sapiens
cctcccatggagctctgtccat

SEQ ID NO: 9232262 - DNA, 22 bp, Homo sapiens
cctccccacagcccaggagact

SEQ ID NO: 9232263 - DNA, 22 bp, Homo sapiens
cctccccacaggccaaataggc

SEQ ID NO: 9232264 - DNA, 22 bp, Homo sapiens
cctctccttgcacccgtcccgc

SEQ ID NO: 9232265 - DNA, 22 bp, Homo sapiens
cctctccttgcacccgtcccgc

SEQ ID NO: 9232266 - DNA, 22 bp, Homo sapiens
cctctctcagcttgctgcaact

SEQ ID NO: 9232267 - DNA, 22 bp, Homo sapiens
cctccccacccacggctggtgg

SEQ ID NO: 9232268 - DNA, 21 bp, Homo sapiens
cctccaggagcagagccctga

SEQ ID NO: 9232269 - DNA, 21 bp, Homo sapiens
cctccaggagcagagccctga

SEQ ID NO: 9232270 - DNA, 22 bp, Homo sapiens
cctccaggaacttgagagacac

SEQ ID NO: 9232271 - DNA, 22 bp, Homo sapiens
cctccaggaggaaatggaacac

SEQ ID NO: 9232272 - DNA, 22 bp, Homo sapiens
cctccagctgcctcagtctctt

SEQ ID NO: 9232273 - DNA, 22 bp, Homo sapiens
cctccaggaacttgagagacac

SEQ ID NO: 9232274 - DNA, 22 bp, Homo sapiens
cctcagtgacctattgcattca

SEQ ID NO: 9232275 - DNA, 22 bp, Homo sapiens
cctcagtcttgaattagccaga

SEQ ID NO: 9232276 - DNA, 22 bp, Homo sapiens
cctccagctgcctcagtctctt

SEQ ID NO: 9232277 - DNA, 22 bp, Homo sapiens
cctccagctgcctcagtctctt

SEQ ID NO: 9232278 - DNA, 20 bp, Homo sapiens
cctccaggcacacccatgtg

SEQ ID NO: 9232279 - DNA, 22 bp, Homo sapiens
cctccaggataagtcagggcct

SEQ ID NO: 9232280 - DNA, 22 bp, Homo sapiens
cctccaggataagtcagggcct

SEQ ID NO: 9232281 - DNA, 22 bp, Homo sapiens
cctccaggataagtcagggcct

SEQ ID NO: 9232282 - DNA, 22 bp, Homo sapiens
cctccaggctgaatatctagaa

SEQ ID NO: 9232283 - DNA, 22 bp, Homo sapiens
agggccaggatcacagccaaga

SEQ ID NO: 9232284 - DNA, 19 bp, Homo sapiens
agggccaggattctggaac

SEQ ID NO: 9232285 - DNA, 19 bp, Homo sapiens
agggccaggattctggaac

SEQ ID NO: 9232286 - DNA, 22 bp, Homo sapiens
agggccaggctcccatgtcagg

SEQ ID NO: 9232287 - DNA, 22 bp, Homo sapiens
agggccaggatcacagccaaga

SEQ ID NO: 9232288 - DNA, 22 bp, Homo sapiens
agggccaggaacacctgaaggg

SEQ ID NO: 9232289 - DNA, 22 bp, Homo sapiens
agggccaggaacacctgaaggg

SEQ ID NO: 9232290 - DNA, 18 bp, Homo sapiens
agggccagctgtgagtag

SEQ ID NO: 9232291 - DNA, 18 bp, Homo sapiens
agggccagctgtgagtag

SEQ ID NO: 9232292 - DNA, 22 bp, Homo sapiens
agggccaggaacacctgaaggg

SEQ ID NO: 9232293 - DNA, 22 bp, Homo sapiens
agggccaggaacacctgaaggg

SEQ ID NO: 9232294 - DNA, 22 bp, Homo sapiens
agggccagccgacttccagcct

SEQ ID NO: 9232295 - DNA, 22 bp, Homo sapiens
agggccagccgacttccagcct

SEQ ID NO: 9232296 - DNA, 22 bp, Homo sapiens
agggccagctagagccctcgcc

SEQ ID NO: 9232297 - DNA, 22 bp, Homo sapiens
agggccagctagagccctcgcc

SEQ ID NO: 9232298 - DNA, 22 bp, Homo sapiens
agggccagctagagccctcgcc

SEQ ID NO: 9232299 - DNA, 22 bp, Homo sapiens
agggccagctagagccctcgcc

SEQ ID NO: 9232300 - DNA, 22 bp, Homo sapiens
agggccagctgatgagaatgag

SEQ ID NO: 9232301 - DNA, 22 bp, Homo sapiens
agggccagctgcagaattagca

SEQ ID NO: 9232302 - DNA, 22 bp, Homo sapiens
agggccagctgcagaattagca

SEQ ID NO: 9232303 - DNA, 18 bp, Homo sapiens
agggccagctgtgagtag

SEQ ID NO: 9232304 - DNA, 22 bp, Homo sapiens
agggccagctgatgagaatgag

SEQ ID NO: 9232305 - DNA, 22 bp, Homo sapiens
ccctggggagcaggcgaaggag

SEQ ID NO: 9232306 - DNA, 22 bp, Homo sapiens
ccctggggagcaggcgaaggag

SEQ ID NO: 9232307 - DNA, 22 bp, Homo sapiens
ccctgggctcagagcaggtagc

SEQ ID NO: 9232308 - DNA, 22 bp, Homo sapiens
ccctgggcaagccctattttcc

SEQ ID NO: 9232309 - DNA, 22 bp, Homo sapiens
ccctgggattgccttggccttg

SEQ ID NO: 9232310 - DNA, 22 bp, Homo sapiens
ccctgggcagtctgcacttcag

SEQ ID NO: 9232311 - DNA, 22 bp, Homo sapiens
agggccagggaagctgtatttt

SEQ ID NO: 9232312 - DNA, 22 bp, Homo sapiens
ccctggcccctcactccgaggc

SEQ ID NO: 9232313 - DNA, 22 bp, Homo sapiens
ccctgggatggattggcaggaa

SEQ ID NO: 9232314 - DNA, 22 bp, Homo sapiens
ccctggcccctcactccgaggc

SEQ ID NO: 9232315 - DNA, 22 bp, Homo sapiens
agggccagggaaacgatcagca

SEQ ID NO: 9232316 - DNA, 22 bp, Homo sapiens
agggccaggctcccatgtcagg

SEQ ID NO: 9232317 - DNA, 22 bp, Homo sapiens
agggaggaccaatgtgtggtta

SEQ ID NO: 9232318 - DNA, 22 bp, Homo sapiens
agggaggagaatggactccttc

SEQ ID NO: 9232319 - DNA, 22 bp, Homo sapiens
agggaggagaatggactccttc

SEQ ID NO: 9232320 - DNA, 22 bp, Homo sapiens
agggaggaaggatgttccaaag

SEQ ID NO: 9232321 - DNA, 22 bp, Homo sapiens
agggaggagaatggactccttc

SEQ ID NO: 9232322 - DNA, 22 bp, Homo sapiens
agggcagagggtgcctcacctg

SEQ ID NO: 9232323 - DNA, 22 bp, Homo sapiens
agggcagcattgcctttctcca

SEQ ID NO: 9232324 - DNA, 22 bp, Homo sapiens
agggccagagtctgtgtagata

SEQ ID NO: 9232325 - DNA, 22 bp, Homo sapiens
agggccagagtggcaaaagcct

SEQ ID NO: 9232326 - DNA, 22 bp, Homo sapiens
agggccagccccaccctctctg

SEQ ID NO: 9232327 - DNA, 22 bp, Homo sapiens
agggcagctgtgagccactgtg

SEQ ID NO: 9232328 - DNA, 22 bp, Homo sapiens
agggcagcctgagtgctggccc

SEQ ID NO: 9232329 - DNA, 22 bp, Homo sapiens
agggcagctagctgtagaaaga

SEQ ID NO: 9232330 - DNA, 22 bp, Homo sapiens
agggcagcctctcagcctaggt

SEQ ID NO: 9232331 - DNA, 22 bp, Homo sapiens
agggcagcccttctgggagggc

SEQ ID NO: 9232332 - DNA, 22 bp, Homo sapiens
agggcagcctctcagcctaggt

SEQ ID NO: 9232333 - DNA, 22 bp, Homo sapiens
aggccacaagaaaatgcttcat

SEQ ID NO: 9232334 - DNA, 22 bp, Homo sapiens
aggccacaaccaccctgtgccc

SEQ ID NO: 9232335 - DNA, 22 bp, Homo sapiens
aggccacaagaaaatgcttcat

SEQ ID NO: 9232336 - DNA, 22 bp, Homo sapiens
aggccacaagaaaatgcttcat

SEQ ID NO: 9232337 - DNA, 22 bp, Homo sapiens
aggccagcttccagaggggcag

SEQ ID NO: 9232338 - DNA, 22 bp, Homo sapiens
aggccagctgttactagagcca

SEQ ID NO: 9232339 - DNA, 22 bp, Homo sapiens
aggccagctcaccctggctcct

SEQ ID NO: 9232340 - DNA, 22 bp, Homo sapiens
aggccaagtagccgctgtccta

SEQ ID NO: 9232341 - DNA, 22 bp, Homo sapiens
aggccaagtagctagcattgaa

SEQ ID NO: 9232342 - DNA, 22 bp, Homo sapiens
aggccaagggcaaagcggagag

SEQ ID NO: 9232343 - DNA, 22 bp, Homo sapiens
aggccaagtgctgggacaggtg

SEQ ID NO: 9232344 - DNA, 22 bp, Homo sapiens
aggccaagttacttgggaaagc

SEQ ID NO: 9232345 - DNA, 22 bp, Homo sapiens
aggccacaaccaccctgtgccc

SEQ ID NO: 9232346 - DNA, 22 bp, Homo sapiens
aggccaagattttggatcagct

SEQ ID NO: 9232347 - DNA, 22 bp, Homo sapiens
aggccaagctcccagagaagct

SEQ ID NO: 9232348 - DNA, 22 bp, Homo sapiens
aggccaagctcccagagaagct

SEQ ID NO: 9232349 - DNA, 22 bp, Homo sapiens
aggccaaagcacagagctggaa

SEQ ID NO: 9232350 - DNA, 22 bp, Homo sapiens
aggcattttgttcaagatgaca

SEQ ID NO: 9232351 - DNA, 22 bp, Homo sapiens
aggcattttcactgatgtcatc

SEQ ID NO: 9232352 - DNA, 20 bp, Homo sapiens
aggccaggaaatgtagttct

SEQ ID NO: 9232353 - DNA, 20 bp, Homo sapiens
aggccaggaaatgtagttct

SEQ ID NO: 9232354 - DNA, 22 bp, Homo sapiens
aggccaggacacttaagtaaga

SEQ ID NO: 9232355 - DNA, 22 bp, Homo sapiens
aggccaggaatccttgtcccag

SEQ ID NO: 9232356 - DNA, 22 bp, Homo sapiens
aggccaggaccattagcccaga

SEQ ID NO: 9232357 - DNA, 22 bp, Homo sapiens
aggccaggacacttaagtaaga

SEQ ID NO: 9232358 - DNA, 22 bp, Homo sapiens
aggccaggatagcatggatcag

SEQ ID NO: 9232359 - DNA, 22 bp, Homo sapiens
aggccaggatagcatggatcag

SEQ ID NO: 9232360 - DNA, 22 bp, Homo sapiens
aggcccagtagtcgacggcgct

SEQ ID NO: 9232361 - DNA, 22 bp, Homo sapiens
aggcccagtagtgctgccttta

SEQ ID NO: 9232362 - DNA, 22 bp, Homo sapiens
aggccgaagtggatgggcatct

SEQ ID NO: 9232363 - DNA, 22 bp, Homo sapiens
aggccctgaagtcggcccctca

SEQ ID NO: 9232364 - DNA, 22 bp, Homo sapiens
aggccctgacctgggagatcta

SEQ ID NO: 9232365 - DNA, 22 bp, Homo sapiens
aggccctgaagtcggcccctca

SEQ ID NO: 9232366 - DNA, 22 bp, Homo sapiens
aggccctcacagtctattgtga

SEQ ID NO: 9232367 - DNA, 22 bp, Homo sapiens
aggccctattcaatggggccca

SEQ ID NO: 9232368 - DNA, 22 bp, Homo sapiens
aggcccatgttcacttgctcag

SEQ ID NO: 9232369 - DNA, 22 bp, Homo sapiens
aggcccatgtgagtcttgtcct

SEQ ID NO: 9232370 - DNA, 22 bp, Homo sapiens
aggcccagttatcctacttgtt

SEQ ID NO: 9232371 - DNA, 20 bp, Homo sapiens
aggccccaggaaactctcag

SEQ ID NO: 9232372 - DNA, 22 bp, Homo sapiens
aggcccccacaggcttgaggca

SEQ ID NO: 9232373 - DNA, 22 bp, Homo sapiens
aggcagcctatggggagctcag

SEQ ID NO: 9232374 - DNA, 22 bp, Homo sapiens
aggcagcctggtttgaatggaa

SEQ ID NO: 9232375 - DNA, 22 bp, Homo sapiens
aggcagcccacaggacacagga

SEQ ID NO: 9232376 - DNA, 19 bp, Homo sapiens
aggcagtcattggaatata

SEQ ID NO: 9232377 - DNA, 22 bp, Homo sapiens
aggcagcctttagacagtctgc

SEQ ID NO: 9232378 - DNA, 18 bp, Homo sapiens
aggcaggtgctggaagtc

SEQ ID NO: 9232379 - DNA, 22 bp, Homo sapiens
aggcagtgctcaagacagcagc

SEQ ID NO: 9232380 - DNA, 22 bp, Homo sapiens
aggcagtgctcaagacagcagc

SEQ ID NO: 9232381 - DNA, 22 bp, Homo sapiens
aggcagtgcctggaccccagct

SEQ ID NO: 9232382 - DNA, 22 bp, Homo sapiens
aggcagtgctcaagacagcagc

SEQ ID NO: 9232383 - DNA, 22 bp, Homo sapiens
aggcagtgcagagtcctcttct

SEQ ID NO: 9232384 - DNA, 22 bp, Homo sapiens
aggcagtgcagagtcctcttct

SEQ ID NO: 9232385 - DNA, 22 bp, Homo sapiens
aggcagtggagctggaataggc

SEQ ID NO: 9232386 - DNA, 22 bp, Homo sapiens
aggcagtggagctggaataggc

SEQ ID NO: 9232387 - DNA, 22 bp, Homo sapiens
ccactggcatccagctgccatc

SEQ ID NO: 9232388 - DNA, 22 bp, Homo sapiens
ccactggcagttggctagcctt

SEQ ID NO: 9232389 - DNA, 22 bp, Homo sapiens
ccactggctgtcagcaggactc

SEQ ID NO: 9232390 - DNA, 22 bp, Homo sapiens
ccactggcatccagctgccatc

SEQ ID NO: 9232391 - DNA, 22 bp, Homo sapiens
ccactggaagatgctgaggtca

SEQ ID NO: 9232392 - DNA, 19 bp, Homo sapiens
ccactggggctccacatta

SEQ ID NO: 9232393 - DNA, 22 bp, Homo sapiens
ccactgggcgtttctgtccaat

SEQ ID NO: 9232394 - DNA, 22 bp, Homo sapiens
ccactggcttttcctaggtctc

SEQ ID NO: 9232395 - DNA, 22 bp, Homo sapiens
aggcattctagaagtagaagta

SEQ ID NO: 9232396 - DNA, 22 bp, Homo sapiens
aggcatgtgaccctggactcag

SEQ ID NO: 9232397 - DNA, 22 bp, Homo sapiens
aggcatgactttggctgaagaa

SEQ ID NO: 9232398 - DNA, 22 bp, Homo sapiens
ccactgctagagatgcatcccc

SEQ ID NO: 9232399 - DNA, 22 bp, Homo sapiens
aggcatctgagtttgcaagctt

SEQ ID NO: 9232400 - DNA, 20 bp, Homo sapiens
aggcatctgagtcacatctt

SEQ ID NO: 9232401 - DNA, 22 bp, Homo sapiens
aggcatctgcagagcttggtga

SEQ ID NO: 9232402 - DNA, 22 bp, Homo sapiens
aggcatctgcctcctctacccc

SEQ ID NO: 9232403 - DNA, 22 bp, Homo sapiens
aggcatctgagtttgcaagctt

SEQ ID NO: 9232404 - DNA, 22 bp, Homo sapiens
aggcatctgctgcccttctgga

SEQ ID NO: 9232405 - DNA, 22 bp, Homo sapiens
aggcatctaacagagatcttta

SEQ ID NO: 9232406 - DNA, 21 bp, Homo sapiens
aggcatctaaagagagtagac

SEQ ID NO: 9232407 - DNA, 22 bp, Homo sapiens
aggcatctctctgcttctgagc

SEQ ID NO: 9232408 - DNA, 20 bp, Homo sapiens
aggcatctgagtcacatctt

SEQ ID NO: 9232409 - DNA, 22 bp, Homo sapiens
aggcagttgtagagagggctct

SEQ ID NO: 9232410 - DNA, 22 bp, Homo sapiens
aggcatcaggagtatagccaga

SEQ ID NO: 9232411 - DNA, 22 bp, Homo sapiens
aggcagttctcgtgtgtgtccc

SEQ ID NO: 9232412 - DNA, 22 bp, Homo sapiens
aggctgaggcaggtggatcact

SEQ ID NO: 9232413 - DNA, 22 bp, Homo sapiens
aggctgaggcaggtggatcact

SEQ ID NO: 9232414 - DNA, 22 bp, Homo sapiens
aggctgaggcaggtggatcatt

SEQ ID NO: 9232415 - DNA, 22 bp, Homo sapiens
aggctgaggcaggtggatcact

SEQ ID NO: 9232416 - DNA, 22 bp, Homo sapiens
aggctgaggcaggtggatcact

SEQ ID NO: 9232417 - DNA, 22 bp, Homo sapiens
aggctgaggcaggtggatcact

SEQ ID NO: 9232418 - DNA, 22 bp, Homo sapiens
aggctgaggcaggtggatcact

SEQ ID NO: 9232419 - DNA, 22 bp, Homo sapiens
aggctgaggcaggtggatcatt

SEQ ID NO: 9232420 - DNA, 22 bp, Homo sapiens
aggctgaggcaggtggatcatt

SEQ ID NO: 9232421 - DNA, 22 bp, Homo sapiens
aggctgaggcaggtggatcatt

SEQ ID NO: 9232422 - DNA, 22 bp, Homo sapiens
aggctgaggcaggtggatcatt

SEQ ID NO: 9232423 - DNA, 22 bp, Homo sapiens
aggctgaggcgggaggatcact

SEQ ID NO: 9232424 - DNA, 22 bp, Homo sapiens
aggctgaggcaggtggatcatt

SEQ ID NO: 9232425 - DNA, 22 bp, Homo sapiens
aggctgaggcgggaggatcact

SEQ ID NO: 9232426 - DNA, 22 bp, Homo sapiens
aggctgaggcgggaggatcact

SEQ ID NO: 9232427 - DNA, 22 bp, Homo sapiens
aggctgaggcgggaggatcact

SEQ ID NO: 9232428 - DNA, 22 bp, Homo sapiens
aggctgaggcgggaggatcact

SEQ ID NO: 9232429 - DNA, 22 bp, Homo sapiens
aggctgaggcgggaggatcact

SEQ ID NO: 9232430 - DNA, 22 bp, Homo sapiens
ccagtgtgcattatcatgtgtc

SEQ ID NO: 9232431 - DNA, 22 bp, Homo sapiens
ccagtgtgcattatcatgtgtc

SEQ ID NO: 9232432 - DNA, 22 bp, Homo sapiens
ccagttctttctgtgtgcaaca

SEQ ID NO: 9232433 - DNA, 22 bp, Homo sapiens
ccagttctgagatgaatatcca

SEQ ID NO: 9232434 - DNA, 22 bp, Homo sapiens
ccagttctaaacataaagctaa

SEQ ID NO: 9232435 - DNA, 23 bp, Homo sapiens
aggctgagctctcccagcttcag

SEQ ID NO: 9232436 - DNA, 23 bp, Homo sapiens
aggctgagctctcccagcttcag

SEQ ID NO: 9232437 - DNA, 22 bp, Homo sapiens
aggctgagcggggtcccagagc

SEQ ID NO: 9232438 - DNA, 23 bp, Homo sapiens
aggctgagctctcccagcttcag

SEQ ID NO: 9232439 - DNA, 22 bp, Homo sapiens
aggctgagcggggtcccagagc

SEQ ID NO: 9232440 - DNA, 22 bp, Homo sapiens
aggctgagcggggtcccagagc

SEQ ID NO: 9232441 - DNA, 22 bp, Homo sapiens
aggctgagcggggtcccagagc

SEQ ID NO: 9232442 - DNA, 22 bp, Homo sapiens
aggctgagcctgggcgtggtgg

SEQ ID NO: 9232443 - DNA, 22 bp, Homo sapiens
aggctgagcctgggcgtggtgg

SEQ ID NO: 9232444 - DNA, 22 bp, Homo sapiens
aggctgagcggggtcccagagc

SEQ ID NO: 9232445 - DNA, 22 bp, Homo sapiens
aggctgagctgacctggtttgg

SEQ ID NO: 9232446 - DNA, 23 bp, Homo sapiens
aggctgagctctcccagcttcag

SEQ ID NO: 9232447 - DNA, 22 bp, Homo sapiens
ccagtctgtactttgctctgtt

SEQ ID NO: 9232448 - DNA, 22 bp, Homo sapiens
ccagtctgtactttgctctgtt

SEQ ID NO: 9232449 - DNA, 22 bp, Homo sapiens
ccagtctgtgtgccagcctgcg

SEQ ID NO: 9232450 - DNA, 22 bp, Homo sapiens
ccagtctgtgtgccagcctgcg

SEQ ID NO: 9232451 - DNA, 22 bp, Homo sapiens
ccagtctgtgtgccagcctgcg

SEQ ID NO: 9232452 - DNA, 22 bp, Homo sapiens
ccagtctgtgtgccagcctgcg

SEQ ID NO: 9232453 - DNA, 22 bp, Homo sapiens
ccagtctgttctcacctctgag

SEQ ID NO: 9232454 - DNA, 22 bp, Homo sapiens
ccagtgcacagccaggcaggtg

SEQ ID NO: 9232455 - DNA, 22 bp, Homo sapiens
ccagtgcacagccaggcaggtg

SEQ ID NO: 9232456 - DNA, 23 bp, Homo sapiens
ccagtgattgcctggaaggaggt

SEQ ID NO: 9232457 - DNA, 20 bp, Homo sapiens
aggctctgcctgcaggccca

SEQ ID NO: 9232458 - DNA, 22 bp, Homo sapiens
aggctctgccaattccttcctc

SEQ ID NO: 9232459 - DNA, 22 bp, Homo sapiens
aggctctgccaattccttcctc

SEQ ID NO: 9232460 - DNA, 20 bp, Homo sapiens
aggctctgcatttctgagtg

SEQ ID NO: 9232461 - DNA, 22 bp, Homo sapiens
aggctgagagcaacgtgtcaga

SEQ ID NO: 9232462 - DNA, 22 bp, Homo sapiens
aggctgagagcaacgtgtcaga

SEQ ID NO: 9232463 - DNA, 22 bp, Homo sapiens
aggctgagagcaacgtgtcaga

SEQ ID NO: 9232464 - DNA, 22 bp, Homo sapiens
aggctgagactgtgcattagtg

SEQ ID NO: 9232465 - DNA, 22 bp, Homo sapiens
aggctgagactgtgcattagtg

SEQ ID NO: 9232466 - DNA, 22 bp, Homo sapiens
aggctgagcctgggcgtggtgg

SEQ ID NO: 9232467 - DNA, 22 bp, Homo sapiens
aggctgagccacggggctggct

SEQ ID NO: 9232468 - DNA, 22 bp, Homo sapiens
aggctgagccacggggctggct

SEQ ID NO: 9232469 - DNA, 22 bp, Homo sapiens
aggctgagccacggggctggct

SEQ ID NO: 9232470 - DNA, 22 bp, Homo sapiens
aggctgagccacggggctggct

SEQ ID NO: 9232471 - DNA, 22 bp, Homo sapiens
aggctgagcaaagggccttacc

SEQ ID NO: 9232472 - DNA, 22 bp, Homo sapiens
aggctgagataggtggatcatt

SEQ ID NO: 9232473 - DNA, 22 bp, Homo sapiens
aggctgagagcaacgtgtcaga

SEQ ID NO: 9232474 - DNA, 22 bp, Homo sapiens
aggctgagataggtggatcatt

SEQ ID NO: 9232475 - DNA, 22 bp, Homo sapiens
aggctgagataggtggatcatt

SEQ ID NO: 9232476 - DNA, 22 bp, Homo sapiens
aggctgagcaaagggccttacc

SEQ ID NO: 9232477 - DNA, 22 bp, Homo sapiens
aggctgagcaaagggccttacc

SEQ ID NO: 9232478 - DNA, 22 bp, Homo sapiens
aggctgagataggtggatcatt

SEQ ID NO: 9232479 - DNA, 22 bp, Homo sapiens
aggctgagataggtggatcatt

SEQ ID NO: 9232480 - DNA, 22 bp, Homo sapiens
aggctgagataggtggatcatt

SEQ ID NO: 9232481 - DNA, 22 bp, Homo sapiens
aggctctgcagaccccagctgt

SEQ ID NO: 9232482 - DNA, 22 bp, Homo sapiens
aggctctgcagtccatcccgtg

SEQ ID NO: 9232483 - DNA, 22 bp, Homo sapiens
aggctctgcagtccatcccgtg

SEQ ID NO: 9232484 - DNA, 22 bp, Homo sapiens
aggctctgcagtccatcccgtg

SEQ ID NO: 9232485 - DNA, 22 bp, Homo sapiens
aggctctgcagtgctggaggac

SEQ ID NO: 9232486 - DNA, 20 bp, Homo sapiens
aggctctgcatttctgagtg

SEQ ID NO: 9232487 - DNA, 22 bp, Homo sapiens
aggctctgcatccaggctttat

SEQ ID NO: 9232488 - DNA, 22 bp, Homo sapiens
aggctctgatcaggtggctgtg

SEQ ID NO: 9232489 - DNA, 22 bp, Homo sapiens
aggctctgagtctggtgtctgc

SEQ ID NO: 9232490 - DNA, 22 bp, Homo sapiens
aggctctgagtagagctgccag

SEQ ID NO: 9232491 - DNA, 22 bp, Homo sapiens
aggctctgaggcagattttcgt

SEQ ID NO: 9232492 - DNA, 19 bp, Homo sapiens
aggctctgagctcctggag

SEQ ID NO: 9232493 - DNA, 22 bp, Homo sapiens
aggcctagaggaatggccaggg

SEQ ID NO: 9232494 - DNA, 22 bp, Homo sapiens
aggcctcacattgggcttcaag

SEQ ID NO: 9232495 - DNA, 22 bp, Homo sapiens
aggcctcagcctgccaggcctg

SEQ ID NO: 9232496 - DNA, 22 bp, Homo sapiens
aggcctccagccacatgccagt

SEQ ID NO: 9232497 - DNA, 22 bp, Homo sapiens
aggcctcattgcccacctgtgg

SEQ ID NO: 9232498 - DNA, 22 bp, Homo sapiens
ccaggcatcacgggcatgtggc

SEQ ID NO: 9232499 - DNA, 22 bp, Homo sapiens
ccaggcatccattgcttcctct

SEQ ID NO: 9232500 - DNA, 21 bp, Homo sapiens
ccaggcatgactgcagagagc

SEQ ID NO: 9232501 - DNA, 22 bp, Homo sapiens
ccaggcagtcagggttgtgtgt

SEQ ID NO: 9232502 - DNA, 22 bp, Homo sapiens
ccaggcattgtgagtgggcagg

SEQ ID NO: 9232503 - DNA, 22 bp, Homo sapiens
ccaggccaaattcagtcagcag

SEQ ID NO: 9232504 - DNA, 22 bp, Homo sapiens
ccaggccaaattcagtcagcag

SEQ ID NO: 9232505 - DNA, 22 bp, Homo sapiens
ccaggcagggctcaaggaacct

SEQ ID NO: 9232506 - DNA, 23 bp, Homo sapiens
ccaggcagtagctattgaagtga

SEQ ID NO: 9232507 - DNA, 22 bp, Homo sapiens
aggctccatgcaaaggctgttt

SEQ ID NO: 9232508 - DNA, 22 bp, Homo sapiens
aggctccatgcaaaggctgttt

SEQ ID NO: 9232509 - DNA, 22 bp, Homo sapiens
ccaggcctagcccctgagggta

SEQ ID NO: 9232510 - DNA, 22 bp, Homo sapiens
ccaggcctcacctgcccaccta

SEQ ID NO: 9232511 - DNA, 22 bp, Homo sapiens
ccaggccctgctcctcacacca

SEQ ID NO: 9232512 - DNA, 22 bp, Homo sapiens
ccaggccctgctcctcacacca

SEQ ID NO: 9232513 - DNA, 22 bp, Homo sapiens
ccaggccctgcctgtggttcct

SEQ ID NO: 9232514 - DNA, 22 bp, Homo sapiens
ccaggcccgttcccttctccag

SEQ ID NO: 9232515 - DNA, 22 bp, Homo sapiens
ccaggcccttgcaagtcccacc

SEQ ID NO: 9232516 - DNA, 22 bp, Homo sapiens
ccaggccctgctcctcacacca

SEQ ID NO: 9232517 - DNA, 22 bp, Homo sapiens
ccaggcctagcccctgagggta

SEQ ID NO: 9232518 - DNA, 22 bp, Homo sapiens
ccaggctctgagcctcactctt

SEQ ID NO: 9232519 - DNA, 22 bp, Homo sapiens
ccaggctctgagcctcactctt

SEQ ID NO: 9232520 - DNA, 22 bp, Homo sapiens
ccaggctctgagaggaatgtga

SEQ ID NO: 9232521 - DNA, 22 bp, Homo sapiens
ccaggctctgcgctggacatgg

SEQ ID NO: 9232522 - DNA, 22 bp, Homo sapiens
aggctccttgctcacaggctca

SEQ ID NO: 9232523 - DNA, 22 bp, Homo sapiens
aggctccttgctcacaggctca

SEQ ID NO: 9232524 - DNA, 22 bp, Homo sapiens
ccaggctctgcaaaatcaggct

SEQ ID NO: 9232525 - DNA, 22 bp, Homo sapiens
aggctcccaagcactgacccca

SEQ ID NO: 9232526 - DNA, 22 bp, Homo sapiens
aggctccattttcctgcagctg

SEQ ID NO: 9232527 - DNA, 22 bp, Homo sapiens
aggctcccatggtgtggcagga

SEQ ID NO: 9232528 - DNA, 21 bp, Homo sapiens
aggctcccagaaatgggcatc

SEQ ID NO: 9232529 - DNA, 22 bp, Homo sapiens
ccaggctctatccctccttctt

SEQ ID NO: 9232530 - DNA, 22 bp, Homo sapiens
cggggttcatccatgctgtggc

SEQ ID NO: 9232531 - DNA, 22 bp, Homo sapiens
cggggttcatccatgctgtggc

SEQ ID NO: 9232532 - DNA, 22 bp, Homo sapiens
cggggttcatccatgctgtggc

SEQ ID NO: 9232533 - DNA, 22 bp, Homo sapiens
cggggtggcactctaaatagaa

SEQ ID NO: 9232534 - DNA, 22 bp, Homo sapiens
cggggtgggaatagacctgtct

SEQ ID NO: 9232535 - DNA, 22 bp, Homo sapiens
cgggttcacgccattctcctgc

SEQ ID NO: 9232536 - DNA, 22 bp, Homo sapiens
cgggttcacgccattctcctgc

SEQ ID NO: 9232537 - DNA, 22 bp, Homo sapiens
cgggttcacgccattctcctgc

SEQ ID NO: 9232538 - DNA, 22 bp, Homo sapiens
cgggttcacgccattctcctgc

SEQ ID NO: 9232539 - DNA, 22 bp, Homo sapiens
cgggttcacgccattctcctgc

SEQ ID NO: 9232540 - DNA, 22 bp, Homo sapiens
agtatcatgttggaattaatca

SEQ ID NO: 9232541 - DNA, 21 bp, Homo sapiens
agtatcataatgaatagttct

SEQ ID NO: 9232542 - DNA, 21 bp, Homo sapiens
agtatcataatgaatagttct

SEQ ID NO: 9232543 - DNA, 22 bp, Homo sapiens
agtatcattttggcattagtat

SEQ ID NO: 9232544 - DNA, 22 bp, Homo sapiens
cgggggcacccacaaatgagga

SEQ ID NO: 9232545 - DNA, 22 bp, Homo sapiens
agtatgaagaatacatagatga

SEQ ID NO: 9232546 - DNA, 22 bp, Homo sapiens
ctcaaagagccaggtaatcacc

SEQ ID NO: 9232547 - DNA, 22 bp, Homo sapiens
ctcaaagacaaaaatctgaggt

SEQ ID NO: 9232548 - DNA, 22 bp, Homo sapiens
ctcaaagaagggaggtatttgg

SEQ ID NO: 9232549 - DNA, 22 bp, Homo sapiens
ctcaaaatggttaattttaata

SEQ ID NO: 9232550 - DNA, 21 bp, Homo sapiens
ctcaaaattctttctgttgga

SEQ ID NO: 9232551 - DNA, 21 bp, Homo sapiens
ctcaaatgccagttttattta

SEQ ID NO: 9232552 - DNA, 22 bp, Homo sapiens
ctcaacagactctgccatccct

SEQ ID NO: 9232553 - DNA, 22 bp, Homo sapiens
agtcccaacagcttacaaggaa

SEQ ID NO: 9232554 - DNA, 22 bp, Homo sapiens
agtcccagactccagttttctg

SEQ ID NO: 9232555 - DNA, 22 bp, Homo sapiens
agtcccagactccagttttctg

SEQ ID NO: 9232556 - DNA, 22 bp, Homo sapiens
ctcaagaaggatgagctattgc

SEQ ID NO: 9232557 - DNA, 22 bp, Homo sapiens
ctcaagaagagggagacctaca

SEQ ID NO: 9232558 - DNA, 22 bp, Homo sapiens
agtcccagagaggtcggggcca

SEQ ID NO: 9232559 - DNA, 20 bp, Homo sapiens
agtcccagatcaaatttctg

SEQ ID NO: 9232560 - DNA, 22 bp, Homo sapiens
agtcccagatctacaggaggga

SEQ ID NO: 9232561 - DNA, 22 bp, Homo sapiens
agtcccagatctacaggaggga

SEQ ID NO: 9232562 - DNA, 22 bp, Homo sapiens
agtcccagatctacaggaggga

SEQ ID NO: 9232563 - DNA, 22 bp, Homo sapiens
agtcccagatctccattcggtc

SEQ ID NO: 9232564 - DNA, 22 bp, Homo sapiens
agtcccagatgacccagctact

SEQ ID NO: 9232565 - DNA, 22 bp, Homo sapiens
agtcccagatgacccagctact

SEQ ID NO: 9232566 - DNA, 22 bp, Homo sapiens
agtcccagcccagtcctgtaag

SEQ ID NO: 9232567 - DNA, 22 bp, Homo sapiens
agtcccagcctaggctgtgctg

SEQ ID NO: 9232568 - DNA, 22 bp, Homo sapiens
agtcccagcctaggctgtgctg

SEQ ID NO: 9232569 - DNA, 22 bp, Homo sapiens
agtcccagcccagtcctgtaag

SEQ ID NO: 9232570 - DNA, 22 bp, Homo sapiens
agtcccagcctgtaggattggg

SEQ ID NO: 9232571 - DNA, 22 bp, Homo sapiens
ctcaccaggaacagctgcggag

SEQ ID NO: 9232572 - DNA, 22 bp, Homo sapiens
ctcagaaagtgacaggggggtg

SEQ ID NO: 9232573 - DNA, 22 bp, Homo sapiens
ctcagaaatcccactctgtgta

SEQ ID NO: 9232574 - DNA, 22 bp, Homo sapiens
ctcagaaattacaaaagggaca

SEQ ID NO: 9232575 - DNA, 22 bp, Homo sapiens
ctcagaaatcccactctgtgta

SEQ ID NO: 9232576 - DNA, 22 bp, Homo sapiens
ctcagagggtctcctccagaat

SEQ ID NO: 9232577 - DNA, 21 bp, Homo sapiens
ctcagaccacagctcacaccc

SEQ ID NO: 9232578 - DNA, 23 bp, Homo sapiens
ctcagaggtgtttttcacttact

SEQ ID NO: 9232579 - DNA, 22 bp, Homo sapiens
ctcagggacaaggggagacccc

SEQ ID NO: 9232580 - DNA, 22 bp, Homo sapiens
ctcagggacaaggggagacccc

SEQ ID NO: 9232581 - DNA, 22 bp, Homo sapiens
ctcagggacgttagaggacagg

SEQ ID NO: 9232582 - DNA, 22 bp, Homo sapiens
ctcagggacggaggcttgcgga

SEQ ID NO: 9232583 - DNA, 22 bp, Homo sapiens
ctcagggacttggatcctggcc

SEQ ID NO: 9232584 - DNA, 22 bp, Homo sapiens
ctcagggaggccctgggaccct

SEQ ID NO: 9232585 - DNA, 22 bp, Homo sapiens
ctcagggaggcctctgctggtt

SEQ ID NO: 9232586 - DNA, 22 bp, Homo sapiens
ctcagggaggtcctgtgctgaa

SEQ ID NO: 9232587 - DNA, 22 bp, Homo sapiens
ctcagggaggagcttctgggcc

SEQ ID NO: 9232588 - DNA, 22 bp, Homo sapiens
ctcagggagagccaagagttcc

SEQ ID NO: 9232589 - DNA, 22 bp, Homo sapiens
agtctccacactggcagatgcc

SEQ ID NO: 9232590 - DNA, 22 bp, Homo sapiens
agtctccacaacagccctgata

SEQ ID NO: 9232591 - DNA, 23 bp, Homo sapiens
agtctcagctggaaacatgtgtc

SEQ ID NO: 9232592 - DNA, 22 bp, Homo sapiens
agtctccagaaatatagcagtg

SEQ ID NO: 9232593 - DNA, 22 bp, Homo sapiens
agtctcctctttccttgttatt

SEQ ID NO: 9232594 - DNA, 22 bp, Homo sapiens
agtctccttaaatatttcccag

SEQ ID NO: 9232595 - DNA, 22 bp, Homo sapiens
ctcagctctgacaggaggcatc

SEQ ID NO: 9232596 - DNA, 20 bp, Homo sapiens
ctcagctcttcagggcaagt

SEQ ID NO: 9232597 - DNA, 20 bp, Homo sapiens
ctcagctaaacaacactgac

SEQ ID NO: 9232598 - DNA, 16 bp, Homo sapiens
ctcagctaaggagagg

SEQ ID NO: 9232599 - DNA, 22 bp, Homo sapiens
ctcagcctgtgaagagcagagg

SEQ ID NO: 9232600 - DNA, 22 bp, Homo sapiens
ctcagcacactcccatctaatt

SEQ ID NO: 9232601 - DNA, 22 bp, Homo sapiens
ctcagcacatctttacatttcc

SEQ ID NO: 9232602 - DNA, 22 bp, Homo sapiens
ctcagctacgctttcaccagct

SEQ ID NO: 9232603 - DNA, 22 bp, Homo sapiens
ctcagctccaggtgtgcatctt

SEQ ID NO: 9232604 - DNA, 22 bp, Homo sapiens
ctcagctcattgtggatccggt

SEQ ID NO: 9232605 - DNA, 22 bp, Homo sapiens
ctccagagacacttctcatgat

SEQ ID NO: 9232606 - DNA, 22 bp, Homo sapiens
ctccagagagaaaggaggccgc

SEQ ID NO: 9232607 - DNA, 19 bp, Homo sapiens
ctccagaatacatgttcct

SEQ ID NO: 9232608 - DNA, 22 bp, Homo sapiens
ctccagaaattcaacagcaaat

SEQ ID NO: 9232609 - DNA, 22 bp, Homo sapiens
agtgacaggggaggcaggtgtg

SEQ ID NO: 9232610 - DNA, 21 bp, Homo sapiens
agtgacagaggaaggtgcata

SEQ ID NO: 9232611 - DNA, 22 bp, Homo sapiens
agtgacagctgggaaggtgaaa

SEQ ID NO: 9232612 - DNA, 22 bp, Homo sapiens
agtgacagctgggaaggtgaaa

SEQ ID NO: 9232613 - DNA, 22 bp, Homo sapiens
ctcagtggttgagagcctgggc

SEQ ID NO: 9232614 - DNA, 20 bp, Homo sapiens
ctcagtgtggcctgagtgtt

SEQ ID NO: 9232615 - DNA, 17 bp, Homo sapiens
agtgaaatttacattgc

SEQ ID NO: 9232616 - DNA, 17 bp, Homo sapiens
agtgaaatttacattgc

SEQ ID NO: 9232617 - DNA, 22 bp, Homo sapiens
agtgacaaggcctgaagctcct

SEQ ID NO: 9232618 - DNA, 22 bp, Homo sapiens
ctcttggtaagacattagaggt

SEQ ID NO: 9232619 - DNA, 22 bp, Homo sapiens
ctcttgggagtgctctggagaa

SEQ ID NO: 9232620 - DNA, 21 bp, Homo sapiens
ctcttgctgatgtctccttta

SEQ ID NO: 9232621 - DNA, 22 bp, Homo sapiens
ctcttagctgctgttctttgag

SEQ ID NO: 9232622 - DNA, 22 bp, Homo sapiens
ctcttcttgtctctggttagaa

SEQ ID NO: 9232623 - DNA, 22 bp, Homo sapiens
agtggtgctgcgcgcggagctc

SEQ ID NO: 9232624 - DNA, 22 bp, Homo sapiens
agtggtggagagatgaggacac

SEQ ID NO: 9232625 - DNA, 21 bp, Homo sapiens
agtggtctttttcacccagtg

SEQ ID NO: 9232626 - DNA, 22 bp, Homo sapiens
agtggtggagccaggaaatgtg

SEQ ID NO: 9232627 - DNA, 22 bp, Homo sapiens
agtggtggagccaggaaatgtg

SEQ ID NO: 9232628 - DNA, 22 bp, Homo sapiens
agtggtggagccaggaaatgtg

SEQ ID NO: 9232629 - DNA, 22 bp, Homo sapiens
agtgtaaacttaagagaatatc

SEQ ID NO: 9232630 - DNA, 22 bp, Homo sapiens
ctctgtcctccacctgctttca

SEQ ID NO: 9232631 - DNA, 22 bp, Homo sapiens
ctctgtcccagacccacctctc

SEQ ID NO: 9232632 - DNA, 22 bp, Homo sapiens
ctctgtcccagacccacctctc

SEQ ID NO: 9232633 - DNA, 22 bp, Homo sapiens
ctctgtgagggtctgtacagaa

SEQ ID NO: 9232634 - DNA, 22 bp, Homo sapiens
ctctgtgagggtctgtacagaa

SEQ ID NO: 9232635 - DNA, 22 bp, Homo sapiens
agtggtctgcctgcctcagcct

SEQ ID NO: 9232636 - DNA, 19 bp, Homo sapiens
ctctggagaacaatagtgc

SEQ ID NO: 9232637 - DNA, 20 bp, Homo sapiens
ctctctccatctcagtggcc

SEQ ID NO: 9232638 - DNA, 23 bp, Homo sapiens
ctctggagatcctctgcctgggt

SEQ ID NO: 9232639 - DNA, 22 bp, Homo sapiens
ctctggagatggttctcaattg

SEQ ID NO: 9232640 - DNA, 22 bp, Homo sapiens
agtggctgttccaggtgaggac

SEQ ID NO: 9232641 - DNA, 22 bp, Homo sapiens
agtggctgtttataggtgggta

SEQ ID NO: 9232642 - DNA, 22 bp, Homo sapiens
agtggcttgctctgcctcagcc

SEQ ID NO: 9232643 - DNA, 22 bp, Homo sapiens
agtgggagaatgaataagggcc

SEQ ID NO: 9232644 - DNA, 22 bp, Homo sapiens
agtgggagaatgaataagggcc

SEQ ID NO: 9232645 - DNA, 22 bp, Homo sapiens
ctctggggttagatctgatgct

SEQ ID NO: 9232646 - DNA, 22 bp, Homo sapiens
ctctgtatagaaaggaaacatt

SEQ ID NO: 9232647 - DNA, 22 bp, Homo sapiens
ctctgtatgaatcatatggagt

SEQ ID NO: 9232648 - DNA, 22 bp, Homo sapiens
ctctgtagaaacagggcagaag

SEQ ID NO: 9232649 - DNA, 22 bp, Homo sapiens
ctctgtagaaagagcccaggtg

SEQ ID NO: 9232650 - DNA, 22 bp, Homo sapiens
ctccttctgggcctggcagtgg

SEQ ID NO: 9232651 - DNA, 22 bp, Homo sapiens
ctccttctgggcctggcagtgg

SEQ ID NO: 9232652 - DNA, 22 bp, Homo sapiens
ctcctggttcagagagctgaga

SEQ ID NO: 9232653 - DNA, 22 bp, Homo sapiens
ctcctggttcagagagctgaga

SEQ ID NO: 9232654 - DNA, 22 bp, Homo sapiens
ctcctgccaccgcggtgtcctg

SEQ ID NO: 9232655 - DNA, 22 bp, Homo sapiens
ctcctgagtagtagcattgtca

SEQ ID NO: 9232656 - DNA, 18 bp, Homo sapiens
ctcctttccctacacctc

SEQ ID NO: 9232657 - DNA, 22 bp, Homo sapiens
ctcgcaggacagtgctaggact

SEQ ID NO: 9232658 - DNA, 22 bp, Homo sapiens
agtgctggagggaggcaggttc

SEQ ID NO: 9232659 - DNA, 22 bp, Homo sapiens
agtgctggattacaggcgtgag

SEQ ID NO: 9232660 - DNA, 22 bp, Homo sapiens
agtgctggattacaggcgtgag

SEQ ID NO: 9232661 - DNA, 22 bp, Homo sapiens
agtgctggattacaggcgtgag

SEQ ID NO: 9232662 - DNA, 22 bp, Homo sapiens
agtgctggattacaggcgtgag

SEQ ID NO: 9232663 - DNA, 22 bp, Homo sapiens
agtgctgactctgggcacagtg

SEQ ID NO: 9232664 - DNA, 22 bp, Homo sapiens
agtgctgagtgattgcaaagga

SEQ ID NO: 9232665 - DNA, 23 bp, Homo sapiens
agtgctggagaagcttctggctt

SEQ ID NO: 9232666 - DNA, 22 bp, Homo sapiens
ctccagagagtccagctctggg

SEQ ID NO: 9232667 - DNA, 22 bp, Homo sapiens
ctccagagagtccagctctggg

SEQ ID NO: 9232668 - DNA, 22 bp, Homo sapiens
agtgctgactctgggcacagtg

SEQ ID NO: 9232669 - DNA, 23 bp, Homo sapiens
agtgctgaattgaaagctccagg

SEQ ID NO: 9232670 - DNA, 22 bp, Homo sapiens
agtgctatcgagttctaatgct

SEQ ID NO: 9232671 - DNA, 22 bp, Homo sapiens
agtgctgggctatctactgcta

SEQ ID NO: 9232672 - DNA, 19 bp, Homo sapiens
ctctccacctaacaggtat

SEQ ID NO: 9232673 - DNA, 22 bp, Homo sapiens
ctctccattccctacagttttc

SEQ ID NO: 9232674 - DNA, 20 bp, Homo sapiens
ctctcccagcacagcttcct

SEQ ID NO: 9232675 - DNA, 22 bp, Homo sapiens
ctctccattccctacagttttc

SEQ ID NO: 9232676 - DNA, 22 bp, Homo sapiens
ctctccatctgtgtgacctccc

SEQ ID NO: 9232677 - DNA, 22 bp, Homo sapiens
ctctccatctgtgtgacctccc

SEQ ID NO: 9232678 - DNA, 22 bp, Homo sapiens
agtgctgggattgcaggcatga

SEQ ID NO: 9232679 - DNA, 22 bp, Homo sapiens
agtgctggcccatagctgctgg

SEQ ID NO: 9232680 - DNA, 22 bp, Homo sapiens
agtgctgggattacaggcataa

SEQ ID NO: 9232681 - DNA, 22 bp, Homo sapiens
agtgctggcccatagctgctgg

SEQ ID NO: 9232682 - DNA, 22 bp, Homo sapiens
agtgctggcccatagctgctgg

SEQ ID NO: 9232683 - DNA, 22 bp, Homo sapiens
ctcggcaggtggaggttgtagt

SEQ ID NO: 9232684 - DNA, 22 bp, Homo sapiens
ctcggcaggtggaggttgtagt

SEQ ID NO: 9232685 - DNA, 22 bp, Homo sapiens
ctctcgccagcggggctgcgct

SEQ ID NO: 9232686 - DNA, 22 bp, Homo sapiens
ctctctagaggcccaccttgag

SEQ ID NO: 9232687 - DNA, 19 bp, Homo sapiens
ctctctccagtggctggct

SEQ ID NO: 9232688 - DNA, 22 bp, Homo sapiens
ctctctcagtgtaatacaggat

SEQ ID NO: 9232689 - DNA, 22 bp, Homo sapiens
ctctcctttactgcagagagcg

SEQ ID NO: 9232690 - DNA, 22 bp, Homo sapiens
ctctcctttactgcagagagcg

SEQ ID NO: 9232691 - DNA, 22 bp, Homo sapiens
ctctcctttgaagcaactgtat

SEQ ID NO: 9232692 - DNA, 20 bp, Homo sapiens
ctctcccagcacagcttcct

SEQ ID NO: 9232693 - DNA, 22 bp, Homo sapiens
ctctcccagtcaggctcaggat

SEQ ID NO: 9232694 - DNA, 17 bp, Homo sapiens
ctctccttcctctgagg

SEQ ID NO: 9232695 - DNA, 22 bp, Homo sapiens
ctctcccagtcaggctcaggat

SEQ ID NO: 9232696 - DNA, 22 bp, Homo sapiens
ctctcccagtcaggctcaggat

SEQ ID NO: 9232697 - DNA, 22 bp, Homo sapiens
aggtgctgccccgagaaggatg

SEQ ID NO: 9232698 - DNA, 22 bp, Homo sapiens
aggtgctgccccgagaaggatg

SEQ ID NO: 9232699 - DNA, 22 bp, Homo sapiens
aggtgctggagtagaagaaaaa

SEQ ID NO: 9232700 - DNA, 22 bp, Homo sapiens
aggtgctggagtagaagaaaaa

SEQ ID NO: 9232701 - DNA, 22 bp, Homo sapiens
aggtgctggagtctgggcagga

SEQ ID NO: 9232702 - DNA, 17 bp, Homo sapiens
aggtgctggagcatcag

SEQ ID NO: 9232703 - DNA, 22 bp, Homo sapiens
aggtgctggagtctgggcagga

SEQ ID NO: 9232704 - DNA, 22 bp, Homo sapiens
aggtgctggcgccccaggagac

SEQ ID NO: 9232705 - DNA, 22 bp, Homo sapiens
aggtgctgggcagcagtcattg

SEQ ID NO: 9232706 - DNA, 22 bp, Homo sapiens
aggtgctgtttgtcagcagttt

SEQ ID NO: 9232707 - DNA, 22 bp, Homo sapiens
aggtgctgttggcagcgggcag

SEQ ID NO: 9232708 - DNA, 22 bp, Homo sapiens
aggtgctgtgctatgcacttgt

SEQ ID NO: 9232709 - DNA, 22 bp, Homo sapiens
aggtggcagttgtggaaccatc

SEQ ID NO: 9232710 - DNA, 22 bp, Homo sapiens
aggtggctctgacagctctggt

SEQ ID NO: 9232711 - DNA, 22 bp, Homo sapiens
aggtggctctgacagctctggt

SEQ ID NO: 9232712 - DNA, 22 bp, Homo sapiens
aggtggctctgacagctctggt

SEQ ID NO: 9232713 - DNA, 20 bp, Homo sapiens
aggtggctcttcctgggctt

SEQ ID NO: 9232714 - DNA, 22 bp, Homo sapiens
aggtgcctgggagctccctgag

SEQ ID NO: 9232715 - DNA, 22 bp, Homo sapiens
aggtgcctatctggtctctgca

SEQ ID NO: 9232716 - DNA, 22 bp, Homo sapiens
aggtgcctatctggtctctgca

SEQ ID NO: 9232717 - DNA, 18 bp, Homo sapiens
aggtgccctccttacact

SEQ ID NO: 9232718 - DNA, 22 bp, Homo sapiens
aggtgccagtgctgtggtcccc

SEQ ID NO: 9232719 - DNA, 22 bp, Homo sapiens
aggtgccagtgctgtggtcccc

SEQ ID NO: 9232720 - DNA, 23 bp, Homo sapiens
aggtgcccagggcaggtttactg

SEQ ID NO: 9232721 - DNA, 22 bp, Homo sapiens
aggtgccagctctcaggcagga

SEQ ID NO: 9232722 - DNA, 22 bp, Homo sapiens
cctgggagaactgctgggttgg

SEQ ID NO: 9232723 - DNA, 22 bp, Homo sapiens
cctgggactcggccaggacaga

SEQ ID NO: 9232724 - DNA, 22 bp, Homo sapiens
cctgggagaactgctgggttgg

SEQ ID NO: 9232725 - DNA, 22 bp, Homo sapiens
cctgggagaactgctgggttgg

SEQ ID NO: 9232726 - DNA, 22 bp, Homo sapiens
cctgggaagttgtggctgcagt

SEQ ID NO: 9232727 - DNA, 22 bp, Homo sapiens
cctgggacctcgcgggaagcgg

SEQ ID NO: 9232728 - DNA, 21 bp, Homo sapiens
aggtggctgcatcctcagaag

SEQ ID NO: 9232729 - DNA, 22 bp, Homo sapiens
aggtggcttctggccaggtgtg

SEQ ID NO: 9232730 - DNA, 21 bp, Homo sapiens
aggtgggagaccatgtaggtc

SEQ ID NO: 9232731 - DNA, 21 bp, Homo sapiens
aggtgggagaccatgtaggtc

SEQ ID NO: 9232732 - DNA, 22 bp, Homo sapiens
ccttctctgcaggtagttggct

SEQ ID NO: 9232733 - DNA, 22 bp, Homo sapiens
aggtgggcaatgaggcctgagt

SEQ ID NO: 9232734 - DNA, 22 bp, Homo sapiens
aggtgggacccgtggggtgcga

SEQ ID NO: 9232735 - DNA, 21 bp, Homo sapiens
aggtgggagaccatgtaggtc

SEQ ID NO: 9232736 - DNA, 22 bp, Homo sapiens
aggtgggacccgtggggtgcga

SEQ ID NO: 9232737 - DNA, 22 bp, Homo sapiens
aggtgggacccgtggggtgcga

SEQ ID NO: 9232738 - DNA, 22 bp, Homo sapiens
aggtgggaacccagcagggccc

SEQ ID NO: 9232739 - DNA, 22 bp, Homo sapiens
aggtgggacccgtggggtgcga

SEQ ID NO: 9232740 - DNA, 22 bp, Homo sapiens
aggtgggaacccagcagggccc

SEQ ID NO: 9232741 - DNA, 22 bp, Homo sapiens
ccttgctcatcccccagtgcct

SEQ ID NO: 9232742 - DNA, 22 bp, Homo sapiens
ccttggccctagcctcaggcaa

SEQ ID NO: 9232743 - DNA, 22 bp, Homo sapiens
aggtggggctgggaaagattcc

SEQ ID NO: 9232744 - DNA, 22 bp, Homo sapiens
ccttggattttgtgcccacgcc

SEQ ID NO: 9232745 - DNA, 21 bp, Homo sapiens
cgctccaccccacccactggc

SEQ ID NO: 9232746 - DNA, 22 bp, Homo sapiens
cggaggcaaactcacctggctc

SEQ ID NO: 9232747 - DNA, 22 bp, Homo sapiens
cggaggcaaactcacctggctc

SEQ ID NO: 9232748 - DNA, 22 bp, Homo sapiens
cggagctgcctgccaagcctgc

SEQ ID NO: 9232749 - DNA, 22 bp, Homo sapiens
cggccaagccggggccccgaag

SEQ ID NO: 9232750 - DNA, 22 bp, Homo sapiens
cggcatgggcgtccccctcact

SEQ ID NO: 9232751 - DNA, 22 bp, Homo sapiens
cggaggggtttgaacagaggag

SEQ ID NO: 9232752 - DNA, 22 bp, Homo sapiens
cggctcactgcagctccgcctc

SEQ ID NO: 9232753 - DNA, 22 bp, Homo sapiens
cggctcactgcagctccgcctc

SEQ ID NO: 9232754 - DNA, 22 bp, Homo sapiens
cggctcactgcagctccgcctc

SEQ ID NO: 9232755 - DNA, 22 bp, Homo sapiens
cgaggccagctctaagccctac

SEQ ID NO: 9232756 - DNA, 22 bp, Homo sapiens
cgaggccaccgtggtttccgag

SEQ ID NO: 9232757 - DNA, 22 bp, Homo sapiens
cgaggccaatgtgttttatgaa

SEQ ID NO: 9232758 - DNA, 22 bp, Homo sapiens
cgaggccacacctgcttctggg

SEQ ID NO: 9232759 - DNA, 20 bp, Homo sapiens
cgaggccaaggggctgggcc

SEQ ID NO: 9232760 - DNA, 22 bp, Homo sapiens
cgagcatgatgacggctgtggc

SEQ ID NO: 9232761 - DNA, 22 bp, Homo sapiens
aggtggggtgagctgcagacta

SEQ ID NO: 9232762 - DNA, 22 bp, Homo sapiens
aggtggggtgttggatgtttat

SEQ ID NO: 9232763 - DNA, 22 bp, Homo sapiens
cctttattcaattagtcctaat

SEQ ID NO: 9232764 - DNA, 22 bp, Homo sapiens
cctttattcaattagtcctaat

SEQ ID NO: 9232765 - DNA, 22 bp, Homo sapiens
aggtgggggctgtgtccttgac

SEQ ID NO: 9232766 - DNA, 22 bp, Homo sapiens
aggtggggtgagctgcagacta

SEQ ID NO: 9232767 - DNA, 22 bp, Homo sapiens
cctttgtgaatatgcagaaaat

SEQ ID NO: 9232768 - DNA, 22 bp, Homo sapiens
cctttgtggtggcccagtgtgg

SEQ ID NO: 9232769 - DNA, 22 bp, Homo sapiens
agggtctgactgaatggaaaag

SEQ ID NO: 9232770 - DNA, 22 bp, Homo sapiens
agggtctgactcctctggcaag

SEQ ID NO: 9232771 - DNA, 20 bp, Homo sapiens
agggtctgctgggtaggaca

SEQ ID NO: 9232772 - DNA, 22 bp, Homo sapiens
agggtctgaccaccagtaggga

SEQ ID NO: 9232773 - DNA, 22 bp, Homo sapiens
agggtctgaccaccagtaggga

SEQ ID NO: 9232774 - DNA, 22 bp, Homo sapiens
agggtctctggagagctgagga

SEQ ID NO: 9232775 - DNA, 22 bp, Homo sapiens
agggtctgtggatgcatctggg

SEQ ID NO: 9232776 - DNA, 22 bp, Homo sapiens
agggtctgtggatgcatctggg

SEQ ID NO: 9232777 - DNA, 22 bp, Homo sapiens
agggtctgtggatgcatctggg

SEQ ID NO: 9232778 - DNA, 22 bp, Homo sapiens
agggtcttcccaccattcctgc

SEQ ID NO: 9232779 - DNA, 22 bp, Homo sapiens
agggtcttgaggatctgaactg

SEQ ID NO: 9232780 - DNA, 20 bp, Homo sapiens
agggtgagacatgagcctcc

SEQ ID NO: 9232781 - DNA, 23 bp, Homo sapiens
agggtgagcaagctatggagacc

SEQ ID NO: 9232782 - DNA, 20 bp, Homo sapiens
agggtgagacatgagcctcc

SEQ ID NO: 9232783 - DNA, 20 bp, Homo sapiens
agggtgagacatgagcctcc

SEQ ID NO: 9232784 - DNA, 22 bp, Homo sapiens
agggtgaatctcacaactctta

SEQ ID NO: 9232785 - DNA, 22 bp, Homo sapiens
agggtgaatctcacaactctta

SEQ ID NO: 9232786 - DNA, 22 bp, Homo sapiens
agggtgaatctcacaactctta

SEQ ID NO: 9232787 - DNA, 21 bp, Homo sapiens
agggtcctacagggctcagga

SEQ ID NO: 9232788 - DNA, 22 bp, Homo sapiens
agggtcaggagacactggcaac

SEQ ID NO: 9232789 - DNA, 20 bp, Homo sapiens
agggtcagtagcacagagct

SEQ ID NO: 9232790 - DNA, 21 bp, Homo sapiens
agggtcaggaaccagggtacc

SEQ ID NO: 9232791 - DNA, 21 bp, Homo sapiens
agggtcaggaaccagggtacc

SEQ ID NO: 9232792 - DNA, 22 bp, Homo sapiens
agggtcacctgcttgccagggc

SEQ ID NO: 9232793 - DNA, 22 bp, Homo sapiens
cctctgccacctcccacgaggc

SEQ ID NO: 9232794 - DNA, 22 bp, Homo sapiens
cctctctccaattttcacctca

SEQ ID NO: 9232795 - DNA, 22 bp, Homo sapiens
cctctctctgcatctggagggc

SEQ ID NO: 9232796 - DNA, 22 bp, Homo sapiens
cctctctcttgtagtccctgcc

SEQ ID NO: 9232797 - DNA, 22 bp, Homo sapiens
cctgcccctcaaggcctggtgc

SEQ ID NO: 9232798 - DNA, 22 bp, Homo sapiens
cctgcccagggtcaccacagag

SEQ ID NO: 9232799 - DNA, 22 bp, Homo sapiens
cctgcccagggtcaccacagag

SEQ ID NO: 9232800 - DNA, 22 bp, Homo sapiens
cctgcccatactgacctctaat

SEQ ID NO: 9232801 - DNA, 22 bp, Homo sapiens
cctgccctagagatgacacaat

SEQ ID NO: 9232802 - DNA, 19 bp, Homo sapiens
cctctgccagcccgcctct

SEQ ID NO: 9232803 - DNA, 22 bp, Homo sapiens
cctgccaggacattgcttgaag

SEQ ID NO: 9232804 - DNA, 22 bp, Homo sapiens
cctgcccagcttcacctcaggc

SEQ ID NO: 9232805 - DNA, 22 bp, Homo sapiens
cctgcccaggagtctctctgtg

SEQ ID NO: 9232806 - DNA, 22 bp, Homo sapiens
cctgcccaggagtctctctgtg

SEQ ID NO: 9232807 - DNA, 22 bp, Homo sapiens
cctgcctggcttccagaagaga

SEQ ID NO: 9232808 - DNA, 22 bp, Homo sapiens
cctgcctggcttccagaagaga

SEQ ID NO: 9232809 - DNA, 22 bp, Homo sapiens
cctgctctagactctgggaagg

SEQ ID NO: 9232810 - DNA, 22 bp, Homo sapiens
cctgctctgccaagtcctcttt

SEQ ID NO: 9232811 - DNA, 22 bp, Homo sapiens
cctgctctgccaagtcctcttt

SEQ ID NO: 9232812 - DNA, 22 bp, Homo sapiens
cctgctctgccaagtcctcttt

SEQ ID NO: 9232813 - DNA, 22 bp, Homo sapiens
cctgctctggtttagtcagtct

SEQ ID NO: 9232814 - DNA, 22 bp, Homo sapiens
cctgctctggtttagtcagtct

SEQ ID NO: 9232815 - DNA, 22 bp, Homo sapiens
cctgctctgccaagtcctcttt

SEQ ID NO: 9232816 - DNA, 22 bp, Homo sapiens
cctgctctgccaagtcctcttt

SEQ ID NO: 9232817 - DNA, 19 bp, Homo sapiens
cctgctgcccaccctctgc

SEQ ID NO: 9232818 - DNA, 19 bp, Homo sapiens
cctgctgcaccacttgtta

SEQ ID NO: 9232819 - DNA, 22 bp, Homo sapiens
cctgctgaggtcagccacccaa

SEQ ID NO: 9232820 - DNA, 19 bp, Homo sapiens
cctgctgaagtgatgcagc

SEQ ID NO: 9232821 - DNA, 22 bp, Homo sapiens
cctgctcttatagctgtttcca

SEQ ID NO: 9232822 - DNA, 22 bp, Homo sapiens
cctggcagcgccgaagctggcc

SEQ ID NO: 9232823 - DNA, 22 bp, Homo sapiens
cctggcagcgccgaagctggcc

SEQ ID NO: 9232824 - DNA, 22 bp, Homo sapiens
cctggcagcgtgccgagctgcg

SEQ ID NO: 9232825 - DNA, 22 bp, Homo sapiens
cctggaccaaacactggcctgg

SEQ ID NO: 9232826 - DNA, 22 bp, Homo sapiens
cctggaaggacaatagatagtg

SEQ ID NO: 9232827 - DNA, 22 bp, Homo sapiens
cctgggaagtcagccaaggacg

SEQ ID NO: 9232828 - DNA, 22 bp, Homo sapiens
cctgggaaggtgaggccctgga

SEQ ID NO: 9232829 - DNA, 22 bp, Homo sapiens
cctggctggtggcagcgacaag

SEQ ID NO: 9232830 - DNA, 22 bp, Homo sapiens
cctgggaaggggaagagaattc

SEQ ID NO: 9232831 - DNA, 22 bp, Homo sapiens
cctggctggactggaccgtggc

SEQ ID NO: 9232832 - DNA, 22 bp, Homo sapiens
cctggctggatggagcccctgg

SEQ ID NO: 9232833 - DNA, 22 bp, Homo sapiens
cctggccagaggcgtgcctgtg

SEQ ID NO: 9232834 - DNA, 22 bp, Homo sapiens
cctggccagaggcgtgcctgtg

SEQ ID NO: 9232835 - DNA, 22 bp, Homo sapiens
cctggccactcaggtgtggggc

SEQ ID NO: 9232836 - DNA, 22 bp, Homo sapiens
cctggccactcaggtgtggggc

SEQ ID NO: 9232837 - DNA, 20 bp, Homo sapiens
cctggccaatgagataggaa

SEQ ID NO: 9232838 - DNA, 20 bp, Homo sapiens
cctggccaatgagataggaa

SEQ ID NO: 9232839 - DNA, 21 bp, Homo sapiens
cctggccaatctgatagggtt

SEQ ID NO: 9232840 - DNA, 22 bp, Homo sapiens
cctggccacagggctctgcatt

SEQ ID NO: 9232841 - DNA, 22 bp, Homo sapiens
cctggcagctccgtggccttcc

SEQ ID NO: 9232842 - DNA, 22 bp, Homo sapiens
cctggcagctccgtggccttcc

SEQ ID NO: 9232843 - DNA, 22 bp, Homo sapiens
cctggccaatctagggctgtta

SEQ ID NO: 9232844 - DNA, 22 bp, Homo sapiens
cctggcagctgtttggcttggc

SEQ ID NO: 9232845 - DNA, 22 bp, Homo sapiens
ctgaggcatcatggagaacagt

SEQ ID NO: 9232846 - DNA, 22 bp, Homo sapiens
ctgaggcagtttaatttttgaa

SEQ ID NO: 9232847 - DNA, 22 bp, Homo sapiens
ctgaggcatgaatgtgggcttt

SEQ ID NO: 9232848 - DNA, 22 bp, Homo sapiens
ctgaggcatgaatgtgggcttt

SEQ ID NO: 9232849 - DNA, 22 bp, Homo sapiens
ctgaggcatgaatgtgggcttt

SEQ ID NO: 9232850 - DNA, 22 bp, Homo sapiens
ctgaggcatgaatgtgggcttt

SEQ ID NO: 9232851 - DNA, 21 bp, Homo sapiens
ctgaggcatgcaggcctgggc

SEQ ID NO: 9232852 - DNA, 22 bp, Homo sapiens
ctgaggcctaagacatgaatga

SEQ ID NO: 9232853 - DNA, 22 bp, Homo sapiens
ctgaggccgttggtgggcctta

SEQ ID NO: 9232854 - DNA, 22 bp, Homo sapiens
ctgaggcctcactgtagtccct

SEQ ID NO: 9232855 - DNA, 22 bp, Homo sapiens
ctgaggcctaagacatgaatga

SEQ ID NO: 9232856 - DNA, 22 bp, Homo sapiens
ctgaggcctaagacatgaatga

SEQ ID NO: 9232857 - DNA, 22 bp, Homo sapiens
ctgaggcaggagagttgcttga

SEQ ID NO: 9232858 - DNA, 22 bp, Homo sapiens
ctgaggcaggatggcctggctg

SEQ ID NO: 9232859 - DNA, 22 bp, Homo sapiens
ctgaggcaggcagatcacttga

SEQ ID NO: 9232860 - DNA, 22 bp, Homo sapiens
ctgaggcaggggcagctggaga

SEQ ID NO: 9232861 - DNA, 21 bp, Homo sapiens
ctgaggcagcacagctagtca

SEQ ID NO: 9232862 - DNA, 22 bp, Homo sapiens
ctgaggcaggagaattgctgga

SEQ ID NO: 9232863 - DNA, 22 bp, Homo sapiens
agttggttcactccttcatgcc

SEQ ID NO: 9232864 - DNA, 22 bp, Homo sapiens
agttcttcccttttctatggag

SEQ ID NO: 9232865 - DNA, 22 bp, Homo sapiens
agttgctgcttctctctagaga

SEQ ID NO: 9232866 - DNA, 21 bp, Homo sapiens
agttgctgctgctgcaggtga

SEQ ID NO: 9232867 - DNA, 22 bp, Homo sapiens
ctctttggtcgcatcatccatt

SEQ ID NO: 9232868 - DNA, 19 bp, Homo sapiens
agttggggcagggaagaga

SEQ ID NO: 9232869 - DNA, 19 bp, Homo sapiens
agttggggcagggaagaga

SEQ ID NO: 9232870 - DNA, 22 bp, Homo sapiens
agttggcactgagctgtgattg

SEQ ID NO: 9232871 - DNA, 22 bp, Homo sapiens
ctgaggcctctccttggcttgt

SEQ ID NO: 9232872 - DNA, 22 bp, Homo sapiens
ctgaggcctctcccactccagc

SEQ ID NO: 9232873 - DNA, 22 bp, Homo sapiens
ctgaggcctcgttggctggaac

SEQ ID NO: 9232874 - DNA, 22 bp, Homo sapiens
ctgaggcctcgttggctggaac

SEQ ID NO: 9232875 - DNA, 22 bp, Homo sapiens
ctgaggcctctctcctgggctt

SEQ ID NO: 9232876 - DNA, 22 bp, Homo sapiens
ctgaggcctctctcctgggctt

SEQ ID NO: 9232877 - DNA, 22 bp, Homo sapiens
ctgaggcctctctcctgggctt

SEQ ID NO: 9232878 - DNA, 22 bp, Homo sapiens
ctgaggcctctcccactccagc

SEQ ID NO: 9232879 - DNA, 22 bp, Homo sapiens
ctgaggcctctttccttggctt

SEQ ID NO: 9232880 - DNA, 23 bp, Homo sapiens
ctgaggcctgctgcgttcaggtt

SEQ ID NO: 9232881 - DNA, 22 bp, Homo sapiens
ctgaggcctctctccttggctt

SEQ ID NO: 9232882 - DNA, 22 bp, Homo sapiens
ctgaggcctctgttcaccagaa

SEQ ID NO: 9232883 - DNA, 22 bp, Homo sapiens
ctgaggcctctgttcaccagaa

SEQ ID NO: 9232884 - DNA, 22 bp, Homo sapiens
ctgaggcctctgttcaccagaa

SEQ ID NO: 9232885 - DNA, 22 bp, Homo sapiens
ctgaggcttgtcctctcagctt

SEQ ID NO: 9232886 - DNA, 22 bp, Homo sapiens
ctgaggcttgtcctctcagctt

SEQ ID NO: 9232887 - DNA, 22 bp, Homo sapiens
ctgaggcttctctagttcagct

SEQ ID NO: 9232888 - DNA, 22 bp, Homo sapiens
ctgaggcttctctagttcagct

SEQ ID NO: 9232889 - DNA, 22 bp, Homo sapiens
ctgaggcttggaggggtctggt

SEQ ID NO: 9232890 - DNA, 18 bp, Homo sapiens
ctgaggcttagagaggtt

SEQ ID NO: 9232891 - DNA, 18 bp, Homo sapiens
ctgaggcttagagaggtt

SEQ ID NO: 9232892 - DNA, 22 bp, Homo sapiens
ctgaggctggggaagggaagtg

SEQ ID NO: 9232893 - DNA, 22 bp, Homo sapiens
ctgaggctggggaagggaagtg

SEQ ID NO: 9232894 - DNA, 22 bp, Homo sapiens
ctgaggctgggctgagggtata

SEQ ID NO: 9232895 - DNA, 22 bp, Homo sapiens
ctgaggctgggcttgccttctt

SEQ ID NO: 9232896 - DNA, 22 bp, Homo sapiens
ctgaggctttgtgtgcatgcct

SEQ ID NO: 9232897 - DNA, 22 bp, Homo sapiens
ctgaggctttgtgtgcatgcct

SEQ ID NO: 9232898 - DNA, 22 bp, Homo sapiens
ctgagggtgctattcttgcctt

SEQ ID NO: 9232899 - DNA, 22 bp, Homo sapiens
ctgagggtcaacttgattgtat

SEQ ID NO: 9232900 - DNA, 22 bp, Homo sapiens
ctgaggggtatccaaggggtaa

SEQ ID NO: 9232901 - DNA, 22 bp, Homo sapiens
ctgaggtatgtgggactagcct

SEQ ID NO: 9232902 - DNA, 22 bp, Homo sapiens
ctgaggtatgtgggactagcct

SEQ ID NO: 9232903 - DNA, 20 bp, Homo sapiens
ctgaggtagggcagatcacc

SEQ ID NO: 9232904 - DNA, 22 bp, Homo sapiens
ctgaggtagccatggcccaagt

SEQ ID NO: 9232905 - DNA, 22 bp, Homo sapiens
ctgaggtagctgtgaatgttct

SEQ ID NO: 9232906 - DNA, 22 bp, Homo sapiens
ctgaggtaattttccagataat

SEQ ID NO: 9232907 - DNA, 23 bp, Homo sapiens
ctgaggtaaaatattctgaagga

SEQ ID NO: 9232908 - DNA, 22 bp, Homo sapiens
ctgaggtacctggagcaggtcc

SEQ ID NO: 9232909 - DNA, 22 bp, Homo sapiens
agttgtattagagaacacaaac

SEQ ID NO: 9232910 - DNA, 22 bp, Homo sapiens
ctgaggtcaattaatcaacaac

SEQ ID NO: 9232911 - DNA, 22 bp, Homo sapiens
ctgaggtcaattaatcaacaac

SEQ ID NO: 9232912 - DNA, 22 bp, Homo sapiens
ctgaggtcagagtttagtctgg

SEQ ID NO: 9232913 - DNA, 22 bp, Homo sapiens
ctgaggtcagagtttagtctgg

SEQ ID NO: 9232914 - DNA, 22 bp, Homo sapiens
ctgaggtcaccccactggctgt

SEQ ID NO: 9232915 - DNA, 22 bp, Homo sapiens
ataaaagtaggaccaacttaca

SEQ ID NO: 9232916 - DNA, 22 bp, Homo sapiens
ataaaagtaggaccaacttaca

SEQ ID NO: 9232917 - DNA, 22 bp, Homo sapiens
ataaaagtctgcttatttgggc

SEQ ID NO: 9232918 - DNA, 22 bp, Homo sapiens
ctgccaggcctccgctgtcccc

SEQ ID NO: 9232919 - DNA, 22 bp, Homo sapiens
ctgccaggcctcatcccagcca

SEQ ID NO: 9232920 - DNA, 22 bp, Homo sapiens
ctgccaggcagcagagggagaa

SEQ ID NO: 9232921 - DNA, 22 bp, Homo sapiens
ctgccaggcactgggctctgca

SEQ ID NO: 9232922 - DNA, 22 bp, Homo sapiens
ctgccaggcactgggctctgca

SEQ ID NO: 9232923 - DNA, 22 bp, Homo sapiens
ctgccaggcacgtgcagcatca

SEQ ID NO: 9232924 - DNA, 22 bp, Homo sapiens
ctgccaggattctgtgaacccc

SEQ ID NO: 9232925 - DNA, 22 bp, Homo sapiens
ctgccaggactgacgtcttcag

SEQ ID NO: 9232926 - DNA, 22 bp, Homo sapiens
ctgcatttcacatttaaacttt

SEQ ID NO: 9232927 - DNA, 22 bp, Homo sapiens
ctgcatttcacatttaaacttt

SEQ ID NO: 9232928 - DNA, 22 bp, Homo sapiens
ctgccaggactgacgtcttcag

SEQ ID NO: 9232929 - DNA, 22 bp, Homo sapiens
ataaatatcactgttgtccctc

SEQ ID NO: 9232930 - DNA, 22 bp, Homo sapiens
ataaatatcactgttgtccctc

SEQ ID NO: 9232931 - DNA, 22 bp, Homo sapiens
ataaatatcactgttgtccctc

SEQ ID NO: 9232932 - DNA, 22 bp, Homo sapiens
ataaatatcactgttgtccctc

SEQ ID NO: 9232933 - DNA, 22 bp, Homo sapiens
ataaatagtgtgtcataaagtc

SEQ ID NO: 9232934 - DNA, 22 bp, Homo sapiens
ataaatagtgtgtcataaagtc

SEQ ID NO: 9232935 - DNA, 22 bp, Homo sapiens
ataaatagtgtgtcataaagtc

SEQ ID NO: 9232936 - DNA, 22 bp, Homo sapiens
ataaatagtgctgccatgagta

SEQ ID NO: 9232937 - DNA, 22 bp, Homo sapiens
ataaatagtgctgccatgagta

SEQ ID NO: 9232938 - DNA, 22 bp, Homo sapiens
ataaatagtgtgtcataaagtc

SEQ ID NO: 9232939 - DNA, 22 bp, Homo sapiens
ataaaagtttccaatcatgcct

SEQ ID NO: 9232940 - DNA, 20 bp, Homo sapiens
ataaaataactgccacaaga

SEQ ID NO: 9232941 - DNA, 22 bp, Homo sapiens
ataaaagttcaagagagtacag

SEQ ID NO: 9232942 - DNA, 22 bp, Homo sapiens
ataaaagttcaagagagtacag

SEQ ID NO: 9232943 - DNA, 20 bp, Homo sapiens
ataaaataactgccacaaga

SEQ ID NO: 9232944 - DNA, 20 bp, Homo sapiens
ataaaataactgccacaaga

SEQ ID NO: 9232945 - DNA, 20 bp, Homo sapiens
ataaaataactgccacaaga

SEQ ID NO: 9232946 - DNA, 22 bp, Homo sapiens
agttgtcccggtctagccactt

SEQ ID NO: 9232947 - DNA, 22 bp, Homo sapiens
agttgtcacctctattcaaatc

SEQ ID NO: 9232948 - DNA, 22 bp, Homo sapiens
agtttaactttggaaaactata

SEQ ID NO: 9232949 - DNA, 22 bp, Homo sapiens
ctgcagagcaagttctctgttg

SEQ ID NO: 9232950 - DNA, 20 bp, Homo sapiens
agtttaagaaaaagctccag

SEQ ID NO: 9232951 - DNA, 22 bp, Homo sapiens
ctgcagctatattttcccacag

SEQ ID NO: 9232952 - DNA, 22 bp, Homo sapiens
ctgcagagcagccagtccccca

SEQ ID NO: 9232953 - DNA, 22 bp, Homo sapiens
ctgcagagcaagttctctgttg

SEQ ID NO: 9232954 - DNA, 22 bp, Homo sapiens
ctgcagcctcctggggtacatg

SEQ ID NO: 9232955 - DNA, 22 bp, Homo sapiens
ctgcagctaaggaatgtggttg

SEQ ID NO: 9232956 - DNA, 22 bp, Homo sapiens
agtttgctgatgaagaaaattt

SEQ ID NO: 9232957 - DNA, 22 bp, Homo sapiens
ctgcccagaatcactcactcga

SEQ ID NO: 9232958 - DNA, 22 bp, Homo sapiens
ctgcccagaatcactcactcga

SEQ ID NO: 9232959 - DNA, 22 bp, Homo sapiens
ctgcccaccccgaggcaggaag

SEQ ID NO: 9232960 - DNA, 22 bp, Homo sapiens
ctgcccaccacacctgctcctg

SEQ ID NO: 9232961 - DNA, 22 bp, Homo sapiens
ctgcccaccgtgtgcacgtgcg

SEQ ID NO: 9232962 - DNA, 22 bp, Homo sapiens
ctgcccactatgttgtcatggg

SEQ ID NO: 9232963 - DNA, 22 bp, Homo sapiens
ctgcccacagttctctgccatg

SEQ ID NO: 9232964 - DNA, 22 bp, Homo sapiens
ataaatctattggacatgtgtg

SEQ ID NO: 9232965 - DNA, 22 bp, Homo sapiens
ataaatatcactgttgtccctc

SEQ ID NO: 9232966 - DNA, 22 bp, Homo sapiens
ataaatatcactgttgtccctc

SEQ ID NO: 9232967 - DNA, 22 bp, Homo sapiens
ctgctctggctgtgtacttcag

SEQ ID NO: 9232968 - DNA, 20 bp, Homo sapiens
ctgctctgctttgcaggtgg

SEQ ID NO: 9232969 - DNA, 22 bp, Homo sapiens
ctgctctgctgatcagtgtctc

SEQ ID NO: 9232970 - DNA, 22 bp, Homo sapiens
ctgctctgctgatcagtgtctc

SEQ ID NO: 9232971 - DNA, 22 bp, Homo sapiens
ctgctctgctgatcagtgtctc

SEQ ID NO: 9232972 - DNA, 20 bp, Homo sapiens
ctgctctgctttgcaggtgg

SEQ ID NO: 9232973 - DNA, 22 bp, Homo sapiens
ctgctctgctgatcagtgtctc

SEQ ID NO: 9232974 - DNA, 22 bp, Homo sapiens
ctgctctgcagcttggactccc

SEQ ID NO: 9232975 - DNA, 22 bp, Homo sapiens
ctgctctgcagcttggactccc

SEQ ID NO: 9232976 - DNA, 22 bp, Homo sapiens
ctgctctgcagcttggactccc

SEQ ID NO: 9232977 - DNA, 22 bp, Homo sapiens
ctgctctgagaggctcttccta

SEQ ID NO: 9232978 - DNA, 22 bp, Homo sapiens
ctgcttgggtcctggcatgggt

SEQ ID NO: 9232979 - DNA, 22 bp, Homo sapiens
ataatcaaagtcctatgacatc

SEQ ID NO: 9232980 - DNA, 22 bp, Homo sapiens
ataatatttggataggacagta

SEQ ID NO: 9232981 - DNA, 22 bp, Homo sapiens
ataatatttggataggacagta

SEQ ID NO: 9232982 - DNA, 22 bp, Homo sapiens
ataatataatcctacttcccat

SEQ ID NO: 9232983 - DNA, 22 bp, Homo sapiens
ataatatttgcattactgtgat

SEQ ID NO: 9232984 - DNA, 20 bp, Homo sapiens
atacaagatgagtaatttct

SEQ ID NO: 9232985 - DNA, 19 bp, Homo sapiens
atacaagactagcatttac

SEQ ID NO: 9232986 - DNA, 22 bp, Homo sapiens
ctgctttaatggaaagtgtttt

SEQ ID NO: 9232987 - DNA, 22 bp, Homo sapiens
ctgctttaatccctgcctggaa

SEQ ID NO: 9232988 - DNA, 22 bp, Homo sapiens
ctgctttaatgtaagatatacc

SEQ ID NO: 9232989 - DNA, 22 bp, Homo sapiens
ctgctttaatttagacaaggca

SEQ ID NO: 9232990 - DNA, 22 bp, Homo sapiens
ctgctttaaaactgatacatga

SEQ ID NO: 9232991 - DNA, 22 bp, Homo sapiens
ctgctttaaaaccctcagctgg

SEQ ID NO: 9232992 - DNA, 22 bp, Homo sapiens
ctgctttaacagatgatggtgt

SEQ ID NO: 9232993 - DNA, 22 bp, Homo sapiens
ctgctttaacaaggctgatcag

SEQ ID NO: 9232994 - DNA, 22 bp, Homo sapiens
ctgctttaagtattcaacaaag

SEQ ID NO: 9232995 - DNA, 22 bp, Homo sapiens
ctgctttaactctgggaagcca

SEQ ID NO: 9232996 - DNA, 22 bp, Homo sapiens
ctgctttaagaatgagtgtaag

SEQ ID NO: 9232997 - DNA, 22 bp, Homo sapiens
ctggagccccagacagggagag

SEQ ID NO: 9232998 - DNA, 22 bp, Homo sapiens
ctggagcccaggcctggtgtct

SEQ ID NO: 9232999 - DNA, 22 bp, Homo sapiens
ctggagccatgtcttgactgct

SEQ ID NO: 9233000 - DNA, 22 bp, Homo sapiens
ctggagagaccgaaagaggctg

SEQ ID NO: 9233001 - DNA, 22 bp, Homo sapiens
ctggagagaccgaaagaggctg

SEQ ID NO: 9233002 - DNA, 22 bp, Homo sapiens
ctggagccagccagggccctct

SEQ ID NO: 9233003 - DNA, 22 bp, Homo sapiens
ctggagcatccatgcccagggt

SEQ ID NO: 9233004 - DNA, 17 bp, Homo sapiens
ctggagccaagagggcc

SEQ ID NO: 9233005 - DNA, 22 bp, Homo sapiens
ctggagccactgggtcttgtat

SEQ ID NO: 9233006 - DNA, 22 bp, Homo sapiens
ctggaggaaaacaactgcagac

SEQ ID NO: 9233007 - DNA, 22 bp, Homo sapiens
ctggagggaggaggctgctatt

SEQ ID NO: 9233008 - DNA, 22 bp, Homo sapiens
ctggagggaggaggctgctatt

SEQ ID NO: 9233009 - DNA, 22 bp, Homo sapiens
ctggagggagttaggacccgga

SEQ ID NO: 9233010 - DNA, 22 bp, Homo sapiens
ctggagggatgtagggtgtatt

SEQ ID NO: 9233011 - DNA, 22 bp, Homo sapiens
atacagatgcttgctcgtgact

SEQ ID NO: 9233012 - DNA, 22 bp, Homo sapiens
atacagatcccacagcatgtga

SEQ ID NO: 9233013 - DNA, 22 bp, Homo sapiens
ctggcagcggtttgcagcctgg

SEQ ID NO: 9233014 - DNA, 22 bp, Homo sapiens
atactttagagctagattgcct

SEQ ID NO: 9233015 - DNA, 22 bp, Homo sapiens
ctggcagcgtgagcagcatcca

SEQ ID NO: 9233016 - DNA, 22 bp, Homo sapiens
ctggcagctctactcagagcct

SEQ ID NO: 9233017 - DNA, 22 bp, Homo sapiens
atacttcctgcttccctgatct

SEQ ID NO: 9233018 - DNA, 22 bp, Homo sapiens
atacttccctgttttttcctga

SEQ ID NO: 9233019 - DNA, 22 bp, Homo sapiens
atactttaacgtggcgaacctt

SEQ ID NO: 9233020 - DNA, 22 bp, Homo sapiens
atactttagagctagattgcct

SEQ ID NO: 9233021 - DNA, 22 bp, Homo sapiens
atactttagagctagattgcct

SEQ ID NO: 9233022 - DNA, 22 bp, Homo sapiens
atacttctttgatgttcacagg

SEQ ID NO: 9233023 - DNA, 22 bp, Homo sapiens
atacttggtggtgttccatagg

SEQ ID NO: 9233024 - DNA, 22 bp, Homo sapiens
atacttgaggttgtataaatat

SEQ ID NO: 9233025 - DNA, 21 bp, Homo sapiens
ctggagtctgggggtggcagt

SEQ ID NO: 9233026 - DNA, 22 bp, Homo sapiens
ctggagtcttcagcttgctgcc

SEQ ID NO: 9233027 - DNA, 22 bp, Homo sapiens
ctggagtcttcagcttgctgcc

SEQ ID NO: 9233028 - DNA, 21 bp, Homo sapiens
ctggagtctgggggtggcagt

SEQ ID NO: 9233029 - DNA, 22 bp, Homo sapiens
ctggagtgaagtctggcagctt

SEQ ID NO: 9233030 - DNA, 22 bp, Homo sapiens
ctggagtgaggtctgggagcct

SEQ ID NO: 9233031 - DNA, 22 bp, Homo sapiens
ctggagtgaggtctgggagcct

SEQ ID NO: 9233032 - DNA, 22 bp, Homo sapiens
ctggagggctgcagcgaggctg

SEQ ID NO: 9233033 - DNA, 22 bp, Homo sapiens
ctggagggctgcagcgaggctg

SEQ ID NO: 9233034 - DNA, 22 bp, Homo sapiens
ctggagtctcttctgtagctac

SEQ ID NO: 9233035 - DNA, 22 bp, Homo sapiens
ctggagggctggactaaggaaa

SEQ ID NO: 9233036 - DNA, 22 bp, Homo sapiens
atacttatgataaataattgct

SEQ ID NO: 9233037 - DNA, 22 bp, Homo sapiens
atacttatgataaataattgct

SEQ ID NO: 9233038 - DNA, 22 bp, Homo sapiens
atacttatgataaataattgct

SEQ ID NO: 9233039 - DNA, 22 bp, Homo sapiens
atacttacttttcttcagacta

SEQ ID NO: 9233040 - DNA, 22 bp, Homo sapiens
ctggagtgcagtggcatgatca

SEQ ID NO: 9233041 - DNA, 22 bp, Homo sapiens
ctggagtgcaacctctgcctcc

SEQ ID NO: 9233042 - DNA, 22 bp, Homo sapiens
ctggagtgatactcagaatgtg

SEQ ID NO: 9233043 - DNA, 22 bp, Homo sapiens
ctggcttgaagttatgcaccag

SEQ ID NO: 9233044 - DNA, 22 bp, Homo sapiens
ctgggaagatggtgacagaatt

SEQ ID NO: 9233045 - DNA, 22 bp, Homo sapiens
ctgggaagcatggtgatggtat

SEQ ID NO: 9233046 - DNA, 22 bp, Homo sapiens
ctgggaagcatggtgatggtat

SEQ ID NO: 9233047 - DNA, 22 bp, Homo sapiens
ctgggaagccacagggtgtggg

SEQ ID NO: 9233048 - DNA, 22 bp, Homo sapiens
ctgggaagcttcgagcaggaaa

SEQ ID NO: 9233049 - DNA, 22 bp, Homo sapiens
ctgggacacccaaggaaagagc

SEQ ID NO: 9233050 - DNA, 19 bp, Homo sapiens
ctgggacaatgaaagcatc

SEQ ID NO: 9233051 - DNA, 19 bp, Homo sapiens
ctgggacaatgaaagcatc

SEQ ID NO: 9233052 - DNA, 20 bp, Homo sapiens
atataataaattttggttac

SEQ ID NO: 9233053 - DNA, 22 bp, Homo sapiens
atataactcttgttcttatagt

SEQ ID NO: 9233054 - DNA, 22 bp, Homo sapiens
atataacatacatacagaaaag

SEQ ID NO: 9233055 - DNA, 22 bp, Homo sapiens
atataactcttgttcttatagt

SEQ ID NO: 9233056 - DNA, 22 bp, Homo sapiens
atatataagctgatgagccaca

SEQ ID NO: 9233057 - DNA, 22 bp, Homo sapiens
atatataatacttgctgtgggc

SEQ ID NO: 9233058 - DNA, 22 bp, Homo sapiens
atatataacctggataaggctt

SEQ ID NO: 9233059 - DNA, 22 bp, Homo sapiens
atataatacaacctgctaagtg

SEQ ID NO: 9233060 - DNA, 22 bp, Homo sapiens
atatacttttcactaatggcta

SEQ ID NO: 9233061 - DNA, 22 bp, Homo sapiens
atatataacctggataaggctt

SEQ ID NO: 9233062 - DNA, 22 bp, Homo sapiens
ctgggagaatttgttgaaggat

SEQ ID NO: 9233063 - DNA, 22 bp, Homo sapiens
ctgggagacgcagctggggatc

SEQ ID NO: 9233064 - DNA, 22 bp, Homo sapiens
ctgggagaggaacctcgagggt

SEQ ID NO: 9233065 - DNA, 22 bp, Homo sapiens
ctgggagagcctttcctgagtc

SEQ ID NO: 9233066 - DNA, 22 bp, Homo sapiens
ctgggagagaagcgaagctggg

SEQ ID NO: 9233067 - DNA, 22 bp, Homo sapiens
ctgggagagaagcgaagctggg

SEQ ID NO: 9233068 - DNA, 22 bp, Homo sapiens
atatatacaactagattaaaag

SEQ ID NO: 9233069 - DNA, 22 bp, Homo sapiens
atatatagagctagatgttaaa

SEQ ID NO: 9233070 - DNA, 22 bp, Homo sapiens
ctgggactttgtaggccagttg

SEQ ID NO: 9233071 - DNA, 22 bp, Homo sapiens
ctgggactttgtaggccagttg

SEQ ID NO: 9233072 - DNA, 22 bp, Homo sapiens
ctgggactttgtaggccagttg

SEQ ID NO: 9233073 - DNA, 22 bp, Homo sapiens
ctgggactttaccctgtggccc

SEQ ID NO: 9233074 - DNA, 22 bp, Homo sapiens
ctgggactttaccctgtggccc

SEQ ID NO: 9233075 - DNA, 19 bp, Homo sapiens
ctgggaggtgttcagagaa

SEQ ID NO: 9233076 - DNA, 22 bp, Homo sapiens
ctgggcacaagtggccctggat

SEQ ID NO: 9233077 - DNA, 22 bp, Homo sapiens
ctgggcacacagtgactctgca

SEQ ID NO: 9233078 - DNA, 22 bp, Homo sapiens
ctgggcacacagtgactctgca

SEQ ID NO: 9233079 - DNA, 22 bp, Homo sapiens
ctgggcacaagtggccctggat

SEQ ID NO: 9233080 - DNA, 22 bp, Homo sapiens
ctgggcacagcgttgggctctt

SEQ ID NO: 9233081 - DNA, 22 bp, Homo sapiens
ctgggcacagcgttgggctctt

SEQ ID NO: 9233082 - DNA, 22 bp, Homo sapiens
ctgggcacaggggagcagagtc

SEQ ID NO: 9233083 - DNA, 22 bp, Homo sapiens
ctgggcacaggggagcagagtc

SEQ ID NO: 9233084 - DNA, 22 bp, Homo sapiens
ctgggcacactctgctccagct

SEQ ID NO: 9233085 - DNA, 23 bp, Homo sapiens
ctgggcacccagtacctaggccc

SEQ ID NO: 9233086 - DNA, 20 bp, Homo sapiens
ctgggcacctgtctgcagtt

SEQ ID NO: 9233087 - DNA, 22 bp, Homo sapiens
ctgggcaccaggcatgacaggg

SEQ ID NO: 9233088 - DNA, 22 bp, Homo sapiens
ctgggcaccaggcatgacaggg

SEQ ID NO: 9233089 - DNA, 22 bp, Homo sapiens
ctgggcacattttgactagtgt

SEQ ID NO: 9233090 - DNA, 22 bp, Homo sapiens
ctgggcacaggggagcagagtc

SEQ ID NO: 9233091 - DNA, 22 bp, Homo sapiens
atatatcatgagtaaaacttga

SEQ ID NO: 9233092 - DNA, 22 bp, Homo sapiens
atatatctgcagtactgaagaa

SEQ ID NO: 9233093 - DNA, 21 bp, Homo sapiens
atatgaactgtggactttgga

SEQ ID NO: 9233094 - DNA, 22 bp, Homo sapiens
atatccaagaaacaattaattc

SEQ ID NO: 9233095 - DNA, 18 bp, Homo sapiens
atatccaataatgaacac

SEQ ID NO: 9233096 - DNA, 22 bp, Homo sapiens
atatgagtttcccacttctgga

SEQ ID NO: 9233097 - DNA, 22 bp, Homo sapiens
atatgagagtaaatgccgatct

SEQ ID NO: 9233098 - DNA, 22 bp, Homo sapiens
atatgacagcggattcacatat

SEQ ID NO: 9233099 - DNA, 22 bp, Homo sapiens
atatgacataaaatcatttttg

SEQ ID NO: 9233100 - DNA, 22 bp, Homo sapiens
atatgacagcggattcacatat

SEQ ID NO: 9233101 - DNA, 22 bp, Homo sapiens
atatgaatttggctggaaaggt

SEQ ID NO: 9233102 - DNA, 22 bp, Homo sapiens
atatgaagtcagacaaactggg

SEQ ID NO: 9233103 - DNA, 22 bp, Homo sapiens
atatgaagaattccaatttgga

SEQ ID NO: 9233104 - DNA, 22 bp, Homo sapiens
atatgaagtcagacaaactggg

SEQ ID NO: 9233105 - DNA, 22 bp, Homo sapiens
ctgggcaggtatacaaaaaatg

SEQ ID NO: 9233106 - DNA, 22 bp, Homo sapiens
ctgggcaggtatacaaaaaatg

SEQ ID NO: 9233107 - DNA, 22 bp, Homo sapiens
ctgggcagtatgaatattcaaa

SEQ ID NO: 9233108 - DNA, 22 bp, Homo sapiens
ctgggcagtatgaatattcaaa

SEQ ID NO: 9233109 - DNA, 22 bp, Homo sapiens
atatgattgtccttagcaaatt

SEQ ID NO: 9233110 - DNA, 22 bp, Homo sapiens
atatgcaagcacatagaatact

SEQ ID NO: 9233111 - DNA, 22 bp, Homo sapiens
ctgggcaggagggctctatgga

SEQ ID NO: 9233112 - DNA, 22 bp, Homo sapiens
ctgggcagtggtggcccttccc

SEQ ID NO: 9233113 - DNA, 22 bp, Homo sapiens
atatgctattgctgtaatttaa

SEQ ID NO: 9233114 - DNA, 20 bp, Homo sapiens
atatgcttaatctcactaca

SEQ ID NO: 9233115 - DNA, 22 bp, Homo sapiens
atatgctggagtacaggaaata

SEQ ID NO: 9233116 - DNA, 22 bp, Homo sapiens
atatggcagaccaattagaagc

SEQ ID NO: 9233117 - DNA, 22 bp, Homo sapiens
atatttcttgagcacctggtat

SEQ ID NO: 9233118 - DNA, 22 bp, Homo sapiens
atatttgtagtgggtaagaagt

SEQ ID NO: 9233119 - DNA, 20 bp, Homo sapiens
atatttcttaagaactttca

SEQ ID NO: 9233120 - DNA, 20 bp, Homo sapiens
atatttcttaagaactttca

SEQ ID NO: 9233121 - DNA, 22 bp, Homo sapiens
atatttctgggggtgtgtttct

SEQ ID NO: 9233122 - DNA, 22 bp, Homo sapiens
atatgtttttcacaggtttaag

SEQ ID NO: 9233123 - DNA, 22 bp, Homo sapiens
atatttctctcagacatggaag

SEQ ID NO: 9233124 - DNA, 22 bp, Homo sapiens
atatgttagggaacaatttgag

SEQ ID NO: 9233125 - DNA, 22 bp, Homo sapiens
atatgttactctttcaagcaga

SEQ ID NO: 9233126 - DNA, 22 bp, Homo sapiens
atatgtttcagtattcaagtca

SEQ ID NO: 9233127 - DNA, 22 bp, Homo sapiens
atatgtttcagtattcaagtca

SEQ ID NO: 9233128 - DNA, 22 bp, Homo sapiens
atatgttttgtgcttcattggt

SEQ ID NO: 9233129 - DNA, 22 bp, Homo sapiens
atatgtactgaaactgcttttc

SEQ ID NO: 9233130 - DNA, 22 bp, Homo sapiens
atatgggggggcgtgcagagga

SEQ ID NO: 9233131 - DNA, 23 bp, Homo sapiens
atatgtcatgcaccagcacttta

SEQ ID NO: 9233132 - DNA, 22 bp, Homo sapiens
atatgtgtaaatgcatttgttt

SEQ ID NO: 9233133 - DNA, 22 bp, Homo sapiens
atatgtgtgtgtgagaaaagct

SEQ ID NO: 9233134 - DNA, 18 bp, Homo sapiens
atatgttaattaggtagg

SEQ ID NO: 9233135 - DNA, 22 bp, Homo sapiens
atatgtgtgtatttcttactag

SEQ ID NO: 9233136 - DNA, 22 bp, Homo sapiens
atatgtgtgcacatatgtattt

SEQ ID NO: 9233137 - DNA, 22 bp, Homo sapiens
atatgtgtatggatttctatct

SEQ ID NO: 9233138 - DNA, 22 bp, Homo sapiens
atccctgccctcatggagctta

SEQ ID NO: 9233139 - DNA, 22 bp, Homo sapiens
atccctctgcagctggttcctg

SEQ ID NO: 9233140 - DNA, 22 bp, Homo sapiens
atccccaggggcattcaagctt

SEQ ID NO: 9233141 - DNA, 22 bp, Homo sapiens
atccccaggggcattcaagctt

SEQ ID NO: 9233142 - DNA, 23 bp, Homo sapiens
atcccctgccttgggtgagtccc

SEQ ID NO: 9233143 - DNA, 22 bp, Homo sapiens
atccatttgtaaatgttagagt

SEQ ID NO: 9233144 - DNA, 22 bp, Homo sapiens
atccatttgtaaatgttagagt

SEQ ID NO: 9233145 - DNA, 22 bp, Homo sapiens
atccctgccctcatggagctta

SEQ ID NO: 9233146 - DNA, 22 bp, Homo sapiens
atccctgccctcatggagctta

SEQ ID NO: 9233147 - DNA, 22 bp, Homo sapiens
atcctcagacctcagcaaagcc

SEQ ID NO: 9233148 - DNA, 22 bp, Homo sapiens
atcctcagcatctagcatgaag

SEQ ID NO: 9233149 - DNA, 22 bp, Homo sapiens
atcctcagagaacgaacacaat

SEQ ID NO: 9233150 - DNA, 22 bp, Homo sapiens
atcctcagtgtttctgacatct

SEQ ID NO: 9233151 - DNA, 22 bp, Homo sapiens
atcctccagctcctgcttctgc

SEQ ID NO: 9233152 - DNA, 22 bp, Homo sapiens
atctacaacccctcaaactgtg

SEQ ID NO: 9233153 - DNA, 22 bp, Homo sapiens
atctacaacatcacatggcatt

SEQ ID NO: 9233154 - DNA, 22 bp, Homo sapiens
atctaattttcactcatttgct

SEQ ID NO: 9233155 - DNA, 22 bp, Homo sapiens
atcctttaagttaataaaattc

SEQ ID NO: 9233156 - DNA, 22 bp, Homo sapiens
atctacaacatcacatggcatt

SEQ ID NO: 9233157 - DNA, 22 bp, Homo sapiens
atcctttaagttaataaaattc

SEQ ID NO: 9233158 - DNA, 22 bp, Homo sapiens
ctgtggagtggggagtactggt

SEQ ID NO: 9233159 - DNA, 22 bp, Homo sapiens
ctgtggagtggggagtactggt

SEQ ID NO: 9233160 - DNA, 22 bp, Homo sapiens
atcattctagctgttgtgttga

SEQ ID NO: 9233161 - DNA, 22 bp, Homo sapiens
ctgtggagtgcttggctcagtg

SEQ ID NO: 9233162 - DNA, 22 bp, Homo sapiens
ctgtggagtgcttggctcagtg

SEQ ID NO: 9233163 - DNA, 22 bp, Homo sapiens
ctgtggaggtaggagcaggaca

SEQ ID NO: 9233164 - DNA, 22 bp, Homo sapiens
ctgtggaggtaggagcaggaca

SEQ ID NO: 9233165 - DNA, 22 bp, Homo sapiens
ctgtggagcttgtggcagtggg

SEQ ID NO: 9233166 - DNA, 22 bp, Homo sapiens
ctgtggagcagggcagggtcac

SEQ ID NO: 9233167 - DNA, 22 bp, Homo sapiens
atccaaaggtgacacagaatac

SEQ ID NO: 9233168 - DNA, 22 bp, Homo sapiens
atccaaagtagattaagtcaca

SEQ ID NO: 9233169 - DNA, 22 bp, Homo sapiens
atccaaagccctaagttaactg

SEQ ID NO: 9233170 - DNA, 22 bp, Homo sapiens
atccaaatcatgtcagaagaac

SEQ ID NO: 9233171 - DNA, 22 bp, Homo sapiens
atccaaagaatgcttagacctg

SEQ ID NO: 9233172 - DNA, 22 bp, Homo sapiens
atccaaagatggaaagaacttt

SEQ ID NO: 9233173 - DNA, 22 bp, Homo sapiens
atccaagagacatttgtgaatg

SEQ ID NO: 9233174 - DNA, 22 bp, Homo sapiens
atcattttgtgacaatgcctgt

SEQ ID NO: 9233175 - DNA, 22 bp, Homo sapiens
atcattttgtgacaatgcctgt

SEQ ID NO: 9233176 - DNA, 22 bp, Homo sapiens
atcattctagtccttatggtct

SEQ ID NO: 9233177 - DNA, 22 bp, Homo sapiens
atcatttttaagagactcttct

SEQ ID NO: 9233178 - DNA, 22 bp, Homo sapiens
ctgtcttctcctttgtttcagg

SEQ ID NO: 9233179 - DNA, 22 bp, Homo sapiens
ctgtctgttttaccttctccag

SEQ ID NO: 9233180 - DNA, 22 bp, Homo sapiens
ctgtcttctaccttcaacctcc

SEQ ID NO: 9233181 - DNA, 22 bp, Homo sapiens
ctgtctctgtcttaactcccag

SEQ ID NO: 9233182 - DNA, 22 bp, Homo sapiens
ctgtctctgtcttaactcccag

SEQ ID NO: 9233183 - DNA, 19 bp, Homo sapiens
atcacatgtcaagagcagg

SEQ ID NO: 9233184 - DNA, 22 bp, Homo sapiens
ctgtctctgttgcctgtaggtg

SEQ ID NO: 9233185 - DNA, 22 bp, Homo sapiens
ctgtgatcattcttgatttaag

SEQ ID NO: 9233186 - DNA, 22 bp, Homo sapiens
ctgtgagttcattgtgccacct

SEQ ID NO: 9233187 - DNA, 22 bp, Homo sapiens
ctgtctttttagagagtaggat

SEQ ID NO: 9233188 - DNA, 18 bp, Homo sapiens
ctgtcttttttctctcca

SEQ ID NO: 9233189 - DNA, 22 bp, Homo sapiens
ctgtcttttcatactttccctc

SEQ ID NO: 9233190 - DNA, 22 bp, Homo sapiens
ctgtcttttcatactttccctc

SEQ ID NO: 9233191 - DNA, 22 bp, Homo sapiens
ctgtcttttcttctcattgatg

SEQ ID NO: 9233192 - DNA, 22 bp, Homo sapiens
ctgtcttttcttctcattgatg

SEQ ID NO: 9233193 - DNA, 22 bp, Homo sapiens
ctgtctttggtcctgtctgtta

SEQ ID NO: 9233194 - DNA, 22 bp, Homo sapiens
ctgtcttttactatcatttact

SEQ ID NO: 9233195 - DNA, 22 bp, Homo sapiens
atcatgcaggtttctcctttct

SEQ ID NO: 9233196 - DNA, 18 bp, Homo sapiens
atcatgctgaattaaaga

SEQ ID NO: 9233197 - DNA, 22 bp, Homo sapiens
atcatgacagagtctgccatcc

SEQ ID NO: 9233198 - DNA, 22 bp, Homo sapiens
atcatggaaaggttcagcaagc

SEQ ID NO: 9233199 - DNA, 22 bp, Homo sapiens
atcatggaagcctatcttgaga

SEQ ID NO: 9233200 - DNA, 18 bp, Homo sapiens
ctgtgcagcaaactgagc

SEQ ID NO: 9233201 - DNA, 22 bp, Homo sapiens
ctgtgcacttctctttatttgt

SEQ ID NO: 9233202 - DNA, 19 bp, Homo sapiens
ctgtgcaggccgggctgag

SEQ ID NO: 9233203 - DNA, 22 bp, Homo sapiens
atcatcatctaaattgtgtcgc

SEQ ID NO: 9233204 - DNA, 22 bp, Homo sapiens
ctgggtataggaaacagttaag

SEQ ID NO: 9233205 - DNA, 20 bp, Homo sapiens
ctgggtcacttggctgctct

SEQ ID NO: 9233206 - DNA, 22 bp, Homo sapiens
ctgggtcccacagcctgctggg

SEQ ID NO: 9233207 - DNA, 22 bp, Homo sapiens
ctgggtagggcaaggaactggc

SEQ ID NO: 9233208 - DNA, 18 bp, Homo sapiens
ctgggtctccaggctgcc

SEQ ID NO: 9233209 - DNA, 22 bp, Homo sapiens
ctgtccagtctttagcaagctg

SEQ ID NO: 9233210 - DNA, 22 bp, Homo sapiens
ctgtcctatgagtactcactag

SEQ ID NO: 9233211 - DNA, 18 bp, Homo sapiens
ctgggtctccaggctgcc

SEQ ID NO: 9233212 - DNA, 22 bp, Homo sapiens
ctgggtcctggtgctgagttct

SEQ ID NO: 9233213 - DNA, 22 bp, Homo sapiens
atcacatggaatgattttagac

SEQ ID NO: 9233214 - DNA, 22 bp, Homo sapiens
atcacatatttaagaaacatgt

SEQ ID NO: 9233215 - DNA, 22 bp, Homo sapiens
atcacagtgtagaccttttaaa

SEQ ID NO: 9233216 - DNA, 22 bp, Homo sapiens
atcacagggtgaggattagacc

SEQ ID NO: 9233217 - DNA, 22 bp, Homo sapiens
ctgtcctccggccacctacagt

SEQ ID NO: 9233218 - DNA, 22 bp, Homo sapiens
ctgtcctctgtcctcagcagga

SEQ ID NO: 9233219 - DNA, 22 bp, Homo sapiens
catctttaatttgtgacaacta

SEQ ID NO: 9233220 - DNA, 22 bp, Homo sapiens
catctttagggaccattattct

SEQ ID NO: 9233221 - DNA, 22 bp, Homo sapiens
catctttaatttgtgacaacta

SEQ ID NO: 9233222 - DNA, 22 bp, Homo sapiens
catctttagttattgaatatag

SEQ ID NO: 9233223 - DNA, 22 bp, Homo sapiens
catctttatttatatagacagg

SEQ ID NO: 9233224 - DNA, 22 bp, Homo sapiens
catctttcagtttataagtctg

SEQ ID NO: 9233225 - DNA, 22 bp, Homo sapiens
catctttcttagaactttcagt

SEQ ID NO: 9233226 - DNA, 22 bp, Homo sapiens
tcagttctggctgctgctgtca

SEQ ID NO: 9233227 - DNA, 22 bp, Homo sapiens
tcagttcttagtaatgcagtct

SEQ ID NO: 9233228 - DNA, 22 bp, Homo sapiens
tcagttctgaagttctgcctcc

SEQ ID NO: 9233229 - DNA, 22 bp, Homo sapiens
tcagttctctcatgcctgccct

SEQ ID NO: 9233230 - DNA, 22 bp, Homo sapiens
tcagttctaagtgctttacatg

SEQ ID NO: 9233231 - DNA, 22 bp, Homo sapiens
tcagttctaacagtttagaaca

SEQ ID NO: 9233232 - DNA, 22 bp, Homo sapiens
tcagttgccagtattttatata

SEQ ID NO: 9233233 - DNA, 22 bp, Homo sapiens
tcagttgctgtgtaatgttttc

SEQ ID NO: 9233234 - DNA, 22 bp, Homo sapiens
tcagttcttgggctgctaggac

SEQ ID NO: 9233235 - DNA, 22 bp, Homo sapiens
tcagttcttattttcatgaata

SEQ ID NO: 9233236 - DNA, 22 bp, Homo sapiens
tcagttctttatttcacagtga

SEQ ID NO: 9233237 - DNA, 22 bp, Homo sapiens
tcaggtggcttggagggggacg

SEQ ID NO: 9233238 - DNA, 22 bp, Homo sapiens
tcaggtggcttcggggagtggc

SEQ ID NO: 9233239 - DNA, 22 bp, Homo sapiens
tcaggtgggcgttccggtgcgg

SEQ ID NO: 9233240 - DNA, 22 bp, Homo sapiens
tcaggtgggcagtgggttgagc

SEQ ID NO: 9233241 - DNA, 22 bp, Homo sapiens
catctttaacaatttacaatgt

SEQ ID NO: 9233242 - DNA, 22 bp, Homo sapiens
catctttaaaatgggaacaaca

SEQ ID NO: 9233243 - DNA, 22 bp, Homo sapiens
tcatggggccacagctgccagc

SEQ ID NO: 9233244 - DNA, 22 bp, Homo sapiens
tcatggggctcttcaagtggag

SEQ ID NO: 9233245 - DNA, 22 bp, Homo sapiens
tcatggggtgaattagtatgct

SEQ ID NO: 9233246 - DNA, 22 bp, Homo sapiens
tcatggggtgacagaagggagg

SEQ ID NO: 9233247 - DNA, 22 bp, Homo sapiens
tcatggggtttggctggatgtc

SEQ ID NO: 9233248 - DNA, 22 bp, Homo sapiens
tcatggggtttggctggatgtc

SEQ ID NO: 9233249 - DNA, 22 bp, Homo sapiens
tcatgtaaatgtggatgcttcc

SEQ ID NO: 9233250 - DNA, 22 bp, Homo sapiens
tcatgtcagtttcttctataaa

SEQ ID NO: 9233251 - DNA, 22 bp, Homo sapiens
tcatgtcagtttcttctataaa

SEQ ID NO: 9233252 - DNA, 22 bp, Homo sapiens
tcatgtctctatgtgcctatta

SEQ ID NO: 9233253 - DNA, 19 bp, Homo sapiens
tcatgtctctcatctgtga

SEQ ID NO: 9233254 - DNA, 19 bp, Homo sapiens
tcatgtctctcatctgtga

SEQ ID NO: 9233255 - DNA, 22 bp, Homo sapiens
tcatttcaagttctgacagcta

SEQ ID NO: 9233256 - DNA, 22 bp, Homo sapiens
catgatggatgtgcacttcgct

SEQ ID NO: 9233257 - DNA, 22 bp, Homo sapiens
catgatgtcacagagaagcaca

SEQ ID NO: 9233258 - DNA, 22 bp, Homo sapiens
catgatataaagtagtagataa

SEQ ID NO: 9233259 - DNA, 22 bp, Homo sapiens
catgataggtatttaattaaat

SEQ ID NO: 9233260 - DNA, 22 bp, Homo sapiens
tcagtttataaattgtatttag

SEQ ID NO: 9233261 - DNA, 22 bp, Homo sapiens
catgagaagtggccttcaaaaa

SEQ ID NO: 9233262 - DNA, 22 bp, Homo sapiens
catgagttcaaaatgcctgcct

SEQ ID NO: 9233263 - DNA, 22 bp, Homo sapiens
catgagttttttagttcatgca

SEQ ID NO: 9233264 - DNA, 22 bp, Homo sapiens
tccaggcaaagtgctgggctgc

SEQ ID NO: 9233265 - DNA, 19 bp, Homo sapiens
catgtgcatgagcacagga

SEQ ID NO: 9233266 - DNA, 22 bp, Homo sapiens
tccaggcaaaaaccaactacag

SEQ ID NO: 9233267 - DNA, 22 bp, Homo sapiens
tccaggcaaaaggaactgcttg

SEQ ID NO: 9233268 - DNA, 22 bp, Homo sapiens
catgtcttccttgcacacacac

SEQ ID NO: 9233269 - DNA, 22 bp, Homo sapiens
catgtctttgttatgctcacca

SEQ ID NO: 9233270 - DNA, 22 bp, Homo sapiens
catgtctttctcatcacatcta

SEQ ID NO: 9233271 - DNA, 22 bp, Homo sapiens
catgtgaattccaaagctaggt

SEQ ID NO: 9233272 - DNA, 22 bp, Homo sapiens
catgtgaattccaaagctaggt

SEQ ID NO: 9233273 - DNA, 22 bp, Homo sapiens
tccagccatgactcggacagtg

SEQ ID NO: 9233274 - DNA, 22 bp, Homo sapiens
tccagccatgcatgacaatcac

SEQ ID NO: 9233275 - DNA, 22 bp, Homo sapiens
tccagccatgactcggacagtg

SEQ ID NO: 9233276 - DNA, 22 bp, Homo sapiens
tccagccacttgcacagttaaa

SEQ ID NO: 9233277 - DNA, 22 bp, Homo sapiens
tccagcccagctcctctcagaa

SEQ ID NO: 9233278 - DNA, 22 bp, Homo sapiens
catgatttactaaaatttgttt

SEQ ID NO: 9233279 - DNA, 22 bp, Homo sapiens
catgattttgtcttgtgttaat

SEQ ID NO: 9233280 - DNA, 22 bp, Homo sapiens
catgattttgtcttgtgttaat

SEQ ID NO: 9233281 - DNA, 22 bp, Homo sapiens
catgcaaacacgtaaacattca

SEQ ID NO: 9233282 - DNA, 22 bp, Homo sapiens
catgcaaaatgtattttattag

SEQ ID NO: 9233283 - DNA, 23 bp, Homo sapiens
catgcaaacactattgcatttgg

SEQ ID NO: 9233284 - DNA, 22 bp, Homo sapiens
catgcaagacaatctttaaaat

SEQ ID NO: 9233285 - DNA, 22 bp, Homo sapiens
catgcaagacaatctttaaaat

SEQ ID NO: 9233286 - DNA, 22 bp, Homo sapiens
catgcaaatgtgctaatctgaa

SEQ ID NO: 9233287 - DNA, 23 bp, Homo sapiens
catgcaaacactattgcatttgg

SEQ ID NO: 9233288 - DNA, 22 bp, Homo sapiens
tcattttcccactgaagctgtc

SEQ ID NO: 9233289 - DNA, 22 bp, Homo sapiens
tcattttcaagtttgaacagga

SEQ ID NO: 9233290 - DNA, 22 bp, Homo sapiens
tcattttcacacataaatagca

SEQ ID NO: 9233291 - DNA, 22 bp, Homo sapiens
tcattttcacacataaatagca

SEQ ID NO: 9233292 - DNA, 22 bp, Homo sapiens
tcattttgcctgccatttgagt

SEQ ID NO: 9233293 - DNA, 23 bp, Homo sapiens
catggctgatttcaagctaccac

SEQ ID NO: 9233294 - DNA, 22 bp, Homo sapiens
catggctgcgagaagagtgggt

SEQ ID NO: 9233295 - DNA, 22 bp, Homo sapiens
catggctgaacactcagtgact

SEQ ID NO: 9233296 - DNA, 22 bp, Homo sapiens
catgcacaaaggtaagatgcgt

SEQ ID NO: 9233297 - DNA, 22 bp, Homo sapiens
catggctttccagtcctccact

SEQ ID NO: 9233298 - DNA, 19 bp, Homo sapiens
catggctgctgcttgggag

SEQ ID NO: 9233299 - DNA, 22 bp, Homo sapiens
tcagccccacggggtcagccaa

SEQ ID NO: 9233300 - DNA, 20 bp, Homo sapiens
tcagctcttagaggtcgctt

SEQ ID NO: 9233301 - DNA, 20 bp, Homo sapiens
tcagctcttagaggtcgctt

SEQ ID NO: 9233302 - DNA, 22 bp, Homo sapiens
tcagctcttaaccctctggcct

SEQ ID NO: 9233303 - DNA, 22 bp, Homo sapiens
tcagctgagttctagagcactc

SEQ ID NO: 9233304 - DNA, 22 bp, Homo sapiens
tcagctgaagtggagaagcaga

SEQ ID NO: 9233305 - DNA, 22 bp, Homo sapiens
tcagctgagctccagctcatag

SEQ ID NO: 9233306 - DNA, 20 bp, Homo sapiens
tcagctctgtgcctgggatg

SEQ ID NO: 9233307 - DNA, 22 bp, Homo sapiens
tcagctctgtgtacagttagca

SEQ ID NO: 9233308 - DNA, 22 bp, Homo sapiens
tcagctctgttttgagtggaac

SEQ ID NO: 9233309 - DNA, 22 bp, Homo sapiens
tcagctctgttttgagtggaac

SEQ ID NO: 9233310 - DNA, 22 bp, Homo sapiens
tcagctctgttttgagtggaac

SEQ ID NO: 9233311 - DNA, 22 bp, Homo sapiens
tcagctctggttcatgtggtct

SEQ ID NO: 9233312 - DNA, 22 bp, Homo sapiens
catactttttagatctgccttc

SEQ ID NO: 9233313 - DNA, 22 bp, Homo sapiens
catacttttgccctgacattct

SEQ ID NO: 9233314 - DNA, 22 bp, Homo sapiens
catacttttgccctgacattct

SEQ ID NO: 9233315 - DNA, 22 bp, Homo sapiens
catactttgggataagagtgga

SEQ ID NO: 9233316 - DNA, 22 bp, Homo sapiens
catactttctttttcacgcata

SEQ ID NO: 9233317 - DNA, 22 bp, Homo sapiens
catacattttgcatatttacca

SEQ ID NO: 9233318 - DNA, 22 bp, Homo sapiens
catacattttgcatatttacca

SEQ ID NO: 9233319 - DNA, 22 bp, Homo sapiens
catacctttctcaagcacatgt

SEQ ID NO: 9233320 - DNA, 22 bp, Homo sapiens
cataatttttttaagtcagaac

SEQ ID NO: 9233321 - DNA, 22 bp, Homo sapiens
catacattacctaacttaatgc

SEQ ID NO: 9233322 - DNA, 22 bp, Homo sapiens
catacatttatacacatctatg

SEQ ID NO: 9233323 - DNA, 22 bp, Homo sapiens
catacatttatacacatctatg

SEQ ID NO: 9233324 - DNA, 22 bp, Homo sapiens
catacatttatacacatctatg

SEQ ID NO: 9233325 - DNA, 22 bp, Homo sapiens
catacatttatacacatctatg

SEQ ID NO: 9233326 - DNA, 22 bp, Homo sapiens
catacattgctcattcagtatc

SEQ ID NO: 9233327 - DNA, 22 bp, Homo sapiens
catacattgctcattcagtatc

SEQ ID NO: 9233328 - DNA, 22 bp, Homo sapiens
catacattgctcattcagtatc

SEQ ID NO: 9233329 - DNA, 22 bp, Homo sapiens
cataatttttttaagtcagaac

SEQ ID NO: 9233330 - DNA, 22 bp, Homo sapiens
catacattacctaacttaatgc

SEQ ID NO: 9233331 - DNA, 19 bp, Homo sapiens
cagtttgtccagaggggac

SEQ ID NO: 9233332 - DNA, 22 bp, Homo sapiens
cagtttcttggatgccaatttc

SEQ ID NO: 9233333 - DNA, 22 bp, Homo sapiens
cagtttcttctattttgaacta

SEQ ID NO: 9233334 - DNA, 22 bp, Homo sapiens
cagtttgcaaatgacttacaga

SEQ ID NO: 9233335 - DNA, 22 bp, Homo sapiens
cagtttctttccattgttacct

SEQ ID NO: 9233336 - DNA, 22 bp, Homo sapiens
cagtttctttccattgttacct

SEQ ID NO: 9233337 - DNA, 17 bp, Homo sapiens
cagtttcttccccctct

SEQ ID NO: 9233338 - DNA, 22 bp, Homo sapiens
cagtttctgttttaaatagcag

SEQ ID NO: 9233339 - DNA, 22 bp, Homo sapiens
cagtttctgttttaaatagcag

SEQ ID NO: 9233340 - DNA, 22 bp, Homo sapiens
cagtttcttatcttcaaaattg

SEQ ID NO: 9233341 - DNA, 22 bp, Homo sapiens
cagtttcttcatcagttaagca

SEQ ID NO: 9233342 - DNA, 22 bp, Homo sapiens
cagtttcttcatctgcagaatc

SEQ ID NO: 9233343 - DNA, 22 bp, Homo sapiens
cagtttcttctattttgaacta

SEQ ID NO: 9233344 - DNA, 22 bp, Homo sapiens
cagtttctgaggttccaggttt

SEQ ID NO: 9233345 - DNA, 22 bp, Homo sapiens
cagtttctgagccctgtcattt

SEQ ID NO: 9233346 - DNA, 22 bp, Homo sapiens
cagtttctctcatacatatttg

SEQ ID NO: 9233347 - DNA, 22 bp, Homo sapiens
cagtttctctcatacatatttg

SEQ ID NO: 9233348 - DNA, 22 bp, Homo sapiens
cagtttctgccaggatgtgtta

SEQ ID NO: 9233349 - DNA, 22 bp, Homo sapiens
cagtttctgccaggatgtgtta

SEQ ID NO: 9233350 - DNA, 22 bp, Homo sapiens
cagtttctgggaggaaaggaag

SEQ ID NO: 9233351 - DNA, 22 bp, Homo sapiens
cagtttctgggcgttcacaggt

SEQ ID NO: 9233352 - DNA, 22 bp, Homo sapiens
cagtttctgtctgttcttatcc

SEQ ID NO: 9233353 - DNA, 22 bp, Homo sapiens
tcagaaggtggaggttgcagtg

SEQ ID NO: 9233354 - DNA, 20 bp, Homo sapiens
catatatacctagaagtgga

SEQ ID NO: 9233355 - DNA, 22 bp, Homo sapiens
catatcataggtcttggataat

SEQ ID NO: 9233356 - DNA, 22 bp, Homo sapiens
catatcaaagagaaggatagga

SEQ ID NO: 9233357 - DNA, 22 bp, Homo sapiens
catatattctggttttcactgg

SEQ ID NO: 9233358 - DNA, 22 bp, Homo sapiens
catatcatttgcttataaatct

SEQ ID NO: 9233359 - DNA, 22 bp, Homo sapiens
catatcatttgcttataaatct

SEQ ID NO: 9233360 - DNA, 22 bp, Homo sapiens
catatcttatggttttctaagt

SEQ ID NO: 9233361 - DNA, 22 bp, Homo sapiens
catatcttctgacatgatcagg

SEQ ID NO: 9233362 - DNA, 22 bp, Homo sapiens
catatcttatggttttctaagt

SEQ ID NO: 9233363 - DNA, 21 bp, Homo sapiens
catatgaaagaagtatctgac

SEQ ID NO: 9233364 - DNA, 22 bp, Homo sapiens
catataaatacaacatgtgtta

SEQ ID NO: 9233365 - DNA, 22 bp, Homo sapiens
catataaatacaacatgtgtta

SEQ ID NO: 9233366 - DNA, 22 bp, Homo sapiens
catatacacttccacctctgtg

SEQ ID NO: 9233367 - DNA, 22 bp, Homo sapiens
catcacatgtaggcagcatcac

SEQ ID NO: 9233368 - DNA, 19 bp, Homo sapiens
catcacatggtctgatgaa

SEQ ID NO: 9233369 - DNA, 22 bp, Homo sapiens
catcacatgcctatcatgagct

SEQ ID NO: 9233370 - DNA, 22 bp, Homo sapiens
catcacagtttgtcagaaatca

SEQ ID NO: 9233371 - DNA, 22 bp, Homo sapiens
catcacaggtcctgatgacatt

SEQ ID NO: 9233372 - DNA, 22 bp, Homo sapiens
catcacagggggctagaagtct

SEQ ID NO: 9233373 - DNA, 22 bp, Homo sapiens
catccactagaatgacagagtt

SEQ ID NO: 9233374 - DNA, 22 bp, Homo sapiens
catccagctcctgggggccacc

SEQ ID NO: 9233375 - DNA, 22 bp, Homo sapiens
catccaggctgaagtgcagtgg

SEQ ID NO: 9233376 - DNA, 23 bp, Homo sapiens
catccaggagctgagtctgactg

SEQ ID NO: 9233377 - DNA, 22 bp, Homo sapiens
tcagggccatcttttgcctcaa

SEQ ID NO: 9233378 - DNA, 22 bp, Homo sapiens
tcagggattgcaaaattcatcc

SEQ ID NO: 9233379 - DNA, 20 bp, Homo sapiens
catatggaaagatattgttc

SEQ ID NO: 9233380 - DNA, 22 bp, Homo sapiens
caggtctgggttgatggcctgg

SEQ ID NO: 9233381 - DNA, 22 bp, Homo sapiens
caggtctggtgagagaacagtt

SEQ ID NO: 9233382 - DNA, 22 bp, Homo sapiens
caggtctgttttcaaggtcagt

SEQ ID NO: 9233383 - DNA, 22 bp, Homo sapiens
caggtctgtttccatcagtgct

SEQ ID NO: 9233384 - DNA, 22 bp, Homo sapiens
caggtctgtttccatcagtgct

SEQ ID NO: 9233385 - DNA, 18 bp, Homo sapiens
caggtctgtctgcctccc

SEQ ID NO: 9233386 - DNA, 22 bp, Homo sapiens
caggtctgtattaacagagggt

SEQ ID NO: 9233387 - DNA, 22 bp, Homo sapiens
caggtctgtattaacagagggt

SEQ ID NO: 9233388 - DNA, 20 bp, Homo sapiens
caggtcttcatgtggctgtc

SEQ ID NO: 9233389 - DNA, 22 bp, Homo sapiens
caggtgaaaaagcaaccatatt

SEQ ID NO: 9233390 - DNA, 22 bp, Homo sapiens
tatgtacatgttaaagggcaaa

SEQ ID NO: 9233391 - DNA, 22 bp, Homo sapiens
caggtgaactcagttttgtatt

SEQ ID NO: 9233392 - DNA, 22 bp, Homo sapiens
caggtgaacccagtctaatcat

SEQ ID NO: 9233393 - DNA, 22 bp, Homo sapiens
caggtgaaaaagcaaccatatt

SEQ ID NO: 9233394 - DNA, 22 bp, Homo sapiens
tatggcagaggagaggcactag

SEQ ID NO: 9233395 - DNA, 22 bp, Homo sapiens
tatggcaagatgacatgttctc

SEQ ID NO: 9233396 - DNA, 22 bp, Homo sapiens
tatggcaagatgacatgttctc

SEQ ID NO: 9233397 - DNA, 22 bp, Homo sapiens
tatggcaagagaatcaactgaa

SEQ ID NO: 9233398 - DNA, 22 bp, Homo sapiens
tatgcacagttacaagaatatc

SEQ ID NO: 9233399 - DNA, 22 bp, Homo sapiens
tatggagattcaaaagcatctt

SEQ ID NO: 9233400 - DNA, 22 bp, Homo sapiens
tatctctgtaaaagaaatcaca

SEQ ID NO: 9233401 - DNA, 22 bp, Homo sapiens
tatctcttgcatgctttttaga

SEQ ID NO: 9233402 - DNA, 17 bp, Homo sapiens
tatctcttcaagtttca

SEQ ID NO: 9233403 - DNA, 22 bp, Homo sapiens
tatctcttgtctgttttgcaaa

SEQ ID NO: 9233404 - DNA, 22 bp, Homo sapiens
tattgcctgagtgtttcataat

SEQ ID NO: 9233405 - DNA, 22 bp, Homo sapiens
tattgccaaatgtctgctggaa

SEQ ID NO: 9233406 - DNA, 22 bp, Homo sapiens
tattgctttctcagacgtttag

SEQ ID NO: 9233407 - DNA, 22 bp, Homo sapiens
tattgcttaaaaaatatgtgag

SEQ ID NO: 9233408 - DNA, 22 bp, Homo sapiens
tattaaatatatctgttagttg

SEQ ID NO: 9233409 - DNA, 22 bp, Homo sapiens
tattaaatatatctgttagttg

SEQ ID NO: 9233410 - DNA, 22 bp, Homo sapiens
tattaaagggaagttatgcatg

SEQ ID NO: 9233411 - DNA, 22 bp, Homo sapiens
tattaaagagagaatcatcatc

SEQ ID NO: 9233412 - DNA, 22 bp, Homo sapiens
tatgtttttcaagtgcacacta

SEQ ID NO: 9233413 - DNA, 22 bp, Homo sapiens
tatgtttttcaagtgcacacta

SEQ ID NO: 9233414 - DNA, 22 bp, Homo sapiens
tatgtttttcagacgtcctaca

SEQ ID NO: 9233415 - DNA, 22 bp, Homo sapiens
tatgttttaggaattaattgtt

SEQ ID NO: 9233416 - DNA, 22 bp, Homo sapiens
tatgtttttaagagaatgcatt

SEQ ID NO: 9233417 - DNA, 22 bp, Homo sapiens
tatgtttttaagagaatgcatt

SEQ ID NO: 9233418 - DNA, 22 bp, Homo sapiens
tatgttttaggaattaattgtt

SEQ ID NO: 9233419 - DNA, 22 bp, Homo sapiens
tatgttttaggaattaattgtt

SEQ ID NO: 9233420 - DNA, 22 bp, Homo sapiens
tatgtgtatgtacatacataca

SEQ ID NO: 9233421 - DNA, 22 bp, Homo sapiens
tatgtgtatgtacatacataca

SEQ ID NO: 9233422 - DNA, 22 bp, Homo sapiens
tatgtgtagtgtgatcccaatg

SEQ ID NO: 9233423 - DNA, 22 bp, Homo sapiens
tatgtgtactcgttaaatattt

SEQ ID NO: 9233424 - DNA, 22 bp, Homo sapiens
tatgtgtactcgttaaatattt

SEQ ID NO: 9233425 - DNA, 22 bp, Homo sapiens
tatgtgcatgctgacttgagga

SEQ ID NO: 9233426 - DNA, 23 bp, Homo sapiens
tatgtgcatatgtgtaagaatac

SEQ ID NO: 9233427 - DNA, 22 bp, Homo sapiens
tatgtactaactttcattctag

SEQ ID NO: 9233428 - DNA, 22 bp, Homo sapiens
tatacagatggaaagatacaca

SEQ ID NO: 9233429 - DNA, 22 bp, Homo sapiens
cagggtggcacatcacagcatt

SEQ ID NO: 9233430 - DNA, 22 bp, Homo sapiens
cagggtggaatggaatgctggc

SEQ ID NO: 9233431 - DNA, 22 bp, Homo sapiens
cagggtggaagctgtagagtgg

SEQ ID NO: 9233432 - DNA, 22 bp, Homo sapiens
cagggtggaatggaatgctggc

SEQ ID NO: 9233433 - DNA, 22 bp, Homo sapiens
tatacagtatcttttgaaggca

SEQ ID NO: 9233434 - DNA, 21 bp, Homo sapiens
tatacagtaattaagtggtat

SEQ ID NO: 9233435 - DNA, 22 bp, Homo sapiens
tatacagtatcttttgaaggca

SEQ ID NO: 9233436 - DNA, 22 bp, Homo sapiens
caggtctgcagacagggccatg

SEQ ID NO: 9233437 - DNA, 22 bp, Homo sapiens
caggtctgcagacagggccatg

SEQ ID NO: 9233438 - DNA, 17 bp, Homo sapiens
caggtctgaggccaggc

SEQ ID NO: 9233439 - DNA, 17 bp, Homo sapiens
caggtctgaggccaggc

SEQ ID NO: 9233440 - DNA, 22 bp, Homo sapiens
tatctattatgttctatgtgtc

SEQ ID NO: 9233441 - DNA, 22 bp, Homo sapiens
tatctattccaaatatcagcgt

SEQ ID NO: 9233442 - DNA, 22 bp, Homo sapiens
tatctatgtggtgatcttattt

SEQ ID NO: 9233443 - DNA, 22 bp, Homo sapiens
tatctatgtgctctgacctctc

SEQ ID NO: 9233444 - DNA, 22 bp, Homo sapiens
tatctatgtggtgatcttattt

SEQ ID NO: 9233445 - DNA, 22 bp, Homo sapiens
tatctatgtggtgatcttattt

SEQ ID NO: 9233446 - DNA, 22 bp, Homo sapiens
cagggtggaaaagctagttgga

SEQ ID NO: 9233447 - DNA, 22 bp, Homo sapiens
cagggtgcttccgtggagctgt

SEQ ID NO: 9233448 - DNA, 22 bp, Homo sapiens
cagggtggaacaggcaatactt

SEQ ID NO: 9233449 - DNA, 22 bp, Homo sapiens
cagggtggaagctgtagagtgg

SEQ ID NO: 9233450 - DNA, 22 bp, Homo sapiens
cagggtggaagctgtagagtgg

SEQ ID NO: 9233451 - DNA, 22 bp, Homo sapiens
caggggcctggctgtctaggaa

SEQ ID NO: 9233452 - DNA, 22 bp, Homo sapiens
caggggcctggctgtctaggaa

SEQ ID NO: 9233453 - DNA, 22 bp, Homo sapiens
cagggtgcttccgtggagctgt

SEQ ID NO: 9233454 - DNA, 22 bp, Homo sapiens
caggggcagtctgtgtgcgtgg

SEQ ID NO: 9233455 - DNA, 22 bp, Homo sapiens
caggggcagtctgtgtgcgtgg

SEQ ID NO: 9233456 - DNA, 22 bp, Homo sapiens
caggggcaggtgtgagatcatc

SEQ ID NO: 9233457 - DNA, 22 bp, Homo sapiens
caggggccaagggtccagacct

SEQ ID NO: 9233458 - DNA, 22 bp, Homo sapiens
caggggccaggctgtctgctgt

SEQ ID NO: 9233459 - DNA, 22 bp, Homo sapiens
caggggccggctgtccgtgccc

SEQ ID NO: 9233460 - DNA, 22 bp, Homo sapiens
caggggccaggctgtctgctgt

SEQ ID NO: 9233461 - DNA, 22 bp, Homo sapiens
caggggccggctgtccgtgccc

SEQ ID NO: 9233462 - DNA, 22 bp, Homo sapiens
tataagtagttgttgaagactt

SEQ ID NO: 9233463 - DNA, 22 bp, Homo sapiens
tataagtgacagattatccaaa

SEQ ID NO: 9233464 - DNA, 22 bp, Homo sapiens
tataagtagttgttgaagactt

SEQ ID NO: 9233465 - DNA, 22 bp, Homo sapiens
tataatatgaggcaggagtgat

SEQ ID NO: 9233466 - DNA, 22 bp, Homo sapiens
tataagtgtagtttcaaatgtt

SEQ ID NO: 9233467 - DNA, 22 bp, Homo sapiens
tataatattccttgttgtaggt

SEQ ID NO: 9233468 - DNA, 22 bp, Homo sapiens
tataatattccttgttgtaggt

SEQ ID NO: 9233469 - DNA, 22 bp, Homo sapiens
tataattagtaaatggcagatt

SEQ ID NO: 9233470 - DNA, 22 bp, Homo sapiens
caggggcaagaatgctgtcagc

SEQ ID NO: 9233471 - DNA, 22 bp, Homo sapiens
tacatgtgttctgtttcaagtt

SEQ ID NO: 9233472 - DNA, 22 bp, Homo sapiens
tataagaagtgaagaagagtta

SEQ ID NO: 9233473 - DNA, 22 bp, Homo sapiens
tataagaaacaaggcaaatttt

SEQ ID NO: 9233474 - DNA, 19 bp, Homo sapiens
cagtgcccgacgcaggtct

SEQ ID NO: 9233475 - DNA, 22 bp, Homo sapiens
cagtgctcctgatgtacccttg

SEQ ID NO: 9233476 - DNA, 22 bp, Homo sapiens
cagtgctgcaggcgcctgcggt

SEQ ID NO: 9233477 - DNA, 22 bp, Homo sapiens
cagtgctgagagcctggccagg

SEQ ID NO: 9233478 - DNA, 22 bp, Homo sapiens
cagtgctgggcagaggagagcg

SEQ ID NO: 9233479 - DNA, 22 bp, Homo sapiens
cagtgctggctgttaggacagt

SEQ ID NO: 9233480 - DNA, 22 bp, Homo sapiens
cagtgctgctctctgtaagaga

SEQ ID NO: 9233481 - DNA, 22 bp, Homo sapiens
cagtgctgtgtttgctgcctgg

SEQ ID NO: 9233482 - DNA, 22 bp, Homo sapiens
cagtgctgttgggcccagagag

SEQ ID NO: 9233483 - DNA, 22 bp, Homo sapiens
cagtgctgtgctggaagctgtt

SEQ ID NO: 9233484 - DNA, 23 bp, Homo sapiens
cagtgctggttctgcctgtgggg

SEQ ID NO: 9233485 - DNA, 22 bp, Homo sapiens
tcaccaggctggagtgcagtgg

SEQ ID NO: 9233486 - DNA, 22 bp, Homo sapiens
tcaccaggctggagtgcagtgg

SEQ ID NO: 9233487 - DNA, 22 bp, Homo sapiens
tcaccaggctggaatgcagtgg

SEQ ID NO: 9233488 - DNA, 22 bp, Homo sapiens
tcaccaggctcctgttaagatg

SEQ ID NO: 9233489 - DNA, 22 bp, Homo sapiens
tcaccaggctagagtgcagtgg

SEQ ID NO: 9233490 - DNA, 22 bp, Homo sapiens
tcaccaggctggaatgcagtgg

SEQ ID NO: 9233491 - DNA, 22 bp, Homo sapiens
tcaccattggcaattataaaac

SEQ ID NO: 9233492 - DNA, 22 bp, Homo sapiens
tcacccaagaccatcggaagtg

SEQ ID NO: 9233493 - DNA, 22 bp, Homo sapiens
tcaccagggagcttgtcctctg

SEQ ID NO: 9233494 - DNA, 22 bp, Homo sapiens
tcacccagacagcttgcactga

SEQ ID NO: 9233495 - DNA, 22 bp, Homo sapiens
tcacccagacagcttgcactga

SEQ ID NO: 9233496 - DNA, 22 bp, Homo sapiens
tcacccagactgtctgactctt

SEQ ID NO: 9233497 - DNA, 22 bp, Homo sapiens
tcacccagaaaagacagcagat

SEQ ID NO: 9233498 - DNA, 22 bp, Homo sapiens
tcacccagaaaagacagcagat

SEQ ID NO: 9233499 - DNA, 22 bp, Homo sapiens
tcacccagacttgtgaatgtgt

SEQ ID NO: 9233500 - DNA, 22 bp, Homo sapiens
tcacccagatagtgagcatagt

SEQ ID NO: 9233501 - DNA, 22 bp, Homo sapiens
tcacccagattacatcctgtca

SEQ ID NO: 9233502 - DNA, 22 bp, Homo sapiens
tcacccagacttgtgaatgtgt

SEQ ID NO: 9233503 - DNA, 22 bp, Homo sapiens
tcactatgcccagaatacagtt

SEQ ID NO: 9233504 - DNA, 22 bp, Homo sapiens
tcactcaggttcatgtctttgt

SEQ ID NO: 9233505 - DNA, 22 bp, Homo sapiens
tcactccatagcttaactcttt

SEQ ID NO: 9233506 - DNA, 22 bp, Homo sapiens
tcactccatagcttaactcttt

SEQ ID NO: 9233507 - DNA, 22 bp, Homo sapiens
tcacttcccagacggggtggca

SEQ ID NO: 9233508 - DNA, 22 bp, Homo sapiens
tcacttcccagacggggtggca

SEQ ID NO: 9233509 - DNA, 22 bp, Homo sapiens
tcacttccctcttcagctccca

SEQ ID NO: 9233510 - DNA, 22 bp, Homo sapiens
tcagaaatagtctttaaaatga

SEQ ID NO: 9233511 - DNA, 22 bp, Homo sapiens
tcagaaatgatcgttattcatt

SEQ ID NO: 9233512 - DNA, 22 bp, Homo sapiens
tcagaaatgatcgttattcatt

SEQ ID NO: 9233513 - DNA, 22 bp, Homo sapiens
tcagaaatgtaagctgatgact

SEQ ID NO: 9233514 - DNA, 22 bp, Homo sapiens
tcagaaatagctctaagctcct

SEQ ID NO: 9233515 - DNA, 22 bp, Homo sapiens
tcagaaatacaaaacacttact

SEQ ID NO: 9233516 - DNA, 22 bp, Homo sapiens
tcagaaataatgaatgatgggg

SEQ ID NO: 9233517 - DNA, 22 bp, Homo sapiens
tcagaagctggtgtcctttgaa

SEQ ID NO: 9233518 - DNA, 22 bp, Homo sapiens
tcagaaggaaacgatgccagct

SEQ ID NO: 9233519 - DNA, 23 bp, Homo sapiens
tcagaacaatgccttaggggcat

SEQ ID NO: 9233520 - DNA, 22 bp, Homo sapiens
tcagaaatttaggctggacttg

SEQ ID NO: 9233521 - DNA, 22 bp, Homo sapiens
tcagaagctaaatttgatattt

SEQ ID NO: 9233522 - DNA, 21 bp, Homo sapiens
tcagaacaattccatgcctcc

SEQ ID NO: 9233523 - DNA, 22 bp, Homo sapiens
cagtcctggggaccaggctgag

SEQ ID NO: 9233524 - DNA, 22 bp, Homo sapiens
cagtcctggggaccaggctgag

SEQ ID NO: 9233525 - DNA, 22 bp, Homo sapiens
cagtcctgggtgcagcaggaaa

SEQ ID NO: 9233526 - DNA, 22 bp, Homo sapiens
cagtcctgggcaggtcaggcca

SEQ ID NO: 9233527 - DNA, 22 bp, Homo sapiens
cagtcctctctgtgtctgcacc

SEQ ID NO: 9233528 - DNA, 22 bp, Homo sapiens
cagtccttgctcaaagtctaca

SEQ ID NO: 9233529 - DNA, 22 bp, Homo sapiens
cagtccttgctatgaccctgag

SEQ ID NO: 9233530 - DNA, 22 bp, Homo sapiens
cagtccttgctatgaccctgag

SEQ ID NO: 9233531 - DNA, 22 bp, Homo sapiens
cagtccttgatccaatagtggg

SEQ ID NO: 9233532 - DNA, 22 bp, Homo sapiens
cagtccttgctctgggatgatg

SEQ ID NO: 9233533 - DNA, 22 bp, Homo sapiens
cagtccttggcttcatccgagt

SEQ ID NO: 9233534 - DNA, 22 bp, Homo sapiens
cagtccttggcaagttctcagt

SEQ ID NO: 9233535 - DNA, 22 bp, Homo sapiens
cagtccttggcaagttctcagt

SEQ ID NO: 9233536 - DNA, 22 bp, Homo sapiens
cagtccttctccattaaggctc

SEQ ID NO: 9233537 - DNA, 22 bp, Homo sapiens
cagtccttccttgccccttggg

SEQ ID NO: 9233538 - DNA, 22 bp, Homo sapiens
cagtccttcattcctcctttga

SEQ ID NO: 9233539 - DNA, 22 bp, Homo sapiens
cagtccttagtctggatggctt

SEQ ID NO: 9233540 - DNA, 22 bp, Homo sapiens
cagtccttagattttactgcca

SEQ ID NO: 9233541 - DNA, 22 bp, Homo sapiens
cagtccttattcctatattcct

SEQ ID NO: 9233542 - DNA, 22 bp, Homo sapiens
cagtccttaaggaaacatttgt

SEQ ID NO: 9233543 - DNA, 22 bp, Homo sapiens
cagtccttagattttactgcca

SEQ ID NO: 9233544 - DNA, 22 bp, Homo sapiens
cagtccttaaggaaacatttgt

SEQ ID NO: 9233545 - DNA, 22 bp, Homo sapiens
tattggattgagacattttaga

SEQ ID NO: 9233546 - DNA, 22 bp, Homo sapiens
tattggaccacagactttaagg

SEQ ID NO: 9233547 - DNA, 22 bp, Homo sapiens
tatttagatgcatttggattgc

SEQ ID NO: 9233548 - DNA, 22 bp, Homo sapiens
tatttactgtatttgaagttga

SEQ ID NO: 9233549 - DNA, 22 bp, Homo sapiens
tatttagaacagacaatagaaa

SEQ ID NO: 9233550 - DNA, 22 bp, Homo sapiens
cagtgcagaggccagggaggat

SEQ ID NO: 9233551 - DNA, 22 bp, Homo sapiens
cagtgcagacgtggagggggca

SEQ ID NO: 9233552 - DNA, 22 bp, Homo sapiens
cagtgcaattacaagctaattc

SEQ ID NO: 9233553 - DNA, 22 bp, Homo sapiens
cagtgattcagactcatcattt

SEQ ID NO: 9233554 - DNA, 19 bp, Homo sapiens
cagtgattaattcatctta

SEQ ID NO: 9233555 - DNA, 22 bp, Homo sapiens
cagtgatggatatggagaagtc

SEQ ID NO: 9233556 - DNA, 22 bp, Homo sapiens
cagtgaggtggatggatggcct

SEQ ID NO: 9233557 - DNA, 20 bp, Homo sapiens
cagtgaggaggtgctggggg

SEQ ID NO: 9233558 - DNA, 22 bp, Homo sapiens
cagtgagggcccccttccaggt

SEQ ID NO: 9233559 - DNA, 21 bp, Homo sapiens
cagtgaggtccccagcctagg

SEQ ID NO: 9233560 - DNA, 22 bp, Homo sapiens
cagtgaggtgcccagcctgccc

SEQ ID NO: 9233561 - DNA, 22 bp, Homo sapiens
cagtgaggtggatggatggcct

SEQ ID NO: 9233562 - DNA, 22 bp, Homo sapiens
cagtcctttcaatggtgacctt

SEQ ID NO: 9233563 - DNA, 19 bp, Homo sapiens
cagtcctttccgctttctc

SEQ ID NO: 9233564 - DNA, 22 bp, Homo sapiens
cagtcctttctgaaatcctata

SEQ ID NO: 9233565 - DNA, 22 bp, Homo sapiens
cagtgaggaagctgtctggacc

SEQ ID NO: 9233566 - DNA, 22 bp, Homo sapiens
cagtctccgccagctcctcaca

SEQ ID NO: 9233567 - DNA, 22 bp, Homo sapiens
cagtctcctgggggctgttgtt

SEQ ID NO: 9233568 - DNA, 22 bp, Homo sapiens
cagtctccaaatcagtctgaat

SEQ ID NO: 9233569 - DNA, 22 bp, Homo sapiens
cagtctccaaatcaatctgaat

SEQ ID NO: 9233570 - DNA, 22 bp, Homo sapiens
tctgaggcataacctgttctgc

SEQ ID NO: 9233571 - DNA, 22 bp, Homo sapiens
tctgaggcataacctgttctgc

SEQ ID NO: 9233572 - DNA, 22 bp, Homo sapiens
tctgaggcagcttgccactcta

SEQ ID NO: 9233573 - DNA, 22 bp, Homo sapiens
tctgaggcatacccaggccccc

SEQ ID NO: 9233574 - DNA, 22 bp, Homo sapiens
tctgaggcataacctgttctgc

SEQ ID NO: 9233575 - DNA, 22 bp, Homo sapiens
tctgaggcatacccaggccccc

SEQ ID NO: 9233576 - DNA, 22 bp, Homo sapiens
tctgaggcccagttcaactctt

SEQ ID NO: 9233577 - DNA, 22 bp, Homo sapiens
tctgaggccccagccctgcaca

SEQ ID NO: 9233578 - DNA, 22 bp, Homo sapiens
tctgaggcccagttcaactctt

SEQ ID NO: 9233579 - DNA, 22 bp, Homo sapiens
tctgaggcccctgggcaggatg

SEQ ID NO: 9233580 - DNA, 22 bp, Homo sapiens
tctgagtcttggggtccctatt

SEQ ID NO: 9233581 - DNA, 22 bp, Homo sapiens
tctgaggttttcatgttttctg

SEQ ID NO: 9233582 - DNA, 22 bp, Homo sapiens
tctgaggttgaactttgcaaag

SEQ ID NO: 9233583 - DNA, 22 bp, Homo sapiens
tctgaggttctgttttcaactg

SEQ ID NO: 9233584 - DNA, 22 bp, Homo sapiens
tctgaggttccctcaactacct

SEQ ID NO: 9233585 - DNA, 22 bp, Homo sapiens
tctgaggcaaacagaggagtgt

SEQ ID NO: 9233586 - DNA, 22 bp, Homo sapiens
tctgaggcagcttgccactcta

SEQ ID NO: 9233587 - DNA, 22 bp, Homo sapiens
tctgaggacctactgaagagtt

SEQ ID NO: 9233588 - DNA, 22 bp, Homo sapiens
tctgaggagttgggccagtgct

SEQ ID NO: 9233589 - DNA, 22 bp, Homo sapiens
ccagccctacagtatcacctgt

SEQ ID NO: 9233590 - DNA, 22 bp, Homo sapiens
ccagccctcactgaggcctctc

SEQ ID NO: 9233591 - DNA, 21 bp, Homo sapiens
ccagcccagctgtgtcccagc

SEQ ID NO: 9233592 - DNA, 21 bp, Homo sapiens
ccagcccagcctccttctctt

SEQ ID NO: 9233593 - DNA, 22 bp, Homo sapiens
ccagccccgggaacctggccgt

SEQ ID NO: 9233594 - DNA, 22 bp, Homo sapiens
ccagccccgggccttaccgtgc

SEQ ID NO: 9233595 - DNA, 22 bp, Homo sapiens
ccagcccctatcctcgctccac

SEQ ID NO: 9233596 - DNA, 22 bp, Homo sapiens
ccagccagtcccgcatgaccgc

SEQ ID NO: 9233597 - DNA, 22 bp, Homo sapiens
ccagccagtccagcattggtgt

SEQ ID NO: 9233598 - DNA, 22 bp, Homo sapiens
tctgaaatctaatgctctgtgg

SEQ ID NO: 9233599 - DNA, 22 bp, Homo sapiens
tctgaaatctaatgctctgtgg

SEQ ID NO: 9233600 - DNA, 22 bp, Homo sapiens
tctgaaatcctttatcttggct

SEQ ID NO: 9233601 - DNA, 22 bp, Homo sapiens
tctgaaatcctttatcttggct

SEQ ID NO: 9233602 - DNA, 22 bp, Homo sapiens
tctgaaatctgtaagcactagc

SEQ ID NO: 9233603 - DNA, 22 bp, Homo sapiens
tctgaaatctgtaagcactagc

SEQ ID NO: 9233604 - DNA, 22 bp, Homo sapiens
tctgaaatgaactcttgaactt

SEQ ID NO: 9233605 - DNA, 22 bp, Homo sapiens
tctcttgtaatttaaaaaatct

SEQ ID NO: 9233606 - DNA, 22 bp, Homo sapiens
tctgaaataggaaagcaaatgg

SEQ ID NO: 9233607 - DNA, 22 bp, Homo sapiens
tctcttggtgatagtctttctt

SEQ ID NO: 9233608 - DNA, 22 bp, Homo sapiens
tctgaaatattggtaatacttt

SEQ ID NO: 9233609 - DNA, 22 bp, Homo sapiens
tctgaaatcctttatcttggct

SEQ ID NO: 9233610 - DNA, 22 bp, Homo sapiens
tctgaaatattggtaatacttt

SEQ ID NO: 9233611 - DNA, 22 bp, Homo sapiens
tctgaaataggagccatgtaga

SEQ ID NO: 9233612 - DNA, 22 bp, Homo sapiens
tctgaaataggagccatgtaga

SEQ ID NO: 9233613 - DNA, 22 bp, Homo sapiens
tctgaaataggcttcttttggt

SEQ ID NO: 9233614 - DNA, 22 bp, Homo sapiens
tctgaaatatattttgagtgtt

SEQ ID NO: 9233615 - DNA, 22 bp, Homo sapiens
tctgaaatatattttgagtgtt

SEQ ID NO: 9233616 - DNA, 22 bp, Homo sapiens
tctgaaataggcttcttttggt

SEQ ID NO: 9233617 - DNA, 22 bp, Homo sapiens
tctctcttgaagtattagctag

SEQ ID NO: 9233618 - DNA, 22 bp, Homo sapiens
tctctcttgaagtattagctag

SEQ ID NO: 9233619 - DNA, 22 bp, Homo sapiens
tctctcttgaagtattagctag

SEQ ID NO: 9233620 - DNA, 22 bp, Homo sapiens
tctctcttcatgcttttagaat

SEQ ID NO: 9233621 - DNA, 22 bp, Homo sapiens
tctctcttcaacccttaactag

SEQ ID NO: 9233622 - DNA, 22 bp, Homo sapiens
tctctcttcaacccttaactag

SEQ ID NO: 9233623 - DNA, 23 bp, Homo sapiens
tctctcttagctatgcttatggc

SEQ ID NO: 9233624 - DNA, 23 bp, Homo sapiens
tctctcttagctatgcttatggc

SEQ ID NO: 9233625 - DNA, 22 bp, Homo sapiens
tctcttggaggttcttcctgtt

SEQ ID NO: 9233626 - DNA, 18 bp, Homo sapiens
tctcttgcatcttctgta

SEQ ID NO: 9233627 - DNA, 22 bp, Homo sapiens
tctcttggaacacttgctctta

SEQ ID NO: 9233628 - DNA, 22 bp, Homo sapiens
tctcttaactggttcagcaatt

SEQ ID NO: 9233629 - DNA, 22 bp, Homo sapiens
tctcttaataagtaaatactga

SEQ ID NO: 9233630 - DNA, 22 bp, Homo sapiens
tctgccagaagttctgagagta

SEQ ID NO: 9233631 - DNA, 22 bp, Homo sapiens
tctgccagcaccatgatccttc

SEQ ID NO: 9233632 - DNA, 22 bp, Homo sapiens
tctgccagaagccagggtctgg

SEQ ID NO: 9233633 - DNA, 22 bp, Homo sapiens
tctgccaggagccatgagcaag

SEQ ID NO: 9233634 - DNA, 22 bp, Homo sapiens
tctgcctcctgcttgtcccgac

SEQ ID NO: 9233635 - DNA, 21 bp, Homo sapiens
tctgccagctgaagaggtgga

SEQ ID NO: 9233636 - DNA, 22 bp, Homo sapiens
tctgcctcgctaacagcagcca

SEQ ID NO: 9233637 - DNA, 22 bp, Homo sapiens
tctgcctcctgcttgtcccgac

SEQ ID NO: 9233638 - DNA, 22 bp, Homo sapiens
tctgcctcgctaacagcagcca

SEQ ID NO: 9233639 - DNA, 19 bp, Homo sapiens
tctgcctctggtcaggctc

SEQ ID NO: 9233640 - DNA, 22 bp, Homo sapiens
tctgcctcgctaacagcagcca

SEQ ID NO: 9233641 - DNA, 22 bp, Homo sapiens
ccagctcctcttcccagtgtca

SEQ ID NO: 9233642 - DNA, 21 bp, Homo sapiens
ccagctccaggaccttggatc

SEQ ID NO: 9233643 - DNA, 22 bp, Homo sapiens
ccagctccaggactgggagctg

SEQ ID NO: 9233644 - DNA, 22 bp, Homo sapiens
ccagctcctcttgtctctagca

SEQ ID NO: 9233645 - DNA, 22 bp, Homo sapiens
ccagctcctgggtcttagtcag

SEQ ID NO: 9233646 - DNA, 22 bp, Homo sapiens
ccagctcctcttcccagtgtca

SEQ ID NO: 9233647 - DNA, 22 bp, Homo sapiens
ccagctcctcttcccagtgtca

SEQ ID NO: 9233648 - DNA, 22 bp, Homo sapiens
ccagctcctgggtcttagtcag

SEQ ID NO: 9233649 - DNA, 22 bp, Homo sapiens
ccagctccttctgtctgtggag

SEQ ID NO: 9233650 - DNA, 22 bp, Homo sapiens
ccagctctaaacggctctgtgg

SEQ ID NO: 9233651 - DNA, 22 bp, Homo sapiens
ccagctctaaacggctctgtgg

SEQ ID NO: 9233652 - DNA, 22 bp, Homo sapiens
ccagctctaaacggctctgtgg

SEQ ID NO: 9233653 - DNA, 22 bp, Homo sapiens
ccagctctagccccatgtggct

SEQ ID NO: 9233654 - DNA, 22 bp, Homo sapiens
ccagctctagccccatgtggct

SEQ ID NO: 9233655 - DNA, 22 bp, Homo sapiens
ccagctctagccccatgtggct

SEQ ID NO: 9233656 - DNA, 22 bp, Homo sapiens
ccagctctagccccatgtggct

SEQ ID NO: 9233657 - DNA, 22 bp, Homo sapiens
tctgccaccaactgtcactaca

SEQ ID NO: 9233658 - DNA, 22 bp, Homo sapiens
ccagctcatctcagtgaaatgc

SEQ ID NO: 9233659 - DNA, 22 bp, Homo sapiens
ccagctccaagtttgggcatca

SEQ ID NO: 9233660 - DNA, 22 bp, Homo sapiens
ccagctcaagcactgtgtgaag

SEQ ID NO: 9233661 - DNA, 22 bp, Homo sapiens
ccagctcatattttatgtgcag

SEQ ID NO: 9233662 - DNA, 22 bp, Homo sapiens
ccagctcagggtcacatggcac

SEQ ID NO: 9233663 - DNA, 22 bp, Homo sapiens
ccagcgcttcccatcagggagg

SEQ ID NO: 9233664 - DNA, 22 bp, Homo sapiens
ccagctccactgtcagatgaga

SEQ ID NO: 9233665 - DNA, 21 bp, Homo sapiens
ccagctccaggaccttggatc

SEQ ID NO: 9233666 - DNA, 22 bp, Homo sapiens
ccagcctggggaggcagcttct

SEQ ID NO: 9233667 - DNA, 22 bp, Homo sapiens
ccagcctggttcagaattggct

SEQ ID NO: 9233668 - DNA, 22 bp, Homo sapiens
ccagcctgggtgttagaagaca

SEQ ID NO: 9233669 - DNA, 22 bp, Homo sapiens
ccagcctggttcagaattggct

SEQ ID NO: 9233670 - DNA, 22 bp, Homo sapiens
ccagccttctgagctgcctgga

SEQ ID NO: 9233671 - DNA, 22 bp, Homo sapiens
ccagccttgcaccgagccagcc

SEQ ID NO: 9233672 - DNA, 22 bp, Homo sapiens
ccagcgactgtgacctcagcta

SEQ ID NO: 9233673 - DNA, 22 bp, Homo sapiens
ccagcctggggaggcagcttct

SEQ ID NO: 9233674 - DNA, 22 bp, Homo sapiens
ccagcctggagggcagtggtgg

SEQ ID NO: 9233675 - DNA, 22 bp, Homo sapiens
ccagcctggagggcagtggtgg

SEQ ID NO: 9233676 - DNA, 22 bp, Homo sapiens
ccagcctggagggcagtggtgg

SEQ ID NO: 9233677 - DNA, 22 bp, Homo sapiens
ccagcctggagggcagtggtgg

SEQ ID NO: 9233678 - DNA, 22 bp, Homo sapiens
ccagcctggactgggtcttgtg

SEQ ID NO: 9233679 - DNA, 22 bp, Homo sapiens
ccagcctggactgggtcttgtg

SEQ ID NO: 9233680 - DNA, 21 bp, Homo sapiens
ccagcctcagatcagggagct

SEQ ID NO: 9233681 - DNA, 22 bp, Homo sapiens
tctgataggtggtagaaggagg

SEQ ID NO: 9233682 - DNA, 22 bp, Homo sapiens
tctgataggtggtagaaggagg

SEQ ID NO: 9233683 - DNA, 22 bp, Homo sapiens
tctgataatggacttctcatct

SEQ ID NO: 9233684 - DNA, 22 bp, Homo sapiens
tctgataatggacttctcatct

SEQ ID NO: 9233685 - DNA, 22 bp, Homo sapiens
tctgataatgtgcttcgtgacc

SEQ ID NO: 9233686 - DNA, 22 bp, Homo sapiens
tctgagtttaggaccaggctga

SEQ ID NO: 9233687 - DNA, 22 bp, Homo sapiens
tctgagttttctgagaagctta

SEQ ID NO: 9233688 - DNA, 22 bp, Homo sapiens
tctgataaatgccatctttttg

SEQ ID NO: 9233689 - DNA, 22 bp, Homo sapiens
tctgataagacagctgatttga

SEQ ID NO: 9233690 - DNA, 22 bp, Homo sapiens
tctgataagtggtgtatactgt

SEQ ID NO: 9233691 - DNA, 22 bp, Homo sapiens
tctgataacaaccatgtctggc

SEQ ID NO: 9233692 - DNA, 22 bp, Homo sapiens
tctgagttcataccaggctacc

SEQ ID NO: 9233693 - DNA, 22 bp, Homo sapiens
tctggcttcaagtcccagctct

SEQ ID NO: 9233694 - DNA, 23 bp, Homo sapiens
tctggcttccagtgggttcaacc

SEQ ID NO: 9233695 - DNA, 22 bp, Homo sapiens
tctggcttcagtagggttcact

SEQ ID NO: 9233696 - DNA, 22 bp, Homo sapiens
tctggcttccctctgttctggg

SEQ ID NO: 9233697 - DNA, 22 bp, Homo sapiens
tctggctttattccttcactga

SEQ ID NO: 9233698 - DNA, 22 bp, Homo sapiens
tctggctttattccttcactga

SEQ ID NO: 9233699 - DNA, 22 bp, Homo sapiens
tctggcttggcgctgccctctg

SEQ ID NO: 9233700 - DNA, 22 bp, Homo sapiens
tctggcttggctggcatctctg

SEQ ID NO: 9233701 - DNA, 22 bp, Homo sapiens
tctggcttggctggcatctctg

SEQ ID NO: 9233702 - DNA, 22 bp, Homo sapiens
tctggcttgctggcttggtccc

SEQ ID NO: 9233703 - DNA, 22 bp, Homo sapiens
tctggcttgagcttcgaccagt

SEQ ID NO: 9233704 - DNA, 22 bp, Homo sapiens
ccagctgtgccgtgtggatagc

SEQ ID NO: 9233705 - DNA, 22 bp, Homo sapiens
ccagctgtgcctaggagcaggg

SEQ ID NO: 9233706 - DNA, 18 bp, Homo sapiens
ccagctgtgcagcatctg

SEQ ID NO: 9233707 - DNA, 22 bp, Homo sapiens
ccagctgtctggttccagagcc

SEQ ID NO: 9233708 - DNA, 22 bp, Homo sapiens
ccagctgttggagtttcactgc

SEQ ID NO: 9233709 - DNA, 22 bp, Homo sapiens
ccagctggtgttccttaggacc

SEQ ID NO: 9233710 - DNA, 22 bp, Homo sapiens
ccagctggtgttccttaggacc

SEQ ID NO: 9233711 - DNA, 22 bp, Homo sapiens
ccagctggttaaaatagagaaa

SEQ ID NO: 9233712 - DNA, 22 bp, Homo sapiens
ccagctggttaaaatagagaaa

SEQ ID NO: 9233713 - DNA, 21 bp, Homo sapiens
tctggagccctaagctgagaa

SEQ ID NO: 9233714 - DNA, 22 bp, Homo sapiens
ccagctggtgacatccccaacc

SEQ ID NO: 9233715 - DNA, 22 bp, Homo sapiens
ccagctggtgggtctttctctg

SEQ ID NO: 9233716 - DNA, 22 bp, Homo sapiens
ccagctggtctgtgctcatgtt

SEQ ID NO: 9233717 - DNA, 22 bp, Homo sapiens
ccagctggggaagtggggcata

SEQ ID NO: 9233718 - DNA, 22 bp, Homo sapiens
ccagctggtaagtgatggagcc

SEQ ID NO: 9233719 - DNA, 22 bp, Homo sapiens
ccagctggtaagtgatggagcc

SEQ ID NO: 9233720 - DNA, 22 bp, Homo sapiens
ccagctgggattaagggaaaat

SEQ ID NO: 9233721 - DNA, 22 bp, Homo sapiens
tctgcgttgctcacgctgggag

SEQ ID NO: 9233722 - DNA, 22 bp, Homo sapiens
ccagctgctttttgtcacatgg

SEQ ID NO: 9233723 - DNA, 22 bp, Homo sapiens
tctgcctgaaattcacatgtaa

SEQ ID NO: 9233724 - DNA, 22 bp, Homo sapiens
tctgcctgaaattcacatgtaa

SEQ ID NO: 9233725 - DNA, 22 bp, Homo sapiens
tctgcctctttcaggcctggca

SEQ ID NO: 9233726 - DNA, 19 bp, Homo sapiens
tctgcctctggtcaggctc

SEQ ID NO: 9233727 - DNA, 19 bp, Homo sapiens
tctgcctctggtcaggctc

SEQ ID NO: 9233728 - DNA, 22 bp, Homo sapiens
tctgcctgaaccactcttggag

SEQ ID NO: 9233729 - DNA, 22 bp, Homo sapiens
tctgcctgaaccactcttggag

SEQ ID NO: 9233730 - DNA, 22 bp, Homo sapiens
tctgccttggcaaccacagctt

SEQ ID NO: 9233731 - DNA, 22 bp, Homo sapiens
ccaggaggcagaggttgtagtg

SEQ ID NO: 9233732 - DNA, 22 bp, Homo sapiens
ccaggaggcggaggttgcagcg

SEQ ID NO: 9233733 - DNA, 22 bp, Homo sapiens
ccaggaggcggaggttgcagcg

SEQ ID NO: 9233734 - DNA, 22 bp, Homo sapiens
ccaggaggcggaaggtacagtg

SEQ ID NO: 9233735 - DNA, 22 bp, Homo sapiens
ccaggaggcggaaggtacagtg

SEQ ID NO: 9233736 - DNA, 22 bp, Homo sapiens
tctgtcacttattaagatggat

SEQ ID NO: 9233737 - DNA, 23 bp, Homo sapiens
tctgtcactttctgctgtggagt

SEQ ID NO: 9233738 - DNA, 19 bp, Homo sapiens
tctgtcactgggggtattc

SEQ ID NO: 9233739 - DNA, 22 bp, Homo sapiens
tctgtcacttttatttactgaa

SEQ ID NO: 9233740 - DNA, 22 bp, Homo sapiens
tctgtcactgagctcaggattc

SEQ ID NO: 9233741 - DNA, 22 bp, Homo sapiens
tctgtcactctagagatggcag

SEQ ID NO: 9233742 - DNA, 23 bp, Homo sapiens
tctgtcacctatggctgctcttc

SEQ ID NO: 9233743 - DNA, 22 bp, Homo sapiens
tctgtcactattggccagaaca

SEQ ID NO: 9233744 - DNA, 22 bp, Homo sapiens
tctgtcactattggccagaaca

SEQ ID NO: 9233745 - DNA, 22 bp, Homo sapiens
tctgtcactccctgatgatgaa

SEQ ID NO: 9233746 - DNA, 22 bp, Homo sapiens
tctgtcacccctgtttctggct

SEQ ID NO: 9233747 - DNA, 22 bp, Homo sapiens
tctgtcacccgagcaggcgaga

SEQ ID NO: 9233748 - DNA, 22 bp, Homo sapiens
tctgtcaccgagggcatccaaa

SEQ ID NO: 9233749 - DNA, 18 bp, Homo sapiens
tctgtctgtacaagtatc

SEQ ID NO: 9233750 - DNA, 21 bp, Homo sapiens
tctgtctggttttagagtggc

SEQ ID NO: 9233751 - DNA, 17 bp, Homo sapiens
tctgtctgtggtccact

SEQ ID NO: 9233752 - DNA, 22 bp, Homo sapiens
tctgtctgtccagggcccccgc

SEQ ID NO: 9233753 - DNA, 21 bp, Homo sapiens
tctgtctggttttagagtggc

SEQ ID NO: 9233754 - DNA, 22 bp, Homo sapiens
tctgtctgggtgcctcgagtac

SEQ ID NO: 9233755 - DNA, 22 bp, Homo sapiens
tctgtctgggtgcctcgagtac

SEQ ID NO: 9233756 - DNA, 22 bp, Homo sapiens
tctgtcttagccatctcaggct

SEQ ID NO: 9233757 - DNA, 18 bp, Homo sapiens
tctgtctgtgttgtcttt

SEQ ID NO: 9233758 - DNA, 18 bp, Homo sapiens
tctgtctgtgttgtcttt

SEQ ID NO: 9233759 - DNA, 23 bp, Homo sapiens
tctgtctgtgtatgtgcagaaag

SEQ ID NO: 9233760 - DNA, 22 bp, Homo sapiens
tctgtcttggccagccatctgg

SEQ ID NO: 9233761 - DNA, 21 bp, Homo sapiens
tctgtcttcctcagcctaagg

SEQ ID NO: 9233762 - DNA, 22 bp, Homo sapiens
tctgtcttctgtagctaataat

SEQ ID NO: 9233763 - DNA, 22 bp, Homo sapiens
tctgtggcacgattgcactgca

SEQ ID NO: 9233764 - DNA, 22 bp, Homo sapiens
tctgtggcacgattgcactgca

SEQ ID NO: 9233765 - DNA, 18 bp, Homo sapiens
tctgtggcagcagtgcac

SEQ ID NO: 9233766 - DNA, 19 bp, Homo sapiens
tctgtggcacctgggaggg

SEQ ID NO: 9233767 - DNA, 16 bp, Homo sapiens
ccaggaacacacagct

SEQ ID NO: 9233768 - DNA, 22 bp, Homo sapiens
ccaggaacaaagccccatccac

SEQ ID NO: 9233769 - DNA, 22 bp, Homo sapiens
ccagcttcatgggcatgcacca

SEQ ID NO: 9233770 - DNA, 23 bp, Homo sapiens
ccaggaagaggccatccacagtc

SEQ ID NO: 9233771 - DNA, 22 bp, Homo sapiens
ccaggaagcctcagatgctgag

SEQ ID NO: 9233772 - DNA, 22 bp, Homo sapiens
ccaggaagcctgtgtctctgga

SEQ ID NO: 9233773 - DNA, 22 bp, Homo sapiens
ccaggaagcctttttctttgac

SEQ ID NO: 9233774 - DNA, 22 bp, Homo sapiens
ccaggaagcggtgagggctgcc

SEQ ID NO: 9233775 - DNA, 22 bp, Homo sapiens
ccaggagcctgggccaggctgg

SEQ ID NO: 9233776 - DNA, 21 bp, Homo sapiens
ccaggaaggactgagctccct

SEQ ID NO: 9233777 - DNA, 22 bp, Homo sapiens
ccaggagcgcgtgaacaggctg

SEQ ID NO: 9233778 - DNA, 22 bp, Homo sapiens
ccaggaggcaatatcaagtcca

SEQ ID NO: 9233779 - DNA, 22 bp, Homo sapiens
ccaggaggcagaagttgcagtg

SEQ ID NO: 9233780 - DNA, 22 bp, Homo sapiens
ccaggaggcagaagttgcagtg

SEQ ID NO: 9233781 - DNA, 22 bp, Homo sapiens
ccaggaggcagaagttgcagtg

SEQ ID NO: 9233782 - DNA, 22 bp, Homo sapiens
tccctgcttgctctcagccctt

SEQ ID NO: 9233783 - DNA, 21 bp, Homo sapiens
tccctgctttctggcccagtc

SEQ ID NO: 9233784 - DNA, 22 bp, Homo sapiens
tccctgctgcactcacacctac

SEQ ID NO: 9233785 - DNA, 22 bp, Homo sapiens
tccctgctcagctcacctggca

SEQ ID NO: 9233786 - DNA, 22 bp, Homo sapiens
tccctgctgcactcacacctac

SEQ ID NO: 9233787 - DNA, 22 bp, Homo sapiens
tccctgctgcactcacacctac

SEQ ID NO: 9233788 - DNA, 22 bp, Homo sapiens
ccaaagtgctaggattacaggt

SEQ ID NO: 9233789 - DNA, 22 bp, Homo sapiens
ccaaagtgctgagattacaggt

SEQ ID NO: 9233790 - DNA, 22 bp, Homo sapiens
ccaaagtgctgggattacaggc

SEQ ID NO: 9233791 - DNA, 22 bp, Homo sapiens
ccaaagtgctgggattacaggt

SEQ ID NO: 9233792 - DNA, 22 bp, Homo sapiens
ccaaagtgctaggattacaggc

SEQ ID NO: 9233793 - DNA, 22 bp, Homo sapiens
catttgaagaagaaacgtacta

SEQ ID NO: 9233794 - DNA, 22 bp, Homo sapiens
catttgaactaataactgtgct

SEQ ID NO: 9233795 - DNA, 22 bp, Homo sapiens
catttgaacctggatgttctta

SEQ ID NO: 9233796 - DNA, 22 bp, Homo sapiens
catttgatctcctgaataaaca

SEQ ID NO: 9233797 - DNA, 22 bp, Homo sapiens
catttgatgactcaactcataa

SEQ ID NO: 9233798 - DNA, 22 bp, Homo sapiens
catttgcaagagataaatgttt

SEQ ID NO: 9233799 - DNA, 22 bp, Homo sapiens
catttgctctggttccttctgg

SEQ ID NO: 9233800 - DNA, 22 bp, Homo sapiens
tccctgcctgacagcacccacc

SEQ ID NO: 9233801 - DNA, 22 bp, Homo sapiens
tcccagggtcagtggtgaggcc

SEQ ID NO: 9233802 - DNA, 22 bp, Homo sapiens
tcccagggggatgaacactgcc

SEQ ID NO: 9233803 - DNA, 22 bp, Homo sapiens
tcccagggtatcctgtagtaaa

SEQ ID NO: 9233804 - DNA, 22 bp, Homo sapiens
tcccagggctctagagtgctgg

SEQ ID NO: 9233805 - DNA, 22 bp, Homo sapiens
tcccagggctctagagtgctgg

SEQ ID NO: 9233806 - DNA, 22 bp, Homo sapiens
tcccagggcttttctcatgctt

SEQ ID NO: 9233807 - DNA, 22 bp, Homo sapiens
tcccagggccgcaaacgagttt

SEQ ID NO: 9233808 - DNA, 22 bp, Homo sapiens
tcccagggcttttctcatgctt

SEQ ID NO: 9233809 - DNA, 22 bp, Homo sapiens
tcccagggcttttctcatgctt

SEQ ID NO: 9233810 - DNA, 22 bp, Homo sapiens
tcccagggggatgaacactgcc

SEQ ID NO: 9233811 - DNA, 22 bp, Homo sapiens
tcccagggcttttctcatgctt

SEQ ID NO: 9233812 - DNA, 21 bp, Homo sapiens
tcccagggccaggtgccatca

SEQ ID NO: 9233813 - DNA, 22 bp, Homo sapiens
tcccagggccgcaaacgagttt

SEQ ID NO: 9233814 - DNA, 22 bp, Homo sapiens
tcccagggcactcaccctccct

SEQ ID NO: 9233815 - DNA, 22 bp, Homo sapiens
tcccagggcagctgtccagaag

SEQ ID NO: 9233816 - DNA, 22 bp, Homo sapiens
tcccagggcactcaccctccct

SEQ ID NO: 9233817 - DNA, 22 bp, Homo sapiens
catttattagttagttcgatgt

SEQ ID NO: 9233818 - DNA, 22 bp, Homo sapiens
catttattagttagttcgatgt

SEQ ID NO: 9233819 - DNA, 22 bp, Homo sapiens
catttatgatagtaatatgaaa

SEQ ID NO: 9233820 - DNA, 17 bp, Homo sapiens
tccaggcagcaactgag

SEQ ID NO: 9233821 - DNA, 22 bp, Homo sapiens
tccaggcactatatatactttt

SEQ ID NO: 9233822 - DNA, 22 bp, Homo sapiens
tccaggcacagagttggtcagt

SEQ ID NO: 9233823 - DNA, 22 bp, Homo sapiens
tccaggcacagagttggtcagt

SEQ ID NO: 9233824 - DNA, 22 bp, Homo sapiens
tccaggcacgaggccctgtgca

SEQ ID NO: 9233825 - DNA, 20 bp, Homo sapiens
tccaggcagacagctatggg

SEQ ID NO: 9233826 - DNA, 22 bp, Homo sapiens
catttagagagtaaaaattagc

SEQ ID NO: 9233827 - DNA, 22 bp, Homo sapiens
catttagagaagattacaagga

SEQ ID NO: 9233828 - DNA, 22 bp, Homo sapiens
catttagaagtcttagaactat

SEQ ID NO: 9233829 - DNA, 22 bp, Homo sapiens
ccacaagtttcagcacccagag

SEQ ID NO: 9233830 - DNA, 20 bp, Homo sapiens
ccacaagggaatattgttga

SEQ ID NO: 9233831 - DNA, 22 bp, Homo sapiens
ccacacagggggatgagttatt

SEQ ID NO: 9233832 - DNA, 22 bp, Homo sapiens
ccacacagataagtgttttcta

SEQ ID NO: 9233833 - DNA, 22 bp, Homo sapiens
ccacacagggggatgagttatt

SEQ ID NO: 9233834 - DNA, 22 bp, Homo sapiens
tcctgcagtgtgtctcctgcac

SEQ ID NO: 9233835 - DNA, 22 bp, Homo sapiens
ccacaagactctgtcagcataa

SEQ ID NO: 9233836 - DNA, 22 bp, Homo sapiens
ccacaaattaggttttgcttgt

SEQ ID NO: 9233837 - DNA, 22 bp, Homo sapiens
ccacaaaactgtgtgtcaaaga

SEQ ID NO: 9233838 - DNA, 19 bp, Homo sapiens
ccacaaaattattttagtt

SEQ ID NO: 9233839 - DNA, 19 bp, Homo sapiens
ccacaaaattattttagtt

SEQ ID NO: 9233840 - DNA, 22 bp, Homo sapiens
ccaattttattcttctgcaagt

SEQ ID NO: 9233841 - DNA, 22 bp, Homo sapiens
ccaattttattcttctgcaagt

SEQ ID NO: 9233842 - DNA, 20 bp, Homo sapiens
ccaatgtttacagattactt

SEQ ID NO: 9233843 - DNA, 22 bp, Homo sapiens
ccaatgtttattttcctgctgc

SEQ ID NO: 9233844 - DNA, 22 bp, Homo sapiens
ccaatgttttatacagaagtac

SEQ ID NO: 9233845 - DNA, 22 bp, Homo sapiens
tcctccccaaagcccagcctgg

SEQ ID NO: 9233846 - DNA, 22 bp, Homo sapiens
tcctccccaaagcccagcctgg

SEQ ID NO: 9233847 - DNA, 22 bp, Homo sapiens
tcctccccaaagcccagcctgg

SEQ ID NO: 9233848 - DNA, 22 bp, Homo sapiens
ccaagggaaggatgtatatgat

SEQ ID NO: 9233849 - DNA, 22 bp, Homo sapiens
tcctcccaacttttccatctca

SEQ ID NO: 9233850 - DNA, 22 bp, Homo sapiens
tcctcccaacttttccatctca

SEQ ID NO: 9233851 - DNA, 22 bp, Homo sapiens
tcctcccacataggacaatggg

SEQ ID NO: 9233852 - DNA, 22 bp, Homo sapiens
tcctcccacataggacaatggg

SEQ ID NO: 9233853 - DNA, 22 bp, Homo sapiens
tcctcccacataggacaatggg

SEQ ID NO: 9233854 - DNA, 22 bp, Homo sapiens
ccaaagtgctggggttacaggc

SEQ ID NO: 9233855 - DNA, 23 bp, Homo sapiens
tcctcccaaatttcagcctcatt

SEQ ID NO: 9233856 - DNA, 23 bp, Homo sapiens
tcctcccaaatttcagcctcatt

SEQ ID NO: 9233857 - DNA, 23 bp, Homo sapiens
tcctcccaaatttcagcctcatt

SEQ ID NO: 9233858 - DNA, 22 bp, Homo sapiens
tcctgccactgcacatatactt

SEQ ID NO: 9233859 - DNA, 22 bp, Homo sapiens
tcctgccagcccacagactcat

SEQ ID NO: 9233860 - DNA, 22 bp, Homo sapiens
tcctgccaggagtgctggccct

SEQ ID NO: 9233861 - DNA, 20 bp, Homo sapiens
tcctgccacacctcagttgc

SEQ ID NO: 9233862 - DNA, 22 bp, Homo sapiens
tcctgccacctgcacagctccc

SEQ ID NO: 9233863 - DNA, 20 bp, Homo sapiens
tcctgcagttcctaggaggg

SEQ ID NO: 9233864 - DNA, 20 bp, Homo sapiens
tcctgcagttcctaggaggg

SEQ ID NO: 9233865 - DNA, 22 bp, Homo sapiens
ccacagaggacaactgcctggc

SEQ ID NO: 9233866 - DNA, 22 bp, Homo sapiens
ccacagagtccgcatttgaggc

SEQ ID NO: 9233867 - DNA, 23 bp, Homo sapiens
ccacagagctgccaattcctgtg

SEQ ID NO: 9233868 - DNA, 23 bp, Homo sapiens
ccacagagctgccaattcctgtg

SEQ ID NO: 9233869 - DNA, 22 bp, Homo sapiens
ccacagaggacaactgcctggc

SEQ ID NO: 9233870 - DNA, 22 bp, Homo sapiens
ccacagctagggcaatctgatt

SEQ ID NO: 9233871 - DNA, 22 bp, Homo sapiens
ccacagccattccagggaggct

SEQ ID NO: 9233872 - DNA, 22 bp, Homo sapiens
ccacagctgaaagcagaggctc

SEQ ID NO: 9233873 - DNA, 22 bp, Homo sapiens
ccacagctgaaagcagaggctc

SEQ ID NO: 9233874 - DNA, 23 bp, Homo sapiens
ccacagctatagggtagtgcagt

SEQ ID NO: 9233875 - DNA, 22 bp, Homo sapiens
ccacagcaccgctgccagtccc

SEQ ID NO: 9233876 - DNA, 22 bp, Homo sapiens
ccacagcaccgctgccagtccc

SEQ ID NO: 9233877 - DNA, 22 bp, Homo sapiens
ccacagagttacaaaacagtca

SEQ ID NO: 9233878 - DNA, 22 bp, Homo sapiens
ccacagagttgatgcaataaga

SEQ ID NO: 9233879 - DNA, 22 bp, Homo sapiens
ccacagcatgcaggcctgacac

SEQ ID NO: 9233880 - DNA, 22 bp, Homo sapiens
ccacagcatgcaggcctgacac

SEQ ID NO: 9233881 - DNA, 22 bp, Homo sapiens
ccacagcatgcaggcctgacac

SEQ ID NO: 9233882 - DNA, 22 bp, Homo sapiens
ccacagcatgcaggcctgacac

SEQ ID NO: 9233883 - DNA, 22 bp, Homo sapiens
ccacagcatgcaggcctgacac

SEQ ID NO: 9233884 - DNA, 18 bp, Homo sapiens
ccacagcagagttcttac

SEQ ID NO: 9233885 - DNA, 22 bp, Homo sapiens
ccacaggggtctctgtagctga

SEQ ID NO: 9233886 - DNA, 22 bp, Homo sapiens
ccacaggggtctctgtagctga

SEQ ID NO: 9233887 - DNA, 20 bp, Homo sapiens
tcctggtggatactgcttaa

SEQ ID NO: 9233888 - DNA, 22 bp, Homo sapiens
tcctggtggatagaagccaagg

SEQ ID NO: 9233889 - DNA, 18 bp, Homo sapiens
tcctggtggagaagtggt

SEQ ID NO: 9233890 - DNA, 19 bp, Homo sapiens
tcctggtgcttgacactga

SEQ ID NO: 9233891 - DNA, 22 bp, Homo sapiens
tcctggtgcttgtatttgaagt

SEQ ID NO: 9233892 - DNA, 18 bp, Homo sapiens
tcctggtggagaagtggt

SEQ ID NO: 9233893 - DNA, 22 bp, Homo sapiens
ccacagggtcagccactctgca

SEQ ID NO: 9233894 - DNA, 22 bp, Homo sapiens
ccacagtaagagatagtttatg

SEQ ID NO: 9233895 - DNA, 20 bp, Homo sapiens
tcctggtcatgtggctgggc

SEQ ID NO: 9233896 - DNA, 23 bp, Homo sapiens
tcctggtgacatgcctgagcatc

SEQ ID NO: 9233897 - DNA, 22 bp, Homo sapiens
tcctggtgaatgactttttatt

SEQ ID NO: 9233898 - DNA, 22 bp, Homo sapiens
tcctggtcttcaggttgcaaaa

SEQ ID NO: 9233899 - DNA, 22 bp, Homo sapiens
tcctggtctacactgcattggg

SEQ ID NO: 9233900 - DNA, 22 bp, Homo sapiens
tcctggtgaggctagaagtgtc

SEQ ID NO: 9233901 - DNA, 22 bp, Homo sapiens
tcctggtgaggactccaagata

SEQ ID NO: 9233902 - DNA, 19 bp, Homo sapiens
tcctggtgaccctgaaatt

SEQ ID NO: 9233903 - DNA, 23 bp, Homo sapiens
tcctggtgacatgcctgagcatc

SEQ ID NO: 9233904 - DNA, 22 bp, Homo sapiens
tcctggtgctgacacccatagc

SEQ ID NO: 9233905 - DNA, 22 bp, Homo sapiens
tcctggtgaggctagaagtgtc

SEQ ID NO: 9233906 - DNA, 22 bp, Homo sapiens
tcctggtgatcaaaattcattt

SEQ ID NO: 9233907 - DNA, 22 bp, Homo sapiens
tcctggtgcctggagctctcca

SEQ ID NO: 9233908 - DNA, 22 bp, Homo sapiens
ccactctgctgtgctccatgat

SEQ ID NO: 9233909 - DNA, 22 bp, Homo sapiens
ccactctgattttggctccact

SEQ ID NO: 9233910 - DNA, 23 bp, Homo sapiens
ccactgaagaatccagggagttt

SEQ ID NO: 9233911 - DNA, 16 bp, Homo sapiens
ccacctgcagctctca

SEQ ID NO: 9233912 - DNA, 22 bp, Homo sapiens
ccacctgctggttttgctctcc

SEQ ID NO: 9233913 - DNA, 16 bp, Homo sapiens
ccacctgcagctctca

SEQ ID NO: 9233914 - DNA, 22 bp, Homo sapiens
ccacagtccgggctggcaggac

SEQ ID NO: 9233915 - DNA, 22 bp, Homo sapiens
ccacagtccgggctggcaggac

SEQ ID NO: 9233916 - DNA, 22 bp, Homo sapiens
ccacagtctagctagaaggcat

SEQ ID NO: 9233917 - DNA, 22 bp, Homo sapiens
ccacagtctatgcaacaaggtc

SEQ ID NO: 9233918 - DNA, 23 bp, Homo sapiens
ccactgatgcattttctctctgt

SEQ ID NO: 9233919 - DNA, 22 bp, Homo sapiens
ccactgcactccagccttggca

SEQ ID NO: 9233920 - DNA, 22 bp, Homo sapiens
ccactgatcctgactttggagc

SEQ ID NO: 9233921 - DNA, 22 bp, Homo sapiens
ccagaaaagcatctggttcttt

SEQ ID NO: 9233922 - DNA, 22 bp, Homo sapiens
ccactgccgtgggccttgggga

SEQ ID NO: 9233923 - DNA, 22 bp, Homo sapiens
ccactgcctatttgcagggccc

SEQ ID NO: 9233924 - DNA, 22 bp, Homo sapiens
ccactgccatgggctaggcatg

SEQ ID NO: 9233925 - DNA, 22 bp, Homo sapiens
ccactgccccctgaagaccagg

SEQ ID NO: 9233926 - DNA, 22 bp, Homo sapiens
ccactgcccaccccgacgtcta

SEQ ID NO: 9233927 - DNA, 22 bp, Homo sapiens
ccactgccagctttgtcctccc

SEQ ID NO: 9233928 - DNA, 22 bp, Homo sapiens
ccactgccagctttgtcctccc

SEQ ID NO: 9233929 - DNA, 20 bp, Homo sapiens
ccagaagcactcttcatgtt

SEQ ID NO: 9233930 - DNA, 22 bp, Homo sapiens
ccagaagcttctacacaggaga

SEQ ID NO: 9233931 - DNA, 22 bp, Homo sapiens
ccagaagcagagcctgaggcag

SEQ ID NO: 9233932 - DNA, 21 bp, Homo sapiens
ccagaagctgcttgcaggcta

SEQ ID NO: 9233933 - DNA, 22 bp, Homo sapiens
ccagaagggctattgcagtgac

SEQ ID NO: 9233934 - DNA, 19 bp, Homo sapiens
ccagaagggcagctatgga

SEQ ID NO: 9233935 - DNA, 22 bp, Homo sapiens
ccagaagggctattgcagtgac

SEQ ID NO: 9233936 - DNA, 22 bp, Homo sapiens
ccagaagtcaggaatgagtctt

SEQ ID NO: 9233937 - DNA, 20 bp, Homo sapiens
ccagaaggtaggatggaaca

SEQ ID NO: 9233938 - DNA, 20 bp, Homo sapiens
ccagaaggtaggatggaaca

SEQ ID NO: 9233939 - DNA, 22 bp, Homo sapiens
tctctagtataatatagcaaaa

SEQ ID NO: 9233940 - DNA, 19 bp, Homo sapiens
ccagaggactgttaatgaa

SEQ ID NO: 9233941 - DNA, 22 bp, Homo sapiens
ccagaggacttgggggctgaat

SEQ ID NO: 9233942 - DNA, 22 bp, Homo sapiens
tctctagacatggggaatgtca

SEQ ID NO: 9233943 - DNA, 21 bp, Homo sapiens
tctctacactttcactaggct

SEQ ID NO: 9233944 - DNA, 22 bp, Homo sapiens
tctctaattcaaccagacactt

SEQ ID NO: 9233945 - DNA, 22 bp, Homo sapiens
ccagaggagttgaggctttggg

SEQ ID NO: 9233946 - DNA, 22 bp, Homo sapiens
ccagaggagggctctgatgagg

SEQ ID NO: 9233947 - DNA, 22 bp, Homo sapiens
ccagaggagatgcctcctctgt

SEQ ID NO: 9233948 - DNA, 22 bp, Homo sapiens
ccagaggagcaggctggctcca

SEQ ID NO: 9233949 - DNA, 22 bp, Homo sapiens
ccagaggacttgggggctgaat

SEQ ID NO: 9233950 - DNA, 22 bp, Homo sapiens
ccagatgggccaggggtttgtt

SEQ ID NO: 9233951 - DNA, 22 bp, Homo sapiens
ccagatgggaagaagcatgact

SEQ ID NO: 9233952 - DNA, 19 bp, Homo sapiens
tctctctgtacattagata

SEQ ID NO: 9233953 - DNA, 19 bp, Homo sapiens
tctctctgtacattagata

SEQ ID NO: 9233954 - DNA, 22 bp, Homo sapiens
ccagatatcactgccgtgttgt

SEQ ID NO: 9233955 - DNA, 22 bp, Homo sapiens
ccagagctgcatccagcaggtt

SEQ ID NO: 9233956 - DNA, 22 bp, Homo sapiens
ccagagctgcatccagcaggtt

SEQ ID NO: 9233957 - DNA, 22 bp, Homo sapiens
ccagagctgcatccagcaggtt

SEQ ID NO: 9233958 - DNA, 22 bp, Homo sapiens
ccagagctgattcctgggactt

SEQ ID NO: 9233959 - DNA, 22 bp, Homo sapiens
ccagagctgattcctgggactt

SEQ ID NO: 9233960 - DNA, 22 bp, Homo sapiens
ccagagctgatgggcccagggt

SEQ ID NO: 9233961 - DNA, 22 bp, Homo sapiens
ccagagcttgacgtgcaacgga

SEQ ID NO: 9233962 - DNA, 22 bp, Homo sapiens
ccagagcttcggggcggctgta

SEQ ID NO: 9233963 - DNA, 18 bp, Homo sapiens
ccagagctggctcctcgc

SEQ ID NO: 9233964 - DNA, 18 bp, Homo sapiens
ccagagctggctcctcgc

SEQ ID NO: 9233965 - DNA, 20 bp, Homo sapiens
ccagagctgatggctgcccg

SEQ ID NO: 9233966 - DNA, 22 bp, Homo sapiens
ccagagcctgctgagccccatt

SEQ ID NO: 9233967 - DNA, 22 bp, Homo sapiens
ccagacaggaacacacatctcc

SEQ ID NO: 9233968 - DNA, 20 bp, Homo sapiens
ccagacagcacctgcctggt

SEQ ID NO: 9233969 - DNA, 22 bp, Homo sapiens
ccagaggaattgggaaacatgt

SEQ ID NO: 9233970 - DNA, 21 bp, Homo sapiens
tctccagtatccttctctgag

SEQ ID NO: 9233971 - DNA, 21 bp, Homo sapiens
tctccagtgcttctgcctctt

SEQ ID NO: 9233972 - DNA, 23 bp, Homo sapiens
tctccagtgtctcttcattgagt

SEQ ID NO: 9233973 - DNA, 22 bp, Homo sapiens
tctccagtcccttctctgttag

SEQ ID NO: 9233974 - DNA, 21 bp, Homo sapiens
tctcccaaggaggtcctgagg

SEQ ID NO: 9233975 - DNA, 22 bp, Homo sapiens
tctcccaaggcacagaaagagt

SEQ ID NO: 9233976 - DNA, 22 bp, Homo sapiens
tctcccaacatgtggaggtcag

SEQ ID NO: 9233977 - DNA, 19 bp, Homo sapiens
tctccagttgctttcaggg

SEQ ID NO: 9233978 - DNA, 21 bp, Homo sapiens
tctccagttgacagtgtctcc

SEQ ID NO: 9233979 - DNA, 21 bp, Homo sapiens
tctccagttgacagtgtctcc

SEQ ID NO: 9233980 - DNA, 22 bp, Homo sapiens
tctcccacagccgtgcttcaag

SEQ ID NO: 9233981 - DNA, 22 bp, Homo sapiens
tctcccaagtgaccaggaaaga

SEQ ID NO: 9233982 - DNA, 22 bp, Homo sapiens
tctcctgggaggacaaggaagg

SEQ ID NO: 9233983 - DNA, 22 bp, Homo sapiens
tctcctgggaggacaaggaagg

SEQ ID NO: 9233984 - DNA, 22 bp, Homo sapiens
cagctctgctgggaggatgcag

SEQ ID NO: 9233985 - DNA, 22 bp, Homo sapiens
cagctctgctgggaggatgcag

SEQ ID NO: 9233986 - DNA, 22 bp, Homo sapiens
cagctctgctggtggtgccagg

SEQ ID NO: 9233987 - DNA, 22 bp, Homo sapiens
cagctctgctggtggtgccagg

SEQ ID NO: 9233988 - DNA, 22 bp, Homo sapiens
cagctctgctggtggtgccagg

SEQ ID NO: 9233989 - DNA, 22 bp, Homo sapiens
cagctctgctggtggtgccagg

SEQ ID NO: 9233990 - DNA, 22 bp, Homo sapiens
cagctctgcttccttgtacagg

SEQ ID NO: 9233991 - DNA, 22 bp, Homo sapiens
cagctctggccagatctatcct

SEQ ID NO: 9233992 - DNA, 22 bp, Homo sapiens
cagctctggcagagcccaaccc

SEQ ID NO: 9233993 - DNA, 22 bp, Homo sapiens
cagctctgcttccttgtacagg

SEQ ID NO: 9233994 - DNA, 22 bp, Homo sapiens
cagctctggcgtcagggagcga

SEQ ID NO: 9233995 - DNA, 22 bp, Homo sapiens
cagctctggcgtcagggagcga

SEQ ID NO: 9233996 - DNA, 22 bp, Homo sapiens
cagctctggcgtcagggagcga

SEQ ID NO: 9233997 - DNA, 22 bp, Homo sapiens
cagctctgtgcaggcctgggga

SEQ ID NO: 9233998 - DNA, 22 bp, Homo sapiens
cagctctgtgcaggcctgggga

SEQ ID NO: 9233999 - DNA, 22 bp, Homo sapiens
cagctctgtgggagcgtatgtg

SEQ ID NO: 9234000 - DNA, 22 bp, Homo sapiens
cagctctgtgtattttccccac

SEQ ID NO: 9234001 - DNA, 22 bp, Homo sapiens
cagctctgggagtcccacccct

SEQ ID NO: 9234002 - DNA, 20 bp, Homo sapiens
cagctctgggaaagaggcca

SEQ ID NO: 9234003 - DNA, 22 bp, Homo sapiens
cagctctggctttggggagctt

SEQ ID NO: 9234004 - DNA, 20 bp, Homo sapiens
cagctctgggaaagaggcca

SEQ ID NO: 9234005 - DNA, 22 bp, Homo sapiens
cagctctggctttggggagctt

SEQ ID NO: 9234006 - DNA, 22 bp, Homo sapiens
cagctctggctattgaggacca

SEQ ID NO: 9234007 - DNA, 19 bp, Homo sapiens
gtggccagggcaggggctg

SEQ ID NO: 9234008 - DNA, 22 bp, Homo sapiens
gtggccaggccgactgccaggc

SEQ ID NO: 9234009 - DNA, 22 bp, Homo sapiens
gtggccatttggaaggcaagta

SEQ ID NO: 9234010 - DNA, 22 bp, Homo sapiens
gtggccagtgggaatgggctca

SEQ ID NO: 9234011 - DNA, 22 bp, Homo sapiens
gtggccagggcccacaggatga

SEQ ID NO: 9234012 - DNA, 19 bp, Homo sapiens
gtggccagggcaggggctg

SEQ ID NO: 9234013 - DNA, 22 bp, Homo sapiens
gtggccagtcccgatgcttgtt

SEQ ID NO: 9234014 - DNA, 22 bp, Homo sapiens
gtggagccctgccttgctcatg

SEQ ID NO: 9234015 - DNA, 22 bp, Homo sapiens
cagcccaggactgcaggtgttt

SEQ ID NO: 9234016 - DNA, 22 bp, Homo sapiens
cagcccaggccgacagttcctc

SEQ ID NO: 9234017 - DNA, 22 bp, Homo sapiens
cagcccagccgagggcctggct

SEQ ID NO: 9234018 - DNA, 22 bp, Homo sapiens
cagcccagccgagggcctggct

SEQ ID NO: 9234019 - DNA, 22 bp, Homo sapiens
cagcccagccgagggcctggct

SEQ ID NO: 9234020 - DNA, 22 bp, Homo sapiens
gtggcagagaacaaggagaggt

SEQ ID NO: 9234021 - DNA, 22 bp, Homo sapiens
gtggcagagcaggagacaggac

SEQ ID NO: 9234022 - DNA, 22 bp, Homo sapiens
gtggcagagcaggagacaggac

SEQ ID NO: 9234023 - DNA, 22 bp, Homo sapiens
gtggcagagatagaactggaat

SEQ ID NO: 9234024 - DNA, 22 bp, Homo sapiens
gtggcagagagcaagtgtctga

SEQ ID NO: 9234025 - DNA, 22 bp, Homo sapiens
gtggcagaaatattcttgctct

SEQ ID NO: 9234026 - DNA, 22 bp, Homo sapiens
gtggcagaaactggcagaggag

SEQ ID NO: 9234027 - DNA, 22 bp, Homo sapiens
gtggcagagccaaggctggagc

SEQ ID NO: 9234028 - DNA, 22 bp, Homo sapiens
gtggcagagccaaggctggagc

SEQ ID NO: 9234029 - DNA, 22 bp, Homo sapiens
gtggcaggtcccattggagcag

SEQ ID NO: 9234030 - DNA, 22 bp, Homo sapiens
gtggcaggtcccattggagcag

SEQ ID NO: 9234031 - DNA, 22 bp, Homo sapiens
gtggcaggttataagcatctca

SEQ ID NO: 9234032 - DNA, 22 bp, Homo sapiens
gtggcaggtggagcctcctgca

SEQ ID NO: 9234033 - DNA, 22 bp, Homo sapiens
gtggcaggttccgtagacagca

SEQ ID NO: 9234034 - DNA, 22 bp, Homo sapiens
cagctctgttcatagatggtgc

SEQ ID NO: 9234035 - DNA, 22 bp, Homo sapiens
cagctctgttcatagatggtgc

SEQ ID NO: 9234036 - DNA, 22 bp, Homo sapiens
cagctctgttgccaaagtgggc

SEQ ID NO: 9234037 - DNA, 22 bp, Homo sapiens
cagctctgttgccaaagtgggc

SEQ ID NO: 9234038 - DNA, 22 bp, Homo sapiens
cagctctgttgccctggaaacg

SEQ ID NO: 9234039 - DNA, 22 bp, Homo sapiens
cagctcttcctaccctagttgg

SEQ ID NO: 9234040 - DNA, 22 bp, Homo sapiens
cagctcttccatttccttcagc

SEQ ID NO: 9234041 - DNA, 22 bp, Homo sapiens
cagctcttcagtgcctgagata

SEQ ID NO: 9234042 - DNA, 22 bp, Homo sapiens
cagctcttaacacagcttgtat

SEQ ID NO: 9234043 - DNA, 22 bp, Homo sapiens
cagctcttaacacagcttgtat

SEQ ID NO: 9234044 - DNA, 22 bp, Homo sapiens
cagctcttcagagtgagcaatg

SEQ ID NO: 9234045 - DNA, 22 bp, Homo sapiens
cagctcttattttctctcctaa

SEQ ID NO: 9234046 - DNA, 22 bp, Homo sapiens
cagctgaacatgtagagcatct

SEQ ID NO: 9234047 - DNA, 22 bp, Homo sapiens
cagctgaaagaaggaagtgtca

SEQ ID NO: 9234048 - DNA, 22 bp, Homo sapiens
cagctgaagaaagagtggttag

SEQ ID NO: 9234049 - DNA, 22 bp, Homo sapiens
cagctgaacatgtagagcatct

SEQ ID NO: 9234050 - DNA, 22 bp, Homo sapiens
cagctctttttcacacaacatg

SEQ ID NO: 9234051 - DNA, 22 bp, Homo sapiens
cagctctttgagtattccattt

SEQ ID NO: 9234052 - DNA, 18 bp, Homo sapiens
cagctcttctccagtaac

SEQ ID NO: 9234053 - DNA, 22 bp, Homo sapiens
cagctctttattgaaacaaaaa

SEQ ID NO: 9234054 - DNA, 22 bp, Homo sapiens
cagctctttattgccaatattc

SEQ ID NO: 9234055 - DNA, 17 bp, Homo sapiens
cagctcttcctccctct

SEQ ID NO: 9234056 - DNA, 22 bp, Homo sapiens
cagctgagtctgaggttctttg

SEQ ID NO: 9234057 - DNA, 22 bp, Homo sapiens
cagctgaggtcaaagaagcagg

SEQ ID NO: 9234058 - DNA, 22 bp, Homo sapiens
cagctgaggtcaaagaagcagg

SEQ ID NO: 9234059 - DNA, 22 bp, Homo sapiens
cagctgaggaatactagatgta

SEQ ID NO: 9234060 - DNA, 22 bp, Homo sapiens
cagctgagctgccagactactg

SEQ ID NO: 9234061 - DNA, 22 bp, Homo sapiens
cagctgagctgccagactactg

SEQ ID NO: 9234062 - DNA, 22 bp, Homo sapiens
cagctgagctcccaggccatca

SEQ ID NO: 9234063 - DNA, 22 bp, Homo sapiens
cagctgagctcccaggccatca

SEQ ID NO: 9234064 - DNA, 23 bp, Homo sapiens
cagctgaagcagcctgggctgga

SEQ ID NO: 9234065 - DNA, 22 bp, Homo sapiens
cagctgagcatcactagtctgg

SEQ ID NO: 9234066 - DNA, 22 bp, Homo sapiens
cagctgaagagaggtgctgagt

SEQ ID NO: 9234067 - DNA, 23 bp, Homo sapiens
cagctgaagcagcctgggctgga

SEQ ID NO: 9234068 - DNA, 22 bp, Homo sapiens
cagctgagtgttggcatgttca

SEQ ID NO: 9234069 - DNA, 22 bp, Homo sapiens
cagctgagtggaccctagaggc

SEQ ID NO: 9234070 - DNA, 22 bp, Homo sapiens
cagctgagtggaccctagaggc

SEQ ID NO: 9234071 - DNA, 22 bp, Homo sapiens
cagctgagtttccaagtctgcc

SEQ ID NO: 9234072 - DNA, 22 bp, Homo sapiens
cagctgagttactctgaggtct

SEQ ID NO: 9234073 - DNA, 22 bp, Homo sapiens
cagctgagtttccaagtctgcc

SEQ ID NO: 9234074 - DNA, 22 bp, Homo sapiens
gtggcctgtcagaagccgtggg

SEQ ID NO: 9234075 - DNA, 20 bp, Homo sapiens
gtggcctgtcctgttgtggg

SEQ ID NO: 9234076 - DNA, 20 bp, Homo sapiens
gtggcctgtcctgttgtggg

SEQ ID NO: 9234077 - DNA, 22 bp, Homo sapiens
gtggcctgtcagaagccgtggg

SEQ ID NO: 9234078 - DNA, 22 bp, Homo sapiens
gtggcgcagagggtggcagaga

SEQ ID NO: 9234079 - DNA, 22 bp, Homo sapiens
gtggctcacgtctgtcatctca

SEQ ID NO: 9234080 - DNA, 22 bp, Homo sapiens
gtggctcacgcctgtaatccca

SEQ ID NO: 9234081 - DNA, 22 bp, Homo sapiens
gtggctcacgtctgtcatctca

SEQ ID NO: 9234082 - DNA, 22 bp, Homo sapiens
gtggctcacgtctgtcatctca

SEQ ID NO: 9234083 - DNA, 22 bp, Homo sapiens
gtggctcacacctgtaatccca

SEQ ID NO: 9234084 - DNA, 22 bp, Homo sapiens
gtggctatatttgaggatacgt

SEQ ID NO: 9234085 - DNA, 22 bp, Homo sapiens
gtggctcacagcaatgtttcct

SEQ ID NO: 9234086 - DNA, 22 bp, Homo sapiens
gtggctcacacctgtaatccca

SEQ ID NO: 9234087 - DNA, 22 bp, Homo sapiens
gtggctcacgcctgtaatccca

SEQ ID NO: 9234088 - DNA, 22 bp, Homo sapiens
gtggctcacagcaatgtttcct

SEQ ID NO: 9234089 - DNA, 22 bp, Homo sapiens
gtgggaagaacttcaagtggct

SEQ ID NO: 9234090 - DNA, 22 bp, Homo sapiens
gtggcttgaccatccctgctac

SEQ ID NO: 9234091 - DNA, 22 bp, Homo sapiens
gtgggaagaacttcaagtggct

SEQ ID NO: 9234092 - DNA, 22 bp, Homo sapiens
gtgggaagagccaattggggta

SEQ ID NO: 9234093 - DNA, 22 bp, Homo sapiens
gtgggcagtgcctgacggatga

SEQ ID NO: 9234094 - DNA, 22 bp, Homo sapiens
gtgggcaggtaggcaccagcta

SEQ ID NO: 9234095 - DNA, 22 bp, Homo sapiens
gtgggcaggtaggcaccagcta

SEQ ID NO: 9234096 - DNA, 22 bp, Homo sapiens
gtgggcagtgcctgacggatga

SEQ ID NO: 9234097 - DNA, 22 bp, Homo sapiens
gtgggcagggttgctttctccg

SEQ ID NO: 9234098 - DNA, 22 bp, Homo sapiens
gtggggaggcctaagcaagttg

SEQ ID NO: 9234099 - DNA, 22 bp, Homo sapiens
gtggggaggcctaagcaagttg

SEQ ID NO: 9234100 - DNA, 22 bp, Homo sapiens
gtggggagggagatgctgaagt

SEQ ID NO: 9234101 - DNA, 22 bp, Homo sapiens
gtgggcagtggggtcttctgcc

SEQ ID NO: 9234102 - DNA, 22 bp, Homo sapiens
gtgggcagtggggtcttctgcc

SEQ ID NO: 9234103 - DNA, 22 bp, Homo sapiens
gtgggcaggccccaaagcaggg

SEQ ID NO: 9234104 - DNA, 22 bp, Homo sapiens
gtgggcaggccccaaagcaggg

SEQ ID NO: 9234105 - DNA, 22 bp, Homo sapiens
gtgggcaggccctaggcgattt

SEQ ID NO: 9234106 - DNA, 22 bp, Homo sapiens
gtgggcaggccctaggcgattt

SEQ ID NO: 9234107 - DNA, 22 bp, Homo sapiens
gtgggcaggccctaggcgattt

SEQ ID NO: 9234108 - DNA, 22 bp, Homo sapiens
gtgggcaggccctaggcgattt

SEQ ID NO: 9234109 - DNA, 22 bp, Homo sapiens
gtgggacagcggggtgggacag

SEQ ID NO: 9234110 - DNA, 22 bp, Homo sapiens
gtgggacagtcagaagtgagca

SEQ ID NO: 9234111 - DNA, 22 bp, Homo sapiens
gtgggacagtcagaagtgagca

SEQ ID NO: 9234112 - DNA, 22 bp, Homo sapiens
gtgggactcttctttggcagtg

SEQ ID NO: 9234113 - DNA, 22 bp, Homo sapiens
gtgggcaggaggccctgccctg

SEQ ID NO: 9234114 - DNA, 22 bp, Homo sapiens
cagctgcagttcaatgcttgct

SEQ ID NO: 9234115 - DNA, 22 bp, Homo sapiens
cagctgccaagaatcttttcta

SEQ ID NO: 9234116 - DNA, 22 bp, Homo sapiens
cagctgccacttgctctcggct

SEQ ID NO: 9234117 - DNA, 22 bp, Homo sapiens
cagctgccacaggactttctga

SEQ ID NO: 9234118 - DNA, 22 bp, Homo sapiens
cagctgccacacctctttctct

SEQ ID NO: 9234119 - DNA, 22 bp, Homo sapiens
cagctgcctgcaacacaagctt

SEQ ID NO: 9234120 - DNA, 20 bp, Homo sapiens
cagctgcctggctctgggat

SEQ ID NO: 9234121 - DNA, 22 bp, Homo sapiens
cagctgcctgtattgtcctcat

SEQ ID NO: 9234122 - DNA, 22 bp, Homo sapiens
cagctgcctatgacctagcctc

SEQ ID NO: 9234123 - DNA, 22 bp, Homo sapiens
cagctgcctatgacctagcctc

SEQ ID NO: 9234124 - DNA, 22 bp, Homo sapiens
cagctgccctgccttgccctta

SEQ ID NO: 9234125 - DNA, 22 bp, Homo sapiens
cagctgcccctccagggctggg

SEQ ID NO: 9234126 - DNA, 22 bp, Homo sapiens
cagctgcagaaagcaagcaggt

SEQ ID NO: 9234127 - DNA, 22 bp, Homo sapiens
cagctgcagaaagcaagcaggt

SEQ ID NO: 9234128 - DNA, 22 bp, Homo sapiens
cagctgcactgaagcaggtttg

SEQ ID NO: 9234129 - DNA, 22 bp, Homo sapiens
cagctgcactgaagcaggtttg

SEQ ID NO: 9234130 - DNA, 19 bp, Homo sapiens
cagctgcaccgtgaccatc

SEQ ID NO: 9234131 - DNA, 22 bp, Homo sapiens
gtggggctgagtggagccagaa

SEQ ID NO: 9234132 - DNA, 22 bp, Homo sapiens
gtggggctgcttaggctgcgca

SEQ ID NO: 9234133 - DNA, 22 bp, Homo sapiens
gtggggcatgcacgctgctcct

SEQ ID NO: 9234134 - DNA, 22 bp, Homo sapiens
gtggggcatgcacgctgctcct

SEQ ID NO: 9234135 - DNA, 22 bp, Homo sapiens
gtggggctaaaaactgtgcagt

SEQ ID NO: 9234136 - DNA, 22 bp, Homo sapiens
gtggggagtgttctgtgattgg

SEQ ID NO: 9234137 - DNA, 22 bp, Homo sapiens
gtggggagggagatgctgaagt

SEQ ID NO: 9234138 - DNA, 22 bp, Homo sapiens
gtggggcagtggcctgggagca

SEQ ID NO: 9234139 - DNA, 22 bp, Homo sapiens
gtggggcagtggcctgggagca

SEQ ID NO: 9234140 - DNA, 22 bp, Homo sapiens
gtggggcagtggcctgggagca

SEQ ID NO: 9234141 - DNA, 22 bp, Homo sapiens
gtggggcagtggcctgggagca

SEQ ID NO: 9234142 - DNA, 22 bp, Homo sapiens
cagctggcgtggagtgattgca

SEQ ID NO: 9234143 - DNA, 22 bp, Homo sapiens
cagctggcgtggagtgattgca

SEQ ID NO: 9234144 - DNA, 22 bp, Homo sapiens
cagctggccccacagtagaggc

SEQ ID NO: 9234145 - DNA, 22 bp, Homo sapiens
gtgggtggatcacctgaggtca

SEQ ID NO: 9234146 - DNA, 22 bp, Homo sapiens
gtgggtggatcacctgaggtca

SEQ ID NO: 9234147 - DNA, 22 bp, Homo sapiens
gtgggtggatcatgaggtcagg

SEQ ID NO: 9234148 - DNA, 22 bp, Homo sapiens
gtgggtggatcatgaggtcagg

SEQ ID NO: 9234149 - DNA, 22 bp, Homo sapiens
gtgggtggatcatgaggtcagg

SEQ ID NO: 9234150 - DNA, 22 bp, Homo sapiens
gtgggtggatcatgaggtcagg

SEQ ID NO: 9234151 - DNA, 22 bp, Homo sapiens
gtgggtggatcacctgaggtca

SEQ ID NO: 9234152 - DNA, 22 bp, Homo sapiens
gtgggtggatcacctgaggtca

SEQ ID NO: 9234153 - DNA, 22 bp, Homo sapiens
gtgggtggaggcgtcgagggca

SEQ ID NO: 9234154 - DNA, 22 bp, Homo sapiens
gtgggtggaggcgtcgagggca

SEQ ID NO: 9234155 - DNA, 22 bp, Homo sapiens
cagctggctgcatgatgccaaa

SEQ ID NO: 9234156 - DNA, 22 bp, Homo sapiens
cagctggctgcatgatgccaaa

SEQ ID NO: 9234157 - DNA, 22 bp, Homo sapiens
cagctgctgatggcctgacaga

SEQ ID NO: 9234158 - DNA, 22 bp, Homo sapiens
cagctgcctgtctggaggcaat

SEQ ID NO: 9234159 - DNA, 22 bp, Homo sapiens
cagctgccttctgcgggaagtc

SEQ ID NO: 9234160 - DNA, 19 bp, Homo sapiens
cagctgccttttctttgca

SEQ ID NO: 9234161 - DNA, 22 bp, Homo sapiens
cagctgctgcccttggctgcag

SEQ ID NO: 9234162 - DNA, 22 bp, Homo sapiens
cagctgctgcctcatccacttt

SEQ ID NO: 9234163 - DNA, 22 bp, Homo sapiens
cagctgctgcccttggctgcag

SEQ ID NO: 9234164 - DNA, 22 bp, Homo sapiens
cagctgctgcctcatccacttt

SEQ ID NO: 9234165 - DNA, 22 bp, Homo sapiens
cagctgctgttactgcttatta

SEQ ID NO: 9234166 - DNA, 22 bp, Homo sapiens
cagctgcttactagctgtgtga

SEQ ID NO: 9234167 - DNA, 22 bp, Homo sapiens
cagctgcttactagctgtgtga

SEQ ID NO: 9234168 - DNA, 22 bp, Homo sapiens
cagctgctgttcagttttgttt

SEQ ID NO: 9234169 - DNA, 22 bp, Homo sapiens
cagctgctgttcagttttgttt

SEQ ID NO: 9234170 - DNA, 22 bp, Homo sapiens
gtgtgaaagtaattgcggtttt

SEQ ID NO: 9234171 - DNA, 22 bp, Homo sapiens
gtgtgaaatggttctctttgtt

SEQ ID NO: 9234172 - DNA, 22 bp, Homo sapiens
gtgtgagagaagctgccatgga

SEQ ID NO: 9234173 - DNA, 22 bp, Homo sapiens
gtgggtggggagctctctggag

SEQ ID NO: 9234174 - DNA, 22 bp, Homo sapiens
gtgggtggattccagcaacgct

SEQ ID NO: 9234175 - DNA, 22 bp, Homo sapiens
gtgggtggattccagcaacgct

SEQ ID NO: 9234176 - DNA, 22 bp, Homo sapiens
gtgggtggggagctctctggag

SEQ ID NO: 9234177 - DNA, 22 bp, Homo sapiens
gtgtagagtgacaaggtgggaa

SEQ ID NO: 9234178 - DNA, 22 bp, Homo sapiens
gtgtagagtgacaaggtgggaa

SEQ ID NO: 9234179 - DNA, 22 bp, Homo sapiens
gtgtagatagtttagatttcaa

SEQ ID NO: 9234180 - DNA, 22 bp, Homo sapiens
gtgtataacccaaatatgctgc

SEQ ID NO: 9234181 - DNA, 22 bp, Homo sapiens
gtgtacatagaattgtgctttg

SEQ ID NO: 9234182 - DNA, 22 bp, Homo sapiens
gtgtacatattgagtctgctga

SEQ ID NO: 9234183 - DNA, 22 bp, Homo sapiens
gtgtataatgctgtttgtacat

SEQ ID NO: 9234184 - DNA, 22 bp, Homo sapiens
gtgtataatgctttgaagatta

SEQ ID NO: 9234185 - DNA, 22 bp, Homo sapiens
gtgtataatgctttgaagatta

SEQ ID NO: 9234186 - DNA, 22 bp, Homo sapiens
gtgtataataatgtgagctaaa

SEQ ID NO: 9234187 - DNA, 22 bp, Homo sapiens
gtgtataactatctatctagta

SEQ ID NO: 9234188 - DNA, 22 bp, Homo sapiens
gtgtataatcctgcaaagggag

SEQ ID NO: 9234189 - DNA, 22 bp, Homo sapiens
gtgtggcaaggtgagaagtggg

SEQ ID NO: 9234190 - DNA, 19 bp, Homo sapiens
gtgtggcagagagtgacca

SEQ ID NO: 9234191 - DNA, 22 bp, Homo sapiens
cagctggctggtcagtgcacaa

SEQ ID NO: 9234192 - DNA, 22 bp, Homo sapiens
cagctggcttgtttgttcttga

SEQ ID NO: 9234193 - DNA, 22 bp, Homo sapiens
gtgtggaaacagagagggcaac

SEQ ID NO: 9234194 - DNA, 22 bp, Homo sapiens
gtgtggaaagagtggcctctca

SEQ ID NO: 9234195 - DNA, 22 bp, Homo sapiens
gtgtgcgccgacacagccaggt

SEQ ID NO: 9234196 - DNA, 22 bp, Homo sapiens
cagctgggagctccattagata

SEQ ID NO: 9234197 - DNA, 22 bp, Homo sapiens
cagctgggctaagagtagaggc

SEQ ID NO: 9234198 - DNA, 22 bp, Homo sapiens
cagctggggcagccacgtgcgg

SEQ ID NO: 9234199 - DNA, 22 bp, Homo sapiens
cagctgtctaagttgagcagga

SEQ ID NO: 9234200 - DNA, 22 bp, Homo sapiens
cagctgtgaattgtcttatcta

SEQ ID NO: 9234201 - DNA, 17 bp, Homo sapiens
cagctgtgagagcctta

SEQ ID NO: 9234202 - DNA, 22 bp, Homo sapiens
caggaacagctgacctgacaat

SEQ ID NO: 9234203 - DNA, 22 bp, Homo sapiens
caggaacagcaccaggagctag

SEQ ID NO: 9234204 - DNA, 22 bp, Homo sapiens
caggaacaggggagtgaacctg

SEQ ID NO: 9234205 - DNA, 22 bp, Homo sapiens
caggaacaggctgatgggcagg

SEQ ID NO: 9234206 - DNA, 22 bp, Homo sapiens
caggaacaggctgatgggcagg

SEQ ID NO: 9234207 - DNA, 19 bp, Homo sapiens
caggaacatggagggaggg

SEQ ID NO: 9234208 - DNA, 22 bp, Homo sapiens
caggaacacaatgagtctcaaa

SEQ ID NO: 9234209 - DNA, 22 bp, Homo sapiens
caggaacacaagttcagggatg

SEQ ID NO: 9234210 - DNA, 22 bp, Homo sapiens
caggaacaatgtaagtctcatt

SEQ ID NO: 9234211 - DNA, 22 bp, Homo sapiens
caggaacagagtggcattgtct

SEQ ID NO: 9234212 - DNA, 22 bp, Homo sapiens
caggaacacctgcagctagtgg

SEQ ID NO: 9234213 - DNA, 22 bp, Homo sapiens
caggaacacaatgagtctcaaa

SEQ ID NO: 9234214 - DNA, 22 bp, Homo sapiens
caggaagaggacaggcttcccc

SEQ ID NO: 9234215 - DNA, 22 bp, Homo sapiens
caggaagaggtatcaccgagca

SEQ ID NO: 9234216 - DNA, 22 bp, Homo sapiens
caggaacatgttggaaagaaat

SEQ ID NO: 9234217 - DNA, 22 bp, Homo sapiens
caggaacatgtctccaattaga

SEQ ID NO: 9234218 - DNA, 22 bp, Homo sapiens
caggaagagaacatggaggctg

SEQ ID NO: 9234219 - DNA, 22 bp, Homo sapiens
caggaacattgtagaattgaaa

SEQ ID NO: 9234220 - DNA, 21 bp, Homo sapiens
caggaacattctttacattta

SEQ ID NO: 9234221 - DNA, 22 bp, Homo sapiens
gtttacatattttaattggtga

SEQ ID NO: 9234222 - DNA, 22 bp, Homo sapiens
gtttacatgcagaaaatcaatg

SEQ ID NO: 9234223 - DNA, 22 bp, Homo sapiens
gtttacagagacagaaagtagt

SEQ ID NO: 9234224 - DNA, 22 bp, Homo sapiens
caggaagattagaccaagagct

SEQ ID NO: 9234225 - DNA, 22 bp, Homo sapiens
caggaagattagaccaagagct

SEQ ID NO: 9234226 - DNA, 22 bp, Homo sapiens
caggaagcaagtgattttcttg

SEQ ID NO: 9234227 - DNA, 22 bp, Homo sapiens
gtttacatgtttttctcttaca

SEQ ID NO: 9234228 - DNA, 22 bp, Homo sapiens
gtttacattaagtattagcatc

SEQ ID NO: 9234229 - DNA, 22 bp, Homo sapiens
gtttacatgtactcattatact

SEQ ID NO: 9234230 - DNA, 22 bp, Homo sapiens
gtttacatgtttttctcttaca

SEQ ID NO: 9234231 - DNA, 22 bp, Homo sapiens
gtttacatgtaatgtgttattg

SEQ ID NO: 9234232 - DNA, 22 bp, Homo sapiens
gtttacatgtaatgtgttattg

SEQ ID NO: 9234233 - DNA, 22 bp, Homo sapiens
gtttacatgcatgcaagaatga

SEQ ID NO: 9234234 - DNA, 22 bp, Homo sapiens
gtttattattcaacttcatgtt

SEQ ID NO: 9234235 - DNA, 22 bp, Homo sapiens
gtttattattcaacttcatgtt

SEQ ID NO: 9234236 - DNA, 22 bp, Homo sapiens
gtttattatacaacaaaagcta

SEQ ID NO: 9234237 - DNA, 18 bp, Homo sapiens
gtttacattactgaatag

SEQ ID NO: 9234238 - DNA, 22 bp, Homo sapiens
gtttattgggtattgtggagcc

SEQ ID NO: 9234239 - DNA, 22 bp, Homo sapiens
gtttattgggtattgtggagcc

SEQ ID NO: 9234240 - DNA, 22 bp, Homo sapiens
gtttattgggtattgtggagcc

SEQ ID NO: 9234241 - DNA, 22 bp, Homo sapiens
gtttattgataaaagctggaca

SEQ ID NO: 9234242 - DNA, 22 bp, Homo sapiens
gtttattgataaaagctggaca

SEQ ID NO: 9234243 - DNA, 22 bp, Homo sapiens
gtttattgataaaagctggaca

SEQ ID NO: 9234244 - DNA, 22 bp, Homo sapiens
gtttcctatggctgctgcagga

SEQ ID NO: 9234245 - DNA, 22 bp, Homo sapiens
gtttcctataactcaggcacca

SEQ ID NO: 9234246 - DNA, 20 bp, Homo sapiens
gtttcctatttacctcctca

SEQ ID NO: 9234247 - DNA, 22 bp, Homo sapiens
gtttcctatgtccattgaggga

SEQ ID NO: 9234248 - DNA, 22 bp, Homo sapiens
gtttcctttaatagtgatattg

SEQ ID NO: 9234249 - DNA, 22 bp, Homo sapiens
gtttcctttaatagtgatattg

SEQ ID NO: 9234250 - DNA, 19 bp, Homo sapiens
gtttccttgggtgtaggga

SEQ ID NO: 9234251 - DNA, 22 bp, Homo sapiens
gttctgtctgagcaccacagga

SEQ ID NO: 9234252 - DNA, 22 bp, Homo sapiens
gttcttaaagattcatcaagca

SEQ ID NO: 9234253 - DNA, 22 bp, Homo sapiens
gttcttaaccttctttggttgt

SEQ ID NO: 9234254 - DNA, 22 bp, Homo sapiens
gttgctgaaggcatgccagaga

SEQ ID NO: 9234255 - DNA, 22 bp, Homo sapiens
gttgctgatggcaagattccag

SEQ ID NO: 9234256 - DNA, 22 bp, Homo sapiens
gttgctgattaacactttgagt

SEQ ID NO: 9234257 - DNA, 22 bp, Homo sapiens
gttgcttctcttaagtccagct

SEQ ID NO: 9234258 - DNA, 22 bp, Homo sapiens
gttgctgaaattaatattggag

SEQ ID NO: 9234259 - DNA, 22 bp, Homo sapiens
gttgctgaaagccctgactggc

SEQ ID NO: 9234260 - DNA, 22 bp, Homo sapiens
gttcttcagaggggaaagaacc

SEQ ID NO: 9234261 - DNA, 22 bp, Homo sapiens
gttcctaaccagcagagaaaca

SEQ ID NO: 9234262 - DNA, 22 bp, Homo sapiens
gttcctaaatttgaaggacttt

SEQ ID NO: 9234263 - DNA, 22 bp, Homo sapiens
gttcctaaatctggaggacctc

SEQ ID NO: 9234264 - DNA, 22 bp, Homo sapiens
gttcctaagctgtggccctgga

SEQ ID NO: 9234265 - DNA, 22 bp, Homo sapiens
gttcctaagcactgtgcattct

SEQ ID NO: 9234266 - DNA, 22 bp, Homo sapiens
gttcctgagaaataaagagaga

SEQ ID NO: 9234267 - DNA, 22 bp, Homo sapiens
gttcctgatgctttgaaattca

SEQ ID NO: 9234268 - DNA, 22 bp, Homo sapiens
gttcctgagaaataaagagaga

SEQ ID NO: 9234269 - DNA, 22 bp, Homo sapiens
gttcacagtgttttctttgcat

SEQ ID NO: 9234270 - DNA, 22 bp, Homo sapiens
gttcacaggttctctttctaag

SEQ ID NO: 9234271 - DNA, 20 bp, Homo sapiens
gttcacaggcttcctttcag

SEQ ID NO: 9234272 - DNA, 22 bp, Homo sapiens
gttccccttgtgttgttgccca

SEQ ID NO: 9234273 - DNA, 22 bp, Homo sapiens
gttggctatgagagctttagtg

SEQ ID NO: 9234274 - DNA, 22 bp, Homo sapiens
gttggctatgagagctttagtg

SEQ ID NO: 9234275 - DNA, 22 bp, Homo sapiens
gttggctcattttatagacagc

SEQ ID NO: 9234276 - DNA, 22 bp, Homo sapiens
gttgggaaggcaagaagtagaa

SEQ ID NO: 9234277 - DNA, 22 bp, Homo sapiens
gttgggaagcagatggatgagc

SEQ ID NO: 9234278 - DNA, 22 bp, Homo sapiens
gttggcagaaagctttcgatcg

SEQ ID NO: 9234279 - DNA, 22 bp, Homo sapiens
caggaaaggtgtgtcatgatgg

SEQ ID NO: 9234280 - DNA, 22 bp, Homo sapiens
caggaaagtctgtaaaggaacc

SEQ ID NO: 9234281 - DNA, 22 bp, Homo sapiens
caggaacaatcttactactatt

SEQ ID NO: 9234282 - DNA, 22 bp, Homo sapiens
caggaacaatgtaagtctcatt

SEQ ID NO: 9234283 - DNA, 22 bp, Homo sapiens
caggaacaactcccagcatctc

SEQ ID NO: 9234284 - DNA, 22 bp, Homo sapiens
caggaacaactcccagcatctc

SEQ ID NO: 9234285 - DNA, 22 bp, Homo sapiens
caggaacaaggcctatgggact

SEQ ID NO: 9234286 - DNA, 22 bp, Homo sapiens
caggaaattcttttgtttgtgc

SEQ ID NO: 9234287 - DNA, 22 bp, Homo sapiens
caggaaatgggtcgttttataa

SEQ ID NO: 9234288 - DNA, 22 bp, Homo sapiens
caggaaatggctgaataaattc

SEQ ID NO: 9234289 - DNA, 22 bp, Homo sapiens
caggaaataggcgtttgtcctc

SEQ ID NO: 9234290 - DNA, 22 bp, Homo sapiens
cagcttcaactgcacagtcaac

SEQ ID NO: 9234291 - DNA, 22 bp, Homo sapiens
cagcttcagcgtgacaccagtg

SEQ ID NO: 9234292 - DNA, 22 bp, Homo sapiens
cagcttcatgacaaacagtttt

SEQ ID NO: 9234293 - DNA, 22 bp, Homo sapiens
cagctgtttgggcatggccaga

SEQ ID NO: 9234294 - DNA, 22 bp, Homo sapiens
cagctgtttcagtagcgttact

SEQ ID NO: 9234295 - DNA, 22 bp, Homo sapiens
cagctgttgtgatccatttacg

SEQ ID NO: 9234296 - DNA, 22 bp, Homo sapiens
cagctgttgtgctgggcagtta

SEQ ID NO: 9234297 - DNA, 22 bp, Homo sapiens
cagctgttgtgtatcaggcaga

SEQ ID NO: 9234298 - DNA, 22 bp, Homo sapiens
cagctgttgtgtatcaggcaga

SEQ ID NO: 9234299 - DNA, 22 bp, Homo sapiens
cagcttccgaccgggggctgca

SEQ ID NO: 9234300 - DNA, 22 bp, Homo sapiens
gtgtgtctgaagttgagtagac

SEQ ID NO: 9234301 - DNA, 22 bp, Homo sapiens
cagcttccatctccactgccct

SEQ ID NO: 9234302 - DNA, 22 bp, Homo sapiens
cagcttccatctccactgccct

SEQ ID NO: 9234303 - DNA, 22 bp, Homo sapiens
cagcttcccagctcactcataa

SEQ ID NO: 9234304 - DNA, 22 bp, Homo sapiens
cagcttcccttggctgagcaga

SEQ ID NO: 9234305 - DNA, 22 bp, Homo sapiens
cagcttcccttggctgagcaga

SEQ ID NO: 9234306 - DNA, 22 bp, Homo sapiens
cagcttccccccgggcttgaga

SEQ ID NO: 9234307 - DNA, 22 bp, Homo sapiens
cagcttccacagacttggctcg

SEQ ID NO: 9234308 - DNA, 22 bp, Homo sapiens
cagcttccataagagatggaga

SEQ ID NO: 9234309 - DNA, 22 bp, Homo sapiens
cagcttcattgcctgatgtctt

SEQ ID NO: 9234310 - DNA, 22 bp, Homo sapiens
cagctgtgtaaacacatgtgta

SEQ ID NO: 9234311 - DNA, 22 bp, Homo sapiens
cagctgtgtagatgcagggtca

SEQ ID NO: 9234312 - DNA, 22 bp, Homo sapiens
cagctgtgtagatgcagggtca

SEQ ID NO: 9234313 - DNA, 22 bp, Homo sapiens
cagctgtggctgccactgctcc

SEQ ID NO: 9234314 - DNA, 22 bp, Homo sapiens
cagctgtggctgccactgctcc

SEQ ID NO: 9234315 - DNA, 22 bp, Homo sapiens
cagctgtgggcctgacgtggca

SEQ ID NO: 9234316 - DNA, 22 bp, Homo sapiens
cagctgtgatatgcctgcctga

SEQ ID NO: 9234317 - DNA, 18 bp, Homo sapiens
cagctgtgccctgtttgg

SEQ ID NO: 9234318 - DNA, 22 bp, Homo sapiens
cagctgtgctgattgctcagta

SEQ ID NO: 9234319 - DNA, 22 bp, Homo sapiens
cagctgtgctgattgctcagta

SEQ ID NO: 9234320 - DNA, 22 bp, Homo sapiens
cagctgtggagatggggtgcat

SEQ ID NO: 9234321 - DNA, 22 bp, Homo sapiens
cagctgtgctgtattaagctct

SEQ ID NO: 9234322 - DNA, 22 bp, Homo sapiens
gttacaaatgccaaagctgaga

SEQ ID NO: 9234323 - DNA, 22 bp, Homo sapiens
gttacaaatgccaaagctgaga

SEQ ID NO: 9234324 - DNA, 22 bp, Homo sapiens
gttaaagtgagctactttaggt

SEQ ID NO: 9234325 - DNA, 22 bp, Homo sapiens
gtgttttctctccagcaggcag

SEQ ID NO: 9234326 - DNA, 22 bp, Homo sapiens
gtgttttattggtgcagtcaga

SEQ ID NO: 9234327 - DNA, 22 bp, Homo sapiens
gttacaatgttcttcagttctg

SEQ ID NO: 9234328 - DNA, 22 bp, Homo sapiens
gttacacaggaaaacattagca

SEQ ID NO: 9234329 - DNA, 22 bp, Homo sapiens
gttacactctccaggcacttgg

SEQ ID NO: 9234330 - DNA, 22 bp, Homo sapiens
gttacaaatgtaaattctgggg

SEQ ID NO: 9234331 - DNA, 22 bp, Homo sapiens
gttacaaatgtaaattctgggg

SEQ ID NO: 9234332 - DNA, 22 bp, Homo sapiens
gttacaaatgccaaagctgaga

SEQ ID NO: 9234333 - DNA, 22 bp, Homo sapiens
gtgtgtggggccttcgggtcct

SEQ ID NO: 9234334 - DNA, 22 bp, Homo sapiens
gtgtgtgtactctgtatataaa

SEQ ID NO: 9234335 - DNA, 22 bp, Homo sapiens
gtgtgtgtactctgtatataaa

SEQ ID NO: 9234336 - DNA, 22 bp, Homo sapiens
gtgtgtgtactctgtatataaa

SEQ ID NO: 9234337 - DNA, 22 bp, Homo sapiens
gtgtgtgtatatatacacacac

SEQ ID NO: 9234338 - DNA, 22 bp, Homo sapiens
gtgtttgtgagctaggtgacat

SEQ ID NO: 9234339 - DNA, 22 bp, Homo sapiens
gtgtttgtctcttggcctacct

SEQ ID NO: 9234340 - DNA, 22 bp, Homo sapiens
gtgtttgtttgggtagctagac

SEQ ID NO: 9234341 - DNA, 22 bp, Homo sapiens
gtgtttgttcgtgactccaaag

SEQ ID NO: 9234342 - DNA, 22 bp, Homo sapiens
gtgtttgtttagtgcagagaga

SEQ ID NO: 9234343 - DNA, 22 bp, Homo sapiens
gtgttttatggagtcataacgt

SEQ ID NO: 9234344 - DNA, 22 bp, Homo sapiens
gtgttttatcagacaaagtata

SEQ ID NO: 9234345 - DNA, 22 bp, Homo sapiens
cagcttgggagtttggttttat

SEQ ID NO: 9234346 - DNA, 22 bp, Homo sapiens
cagcttggcttccgctttactg

SEQ ID NO: 9234347 - DNA, 22 bp, Homo sapiens
cagcttgggtcaggtgcctgct

SEQ ID NO: 9234348 - DNA, 22 bp, Homo sapiens
cagcttgggtcaggtgcctgct

SEQ ID NO: 9234349 - DNA, 22 bp, Homo sapiens
cagcttggaggaggatctaaga

SEQ ID NO: 9234350 - DNA, 20 bp, Homo sapiens
cagcttggatgagaggctga

SEQ ID NO: 9234351 - DNA, 20 bp, Homo sapiens
cagcttggatgagaggctga

SEQ ID NO: 9234352 - DNA, 20 bp, Homo sapiens
cagcttggatgagaggctga

SEQ ID NO: 9234353 - DNA, 22 bp, Homo sapiens
cagcttctgagcaagccagggg

SEQ ID NO: 9234354 - DNA, 22 bp, Homo sapiens
cagcttctgagcaagccagggg

SEQ ID NO: 9234355 - DNA, 22 bp, Homo sapiens
cagcttctcagaaagctgaggt

SEQ ID NO: 9234356 - DNA, 22 bp, Homo sapiens
cagcttctatttatctttgtgt

SEQ ID NO: 9234357 - DNA, 22 bp, Homo sapiens
cagcttctccagatgaccctca

SEQ ID NO: 9234358 - DNA, 22 bp, Homo sapiens
cagcttctaccatcaggaaatt

SEQ ID NO: 9234359 - DNA, 22 bp, Homo sapiens
gttattgaggtggagtctcact

SEQ ID NO: 9234360 - DNA, 22 bp, Homo sapiens
gttattgaggtggagtctcact

SEQ ID NO: 9234361 - DNA, 22 bp, Homo sapiens
gttattgactctcttgtggctt

SEQ ID NO: 9234362 - DNA, 22 bp, Homo sapiens
gttattgagacatagagttatg

SEQ ID NO: 9234363 - DNA, 21 bp, Homo sapiens
gttattgacctccaggctggc

SEQ ID NO: 9234364 - DNA, 22 bp, Homo sapiens
gttattgacatgtattaagcac

SEQ ID NO: 9234365 - DNA, 22 bp, Homo sapiens
gttacattaggataatttgctg

SEQ ID NO: 9234366 - DNA, 22 bp, Homo sapiens
gttacattacttgtgcagttgt

SEQ ID NO: 9234367 - DNA, 22 bp, Homo sapiens
gttacatggagcaatgatgcat

SEQ ID NO: 9234368 - DNA, 22 bp, Homo sapiens
gttattatcttgaggaatctgt

SEQ ID NO: 9234369 - DNA, 22 bp, Homo sapiens
gttattatttctctccttgcta

SEQ ID NO: 9234370 - DNA, 22 bp, Homo sapiens
cagctttagagaaaacatattt

SEQ ID NO: 9234371 - DNA, 22 bp, Homo sapiens
cagctttaggactcataataaa

SEQ ID NO: 9234372 - DNA, 22 bp, Homo sapiens
cagctttaggactcataataaa

SEQ ID NO: 9234373 - DNA, 22 bp, Homo sapiens
cagctttagagaaaacatattt

SEQ ID NO: 9234374 - DNA, 22 bp, Homo sapiens
cagctttccccgtgcctcagcc

SEQ ID NO: 9234375 - DNA, 22 bp, Homo sapiens
cagctttcatcagtgacactca

SEQ ID NO: 9234376 - DNA, 22 bp, Homo sapiens
cagctttcttccttctgtctgt

SEQ ID NO: 9234377 - DNA, 22 bp, Homo sapiens
cagctttgaaacatggctctag

SEQ ID NO: 9234378 - DNA, 22 bp, Homo sapiens
cagctttctgtctcatgactga

SEQ ID NO: 9234379 - DNA, 22 bp, Homo sapiens
cagctttgacctaaagtaggaa

SEQ ID NO: 9234380 - DNA, 22 bp, Homo sapiens
cagctttgagagttgcatttta

SEQ ID NO: 9234381 - DNA, 22 bp, Homo sapiens
cagctttgagcagccagtggca

SEQ ID NO: 9234382 - DNA, 22 bp, Homo sapiens
cagctttgattcactgcctagt

SEQ ID NO: 9234383 - DNA, 22 bp, Homo sapiens
caggaaaatggaatcacctgta

SEQ ID NO: 9234384 - DNA, 22 bp, Homo sapiens
caggaaaatgtcaatggaaagc

SEQ ID NO: 9234385 - DNA, 22 bp, Homo sapiens
caggaaacattcccataacaca

SEQ ID NO: 9234386 - DNA, 22 bp, Homo sapiens
caggaaacattcccataacaca

SEQ ID NO: 9234387 - DNA, 21 bp, Homo sapiens
caggaaactgaggccatgggg

SEQ ID NO: 9234388 - DNA, 22 bp, Homo sapiens
caggaaagccgagtgccatagg

SEQ ID NO: 9234389 - DNA, 22 bp, Homo sapiens
gttcacaagctgattgtctttc

SEQ ID NO: 9234390 - DNA, 22 bp, Homo sapiens
gttcacagaaattgtgtacctc

SEQ ID NO: 9234391 - DNA, 22 bp, Homo sapiens
gttcacaagctgggtttctgca

SEQ ID NO: 9234392 - DNA, 19 bp, Homo sapiens
taacaaagtctgaagtcag

SEQ ID NO: 9234393 - DNA, 22 bp, Homo sapiens
taacactttggattaaaattct

SEQ ID NO: 9234394 - DNA, 22 bp, Homo sapiens
taacagaaacagataagtgtaa

SEQ ID NO: 9234395 - DNA, 22 bp, Homo sapiens
taacactgtgtctgccatatcc

SEQ ID NO: 9234396 - DNA, 22 bp, Homo sapiens
taacactgtgtctgccatatcc

SEQ ID NO: 9234397 - DNA, 22 bp, Homo sapiens
taacaatacccattctaattac

SEQ ID NO: 9234398 - DNA, 22 bp, Homo sapiens
taacaatacccattctaattac

SEQ ID NO: 9234399 - DNA, 22 bp, Homo sapiens
taacaatacccattctaattac

SEQ ID NO: 9234400 - DNA, 22 bp, Homo sapiens
taacaatacccattctaattac

SEQ ID NO: 9234401 - DNA, 22 bp, Homo sapiens
taacagaaaggggacagaaata

SEQ ID NO: 9234402 - DNA, 22 bp, Homo sapiens
taacagaagatgaaacttcttt

SEQ ID NO: 9234403 - DNA, 22 bp, Homo sapiens
taacattaggtagacataagcc

SEQ ID NO: 9234404 - DNA, 22 bp, Homo sapiens
taacattccatggatctgcaga

SEQ ID NO: 9234405 - DNA, 22 bp, Homo sapiens
taacattccatggatctgcaga

SEQ ID NO: 9234406 - DNA, 22 bp, Homo sapiens
taacattgagtccactaaacag

SEQ ID NO: 9234407 - DNA, 22 bp, Homo sapiens
taacattgttatgaatcaggtc

SEQ ID NO: 9234408 - DNA, 22 bp, Homo sapiens
taactttaggaataggtaatct

SEQ ID NO: 9234409 - DNA, 22 bp, Homo sapiens
taactttagtgtatgaggtaag

SEQ ID NO: 9234410 - DNA, 22 bp, Homo sapiens
taagaaacatgatacttttcct

SEQ ID NO: 9234411 - DNA, 21 bp, Homo sapiens
taacttttgtgcctatcttgt

SEQ ID NO: 9234412 - DNA, 22 bp, Homo sapiens
taacttgacctgtataaaacac

SEQ ID NO: 9234413 - DNA, 22 bp, Homo sapiens
taacttctttggtttaaagaga

SEQ ID NO: 9234414 - DNA, 16 bp, Homo sapiens
taacatttttaaaagg

SEQ ID NO: 9234415 - DNA, 19 bp, Homo sapiens
taacttgtagatatgaagt

SEQ ID NO: 9234416 - DNA, 19 bp, Homo sapiens
taacttgtagatatgaagt

SEQ ID NO: 9234417 - DNA, 22 bp, Homo sapiens
taacttgataagtattctctgc

SEQ ID NO: 9234418 - DNA, 22 bp, Homo sapiens
taacttgtgttacattactctt

SEQ ID NO: 9234419 - DNA, 22 bp, Homo sapiens
taacatttaaatttttcacata

SEQ ID NO: 9234420 - DNA, 22 bp, Homo sapiens
taacatttcggtgacagtggga

SEQ ID NO: 9234421 - DNA, 22 bp, Homo sapiens
taacatttgctgtctcctatgt

SEQ ID NO: 9234422 - DNA, 21 bp, Homo sapiens
caggatgatgggaaggtggtg

SEQ ID NO: 9234423 - DNA, 22 bp, Homo sapiens
caggatggtggcatgatcagaa

SEQ ID NO: 9234424 - DNA, 22 bp, Homo sapiens
caggatggtcttcatttggctc

SEQ ID NO: 9234425 - DNA, 22 bp, Homo sapiens
caggatggagagtgaggggtca

SEQ ID NO: 9234426 - DNA, 22 bp, Homo sapiens
caggatgaggtagaggcagata

SEQ ID NO: 9234427 - DNA, 18 bp, Homo sapiens
caggatgagtgatgggga

SEQ ID NO: 9234428 - DNA, 19 bp, Homo sapiens
caggatgatcccatgacac

SEQ ID NO: 9234429 - DNA, 22 bp, Homo sapiens
caggatgaggtagaggcagata

SEQ ID NO: 9234430 - DNA, 22 bp, Homo sapiens
taagattacagtgagaaataaa

SEQ ID NO: 9234431 - DNA, 22 bp, Homo sapiens
taagattatacttaaagagaaa

SEQ ID NO: 9234432 - DNA, 22 bp, Homo sapiens
taagatttttaaaatgtcctca

SEQ ID NO: 9234433 - DNA, 22 bp, Homo sapiens
taagatttttaaaatgtcctca

SEQ ID NO: 9234434 - DNA, 19 bp, Homo sapiens
taagacagattcctagagt

SEQ ID NO: 9234435 - DNA, 23 bp, Homo sapiens
taagacacccgactccagagatg

SEQ ID NO: 9234436 - DNA, 22 bp, Homo sapiens
taagacacattggagtagatga

SEQ ID NO: 9234437 - DNA, 22 bp, Homo sapiens
taagacacattgagaaacacaa

SEQ ID NO: 9234438 - DNA, 22 bp, Homo sapiens
taaggcagaaatatgagcaggg

SEQ ID NO: 9234439 - DNA, 22 bp, Homo sapiens
taaggcagaaatatgagcaggg

SEQ ID NO: 9234440 - DNA, 22 bp, Homo sapiens
taagcaaataatgcatcaaggg

SEQ ID NO: 9234441 - DNA, 19 bp, Homo sapiens
taaggcagcagtgacaggc

SEQ ID NO: 9234442 - DNA, 22 bp, Homo sapiens
taaggcagatgtggaatcaatt

SEQ ID NO: 9234443 - DNA, 22 bp, Homo sapiens
caggcagaaagtattctgtgta

SEQ ID NO: 9234444 - DNA, 22 bp, Homo sapiens
taaggcagccgctcagagaggt

SEQ ID NO: 9234445 - DNA, 22 bp, Homo sapiens
caggcactcagtctggatccct

SEQ ID NO: 9234446 - DNA, 22 bp, Homo sapiens
caggcaacgtccttagagatgc

SEQ ID NO: 9234447 - DNA, 22 bp, Homo sapiens
caggattgcagatttgattaga

SEQ ID NO: 9234448 - DNA, 22 bp, Homo sapiens
caggattgagcaaatggattat

SEQ ID NO: 9234449 - DNA, 19 bp, Homo sapiens
caggattgtttaaagcttt

SEQ ID NO: 9234450 - DNA, 22 bp, Homo sapiens
caggatggtggcatgatcagaa

SEQ ID NO: 9234451 - DNA, 22 bp, Homo sapiens
caggatggtggcatgatcagaa

SEQ ID NO: 9234452 - DNA, 22 bp, Homo sapiens
caggattaaggtgaggggagta

SEQ ID NO: 9234453 - DNA, 22 bp, Homo sapiens
caggattgaatgcttctccctg

SEQ ID NO: 9234454 - DNA, 22 bp, Homo sapiens
caggatggtgtgagtgtgagga

SEQ ID NO: 9234455 - DNA, 22 bp, Homo sapiens
caggatgtgaggaggccatttg

SEQ ID NO: 9234456 - DNA, 22 bp, Homo sapiens
caggcacaaatttctagataag

SEQ ID NO: 9234457 - DNA, 22 bp, Homo sapiens
caggcaagattagagatgagca

SEQ ID NO: 9234458 - DNA, 22 bp, Homo sapiens
caggcacaggggaatgtctttt

SEQ ID NO: 9234459 - DNA, 22 bp, Homo sapiens
caggcacaagatcggctagata

SEQ ID NO: 9234460 - DNA, 22 bp, Homo sapiens
caggcaccaacttcctggggag

SEQ ID NO: 9234461 - DNA, 22 bp, Homo sapiens
caggcaccaacttcctggggag

SEQ ID NO: 9234462 - DNA, 22 bp, Homo sapiens
taagacaattcttcagtcacaa

SEQ ID NO: 9234463 - DNA, 22 bp, Homo sapiens
taagacaattcttcagtcacaa

SEQ ID NO: 9234464 - DNA, 17 bp, Homo sapiens
caggcacatgaagccag

SEQ ID NO: 9234465 - DNA, 22 bp, Homo sapiens
tacatattgtccatagttgctt

SEQ ID NO: 9234466 - DNA, 22 bp, Homo sapiens
tacatatttgtctttgtactgt

SEQ ID NO: 9234467 - DNA, 22 bp, Homo sapiens
tacatattcaacgttcagtatt

SEQ ID NO: 9234468 - DNA, 22 bp, Homo sapiens
tacatattctacccctttttct

SEQ ID NO: 9234469 - DNA, 22 bp, Homo sapiens
tacatattgtccatagttgctt

SEQ ID NO: 9234470 - DNA, 20 bp, Homo sapiens
tacatattatatcagctgca

SEQ ID NO: 9234471 - DNA, 20 bp, Homo sapiens
tacatattatatcagctgca

SEQ ID NO: 9234472 - DNA, 22 bp, Homo sapiens
tacatatgtaaacatgtataaa

SEQ ID NO: 9234473 - DNA, 22 bp, Homo sapiens
tacatatgtaaacatgtataaa

SEQ ID NO: 9234474 - DNA, 22 bp, Homo sapiens
tacatatccaggctgagaagat

SEQ ID NO: 9234475 - DNA, 22 bp, Homo sapiens
tacatatagacagttactctag

SEQ ID NO: 9234476 - DNA, 22 bp, Homo sapiens
tacatcatggcttcatgctgca

SEQ ID NO: 9234477 - DNA, 22 bp, Homo sapiens
tacatatttgtctttgtactgt

SEQ ID NO: 9234478 - DNA, 22 bp, Homo sapiens
tacatcaagataaaaactgtca

SEQ ID NO: 9234479 - DNA, 22 bp, Homo sapiens
tacatcaagataaaaactgtca

SEQ ID NO: 9234480 - DNA, 22 bp, Homo sapiens
tacatcataataatacttagaa

SEQ ID NO: 9234481 - DNA, 22 bp, Homo sapiens
tacatcataataatacttagaa

SEQ ID NO: 9234482 - DNA, 22 bp, Homo sapiens
caggccctggcagggctgagtc

SEQ ID NO: 9234483 - DNA, 22 bp, Homo sapiens
caggccctgggcaggatcagcc

SEQ ID NO: 9234484 - DNA, 22 bp, Homo sapiens
tacagtaaagctgctatgaatt

SEQ ID NO: 9234485 - DNA, 22 bp, Homo sapiens
tacaggtggtaaaaatattgtt

SEQ ID NO: 9234486 - DNA, 22 bp, Homo sapiens
tacaggtggatcactagtatag

SEQ ID NO: 9234487 - DNA, 22 bp, Homo sapiens
caggccctggcagggctgagtc

SEQ ID NO: 9234488 - DNA, 22 bp, Homo sapiens
tacaagtatggaatgattctca

SEQ ID NO: 9234489 - DNA, 22 bp, Homo sapiens
tacaggtagagtctctagttta

SEQ ID NO: 9234490 - DNA, 22 bp, Homo sapiens
tacagggtattcaagggtagtt

SEQ ID NO: 9234491 - DNA, 22 bp, Homo sapiens
tacagggtataggtacagatga

SEQ ID NO: 9234492 - DNA, 22 bp, Homo sapiens
tacagggtattcaagggtagtt

SEQ ID NO: 9234493 - DNA, 22 bp, Homo sapiens
tacagctgttggtgtttcctct

SEQ ID NO: 9234494 - DNA, 22 bp, Homo sapiens
tacagctggactggtagctgtg

SEQ ID NO: 9234495 - DNA, 22 bp, Homo sapiens
tacagcttaaaaaagccaactt

SEQ ID NO: 9234496 - DNA, 22 bp, Homo sapiens
tacaaattaatgggcatgttta

SEQ ID NO: 9234497 - DNA, 22 bp, Homo sapiens
tacaaatgtattttattttggt

SEQ ID NO: 9234498 - DNA, 22 bp, Homo sapiens
tacaaatggttgaatggatgaa

SEQ ID NO: 9234499 - DNA, 22 bp, Homo sapiens
tacaaatggttgaatggatgaa

SEQ ID NO: 9234500 - DNA, 22 bp, Homo sapiens
tacaaatgagttgtatgaacca

SEQ ID NO: 9234501 - DNA, 22 bp, Homo sapiens
tacaaatgcctgacacacagat

SEQ ID NO: 9234502 - DNA, 22 bp, Homo sapiens
tacaaatgcctgacacacagat

SEQ ID NO: 9234503 - DNA, 22 bp, Homo sapiens
tacaaatgaaccaactttgatg

SEQ ID NO: 9234504 - DNA, 22 bp, Homo sapiens
caggcagaaattttgtttcatt

SEQ ID NO: 9234505 - DNA, 22 bp, Homo sapiens
caggcagaagaagtggaaggac

SEQ ID NO: 9234506 - DNA, 22 bp, Homo sapiens
caggcagaaggaagtaccaggc

SEQ ID NO: 9234507 - DNA, 22 bp, Homo sapiens
caggcagaaggaagtaccaggc

SEQ ID NO: 9234508 - DNA, 22 bp, Homo sapiens
caggcagagaccctctcctaaa

SEQ ID NO: 9234509 - DNA, 22 bp, Homo sapiens
caggcagagaggagcatttaat

SEQ ID NO: 9234510 - DNA, 22 bp, Homo sapiens
caggcagagaggagcatttaat

SEQ ID NO: 9234511 - DNA, 17 bp, Homo sapiens
caggcagacatgtaagc

SEQ ID NO: 9234512 - DNA, 22 bp, Homo sapiens
caggcagagcaactggtccaga

SEQ ID NO: 9234513 - DNA, 22 bp, Homo sapiens
caggcagagcaactggtccaga

SEQ ID NO: 9234514 - DNA, 22 bp, Homo sapiens
taatgttagtatgtaatcttat

SEQ ID NO: 9234515 - DNA, 22 bp, Homo sapiens
taatgttagtatgtaatcttat

SEQ ID NO: 9234516 - DNA, 22 bp, Homo sapiens
taatgttataaattcttggttt

SEQ ID NO: 9234517 - DNA, 22 bp, Homo sapiens
taattgtaaagtagtagtacag

SEQ ID NO: 9234518 - DNA, 22 bp, Homo sapiens
taatttacagagatacagtcag

SEQ ID NO: 9234519 - DNA, 22 bp, Homo sapiens
taatttaatttcatgccagcct

SEQ ID NO: 9234520 - DNA, 22 bp, Homo sapiens
taatttaatttcatgccagcct

SEQ ID NO: 9234521 - DNA, 22 bp, Homo sapiens
taatttactcagatgttcaatc

SEQ ID NO: 9234522 - DNA, 22 bp, Homo sapiens
taatttacagttcgccatgtct

SEQ ID NO: 9234523 - DNA, 22 bp, Homo sapiens
taatttaatccaagtgttacat

SEQ ID NO: 9234524 - DNA, 22 bp, Homo sapiens
taatttaatccaagtgttacat

SEQ ID NO: 9234525 - DNA, 22 bp, Homo sapiens
taatttaattccatggattcta

SEQ ID NO: 9234526 - DNA, 22 bp, Homo sapiens
taatttaattccatggattcta

SEQ ID NO: 9234527 - DNA, 22 bp, Homo sapiens
caggcagcatttactctgatga

SEQ ID NO: 9234528 - DNA, 22 bp, Homo sapiens
caggcagcatcagtctgctgta

SEQ ID NO: 9234529 - DNA, 22 bp, Homo sapiens
caggcagcaggagccctgctcg

SEQ ID NO: 9234530 - DNA, 22 bp, Homo sapiens
caggcagcaggagccctgctcg

SEQ ID NO: 9234531 - DNA, 22 bp, Homo sapiens
caggcagcagccactctggtat

SEQ ID NO: 9234532 - DNA, 22 bp, Homo sapiens
caggcagcagccactctggtat

SEQ ID NO: 9234533 - DNA, 22 bp, Homo sapiens
caggcagctctgcttttcctaa

SEQ ID NO: 9234534 - DNA, 22 bp, Homo sapiens
caggcagctgactgtcagatat

SEQ ID NO: 9234535 - DNA, 22 bp, Homo sapiens
caggcagcctgcggtctgcaca

SEQ ID NO: 9234536 - DNA, 22 bp, Homo sapiens
caggcagcctgagggatctggg

SEQ ID NO: 9234537 - DNA, 22 bp, Homo sapiens
caggcagcctgagggatctggg

SEQ ID NO: 9234538 - DNA, 22 bp, Homo sapiens
caggcagccaggggacctgtcc

SEQ ID NO: 9234539 - DNA, 22 bp, Homo sapiens
caggcagcctgagggatctggg

SEQ ID NO: 9234540 - DNA, 22 bp, Homo sapiens
caggcagctgggtcaccgtccc

SEQ ID NO: 9234541 - DNA, 22 bp, Homo sapiens
caggcagctgggtcaccgtccc

SEQ ID NO: 9234542 - DNA, 22 bp, Homo sapiens
caggcagctgctgggttcagcc

SEQ ID NO: 9234543 - DNA, 22 bp, Homo sapiens
caggcagctgctgggttcagcc

SEQ ID NO: 9234544 - DNA, 22 bp, Homo sapiens
caggcagctgctgggttcagcc

SEQ ID NO: 9234545 - DNA, 22 bp, Homo sapiens
caggcagctgcgacaagagagc

SEQ ID NO: 9234546 - DNA, 22 bp, Homo sapiens
caggcagctgaggactttgcta

SEQ ID NO: 9234547 - DNA, 22 bp, Homo sapiens
caggcagctgaggactttgcta

SEQ ID NO: 9234548 - DNA, 22 bp, Homo sapiens
caggcagctgaggactttgcta

SEQ ID NO: 9234549 - DNA, 22 bp, Homo sapiens
caggcaggagaggaggatttct

SEQ ID NO: 9234550 - DNA, 22 bp, Homo sapiens
caggcaggagccagggattcca

SEQ ID NO: 9234551 - DNA, 22 bp, Homo sapiens
caggcaggagccagggattcca

SEQ ID NO: 9234552 - DNA, 23 bp, Homo sapiens
caggcaggatgaggactacactc

SEQ ID NO: 9234553 - DNA, 22 bp, Homo sapiens
caggcagggagccactgtataa

SEQ ID NO: 9234554 - DNA, 22 bp, Homo sapiens
caggaggcagaggatgcccagt

SEQ ID NO: 9234555 - DNA, 22 bp, Homo sapiens
caggaggcagaggatgcccagt

SEQ ID NO: 9234556 - DNA, 22 bp, Homo sapiens
caggaggcagcgctctcaggac

SEQ ID NO: 9234557 - DNA, 22 bp, Homo sapiens
caggaggaagaactctgcaaca

SEQ ID NO: 9234558 - DNA, 20 bp, Homo sapiens
caggaggcaaggtcaaggtc

SEQ ID NO: 9234559 - DNA, 22 bp, Homo sapiens
caggaggaaatgtgaccctgct

SEQ ID NO: 9234560 - DNA, 22 bp, Homo sapiens
caggaggaaatgtgaccctgct

SEQ ID NO: 9234561 - DNA, 22 bp, Homo sapiens
caggaggaaagttccactcaac

SEQ ID NO: 9234562 - DNA, 22 bp, Homo sapiens
caggaggaacaagaggttctgg

SEQ ID NO: 9234563 - DNA, 22 bp, Homo sapiens
caggagctgggtctggaagcag

SEQ ID NO: 9234564 - DNA, 22 bp, Homo sapiens
caggagcttctgcccatggcca

SEQ ID NO: 9234565 - DNA, 22 bp, Homo sapiens
caggagcttctgcccatggcca

SEQ ID NO: 9234566 - DNA, 22 bp, Homo sapiens
caggagctggatctccttgcgg

SEQ ID NO: 9234567 - DNA, 22 bp, Homo sapiens
caggagctggatctccttgcgg

SEQ ID NO: 9234568 - DNA, 22 bp, Homo sapiens
caggagctgggtctggaagcag

SEQ ID NO: 9234569 - DNA, 21 bp, Homo sapiens
taaatgtgagcagggctgggc

SEQ ID NO: 9234570 - DNA, 22 bp, Homo sapiens
taaatgtgcacaggttagaagg

SEQ ID NO: 9234571 - DNA, 22 bp, Homo sapiens
taaatgtataggcactaaacct

SEQ ID NO: 9234572 - DNA, 22 bp, Homo sapiens
taaatgtataggcactaaacct

SEQ ID NO: 9234573 - DNA, 22 bp, Homo sapiens
taaatgtataggcactaaacct

SEQ ID NO: 9234574 - DNA, 22 bp, Homo sapiens
taaatggtatccttgctgtgct

SEQ ID NO: 9234575 - DNA, 20 bp, Homo sapiens
taaatggtgcatttcttata

SEQ ID NO: 9234576 - DNA, 22 bp, Homo sapiens
taaatgtaccttctgccttact

SEQ ID NO: 9234577 - DNA, 22 bp, Homo sapiens
caggaggcccaaagggcgcaga

SEQ ID NO: 9234578 - DNA, 22 bp, Homo sapiens
caggaggccaactgtgggactt

SEQ ID NO: 9234579 - DNA, 22 bp, Homo sapiens
caggaggccaactgtgggactt

SEQ ID NO: 9234580 - DNA, 22 bp, Homo sapiens
caggaggcatcatggagcggac

SEQ ID NO: 9234581 - DNA, 22 bp, Homo sapiens
caggaggctcctagggctctgt

SEQ ID NO: 9234582 - DNA, 22 bp, Homo sapiens
caggaggctcctagggctctgt

SEQ ID NO: 9234583 - DNA, 23 bp, Homo sapiens
caggagggaatgaagttagacaa

SEQ ID NO: 9234584 - DNA, 22 bp, Homo sapiens
caggagggggtggagtttcgcc

SEQ ID NO: 9234585 - DNA, 22 bp, Homo sapiens
caggagtgtcgggtcactaggt

SEQ ID NO: 9234586 - DNA, 22 bp, Homo sapiens
caggagtggtgtgagggactcc

SEQ ID NO: 9234587 - DNA, 22 bp, Homo sapiens
caggagtgcaggtggtgaggca

SEQ ID NO: 9234588 - DNA, 22 bp, Homo sapiens
caggagtgcaggtggtgaggca

SEQ ID NO: 9234589 - DNA, 22 bp, Homo sapiens
taacaaagtaccatagactgga

SEQ ID NO: 9234590 - DNA, 19 bp, Homo sapiens
taacaaagtctgaagtcag

SEQ ID NO: 9234591 - DNA, 22 bp, Homo sapiens
taacaaagtattgtttgtgtat

SEQ ID NO: 9234592 - DNA, 22 bp, Homo sapiens
caggagttttaaatctagcatg

SEQ ID NO: 9234593 - DNA, 22 bp, Homo sapiens
caggagtgtctccacacagcaa

SEQ ID NO: 9234594 - DNA, 22 bp, Homo sapiens
caggagtgttgattgctcagga

SEQ ID NO: 9234595 - DNA, 22 bp, Homo sapiens
taaagccacgctggaaatcagg

SEQ ID NO: 9234596 - DNA, 22 bp, Homo sapiens
taaagccatactgaaagccact

SEQ ID NO: 9234597 - DNA, 22 bp, Homo sapiens
taaagcatgtgttagaagtgca

SEQ ID NO: 9234598 - DNA, 22 bp, Homo sapiens
taaagcatgtttcagtaaggtt

SEQ ID NO: 9234599 - DNA, 22 bp, Homo sapiens
taaagtcatctttacatctttg

SEQ ID NO: 9234600 - DNA, 22 bp, Homo sapiens
taaagtcatctttacatctttg

SEQ ID NO: 9234601 - DNA, 18 bp, Homo sapiens
taaatatatttccccctt

SEQ ID NO: 9234602 - DNA, 18 bp, Homo sapiens
taaatatatttccccctt

SEQ ID NO: 9234603 - DNA, 22 bp, Homo sapiens
taaatagggtaagcgtgtttac

SEQ ID NO: 9234604 - DNA, 22 bp, Homo sapiens
taaatagagaatcagcttggag

SEQ ID NO: 9234605 - DNA, 22 bp, Homo sapiens
taaatagagaatcagcttggag

SEQ ID NO: 9234606 - DNA, 22 bp, Homo sapiens
taaatagagaatcagcttggag

SEQ ID NO: 9234607 - DNA, 22 bp, Homo sapiens
taaatagaatctaaactgctca

SEQ ID NO: 9234608 - DNA, 22 bp, Homo sapiens
taaagtgaagttcagaatggct

SEQ ID NO: 9234609 - DNA, 22 bp, Homo sapiens
taaatatgcatgtatccttatc

SEQ ID NO: 9234610 - DNA, 22 bp, Homo sapiens
taaatatcacctggaattgtta

SEQ ID NO: 9234611 - DNA, 22 bp, Homo sapiens
taaatgctttctatgaaagagg

SEQ ID NO: 9234612 - DNA, 22 bp, Homo sapiens
taaatgctttctatgaaagagg

SEQ ID NO: 9234613 - DNA, 22 bp, Homo sapiens
taaatgcttagattcatagaaa

SEQ ID NO: 9234614 - DNA, 22 bp, Homo sapiens
taaatcaagaatatcagcttgt

SEQ ID NO: 9234615 - DNA, 22 bp, Homo sapiens
taaatcacaaattttctcattt

SEQ ID NO: 9234616 - DNA, 22 bp, Homo sapiens
caggagccctggtgggtggaca

SEQ ID NO: 9234617 - DNA, 22 bp, Homo sapiens
caggagctcaagaccaccctgg

SEQ ID NO: 9234618 - DNA, 22 bp, Homo sapiens
caggagctactcaggttgggtt

SEQ ID NO: 9234619 - DNA, 22 bp, Homo sapiens
caggagctactcaggttgggtt

SEQ ID NO: 9234620 - DNA, 22 bp, Homo sapiens
caggagctcacagtctttgggt

SEQ ID NO: 9234621 - DNA, 22 bp, Homo sapiens
caggagctcacagtctttgggt

SEQ ID NO: 9234622 - DNA, 22 bp, Homo sapiens
caggagctcagatgacatctca

SEQ ID NO: 9234623 - DNA, 22 bp, Homo sapiens
caggagctcagatgacatctca

SEQ ID NO: 9234624 - DNA, 22 bp, Homo sapiens
taaagcagtggttctcaaactt

SEQ ID NO: 9234625 - DNA, 22 bp, Homo sapiens
taaagcagtgcaaaagcgtttt

SEQ ID NO: 9234626 - DNA, 22 bp, Homo sapiens
taaagcagtgtggttgtgtccc

SEQ ID NO: 9234627 - DNA, 22 bp, Homo sapiens
taaagcataatgaatatctaga

SEQ ID NO: 9234628 - DNA, 22 bp, Homo sapiens
caggagctctcatcgtcagggc

SEQ ID NO: 9234629 - DNA, 22 bp, Homo sapiens
caggagctctcatcgtcagggc

SEQ ID NO: 9234630 - DNA, 22 bp, Homo sapiens
caggagctcttaaggatgtgat

SEQ ID NO: 9234631 - DNA, 22 bp, Homo sapiens
caggagctcttaaggatgtgat

SEQ ID NO: 9234632 - DNA, 22 bp, Homo sapiens
caggagctcttaaggatgtgat

SEQ ID NO: 9234633 - DNA, 22 bp, Homo sapiens
caggagctggataggaccacaa

SEQ ID NO: 9234634 - DNA, 22 bp, Homo sapiens
caggagagcccgggtccgggct

SEQ ID NO: 9234635 - DNA, 15 bp, Homo sapiens
caggagaggaaggtt

SEQ ID NO: 9234636 - DNA, 19 bp, Homo sapiens
caggagagcatgcactttg

SEQ ID NO: 9234637 - DNA, 22 bp, Homo sapiens
caggagagcccgggtccgggct

SEQ ID NO: 9234638 - DNA, 22 bp, Homo sapiens
caggagactcagcatccaggat

SEQ ID NO: 9234639 - DNA, 22 bp, Homo sapiens
caggagagatatgagtccccac

SEQ ID NO: 9234640 - DNA, 22 bp, Homo sapiens
caggagagatatgagtccccac

SEQ ID NO: 9234641 - DNA, 22 bp, Homo sapiens
caggagagatatgagtccccac

SEQ ID NO: 9234642 - DNA, 22 bp, Homo sapiens
caggagatgtaagacttctgtt

SEQ ID NO: 9234643 - DNA, 22 bp, Homo sapiens
caggagatgacagggaagaacc

SEQ ID NO: 9234644 - DNA, 22 bp, Homo sapiens
caggagatgacagggaagaacc

SEQ ID NO: 9234645 - DNA, 22 bp, Homo sapiens
caggagatgacagggaagaacc

SEQ ID NO: 9234646 - DNA, 22 bp, Homo sapiens
caggagataaaagagatgcttt

SEQ ID NO: 9234647 - DNA, 22 bp, Homo sapiens
caggagatgacagggaagaacc

SEQ ID NO: 9234648 - DNA, 22 bp, Homo sapiens
caggagaggctgtacgtttctc

SEQ ID NO: 9234649 - DNA, 22 bp, Homo sapiens
caggagaggaggctacttctta

SEQ ID NO: 9234650 - DNA, 22 bp, Homo sapiens
caggagacctggtaagccaagt

SEQ ID NO: 9234651 - DNA, 22 bp, Homo sapiens
caggagactatggcccaaggcc

SEQ ID NO: 9234652 - DNA, 22 bp, Homo sapiens
caggagacctggtaagccaagt

SEQ ID NO: 9234653 - DNA, 22 bp, Homo sapiens
caggagacaagttagcagctga

SEQ ID NO: 9234654 - DNA, 22 bp, Homo sapiens
caggagaagtctctagggggtg

SEQ ID NO: 9234655 - DNA, 22 bp, Homo sapiens
caggacagtttgctttgccctg

SEQ ID NO: 9234656 - DNA, 19 bp, Homo sapiens
caggacagtttgccaagaa

SEQ ID NO: 9234657 - DNA, 22 bp, Homo sapiens
taaactacccatgacagtttca

SEQ ID NO: 9234658 - DNA, 22 bp, Homo sapiens
taaaccttatttgaataccaac

SEQ ID NO: 9234659 - DNA, 22 bp, Homo sapiens
taaactatctgtgtttgaagtt

SEQ ID NO: 9234660 - DNA, 22 bp, Homo sapiens
taaactcttctgtagaatcaga

SEQ ID NO: 9234661 - DNA, 22 bp, Homo sapiens
taaactcttctgtagaatcaga

SEQ ID NO: 9234662 - DNA, 22 bp, Homo sapiens
taaacatttgttattcttgttt

SEQ ID NO: 9234663 - DNA, 22 bp, Homo sapiens
taaaatagccagtgcccctctg

SEQ ID NO: 9234664 - DNA, 22 bp, Homo sapiens
taaaatagccagtgcccctctg

SEQ ID NO: 9234665 - DNA, 22 bp, Homo sapiens
taaaatagcttatgtcttttga

SEQ ID NO: 9234666 - DNA, 22 bp, Homo sapiens
taaaatagcttatgtcttttga

SEQ ID NO: 9234667 - DNA, 22 bp, Homo sapiens
taaaatagcttatgtcttttga

SEQ ID NO: 9234668 - DNA, 22 bp, Homo sapiens
taaaatagcatgtgcagtgaaa

SEQ ID NO: 9234669 - DNA, 22 bp, Homo sapiens
taaaatagcatgtgcagtgaaa

SEQ ID NO: 9234670 - DNA, 22 bp, Homo sapiens
taaaatgacttcctccaacatc

SEQ ID NO: 9234671 - DNA, 22 bp, Homo sapiens
taaaatgacttcctccaacatc

SEQ ID NO: 9234672 - DNA, 22 bp, Homo sapiens
taaaatcattctggtgtcagta

SEQ ID NO: 9234673 - DNA, 22 bp, Homo sapiens
taaaatcattctggtgtcagta

SEQ ID NO: 9234674 - DNA, 22 bp, Homo sapiens
taaaatcatgacagattgacat

SEQ ID NO: 9234675 - DNA, 22 bp, Homo sapiens
taaaatcagccgaccatggtgg

SEQ ID NO: 9234676 - DNA, 22 bp, Homo sapiens
taaaatcaccaaaagcaggtgg

SEQ ID NO: 9234677 - DNA, 22 bp, Homo sapiens
taaaatcaccaaaagcaggtgg

SEQ ID NO: 9234678 - DNA, 22 bp, Homo sapiens
gttttcctgaaactgatggtgt

SEQ ID NO: 9234679 - DNA, 22 bp, Homo sapiens
gttttccttctcagccattgcc

SEQ ID NO: 9234680 - DNA, 22 bp, Homo sapiens
gttttctaagtaggtagcacca

SEQ ID NO: 9234681 - DNA, 22 bp, Homo sapiens
gttttctaccagggaagagagt

SEQ ID NO: 9234682 - DNA, 22 bp, Homo sapiens
gttttccttctcagccattgcc

SEQ ID NO: 9234683 - DNA, 22 bp, Homo sapiens
gttttctaccagggaagagagt

SEQ ID NO: 9234684 - DNA, 22 bp, Homo sapiens
gttttctaggatcccctccaag

SEQ ID NO: 9234685 - DNA, 22 bp, Homo sapiens
gttttctaccagggaagagagt

SEQ ID NO: 9234686 - DNA, 22 bp, Homo sapiens
gttttctcatctcctcaatggt

SEQ ID NO: 9234687 - DNA, 22 bp, Homo sapiens
gttttctgcctgaaggtgacca

SEQ ID NO: 9234688 - DNA, 22 bp, Homo sapiens
gttttctgattagcaaatctga

SEQ ID NO: 9234689 - DNA, 22 bp, Homo sapiens
gttttcttcctgcaattggcat

SEQ ID NO: 9234690 - DNA, 22 bp, Homo sapiens
gttttctggcagttattcctta

SEQ ID NO: 9234691 - DNA, 22 bp, Homo sapiens
gttttcttcctgcaattggcat

SEQ ID NO: 9234692 - DNA, 22 bp, Homo sapiens
taaaaaacattactctgtcctg

SEQ ID NO: 9234693 - DNA, 22 bp, Homo sapiens
taaaaaacattactctgtcctg

SEQ ID NO: 9234694 - DNA, 22 bp, Homo sapiens
taaaaagcagctgagattttct

SEQ ID NO: 9234695 - DNA, 19 bp, Homo sapiens
taaaaactgaaggaagcag

SEQ ID NO: 9234696 - DNA, 19 bp, Homo sapiens
taaaaactgaaggaagcag

SEQ ID NO: 9234697 - DNA, 22 bp, Homo sapiens
caggacagctcaacacctcctc

SEQ ID NO: 9234698 - DNA, 22 bp, Homo sapiens
caggacaggagtggggtcaaag

SEQ ID NO: 9234699 - DNA, 22 bp, Homo sapiens
caggacaggccctgtggggtct

SEQ ID NO: 9234700 - DNA, 22 bp, Homo sapiens
caggacaggccctgtggggtct

SEQ ID NO: 9234701 - DNA, 22 bp, Homo sapiens
caggacaggagtggggtcaaag

SEQ ID NO: 9234702 - DNA, 22 bp, Homo sapiens
caggacagtataggctttagga

SEQ ID NO: 9234703 - DNA, 22 bp, Homo sapiens
caggacaggtgttctagatcag

SEQ ID NO: 9234704 - DNA, 22 bp, Homo sapiens
caggacaggccctgtggggtct

SEQ ID NO: 9234705 - DNA, 22 bp, Homo sapiens
gttttccatggaggtctgacct

SEQ ID NO: 9234706 - DNA, 22 bp, Homo sapiens
gttttccaggtaccttggtatt

SEQ ID NO: 9234707 - DNA, 22 bp, Homo sapiens
gttttccactggattgtttgga

SEQ ID NO: 9234708 - DNA, 22 bp, Homo sapiens
caggacagtgcaggtccatcct

SEQ ID NO: 9234709 - DNA, 22 bp, Homo sapiens
caggaatgtagcagcgatggaa

SEQ ID NO: 9234710 - DNA, 22 bp, Homo sapiens
caggaatgatattcgaggagat

SEQ ID NO: 9234711 - DNA, 22 bp, Homo sapiens
caggaatgatctgctgagtgat

SEQ ID NO: 9234712 - DNA, 22 bp, Homo sapiens
caggaatgccaaccagtgcatg

SEQ ID NO: 9234713 - DNA, 22 bp, Homo sapiens
caggaagggggatccttggaag

SEQ ID NO: 9234714 - DNA, 22 bp, Homo sapiens
caggaagggggatccttggaag

SEQ ID NO: 9234715 - DNA, 22 bp, Homo sapiens
caggaagctgagctgcactgca

SEQ ID NO: 9234716 - DNA, 22 bp, Homo sapiens
caggaaggaaagggtgtggaga

SEQ ID NO: 9234717 - DNA, 22 bp, Homo sapiens
caggaaggaaagggtgtggaga

SEQ ID NO: 9234718 - DNA, 22 bp, Homo sapiens
gtttggggagttcctttaggcc

SEQ ID NO: 9234719 - DNA, 22 bp, Homo sapiens
gtttggggtctgcagagcggcg

SEQ ID NO: 9234720 - DNA, 22 bp, Homo sapiens
gtttggcatctcacttaaaccg

SEQ ID NO: 9234721 - DNA, 22 bp, Homo sapiens
gtttgtatgaatgttttatgct

SEQ ID NO: 9234722 - DNA, 22 bp, Homo sapiens
gtttgtaattactgcagcatgg

SEQ ID NO: 9234723 - DNA, 22 bp, Homo sapiens
gtttgtaattacctcttttgac

SEQ ID NO: 9234724 - DNA, 22 bp, Homo sapiens
gtttgtaaccagaacagagagt

SEQ ID NO: 9234725 - DNA, 21 bp, Homo sapiens
gtttgtaaggcactgtgttct

SEQ ID NO: 9234726 - DNA, 22 bp, Homo sapiens
gtttgtaagcagtctgcttgtg

SEQ ID NO: 9234727 - DNA, 22 bp, Homo sapiens
ttccgctgtttagttgaagttt

SEQ ID NO: 9234728 - DNA, 22 bp, Homo sapiens
ctaagaaaatagaagcatgcta

SEQ ID NO: 9234729 - DNA, 21 bp, Homo sapiens
ttcccttctggttttgagaga

SEQ ID NO: 9234730 - DNA, 22 bp, Homo sapiens
ttcccttctagttttgagagac

SEQ ID NO: 9234731 - DNA, 22 bp, Homo sapiens
ttcccttcctcactctacttgt

SEQ ID NO: 9234732 - DNA, 22 bp, Homo sapiens
ttcccttaaattatggcatcta

SEQ ID NO: 9234733 - DNA, 22 bp, Homo sapiens
ttcccttaaattatggcatcta

SEQ ID NO: 9234734 - DNA, 22 bp, Homo sapiens
ttccatttggcacttcactgag

SEQ ID NO: 9234735 - DNA, 22 bp, Homo sapiens
ttccaaatgttggacaactgta

SEQ ID NO: 9234736 - DNA, 22 bp, Homo sapiens
ttccaaatggagaagatgagtt

SEQ ID NO: 9234737 - DNA, 22 bp, Homo sapiens
ttccaaatgagttccatcgaat

SEQ ID NO: 9234738 - DNA, 22 bp, Homo sapiens
ttccaaagtcatgttgctgata

SEQ ID NO: 9234739 - DNA, 22 bp, Homo sapiens
ttccaaagaaattgaccaagac

SEQ ID NO: 9234740 - DNA, 22 bp, Homo sapiens
ttccaaagctgctttatttagt

SEQ ID NO: 9234741 - DNA, 22 bp, Homo sapiens
ctacaaatataaaacacagata

SEQ ID NO: 9234742 - DNA, 21 bp, Homo sapiens
ttcctggggaaggagctgcct

SEQ ID NO: 9234743 - DNA, 22 bp, Homo sapiens
ttcctggggacttaccgtcatt

SEQ ID NO: 9234744 - DNA, 22 bp, Homo sapiens
ctacaaagctcttctacaggca

SEQ ID NO: 9234745 - DNA, 22 bp, Homo sapiens
ttccttccctcagtggctgaag

SEQ ID NO: 9234746 - DNA, 22 bp, Homo sapiens
ttccttccatagcaaaacatgc

SEQ ID NO: 9234747 - DNA, 22 bp, Homo sapiens
ttccttctaatattctgcctgt

SEQ ID NO: 9234748 - DNA, 22 bp, Homo sapiens
ttccttctaatattctgcctgt

SEQ ID NO: 9234749 - DNA, 22 bp, Homo sapiens
ctaagggttgaaacagcaagaa

SEQ ID NO: 9234750 - DNA, 22 bp, Homo sapiens
ctaatgtaaaacagacttgcat

SEQ ID NO: 9234751 - DNA, 22 bp, Homo sapiens
ctacaaaagtaattgtggtttt

SEQ ID NO: 9234752 - DNA, 22 bp, Homo sapiens
ctacaaaagtaattgtggtttt

SEQ ID NO: 9234753 - DNA, 22 bp, Homo sapiens
ctaatttaatgaatgagtctta

SEQ ID NO: 9234754 - DNA, 22 bp, Homo sapiens
ctaatttaatgaatgagtctta

SEQ ID NO: 9234755 - DNA, 22 bp, Homo sapiens
ctaattttcccaaggccttcta

SEQ ID NO: 9234756 - DNA, 22 bp, Homo sapiens
ctaatttaatgaatgagtctta

SEQ ID NO: 9234757 - DNA, 22 bp, Homo sapiens
ctaattgtaagctccttgaggg

SEQ ID NO: 9234758 - DNA, 22 bp, Homo sapiens
ctaattatgttgttataatcaa

SEQ ID NO: 9234759 - DNA, 22 bp, Homo sapiens
ctaatgtatcatggctctcagc

SEQ ID NO: 9234760 - DNA, 22 bp, Homo sapiens
ctaatgtaaagcatttgttcag

SEQ ID NO: 9234761 - DNA, 22 bp, Homo sapiens
cggcagtgggcgccaggtctcc

SEQ ID NO: 9234762 - DNA, 22 bp, Homo sapiens
cggcatccccacttcctcctgc

SEQ ID NO: 9234763 - DNA, 22 bp, Homo sapiens
cggaagcgttctcagcaggggc

SEQ ID NO: 9234764 - DNA, 21 bp, Homo sapiens
cggaaactcggctctggttcc

SEQ ID NO: 9234765 - DNA, 21 bp, Homo sapiens
cggaaaggactagggctcaga

SEQ ID NO: 9234766 - DNA, 22 bp, Homo sapiens
cgctgtgtgcagactgaaaatg

SEQ ID NO: 9234767 - DNA, 22 bp, Homo sapiens
cgctggtcaccatggcgtcctg

SEQ ID NO: 9234768 - DNA, 22 bp, Homo sapiens
cgctgggggaacagcgagggtg

SEQ ID NO: 9234769 - DNA, 22 bp, Homo sapiens
cgctgggcgccgacctgctggc

SEQ ID NO: 9234770 - DNA, 22 bp, Homo sapiens
ttcacatgacagggtgaagcat

SEQ ID NO: 9234771 - DNA, 22 bp, Homo sapiens
ttcacagtggcttaggctatgg

SEQ ID NO: 9234772 - DNA, 22 bp, Homo sapiens
cctgggtggttccggcaaggag

SEQ ID NO: 9234773 - DNA, 22 bp, Homo sapiens
cctgggtggcagaggttgcagt

SEQ ID NO: 9234774 - DNA, 22 bp, Homo sapiens
ttcagaaacatcagtggatgga

SEQ ID NO: 9234775 - DNA, 22 bp, Homo sapiens
ttcagaaacagagtgagtgagt

SEQ ID NO: 9234776 - DNA, 22 bp, Homo sapiens
ttcagaaaggataattggaagg

SEQ ID NO: 9234777 - DNA, 22 bp, Homo sapiens
ttcagaaacagagtgagtgagt

SEQ ID NO: 9234778 - DNA, 22 bp, Homo sapiens
ttcagaaaaagaccattgcaat

SEQ ID NO: 9234779 - DNA, 22 bp, Homo sapiens
ttcagaaaaagaccattgcaat

SEQ ID NO: 9234780 - DNA, 22 bp, Homo sapiens
ttcagaaaaaacttcaataagt

SEQ ID NO: 9234781 - DNA, 22 bp, Homo sapiens
ttcactgttgttagcagaggcg

SEQ ID NO: 9234782 - DNA, 22 bp, Homo sapiens
ttcactgttggctttgcttgtc

SEQ ID NO: 9234783 - DNA, 22 bp, Homo sapiens
ttcactgtttcatcctacttct

SEQ ID NO: 9234784 - DNA, 22 bp, Homo sapiens
cggctgagacggccatagacac

SEQ ID NO: 9234785 - DNA, 22 bp, Homo sapiens
cggctgagacggccatagacac

SEQ ID NO: 9234786 - DNA, 23 bp, Homo sapiens
cggctgctcggccgagtcctcgg

SEQ ID NO: 9234787 - DNA, 22 bp, Homo sapiens
cggctgaggatctccaggcctg

SEQ ID NO: 9234788 - DNA, 22 bp, Homo sapiens
cggctgaggatctccaggcctg

SEQ ID NO: 9234789 - DNA, 22 bp, Homo sapiens
cggctgagcagtgctgatggaa

SEQ ID NO: 9234790 - DNA, 22 bp, Homo sapiens
cggctgagcagtgctgatggaa

SEQ ID NO: 9234791 - DNA, 22 bp, Homo sapiens
cggctgctgcctgagtcgctgt

SEQ ID NO: 9234792 - DNA, 20 bp, Homo sapiens
ttcattcattccacaacttc

SEQ ID NO: 9234793 - DNA, 22 bp, Homo sapiens
ttcattcccaagagtaaacata

SEQ ID NO: 9234794 - DNA, 22 bp, Homo sapiens
ttcattccttctgtaccttgcc

SEQ ID NO: 9234795 - DNA, 22 bp, Homo sapiens
ttcattccttccctaagcaact

SEQ ID NO: 9234796 - DNA, 22 bp, Homo sapiens
ttcattcctgagcccatattta

SEQ ID NO: 9234797 - DNA, 22 bp, Homo sapiens
ttcagaaaggtaaatggatttc

SEQ ID NO: 9234798 - DNA, 22 bp, Homo sapiens
ttcagaaaggttaatctggatt

SEQ ID NO: 9234799 - DNA, 22 bp, Homo sapiens
ttcagaaaggtaaatggatttc

SEQ ID NO: 9234800 - DNA, 22 bp, Homo sapiens
ttcagaaaggtaaatggatttc

SEQ ID NO: 9234801 - DNA, 22 bp, Homo sapiens
ttcattcttgggatcagagagt

SEQ ID NO: 9234802 - DNA, 22 bp, Homo sapiens
ttcattcttatttgtgatctgg

SEQ ID NO: 9234803 - DNA, 22 bp, Homo sapiens
ttccaaaatgccttgatatgat

SEQ ID NO: 9234804 - DNA, 22 bp, Homo sapiens
ttcattcttgggatcagagagt

SEQ ID NO: 9234805 - DNA, 22 bp, Homo sapiens
ttcattccttctgtaccttgcc

SEQ ID NO: 9234806 - DNA, 22 bp, Homo sapiens
ttcattctcttagcatagtcct

SEQ ID NO: 9234807 - DNA, 22 bp, Homo sapiens
ttcattctcttagcatagtcct

SEQ ID NO: 9234808 - DNA, 22 bp, Homo sapiens
ttcattctgcagttctcagctc

SEQ ID NO: 9234809 - DNA, 22 bp, Homo sapiens
ttcattctgcagttctcagctc

SEQ ID NO: 9234810 - DNA, 22 bp, Homo sapiens
ttcattctgtttggaaaggtgg

SEQ ID NO: 9234811 - DNA, 22 bp, Homo sapiens
ttcttgttctggttctgttagc

SEQ ID NO: 9234812 - DNA, 22 bp, Homo sapiens
ttcttgttctggttctgttagc

SEQ ID NO: 9234813 - DNA, 22 bp, Homo sapiens
ttcttgttctcctcatttagag

SEQ ID NO: 9234814 - DNA, 22 bp, Homo sapiens
ttcttgtatgtatgcaaaatca

SEQ ID NO: 9234815 - DNA, 22 bp, Homo sapiens
ttcttgggaatttttccaacac

SEQ ID NO: 9234816 - DNA, 22 bp, Homo sapiens
ttcttgtactggagatacatga

SEQ ID NO: 9234817 - DNA, 22 bp, Homo sapiens
ttcttgtatataaaaatcattt

SEQ ID NO: 9234818 - DNA, 22 bp, Homo sapiens
ttcttgtactggagatacatga

SEQ ID NO: 9234819 - DNA, 22 bp, Homo sapiens
ttcttgggtgtgaccagtctga

SEQ ID NO: 9234820 - DNA, 22 bp, Homo sapiens
ttcttgggtgtgaccagtctga

SEQ ID NO: 9234821 - DNA, 22 bp, Homo sapiens
ctattttcattcttacattgtc

SEQ ID NO: 9234822 - DNA, 22 bp, Homo sapiens
ctattttaagaggccattaggt

SEQ ID NO: 9234823 - DNA, 22 bp, Homo sapiens
ctattttaacttgattacctct

SEQ ID NO: 9234824 - DNA, 22 bp, Homo sapiens
ctattttaagaggccattaggt

SEQ ID NO: 9234825 - DNA, 22 bp, Homo sapiens
ttcttgttctggttctgttagc

SEQ ID NO: 9234826 - DNA, 22 bp, Homo sapiens
ttctttaaaatagtgagaaaga

SEQ ID NO: 9234827 - DNA, 19 bp, Homo sapiens
ctcagcacttttacacagg

SEQ ID NO: 9234828 - DNA, 22 bp, Homo sapiens
ctcagcactgacccaggagatg

SEQ ID NO: 9234829 - DNA, 22 bp, Homo sapiens
ctcagcactttggaaggctgat

SEQ ID NO: 9234830 - DNA, 22 bp, Homo sapiens
ctcagcaccccgacaggacatt

SEQ ID NO: 9234831 - DNA, 22 bp, Homo sapiens
ctcagcaccccgacaggacatt

SEQ ID NO: 9234832 - DNA, 22 bp, Homo sapiens
ctatttttctgtaccctaattt

SEQ ID NO: 9234833 - DNA, 22 bp, Homo sapiens
ttgagctgtaaggtgggatgtg

SEQ ID NO: 9234834 - DNA, 22 bp, Homo sapiens
ttgagaaaagctgtgtaaggat

SEQ ID NO: 9234835 - DNA, 22 bp, Homo sapiens
ttgacttttcttggtcacatga

SEQ ID NO: 9234836 - DNA, 22 bp, Homo sapiens
ttgacctatgtttcttcatctg

SEQ ID NO: 9234837 - DNA, 22 bp, Homo sapiens
ttgactgtacaaccttttgtag

SEQ ID NO: 9234838 - DNA, 22 bp, Homo sapiens
ttgaccttggcttttaaaatat

SEQ ID NO: 9234839 - DNA, 22 bp, Homo sapiens
ttgactgttgctgccattctgg

SEQ ID NO: 9234840 - DNA, 22 bp, Homo sapiens
ttgactgtgatgggctcagctg

SEQ ID NO: 9234841 - DNA, 22 bp, Homo sapiens
ttgactttacagttttcttagg

SEQ ID NO: 9234842 - DNA, 22 bp, Homo sapiens
ttgaggagcaggatgggaggct

SEQ ID NO: 9234843 - DNA, 23 bp, Homo sapiens
ttgaggacaatttacatggtgtt

SEQ ID NO: 9234844 - DNA, 22 bp, Homo sapiens
ttgaggaaaggaatttatttta

SEQ ID NO: 9234845 - DNA, 22 bp, Homo sapiens
ttgaggaggcctttcagggctt

SEQ ID NO: 9234846 - DNA, 22 bp, Homo sapiens
ttgaggaggcctttcagggctt

SEQ ID NO: 9234847 - DNA, 18 bp, Homo sapiens
ttgataaacaatttcatt

SEQ ID NO: 9234848 - DNA, 22 bp, Homo sapiens
ttgataaaatgatgaaatcact

SEQ ID NO: 9234849 - DNA, 22 bp, Homo sapiens
ttgatacaggccttctagatga

SEQ ID NO: 9234850 - DNA, 22 bp, Homo sapiens
ttgatacagcagcctgtgatcc

SEQ ID NO: 9234851 - DNA, 22 bp, Homo sapiens
ttgatacacaatggaacaatgt

SEQ ID NO: 9234852 - DNA, 23 bp, Homo sapiens
ttgatacagaagaatcagtttgt

SEQ ID NO: 9234853 - DNA, 23 bp, Homo sapiens
ttgatacagaagaatcagtttgt

SEQ ID NO: 9234854 - DNA, 22 bp, Homo sapiens
ttgataaaatgatatcttcttt

SEQ ID NO: 9234855 - DNA, 22 bp, Homo sapiens
ttgataaaatgatatcttcttt

SEQ ID NO: 9234856 - DNA, 22 bp, Homo sapiens
ttgataaaatgatatcttcttt

SEQ ID NO: 9234857 - DNA, 22 bp, Homo sapiens
ttgataaaatgatgaaatcact

SEQ ID NO: 9234858 - DNA, 22 bp, Homo sapiens
ttctgtcaaagactttttcagg

SEQ ID NO: 9234859 - DNA, 22 bp, Homo sapiens
ctattttaacttgattacctct

SEQ ID NO: 9234860 - DNA, 22 bp, Homo sapiens
ttctgtaggcatggaacaggga

SEQ ID NO: 9234861 - DNA, 22 bp, Homo sapiens
ttctgtcacagtgctggtatca

SEQ ID NO: 9234862 - DNA, 22 bp, Homo sapiens
ttctgtcacttaggaggtcata

SEQ ID NO: 9234863 - DNA, 22 bp, Homo sapiens
ttctgtcatgctcatgtaattg

SEQ ID NO: 9234864 - DNA, 22 bp, Homo sapiens
ttcttggagataaattcttaca

SEQ ID NO: 9234865 - DNA, 22 bp, Homo sapiens
ttcttggagataaattcttaca

SEQ ID NO: 9234866 - DNA, 22 bp, Homo sapiens
ttcttggatgccctcatgcctt

SEQ ID NO: 9234867 - DNA, 22 bp, Homo sapiens
ttcttggaaatacattcaataa

SEQ ID NO: 9234868 - DNA, 22 bp, Homo sapiens
ctagggagtggcagagctggga

SEQ ID NO: 9234869 - DNA, 23 bp, Homo sapiens
ctagggcagtatttcacagacac

SEQ ID NO: 9234870 - DNA, 22 bp, Homo sapiens
ctagggccaaaggctgtgatgc

SEQ ID NO: 9234871 - DNA, 22 bp, Homo sapiens
ctagggctccaaagctgagaag

SEQ ID NO: 9234872 - DNA, 22 bp, Homo sapiens
ctagggctcgcaagggctggag

SEQ ID NO: 9234873 - DNA, 22 bp, Homo sapiens
ctatttcagctgcctttgactg

SEQ ID NO: 9234874 - DNA, 22 bp, Homo sapiens
ctatttcatgttcctatggccg

SEQ ID NO: 9234875 - DNA, 22 bp, Homo sapiens
ctatttctaaacctataagtga

SEQ ID NO: 9234876 - DNA, 22 bp, Homo sapiens
ctatttctgcctaatgacctgt

SEQ ID NO: 9234877 - DNA, 22 bp, Homo sapiens
ctaggcagatggagaagtggct

SEQ ID NO: 9234878 - DNA, 22 bp, Homo sapiens
ctaggcagactgagctctaggg

SEQ ID NO: 9234879 - DNA, 22 bp, Homo sapiens
ctaggcagatggagaagtggct

SEQ ID NO: 9234880 - DNA, 22 bp, Homo sapiens
ttccttttagaatcatgaagac

SEQ ID NO: 9234881 - DNA, 22 bp, Homo sapiens
ttcctttgggaaatcactaagg

SEQ ID NO: 9234882 - DNA, 22 bp, Homo sapiens
ttcctttctctggactgcagcc

SEQ ID NO: 9234883 - DNA, 22 bp, Homo sapiens
ttcctttctgtcagcctgagtg

SEQ ID NO: 9234884 - DNA, 22 bp, Homo sapiens
ttcctttcacgttttaatgcac

SEQ ID NO: 9234885 - DNA, 22 bp, Homo sapiens
ttccttctaattttacacctga

SEQ ID NO: 9234886 - DNA, 22 bp, Homo sapiens
ttcctttcccttgcttctgtgc

SEQ ID NO: 9234887 - DNA, 22 bp, Homo sapiens
ttcctttccctcacagcctcgg

SEQ ID NO: 9234888 - DNA, 22 bp, Homo sapiens
ttcctttccctcacagcctcgg

SEQ ID NO: 9234889 - DNA, 22 bp, Homo sapiens
ttccttctaatattctgcctgt

SEQ ID NO: 9234890 - DNA, 22 bp, Homo sapiens
ttccttctaattttacacctga

SEQ ID NO: 9234891 - DNA, 22 bp, Homo sapiens
ttccttctaattttacacctga

SEQ ID NO: 9234892 - DNA, 22 bp, Homo sapiens
ctaggctgagctgggctgagct

SEQ ID NO: 9234893 - DNA, 22 bp, Homo sapiens
ctaggccatattttgagaactg

SEQ ID NO: 9234894 - DNA, 22 bp, Homo sapiens
ctaggccagttaggaagagaag

SEQ ID NO: 9234895 - DNA, 22 bp, Homo sapiens
ctaggccagagagacctcatga

SEQ ID NO: 9234896 - DNA, 22 bp, Homo sapiens
ctaggcagtcctgacggtacta

SEQ ID NO: 9234897 - DNA, 23 bp, Homo sapiens
ctaggcaggattgtaggcgggta

SEQ ID NO: 9234898 - DNA, 22 bp, Homo sapiens
ctaggcagggtgctgtgccatg

SEQ ID NO: 9234899 - DNA, 22 bp, Homo sapiens
ctaggctggagtgcattggcgt

SEQ ID NO: 9234900 - DNA, 22 bp, Homo sapiens
ctaggctgtgcattgcatgaca

SEQ ID NO: 9234901 - DNA, 22 bp, Homo sapiens
ctagggaaataaactgagtggt

SEQ ID NO: 9234902 - DNA, 22 bp, Homo sapiens
ctagggaaataaactgagtggt

SEQ ID NO: 9234903 - DNA, 22 bp, Homo sapiens
ctagggagactcgcaggactca

SEQ ID NO: 9234904 - DNA, 22 bp, Homo sapiens
tttaacagatgctatgtctacc

SEQ ID NO: 9234905 - DNA, 22 bp, Homo sapiens
tttacacatacctctttaaagt

SEQ ID NO: 9234906 - DNA, 22 bp, Homo sapiens
tttacacatacctctttaaagt

SEQ ID NO: 9234907 - DNA, 22 bp, Homo sapiens
tttacatggaatattgtcttgt

SEQ ID NO: 9234908 - DNA, 22 bp, Homo sapiens
tttacatgtaatgttatacaaa

SEQ ID NO: 9234909 - DNA, 22 bp, Homo sapiens
tttacattgcattaggtattat

SEQ ID NO: 9234910 - DNA, 17 bp, Homo sapiens
tttagaatacaatgttt

SEQ ID NO: 9234911 - DNA, 17 bp, Homo sapiens
tttagaatacaatgttt

SEQ ID NO: 9234912 - DNA, 22 bp, Homo sapiens
tttaaaaaactagtctgagtct

SEQ ID NO: 9234913 - DNA, 22 bp, Homo sapiens
tttaaaaaactagtctgagtct

SEQ ID NO: 9234914 - DNA, 22 bp, Homo sapiens
tttaaaaaactagtctgagtct

SEQ ID NO: 9234915 - DNA, 22 bp, Homo sapiens
tttaaaaaactagtctgagtct

SEQ ID NO: 9234916 - DNA, 22 bp, Homo sapiens
tttaaaaaactagtctgagtct

SEQ ID NO: 9234917 - DNA, 22 bp, Homo sapiens
tttaaaagttatcatctgtcca

SEQ ID NO: 9234918 - DNA, 22 bp, Homo sapiens
tttaaatttgtgtttagagggt

SEQ ID NO: 9234919 - DNA, 22 bp, Homo sapiens
tttaacagatgaggaggtgagg

SEQ ID NO: 9234920 - DNA, 22 bp, Homo sapiens
tttaaatttagaagaaacactg

SEQ ID NO: 9234921 - DNA, 22 bp, Homo sapiens
tttaaatttagaagaaacactg

SEQ ID NO: 9234922 - DNA, 22 bp, Homo sapiens
tttaaattctgtctgccgctta

SEQ ID NO: 9234923 - DNA, 22 bp, Homo sapiens
ctcctctgtctggccctgagcc

SEQ ID NO: 9234924 - DNA, 22 bp, Homo sapiens
ctcctctgtctaccacgagggt

SEQ ID NO: 9234925 - DNA, 22 bp, Homo sapiens
ctcctctgtattgattgggact

SEQ ID NO: 9234926 - DNA, 22 bp, Homo sapiens
ctcctgacttgtgagcccctcc

SEQ ID NO: 9234927 - DNA, 22 bp, Homo sapiens
ctcctgaattgtccctcacagc

SEQ ID NO: 9234928 - DNA, 22 bp, Homo sapiens
ctcctctttagccccagctgga

SEQ ID NO: 9234929 - DNA, 22 bp, Homo sapiens
ctcctgagaggatctctgttgt

SEQ ID NO: 9234930 - DNA, 22 bp, Homo sapiens
tttagacaggggcaaaataagg

SEQ ID NO: 9234931 - DNA, 22 bp, Homo sapiens
tttagacatagctgaaatcatt

SEQ ID NO: 9234932 - DNA, 22 bp, Homo sapiens
tttagacatctataattgctaa

SEQ ID NO: 9234933 - DNA, 22 bp, Homo sapiens
tttagacatagctgaaatcatt

SEQ ID NO: 9234934 - DNA, 22 bp, Homo sapiens
tttagacagcggctctgaacca

SEQ ID NO: 9234935 - DNA, 22 bp, Homo sapiens
tttagacagcatctggtgactt

SEQ ID NO: 9234936 - DNA, 22 bp, Homo sapiens
tttagaatgttagcgttaaagg

SEQ ID NO: 9234937 - DNA, 22 bp, Homo sapiens
tttagaattggctagtgggaat

SEQ ID NO: 9234938 - DNA, 22 bp, Homo sapiens
tttagacacactttgtatattt

SEQ ID NO: 9234939 - DNA, 22 bp, Homo sapiens
tttagaatgtgactgtatttga

SEQ ID NO: 9234940 - DNA, 22 bp, Homo sapiens
ctcctctctggagttatgcaga

SEQ ID NO: 9234941 - DNA, 22 bp, Homo sapiens
ctcctctggcttcctggaggca

SEQ ID NO: 9234942 - DNA, 21 bp, Homo sapiens
ctctccagtggttcctgattc

SEQ ID NO: 9234943 - DNA, 20 bp, Homo sapiens
tttcagttggttaatggcat

SEQ ID NO: 9234944 - DNA, 23 bp, Homo sapiens
tttcagttccagaaaaggggagc

SEQ ID NO: 9234945 - DNA, 23 bp, Homo sapiens
tttcagttccagaaaaggggagc

SEQ ID NO: 9234946 - DNA, 22 bp, Homo sapiens
tttcagttctgtacaagtccag

SEQ ID NO: 9234947 - DNA, 22 bp, Homo sapiens
tttcagttagctgagacccagg

SEQ ID NO: 9234948 - DNA, 22 bp, Homo sapiens
tttcagtgtgtaaattgaaata

SEQ ID NO: 9234949 - DNA, 22 bp, Homo sapiens
tttcagttaagtggctagtccc

SEQ ID NO: 9234950 - DNA, 22 bp, Homo sapiens
tttcagttactgctatatcatt

SEQ ID NO: 9234951 - DNA, 22 bp, Homo sapiens
tttcagttaagtggctagtccc

SEQ ID NO: 9234952 - DNA, 22 bp, Homo sapiens
ctctccaggactttggcccaat

SEQ ID NO: 9234953 - DNA, 22 bp, Homo sapiens
ctctccaggactttggcccaat

SEQ ID NO: 9234954 - DNA, 19 bp, Homo sapiens
ctctccagctccagtagct

SEQ ID NO: 9234955 - DNA, 22 bp, Homo sapiens
ctctcctccaggaactcacagt

SEQ ID NO: 9234956 - DNA, 22 bp, Homo sapiens
ctctcctccaggaactcacagt

SEQ ID NO: 9234957 - DNA, 22 bp, Homo sapiens
ctctcccttgggtgggctttgg

SEQ ID NO: 9234958 - DNA, 22 bp, Homo sapiens
ctctcccccacagcagccttct

SEQ ID NO: 9234959 - DNA, 22 bp, Homo sapiens
ctctcccccacagcagccttct

SEQ ID NO: 9234960 - DNA, 22 bp, Homo sapiens
ctctccctaggttagcggtcag

SEQ ID NO: 9234961 - DNA, 22 bp, Homo sapiens
ctctccctatgcctcccaggag

SEQ ID NO: 9234962 - DNA, 22 bp, Homo sapiens
ctctccctggccagctgtgcag

SEQ ID NO: 9234963 - DNA, 22 bp, Homo sapiens
ctcctgggctcaagtgatcctc

SEQ ID NO: 9234964 - DNA, 22 bp, Homo sapiens
ctcctgggctcatatcattcag

SEQ ID NO: 9234965 - DNA, 18 bp, Homo sapiens
ctcctgggctgcagatgc

SEQ ID NO: 9234966 - DNA, 18 bp, Homo sapiens
ctcctgggctgcagatgc

SEQ ID NO: 9234967 - DNA, 22 bp, Homo sapiens
ctcctgggctcatatcattcag

SEQ ID NO: 9234968 - DNA, 22 bp, Homo sapiens
ctcctgggctatgtctgcttgg

SEQ ID NO: 9234969 - DNA, 22 bp, Homo sapiens
ctcctgggctcaagtgatcctc

SEQ ID NO: 9234970 - DNA, 22 bp, Homo sapiens
ctcctgggctatgtctgcttgg

SEQ ID NO: 9234971 - DNA, 21 bp, Homo sapiens
ctcctgggctaagatatagtg

SEQ ID NO: 9234972 - DNA, 21 bp, Homo sapiens
ctcctgggctaagatatagtg

SEQ ID NO: 9234973 - DNA, 22 bp, Homo sapiens
ctcctgggatgactctttcttt

SEQ ID NO: 9234974 - DNA, 22 bp, Homo sapiens
ctcctggctcgcccccagctga

SEQ ID NO: 9234975 - DNA, 22 bp, Homo sapiens
ctcctgggagcagggatggatg

SEQ ID NO: 9234976 - DNA, 22 bp, Homo sapiens
ctcctgggagcagggatggatg

SEQ ID NO: 9234977 - DNA, 22 bp, Homo sapiens
ctcctgggagctgtggcagagc

SEQ ID NO: 9234978 - DNA, 22 bp, Homo sapiens
ctcctgggagctgtggcagagc

SEQ ID NO: 9234979 - DNA, 22 bp, Homo sapiens
ctcctgggagctgtggcagagc

SEQ ID NO: 9234980 - DNA, 22 bp, Homo sapiens
ctcctgggaggatgcggacccg

SEQ ID NO: 9234981 - DNA, 22 bp, Homo sapiens
ctcctgggagtcttcctggatg

SEQ ID NO: 9234982 - DNA, 22 bp, Homo sapiens
ctcctgggagtcttcctggatg

SEQ ID NO: 9234983 - DNA, 22 bp, Homo sapiens
ctcctgggagtcttcctggatg

SEQ ID NO: 9234984 - DNA, 22 bp, Homo sapiens
ctctccagccacagaagctgct

SEQ ID NO: 9234985 - DNA, 22 bp, Homo sapiens
ctctccagatctgctgagccag

SEQ ID NO: 9234986 - DNA, 22 bp, Homo sapiens
ctcctgggctgtcggcgctctg

SEQ ID NO: 9234987 - DNA, 22 bp, Homo sapiens
ctcctgggctgtcggcgctctg

SEQ ID NO: 9234988 - DNA, 18 bp, Homo sapiens
ctcctgggctgcagatgc

SEQ ID NO: 9234989 - DNA, 18 bp, Homo sapiens
ctcctgggctgcagatgc

SEQ ID NO: 9234990 - DNA, 22 bp, Homo sapiens
ctcctgggctgggaactcagcc

SEQ ID NO: 9234991 - DNA, 22 bp, Homo sapiens
ctctccactgtcctttgctggt

SEQ ID NO: 9234992 - DNA, 22 bp, Homo sapiens
ctctccactgtcctttgctggt

SEQ ID NO: 9234993 - DNA, 18 bp, Homo sapiens
ttgctttgtaagcttgca

SEQ ID NO: 9234994 - DNA, 22 bp, Homo sapiens
ttgcttttaattaatcattgct

SEQ ID NO: 9234995 - DNA, 22 bp, Homo sapiens
ttgcttttccctgtctctgatt

SEQ ID NO: 9234996 - DNA, 22 bp, Homo sapiens
ttgcttttgtgtgctctctgga

SEQ ID NO: 9234997 - DNA, 22 bp, Homo sapiens
ttggaaaacttacacagagctg

SEQ ID NO: 9234998 - DNA, 22 bp, Homo sapiens
ttggaaaaattgcctgatgtct

SEQ ID NO: 9234999 - DNA, 22 bp, Homo sapiens
ttggaaaagcgttctctgtagc

SEQ ID NO: 9235000 - DNA, 22 bp, Homo sapiens
ttggcattgaagtttcattggt

SEQ ID NO: 9235001 - DNA, 22 bp, Homo sapiens
ttggcattggagatgcaagaac

SEQ ID NO: 9235002 - DNA, 22 bp, Homo sapiens
ttggcattcatgggacaacaaa

SEQ ID NO: 9235003 - DNA, 22 bp, Homo sapiens
ttggatgaggttgagaatcatt

SEQ ID NO: 9235004 - DNA, 22 bp, Homo sapiens
ttggccaaaaaagtcattagaa

SEQ ID NO: 9235005 - DNA, 22 bp, Homo sapiens
ctcagttttgctagctggagtt

SEQ ID NO: 9235006 - DNA, 22 bp, Homo sapiens
ctcagtttttgctgtctggttc

SEQ ID NO: 9235007 - DNA, 22 bp, Homo sapiens
ctcagtttgaggggtaggtgtt

SEQ ID NO: 9235008 - DNA, 22 bp, Homo sapiens
ctcagtttcttactctgtataa

SEQ ID NO: 9235009 - DNA, 22 bp, Homo sapiens
ctcagtttctgacattaaaatc

SEQ ID NO: 9235010 - DNA, 22 bp, Homo sapiens
ttgatattagagtatttgtttg

SEQ ID NO: 9235011 - DNA, 22 bp, Homo sapiens
ttgatattagagtatttgtttg

SEQ ID NO: 9235012 - DNA, 22 bp, Homo sapiens
ttgatacatagcacagtttagg

SEQ ID NO: 9235013 - DNA, 22 bp, Homo sapiens
ttgatacaggctctatttcatc

SEQ ID NO: 9235014 - DNA, 22 bp, Homo sapiens
ttgatacaggctctatttcatc

SEQ ID NO: 9235015 - DNA, 22 bp, Homo sapiens
ttgatacatgctctagagttga

SEQ ID NO: 9235016 - DNA, 22 bp, Homo sapiens
ttgatacatagcacagtttagg

SEQ ID NO: 9235017 - DNA, 22 bp, Homo sapiens
ttgatacatgctctagagttga

SEQ ID NO: 9235018 - DNA, 22 bp, Homo sapiens
ttgatattctgagaagctgaag

SEQ ID NO: 9235019 - DNA, 22 bp, Homo sapiens
ctcagtttccccggcctgggcg

SEQ ID NO: 9235020 - DNA, 20 bp, Homo sapiens
ctcagtttcctcatggctca

SEQ ID NO: 9235021 - DNA, 22 bp, Homo sapiens
ctcagtttcctcttctgttgaa

SEQ ID NO: 9235022 - DNA, 22 bp, Homo sapiens
ctcagtttcctcaactgcaaaa

SEQ ID NO: 9235023 - DNA, 20 bp, Homo sapiens
ttggccaaatcttagtcatg

SEQ ID NO: 9235024 - DNA, 22 bp, Homo sapiens
ttggccaaaggaaagactactg

SEQ ID NO: 9235025 - DNA, 22 bp, Homo sapiens
ttggccaacatggtgaaacccc

SEQ ID NO: 9235026 - DNA, 22 bp, Homo sapiens
ttggccagaggtttctctcatg

SEQ ID NO: 9235027 - DNA, 22 bp, Homo sapiens
ttggccacaatccaagccttgg

SEQ ID NO: 9235028 - DNA, 22 bp, Homo sapiens
ttggccagacactacccccctt

SEQ ID NO: 9235029 - DNA, 22 bp, Homo sapiens
ctcataatgtgactgtatttga

SEQ ID NO: 9235030 - DNA, 22 bp, Homo sapiens
ctcataaagtgagaatatgacc

SEQ ID NO: 9235031 - DNA, 22 bp, Homo sapiens
ctcataaagtgagaatatgacc

SEQ ID NO: 9235032 - DNA, 22 bp, Homo sapiens
ctcataaacaattctttgaggt

SEQ ID NO: 9235033 - DNA, 22 bp, Homo sapiens
ctcatattgctggtggtctaag

SEQ ID NO: 9235034 - DNA, 22 bp, Homo sapiens
ttgggcagcattgcagttccct

SEQ ID NO: 9235035 - DNA, 22 bp, Homo sapiens
ttgggcaggctggcagactgct

SEQ ID NO: 9235036 - DNA, 22 bp, Homo sapiens
ttgggcagaggctgtgcagagg

SEQ ID NO: 9235037 - DNA, 22 bp, Homo sapiens
ttgggcagaggccaggaggatg

SEQ ID NO: 9235038 - DNA, 22 bp, Homo sapiens
ttgggcagaggccaggaggatg

SEQ ID NO: 9235039 - DNA, 22 bp, Homo sapiens
ttgggcacggacaggtggggat

SEQ ID NO: 9235040 - DNA, 22 bp, Homo sapiens
ttgggaggtcataaatctgttc

SEQ ID NO: 9235041 - DNA, 22 bp, Homo sapiens
ttgggaggtaatggagccaagt

SEQ ID NO: 9235042 - DNA, 22 bp, Homo sapiens
ctcatctaggataaagcatctt

SEQ ID NO: 9235043 - DNA, 20 bp, Homo sapiens
ctcatctctgagcctcctgg

SEQ ID NO: 9235044 - DNA, 22 bp, Homo sapiens
ctcatctgataaatcactctta

SEQ ID NO: 9235045 - DNA, 22 bp, Homo sapiens
tttaaaaaactagtctgagtct

SEQ ID NO: 9235046 - DNA, 22 bp, Homo sapiens
tttaaaaaactagtctgagtct

SEQ ID NO: 9235047 - DNA, 22 bp, Homo sapiens
ttgtttcatggggatgtttatt

SEQ ID NO: 9235048 - DNA, 22 bp, Homo sapiens
ctccagtgcgcaggacagcccc

SEQ ID NO: 9235049 - DNA, 22 bp, Homo sapiens
ttgtttcagctgtatgctatgt

SEQ ID NO: 9235050 - DNA, 22 bp, Homo sapiens
ctccagtgcactggtcttttca

SEQ ID NO: 9235051 - DNA, 22 bp, Homo sapiens
ctccagtgccctccttgggggc

SEQ ID NO: 9235052 - DNA, 22 bp, Homo sapiens
ctccaggtagctaagtcctggg

SEQ ID NO: 9235053 - DNA, 22 bp, Homo sapiens
ctccaggtgcagaaggactcag

SEQ ID NO: 9235054 - DNA, 22 bp, Homo sapiens
ctccaggtgcagaaggactcag

SEQ ID NO: 9235055 - DNA, 22 bp, Homo sapiens
ctccaggttacttagcctagct

SEQ ID NO: 9235056 - DNA, 22 bp, Homo sapiens
ctccaggttacttagcctagct

SEQ ID NO: 9235057 - DNA, 22 bp, Homo sapiens
ctccagtcatgtttactgtgca

SEQ ID NO: 9235058 - DNA, 22 bp, Homo sapiens
ctccagtcatagcctcttgagt

SEQ ID NO: 9235059 - DNA, 22 bp, Homo sapiens
ctccagtcatagcctcttgagt

SEQ ID NO: 9235060 - DNA, 22 bp, Homo sapiens
ctccaggttttacaaggtctat

SEQ ID NO: 9235061 - DNA, 22 bp, Homo sapiens
ctccaggttgacttcagtcaat

SEQ ID NO: 9235062 - DNA, 22 bp, Homo sapiens
ctccagtgagcgcggggcatgg

SEQ ID NO: 9235063 - DNA, 22 bp, Homo sapiens
ctccagtctaggtcctacttat

SEQ ID NO: 9235064 - DNA, 22 bp, Homo sapiens
ctccagtctaggtcctacttat

SEQ ID NO: 9235065 - DNA, 22 bp, Homo sapiens
ttgttacacataataacatttt

SEQ ID NO: 9235066 - DNA, 22 bp, Homo sapiens
ttgttaaagatgcagattccat

SEQ ID NO: 9235067 - DNA, 23 bp, Homo sapiens
ttgttaactttcctgcccctaca

SEQ ID NO: 9235068 - DNA, 22 bp, Homo sapiens
ttgttaaatggatgcagaataa

SEQ ID NO: 9235069 - DNA, 22 bp, Homo sapiens
ttgttaaaatgaggtcattctg

SEQ ID NO: 9235070 - DNA, 22 bp, Homo sapiens
ttgttaaaactccattggtttg

SEQ ID NO: 9235071 - DNA, 22 bp, Homo sapiens
ttgttaaaaatagatttccagg

SEQ ID NO: 9235072 - DNA, 22 bp, Homo sapiens
ttgttaaaatgcatattctggt

SEQ ID NO: 9235073 - DNA, 22 bp, Homo sapiens
ttgttaaaaatagatttccagg

SEQ ID NO: 9235074 - DNA, 22 bp, Homo sapiens
ttgtgtactgttggttgatatt

SEQ ID NO: 9235075 - DNA, 22 bp, Homo sapiens
ttgtattttgttatgctactgc

SEQ ID NO: 9235076 - DNA, 22 bp, Homo sapiens
ttgtattttgttatgctactgc

SEQ ID NO: 9235077 - DNA, 22 bp, Homo sapiens
ttgtgtactacagtatgccaca

SEQ ID NO: 9235078 - DNA, 22 bp, Homo sapiens
ttgtattttgttatgctactgc

SEQ ID NO: 9235079 - DNA, 22 bp, Homo sapiens
ttgtatttgattgtcatatcgt

SEQ ID NO: 9235080 - DNA, 22 bp, Homo sapiens
ttgtatttgggtagtatagaga

SEQ ID NO: 9235081 - DNA, 22 bp, Homo sapiens
ttgtatttctccactttctgtt

SEQ ID NO: 9235082 - DNA, 22 bp, Homo sapiens
ttgtatttgattgtcatatcgt

SEQ ID NO: 9235083 - DNA, 22 bp, Homo sapiens
ttgtatttgattgtcatatcgt

SEQ ID NO: 9235084 - DNA, 22 bp, Homo sapiens
ctccagggcagcatggcagtgg

SEQ ID NO: 9235085 - DNA, 20 bp, Homo sapiens
ctccaggggaagagccttcc

SEQ ID NO: 9235086 - DNA, 22 bp, Homo sapiens
ctccagggaggtctgcaggact

SEQ ID NO: 9235087 - DNA, 22 bp, Homo sapiens
ctccagggaggtctgcaggact

SEQ ID NO: 9235088 - DNA, 22 bp, Homo sapiens
ttggtaaattatttcttccaat

SEQ ID NO: 9235089 - DNA, 22 bp, Homo sapiens
ttggtaaattatttcttccaat

SEQ ID NO: 9235090 - DNA, 22 bp, Homo sapiens
ttggtacatgttaaggaagagt

SEQ ID NO: 9235091 - DNA, 22 bp, Homo sapiens
ttggtaaatactataatcaaat

SEQ ID NO: 9235092 - DNA, 22 bp, Homo sapiens
ttggtaaatccccttacacaaa

SEQ ID NO: 9235093 - DNA, 22 bp, Homo sapiens
ttggtaaatccccttacacaaa

SEQ ID NO: 9235094 - DNA, 22 bp, Homo sapiens
ttggggtgttggatggagcaag

SEQ ID NO: 9235095 - DNA, 22 bp, Homo sapiens
ttgggtggtggggagagttcag

SEQ ID NO: 9235096 - DNA, 22 bp, Homo sapiens
ttggtagaatgaacattcattg

SEQ ID NO: 9235097 - DNA, 22 bp, Homo sapiens
ttggtatacaaatatttagcac

SEQ ID NO: 9235098 - DNA, 22 bp, Homo sapiens
ttggtatattgtgctactttat

SEQ ID NO: 9235099 - DNA, 22 bp, Homo sapiens
ttggtcaagtcttaaagaaaaa

SEQ ID NO: 9235100 - DNA, 22 bp, Homo sapiens
ttggtcaaggacattacagttt

SEQ ID NO: 9235101 - DNA, 22 bp, Homo sapiens
ctccagggagcttggaaagacc

SEQ ID NO: 9235102 - DNA, 22 bp, Homo sapiens
ctctgggcaaagatgcctcatc

SEQ ID NO: 9235103 - DNA, 22 bp, Homo sapiens
ctctgggcaagtatgatagaaa

SEQ ID NO: 9235104 - DNA, 19 bp, Homo sapiens
ctctgggcaagtcacttaa

SEQ ID NO: 9235105 - DNA, 22 bp, Homo sapiens
ctctgggcaagtttcttcatga

SEQ ID NO: 9235106 - DNA, 22 bp, Homo sapiens
ctctgggcaagtttcttcatga

SEQ ID NO: 9235107 - DNA, 22 bp, Homo sapiens
ctctgggatgaggcctaggcac

SEQ ID NO: 9235108 - DNA, 22 bp, Homo sapiens
ctctgggcaaagatgcctcatc

SEQ ID NO: 9235109 - DNA, 22 bp, Homo sapiens
ctctgggcaaagatgcctcatc

SEQ ID NO: 9235110 - DNA, 22 bp, Homo sapiens
ctctgggcaggacgccaggcct

SEQ ID NO: 9235111 - DNA, 22 bp, Homo sapiens
ctctgggccaccgctggtgtat

SEQ ID NO: 9235112 - DNA, 22 bp, Homo sapiens
ctctgggcaggaccagtggacc

SEQ ID NO: 9235113 - DNA, 22 bp, Homo sapiens
ctctgggcaggaccagtggacc

SEQ ID NO: 9235114 - DNA, 22 bp, Homo sapiens
ctctgggcacattttccaggac

SEQ ID NO: 9235115 - DNA, 22 bp, Homo sapiens
ctctgggcaccaaagagcagct

SEQ ID NO: 9235116 - DNA, 22 bp, Homo sapiens
ctctgggcactgtatgggttct

SEQ ID NO: 9235117 - DNA, 17 bp, Homo sapiens
ctctgggcagcctgggg

SEQ ID NO: 9235118 - DNA, 22 bp, Homo sapiens
ttttattcatagggatggagag

SEQ ID NO: 9235119 - DNA, 22 bp, Homo sapiens
ttttattcaaatagttcacact

SEQ ID NO: 9235120 - DNA, 22 bp, Homo sapiens
ttttattctcagctccagagag

SEQ ID NO: 9235121 - DNA, 23 bp, Homo sapiens
ttttattgatatgtagctgttgt

SEQ ID NO: 9235122 - DNA, 23 bp, Homo sapiens
ttttattgatatgtagctgttgt

SEQ ID NO: 9235123 - DNA, 23 bp, Homo sapiens
ctctgggcgggcaggtcagcctc

SEQ ID NO: 9235124 - DNA, 21 bp, Homo sapiens
ctctgggccattttcttccac

SEQ ID NO: 9235125 - DNA, 21 bp, Homo sapiens
ctctgggccattttcttccac

SEQ ID NO: 9235126 - DNA, 22 bp, Homo sapiens
ctctgggctccttcagcccttt

SEQ ID NO: 9235127 - DNA, 22 bp, Homo sapiens
ttttattatctttgaatgggac

SEQ ID NO: 9235128 - DNA, 22 bp, Homo sapiens
ctctggctgtcccgatgagcag

SEQ ID NO: 9235129 - DNA, 22 bp, Homo sapiens
tttgtgaataggttggcttcca

SEQ ID NO: 9235130 - DNA, 22 bp, Homo sapiens
tttgtgaataggttggcttcca

SEQ ID NO: 9235131 - DNA, 22 bp, Homo sapiens
ctctggctggcacctgatctga

SEQ ID NO: 9235132 - DNA, 22 bp, Homo sapiens
ctctcctggggagcacacacac

SEQ ID NO: 9235133 - DNA, 22 bp, Homo sapiens
ctctcctggggagcacacacac

SEQ ID NO: 9235134 - DNA, 22 bp, Homo sapiens
ctctcctggggagcacacacac

SEQ ID NO: 9235135 - DNA, 22 bp, Homo sapiens
tttgtacatcctaattctgagt

SEQ ID NO: 9235136 - DNA, 22 bp, Homo sapiens
tttgtacatcctaattctgagt

SEQ ID NO: 9235137 - DNA, 22 bp, Homo sapiens
ctctcctgggctgaccgtccga

SEQ ID NO: 9235138 - DNA, 23 bp, Homo sapiens
ctctcctgaaggacaagctgccg

SEQ ID NO: 9235139 - DNA, 22 bp, Homo sapiens
tttgtgaataggttggcttcca

SEQ ID NO: 9235140 - DNA, 22 bp, Homo sapiens
tttgtgaagggaacagaagtgt

SEQ ID NO: 9235141 - DNA, 22 bp, Homo sapiens
tttgtgaacactgcgcagaact

SEQ ID NO: 9235142 - DNA, 22 bp, Homo sapiens
tttgtgaacaaacatgaagatg

SEQ ID NO: 9235143 - DNA, 22 bp, Homo sapiens
tttgtgaacttaggcaattagg

SEQ ID NO: 9235144 - DNA, 22 bp, Homo sapiens
tttgtgaaatgaagtcacaact

SEQ ID NO: 9235145 - DNA, 22 bp, Homo sapiens
tttgtctttcccctcctcattg

SEQ ID NO: 9235146 - DNA, 20 bp, Homo sapiens
ctgaagagactggaggggca

SEQ ID NO: 9235147 - DNA, 22 bp, Homo sapiens
ctgaagagcaaaccaactggac

SEQ ID NO: 9235148 - DNA, 22 bp, Homo sapiens
ctgaagagcaaaccaactggac

SEQ ID NO: 9235149 - DNA, 22 bp, Homo sapiens
ctgaagactgctgagaagttac

SEQ ID NO: 9235150 - DNA, 22 bp, Homo sapiens
ctgaagagaaagggagctcttc

SEQ ID NO: 9235151 - DNA, 22 bp, Homo sapiens
ctgaacttattgagtgcttgct

SEQ ID NO: 9235152 - DNA, 22 bp, Homo sapiens
ctgaagaaatatgattgcttaa

SEQ ID NO: 9235153 - DNA, 22 bp, Homo sapiens
ctgaacttattgagtgcttgct

SEQ ID NO: 9235154 - DNA, 22 bp, Homo sapiens
ctgaaccatctctgttctgtat

SEQ ID NO: 9235155 - DNA, 22 bp, Homo sapiens
ctgaaccactaatattttgatt

SEQ ID NO: 9235156 - DNA, 22 bp, Homo sapiens
ctgaacattcttgaacatctgt

SEQ ID NO: 9235157 - DNA, 22 bp, Homo sapiens
ctgaacatcccgcagtgcacga

SEQ ID NO: 9235158 - DNA, 20 bp, Homo sapiens
ctgaacacagaataagcaca

SEQ ID NO: 9235159 - DNA, 22 bp, Homo sapiens
ctgaacaacttgtcattccaag

SEQ ID NO: 9235160 - DNA, 22 bp, Homo sapiens
ctgaaagcaaagtaattcttaa

SEQ ID NO: 9235161 - DNA, 22 bp, Homo sapiens
ctgaaaggagagctgcaaggat

SEQ ID NO: 9235162 - DNA, 22 bp, Homo sapiens
ctgaaaggaataaggctctttg

SEQ ID NO: 9235163 - DNA, 20 bp, Homo sapiens
ctgaaaggagtcgggatgtc

SEQ ID NO: 9235164 - DNA, 22 bp, Homo sapiens
ctgagaaagtttatgtttattt

SEQ ID NO: 9235165 - DNA, 22 bp, Homo sapiens
ctgagaaattctttctttcact

SEQ ID NO: 9235166 - DNA, 22 bp, Homo sapiens
ctgagaaatgcatttttccagc

SEQ ID NO: 9235167 - DNA, 22 bp, Homo sapiens
ctgaagatgtctgagatgctca

SEQ ID NO: 9235168 - DNA, 17 bp, Homo sapiens
ctgaagataatggcaac

SEQ ID NO: 9235169 - DNA, 22 bp, Homo sapiens
ctgaagaggacgcagcagcaag

SEQ ID NO: 9235170 - DNA, 22 bp, Homo sapiens
ctgaagaggacgcagcagcaag

SEQ ID NO: 9235171 - DNA, 23 bp, Homo sapiens
ctgaagagccaacaaaaagcttg

SEQ ID NO: 9235172 - DNA, 22 bp, Homo sapiens
ctgaagaggactgggttggagg

SEQ ID NO: 9235173 - DNA, 22 bp, Homo sapiens
ctctttgtagcctttgcatatt

SEQ ID NO: 9235174 - DNA, 22 bp, Homo sapiens
ctctttgtggaacggcagtgtc

SEQ ID NO: 9235175 - DNA, 22 bp, Homo sapiens
ctctggttcagggctccctggc

SEQ ID NO: 9235176 - DNA, 22 bp, Homo sapiens
ctctggttcagggctccctggc

SEQ ID NO: 9235177 - DNA, 22 bp, Homo sapiens
ctctgggttttgtcagctgagg

SEQ ID NO: 9235178 - DNA, 22 bp, Homo sapiens
ctctgggttctggcctgcaccc

SEQ ID NO: 9235179 - DNA, 21 bp, Homo sapiens
ctctggtcctgtctggcaggc

SEQ ID NO: 9235180 - DNA, 22 bp, Homo sapiens
ctctgggttcactgaggctctg

SEQ ID NO: 9235181 - DNA, 21 bp, Homo sapiens
ttttattgatgaatggccact

SEQ ID NO: 9235182 - DNA, 23 bp, Homo sapiens
ttttattgatatgtagctgttgt

SEQ ID NO: 9235183 - DNA, 23 bp, Homo sapiens
ttttattgatatgtagctgttgt

SEQ ID NO: 9235184 - DNA, 22 bp, Homo sapiens
tttttaagctcctttgatgtca

SEQ ID NO: 9235185 - DNA, 22 bp, Homo sapiens
tttttaagctcctttgatgtca

SEQ ID NO: 9235186 - DNA, 22 bp, Homo sapiens
tttttaagctcctttgatgtca

SEQ ID NO: 9235187 - DNA, 22 bp, Homo sapiens
tttttaagctcctttgatgtca

SEQ ID NO: 9235188 - DNA, 22 bp, Homo sapiens
tttttaagagtctggaaatagt

SEQ ID NO: 9235189 - DNA, 22 bp, Homo sapiens
tttttaagagtctggaaatagt

SEQ ID NO: 9235190 - DNA, 22 bp, Homo sapiens
tttttaagagtctggaaatagt

SEQ ID NO: 9235191 - DNA, 22 bp, Homo sapiens
tttttaagagattctccagtct

SEQ ID NO: 9235192 - DNA, 22 bp, Homo sapiens
tttttaagagattctccagtct

SEQ ID NO: 9235193 - DNA, 22 bp, Homo sapiens
tttttaagagattctccagtct

SEQ ID NO: 9235194 - DNA, 22 bp, Homo sapiens
tttttaacctaccttaagagca

SEQ ID NO: 9235195 - DNA, 22 bp, Homo sapiens
ttttgttttcttagaaacctgg

SEQ ID NO: 9235196 - DNA, 22 bp, Homo sapiens
ttttgttttcttagaaacctgg

SEQ ID NO: 9235197 - DNA, 22 bp, Homo sapiens
ttttgttttcttagaaacctgg

SEQ ID NO: 9235198 - DNA, 22 bp, Homo sapiens
ttttgtttgtgtccactgcagt

SEQ ID NO: 9235199 - DNA, 19 bp, Homo sapiens
ctgaaaaacattctcagga

SEQ ID NO: 9235200 - DNA, 17 bp, Homo sapiens
ctcttttgtcttcttcc

SEQ ID NO: 9235201 - DNA, 22 bp, Homo sapiens
ctcttttcaaacctgtttatgg

SEQ ID NO: 9235202 - DNA, 22 bp, Homo sapiens
ctctttttcagccttaccaaag

SEQ ID NO: 9235203 - DNA, 22 bp, Homo sapiens
ctctttttcacctctgtcagcg

SEQ ID NO: 9235204 - DNA, 22 bp, Homo sapiens
ctgccagctggagaccaaggaa

SEQ ID NO: 9235205 - DNA, 22 bp, Homo sapiens
ctgccaggcctccgctgtcccc

SEQ ID NO: 9235206 - DNA, 22 bp, Homo sapiens
ctgccagctctctggaggctct

SEQ ID NO: 9235207 - DNA, 23 bp, Homo sapiens
ctgcagccgcgtggggacgtgga

SEQ ID NO: 9235208 - DNA, 22 bp, Homo sapiens
ctgccagggcatcctgtggtgg

SEQ ID NO: 9235209 - DNA, 22 bp, Homo sapiens
ctgccaggggcctcacaggcca

SEQ ID NO: 9235210 - DNA, 22 bp, Homo sapiens
ctgccagggaggctgggaagtt

SEQ ID NO: 9235211 - DNA, 22 bp, Homo sapiens
ctgccaggcctggggtgctgtc

SEQ ID NO: 9235212 - DNA, 22 bp, Homo sapiens
ctgccaggcctggggtgctgtc

SEQ ID NO: 9235213 - DNA, 22 bp, Homo sapiens
ctgcagcaggaggctcctgcag

SEQ ID NO: 9235214 - DNA, 22 bp, Homo sapiens
ctgcagaggttggttctaagat

SEQ ID NO: 9235215 - DNA, 22 bp, Homo sapiens
ctgcagatgggcgatggggcct

SEQ ID NO: 9235216 - DNA, 22 bp, Homo sapiens
ctgcagaggcctcgcctcctct

SEQ ID NO: 9235217 - DNA, 22 bp, Homo sapiens
ctgcagagctttctgaatgaag

SEQ ID NO: 9235218 - DNA, 22 bp, Homo sapiens
ctgcagagggtttgagcatcct

SEQ ID NO: 9235219 - DNA, 22 bp, Homo sapiens
ctgcctcatgctgcctgcagcc

SEQ ID NO: 9235220 - DNA, 22 bp, Homo sapiens
ctgcctcatgctgcctgcagcc

SEQ ID NO: 9235221 - DNA, 22 bp, Homo sapiens
ctgcctcagcgttgtggcccta

SEQ ID NO: 9235222 - DNA, 22 bp, Homo sapiens
ctgcctcatgctgcctgcagcc

SEQ ID NO: 9235223 - DNA, 22 bp, Homo sapiens
ctgcctcatgctgcctgcagcc

SEQ ID NO: 9235224 - DNA, 22 bp, Homo sapiens
ctgcctcatgctgcctgcagcc

SEQ ID NO: 9235225 - DNA, 22 bp, Homo sapiens
ctgcctccaggctcaccttgac

SEQ ID NO: 9235226 - DNA, 22 bp, Homo sapiens
ctgcctagggtctggtaccaca

SEQ ID NO: 9235227 - DNA, 22 bp, Homo sapiens
ctgcctcagccttctgggtgac

SEQ ID NO: 9235228 - DNA, 22 bp, Homo sapiens
ctgcctcagccttctgggtgac

SEQ ID NO: 9235229 - DNA, 22 bp, Homo sapiens
ctgcctcagcgttgtggcccta

SEQ ID NO: 9235230 - DNA, 22 bp, Homo sapiens
ctgcctagatttgaatcctggc

SEQ ID NO: 9235231 - DNA, 22 bp, Homo sapiens
ctgcctcacattggctgtgtga

SEQ ID NO: 9235232 - DNA, 22 bp, Homo sapiens
ctgcctcacattggctgtgtga

SEQ ID NO: 9235233 - DNA, 22 bp, Homo sapiens
ctgcctgcgttgcctcgtgcct

SEQ ID NO: 9235234 - DNA, 22 bp, Homo sapiens
ctgcctcctgccgtgcagcttc

SEQ ID NO: 9235235 - DNA, 22 bp, Homo sapiens
ctgcctcctggctgatgggtag

SEQ ID NO: 9235236 - DNA, 22 bp, Homo sapiens
ctgcctcctcacgtccacagtg

SEQ ID NO: 9235237 - DNA, 22 bp, Homo sapiens
ctgcctcctcacgtccacagtg

SEQ ID NO: 9235238 - DNA, 22 bp, Homo sapiens
ctgcctcctgccgtgcagcttc

SEQ ID NO: 9235239 - DNA, 22 bp, Homo sapiens
ctgcctcctcacgtccacagtg

SEQ ID NO: 9235240 - DNA, 22 bp, Homo sapiens
ctgccaggttggcgctcgctct

SEQ ID NO: 9235241 - DNA, 22 bp, Homo sapiens
ctgccaggttggcgctcgctct

SEQ ID NO: 9235242 - DNA, 22 bp, Homo sapiens
ctgccaggtaaactgcaggaat

SEQ ID NO: 9235243 - DNA, 20 bp, Homo sapiens
ctgccatgattgatagagtg

SEQ ID NO: 9235244 - DNA, 22 bp, Homo sapiens
ctgccgtgtttttcatgttaaa

SEQ ID NO: 9235245 - DNA, 22 bp, Homo sapiens
ctgcctagatttgaatcctggc

SEQ ID NO: 9235246 - DNA, 22 bp, Homo sapiens
ctgccgttgtgaagctcttaga

SEQ ID NO: 9235247 - DNA, 22 bp, Homo sapiens
ctgccctggggggcctccttgc

SEQ ID NO: 9235248 - DNA, 22 bp, Homo sapiens
ctgccctgggtgctggggatcc

SEQ ID NO: 9235249 - DNA, 22 bp, Homo sapiens
ctgccctggggggcctccttgc

SEQ ID NO: 9235250 - DNA, 22 bp, Homo sapiens
ctgaggcactggtaatgggcat

SEQ ID NO: 9235251 - DNA, 22 bp, Homo sapiens
ctgaggcactgtcagctgaggc

SEQ ID NO: 9235252 - DNA, 22 bp, Homo sapiens
ctgaggcactgtcagctgaggc

SEQ ID NO: 9235253 - DNA, 22 bp, Homo sapiens
ctgaggcagaaaaagcaagggt

SEQ ID NO: 9235254 - DNA, 22 bp, Homo sapiens
ctgaggcactggtaatgggcat

SEQ ID NO: 9235255 - DNA, 22 bp, Homo sapiens
ctgaggcactaacaaggacaag

SEQ ID NO: 9235256 - DNA, 22 bp, Homo sapiens
ctgaggcactaacaaggacaag

SEQ ID NO: 9235257 - DNA, 22 bp, Homo sapiens
ctgaggcacctacagtctcggg

SEQ ID NO: 9235258 - DNA, 22 bp, Homo sapiens
ctgaggcacccatcttctcctg

SEQ ID NO: 9235259 - DNA, 22 bp, Homo sapiens
ctgaggcaccggcaatgttctg

SEQ ID NO: 9235260 - DNA, 17 bp, Homo sapiens
ctgaggattatggttgt

SEQ ID NO: 9235261 - DNA, 19 bp, Homo sapiens
ctgaggcaagtggtggtca

SEQ ID NO: 9235262 - DNA, 22 bp, Homo sapiens
ctgaggcacagtgaacttctcc

SEQ ID NO: 9235263 - DNA, 22 bp, Homo sapiens
ctgaggatctaattattgggtc

SEQ ID NO: 9235264 - DNA, 22 bp, Homo sapiens
ctgaggagtcagttccactcag

SEQ ID NO: 9235265 - DNA, 22 bp, Homo sapiens
ctgagagaatcatgctgcaggt

SEQ ID NO: 9235266 - DNA, 22 bp, Homo sapiens
ctgagagactgtttgtaatatt

SEQ ID NO: 9235267 - DNA, 22 bp, Homo sapiens
ctgaggacattgatgaggcaat

SEQ ID NO: 9235268 - DNA, 22 bp, Homo sapiens
ctgaggaggctaatttgaggat

SEQ ID NO: 9235269 - DNA, 22 bp, Homo sapiens
ctgaggaggggcctgagtgaga

SEQ ID NO: 9235270 - DNA, 22 bp, Homo sapiens
ctgaggagggaagtccccaaag

SEQ ID NO: 9235271 - DNA, 22 bp, Homo sapiens
ctgaggagaaagatggtccaag

SEQ ID NO: 9235272 - DNA, 22 bp, Homo sapiens
ctgagagaatcatgctgcaggt

SEQ ID NO: 9235273 - DNA, 22 bp, Homo sapiens
ctgagagaaacatgactcagga

SEQ ID NO: 9235274 - DNA, 22 bp, Homo sapiens
ctgagacatggtttgactggca

SEQ ID NO: 9235275 - DNA, 22 bp, Homo sapiens
ctgagaattactctgatgagta

SEQ ID NO: 9235276 - DNA, 22 bp, Homo sapiens
ctgagaattactctgatgagta

SEQ ID NO: 9235277 - DNA, 22 bp, Homo sapiens
ctgagaatgttttctgattgat

SEQ ID NO: 9235278 - DNA, 22 bp, Homo sapiens
ctgagtccagggacagaggcgt

SEQ ID NO: 9235279 - DNA, 22 bp, Homo sapiens
ctgagtccagggacagaggcgt

SEQ ID NO: 9235280 - DNA, 22 bp, Homo sapiens
ctgagtcattgcagatgtggag

SEQ ID NO: 9235281 - DNA, 19 bp, Homo sapiens
ctgagtcaaaggttgtggg

SEQ ID NO: 9235282 - DNA, 22 bp, Homo sapiens
ctgagtaagatacagaagctcc

SEQ ID NO: 9235283 - DNA, 22 bp, Homo sapiens
ctgaggcagaaaaagcaagggt

SEQ ID NO: 9235284 - DNA, 22 bp, Homo sapiens
ctgaggcagagaatgagtttgt

SEQ ID NO: 9235285 - DNA, 22 bp, Homo sapiens
ctgagtccagggacagaggcgt

SEQ ID NO: 9235286 - DNA, 22 bp, Homo sapiens
ctgagtccttgggcttagagtg

SEQ ID NO: 9235287 - DNA, 22 bp, Homo sapiens
ctgatcctcctttaagtagctg

SEQ ID NO: 9235288 - DNA, 22 bp, Homo sapiens
ctgatctcaagtgatccaccca

SEQ ID NO: 9235289 - DNA, 22 bp, Homo sapiens
ctgatgctctggatgtagtcaa

SEQ ID NO: 9235290 - DNA, 22 bp, Homo sapiens
ctgatgcttgcaacaaagaacc

SEQ ID NO: 9235291 - DNA, 22 bp, Homo sapiens
ctgatggagactccactgtgat

SEQ ID NO: 9235292 - DNA, 22 bp, Homo sapiens
ctgatgctataagccacagtgg

SEQ ID NO: 9235293 - DNA, 22 bp, Homo sapiens
ctgatgatagtgatttattgag

SEQ ID NO: 9235294 - DNA, 22 bp, Homo sapiens
ctgatttagatttcacacgtga

SEQ ID NO: 9235295 - DNA, 22 bp, Homo sapiens
ctgattttcaaaatgtgttaaa

SEQ ID NO: 9235296 - DNA, 22 bp, Homo sapiens
ctgattctttcttcttgccagg

SEQ ID NO: 9235297 - DNA, 22 bp, Homo sapiens
ctgattctgttgaacaccttcc

SEQ ID NO: 9235298 - DNA, 22 bp, Homo sapiens
ctgattgagaaggaaggggatc

SEQ ID NO: 9235299 - DNA, 22 bp, Homo sapiens
ctgattcctgattcatgctctt

SEQ ID NO: 9235300 - DNA, 22 bp, Homo sapiens
ctgattctaggcgttcctctca

SEQ ID NO: 9235301 - DNA, 22 bp, Homo sapiens
ctgcagagcataaatctgaata

SEQ ID NO: 9235302 - DNA, 22 bp, Homo sapiens
ctgcaaaagtaattgcaggttt

SEQ ID NO: 9235303 - DNA, 22 bp, Homo sapiens
ctgcagacctctgaggtccatg

SEQ ID NO: 9235304 - DNA, 22 bp, Homo sapiens
ctgcagaaagctgagatgatta

SEQ ID NO: 9235305 - DNA, 20 bp, Homo sapiens
ctgcctggaggcctctacct

SEQ ID NO: 9235306 - DNA, 20 bp, Homo sapiens
ctgcctggaggcctctacct

SEQ ID NO: 9235307 - DNA, 20 bp, Homo sapiens
ctgcctggaggcctctacct

SEQ ID NO: 9235308 - DNA, 22 bp, Homo sapiens
ctgcctggatgaatggcgcctt

SEQ ID NO: 9235309 - DNA, 22 bp, Homo sapiens
ctgcctggatgaatggcgcctt

SEQ ID NO: 9235310 - DNA, 22 bp, Homo sapiens
ctgcctggcatggagaagagaa

SEQ ID NO: 9235311 - DNA, 22 bp, Homo sapiens
ctgcctggcatggagaagagaa

SEQ ID NO: 9235312 - DNA, 22 bp, Homo sapiens
ctgcctggcatggagaagagaa

SEQ ID NO: 9235313 - DNA, 22 bp, Homo sapiens
ctgcctggccacaacccagggt

SEQ ID NO: 9235314 - DNA, 22 bp, Homo sapiens
ctgcctgctcaccagggctctg

SEQ ID NO: 9235315 - DNA, 22 bp, Homo sapiens
ctgcctgctcaccagggctctg

SEQ ID NO: 9235316 - DNA, 22 bp, Homo sapiens
ctgcctgctacctgaaatgcca

SEQ ID NO: 9235317 - DNA, 22 bp, Homo sapiens
ctgcctgcgttgcctcgtgcct

SEQ ID NO: 9235318 - DNA, 22 bp, Homo sapiens
ctgcctgctctatccaggcctg

SEQ ID NO: 9235319 - DNA, 22 bp, Homo sapiens
ctgcctggaatgccagcttctc

SEQ ID NO: 9235320 - DNA, 22 bp, Homo sapiens
ctgcctggaccggcagccctcc

SEQ ID NO: 9235321 - DNA, 22 bp, Homo sapiens
ctgcctggagcattctgaaggt

SEQ ID NO: 9235322 - DNA, 22 bp, Homo sapiens
ctgcctggagcattctgaaggt

SEQ ID NO: 9235323 - DNA, 22 bp, Homo sapiens
ctgcctggctaaactcaagtcg

SEQ ID NO: 9235324 - DNA, 22 bp, Homo sapiens
ctgcctggctaaactcaagtcg

SEQ ID NO: 9235325 - DNA, 22 bp, Homo sapiens
ctgcctggcctgatctccacgc

SEQ ID NO: 9235326 - DNA, 22 bp, Homo sapiens
ctgcctggcccagggatgggcc

SEQ ID NO: 9235327 - DNA, 22 bp, Homo sapiens
ctgcctgggccggccaccctct

SEQ ID NO: 9235328 - DNA, 22 bp, Homo sapiens
ctgcttctaagaacctgcagct

SEQ ID NO: 9235329 - DNA, 19 bp, Homo sapiens
ctgcttccttccctcactg

SEQ ID NO: 9235330 - DNA, 23 bp, Homo sapiens
ctgcttccttgcttcattgctgg

SEQ ID NO: 9235331 - DNA, 22 bp, Homo sapiens
ctgcttctaagaacctgcagct

SEQ ID NO: 9235332 - DNA, 22 bp, Homo sapiens
ctgctttactcatagggtttca

SEQ ID NO: 9235333 - DNA, 22 bp, Homo sapiens
ctgctttaccaaactcttggat

SEQ ID NO: 9235334 - DNA, 21 bp, Homo sapiens
ctgctttacttcagaggatct

SEQ ID NO: 9235335 - DNA, 22 bp, Homo sapiens
ctgctttagacaactgctggga

SEQ ID NO: 9235336 - DNA, 22 bp, Homo sapiens
ctgctttagagctgagcctcag

SEQ ID NO: 9235337 - DNA, 22 bp, Homo sapiens
ctgctttagacggctttcgctg

SEQ ID NO: 9235338 - DNA, 23 bp, Homo sapiens
ctgctttcccactccatgctctt

SEQ ID NO: 9235339 - DNA, 22 bp, Homo sapiens
ctgctttatctgagacaagtca

SEQ ID NO: 9235340 - DNA, 22 bp, Homo sapiens
ctgctttatattgagcttgaaa

SEQ ID NO: 9235341 - DNA, 22 bp, Homo sapiens
ctgctttatagggcttccatgt

SEQ ID NO: 9235342 - DNA, 22 bp, Homo sapiens
ctgctttagctagtgctcttag

SEQ ID NO: 9235343 - DNA, 19 bp, Homo sapiens
ctgctttaggccttaaaag

SEQ ID NO: 9235344 - DNA, 22 bp, Homo sapiens
ctgctttaggtggaatgttcta

SEQ ID NO: 9235345 - DNA, 22 bp, Homo sapiens
ctgctttagtgtggtgttagag

SEQ ID NO: 9235346 - DNA, 22 bp, Homo sapiens
ctgctttctgcaccccaggtcg

SEQ ID NO: 9235347 - DNA, 22 bp, Homo sapiens
ctgctttcttgttgcatcttaa

SEQ ID NO: 9235348 - DNA, 22 bp, Homo sapiens
ctgctttgactgttaagaacca

SEQ ID NO: 9235349 - DNA, 22 bp, Homo sapiens
ctgctttgactgttaagaacca

SEQ ID NO: 9235350 - DNA, 22 bp, Homo sapiens
ctgctttgattagaagagtaca

SEQ ID NO: 9235351 - DNA, 17 bp, Homo sapiens
ctgctttgtgcaacgct

SEQ ID NO: 9235352 - DNA, 22 bp, Homo sapiens
ctggaaagggtcctcattctgt

SEQ ID NO: 9235353 - DNA, 22 bp, Homo sapiens
ctgctttttgtaggtcccagag

SEQ ID NO: 9235354 - DNA, 22 bp, Homo sapiens
ctgctttttctaggaggacaat

SEQ ID NO: 9235355 - DNA, 22 bp, Homo sapiens
ctgcttttgagcccagtgctca

SEQ ID NO: 9235356 - DNA, 22 bp, Homo sapiens
ctggacaggctggggactgcaa

SEQ ID NO: 9235357 - DNA, 22 bp, Homo sapiens
ctggacagccctcactgtgtgc

SEQ ID NO: 9235358 - DNA, 22 bp, Homo sapiens
ctggacagaagtggctgggcag

SEQ ID NO: 9235359 - DNA, 22 bp, Homo sapiens
ctggacagaaagggctgctgtg

SEQ ID NO: 9235360 - DNA, 22 bp, Homo sapiens
ctggacagaaaccagtcctggg

SEQ ID NO: 9235361 - DNA, 22 bp, Homo sapiens
ctggacagaaaccagtcctggg

SEQ ID NO: 9235362 - DNA, 22 bp, Homo sapiens
ctggacagaaagggctgctgtg

SEQ ID NO: 9235363 - DNA, 22 bp, Homo sapiens
ctggacagaaagggctgctgtg

SEQ ID NO: 9235364 - DNA, 22 bp, Homo sapiens
ctggacagaagtggctgggcag

SEQ ID NO: 9235365 - DNA, 22 bp, Homo sapiens
ctggacagaagtggctgggcag

SEQ ID NO: 9235366 - DNA, 22 bp, Homo sapiens
ctggaaagtacagtgtgtcaca

SEQ ID NO: 9235367 - DNA, 23 bp, Homo sapiens
ctggaagtgcttttatagctttg

SEQ ID NO: 9235368 - DNA, 22 bp, Homo sapiens
ctggaagtataggggagatgat

SEQ ID NO: 9235369 - DNA, 21 bp, Homo sapiens
ctggagggtagagttgggctg

SEQ ID NO: 9235370 - DNA, 22 bp, Homo sapiens
ctggagggtgagcctcatctct

SEQ ID NO: 9235371 - DNA, 22 bp, Homo sapiens
ctggagggtgagcctcatctct

SEQ ID NO: 9235372 - DNA, 22 bp, Homo sapiens
ctggaggggccatccacagtct

SEQ ID NO: 9235373 - DNA, 22 bp, Homo sapiens
ctggaggggccatccacagtct

SEQ ID NO: 9235374 - DNA, 22 bp, Homo sapiens
ctggagggactttctcacggat

SEQ ID NO: 9235375 - DNA, 22 bp, Homo sapiens
ctggagggactttctcacggat

SEQ ID NO: 9235376 - DNA, 22 bp, Homo sapiens
ctggagggactttctcacggat

SEQ ID NO: 9235377 - DNA, 22 bp, Homo sapiens
ctggagggagattcaaaggagg

SEQ ID NO: 9235378 - DNA, 22 bp, Homo sapiens
ctggagggcttctgcaggttac

SEQ ID NO: 9235379 - DNA, 22 bp, Homo sapiens
ctggagtcagcaaggacgaggc

SEQ ID NO: 9235380 - DNA, 21 bp, Homo sapiens
ctggagtcattttctgagtag

SEQ ID NO: 9235381 - DNA, 22 bp, Homo sapiens
ctggagtcggcgccccaacaga

SEQ ID NO: 9235382 - DNA, 21 bp, Homo sapiens
ctggagtcattttctgagtag

SEQ ID NO: 9235383 - DNA, 22 bp, Homo sapiens
ctggagtctccccaggagcgtg

SEQ ID NO: 9235384 - DNA, 22 bp, Homo sapiens
ctggagtcactcatgtagctgc

SEQ ID NO: 9235385 - DNA, 22 bp, Homo sapiens
ctggagtcactcatgtagctgc

SEQ ID NO: 9235386 - DNA, 22 bp, Homo sapiens
ctggagtcacacacaccaaggt

SEQ ID NO: 9235387 - DNA, 22 bp, Homo sapiens
ctggaggtgcctagatgagctc

SEQ ID NO: 9235388 - DNA, 22 bp, Homo sapiens
ctggagtgtaaagagcatagaa

SEQ ID NO: 9235389 - DNA, 22 bp, Homo sapiens
ctggagtctcttctgtagctac

SEQ ID NO: 9235390 - DNA, 20 bp, Homo sapiens
ctggagtgtagcagtggctg

SEQ ID NO: 9235391 - DNA, 22 bp, Homo sapiens
ctggagtgtaaagagcatagaa

SEQ ID NO: 9235392 - DNA, 22 bp, Homo sapiens
ctggagttagagtagacactga

SEQ ID NO: 9235393 - DNA, 22 bp, Homo sapiens
ctggagttcagtggcgtgaaca

SEQ ID NO: 9235394 - DNA, 22 bp, Homo sapiens
ctggagttcgactgagttgaat

SEQ ID NO: 9235395 - DNA, 22 bp, Homo sapiens
ctggagttctatgtgcttgtga

SEQ ID NO: 9235396 - DNA, 22 bp, Homo sapiens
ctggagtttgcggggacagaga

SEQ ID NO: 9235397 - DNA, 22 bp, Homo sapiens
ctggagttttggaaaaatgctt

SEQ ID NO: 9235398 - DNA, 22 bp, Homo sapiens
ctggagtttgtggcttgctcaa

SEQ ID NO: 9235399 - DNA, 22 bp, Homo sapiens
ctggaggcacccttagagaggc

SEQ ID NO: 9235400 - DNA, 21 bp, Homo sapiens
ctggaggcaggtggtgccagg

SEQ ID NO: 9235401 - DNA, 21 bp, Homo sapiens
ctggaggcaggtggtgccagg

SEQ ID NO: 9235402 - DNA, 22 bp, Homo sapiens
ctggagggacaaggtatgcatt

SEQ ID NO: 9235403 - DNA, 22 bp, Homo sapiens
ctggaggctgagttgggtctcc

SEQ ID NO: 9235404 - DNA, 22 bp, Homo sapiens
ctggaggagaacttgaggaagg

SEQ ID NO: 9235405 - DNA, 22 bp, Homo sapiens
ctggaggagagtctgaatgaca

SEQ ID NO: 9235406 - DNA, 22 bp, Homo sapiens
ctggaggagcatggactggagt

SEQ ID NO: 9235407 - DNA, 22 bp, Homo sapiens
ctggagctctgtgtgttcctga

SEQ ID NO: 9235408 - DNA, 22 bp, Homo sapiens
ctggagctctccagagccccgt

SEQ ID NO: 9235409 - DNA, 22 bp, Homo sapiens
ctggagctctgtgtgttcctga

SEQ ID NO: 9235410 - DNA, 22 bp, Homo sapiens
ctggagctcttctgagtgtgct

SEQ ID NO: 9235411 - DNA, 22 bp, Homo sapiens
ctggagctgccagacgggcaca

SEQ ID NO: 9235412 - DNA, 22 bp, Homo sapiens
ctggaggaccacagaagctggt

SEQ ID NO: 9235413 - DNA, 22 bp, Homo sapiens
ctggaccagaaaggacatggct

SEQ ID NO: 9235414 - DNA, 21 bp, Homo sapiens
ctggactgaggagacagtcgc

SEQ ID NO: 9235415 - DNA, 22 bp, Homo sapiens
ctggactttggcccatctgcca

SEQ ID NO: 9235416 - DNA, 22 bp, Homo sapiens
ctggagctctccagagccccgt

SEQ ID NO: 9235417 - DNA, 17 bp, Homo sapiens
ctggccagtgtacttgg

SEQ ID NO: 9235418 - DNA, 22 bp, Homo sapiens
ctggccagtgtggctctgatct

SEQ ID NO: 9235419 - DNA, 22 bp, Homo sapiens
ctggccagttgtcctggcttgg

SEQ ID NO: 9235420 - DNA, 22 bp, Homo sapiens
ctggccagttgtcctggcttgg

SEQ ID NO: 9235421 - DNA, 22 bp, Homo sapiens
ctggccagttgtcctggcttgg

SEQ ID NO: 9235422 - DNA, 22 bp, Homo sapiens
ctggcccagagagcagagctta

SEQ ID NO: 9235423 - DNA, 22 bp, Homo sapiens
ctggcctgcagatcccagggtc

SEQ ID NO: 9235424 - DNA, 22 bp, Homo sapiens
ctggcctgaggtcggctgtagg

SEQ ID NO: 9235425 - DNA, 22 bp, Homo sapiens
ctggcctgatctcatgctgtcc

SEQ ID NO: 9235426 - DNA, 22 bp, Homo sapiens
ctggcctggcaggggacctcta

SEQ ID NO: 9235427 - DNA, 22 bp, Homo sapiens
ctggcctgaggccgccttcaga

SEQ ID NO: 9235428 - DNA, 22 bp, Homo sapiens
ctggctctaagtgtcagctccc

SEQ ID NO: 9235429 - DNA, 22 bp, Homo sapiens
ctggctctcgctgggagtactt

SEQ ID NO: 9235430 - DNA, 22 bp, Homo sapiens
ctggctctctgagatattgagt

SEQ ID NO: 9235431 - DNA, 22 bp, Homo sapiens
ctggctctgagcccacctccag

SEQ ID NO: 9235432 - DNA, 22 bp, Homo sapiens
ctggctctgtcaccctttctcc

SEQ ID NO: 9235433 - DNA, 23 bp, Homo sapiens
ctggctctgtaggtggcatcctt

SEQ ID NO: 9235434 - DNA, 22 bp, Homo sapiens
ctggctctgtggcttccttcat

SEQ ID NO: 9235435 - DNA, 22 bp, Homo sapiens
ctggctctgtgggacctggcct

SEQ ID NO: 9235436 - DNA, 22 bp, Homo sapiens
ctggcctggggcctcagctgct

SEQ ID NO: 9235437 - DNA, 22 bp, Homo sapiens
ctggcctggggcctcagctgct

SEQ ID NO: 9235438 - DNA, 22 bp, Homo sapiens
ctggcctggtctggcctctcca

SEQ ID NO: 9235439 - DNA, 22 bp, Homo sapiens
ctggcctggcaggggacctcta

SEQ ID NO: 9235440 - DNA, 22 bp, Homo sapiens
ctggcctggcgcagtggctcac

SEQ ID NO: 9235441 - DNA, 22 bp, Homo sapiens
ctggcctggcgcagtggctcac

SEQ ID NO: 9235442 - DNA, 22 bp, Homo sapiens
ctggcctgggagctgctagcgt

SEQ ID NO: 9235443 - DNA, 22 bp, Homo sapiens
ctggctcctccaaggcctggag

SEQ ID NO: 9235444 - DNA, 20 bp, Homo sapiens
ctggatgctaaaacacacac

SEQ ID NO: 9235445 - DNA, 22 bp, Homo sapiens
ctggatgctgagaggtaccaag

SEQ ID NO: 9235446 - DNA, 22 bp, Homo sapiens
ctggatctgtttgtgcttgtgg

SEQ ID NO: 9235447 - DNA, 22 bp, Homo sapiens
ctggatggtcccatgagcagct

SEQ ID NO: 9235448 - DNA, 22 bp, Homo sapiens
ctggatgcttcctctctgctag

SEQ ID NO: 9235449 - DNA, 22 bp, Homo sapiens
ctggatgcttcctctctgctag

SEQ ID NO: 9235450 - DNA, 22 bp, Homo sapiens
ctggatcatgcattgcttgtcc

SEQ ID NO: 9235451 - DNA, 22 bp, Homo sapiens
ctggcaagaaatatatatctta

SEQ ID NO: 9235452 - DNA, 22 bp, Homo sapiens
ctggcaagaaatatatatctta

SEQ ID NO: 9235453 - DNA, 22 bp, Homo sapiens
ctggatgttcttctgcaattat

SEQ ID NO: 9235454 - DNA, 22 bp, Homo sapiens
ctggatgttttgctaaggactc

SEQ ID NO: 9235455 - DNA, 22 bp, Homo sapiens
ctggcagatagtaagtgatcaa

SEQ ID NO: 9235456 - DNA, 22 bp, Homo sapiens
ctggcagcagcttctggatcga

SEQ ID NO: 9235457 - DNA, 22 bp, Homo sapiens
ctggcagcagagctcaacatag

SEQ ID NO: 9235458 - DNA, 22 bp, Homo sapiens
ctggcacatagtcagcactcaa

SEQ ID NO: 9235459 - DNA, 22 bp, Homo sapiens
ctggcacatgtgagccacatca

SEQ ID NO: 9235460 - DNA, 22 bp, Homo sapiens
ctggcaccaggcatgctgggag

SEQ ID NO: 9235461 - DNA, 22 bp, Homo sapiens
ctggcagtgtgaccctggacag

SEQ ID NO: 9235462 - DNA, 22 bp, Homo sapiens
ctggcagtttgccaggagctcg

SEQ ID NO: 9235463 - DNA, 22 bp, Homo sapiens
ctggcagtctggtggaaggcct

SEQ ID NO: 9235464 - DNA, 22 bp, Homo sapiens
ctggcagtgacattgcaggtgc

SEQ ID NO: 9235465 - DNA, 22 bp, Homo sapiens
ctggcagcatggagcctgtgct

SEQ ID NO: 9235466 - DNA, 22 bp, Homo sapiens
ctggcagcattaacagagagca

SEQ ID NO: 9235467 - DNA, 22 bp, Homo sapiens
ctggcatgtgtttggctcctgt

SEQ ID NO: 9235468 - DNA, 22 bp, Homo sapiens
ctggccaatatagggaaatctt

SEQ ID NO: 9235469 - DNA, 22 bp, Homo sapiens
ctggccaacttgcttgttggca

SEQ ID NO: 9235470 - DNA, 22 bp, Homo sapiens
ctggccaggcggcccctgcatg

SEQ ID NO: 9235471 - DNA, 20 bp, Homo sapiens
cccaggcagagctagcggca

SEQ ID NO: 9235472 - DNA, 22 bp, Homo sapiens
cccaggcagcggggtctccttg

SEQ ID NO: 9235473 - DNA, 22 bp, Homo sapiens
cccaggcagcggggtctccttg

SEQ ID NO: 9235474 - DNA, 22 bp, Homo sapiens
cccaggcagcggggtctccttg

SEQ ID NO: 9235475 - DNA, 22 bp, Homo sapiens
cccaggcagcctgcagggaagg

SEQ ID NO: 9235476 - DNA, 22 bp, Homo sapiens
cccaggcagggacgtgctctgg

SEQ ID NO: 9235477 - DNA, 22 bp, Homo sapiens
cccaggcagtctggctctaaag

SEQ ID NO: 9235478 - DNA, 22 bp, Homo sapiens
cccaggcagagagctggtgagc

SEQ ID NO: 9235479 - DNA, 22 bp, Homo sapiens
cccaggcacatccactctgtga

SEQ ID NO: 9235480 - DNA, 21 bp, Homo sapiens
tgccaggcctgagctggggtc

SEQ ID NO: 9235481 - DNA, 21 bp, Homo sapiens
tgccaggcctgagctggggtc

SEQ ID NO: 9235482 - DNA, 21 bp, Homo sapiens
tgccaggcctgagctggggtc

SEQ ID NO: 9235483 - DNA, 22 bp, Homo sapiens
tgccaggcgattgctatcagca

SEQ ID NO: 9235484 - DNA, 22 bp, Homo sapiens
tgccaggcgtggtggtgcgcac

SEQ ID NO: 9235485 - DNA, 22 bp, Homo sapiens
cccaggagttcgaggctgtagt

SEQ ID NO: 9235486 - DNA, 22 bp, Homo sapiens
cccaggagttcgaggctgtagt

SEQ ID NO: 9235487 - DNA, 15 bp, Homo sapiens
cccaggagttcgaga

SEQ ID NO: 9235488 - DNA, 22 bp, Homo sapiens
tgccaggcgtggtggtgcgcac

SEQ ID NO: 9235489 - DNA, 22 bp, Homo sapiens
tgccaggctaagtggaggactt

SEQ ID NO: 9235490 - DNA, 22 bp, Homo sapiens
cccaggagttagaggttgtggt

SEQ ID NO: 9235491 - DNA, 22 bp, Homo sapiens
cccaggagttagaggttgtggt

SEQ ID NO: 9235492 - DNA, 22 bp, Homo sapiens
tgcattagtaagtaattttaat

SEQ ID NO: 9235493 - DNA, 23 bp, Homo sapiens
tgccacaagatctgtgaataaga

SEQ ID NO: 9235494 - DNA, 22 bp, Homo sapiens
tgccacacaattactgctgcta

SEQ ID NO: 9235495 - DNA, 22 bp, Homo sapiens
tgccaagggtatgggcaagata

SEQ ID NO: 9235496 - DNA, 22 bp, Homo sapiens
tgccaagggtatgggcaagata

SEQ ID NO: 9235497 - DNA, 22 bp, Homo sapiens
tgccacagagactttcattgta

SEQ ID NO: 9235498 - DNA, 22 bp, Homo sapiens
tgccacactcccctgctgcagt

SEQ ID NO: 9235499 - DNA, 22 bp, Homo sapiens
cccaggagggtggcctctgccc

SEQ ID NO: 9235500 - DNA, 22 bp, Homo sapiens
cccaggagggtggcctctgccc

SEQ ID NO: 9235501 - DNA, 22 bp, Homo sapiens
cccaggaggtggaggctgcagt

SEQ ID NO: 9235502 - DNA, 22 bp, Homo sapiens
tgccacagagcaattctgctga

SEQ ID NO: 9235503 - DNA, 22 bp, Homo sapiens
tgccacagagcaattctgctga

SEQ ID NO: 9235504 - DNA, 22 bp, Homo sapiens
cccaggaggtggaggctgcagt

SEQ ID NO: 9235505 - DNA, 22 bp, Homo sapiens
cccaggaggtggaggctgcagt

SEQ ID NO: 9235506 - DNA, 22 bp, Homo sapiens
cccaggaggtggaggttgcagc

SEQ ID NO: 9235507 - DNA, 22 bp, Homo sapiens
cccaggaggtggaggttgcagt

SEQ ID NO: 9235508 - DNA, 22 bp, Homo sapiens
cccaggaggtggaggttgcagt

SEQ ID NO: 9235509 - DNA, 22 bp, Homo sapiens
cccaggaggtggaggttgcagc

SEQ ID NO: 9235510 - DNA, 22 bp, Homo sapiens
cccaggaggtggaggttgcagc

SEQ ID NO: 9235511 - DNA, 22 bp, Homo sapiens
cccaggaggtggaggttgcagc

SEQ ID NO: 9235512 - DNA, 22 bp, Homo sapiens
cccaggaggtgtagctgcgtgg

SEQ ID NO: 9235513 - DNA, 22 bp, Homo sapiens
cccaggaggtgtgcccaactcg

SEQ ID NO: 9235514 - DNA, 22 bp, Homo sapiens
cccaggaggtggagttcacagt

SEQ ID NO: 9235515 - DNA, 22 bp, Homo sapiens
cccaggaggtggaggttgcggt

SEQ ID NO: 9235516 - DNA, 22 bp, Homo sapiens
cccaggaggtggaggttgcggt

SEQ ID NO: 9235517 - DNA, 22 bp, Homo sapiens
cccaggaggtggagttcacagt

SEQ ID NO: 9235518 - DNA, 22 bp, Homo sapiens
cccaggaggtggaggttgcagt

SEQ ID NO: 9235519 - DNA, 22 bp, Homo sapiens
cccaggaggtggaggttgcagt

SEQ ID NO: 9235520 - DNA, 22 bp, Homo sapiens
tgccaggcctcaggagtctcca

SEQ ID NO: 9235521 - DNA, 22 bp, Homo sapiens
tgccaggcctcaggagtctcca

SEQ ID NO: 9235522 - DNA, 22 bp, Homo sapiens
tgccaggcctcaggagtctcca

SEQ ID NO: 9235523 - DNA, 22 bp, Homo sapiens
cccaggaggtgtgcccaactcg

SEQ ID NO: 9235524 - DNA, 22 bp, Homo sapiens
cccaggaggttgaggctgcagt

SEQ ID NO: 9235525 - DNA, 22 bp, Homo sapiens
cccagctccttacagggccgaa

SEQ ID NO: 9235526 - DNA, 22 bp, Homo sapiens
cccagctccttacagggccgaa

SEQ ID NO: 9235527 - DNA, 22 bp, Homo sapiens
cccagctccgagctccgagccg

SEQ ID NO: 9235528 - DNA, 22 bp, Homo sapiens
cccagctcttcaagtcaccccc

SEQ ID NO: 9235529 - DNA, 22 bp, Homo sapiens
cccagctcaagcagagagctaa

SEQ ID NO: 9235530 - DNA, 22 bp, Homo sapiens
cccagctcaagcagagagctaa

SEQ ID NO: 9235531 - DNA, 22 bp, Homo sapiens
cccagctacctctgctaggaga

SEQ ID NO: 9235532 - DNA, 22 bp, Homo sapiens
cccagcgagtttgccggtgaac

SEQ ID NO: 9235533 - DNA, 22 bp, Homo sapiens
cccagcgagtttgccggtgaac

SEQ ID NO: 9235534 - DNA, 23 bp, Homo sapiens
cccagcgctgagccctgcaggca

SEQ ID NO: 9235535 - DNA, 22 bp, Homo sapiens
tgcagggacacgaagacaaata

SEQ ID NO: 9235536 - DNA, 22 bp, Homo sapiens
tgcagggaatgcttgcagcatg

SEQ ID NO: 9235537 - DNA, 22 bp, Homo sapiens
tctgtggcccaagtgatggctg

SEQ ID NO: 9235538 - DNA, 20 bp, Homo sapiens
tctgtggcaggtggcgcttg

SEQ ID NO: 9235539 - DNA, 22 bp, Homo sapiens
tctgtggcatagtgcttgggaa

SEQ ID NO: 9235540 - DNA, 22 bp, Homo sapiens
tctgtggcatgttgcacttgta

SEQ ID NO: 9235541 - DNA, 22 bp, Homo sapiens
cccagcctttgcttcctggttc

SEQ ID NO: 9235542 - DNA, 22 bp, Homo sapiens
cccagcctttgcttcctggttc

SEQ ID NO: 9235543 - DNA, 22 bp, Homo sapiens
cccagcctgtctttcccaatga

SEQ ID NO: 9235544 - DNA, 22 bp, Homo sapiens
cccagcctgtgacagccgtcct

SEQ ID NO: 9235545 - DNA, 22 bp, Homo sapiens
tgcattaaaaccatcgaccatc

SEQ ID NO: 9235546 - DNA, 22 bp, Homo sapiens
tgcattaaaatgtgcctctctt

SEQ ID NO: 9235547 - DNA, 22 bp, Homo sapiens
tgcatgtttctgtatgttaatg

SEQ ID NO: 9235548 - DNA, 20 bp, Homo sapiens
tgcattaagtggcattgagc

SEQ ID NO: 9235549 - DNA, 22 bp, Homo sapiens
tgcattaaggccattgaaattt

SEQ ID NO: 9235550 - DNA, 22 bp, Homo sapiens
cccagctgtggcagaggccggg

SEQ ID NO: 9235551 - DNA, 19 bp, Homo sapiens
cccagcttgaccacctgct

SEQ ID NO: 9235552 - DNA, 23 bp, Homo sapiens
cccagctttcccactgccgagag

SEQ ID NO: 9235553 - DNA, 22 bp, Homo sapiens
cccagcttgcgggcggcaggag

SEQ ID NO: 9235554 - DNA, 22 bp, Homo sapiens
cccagcttgcccaggactgagg

SEQ ID NO: 9235555 - DNA, 22 bp, Homo sapiens
cccagcttgcaaatgggttgct

SEQ ID NO: 9235556 - DNA, 22 bp, Homo sapiens
cccagctgtaacgggtctgcac

SEQ ID NO: 9235557 - DNA, 18 bp, Homo sapiens
cccagctggtgggtcagt

SEQ ID NO: 9235558 - DNA, 18 bp, Homo sapiens
cccagctggtgggtcagt

SEQ ID NO: 9235559 - DNA, 17 bp, Homo sapiens
cccagctggcagtgccg

SEQ ID NO: 9235560 - DNA, 17 bp, Homo sapiens
cccagctggcagtgccg

SEQ ID NO: 9235561 - DNA, 23 bp, Homo sapiens
cccagctggaagttagaggacca

SEQ ID NO: 9235562 - DNA, 17 bp, Homo sapiens
cccagctggcagtgccg

SEQ ID NO: 9235563 - DNA, 23 bp, Homo sapiens
cccagctgcagacaagggagggt

SEQ ID NO: 9235564 - DNA, 23 bp, Homo sapiens
cccagctgcagacaagggagggt

SEQ ID NO: 9235565 - DNA, 23 bp, Homo sapiens
cccagctgcagacaagggagggt

SEQ ID NO: 9235566 - DNA, 22 bp, Homo sapiens
cccagctgcacctctatggcct

SEQ ID NO: 9235567 - DNA, 22 bp, Homo sapiens
cccagctgatttttgcagagat

SEQ ID NO: 9235568 - DNA, 22 bp, Homo sapiens
cccagctgatttttgcagagat

SEQ ID NO: 9235569 - DNA, 23 bp, Homo sapiens
cccagctgagacttcctgaactc

SEQ ID NO: 9235570 - DNA, 22 bp, Homo sapiens
cccagctgatttttgcagagat

SEQ ID NO: 9235571 - DNA, 22 bp, Homo sapiens
cccagctgatttttgcagagat

SEQ ID NO: 9235572 - DNA, 22 bp, Homo sapiens
cccagctgatttttgcagagat

SEQ ID NO: 9235573 - DNA, 22 bp, Homo sapiens
cccagctcttcaagtcaccccc

SEQ ID NO: 9235574 - DNA, 22 bp, Homo sapiens
cccagctcttcaagtcaccccc

SEQ ID NO: 9235575 - DNA, 22 bp, Homo sapiens
cccagctcttcctgggagctaa

SEQ ID NO: 9235576 - DNA, 22 bp, Homo sapiens
cccagctcttcctgggagctaa

SEQ ID NO: 9235577 - DNA, 22 bp, Homo sapiens
cccagctcttttagcggcatct

SEQ ID NO: 9235578 - DNA, 22 bp, Homo sapiens
cccagctcttttagcggcatct

SEQ ID NO: 9235579 - DNA, 22 bp, Homo sapiens
cccagctcttttagcggcatct

SEQ ID NO: 9235580 - DNA, 22 bp, Homo sapiens
ccccagccagcaggacctctga

SEQ ID NO: 9235581 - DNA, 22 bp, Homo sapiens
tgctgcagatcagctgagtcct

SEQ ID NO: 9235582 - DNA, 22 bp, Homo sapiens
tgctgcagctaaggtgaggtgc

SEQ ID NO: 9235583 - DNA, 22 bp, Homo sapiens
tgctgcagatcagctgagtcct

SEQ ID NO: 9235584 - DNA, 22 bp, Homo sapiens
ccccacctgtgcgtctgccgca

SEQ ID NO: 9235585 - DNA, 22 bp, Homo sapiens
tgctgcaggaacttaagaagct

SEQ ID NO: 9235586 - DNA, 22 bp, Homo sapiens
tgctggagacatagcaggcagc

SEQ ID NO: 9235587 - DNA, 23 bp, Homo sapiens
tgctggagacaagtgtgagaagg

SEQ ID NO: 9235588 - DNA, 22 bp, Homo sapiens
ccccagcccacaagcatattaa

SEQ ID NO: 9235589 - DNA, 22 bp, Homo sapiens
tgctggagacctgcttgcacca

SEQ ID NO: 9235590 - DNA, 22 bp, Homo sapiens
tgctggagacctgcttgcacca

SEQ ID NO: 9235591 - DNA, 22 bp, Homo sapiens
tgctggagactcactcaggtgc

SEQ ID NO: 9235592 - DNA, 22 bp, Homo sapiens
tgctggagacatagcaggcagc

SEQ ID NO: 9235593 - DNA, 22 bp, Homo sapiens
tgctggagatcattaatgttca

SEQ ID NO: 9235594 - DNA, 22 bp, Homo sapiens
tgctggagatgaaagggccctg

SEQ ID NO: 9235595 - DNA, 22 bp, Homo sapiens
tgctggagagccttggccaagg

SEQ ID NO: 9235596 - DNA, 22 bp, Homo sapiens
tgctggagagccttggccaagg

SEQ ID NO: 9235597 - DNA, 22 bp, Homo sapiens
tgctggagaggaaggtggggtc

SEQ ID NO: 9235598 - DNA, 22 bp, Homo sapiens
tgctggagcatctgagagcatc

SEQ ID NO: 9235599 - DNA, 22 bp, Homo sapiens
tgctggagcatctgagagcatc

SEQ ID NO: 9235600 - DNA, 22 bp, Homo sapiens
cccccagtctgaacagcagctg

SEQ ID NO: 9235601 - DNA, 22 bp, Homo sapiens
ccccctctgccggggtccttca

SEQ ID NO: 9235602 - DNA, 22 bp, Homo sapiens
cccccaggctctgacacaggag

SEQ ID NO: 9235603 - DNA, 22 bp, Homo sapiens
cccccaggctctgacacaggag

SEQ ID NO: 9235604 - DNA, 22 bp, Homo sapiens
cccccaggctctgacacaggag

SEQ ID NO: 9235605 - DNA, 22 bp, Homo sapiens
ccccgaggctggagtgcagtgg

SEQ ID NO: 9235606 - DNA, 21 bp, Homo sapiens
cccctcatacactctccttgc

SEQ ID NO: 9235607 - DNA, 22 bp, Homo sapiens
cccccaccgtgttcctgctcgg

SEQ ID NO: 9235608 - DNA, 22 bp, Homo sapiens
cccccaaagtttgcacggataa

SEQ ID NO: 9235609 - DNA, 22 bp, Homo sapiens
cccccagctctgctgggtcccg

SEQ ID NO: 9235610 - DNA, 22 bp, Homo sapiens
cccccagccagcagtgctcagc

SEQ ID NO: 9235611 - DNA, 22 bp, Homo sapiens
cccccagatgcgagccatagcc

SEQ ID NO: 9235612 - DNA, 19 bp, Homo sapiens
ccctcaggtctgagcagtc

SEQ ID NO: 9235613 - DNA, 22 bp, Homo sapiens
ccctcaggatgcagtggaagtg

SEQ ID NO: 9235614 - DNA, 22 bp, Homo sapiens
ccctcaggagatgtcagctgga

SEQ ID NO: 9235615 - DNA, 22 bp, Homo sapiens
ccctcagcttctccctgcagct

SEQ ID NO: 9235616 - DNA, 22 bp, Homo sapiens
ccctcaggagatgtcagctgga

SEQ ID NO: 9235617 - DNA, 21 bp, Homo sapiens
ccctcaggaaacagaatgcac

SEQ ID NO: 9235618 - DNA, 22 bp, Homo sapiens
cccctccctgacctggttgggc

SEQ ID NO: 9235619 - DNA, 22 bp, Homo sapiens
cccctccctgacctggttgggc

SEQ ID NO: 9235620 - DNA, 22 bp, Homo sapiens
cccctccctgacctggttgggc

SEQ ID NO: 9235621 - DNA, 22 bp, Homo sapiens
cccctctccctcacttatcaat

SEQ ID NO: 9235622 - DNA, 22 bp, Homo sapiens
cccctctccctcacttatcaat

SEQ ID NO: 9235623 - DNA, 22 bp, Homo sapiens
cccctcctggccacactgtcag

SEQ ID NO: 9235624 - DNA, 22 bp, Homo sapiens
cccctcctggccacactgtcag

SEQ ID NO: 9235625 - DNA, 20 bp, Homo sapiens
ccctaggaacgcagcaggag

SEQ ID NO: 9235626 - DNA, 20 bp, Homo sapiens
cccagggacctgagctccat

SEQ ID NO: 9235627 - DNA, 22 bp, Homo sapiens
tgctcccaaacgacctactgtg

SEQ ID NO: 9235628 - DNA, 22 bp, Homo sapiens
tgctcccacactactcggaggc

SEQ ID NO: 9235629 - DNA, 22 bp, Homo sapiens
cccagggactcgggattctagg

SEQ ID NO: 9235630 - DNA, 22 bp, Homo sapiens
cccagggactcgggattctagg

SEQ ID NO: 9235631 - DNA, 22 bp, Homo sapiens
cccagggagagcgcggaggcgg

SEQ ID NO: 9235632 - DNA, 22 bp, Homo sapiens
cccagggaggcccaggctctgc

SEQ ID NO: 9235633 - DNA, 22 bp, Homo sapiens
cccagggatgtggcagatgtta

SEQ ID NO: 9235634 - DNA, 22 bp, Homo sapiens
cccagggaggtagcaggagaaa

SEQ ID NO: 9235635 - DNA, 22 bp, Homo sapiens
cccagggaggtagcaggagaaa

SEQ ID NO: 9235636 - DNA, 22 bp, Homo sapiens
cccagggaggtagcaggagaaa

SEQ ID NO: 9235637 - DNA, 22 bp, Homo sapiens
cccagggattataaaggtgaaa

SEQ ID NO: 9235638 - DNA, 22 bp, Homo sapiens
tgctctggagtggcttgtgcac

SEQ ID NO: 9235639 - DNA, 22 bp, Homo sapiens
tgctctggagtggcttgtgcac

SEQ ID NO: 9235640 - DNA, 23 bp, Homo sapiens
tgctgaagtgttggccctgccca

SEQ ID NO: 9235641 - DNA, 22 bp, Homo sapiens
tgctgcagaaattctgtgagga

SEQ ID NO: 9235642 - DNA, 22 bp, Homo sapiens
tgctgcagaaattctgtgagga

SEQ ID NO: 9235643 - DNA, 22 bp, Homo sapiens
tgctgcagaaattctgtgagga

SEQ ID NO: 9235644 - DNA, 22 bp, Homo sapiens
tgctgactcctggctgtgacac

SEQ ID NO: 9235645 - DNA, 19 bp, Homo sapiens
tgctgactgggcctcaccg

SEQ ID NO: 9235646 - DNA, 19 bp, Homo sapiens
tgctgactgagctgcaaaa

SEQ ID NO: 9235647 - DNA, 22 bp, Homo sapiens
tgctgagacacctaaggtaaat

SEQ ID NO: 9235648 - DNA, 22 bp, Homo sapiens
tgctgagacaacaggaaacaag

SEQ ID NO: 9235649 - DNA, 22 bp, Homo sapiens
tgctgaagttactagagactat

SEQ ID NO: 9235650 - DNA, 22 bp, Homo sapiens
tgctgaataaagatatattttc

SEQ ID NO: 9235651 - DNA, 22 bp, Homo sapiens
tgctgaataaataaagtctatt

SEQ ID NO: 9235652 - DNA, 22 bp, Homo sapiens
tgctgaataagacgtggcttgt

SEQ ID NO: 9235653 - DNA, 22 bp, Homo sapiens
tgctgaatcccaccctccagtg

SEQ ID NO: 9235654 - DNA, 22 bp, Homo sapiens
tgctgaatgaatggatggttgc

SEQ ID NO: 9235655 - DNA, 21 bp, Homo sapiens
tgctgaatctgccatattttc

SEQ ID NO: 9235656 - DNA, 22 bp, Homo sapiens
tgctgaataataagattactca

SEQ ID NO: 9235657 - DNA, 22 bp, Homo sapiens
tgctgaatatagagcaagaagt

SEQ ID NO: 9235658 - DNA, 22 bp, Homo sapiens
tgctgaatcaaaacaaaggttt

SEQ ID NO: 9235659 - DNA, 22 bp, Homo sapiens
tgctgaatcatatggtaattct

SEQ ID NO: 9235660 - DNA, 22 bp, Homo sapiens
tgctgaattctcattccctgga

SEQ ID NO: 9235661 - DNA, 22 bp, Homo sapiens
tgctgaattggtagtactgttg

SEQ ID NO: 9235662 - DNA, 22 bp, Homo sapiens
tgctgaatttacatttttgtag

SEQ ID NO: 9235663 - DNA, 22 bp, Homo sapiens
tgctgaatgtgctcccttttaa

SEQ ID NO: 9235664 - DNA, 22 bp, Homo sapiens
tgctgaattaaactctatgtgg

SEQ ID NO: 9235665 - DNA, 22 bp, Homo sapiens
tgctgaattctaccatccattt

SEQ ID NO: 9235666 - DNA, 22 bp, Homo sapiens
tgctgaattccagggccccact

SEQ ID NO: 9235667 - DNA, 22 bp, Homo sapiens
tgctgaatgctgcatgccgtat

SEQ ID NO: 9235668 - DNA, 22 bp, Homo sapiens
tgctgaatgggatatgttgagc

SEQ ID NO: 9235669 - DNA, 22 bp, Homo sapiens
tgctgaatgggtgattttggag

SEQ ID NO: 9235670 - DNA, 22 bp, Homo sapiens
tgctgaatggtaaagaagtata

SEQ ID NO: 9235671 - DNA, 22 bp, Homo sapiens
tgcctgctcttgagacttacaa

SEQ ID NO: 9235672 - DNA, 22 bp, Homo sapiens
tgcctgggaaccaatcctggct

SEQ ID NO: 9235673 - DNA, 22 bp, Homo sapiens
tgcctgggacatgctgtggact

SEQ ID NO: 9235674 - DNA, 22 bp, Homo sapiens
tgcctgggagtgaccaagactc

SEQ ID NO: 9235675 - DNA, 22 bp, Homo sapiens
tgcctgggagtgaccaagactc

SEQ ID NO: 9235676 - DNA, 22 bp, Homo sapiens
tgcctgggactgtactaaattt

SEQ ID NO: 9235677 - DNA, 22 bp, Homo sapiens
tgcctgggccttcccacctctg

SEQ ID NO: 9235678 - DNA, 22 bp, Homo sapiens
tgcctgggccttcccacctctg

SEQ ID NO: 9235679 - DNA, 22 bp, Homo sapiens
tgcctgggcctctgaggaaggc

SEQ ID NO: 9235680 - DNA, 22 bp, Homo sapiens
tgcctgggcctctgaggaaggc

SEQ ID NO: 9235681 - DNA, 22 bp, Homo sapiens
tgcctgggcctctgaggaaggc

SEQ ID NO: 9235682 - DNA, 22 bp, Homo sapiens
tgcctgggccttcccacctctg

SEQ ID NO: 9235683 - DNA, 22 bp, Homo sapiens
cccaggctcctactgtattctg

SEQ ID NO: 9235684 - DNA, 22 bp, Homo sapiens
tgcctgggctcaccgcctcttt

SEQ ID NO: 9235685 - DNA, 22 bp, Homo sapiens
cccaggctcctactgtattctg

SEQ ID NO: 9235686 - DNA, 22 bp, Homo sapiens
cccaggctcctagaggcccaga

SEQ ID NO: 9235687 - DNA, 22 bp, Homo sapiens
cccaggctcctagaggcccaga

SEQ ID NO: 9235688 - DNA, 22 bp, Homo sapiens
tgctccagtgcctgccccacag

SEQ ID NO: 9235689 - DNA, 22 bp, Homo sapiens
tgctccagtgagctggccatcc

SEQ ID NO: 9235690 - DNA, 22 bp, Homo sapiens
tgctccagtgagctggccatcc

SEQ ID NO: 9235691 - DNA, 22 bp, Homo sapiens
tgctccagggctgccagaccct

SEQ ID NO: 9235692 - DNA, 23 bp, Homo sapiens
tgctccaggtacagaactccagg

SEQ ID NO: 9235693 - DNA, 22 bp, Homo sapiens
tgctccaggtgtgcctctcatg

SEQ ID NO: 9235694 - DNA, 22 bp, Homo sapiens
cccaggctcctgctgtgttgac

SEQ ID NO: 9235695 - DNA, 22 bp, Homo sapiens
cccaggctcctgctgtgttgac

SEQ ID NO: 9235696 - DNA, 22 bp, Homo sapiens
cccaggctcctgctgtgttgac

SEQ ID NO: 9235697 - DNA, 22 bp, Homo sapiens
cccaggctcctgactcattcta

SEQ ID NO: 9235698 - DNA, 22 bp, Homo sapiens
cccaggctcctgactcattcta

SEQ ID NO: 9235699 - DNA, 22 bp, Homo sapiens
cccaggctcctgactcattcta

SEQ ID NO: 9235700 - DNA, 21 bp, Homo sapiens
cccaggctgaattaaaaatat

SEQ ID NO: 9235701 - DNA, 22 bp, Homo sapiens
cccaggctcttatgtgacttgc

SEQ ID NO: 9235702 - DNA, 22 bp, Homo sapiens
cccaggctcttatgtgacttgc

SEQ ID NO: 9235703 - DNA, 22 bp, Homo sapiens
tgctccagggctgccagaccct

SEQ ID NO: 9235704 - DNA, 22 bp, Homo sapiens
tgctcagtagcagtgtgctgct

SEQ ID NO: 9235705 - DNA, 21 bp, Homo sapiens
cccaggctgaattaaaaatat

SEQ ID NO: 9235706 - DNA, 21 bp, Homo sapiens
tgctcagtaaatgctgagtga

SEQ ID NO: 9235707 - DNA, 22 bp, Homo sapiens
tggcagctttttgtttcaggct

SEQ ID NO: 9235708 - DNA, 22 bp, Homo sapiens
tggcagcttgaatgcagtcttt

SEQ ID NO: 9235709 - DNA, 22 bp, Homo sapiens
tggcagcttgaatgcagtcttt

SEQ ID NO: 9235710 - DNA, 22 bp, Homo sapiens
tggccaggaggctgcttctgac

SEQ ID NO: 9235711 - DNA, 22 bp, Homo sapiens
tggccaggaggctgcttctgac

SEQ ID NO: 9235712 - DNA, 22 bp, Homo sapiens
tggccaggaggctgcttctgac

SEQ ID NO: 9235713 - DNA, 22 bp, Homo sapiens
tggccaggcaggtagaacggcc

SEQ ID NO: 9235714 - DNA, 22 bp, Homo sapiens
tggcagctgtctgtggggtctc

SEQ ID NO: 9235715 - DNA, 22 bp, Homo sapiens
tggcagctgtgcttcattcttt

SEQ ID NO: 9235716 - DNA, 22 bp, Homo sapiens
tggcagctggtacagtgggtct

SEQ ID NO: 9235717 - DNA, 22 bp, Homo sapiens
tggcagctgtgtccaggtagaa

SEQ ID NO: 9235718 - DNA, 22 bp, Homo sapiens
tggcagctgtgtccaggtagaa

SEQ ID NO: 9235719 - DNA, 22 bp, Homo sapiens
tggcagcttcctgctcatagga

SEQ ID NO: 9235720 - DNA, 22 bp, Homo sapiens
tggcagctgttaatgttttgtt

SEQ ID NO: 9235721 - DNA, 23 bp, Homo sapiens
tggccaggcataaaggtgggtgg

SEQ ID NO: 9235722 - DNA, 23 bp, Homo sapiens
tggccaggcataaaggtgggtgg

SEQ ID NO: 9235723 - DNA, 22 bp, Homo sapiens
tggccaggcattcagataagac

SEQ ID NO: 9235724 - DNA, 22 bp, Homo sapiens
tggccaggcaggtagaacggcc

SEQ ID NO: 9235725 - DNA, 22 bp, Homo sapiens
tggccaggcaggtagaacggcc

SEQ ID NO: 9235726 - DNA, 22 bp, Homo sapiens
cctagtcttccgcgtccccacc

SEQ ID NO: 9235727 - DNA, 21 bp, Homo sapiens
cctagtgttaaaacagtttaa

SEQ ID NO: 9235728 - DNA, 22 bp, Homo sapiens
cctagtcttccgcgtccccacc

SEQ ID NO: 9235729 - DNA, 20 bp, Homo sapiens
cctagttttctgagcgtgac

SEQ ID NO: 9235730 - DNA, 22 bp, Homo sapiens
cctagttttcattcagcagcct

SEQ ID NO: 9235731 - DNA, 22 bp, Homo sapiens
cctaggctaattcagtccagta

SEQ ID NO: 9235732 - DNA, 22 bp, Homo sapiens
cctagggagcctgagagcagtg

SEQ ID NO: 9235733 - DNA, 18 bp, Homo sapiens
tggcaagtaatgacaaaa

SEQ ID NO: 9235734 - DNA, 22 bp, Homo sapiens
tggcaaggctgtgggggcagag

SEQ ID NO: 9235735 - DNA, 22 bp, Homo sapiens
tggcaaggccacaggtgcagtt

SEQ ID NO: 9235736 - DNA, 22 bp, Homo sapiens
tggcacaggagcactgccctgg

SEQ ID NO: 9235737 - DNA, 22 bp, Homo sapiens
tggcacaggatctcagcggcca

SEQ ID NO: 9235738 - DNA, 22 bp, Homo sapiens
tggcacagtcctgggtgcctgc

SEQ ID NO: 9235739 - DNA, 22 bp, Homo sapiens
tggcacagggcttggtcgctca

SEQ ID NO: 9235740 - DNA, 22 bp, Homo sapiens
tggcagctggagggcaatggcc

SEQ ID NO: 9235741 - DNA, 22 bp, Homo sapiens
tggcagctggagggcaatggcc

SEQ ID NO: 9235742 - DNA, 22 bp, Homo sapiens
tggcagcaatttgtgatgttga

SEQ ID NO: 9235743 - DNA, 22 bp, Homo sapiens
tggcagaggtatattgggagga

SEQ ID NO: 9235744 - DNA, 22 bp, Homo sapiens
tggcagcaaaaccagaatcaga

SEQ ID NO: 9235745 - DNA, 17 bp, Homo sapiens
ccctggctctaggtgga

SEQ ID NO: 9235746 - DNA, 22 bp, Homo sapiens
ccctggctgataccggaaaggc

SEQ ID NO: 9235747 - DNA, 22 bp, Homo sapiens
tggagctgagcacctccagggc

SEQ ID NO: 9235748 - DNA, 18 bp, Homo sapiens
tggagctgagggcaatgc

SEQ ID NO: 9235749 - DNA, 18 bp, Homo sapiens
tggagctgagggcaatgc

SEQ ID NO: 9235750 - DNA, 22 bp, Homo sapiens
tggagctgagcacctccagggc

SEQ ID NO: 9235751 - DNA, 22 bp, Homo sapiens
tggcaaggaagagcctggtgca

SEQ ID NO: 9235752 - DNA, 17 bp, Homo sapiens
tggcaagacagctcagg

SEQ ID NO: 9235753 - DNA, 17 bp, Homo sapiens
tggcaagaatggaaatg

SEQ ID NO: 9235754 - DNA, 22 bp, Homo sapiens
tggcaagagggatgcaaggttt

SEQ ID NO: 9235755 - DNA, 22 bp, Homo sapiens
tggatgcctgggcctccttcca

SEQ ID NO: 9235756 - DNA, 22 bp, Homo sapiens
tggatgagttcaatgaggcaga

SEQ ID NO: 9235757 - DNA, 22 bp, Homo sapiens
tggcaagaatattggaccagaa

SEQ ID NO: 9235758 - DNA, 22 bp, Homo sapiens
tggcaagaatattggaccagaa

SEQ ID NO: 9235759 - DNA, 22 bp, Homo sapiens
tggatctcggcaatgcgggact

SEQ ID NO: 9235760 - DNA, 22 bp, Homo sapiens
tggatctcggcaatgcgggact

SEQ ID NO: 9235761 - DNA, 22 bp, Homo sapiens
tggatcctgcactgagtggagt

SEQ ID NO: 9235762 - DNA, 22 bp, Homo sapiens
tggatcatcttaagaagtgatt

SEQ ID NO: 9235763 - DNA, 22 bp, Homo sapiens
tggatcatgtgatgtcaggagt

SEQ ID NO: 9235764 - DNA, 22 bp, Homo sapiens
tggatgagattaaagtgaggtt

SEQ ID NO: 9235765 - DNA, 22 bp, Homo sapiens
tggatgagggctgagcactggg

SEQ ID NO: 9235766 - DNA, 22 bp, Homo sapiens
ccctggagcatctctgctgtct

SEQ ID NO: 9235767 - DNA, 22 bp, Homo sapiens
ccctggagctagtctgagcaga

SEQ ID NO: 9235768 - DNA, 22 bp, Homo sapiens
ccctggagatcgggagaggaag

SEQ ID NO: 9235769 - DNA, 20 bp, Homo sapiens
ccctggagagaagctccacg

SEQ ID NO: 9235770 - DNA, 20 bp, Homo sapiens
ccctggagagaagctccacg

SEQ ID NO: 9235771 - DNA, 22 bp, Homo sapiens
tggagctgagagccaggctggc

SEQ ID NO: 9235772 - DNA, 22 bp, Homo sapiens
tggagctgagagccaggctggc

SEQ ID NO: 9235773 - DNA, 22 bp, Homo sapiens
tggagctgagaagtggagctct

SEQ ID NO: 9235774 - DNA, 22 bp, Homo sapiens
tggagctgagaagtggagctct

SEQ ID NO: 9235775 - DNA, 22 bp, Homo sapiens
tggagctgagagccaggctggc

SEQ ID NO: 9235776 - DNA, 22 bp, Homo sapiens
tggagctgagaagtggagctct

SEQ ID NO: 9235777 - DNA, 22 bp, Homo sapiens
tggagctgagaagtggagctct

SEQ ID NO: 9235778 - DNA, 23 bp, Homo sapiens
tggagctgacagtcagagggagg

SEQ ID NO: 9235779 - DNA, 23 bp, Homo sapiens
tggagctgacagtcagagggagg

SEQ ID NO: 9235780 - DNA, 22 bp, Homo sapiens
tggagctgactcacaccagcta

SEQ ID NO: 9235781 - DNA, 22 bp, Homo sapiens
ccctccagagcttgacctgctg

SEQ ID NO: 9235782 - DNA, 22 bp, Homo sapiens
ccctccagccatggacccaggt

SEQ ID NO: 9235783 - DNA, 22 bp, Homo sapiens
ccctccagccatggacccaggt

SEQ ID NO: 9235784 - DNA, 20 bp, Homo sapiens
ccctccagcaaccaggactt

SEQ ID NO: 9235785 - DNA, 22 bp, Homo sapiens
ccctccagagcctggacattct

SEQ ID NO: 9235786 - DNA, 20 bp, Homo sapiens
ccctccagcaaccaggactt

SEQ ID NO: 9235787 - DNA, 22 bp, Homo sapiens
ccctccagagcttgacctgctg

SEQ ID NO: 9235788 - DNA, 22 bp, Homo sapiens
ccctccagagcttgacctgctg

SEQ ID NO: 9235789 - DNA, 22 bp, Homo sapiens
ccctcaggtgaaaggaaaaatt

SEQ ID NO: 9235790 - DNA, 22 bp, Homo sapiens
ccctcatgccagacagcatgca

SEQ ID NO: 9235791 - DNA, 22 bp, Homo sapiens
ccctccacagacaggacttgtc

SEQ ID NO: 9235792 - DNA, 22 bp, Homo sapiens
ccctccagggagccatgctggg

SEQ ID NO: 9235793 - DNA, 22 bp, Homo sapiens
ccctccagggagccatgctggg

SEQ ID NO: 9235794 - DNA, 22 bp, Homo sapiens
ccctccagctcaaagcaaccgg

SEQ ID NO: 9235795 - DNA, 22 bp, Homo sapiens
ccctccagctcaaagcaaccgg

SEQ ID NO: 9235796 - DNA, 22 bp, Homo sapiens
ccctccagctcaaagcaaccgg

SEQ ID NO: 9235797 - DNA, 22 bp, Homo sapiens
ccctccaggcactgccctcttc

SEQ ID NO: 9235798 - DNA, 22 bp, Homo sapiens
ccctccaggcctgtcatgttcc

SEQ ID NO: 9235799 - DNA, 22 bp, Homo sapiens
ccctccaggcctgtcatgttcc

SEQ ID NO: 9235800 - DNA, 22 bp, Homo sapiens
ccctccaggcactgccctcttc

SEQ ID NO: 9235801 - DNA, 22 bp, Homo sapiens
ccctccaggcactgccctcttc

SEQ ID NO: 9235802 - DNA, 22 bp, Homo sapiens
cctccagcattactggcccatg

SEQ ID NO: 9235803 - DNA, 20 bp, Homo sapiens
cctccactgtcactgacctg

SEQ ID NO: 9235804 - DNA, 22 bp, Homo sapiens
cctccactctggcctctcaggt

SEQ ID NO: 9235805 - DNA, 22 bp, Homo sapiens
cctccactgcttcccagctttg

SEQ ID NO: 9235806 - DNA, 22 bp, Homo sapiens
cctccaagtttgactcaggaca

SEQ ID NO: 9235807 - DNA, 22 bp, Homo sapiens
cctccagccttcctgaagagcc

SEQ ID NO: 9235808 - DNA, 22 bp, Homo sapiens
cctccagcgcgatccactccgg

SEQ ID NO: 9235809 - DNA, 22 bp, Homo sapiens
cctccagcgcgatccactccgg

SEQ ID NO: 9235810 - DNA, 22 bp, Homo sapiens
cctccagcgcgatccactccgg

SEQ ID NO: 9235811 - DNA, 22 bp, Homo sapiens
tggctgagagcaattgactctg

SEQ ID NO: 9235812 - DNA, 22 bp, Homo sapiens
tggctgagagcaattgactctg

SEQ ID NO: 9235813 - DNA, 22 bp, Homo sapiens
tggctgagggggcagttcagga

SEQ ID NO: 9235814 - DNA, 22 bp, Homo sapiens
tggctgagggggcagttcagga

SEQ ID NO: 9235815 - DNA, 22 bp, Homo sapiens
tggctgagggggcagttcagga

SEQ ID NO: 9235816 - DNA, 22 bp, Homo sapiens
tggctgaggtaactatgaataa

SEQ ID NO: 9235817 - DNA, 22 bp, Homo sapiens
tggctgaggtaactatgaataa

SEQ ID NO: 9235818 - DNA, 22 bp, Homo sapiens
tggctgagggggctctgctcag

SEQ ID NO: 9235819 - DNA, 22 bp, Homo sapiens
tggctgagggggctctgctcag

SEQ ID NO: 9235820 - DNA, 22 bp, Homo sapiens
tggctgagggggctctgctcag

SEQ ID NO: 9235821 - DNA, 22 bp, Homo sapiens
tggctgagggggctctgctcag

SEQ ID NO: 9235822 - DNA, 22 bp, Homo sapiens
tggctgagggggcagttcagga

SEQ ID NO: 9235823 - DNA, 22 bp, Homo sapiens
tggctgaggtctggggcttctg

SEQ ID NO: 9235824 - DNA, 23 bp, Homo sapiens
tggctgaggtccaggtagtttca

SEQ ID NO: 9235825 - DNA, 23 bp, Homo sapiens
tggctgaggtccaggtagtttca

SEQ ID NO: 9235826 - DNA, 23 bp, Homo sapiens
tggctgaggtccaggtagtttca

SEQ ID NO: 9235827 - DNA, 23 bp, Homo sapiens
tggctgaggtccaggtagtttca

SEQ ID NO: 9235828 - DNA, 22 bp, Homo sapiens
tggctgaggtaactatgaataa

SEQ ID NO: 9235829 - DNA, 22 bp, Homo sapiens
cctccctgtctacctgttgtgg

SEQ ID NO: 9235830 - DNA, 22 bp, Homo sapiens
cctcccttttggtgtctgcata

SEQ ID NO: 9235831 - DNA, 22 bp, Homo sapiens
cctccctggccagagcagcagc

SEQ ID NO: 9235832 - DNA, 22 bp, Homo sapiens
cctccctggccagagcagcagc

SEQ ID NO: 9235833 - DNA, 22 bp, Homo sapiens
cctccctgggtgctgggattgc

SEQ ID NO: 9235834 - DNA, 22 bp, Homo sapiens
cctccctgggtgacgggctcct

SEQ ID NO: 9235835 - DNA, 22 bp, Homo sapiens
cctccctggtggctctggtcta

SEQ ID NO: 9235836 - DNA, 22 bp, Homo sapiens
cctcggctgggccttggccact

SEQ ID NO: 9235837 - DNA, 22 bp, Homo sapiens
cctcctggtccagcatctcttt

SEQ ID NO: 9235838 - DNA, 22 bp, Homo sapiens
cctcctggtccagcatctcttt

SEQ ID NO: 9235839 - DNA, 22 bp, Homo sapiens
tggccctgctgtatcatctgct

SEQ ID NO: 9235840 - DNA, 22 bp, Homo sapiens
tggccctgctgggtcagagctg

SEQ ID NO: 9235841 - DNA, 22 bp, Homo sapiens
tggccctgctgggtcagagctg

SEQ ID NO: 9235842 - DNA, 21 bp, Homo sapiens
tggctcagttgctgggcacag

SEQ ID NO: 9235843 - DNA, 22 bp, Homo sapiens
tggctcagtttagcagctcagt

SEQ ID NO: 9235844 - DNA, 22 bp, Homo sapiens
tggccctgcttatgtctctctt

SEQ ID NO: 9235845 - DNA, 22 bp, Homo sapiens
tggctcagctgactcggcttct

SEQ ID NO: 9235846 - DNA, 22 bp, Homo sapiens
tggctcagtttgggggattgaa

SEQ ID NO: 9235847 - DNA, 22 bp, Homo sapiens
tggctcatattgagtgatttct

SEQ ID NO: 9235848 - DNA, 22 bp, Homo sapiens
tggctcatgcatcttttctaca

SEQ ID NO: 9235849 - DNA, 22 bp, Homo sapiens
tggctcatctttttagacttat

SEQ ID NO: 9235850 - DNA, 22 bp, Homo sapiens
tggctcatctatcagaaagtcc

SEQ ID NO: 9235851 - DNA, 22 bp, Homo sapiens
tggctcagtttagcagctcagt

SEQ ID NO: 9235852 - DNA, 22 bp, Homo sapiens
tggctcagtttcagtcctggtt

SEQ ID NO: 9235853 - DNA, 22 bp, Homo sapiens
tggctcagtttcagtcctggtt

SEQ ID NO: 9235854 - DNA, 22 bp, Homo sapiens
tggctcagtttcagtcctggtt

SEQ ID NO: 9235855 - DNA, 20 bp, Homo sapiens
tggcccagtggggcagggtg

SEQ ID NO: 9235856 - DNA, 22 bp, Homo sapiens
tggccccatcaagggatgagtt

SEQ ID NO: 9235857 - DNA, 22 bp, Homo sapiens
tggcccagtgcttatgctctga

SEQ ID NO: 9235858 - DNA, 22 bp, Homo sapiens
tggccctgctggccaaaggcta

SEQ ID NO: 9235859 - DNA, 22 bp, Homo sapiens
tggcccgaagatccgagggtca

SEQ ID NO: 9235860 - DNA, 22 bp, Homo sapiens
cctctatagatgtgtgcatcta

SEQ ID NO: 9235861 - DNA, 22 bp, Homo sapiens
cctctatgtacacatttccagc

SEQ ID NO: 9235862 - DNA, 22 bp, Homo sapiens
cctctacagggcatagcccaaa

SEQ ID NO: 9235863 - DNA, 22 bp, Homo sapiens
cctctcagcgattcctcttgga

SEQ ID NO: 9235864 - DNA, 22 bp, Homo sapiens
cctctcatagtctgtatccttt

SEQ ID NO: 9235865 - DNA, 22 bp, Homo sapiens
cctctcagcgattcctcttgga

SEQ ID NO: 9235866 - DNA, 22 bp, Homo sapiens
cctctcagccggactgtcaggc

SEQ ID NO: 9235867 - DNA, 22 bp, Homo sapiens
cctctcatagtctgtatccttt

SEQ ID NO: 9235868 - DNA, 22 bp, Homo sapiens
cctctcatcattatcgctttgt

SEQ ID NO: 9235869 - DNA, 22 bp, Homo sapiens
tggctgccgactggctcttggc

SEQ ID NO: 9235870 - DNA, 21 bp, Homo sapiens
tggctgcctacatgctgcagg

SEQ ID NO: 9235871 - DNA, 22 bp, Homo sapiens
tggctgccctcatgggcctgat

SEQ ID NO: 9235872 - DNA, 21 bp, Homo sapiens
tggctgcctacatgctgcagg

SEQ ID NO: 9235873 - DNA, 22 bp, Homo sapiens
tggctgcctagtccctcagcct

SEQ ID NO: 9235874 - DNA, 21 bp, Homo sapiens
tggctgcctacatgctgcagg

SEQ ID NO: 9235875 - DNA, 19 bp, Homo sapiens
cctctccgcccaccagccc

SEQ ID NO: 9235876 - DNA, 22 bp, Homo sapiens
tggctgccttccctgctggagg

SEQ ID NO: 9235877 - DNA, 22 bp, Homo sapiens
tggctgcctttcacctcatctc

SEQ ID NO: 9235878 - DNA, 20 bp, Homo sapiens
cctctctgaagaggtcatct

SEQ ID NO: 9235879 - DNA, 20 bp, Homo sapiens
cctctctgaagaggtcatct

SEQ ID NO: 9235880 - DNA, 20 bp, Homo sapiens
cctctctgcatgctccctga

SEQ ID NO: 9235881 - DNA, 20 bp, Homo sapiens
cctctctgcatgctccctga

SEQ ID NO: 9235882 - DNA, 20 bp, Homo sapiens
cctctctgccctgcaaggcc

SEQ ID NO: 9235883 - DNA, 16 bp, Homo sapiens
cctctcttattcctcc

SEQ ID NO: 9235884 - DNA, 22 bp, Homo sapiens
cctctctgtgtggcctctccat

SEQ ID NO: 9235885 - DNA, 22 bp, Homo sapiens
cctctctgtgtggcctctccat

SEQ ID NO: 9235886 - DNA, 22 bp, Homo sapiens
cctctctgtaagggtccctccc

SEQ ID NO: 9235887 - DNA, 22 bp, Homo sapiens
cctctctgtaagggtccctccc

SEQ ID NO: 9235888 - DNA, 22 bp, Homo sapiens
cctctctgtagcagcccccagt

SEQ ID NO: 9235889 - DNA, 22 bp, Homo sapiens
cctctgagaccagctctgcacc

SEQ ID NO: 9235890 - DNA, 22 bp, Homo sapiens
cctctgagagaaggccttcagc

SEQ ID NO: 9235891 - DNA, 22 bp, Homo sapiens
cctctcttggccgcagtcttct

SEQ ID NO: 9235892 - DNA, 22 bp, Homo sapiens
cctctgaggtgagcccagctgg

SEQ ID NO: 9235893 - DNA, 22 bp, Homo sapiens
cctctggctgtaccactggcac

SEQ ID NO: 9235894 - DNA, 22 bp, Homo sapiens
cctctgaggtcatggacttggc

SEQ ID NO: 9235895 - DNA, 22 bp, Homo sapiens
cctctgggggcttccttaccct

SEQ ID NO: 9235896 - DNA, 22 bp, Homo sapiens
cctctgggtatctgtggaagta

SEQ ID NO: 9235897 - DNA, 22 bp, Homo sapiens
cctctgggtgacagactcttgg

SEQ ID NO: 9235898 - DNA, 22 bp, Homo sapiens
cctctggggtgagtgggccact

SEQ ID NO: 9235899 - DNA, 22 bp, Homo sapiens
cctgggcatcaacaagcagaga

SEQ ID NO: 9235900 - DNA, 22 bp, Homo sapiens
cctgggcaatatagtgaggccc

SEQ ID NO: 9235901 - DNA, 19 bp, Homo sapiens
cctgggaggcggaggttgc

SEQ ID NO: 9235902 - DNA, 19 bp, Homo sapiens
cctgggaggcggaggttgc

SEQ ID NO: 9235903 - DNA, 22 bp, Homo sapiens
cctgggcctatcctagaaccaa

SEQ ID NO: 9235904 - DNA, 22 bp, Homo sapiens
cctgggcatctcatgcacctgc

SEQ ID NO: 9235905 - DNA, 22 bp, Homo sapiens
cctgggcatctcatgcacctgc

SEQ ID NO: 9235906 - DNA, 23 bp, Homo sapiens
cctgggcattggctgcagcttct

SEQ ID NO: 9235907 - DNA, 22 bp, Homo sapiens
tgtgtgggtggtaaggaaggcc

SEQ ID NO: 9235908 - DNA, 22 bp, Homo sapiens
tgtgtgggcgaagacagccttt

SEQ ID NO: 9235909 - DNA, 22 bp, Homo sapiens
tgtgggggtacacgtacacatg

SEQ ID NO: 9235910 - DNA, 22 bp, Homo sapiens
tgtgggggtacacgtacacatg

SEQ ID NO: 9235911 - DNA, 22 bp, Homo sapiens
tgtggggctgtggtgttcttct

SEQ ID NO: 9235912 - DNA, 22 bp, Homo sapiens
tgtggggcttacaaaggcagat

SEQ ID NO: 9235913 - DNA, 22 bp, Homo sapiens
tgtggggcttacaaaggcagat

SEQ ID NO: 9235914 - DNA, 22 bp, Homo sapiens
tgtggggctccctggcagcctg

SEQ ID NO: 9235915 - DNA, 17 bp, Homo sapiens
cctgggaggagttatga

SEQ ID NO: 9235916 - DNA, 17 bp, Homo sapiens
tgtggctttgactggga

SEQ ID NO: 9235917 - DNA, 22 bp, Homo sapiens
tgtggcttttgctagctttgca

SEQ ID NO: 9235918 - DNA, 22 bp, Homo sapiens
cctgggagctgtggaaaggctg

SEQ ID NO: 9235919 - DNA, 22 bp, Homo sapiens
tgtgggaaatgggagtggaaga

SEQ ID NO: 9235920 - DNA, 22 bp, Homo sapiens
tgtggctgtgtccacctgctgc

SEQ ID NO: 9235921 - DNA, 22 bp, Homo sapiens
tgtggcagggatactgaggcag

SEQ ID NO: 9235922 - DNA, 21 bp, Homo sapiens
tgtggctgcctctggccctgg

SEQ ID NO: 9235923 - DNA, 22 bp, Homo sapiens
tgtggcaggcattctgaggctg

SEQ ID NO: 9235924 - DNA, 22 bp, Homo sapiens
tgtggcaggcattctgaggctg

SEQ ID NO: 9235925 - DNA, 22 bp, Homo sapiens
tgtggcagggatactgaggcag

SEQ ID NO: 9235926 - DNA, 22 bp, Homo sapiens
tgtggcaggcaagatgtacaga

SEQ ID NO: 9235927 - DNA, 22 bp, Homo sapiens
tgtggcaggaagagcttctgag

SEQ ID NO: 9235928 - DNA, 22 bp, Homo sapiens
tgtggcaggaagagcttctgag

SEQ ID NO: 9235929 - DNA, 20 bp, Homo sapiens
tgtggcaggatgagggcgga

SEQ ID NO: 9235930 - DNA, 22 bp, Homo sapiens
tgtggcagctggaggtggagaa

SEQ ID NO: 9235931 - DNA, 22 bp, Homo sapiens
tgtggcagctggaggtggagaa

SEQ ID NO: 9235932 - DNA, 22 bp, Homo sapiens
tgtggcagctggaggtggagaa

SEQ ID NO: 9235933 - DNA, 22 bp, Homo sapiens
tgtgctttcaaagttaagtaaa

SEQ ID NO: 9235934 - DNA, 22 bp, Homo sapiens
tgtgcttttctctgctcctgga

SEQ ID NO: 9235935 - DNA, 20 bp, Homo sapiens
tgtggaaaaacagaagcaga

SEQ ID NO: 9235936 - DNA, 22 bp, Homo sapiens
cctgggtcccagccaggctttg

SEQ ID NO: 9235937 - DNA, 22 bp, Homo sapiens
cctgggtcttggttcatgctct

SEQ ID NO: 9235938 - DNA, 22 bp, Homo sapiens
cctgggtcttggttcatgctct

SEQ ID NO: 9235939 - DNA, 22 bp, Homo sapiens
cctgggtgacccgtgagcgtcc

SEQ ID NO: 9235940 - DNA, 22 bp, Homo sapiens
cctgggtgatgtgctgccctcg

SEQ ID NO: 9235941 - DNA, 22 bp, Homo sapiens
cctgggtgacccgtgagcgtcc

SEQ ID NO: 9235942 - DNA, 22 bp, Homo sapiens
cctgggtgacagagtgagacct

SEQ ID NO: 9235943 - DNA, 22 bp, Homo sapiens
cctgggtgacagagtgagacct

SEQ ID NO: 9235944 - DNA, 22 bp, Homo sapiens
cctgggtgaaatagtcctcaag

SEQ ID NO: 9235945 - DNA, 22 bp, Homo sapiens
cctgggtgaaatagtcctcaag

SEQ ID NO: 9235946 - DNA, 22 bp, Homo sapiens
cctgggtgaaatctctcctgca

SEQ ID NO: 9235947 - DNA, 22 bp, Homo sapiens
cctgggtgaaatctctcctgca

SEQ ID NO: 9235948 - DNA, 22 bp, Homo sapiens
cctggggaatcttgcaggggaa

SEQ ID NO: 9235949 - DNA, 22 bp, Homo sapiens
cctggggacctgcctcagccct

SEQ ID NO: 9235950 - DNA, 22 bp, Homo sapiens
cctggggacctgcctcagccct

SEQ ID NO: 9235951 - DNA, 22 bp, Homo sapiens
cctggggagaagagcttccccc

SEQ ID NO: 9235952 - DNA, 23 bp, Homo sapiens
tgtgttcagtcaaggatcagagt

SEQ ID NO: 9235953 - DNA, 22 bp, Homo sapiens
tgtgttcatctttaaagggaag

SEQ ID NO: 9235954 - DNA, 22 bp, Homo sapiens
tgtgttcaccctagcacttaac

SEQ ID NO: 9235955 - DNA, 22 bp, Homo sapiens
tgtgttcagtatgacattcaca

SEQ ID NO: 9235956 - DNA, 19 bp, Homo sapiens
cctgggtccactcagacta

SEQ ID NO: 9235957 - DNA, 19 bp, Homo sapiens
cctgggtccactcagacta

SEQ ID NO: 9235958 - DNA, 22 bp, Homo sapiens
tgtgttctatggttcagggtgg

SEQ ID NO: 9235959 - DNA, 23 bp, Homo sapiens
tgtgttctcacacagatgcagta

SEQ ID NO: 9235960 - DNA, 23 bp, Homo sapiens
tgtgttctcacacagatgcagta

SEQ ID NO: 9235961 - DNA, 22 bp, Homo sapiens
tgtgttcatgtatgtatacata

SEQ ID NO: 9235962 - DNA, 19 bp, Homo sapiens
tgtgttcattcatcagagg

SEQ ID NO: 9235963 - DNA, 22 bp, Homo sapiens
tgtgttcatttaactgttcttt

SEQ ID NO: 9235964 - DNA, 20 bp, Homo sapiens
cctgggctcaaagcatcctc

SEQ ID NO: 9235965 - DNA, 22 bp, Homo sapiens
cctgggcttccacgagcagagg

SEQ ID NO: 9235966 - DNA, 22 bp, Homo sapiens
cctgggctcaagcgatcttgtc

SEQ ID NO: 9235967 - DNA, 22 bp, Homo sapiens
cctggggaagtcacttctcttt

SEQ ID NO: 9235968 - DNA, 22 bp, Homo sapiens
cctgggctttgctggcaaggcc

SEQ ID NO: 9235969 - DNA, 22 bp, Homo sapiens
cctggggaatagagtcaagggg

SEQ ID NO: 9235970 - DNA, 22 bp, Homo sapiens
cctggggaatagagtcaagggg

SEQ ID NO: 9235971 - DNA, 22 bp, Homo sapiens
cctggggaatagagtcaagggg

SEQ ID NO: 9235972 - DNA, 22 bp, Homo sapiens
cctgggcctctcaaagtgctgg

SEQ ID NO: 9235973 - DNA, 22 bp, Homo sapiens
tgtgtgtataataatgtctgca

SEQ ID NO: 9235974 - DNA, 22 bp, Homo sapiens
tgtgtgtataataatgtctgca

SEQ ID NO: 9235975 - DNA, 22 bp, Homo sapiens
tgtgtgggtggtaaggaaggcc

SEQ ID NO: 9235976 - DNA, 22 bp, Homo sapiens
tgtctttacttaataaatatac

SEQ ID NO: 9235977 - DNA, 22 bp, Homo sapiens
tgtctttacttagaagttcagg

SEQ ID NO: 9235978 - DNA, 22 bp, Homo sapiens
tgtctttagaaagaagcagaca

SEQ ID NO: 9235979 - DNA, 21 bp, Homo sapiens
tgtctttaggacctgttaaat

SEQ ID NO: 9235980 - DNA, 22 bp, Homo sapiens
tgtctttagcccatatagactt

SEQ ID NO: 9235981 - DNA, 22 bp, Homo sapiens
tgtctggtgggttgacaggcag

SEQ ID NO: 9235982 - DNA, 22 bp, Homo sapiens
tgtctggtgggttgacaggcag

SEQ ID NO: 9235983 - DNA, 22 bp, Homo sapiens
tgtctggtgggttgacaggcag

SEQ ID NO: 9235984 - DNA, 21 bp, Homo sapiens
cctggctgcacagttgctggt

SEQ ID NO: 9235985 - DNA, 22 bp, Homo sapiens
tgtctggggaactgtgcatcca

SEQ ID NO: 9235986 - DNA, 21 bp, Homo sapiens
cctggctgcacagttgctggt

SEQ ID NO: 9235987 - DNA, 22 bp, Homo sapiens
tgtctggtgggttgacaggcag

SEQ ID NO: 9235988 - DNA, 22 bp, Homo sapiens
cctggctgagggacctcgggta

SEQ ID NO: 9235989 - DNA, 22 bp, Homo sapiens
cctggctgaacaaagtccctcc

SEQ ID NO: 9235990 - DNA, 19 bp, Homo sapiens
cctggctctgagcccagcc

SEQ ID NO: 9235991 - DNA, 22 bp, Homo sapiens
tgtgagcttaggacagggctat

SEQ ID NO: 9235992 - DNA, 23 bp, Homo sapiens
tgtgaaggtgggtccaagggctg

SEQ ID NO: 9235993 - DNA, 22 bp, Homo sapiens
tgtgagcagagacatgaaaagc

SEQ ID NO: 9235994 - DNA, 22 bp, Homo sapiens
tgtgaggcgaggccagtgagct

SEQ ID NO: 9235995 - DNA, 22 bp, Homo sapiens
tgtgaggcctctgcaggagcag

SEQ ID NO: 9235996 - DNA, 22 bp, Homo sapiens
tgtgaggcctagacagcctggg

SEQ ID NO: 9235997 - DNA, 22 bp, Homo sapiens
tgtgaggctacctgccagggtc

SEQ ID NO: 9235998 - DNA, 22 bp, Homo sapiens
tgtctttctgcaccacctcaca

SEQ ID NO: 9235999 - DNA, 22 bp, Homo sapiens
tgtctttctgcaccacctcaca

SEQ ID NO: 9236000 - DNA, 22 bp, Homo sapiens
tgtctttctgacccaaggtagt

SEQ ID NO: 9236001 - DNA, 22 bp, Homo sapiens
tgtctttagttttactgtctgg

SEQ ID NO: 9236002 - DNA, 22 bp, Homo sapiens
tgtgaactctggaacaaaacta

SEQ ID NO: 9236003 - DNA, 22 bp, Homo sapiens
tgtgaagagagtaataaagtca

SEQ ID NO: 9236004 - DNA, 22 bp, Homo sapiens
tgtgaagaattaatgtgaatca

SEQ ID NO: 9236005 - DNA, 22 bp, Homo sapiens
tgtgaagctggatcctggagct

SEQ ID NO: 9236006 - DNA, 22 bp, Homo sapiens
tgtgaagatttggcatgcagaa

SEQ ID NO: 9236007 - DNA, 22 bp, Homo sapiens
tgtgaagattaagttactgggc

SEQ ID NO: 9236008 - DNA, 22 bp, Homo sapiens
tgtgaagatcagggtcctagag

SEQ ID NO: 9236009 - DNA, 22 bp, Homo sapiens
tgtgaagagtagacatgtggtg

SEQ ID NO: 9236010 - DNA, 22 bp, Homo sapiens
tgtgaagatagctgttacatct

SEQ ID NO: 9236011 - DNA, 22 bp, Homo sapiens
tgtgaaggcagagccagtgaaa

SEQ ID NO: 9236012 - DNA, 22 bp, Homo sapiens
tgtgaaggagcatgcagagggg

SEQ ID NO: 9236013 - DNA, 22 bp, Homo sapiens
tgtgaaggagcatgcagagggg

SEQ ID NO: 9236014 - DNA, 22 bp, Homo sapiens
tgtgaaggagatgaagggagtg

SEQ ID NO: 9236015 - DNA, 22 bp, Homo sapiens
tgtgaaggagatgaagggagtg

SEQ ID NO: 9236016 - DNA, 23 bp, Homo sapiens
tgtgaaggtgggtccaagggctg

SEQ ID NO: 9236017 - DNA, 22 bp, Homo sapiens
tgtgaaggtaaggaggggcaag

SEQ ID NO: 9236018 - DNA, 22 bp, Homo sapiens
cctgggagccgactgactgtgc

SEQ ID NO: 9236019 - DNA, 22 bp, Homo sapiens
cctgggagctgtggaaaggctg

SEQ ID NO: 9236020 - DNA, 22 bp, Homo sapiens
cctgggagccgactgactgtgc

SEQ ID NO: 9236021 - DNA, 22 bp, Homo sapiens
tgtgccagaaaatatgctgagg

SEQ ID NO: 9236022 - DNA, 22 bp, Homo sapiens
tgtgccagcctctggctgtgtc

SEQ ID NO: 9236023 - DNA, 22 bp, Homo sapiens
tgtgccaggcacttgcccaggc

SEQ ID NO: 9236024 - DNA, 21 bp, Homo sapiens
cctgggagatcagctgccttc

SEQ ID NO: 9236025 - DNA, 21 bp, Homo sapiens
cctgggagatcagctgccttc

SEQ ID NO: 9236026 - DNA, 21 bp, Homo sapiens
cctgggagatcagctgccttc

SEQ ID NO: 9236027 - DNA, 22 bp, Homo sapiens
cctgggagccaagcctctgtgt

SEQ ID NO: 9236028 - DNA, 22 bp, Homo sapiens
cctgggagccaagcctctgtgt

SEQ ID NO: 9236029 - DNA, 22 bp, Homo sapiens
cctgggagccaagcctctgtgt

SEQ ID NO: 9236030 - DNA, 22 bp, Homo sapiens
cctgggagagccatctgtggcc

SEQ ID NO: 9236031 - DNA, 20 bp, Homo sapiens
cctgggaaggcagccccagc

SEQ ID NO: 9236032 - DNA, 22 bp, Homo sapiens
cctgggaagagctgacaggagg

SEQ ID NO: 9236033 - DNA, 22 bp, Homo sapiens
cctgggagagtctgtggtctcc

SEQ ID NO: 9236034 - DNA, 22 bp, Homo sapiens
cctgggagagtctgtggtctcc

SEQ ID NO: 9236035 - DNA, 22 bp, Homo sapiens
cctgggagagtctgtggtctcc

SEQ ID NO: 9236036 - DNA, 22 bp, Homo sapiens
cctgggagagtctgtggtctcc

SEQ ID NO: 9236037 - DNA, 22 bp, Homo sapiens
tgtgcccatccctctggagtgt

SEQ ID NO: 9236038 - DNA, 22 bp, Homo sapiens
tgtgcccatccctctggagtgt

SEQ ID NO: 9236039 - DNA, 22 bp, Homo sapiens
tgtgcccatctcccagcttgac

SEQ ID NO: 9236040 - DNA, 22 bp, Homo sapiens
tgtgcccattacacagaggcat

SEQ ID NO: 9236041 - DNA, 22 bp, Homo sapiens
tgtgcccagactgcctcagtga

SEQ ID NO: 9236042 - DNA, 20 bp, Homo sapiens
tgtgcccaatgtccaggttc

SEQ ID NO: 9236043 - DNA, 22 bp, Homo sapiens
tgtgcttcttgcagctcctgta

SEQ ID NO: 9236044 - DNA, 22 bp, Homo sapiens
tgtgcttctgcagagactattt

SEQ ID NO: 9236045 - DNA, 22 bp, Homo sapiens
tgtgcttctgcagagactattt

SEQ ID NO: 9236046 - DNA, 22 bp, Homo sapiens
tgtgcttctcacatcactgttg

SEQ ID NO: 9236047 - DNA, 22 bp, Homo sapiens
tgtgcttcatcacttctcagtt

SEQ ID NO: 9236048 - DNA, 22 bp, Homo sapiens
tgtgcttctcacatcactgttg

SEQ ID NO: 9236049 - DNA, 22 bp, Homo sapiens
tgtgcccattacacagaggcat

SEQ ID NO: 9236050 - DNA, 22 bp, Homo sapiens
cctggctgtggcggtgctctca

SEQ ID NO: 9236051 - DNA, 23 bp, Homo sapiens
cctggctgtggatttgggcctgc

SEQ ID NO: 9236052 - DNA, 22 bp, Homo sapiens
cctggctgtgcattgccggccc

SEQ ID NO: 9236053 - DNA, 19 bp, Homo sapiens
cctggctgtgaagcctgca

SEQ ID NO: 9236054 - DNA, 22 bp, Homo sapiens
cctggctggttgtctgattcta

SEQ ID NO: 9236055 - DNA, 22 bp, Homo sapiens
cctggctgctgtcactgaccat

SEQ ID NO: 9236056 - DNA, 22 bp, Homo sapiens
cctggctgcattttgctggatg

SEQ ID NO: 9236057 - DNA, 22 bp, Homo sapiens
cctggctgcccatggaccctct

SEQ ID NO: 9236058 - DNA, 20 bp, Homo sapiens
cctggctgcattcaggacgg

SEQ ID NO: 9236059 - DNA, 22 bp, Homo sapiens
cctggctgctatagcagcatgt

SEQ ID NO: 9236060 - DNA, 22 bp, Homo sapiens
cctggctgccgagtgtgcagcg

SEQ ID NO: 9236061 - DNA, 22 bp, Homo sapiens
cctggctgtgtgaccttggcaa

SEQ ID NO: 9236062 - DNA, 18 bp, Homo sapiens
cctggcttttctacttgc

SEQ ID NO: 9236063 - DNA, 22 bp, Homo sapiens
cctgggaagaccggcagtgggg

SEQ ID NO: 9236064 - DNA, 22 bp, Homo sapiens
cctgggaacagtgggttggctc

SEQ ID NO: 9236065 - DNA, 22 bp, Homo sapiens
cctgggaaagtgaggtcattat

SEQ ID NO: 9236066 - DNA, 22 bp, Homo sapiens
cctggcaggcaagaggaaggga

SEQ ID NO: 9236067 - DNA, 22 bp, Homo sapiens
cctggcaggcaagaggaaggga

SEQ ID NO: 9236068 - DNA, 22 bp, Homo sapiens
cctggcaggctggggacagtgc

SEQ ID NO: 9236069 - DNA, 22 bp, Homo sapiens
tgtcattatttgcctactgact

SEQ ID NO: 9236070 - DNA, 22 bp, Homo sapiens
cctggcagactgtgagggcagg

SEQ ID NO: 9236071 - DNA, 22 bp, Homo sapiens
cctggcagactgtgagggcagg

SEQ ID NO: 9236072 - DNA, 23 bp, Homo sapiens
cctggcagcaaacgaggaggtta

SEQ ID NO: 9236073 - DNA, 23 bp, Homo sapiens
cctggcagcaaacgaggaggtta

SEQ ID NO: 9236074 - DNA, 22 bp, Homo sapiens
cctggcagcaggtgggcccgtg

SEQ ID NO: 9236075 - DNA, 22 bp, Homo sapiens
cctggcagcattggtagagatt

SEQ ID NO: 9236076 - DNA, 22 bp, Homo sapiens
tgtccagtgattctcatgagcc

SEQ ID NO: 9236077 - DNA, 22 bp, Homo sapiens
tgtccagtgattctcatgagcc

SEQ ID NO: 9236078 - DNA, 22 bp, Homo sapiens
tgtccatggagaagctcagggc

SEQ ID NO: 9236079 - DNA, 19 bp, Homo sapiens
tgtcccagactccgtgtct

SEQ ID NO: 9236080 - DNA, 22 bp, Homo sapiens
tgtcccagacataagtggacat

SEQ ID NO: 9236081 - DNA, 22 bp, Homo sapiens
tgtcccagacacagtatgcgct

SEQ ID NO: 9236082 - DNA, 22 bp, Homo sapiens
tgtcccagatactggacataga

SEQ ID NO: 9236083 - DNA, 23 bp, Homo sapiens
tgtcccagagggagggataggct

SEQ ID NO: 9236084 - DNA, 22 bp, Homo sapiens
tgtcccagatcacaggagggga

SEQ ID NO: 9236085 - DNA, 22 bp, Homo sapiens
tgtcctcatcctccagtctgtc

SEQ ID NO: 9236086 - DNA, 22 bp, Homo sapiens
tgtcccagcactttgggagtct

SEQ ID NO: 9236087 - DNA, 22 bp, Homo sapiens
cctggccaggcatggagtcaca

SEQ ID NO: 9236088 - DNA, 22 bp, Homo sapiens
cctggccagggtctgggctgct

SEQ ID NO: 9236089 - DNA, 22 bp, Homo sapiens
cctggccagggtctgggctgct

SEQ ID NO: 9236090 - DNA, 22 bp, Homo sapiens
cctggccagccagggctggggt

SEQ ID NO: 9236091 - DNA, 22 bp, Homo sapiens
cctggccagcgccggctgctcg

SEQ ID NO: 9236092 - DNA, 22 bp, Homo sapiens
tgtcctgcaagccctaatgaat

SEQ ID NO: 9236093 - DNA, 22 bp, Homo sapiens
tgtcctctccaacagcctctgt

SEQ ID NO: 9236094 - DNA, 22 bp, Homo sapiens
tgtcctcttccagtgctccttc

SEQ ID NO: 9236095 - DNA, 22 bp, Homo sapiens
tgtctcaaggttactctatgat

SEQ ID NO: 9236096 - DNA, 21 bp, Homo sapiens
tgtctcaagaaaggcctctcc

SEQ ID NO: 9236097 - DNA, 21 bp, Homo sapiens
tgtctcaatcagaagtcatta

SEQ ID NO: 9236098 - DNA, 21 bp, Homo sapiens
tgtctcaatcagaagtcatta

SEQ ID NO: 9236099 - DNA, 22 bp, Homo sapiens
tgtctctgtctcccaggttgtg

SEQ ID NO: 9236100 - DNA, 22 bp, Homo sapiens
tgtctctgggtgattcagtcct

SEQ ID NO: 9236101 - DNA, 22 bp, Homo sapiens
tgtctcatctcttaaccccact

SEQ ID NO: 9236102 - DNA, 22 bp, Homo sapiens
tgtctcatctcttaaccccact

SEQ ID NO: 9236103 - DNA, 22 bp, Homo sapiens
tgtctcagttcccttctctgga

SEQ ID NO: 9236104 - DNA, 22 bp, Homo sapiens
tgtctcttcccactcagacccc

SEQ ID NO: 9236105 - DNA, 22 bp, Homo sapiens
tgtctcttgagctgcctgatgc

SEQ ID NO: 9236106 - DNA, 22 bp, Homo sapiens
tgtctcttctgcctccagctgt

SEQ ID NO: 9236107 - DNA, 22 bp, Homo sapiens
tgtctcttggctctatcactta

SEQ ID NO: 9236108 - DNA, 22 bp, Homo sapiens
cctggcctgtgaatctgagagc

SEQ ID NO: 9236109 - DNA, 22 bp, Homo sapiens
cctggcctgtgaatctgagagc

SEQ ID NO: 9236110 - DNA, 22 bp, Homo sapiens
cctggcctgtgaatctgagagc

SEQ ID NO: 9236111 - DNA, 22 bp, Homo sapiens
cctggcctgctcggctcttaag

SEQ ID NO: 9236112 - DNA, 22 bp, Homo sapiens
cctggcctggcactccctctgc

SEQ ID NO: 9236113 - DNA, 22 bp, Homo sapiens
cctggcctgtgaatctgagagc

SEQ ID NO: 9236114 - DNA, 22 bp, Homo sapiens
cctggcctggcactccctctgc

SEQ ID NO: 9236115 - DNA, 22 bp, Homo sapiens
cctggctccagctgcctgtcct

SEQ ID NO: 9236116 - DNA, 22 bp, Homo sapiens
cctggcctcagcctagggctga

SEQ ID NO: 9236117 - DNA, 22 bp, Homo sapiens
cctggcctcgtgctcacggctc

SEQ ID NO: 9236118 - DNA, 22 bp, Homo sapiens
cctggcctcctggccttctcat

SEQ ID NO: 9236119 - DNA, 22 bp, Homo sapiens
cctggcctcctggccttctcat

SEQ ID NO: 9236120 - DNA, 22 bp, Homo sapiens
cctggccctggaatagggcagg

SEQ ID NO: 9236121 - DNA, 19 bp, Homo sapiens
cctggccctgctgcgcggg

SEQ ID NO: 9236122 - DNA, 19 bp, Homo sapiens
cctggccctgctgcgcggg

SEQ ID NO: 9236123 - DNA, 22 bp, Homo sapiens
cctggctctctgcagatcctgg

SEQ ID NO: 9236124 - DNA, 22 bp, Homo sapiens
cctggctcctgcctctgcaggg

SEQ ID NO: 9236125 - DNA, 22 bp, Homo sapiens
cctctgtgcctcagtttcatgt

SEQ ID NO: 9236126 - DNA, 22 bp, Homo sapiens
cctctgtgcctcgtgtcctctg

SEQ ID NO: 9236127 - DNA, 22 bp, Homo sapiens
cctctgtgctttgtccagcctc

SEQ ID NO: 9236128 - DNA, 22 bp, Homo sapiens
cctctgtgctttgtccagcctc

SEQ ID NO: 9236129 - DNA, 22 bp, Homo sapiens
cctctgtggccctgactctctt

SEQ ID NO: 9236130 - DNA, 22 bp, Homo sapiens
tggtccagtagcagggatacca

SEQ ID NO: 9236131 - DNA, 22 bp, Homo sapiens
tggtaggatagtgacttatatg

SEQ ID NO: 9236132 - DNA, 21 bp, Homo sapiens
tggtaggatccaggaatctgc

SEQ ID NO: 9236133 - DNA, 22 bp, Homo sapiens
tggtaggagggaaatgcgggtt

SEQ ID NO: 9236134 - DNA, 17 bp, Homo sapiens
tggtccaggtggagcca

SEQ ID NO: 9236135 - DNA, 22 bp, Homo sapiens
tggtccctgatctaatgtctca

SEQ ID NO: 9236136 - DNA, 22 bp, Homo sapiens
tggtccctaaagatgtctacat

SEQ ID NO: 9236137 - DNA, 22 bp, Homo sapiens
tggtccatgttcccagaagaca

SEQ ID NO: 9236138 - DNA, 22 bp, Homo sapiens
tggtccatgtcctccatctctc

SEQ ID NO: 9236139 - DNA, 22 bp, Homo sapiens
tggtccatgcccacggaatgtg

SEQ ID NO: 9236140 - DNA, 21 bp, Homo sapiens
tggtgccttcagctgtctttt

SEQ ID NO: 9236141 - DNA, 22 bp, Homo sapiens
tggtgccttgggcctacagcgc

SEQ ID NO: 9236142 - DNA, 22 bp, Homo sapiens
tggtgctgacagttctgagtgc

SEQ ID NO: 9236143 - DNA, 22 bp, Homo sapiens
tggtgctgacagttctgagtgc

SEQ ID NO: 9236144 - DNA, 22 bp, Homo sapiens
cctgcccactgcccggtcagcc

SEQ ID NO: 9236145 - DNA, 17 bp, Homo sapiens
cctgcccagagacagat

SEQ ID NO: 9236146 - DNA, 17 bp, Homo sapiens
cctgcccagagacagat

SEQ ID NO: 9236147 - DNA, 22 bp, Homo sapiens
tggtcttagctggaaggaggga

SEQ ID NO: 9236148 - DNA, 22 bp, Homo sapiens
cctgccagtgcctcccactggt

SEQ ID NO: 9236149 - DNA, 22 bp, Homo sapiens
cctgcccactccaggagcaact

SEQ ID NO: 9236150 - DNA, 22 bp, Homo sapiens
cctgcccactccaggagcaact

SEQ ID NO: 9236151 - DNA, 22 bp, Homo sapiens
cctgcccacagagagggtgcat

SEQ ID NO: 9236152 - DNA, 22 bp, Homo sapiens
cctgcccacagagagggtgcat

SEQ ID NO: 9236153 - DNA, 22 bp, Homo sapiens
tggtggctcacacctgtaatcc

SEQ ID NO: 9236154 - DNA, 22 bp, Homo sapiens
tggtggctcacgtctgtaatct

SEQ ID NO: 9236155 - DNA, 22 bp, Homo sapiens
tggtggctgctccctgccttga

SEQ ID NO: 9236156 - DNA, 17 bp, Homo sapiens
tggtggctggagtcagg

SEQ ID NO: 9236157 - DNA, 22 bp, Homo sapiens
tggtggctgtaagggagagaag

SEQ ID NO: 9236158 - DNA, 17 bp, Homo sapiens
tggtggctggagtcagg

SEQ ID NO: 9236159 - DNA, 22 bp, Homo sapiens
tggtggctgttgcagaactgag

SEQ ID NO: 9236160 - DNA, 22 bp, Homo sapiens
tggtggctgttgcagaactgag

SEQ ID NO: 9236161 - DNA, 23 bp, Homo sapiens
tggtggcttgtggtggccaccag

SEQ ID NO: 9236162 - DNA, 23 bp, Homo sapiens
tggtggcttgtggtggccaccag

SEQ ID NO: 9236163 - DNA, 22 bp, Homo sapiens
tggtgctgccacctcctctgct

SEQ ID NO: 9236164 - DNA, 22 bp, Homo sapiens
tggtgctgccacctcctctgct

SEQ ID NO: 9236165 - DNA, 22 bp, Homo sapiens
tggtgctgcctcagatgcctta

SEQ ID NO: 9236166 - DNA, 22 bp, Homo sapiens
tggtggccgaagccctctctca

SEQ ID NO: 9236167 - DNA, 21 bp, Homo sapiens
cctggagacaaagacagggtg

SEQ ID NO: 9236168 - DNA, 22 bp, Homo sapiens
cctggagacccacttctgccaa

SEQ ID NO: 9236169 - DNA, 21 bp, Homo sapiens
cctggagacaaagacagggtg

SEQ ID NO: 9236170 - DNA, 22 bp, Homo sapiens
cctggaaacacatgatgatgaa

SEQ ID NO: 9236171 - DNA, 22 bp, Homo sapiens
tgtaaacagccccatggagagc

SEQ ID NO: 9236172 - DNA, 22 bp, Homo sapiens
tgtaaacagtaggactaaagag

SEQ ID NO: 9236173 - DNA, 22 bp, Homo sapiens
cctggagacctgatggcagcgg

SEQ ID NO: 9236174 - DNA, 22 bp, Homo sapiens
cctggagaggcgctgcagagga

SEQ ID NO: 9236175 - DNA, 22 bp, Homo sapiens
cctggagaggcgctgcagagga

SEQ ID NO: 9236176 - DNA, 22 bp, Homo sapiens
cctggagaggcgctgcagagga

SEQ ID NO: 9236177 - DNA, 22 bp, Homo sapiens
cctggagaggagaaagggccca

SEQ ID NO: 9236178 - DNA, 22 bp, Homo sapiens
cctggagaggagaaagggccca

SEQ ID NO: 9236179 - DNA, 22 bp, Homo sapiens
cctggagagctcgggccaggca

SEQ ID NO: 9236180 - DNA, 22 bp, Homo sapiens
tgtagtaagtgcgcaataaata

SEQ ID NO: 9236181 - DNA, 22 bp, Homo sapiens
tgtagtaagtgcgcaataaata

SEQ ID NO: 9236182 - DNA, 22 bp, Homo sapiens
tgtagtaagtgcgcaataaata

SEQ ID NO: 9236183 - DNA, 22 bp, Homo sapiens
tgtagtagcattcacgaagtgt

SEQ ID NO: 9236184 - DNA, 22 bp, Homo sapiens
tgtagtgtgacataggtgtcca

SEQ ID NO: 9236185 - DNA, 22 bp, Homo sapiens
cctggagatttcttcaagcttt

SEQ ID NO: 9236186 - DNA, 22 bp, Homo sapiens
cctggagcaaaaatctaaggag

SEQ ID NO: 9236187 - DNA, 22 bp, Homo sapiens
cctggagattatttggtccaat

SEQ ID NO: 9236188 - DNA, 22 bp, Homo sapiens
cctggagcacatggcaggaggc

SEQ ID NO: 9236189 - DNA, 22 bp, Homo sapiens
cctggaggtggaggttgcagtg

SEQ ID NO: 9236190 - DNA, 22 bp, Homo sapiens
tgtaaactagggctgataaggg

SEQ ID NO: 9236191 - DNA, 22 bp, Homo sapiens
tgtaggaatggattctagaagg

SEQ ID NO: 9236192 - DNA, 22 bp, Homo sapiens
tgtaccaaaaatgtgtcagact

SEQ ID NO: 9236193 - DNA, 22 bp, Homo sapiens
tgtaggatgtaaggcaggcatc

SEQ ID NO: 9236194 - DNA, 16 bp, Homo sapiens
tgtaggataaccatac

SEQ ID NO: 9236195 - DNA, 22 bp, Homo sapiens
tgtaggagtccaatcaggagac

SEQ ID NO: 9236196 - DNA, 22 bp, Homo sapiens
tgtaggattttcaccagacctt

SEQ ID NO: 9236197 - DNA, 23 bp, Homo sapiens
tgtaggctgtagtttgtaggtcc

SEQ ID NO: 9236198 - DNA, 22 bp, Homo sapiens
tgtaggcatcactttctcttgg

SEQ ID NO: 9236199 - DNA, 22 bp, Homo sapiens
tgtagggaggaaagggctcttg

SEQ ID NO: 9236200 - DNA, 22 bp, Homo sapiens
tgtagggagaagagaggcacct

SEQ ID NO: 9236201 - DNA, 22 bp, Homo sapiens
tgtagggagaagagaggcacct

SEQ ID NO: 9236202 - DNA, 22 bp, Homo sapiens
tgtagggactgaggctggagag

SEQ ID NO: 9236203 - DNA, 22 bp, Homo sapiens
tgtaggtctcagtgtctgagct

SEQ ID NO: 9236204 - DNA, 22 bp, Homo sapiens
tgtattatgattgttgttcatg

SEQ ID NO: 9236205 - DNA, 22 bp, Homo sapiens
tgtattaacattaataaaatgg

SEQ ID NO: 9236206 - DNA, 22 bp, Homo sapiens
tgtattaacattaataaaatgg

SEQ ID NO: 9236207 - DNA, 22 bp, Homo sapiens
tgtattagagcatataatttga

SEQ ID NO: 9236208 - DNA, 22 bp, Homo sapiens
tgtattagagcatataatttga

SEQ ID NO: 9236209 - DNA, 22 bp, Homo sapiens
tgtcatgggcatttattgaggg

SEQ ID NO: 9236210 - DNA, 22 bp, Homo sapiens
tgtcatggggaaaataacagac

SEQ ID NO: 9236211 - DNA, 22 bp, Homo sapiens
tgtcatgcccaggagcaaggta

SEQ ID NO: 9236212 - DNA, 22 bp, Homo sapiens
tgtcaggagccaccagcactcc

SEQ ID NO: 9236213 - DNA, 22 bp, Homo sapiens
tgtcatgggtctaaacattgat

SEQ ID NO: 9236214 - DNA, 22 bp, Homo sapiens
tgtcatgggtctaaacattgat

SEQ ID NO: 9236215 - DNA, 22 bp, Homo sapiens
cctggcaccttcacagactact

SEQ ID NO: 9236216 - DNA, 21 bp, Homo sapiens
cctggcagaagcctgatatgc

SEQ ID NO: 9236217 - DNA, 22 bp, Homo sapiens
tgtatgtgcttgagaaggtggg

SEQ ID NO: 9236218 - DNA, 22 bp, Homo sapiens
gacaggcatgctttcaggacta

SEQ ID NO: 9236219 - DNA, 22 bp, Homo sapiens
gacaggcagttttccagatcag

SEQ ID NO: 9236220 - DNA, 22 bp, Homo sapiens
gacaggcagttttccagatcag

SEQ ID NO: 9236221 - DNA, 22 bp, Homo sapiens
gacaggcaggccagggctgtgg

SEQ ID NO: 9236222 - DNA, 22 bp, Homo sapiens
gaccagtcattactcatgccct

SEQ ID NO: 9236223 - DNA, 22 bp, Homo sapiens
gaccagggtcactcacagggct

SEQ ID NO: 9236224 - DNA, 22 bp, Homo sapiens
gaccagggtcactcacagggct

SEQ ID NO: 9236225 - DNA, 22 bp, Homo sapiens
gaccatcctggccaacgtggta

SEQ ID NO: 9236226 - DNA, 22 bp, Homo sapiens
gacaggaggcagagctcaggtg

SEQ ID NO: 9236227 - DNA, 22 bp, Homo sapiens
gacaggaggcagagctcaggtg

SEQ ID NO: 9236228 - DNA, 22 bp, Homo sapiens
gacaggaggcagagctcaggtg

SEQ ID NO: 9236229 - DNA, 22 bp, Homo sapiens
gacaggaggcagagctcaggtg

SEQ ID NO: 9236230 - DNA, 22 bp, Homo sapiens
gacaggaggcagagctcaggtg

SEQ ID NO: 9236231 - DNA, 22 bp, Homo sapiens
gacaggaggcagagctcaggtg

SEQ ID NO: 9236232 - DNA, 22 bp, Homo sapiens
gacaggcacgaaattgggctgg

SEQ ID NO: 9236233 - DNA, 22 bp, Homo sapiens
gacaggcagacctgtgccctgg

SEQ ID NO: 9236234 - DNA, 22 bp, Homo sapiens
gacaggcaggccagggctgtgg

SEQ ID NO: 9236235 - DNA, 22 bp, Homo sapiens
gacaggcaattaccagcgccca

SEQ ID NO: 9236236 - DNA, 22 bp, Homo sapiens
gacccaggggcagggagaaagt

SEQ ID NO: 9236237 - DNA, 22 bp, Homo sapiens
gacccaggggcagggagaaagt

SEQ ID NO: 9236238 - DNA, 22 bp, Homo sapiens
gacccagggtatccagagctgc

SEQ ID NO: 9236239 - DNA, 22 bp, Homo sapiens
gacccagggtatccagagctgc

SEQ ID NO: 9236240 - DNA, 22 bp, Homo sapiens
gacccagggtatccagagctgc

SEQ ID NO: 9236241 - DNA, 22 bp, Homo sapiens
gacccaggagtgcagagagtgg

SEQ ID NO: 9236242 - DNA, 22 bp, Homo sapiens
gacccaggagtgcagagagtgg

SEQ ID NO: 9236243 - DNA, 22 bp, Homo sapiens
gacccaggagtgcagagagtgg

SEQ ID NO: 9236244 - DNA, 22 bp, Homo sapiens
gacccagcttaagtcacatgtt

SEQ ID NO: 9236245 - DNA, 22 bp, Homo sapiens
gacccagcttaagtcacatgtt

SEQ ID NO: 9236246 - DNA, 22 bp, Homo sapiens
gacccagctaaccaggtgggga

SEQ ID NO: 9236247 - DNA, 22 bp, Homo sapiens
gacccagcctggtttttatagg

SEQ ID NO: 9236248 - DNA, 18 bp, Homo sapiens
gacccagcagatgggctt

SEQ ID NO: 9236249 - DNA, 22 bp, Homo sapiens
gactgtccagaattcctaggtg

SEQ ID NO: 9236250 - DNA, 22 bp, Homo sapiens
gacccagggtttctgcacaggg

SEQ ID NO: 9236251 - DNA, 22 bp, Homo sapiens
gacccagggtttctgcacaggg

SEQ ID NO: 9236252 - DNA, 22 bp, Homo sapiens
gacccagggtttctgcacaggg

SEQ ID NO: 9236253 - DNA, 22 bp, Homo sapiens
gactgcttgagaaggaacaaat

SEQ ID NO: 9236254 - DNA, 22 bp, Homo sapiens
gactgctttggtttgtaaatgt

SEQ ID NO: 9236255 - DNA, 22 bp, Homo sapiens
gactgctttgacaaatgatacc

SEQ ID NO: 9236256 - DNA, 22 bp, Homo sapiens
gactgctttgaccaatagcaca

SEQ ID NO: 9236257 - DNA, 22 bp, Homo sapiens
gactgcttaaatatatgatgtt

SEQ ID NO: 9236258 - DNA, 22 bp, Homo sapiens
gactgcttatatgttaaagata

SEQ ID NO: 9236259 - DNA, 22 bp, Homo sapiens
gactggaaagcctgtcctcaga

SEQ ID NO: 9236260 - DNA, 22 bp, Homo sapiens
gactggaaagcctgtcctcaga

SEQ ID NO: 9236261 - DNA, 22 bp, Homo sapiens
gactgcttatatgttaaagata

SEQ ID NO: 9236262 - DNA, 22 bp, Homo sapiens
gactggtcttttgtgatggatg

SEQ ID NO: 9236263 - DNA, 22 bp, Homo sapiens
gacttggggatttatctcacag

SEQ ID NO: 9236264 - DNA, 22 bp, Homo sapiens
gactttaaaatgctagaacagg

SEQ ID NO: 9236265 - DNA, 21 bp, Homo sapiens
gacttcatgggtcaaccaatt

SEQ ID NO: 9236266 - DNA, 22 bp, Homo sapiens
gacttcatgacattcaggtcag

SEQ ID NO: 9236267 - DNA, 22 bp, Homo sapiens
gacttcataatattgagcatgt

SEQ ID NO: 9236268 - DNA, 19 bp, Homo sapiens
gacttctgatgtccagatg

SEQ ID NO: 9236269 - DNA, 22 bp, Homo sapiens
gacttagaccctgtctttattc

SEQ ID NO: 9236270 - DNA, 22 bp, Homo sapiens
gactgtgtccatgtgctggatt

SEQ ID NO: 9236271 - DNA, 22 bp, Homo sapiens
gagacagagtttcactcttgtt

SEQ ID NO: 9236272 - DNA, 22 bp, Homo sapiens
gagacagagtttcactcttgtt

SEQ ID NO: 9236273 - DNA, 22 bp, Homo sapiens
gagacagatctcggctccatgc

SEQ ID NO: 9236274 - DNA, 23 bp, Homo sapiens
gagagctgactgtcaagactgtt

SEQ ID NO: 9236275 - DNA, 17 bp, Homo sapiens
gagagctgctgcttccg

SEQ ID NO: 9236276 - DNA, 22 bp, Homo sapiens
gagagctgcagccgagaggggg

SEQ ID NO: 9236277 - DNA, 22 bp, Homo sapiens
gagagctgcattctcagacaca

SEQ ID NO: 9236278 - DNA, 22 bp, Homo sapiens
gagagctgcaaggtagggcggg

SEQ ID NO: 9236279 - DNA, 22 bp, Homo sapiens
gagagctgcagccgagaggggg

SEQ ID NO: 9236280 - DNA, 22 bp, Homo sapiens
gagagctgatagatgagctact

SEQ ID NO: 9236281 - DNA, 22 bp, Homo sapiens
gagagctgatagatgagctact

SEQ ID NO: 9236282 - DNA, 22 bp, Homo sapiens
gagagctgggaaagccgtggag

SEQ ID NO: 9236283 - DNA, 22 bp, Homo sapiens
gagagctggccagcttcagtat

SEQ ID NO: 9236284 - DNA, 22 bp, Homo sapiens
gagagctggagttatttctctg

SEQ ID NO: 9236285 - DNA, 22 bp, Homo sapiens
gagagctggattctggataggt

SEQ ID NO: 9236286 - DNA, 22 bp, Homo sapiens
gagagctggattctggataggt

SEQ ID NO: 9236287 - DNA, 22 bp, Homo sapiens
gagagctggattctggataggt

SEQ ID NO: 9236288 - DNA, 22 bp, Homo sapiens
gagagctgggctttgggtgaag

SEQ ID NO: 9236289 - DNA, 20 bp, Homo sapiens
gagagctggggatgaggctg

SEQ ID NO: 9236290 - DNA, 22 bp, Homo sapiens
gagagctgggaaagccgtggag

SEQ ID NO: 9236291 - DNA, 22 bp, Homo sapiens
gagagctgggctttgggtgaag

SEQ ID NO: 9236292 - DNA, 22 bp, Homo sapiens
gagagtctaggaacctcatata

SEQ ID NO: 9236293 - DNA, 22 bp, Homo sapiens
gagaggtacggaaagagcgtgg

SEQ ID NO: 9236294 - DNA, 22 bp, Homo sapiens
gagaggtacaccctttaaactt

SEQ ID NO: 9236295 - DNA, 22 bp, Homo sapiens
gagaggtaatttgaagtgcaaa

SEQ ID NO: 9236296 - DNA, 22 bp, Homo sapiens
gagagctgtaatagtcatgtct

SEQ ID NO: 9236297 - DNA, 22 bp, Homo sapiens
gagagctgggttcaagtagctg

SEQ ID NO: 9236298 - DNA, 22 bp, Homo sapiens
gagagctgggttcaagtagctg

SEQ ID NO: 9236299 - DNA, 22 bp, Homo sapiens
gagagctgggggactgtggatg

SEQ ID NO: 9236300 - DNA, 22 bp, Homo sapiens
gagagctgggggactgtggatg

SEQ ID NO: 9236301 - DNA, 21 bp, Homo sapiens
gactttaatttgagagcaaaa

SEQ ID NO: 9236302 - DNA, 21 bp, Homo sapiens
gactttaatttgagagcaaaa

SEQ ID NO: 9236303 - DNA, 22 bp, Homo sapiens
gactttataaatgagaggcgga

SEQ ID NO: 9236304 - DNA, 22 bp, Homo sapiens
gactttatcctgcctgaccacg

SEQ ID NO: 9236305 - DNA, 22 bp, Homo sapiens
gactttatgaagagatgaccaa

SEQ ID NO: 9236306 - DNA, 22 bp, Homo sapiens
gactttatcttgtccttcctgc

SEQ ID NO: 9236307 - DNA, 22 bp, Homo sapiens
gactttattactaaccctgtga

SEQ ID NO: 9236308 - DNA, 22 bp, Homo sapiens
gactttattcgttaactgttaa

SEQ ID NO: 9236309 - DNA, 22 bp, Homo sapiens
gactttattatagtggcaatag

SEQ ID NO: 9236310 - DNA, 22 bp, Homo sapiens
gactttatttccttatttgtga

SEQ ID NO: 9236311 - DNA, 22 bp, Homo sapiens
gactttattttaacggagattc

SEQ ID NO: 9236312 - DNA, 22 bp, Homo sapiens
gactttatttccttatttgtga

SEQ ID NO: 9236313 - DNA, 22 bp, Homo sapiens
gagaaaagcgaaggacctggag

SEQ ID NO: 9236314 - DNA, 22 bp, Homo sapiens
gacttttgaataaggtaggata

SEQ ID NO: 9236315 - DNA, 22 bp, Homo sapiens
gagaaacaacacttgatgcctt

SEQ ID NO: 9236316 - DNA, 22 bp, Homo sapiens
gagaaaatgtcagacttggtcg

SEQ ID NO: 9236317 - DNA, 22 bp, Homo sapiens
gagacacagcagatattcaatc

SEQ ID NO: 9236318 - DNA, 22 bp, Homo sapiens
gagacacagttatcaggcatac

SEQ ID NO: 9236319 - DNA, 22 bp, Homo sapiens
gagacactcaacaaagatatga

SEQ ID NO: 9236320 - DNA, 22 bp, Homo sapiens
gagacagagatcttgctgagtc

SEQ ID NO: 9236321 - DNA, 21 bp, Homo sapiens
gagacagactttcgtcccctg

SEQ ID NO: 9236322 - DNA, 22 bp, Homo sapiens
gagacacttgctgtgaggtcgc

SEQ ID NO: 9236323 - DNA, 22 bp, Homo sapiens
gagacacacacaggaggtggca

SEQ ID NO: 9236324 - DNA, 22 bp, Homo sapiens
gagacacacattctggagagaa

SEQ ID NO: 9236325 - DNA, 22 bp, Homo sapiens
gagacacacccaaggttatgag

SEQ ID NO: 9236326 - DNA, 22 bp, Homo sapiens
gacagctgtgcaggagaagggg

SEQ ID NO: 9236327 - DNA, 22 bp, Homo sapiens
gacagctgtggagaggcatgtg

SEQ ID NO: 9236328 - DNA, 22 bp, Homo sapiens
gacagctgtggagaggcatgtg

SEQ ID NO: 9236329 - DNA, 22 bp, Homo sapiens
gacagctgtgcaggagaagggg

SEQ ID NO: 9236330 - DNA, 22 bp, Homo sapiens
gacacagggggatgtgtggacg

SEQ ID NO: 9236331 - DNA, 22 bp, Homo sapiens
gacacagggggatgtgtggacg

SEQ ID NO: 9236332 - DNA, 22 bp, Homo sapiens
gacacaggggggcgctagaaga

SEQ ID NO: 9236333 - DNA, 22 bp, Homo sapiens
gacacagggggatgtgtggacg

SEQ ID NO: 9236334 - DNA, 20 bp, Homo sapiens
gacaggagagttaggtaggt

SEQ ID NO: 9236335 - DNA, 20 bp, Homo sapiens
gacaggagagttaggtaggt

SEQ ID NO: 9236336 - DNA, 22 bp, Homo sapiens
gacaggacttcactgtgttgcc

SEQ ID NO: 9236337 - DNA, 19 bp, Homo sapiens
gacaggacgaagggaagtt

SEQ ID NO: 9236338 - DNA, 21 bp, Homo sapiens
gacaggactagaccagagctc

SEQ ID NO: 9236339 - DNA, 22 bp, Homo sapiens
gacaggaagtctgaaggaggga

SEQ ID NO: 9236340 - DNA, 22 bp, Homo sapiens
gacaggaatgtgtggatgcgga

SEQ ID NO: 9236341 - DNA, 19 bp, Homo sapiens
gacaggaaggctaccagta

SEQ ID NO: 9236342 - DNA, 22 bp, Homo sapiens
gacaggaacataaatgtaggag

SEQ ID NO: 9236343 - DNA, 22 bp, Homo sapiens
gacacaggaatcaccttggatg

SEQ ID NO: 9236344 - DNA, 23 bp, Homo sapiens
gacacaggagcacccagctgagc

SEQ ID NO: 9236345 - DNA, 22 bp, Homo sapiens
gacacaggattcctggctctgc

SEQ ID NO: 9236346 - DNA, 23 bp, Homo sapiens
gacacaggagcacccagctgagc

SEQ ID NO: 9236347 - DNA, 22 bp, Homo sapiens
gacacagagtattttaagtact

SEQ ID NO: 9236348 - DNA, 22 bp, Homo sapiens
gacacagatgatcaggtgtgga

SEQ ID NO: 9236349 - DNA, 22 bp, Homo sapiens
gaatttaaaggccagacctgag

SEQ ID NO: 9236350 - DNA, 22 bp, Homo sapiens
gaatttaaatttaaatctacca

SEQ ID NO: 9236351 - DNA, 22 bp, Homo sapiens
gaatttaagaggatgaatctgt

SEQ ID NO: 9236352 - DNA, 22 bp, Homo sapiens
gaatttaagaggatgaatctgt

SEQ ID NO: 9236353 - DNA, 22 bp, Homo sapiens
gaattctggttttgaaatgaat

SEQ ID NO: 9236354 - DNA, 22 bp, Homo sapiens
gaattctagggtaaatatccta

SEQ ID NO: 9236355 - DNA, 22 bp, Homo sapiens
gaattctagtcacacacattca

SEQ ID NO: 9236356 - DNA, 22 bp, Homo sapiens
gaattcttctgtctttaactga

SEQ ID NO: 9236357 - DNA, 23 bp, Homo sapiens
gaattcttaaggtcactaaagtc

SEQ ID NO: 9236358 - DNA, 22 bp, Homo sapiens
gaattcttttctttctgaaagt

SEQ ID NO: 9236359 - DNA, 22 bp, Homo sapiens
gaagttcaactgccatgcttgg

SEQ ID NO: 9236360 - DNA, 22 bp, Homo sapiens
gaagttcacatagctggcaggt

SEQ ID NO: 9236361 - DNA, 22 bp, Homo sapiens
gaagttatcaaagatgtattct

SEQ ID NO: 9236362 - DNA, 22 bp, Homo sapiens
gaagttatcaggattaaagttg

SEQ ID NO: 9236363 - DNA, 22 bp, Homo sapiens
gaagttattttacctgttaaag

SEQ ID NO: 9236364 - DNA, 22 bp, Homo sapiens
gaagttatttgctatctactga

SEQ ID NO: 9236365 - DNA, 22 bp, Homo sapiens
gaattataggtttgcatgctaa

SEQ ID NO: 9236366 - DNA, 22 bp, Homo sapiens
gaattagacatgctttgctttt

SEQ ID NO: 9236367 - DNA, 22 bp, Homo sapiens
gaattaggtgcatgtttacaaa

SEQ ID NO: 9236368 - DNA, 22 bp, Homo sapiens
gaattataggcaaagcagtcat

SEQ ID NO: 9236369 - DNA, 22 bp, Homo sapiens
gaattataaactagtgacttca

SEQ ID NO: 9236370 - DNA, 22 bp, Homo sapiens
gaattataaactagtgacttca

SEQ ID NO: 9236371 - DNA, 22 bp, Homo sapiens
gaattacatgaccctgagtaga

SEQ ID NO: 9236372 - DNA, 21 bp, Homo sapiens
gaaggagaaagcaagtgctgc

SEQ ID NO: 9236373 - DNA, 21 bp, Homo sapiens
gaaggagaaagcaagtgctgc

SEQ ID NO: 9236374 - DNA, 22 bp, Homo sapiens
gaaggaagtttattttagaaga

SEQ ID NO: 9236375 - DNA, 22 bp, Homo sapiens
gaaggaagtcattagtgcagac

SEQ ID NO: 9236376 - DNA, 20 bp, Homo sapiens
gaaggaagggggcaaggtga

SEQ ID NO: 9236377 - DNA, 20 bp, Homo sapiens
gaaggaagggggcaaggtga

SEQ ID NO: 9236378 - DNA, 22 bp, Homo sapiens
gaaggaagtcattagtgcagac

SEQ ID NO: 9236379 - DNA, 20 bp, Homo sapiens
gaaggaagggggcaaggtga

SEQ ID NO: 9236380 - DNA, 22 bp, Homo sapiens
gaacttagtagtctacttctta

SEQ ID NO: 9236381 - DNA, 22 bp, Homo sapiens
gaaggaagggctggctgtcttg

SEQ ID NO: 9236382 - DNA, 22 bp, Homo sapiens
gaactgtttttaagtcctaaga

SEQ ID NO: 9236383 - DNA, 19 bp, Homo sapiens
gaaggagagctgagttagg

SEQ ID NO: 9236384 - DNA, 22 bp, Homo sapiens
gaaggagagagacatcgtccct

SEQ ID NO: 9236385 - DNA, 19 bp, Homo sapiens
gaaggagagctgagttagg

SEQ ID NO: 9236386 - DNA, 22 bp, Homo sapiens
gaaggagaggattgtgaggctg

SEQ ID NO: 9236387 - DNA, 22 bp, Homo sapiens
gaaggagaggattgtgaggctg

SEQ ID NO: 9236388 - DNA, 22 bp, Homo sapiens
gaaggagaggattgtgaggctg

SEQ ID NO: 9236389 - DNA, 21 bp, Homo sapiens
gaaggagaaagcaagtgctgc

SEQ ID NO: 9236390 - DNA, 22 bp, Homo sapiens
gaaggagaccctgaagatgctg

SEQ ID NO: 9236391 - DNA, 22 bp, Homo sapiens
gaaggcccgccctgagcaaggg

SEQ ID NO: 9236392 - DNA, 22 bp, Homo sapiens
gaaggcctaggaaggaagcctt

SEQ ID NO: 9236393 - DNA, 22 bp, Homo sapiens
gaaggagagggtcaaggataat

SEQ ID NO: 9236394 - DNA, 22 bp, Homo sapiens
gaaggagaggattgtgaggctg

SEQ ID NO: 9236395 - DNA, 22 bp, Homo sapiens
gaaggagagggtcaaggataat

SEQ ID NO: 9236396 - DNA, 22 bp, Homo sapiens
gaaggagagggtcaaggataat

SEQ ID NO: 9236397 - DNA, 22 bp, Homo sapiens
gaaggctaaaggggcagaggtt

SEQ ID NO: 9236398 - DNA, 22 bp, Homo sapiens
gaaggctgagcagacaggccaa

SEQ ID NO: 9236399 - DNA, 19 bp, Homo sapiens
gaaggctgaaatgaagcac

SEQ ID NO: 9236400 - DNA, 22 bp, Homo sapiens
gaaggctgcgaggggagtgccg

SEQ ID NO: 9236401 - DNA, 22 bp, Homo sapiens
gaaggctgagcagacaggccaa

SEQ ID NO: 9236402 - DNA, 22 bp, Homo sapiens
gaaggctgagtgggtacggagg

SEQ ID NO: 9236403 - DNA, 22 bp, Homo sapiens
gaaggctgatgacagattctgc

SEQ ID NO: 9236404 - DNA, 22 bp, Homo sapiens
gaaggctttttgggtaattgta

SEQ ID NO: 9236405 - DNA, 22 bp, Homo sapiens
gaagtgtgcacatcttacaagt

SEQ ID NO: 9236406 - DNA, 22 bp, Homo sapiens
gaagtgggctttgtggtcagct

SEQ ID NO: 9236407 - DNA, 22 bp, Homo sapiens
gaagtggaattactgggtcata

SEQ ID NO: 9236408 - DNA, 22 bp, Homo sapiens
gaagtgggctttgtggtcagct

SEQ ID NO: 9236409 - DNA, 22 bp, Homo sapiens
gaagggaaattcagatcttcag

SEQ ID NO: 9236410 - DNA, 22 bp, Homo sapiens
gaaggttttcaggagcctagtc

SEQ ID NO: 9236411 - DNA, 22 bp, Homo sapiens
gaaggttttgtttgcaaatcat

SEQ ID NO: 9236412 - DNA, 22 bp, Homo sapiens
gaaggttttgattccactgaat

SEQ ID NO: 9236413 - DNA, 22 bp, Homo sapiens
gaagtggaagccatcggcagtc

SEQ ID NO: 9236414 - DNA, 22 bp, Homo sapiens
gaacagatgggctcagatcctg

SEQ ID NO: 9236415 - DNA, 22 bp, Homo sapiens
gaacagagttgaaacaaggctg

SEQ ID NO: 9236416 - DNA, 17 bp, Homo sapiens
gaacagcagaggggaca

SEQ ID NO: 9236417 - DNA, 23 bp, Homo sapiens
gaacccagctctgccacttgcca

SEQ ID NO: 9236418 - DNA, 21 bp, Homo sapiens
gaacccagcagcagtgctctg

SEQ ID NO: 9236419 - DNA, 22 bp, Homo sapiens
gaacccagtccaggtgcagcct

SEQ ID NO: 9236420 - DNA, 22 bp, Homo sapiens
gaacccaggaggttgcagtgag

SEQ ID NO: 9236421 - DNA, 22 bp, Homo sapiens
gaacactgaggacactgagaat

SEQ ID NO: 9236422 - DNA, 22 bp, Homo sapiens
gaacactgaggacactgagaat

SEQ ID NO: 9236423 - DNA, 22 bp, Homo sapiens
gaacactggggtatcattgagc

SEQ ID NO: 9236424 - DNA, 22 bp, Homo sapiens
gaacactggggtatcattgagc

SEQ ID NO: 9236425 - DNA, 22 bp, Homo sapiens
gaacactgtttcttcgtgaaca

SEQ ID NO: 9236426 - DNA, 22 bp, Homo sapiens
gaactgggtccttgagtctaga

SEQ ID NO: 9236427 - DNA, 22 bp, Homo sapiens
gaactgggaatgctgtcccatc

SEQ ID NO: 9236428 - DNA, 22 bp, Homo sapiens
gaactgggaatgctgtcccatc

SEQ ID NO: 9236429 - DNA, 22 bp, Homo sapiens
gaactgggtccttgagtctaga

SEQ ID NO: 9236430 - DNA, 22 bp, Homo sapiens
gaactacagtaagaattgatgt

SEQ ID NO: 9236431 - DNA, 22 bp, Homo sapiens
gaactacagtgcattttcttaa

SEQ ID NO: 9236432 - DNA, 22 bp, Homo sapiens
gaactacagtaagaattgatgt

SEQ ID NO: 9236433 - DNA, 22 bp, Homo sapiens
gaactacaggtgcagcaagtga

SEQ ID NO: 9236434 - DNA, 22 bp, Homo sapiens
gaactaaatttgacagacaaca

SEQ ID NO: 9236435 - DNA, 22 bp, Homo sapiens
gaactaaatgaaattactggtg

SEQ ID NO: 9236436 - DNA, 22 bp, Homo sapiens
gaacacagcagggataaccact

SEQ ID NO: 9236437 - DNA, 22 bp, Homo sapiens
gaacacaagcgtatgtctttgt

SEQ ID NO: 9236438 - DNA, 22 bp, Homo sapiens
gaacacaactcagaatgctggt

SEQ ID NO: 9236439 - DNA, 22 bp, Homo sapiens
gaaatttacaactttctcatgg

SEQ ID NO: 9236440 - DNA, 22 bp, Homo sapiens
gaaatttacaactttctcatgg

SEQ ID NO: 9236441 - DNA, 22 bp, Homo sapiens
gaacacagtcaagggctgctgt

SEQ ID NO: 9236442 - DNA, 22 bp, Homo sapiens
gaacacagtacttttcctgatg

SEQ ID NO: 9236443 - DNA, 22 bp, Homo sapiens
gaacacagtgtgatcgtatgtc

SEQ ID NO: 9236444 - DNA, 22 bp, Homo sapiens
gaacacatttctctgactgtag

SEQ ID NO: 9236445 - DNA, 22 bp, Homo sapiens
gaacactgacattttcctgact

SEQ ID NO: 9236446 - DNA, 22 bp, Homo sapiens
gaaataacctcatgcaccatga

SEQ ID NO: 9236447 - DNA, 22 bp, Homo sapiens
gaaataacagctctggaagagt

SEQ ID NO: 9236448 - DNA, 22 bp, Homo sapiens
gaaagttttctcacacagtaat

SEQ ID NO: 9236449 - DNA, 17 bp, Homo sapiens
gaaagtttctctctctt

SEQ ID NO: 9236450 - DNA, 22 bp, Homo sapiens
gaaagtttgcctctctcttgag

SEQ ID NO: 9236451 - DNA, 22 bp, Homo sapiens
gaaagtttcttcattaagatgt

SEQ ID NO: 9236452 - DNA, 22 bp, Homo sapiens
gaaagttttcatatataccaaa

SEQ ID NO: 9236453 - DNA, 22 bp, Homo sapiens
gaaagttttcatatataccaaa

SEQ ID NO: 9236454 - DNA, 22 bp, Homo sapiens
gaaatacaaagccagccatttt

SEQ ID NO: 9236455 - DNA, 22 bp, Homo sapiens
gaaataatttagaaggtattcc

SEQ ID NO: 9236456 - DNA, 22 bp, Homo sapiens
gaaataatttagaaggtattcc

SEQ ID NO: 9236457 - DNA, 22 bp, Homo sapiens
gaaataattctgtgtctgaaca

SEQ ID NO: 9236458 - DNA, 22 bp, Homo sapiens
gaaataatacagtgctcttctc

SEQ ID NO: 9236459 - DNA, 22 bp, Homo sapiens
gaaaacatccagagatagacct

SEQ ID NO: 9236460 - DNA, 22 bp, Homo sapiens
gaaaagagtcctgtgtgaggag

SEQ ID NO: 9236461 - DNA, 22 bp, Homo sapiens
gaaaagctaggccagttcagct

SEQ ID NO: 9236462 - DNA, 22 bp, Homo sapiens
gaaaaggaaatttatagagatc

SEQ ID NO: 9236463 - DNA, 22 bp, Homo sapiens
gaaaaggattggtaaaatatct

SEQ ID NO: 9236464 - DNA, 22 bp, Homo sapiens
gaaaagggcaagagagagggca

SEQ ID NO: 9236465 - DNA, 22 bp, Homo sapiens
gaaaaggattggtaaaatatct

SEQ ID NO: 9236466 - DNA, 22 bp, Homo sapiens
ctttgtgtctgttaataattat

SEQ ID NO: 9236467 - DNA, 22 bp, Homo sapiens
ctttgttagcagccaatttgtt

SEQ ID NO: 9236468 - DNA, 22 bp, Homo sapiens
ctttgtccattgattcgttcaa

SEQ ID NO: 9236469 - DNA, 22 bp, Homo sapiens
ctttgtgatgaggcctaagaca

SEQ ID NO: 9236470 - DNA, 22 bp, Homo sapiens
ctttgtgcaaaccctagaatca

SEQ ID NO: 9236471 - DNA, 22 bp, Homo sapiens
ctttgtgctttgaatgatagct

SEQ ID NO: 9236472 - DNA, 22 bp, Homo sapiens
ctttgtgcgtagtgagtggtca

SEQ ID NO: 9236473 - DNA, 22 bp, Homo sapiens
ctttgttatctgtaaatggtta

SEQ ID NO: 9236474 - DNA, 22 bp, Homo sapiens
ctttgttatctgtaaatggtta

SEQ ID NO: 9236475 - DNA, 22 bp, Homo sapiens
ctttgtttatatttctcctcga

SEQ ID NO: 9236476 - DNA, 22 bp, Homo sapiens
gaaaacactttgatctgaaagt

SEQ ID NO: 9236477 - DNA, 22 bp, Homo sapiens
gaaaacactttgatctgaaagt

SEQ ID NO: 9236478 - DNA, 23 bp, Homo sapiens
cttttaactagagtatcagctgc

SEQ ID NO: 9236479 - DNA, 23 bp, Homo sapiens
cttttaaccggcatgggagggca

SEQ ID NO: 9236480 - DNA, 22 bp, Homo sapiens
ctttgttttactcagaggcatg

SEQ ID NO: 9236481 - DNA, 22 bp, Homo sapiens
ctttgttttactcagaggcatg

SEQ ID NO: 9236482 - DNA, 23 bp, Homo sapiens
cttttaacttgatctgagaccag

SEQ ID NO: 9236483 - DNA, 22 bp, Homo sapiens
cttttaagggataataagatgt

SEQ ID NO: 9236484 - DNA, 22 bp, Homo sapiens
gaaaagttcatcatatattcag

SEQ ID NO: 9236485 - DNA, 22 bp, Homo sapiens
gaaaagttcatcatatattcag

SEQ ID NO: 9236486 - DNA, 22 bp, Homo sapiens
gaaaagtatgtttattttgact

SEQ ID NO: 9236487 - DNA, 22 bp, Homo sapiens
gaaaggcagtacagctgagcct

SEQ ID NO: 9236488 - DNA, 22 bp, Homo sapiens
gaaaggcatcttcagtctctga

SEQ ID NO: 9236489 - DNA, 22 bp, Homo sapiens
gaaagtttataggttatataat

SEQ ID NO: 9236490 - DNA, 22 bp, Homo sapiens
gaaagtttataggttatataat

SEQ ID NO: 9236491 - DNA, 22 bp, Homo sapiens
gaaagtttctcacacatgcaga

SEQ ID NO: 9236492 - DNA, 22 bp, Homo sapiens
gaaagggtctttgatttccctc

SEQ ID NO: 9236493 - DNA, 22 bp, Homo sapiens
gaaagggagtggacaacaggca

SEQ ID NO: 9236494 - DNA, 22 bp, Homo sapiens
gaaagggagtggacaacaggca

SEQ ID NO: 9236495 - DNA, 22 bp, Homo sapiens
gaaaggttgggtgaatggtgga

SEQ ID NO: 9236496 - DNA, 22 bp, Homo sapiens
gaaaggttgggtgaatggtgga

SEQ ID NO: 9236497 - DNA, 22 bp, Homo sapiens
gaaaggttcttgggagttcaca

SEQ ID NO: 9236498 - DNA, 22 bp, Homo sapiens
ctggctggaggtgagtcactga

SEQ ID NO: 9236499 - DNA, 22 bp, Homo sapiens
ctggctggtcatgtcatgagcc

SEQ ID NO: 9236500 - DNA, 22 bp, Homo sapiens
ctggctggtcatgtcatgagcc

SEQ ID NO: 9236501 - DNA, 22 bp, Homo sapiens
ctggctggtcatcagcagtacg

SEQ ID NO: 9236502 - DNA, 22 bp, Homo sapiens
ctggctgggttccaggattcca

SEQ ID NO: 9236503 - DNA, 22 bp, Homo sapiens
cttctctatgatgttctaaggt

SEQ ID NO: 9236504 - DNA, 22 bp, Homo sapiens
cttctccagccacgcccactcc

SEQ ID NO: 9236505 - DNA, 22 bp, Homo sapiens
cttctcggccgtgtggatgcgc

SEQ ID NO: 9236506 - DNA, 22 bp, Homo sapiens
cttctctccctggcactcagac

SEQ ID NO: 9236507 - DNA, 22 bp, Homo sapiens
cttctctcggtgcatccctcac

SEQ ID NO: 9236508 - DNA, 22 bp, Homo sapiens
ctggctggttactatttctggt

SEQ ID NO: 9236509 - DNA, 22 bp, Homo sapiens
cttctctggctcctcagcgccc

SEQ ID NO: 9236510 - DNA, 22 bp, Homo sapiens
cttctctggcagatgtgtgtcc

SEQ ID NO: 9236511 - DNA, 22 bp, Homo sapiens
cttctctctgcataggcatggg

SEQ ID NO: 9236512 - DNA, 22 bp, Homo sapiens
cttctctgacagtctgtttcac

SEQ ID NO: 9236513 - DNA, 23 bp, Homo sapiens
cttctctgagctaggaatgctct

SEQ ID NO: 9236514 - DNA, 22 bp, Homo sapiens
cttctctgtgtagagattcaga

SEQ ID NO: 9236515 - DNA, 22 bp, Homo sapiens
cttctcttcccagggacacagg

SEQ ID NO: 9236516 - DNA, 22 bp, Homo sapiens
cttctctggctcctcagcgccc

SEQ ID NO: 9236517 - DNA, 22 bp, Homo sapiens
cttctcttcctttgtcaactga

SEQ ID NO: 9236518 - DNA, 22 bp, Homo sapiens
cttctcttgggtgtggtgtctt

SEQ ID NO: 9236519 - DNA, 22 bp, Homo sapiens
cttctcttcctttgtcaactga

SEQ ID NO: 9236520 - DNA, 22 bp, Homo sapiens
cttctcttcctttgtcaactga

SEQ ID NO: 9236521 - DNA, 22 bp, Homo sapiens
cttctcttgggtgtggtgtctt

SEQ ID NO: 9236522 - DNA, 22 bp, Homo sapiens
cttcttcttttaataaatgtct

SEQ ID NO: 9236523 - DNA, 22 bp, Homo sapiens
cttcttcttttaataaatgtct

SEQ ID NO: 9236524 - DNA, 22 bp, Homo sapiens
cttctcttggtagttcttgttg

SEQ ID NO: 9236525 - DNA, 22 bp, Homo sapiens
cttcttgagcatgggtagtact

SEQ ID NO: 9236526 - DNA, 22 bp, Homo sapiens
cttcttcttttgtgggtggtaa

SEQ ID NO: 9236527 - DNA, 22 bp, Homo sapiens
cttctttcttttgatcacaggt

SEQ ID NO: 9236528 - DNA, 22 bp, Homo sapiens
cttctttcaagaatggattagg

SEQ ID NO: 9236529 - DNA, 22 bp, Homo sapiens
cttctttcccaggcatgtttta

SEQ ID NO: 9236530 - DNA, 22 bp, Homo sapiens
cttctttcccaggcatgtttta

SEQ ID NO: 9236531 - DNA, 22 bp, Homo sapiens
cttgaaaaatatgccttgcttc

SEQ ID NO: 9236532 - DNA, 22 bp, Homo sapiens
cttgaaagaagggtcttttaat

SEQ ID NO: 9236533 - DNA, 22 bp, Homo sapiens
cttgaaaataagaaagactttc

SEQ ID NO: 9236534 - DNA, 22 bp, Homo sapiens
cttgaaatccagatttcagagg

SEQ ID NO: 9236535 - DNA, 19 bp, Homo sapiens
cttgaaatgagactgaagg

SEQ ID NO: 9236536 - DNA, 22 bp, Homo sapiens
cttgaaccaatcactgtagcca

SEQ ID NO: 9236537 - DNA, 20 bp, Homo sapiens
cttgaactgattctatttcc

SEQ ID NO: 9236538 - DNA, 22 bp, Homo sapiens
cttgaagacaatggcagattcc

SEQ ID NO: 9236539 - DNA, 22 bp, Homo sapiens
cttggctgtcataaggtcctgg

SEQ ID NO: 9236540 - DNA, 22 bp, Homo sapiens
cttggctgtaaaatcagaggct

SEQ ID NO: 9236541 - DNA, 22 bp, Homo sapiens
cttggcttttgctcccagatca

SEQ ID NO: 9236542 - DNA, 22 bp, Homo sapiens
cttgaattgggggaagatcact

SEQ ID NO: 9236543 - DNA, 22 bp, Homo sapiens
cttgaatcttctgagtatttgc

SEQ ID NO: 9236544 - DNA, 22 bp, Homo sapiens
cttgggcttagaaggtaagtga

SEQ ID NO: 9236545 - DNA, 22 bp, Homo sapiens
cttggggatgcaaagccagtgt

SEQ ID NO: 9236546 - DNA, 22 bp, Homo sapiens
cttggggaggacgcagtgtcct

SEQ ID NO: 9236547 - DNA, 22 bp, Homo sapiens
cttggggacacagagcccaggg

SEQ ID NO: 9236548 - DNA, 22 bp, Homo sapiens
ctttacaacctaagttgaagct

SEQ ID NO: 9236549 - DNA, 22 bp, Homo sapiens
cttgggcaggggaaacagctgc

SEQ ID NO: 9236550 - DNA, 22 bp, Homo sapiens
cttgggccacctggagggactg

SEQ ID NO: 9236551 - DNA, 22 bp, Homo sapiens
cttgggccagcccagggggcat

SEQ ID NO: 9236552 - DNA, 23 bp, Homo sapiens
cttgggctagagacttagcagtg

SEQ ID NO: 9236553 - DNA, 22 bp, Homo sapiens
cttgggagacacaagaagacat

SEQ ID NO: 9236554 - DNA, 22 bp, Homo sapiens
cttgggagacacaagaagacat

SEQ ID NO: 9236555 - DNA, 22 bp, Homo sapiens
cttgggagtagaggcaggagca

SEQ ID NO: 9236556 - DNA, 22 bp, Homo sapiens
ctttggcagcctcagctgcagg

SEQ ID NO: 9236557 - DNA, 22 bp, Homo sapiens
ctttggcagcctcagctgcagg

SEQ ID NO: 9236558 - DNA, 22 bp, Homo sapiens
ctttatgactgagttgtcaatt

SEQ ID NO: 9236559 - DNA, 22 bp, Homo sapiens
ctttatgactgagttgtcaatt

SEQ ID NO: 9236560 - DNA, 22 bp, Homo sapiens
ctttatgagccttgtgaaggag

SEQ ID NO: 9236561 - DNA, 22 bp, Homo sapiens
ctttatgaaaaccagattgggg

SEQ ID NO: 9236562 - DNA, 22 bp, Homo sapiens
ctttatgaaaacctgaattatg

SEQ ID NO: 9236563 - DNA, 22 bp, Homo sapiens
ctttatgaaggaacaatgctcc

SEQ ID NO: 9236564 - DNA, 22 bp, Homo sapiens
ctttatgaacctgttcagcttg

SEQ ID NO: 9236565 - DNA, 22 bp, Homo sapiens
ctttatatattcccaggctgcc

SEQ ID NO: 9236566 - DNA, 22 bp, Homo sapiens
ctttatctagggtaagaaaacc

SEQ ID NO: 9236567 - DNA, 22 bp, Homo sapiens
ctttgtaatcattcccttggtt

SEQ ID NO: 9236568 - DNA, 22 bp, Homo sapiens
ctttgtaagtctttctccaaga

SEQ ID NO: 9236569 - DNA, 22 bp, Homo sapiens
ctttacaacctaagttgaagct

SEQ ID NO: 9236570 - DNA, 22 bp, Homo sapiens
ctttacaattcaagggaactct

SEQ ID NO: 9236571 - DNA, 22 bp, Homo sapiens
ctttagaagggtaacggaatta

SEQ ID NO: 9236572 - DNA, 22 bp, Homo sapiens
ctttagaagggtaacggaatta

SEQ ID NO: 9236573 - DNA, 22 bp, Homo sapiens
ctttagaaatctggatgtattt

SEQ ID NO: 9236574 - DNA, 20 bp, Homo sapiens
ctttagaagaacccaagcat

SEQ ID NO: 9236575 - DNA, 22 bp, Homo sapiens
ctttagaatttcatgtttggtc

SEQ ID NO: 9236576 - DNA, 22 bp, Homo sapiens
ctttagaatttgatataatcaa

SEQ ID NO: 9236577 - DNA, 22 bp, Homo sapiens
ctttagaatttgatataatcaa

SEQ ID NO: 9236578 - DNA, 22 bp, Homo sapiens
ctttagaatttgatataatcaa

SEQ ID NO: 9236579 - DNA, 22 bp, Homo sapiens
ctttagtggtattttagcaagt

SEQ ID NO: 9236580 - DNA, 22 bp, Homo sapiens
ctttagttagtagataatggca

SEQ ID NO: 9236581 - DNA, 22 bp, Homo sapiens
ctttaggttttgcctgagatct

SEQ ID NO: 9236582 - DNA, 22 bp, Homo sapiens
gatatttttagtatttctgcct

SEQ ID NO: 9236583 - DNA, 22 bp, Homo sapiens
gatatttttagtatttctgcct

SEQ ID NO: 9236584 - DNA, 22 bp, Homo sapiens
gatatttttgcagacacctggg

SEQ ID NO: 9236585 - DNA, 22 bp, Homo sapiens
gatatttttgcagacacctggg
